US008106174B2

(12) United States Patent
Kovalic et al.

(10) Patent No.: US 8,106,174 B2
(45) Date of Patent: Jan. 31, 2012

(54) NUCLEIC ACID MOLECULES AND OTHER MOLECULES ASSOCIATED WITH PLANTS AND USES THEREOF FOR PLANT IMPROVEMENT

(75) Inventors: David K. Kovalic, Clayton, MO (US); Yihua Zhou, Ballwin, MO (US); Yongwei Cao, Chesterfield, MO (US); Scott E. Andersen, St. Louis, MO (US); Michael D. Edgerton, St. Louis, MO (US); Jingdong Liu, Chesterfield, MO (US)

(73) Assignee: Monsanto Technology LLC, St. Louis, MO (US)

( * ) Notice: Subject to any disclaimer, the term of this patent is extended or adjusted under 35 U.S.C. 154(b) by 1085 days.

(21) Appl. No.: 11/978,197

(22) Filed: Oct. 29, 2007

(65) Prior Publication Data

US 2009/0144848 A1  Jun. 4, 2009

Related U.S. Application Data

(63) Continuation-in-part of application No. 10/767,701, filed on Jan. 29, 2004, now Pat. No. 7,834,146, which is a continuation-in-part of application No. 09/684,016, filed on Oct. 10, 2000, now abandoned, which is a continuation-in-part of application No. 09/654,617, filed on Sep. 5, 2000, now abandoned, said application No. 10/767,701 is a continuation-in-part of application No. 09/850,147, filed on May 8, 2001, now abandoned.

(60) Provisional application No. 60/202,213, filed on May 8, 2000.

(51) Int. Cl.
*C07H 21/04* (2006.01)
*C12Q 1/68* (2006.01)
*C12N 5/04* (2006.01)
*A01H 9/00* (2006.01)

(52) U.S. Cl. .......... 536/23.1; 435/6; 435/419; 536/24.1; 800/295

(58) Field of Classification Search .................. None
See application file for complete search history.

(56) References Cited

OTHER PUBLICATIONS

Database sequence, Geneseq Accession No. AAG44786 (Oct. 2000).
Database sequence, Geneseq Accession No. AAO72389 (also identified as gi29150380) (Mar. 2003).
Everett et al., *Nature Genetics*, vol. 17, pp. 411-422 (1997).
Raptis et al., *Journal of Chemical Neuroanatomy*, vol. 30, pp. 201-211 (2005).
Scott et al., *Nature Genetics*, vol. 21, pp. 440-443 (1999).
Bassie et al., Transgenic Cell Lines as a Useful Tool to Study the Biochemistry of Down-Regulation of an Endogenous Rice Gene Using a Heterologous *Diamine-Oxidase* cDNA, *Plant Physiol. Biochem.* 38:729-737 (2000).
GenBank Accession No. CAC42119 (Jun. 17, 2001) (1 page).

*Primary Examiner* — Shubo Zhou
(74) *Attorney, Agent, or Firm* — Lawrence M. Lavin, Jr.; Arnold & Porter LLP

(57) ABSTRACT

Recombinant polynucleotides and recombinant polypeptides useful for improvement of plants are provided. The disclosed recombinant polynucleotides and recombinant polypeptides find use in production of transgenic plants to produce plants having improved properties.

16 Claims, No Drawings

NUCLEIC ACID MOLECULES AND OTHER MOLECULES ASSOCIATED WITH PLANTS AND USES THEREOF FOR PLANT IMPROVEMENT

CROSS-REFERENCE TO RELATED APPLICATIONS

This application is a continuation-in-part under 35 U.S.C. §120 of U.S. application Ser. No. 10/767,701, filed on Jan. 29, 2004 now U.S. Pat. No. 7,834,146, which is hereby incorporated by reference in its entirety, including the sequence listing and Table 1. U.S. application Ser. No. 10/767,701 is also a continuation-in-part of U.S. application Ser. No. 09/684,016 filed Oct. 10, 2000 (abandoned), which is a continuation-in-part of U.S. application Ser. No. 09/654,617, filed Sep. 5, 2000 (abandoned). U.S. application Ser. No. 10/767,701 is also a continuation-in-part of U.S. application Ser. No. 09/850,147 filed May 8, 2001 (abandoned), which claims the benefit of U.S. Provisional Application No. 60/202,213, filed May 8, 2000. All of the foregoing applications are hereby incorporated by reference in their entirety, including their sequence listings and tables.

INCORPORATION OF SEQUENCE LISTING

Two copies of the sequence listing (Sequence Listing Copy 1 and Sequence Listing Copy 2) and a computer-readable form of the sequence listing, all on CD-ROMs, each containing the file named SequenceListing.txt, which is 74,251,352 bytes (measured in MS-DOS) and was created on Jan. 27, 2004, are herein incorporated by reference.

FIELD OF THE INVENTION

Disclosed herein are inventions in the field of plant biochemistry and genetics. More specifically recombinant polynucleotides and recombinant polypeptides from *Sorghum* for use in plant improvement are provided. Methods of using the recombinant polynucleotides and recombinant polypeptides for production of transgenic plants with improved biological characteristics are disclosed.

BACKGROUND OF THE INVENTION

The ability to develop transgenic plants with improved traits depends in part on the identification of polynucleotides that are useful for the production of transformed plants having desirable qualities. In this regard, the discovery of polynucleotide sequences of genes, and the polypeptides encoded by such genes, is needed. Molecules comprising such polynucleotides may be used, for example, in recombinant DNA constructs useful for imparting unique genetic properties into transgenic plants.

SUMMARY OF THE INVENTION

The present invention provides a recombinant polynucleotide selected from the group consisting of SEQ ID NO: 1 through SEQ ID NO: 31,564. The present invention also provides a recombinant polypeptide selected from the group consisting of SEQ ID NO: 31,565 through SEQ ID NO: 63,128.

The present invention also provides a method of producing a plant having an improved property, wherein said method comprises transforming a plant with a recombinant construct comprising a promoter region functional in a plant cell operably joined to a polynucleotide comprising a coding sequence for a polypeptide associated with said property, and growing said transformed plant.

DETAILED DESCRIPTION OF THE INVENTION

The present invention provides recombinant polynucleotides and recombinant polypeptides from *Sorghum*. The recombinant polynucleotides and recombinant polypeptides of the present invention find a number of uses, for example in recombinant DNA constructs, in physical arrays of molecules, for use as plant breeding markers, and for use in computer based storage and analysis systems.

The recombinant polynucleotides of the present invention also find use in generation of transgenic plants to provide for increased or decreased expression of the polypeptides encoded by the recombinant polynucleotides provided herein. As used herein a "transgenic" organism is one whose genome has been altered by the incorporation of foreign genetic material or additional copies of native genetic material, e.g. by transformation or recombination. As a result of such biotechnological applications, plants, particularly crop plants, having improved properties are obtained. Crop plants of interest in the present invention include, but are not limited to soy, cotton, canola, maize, wheat, sunflower, sorghum, alfalfa, barley, millet, rice, tobacco, fruit and vegetable crops, and turf grass. In one embodiment the disclosed recombinant polynucleotides provide plants having improved yield resulting from improved utilization of key biochemical compounds, such as nitrogen, phosphorous and carbohydrate, or resulting from improved responses to environmental stresses, such as cold, heat, drought, salt, and attack by pests or pathogens. Recombinant polynucleotides of the present invention may be used to provide plants having improved growth and development, and ultimately increased yield, as the result of modified expression of plant growth regulators or modification of cell cycle or photosynthesis pathways. Other traits of interest that may be modified in plants using polynucleotides of the present invention include flavonoid content, seed oil and protein quantity and quality, herbicide tolerance, and rate of homologous recombination.

Polynucleotides

Depending on the intended use, the recombinant polynucleotides of the present invention may be present in the form of DNA, such as cDNA or genomic DNA, or as RNA, for example mRNA. The polynucleotides of the present invention may be single or double stranded and may represent the coding, or sense strand of a gene, or the non-coding, antisense, strand. In one embodiment, the recombinant polynucleotides of this invention represent cDNA sequences from *Sorghum*. DNA sequences representing the recombinant polynucleotides are provided herein as SEQ ID NO: 1 through SEQ ID NO: 31,564.

The term "recombinant polynucleotide" as used herein refers to a polynucleotide produced by recombinant DNA technology. In one embodiment a recombinant polynucleotide may be produced by separation from substantially all other molecules normally associated with it in its native state. A recombinant polynucleotide may be greater than 60% free, greater than 75% free, greater than 90% free, or greater than 95% free from the other molecules (exclusive of solvent) present in the natural mixture. In another embodiment, a recombinant polynucleotide may be separated from nucleic acids which normally flank the polynucleotide in nature. Thus, polynucleotides fused to regulatory or coding sequences with which they are not normally associated, for example as the result of recombinant techniques, are considered recombinant polynucleotides herein. Such molecules are considered recombinant polynucleotides even when present, for example in the chromosome of a host cell, or in a nucleic acid solution. The term recombinant polynucleotide as used herein is not intended to encompass molecules present in their native state.

It is understood that the molecules of the invention may be labeled with reagents that facilitate detection of the molecule. As used herein, a label can be any reagent that facilitates detection, including fluorescent labels, chemical labels, or modified bases, including nucleotides with radioactive elements, e.g. $^{32}P$, $^{33}P$, $^{35}S$ or $^{121}I$ such as $^{32}P$ deoxycytidine-5'-triphosphate ($^{32}PdCTP$).

Recombinant polynucleotides of the present invention are capable of specifically hybridizing to other polynucleotides under certain circumstances. As used herein, two polynucleotides are said to be capable of specifically hybridizing to one another if the two molecules are capable of forming an antiparallel, double-stranded nucleic acid structure. A polynucleotide is said to be the "complement" of another polynucleotide if the molecules exhibit complete complementarity. As used herein, molecules are said to exhibit "complete complementarity" when every nucleotide in each of the polynucleotides is complementary to the corresponding nucleotide of the other. Two polynucleotides are said to be "minimally complementary" if they can hybridize to one another with sufficient stability to permit them to remain annealed to one another under at least conventional "low-stringency" conditions. Similarly, the polynucleotides are said to be "complementary" if they can hybridize to one another with sufficient stability to permit them to remain annealed to one another under conventional "high-stringency" conditions. Conventional stringency conditions are known to those skilled in the art and can be found, for example in *Molecular Cloning: A Laboratory Manual, 3rd edition Volumes* 1, 2, and 3. J. F. Sambrook, D. W. Russell, and N. Irwin, Cold Spring Harbor Laboratory Press, 2000.

Departures from complete complementarity are therefore permissible, as long as such departures do not completely preclude the capacity of the polynucleotides to form a double-stranded structure. Thus, in order for a polynucleotide to serve as a primer or probe it need only be sufficiently complementary in sequence to be able to form a stable double-stranded structure under the particular solvent and salt concentrations employed. Appropriate stringency conditions which promote DNA hybridization are, for example, 6.0× sodium chloride/sodium citrate (SSC) at about 45° C., followed by a wash of 2.0×SSC at 50° C. Such conditions are known to those skilled in the art and can be found, for example in *Current Protocols in Molecular Biology*, John Wiley & Sons, N.Y. (1989). Salt concentration and temperature in the wash step can be adjusted to alter hybridization stringency. For example, conditions may vary from low stringency of about 2.0×SSC at 40° C. to moderately stringent conditions of about 2.0×SSC at 50° C. to high stringency conditions of about 0.2×SSC at 50° C.

As used herein "sequence identity" refers to the extent to which two optimally aligned polynucleotides or polypeptide sequences are invariant throughout a window of alignment of components, e.g. nucleotides or amino acids. An "identity fraction" for aligned segments of a test sequence and a reference sequence is the number of identical components which are shared by the two aligned sequences divided by the total number of components in the reference sequence segment, i.e. the entire reference sequence or a smaller defined part of the reference sequence. "Percent identity" is the identity fraction times 100. Comparison of sequences to determine percent identity can be accomplished by a number of well-known methods, including for example by using mathematical algorithms, such as those in the BLAST suite of sequence analysis programs.

In one embodiment this invention provides recombinant polynucleotides comprising regions that encode polypeptides. The encoded polypeptides may be the complete protein encoded by the gene represented by the polynucleotide, or may be fragments of the encoded protein. In one embodiment, polynucleotides provided herein encode polypeptides constituting a substantial portion of the complete protein. In another embodiment polynucleotides provided herein encode polypeptides constituting a sufficient portion of the complete protein to provide the relevant biological activity.

In one embodiment recombinant polynucleotides of the present invention encode polypeptides involved in one or more important biological function in plants. Such recombinant polynucleotides may be expressed in transgenic plants to produce plants having improved phenotypic properties and/or improved response to stressful environmental conditions. See, for example, Table 1 of U.S. application Ser. No. 10/767,701 for a list of SEQ ID numbers representing the recombinant polynucleotides that may be expressed in transgenic plants to impart an improved plant property where improved plant properties are provided for each sequence in the PRODUCT_CAT_DESC column.

Recombinant polynucleotides of the present invention are generally used to impart such improved properties by providing for enhanced protein activity in a transgenic organism, such as a transgenic plant, although in some cases, improved properties are obtained by providing for reduced protein activity in a transgenic plant. Reduced protein activity and enhanced protein activity are measured by reference to a wild type cell or organism and can be determined by direct or indirect measurement. Direct measurement of protein activity might include an analytical assay for the protein, per se, or enzymatic product of protein activity. Indirect assay might include measurement of a property affected by the protein. Enhanced protein activity can be achieved in a number of ways, for example by overproduction of mRNA encoding the protein or by gene shuffling. One skilled in the art will know methods to achieve overproduction of mRNA, for example by providing increased recombinant copies of a gene or by introducing a recombinant construct having a heterologous promoter operably linked to a recombinant polynucleotide encoding a polypeptide into a target cell or organism. Reduced protein activity can be achieved by a variety of mechanisms including antisense, mutation, or knockout. Antisense RNA will reduce the level of expressed protein resulting in reduced protein activity as compared to wild type activity levels. A mutation in the gene encoding a protein may reduce the level of expressed protein and/or interfere with the function of expressed protein to cause reduced protein activity.

In one embodiment, the invention is a fragment of a disclosed recombinant polynucleotide consisting of oligonucleotides of at least 15, at least 16 or 17, at least 18 or 19, or at least 20 or more consecutive nucleotides. Such oligonucleotides are fragments of the larger recombinant polynucleotides having a sequence selected from the group consisting of SEQ ID NO: 1 through SEQ ID NO: 31,564, and find use, for example as probes and primers for detection of the polynucleotides of the present invention.

In one embodiment the present invention is a functional variant of a recombinant polynucleotide provided herein. As used herein, a "functional variant" refers to any second polynucleotide varying from a first polynucleotide sequence in such a way so as not to significantly affect the function when compared to the function of the first polynucleotide. Such functional variants may be naturally occurring, including homologous polynucleotides from the same or a different species, or may be non-natural functional variants, for example polynucleotides synthesized using chemical synthesis methods, or generated using recombinant DNA techniques. With respect to nucleotide sequences, degeneracy of the genetic code provides the possibility to substitute at least one base of the protein encoding sequence of a gene with a different base without causing the amino acid sequence of the polypeptide produced from the gene to be changed. Hence, in one embodiment, a recombinant polynucleotide of the present invention may have any base sequence that has been changed from SEQ ID NO: 1 through SEQ ID NO: 31,564 by substitution in accordance with degeneracy of the genetic code. See for example, U.S. Pat. No. 5,500,365, which is hereby incorporated by reference.

Polynucleotides of the present invention that are functional variants of the polynucleotides provided herein will generally demonstrate significant identity with the polynucleotides provided herein. Of particular interest are polynucleotide homologs having at least about 60% sequence identity, at least about 70% sequence identity, at least about 80% sequence identity, at least about 85% sequence identity, and at least about 90%, 95% or even greater, such as 98% or 99% sequence identity with polynucleotide sequences described herein.

Polypeptides

In one embodiment this invention also provides recombinant polypeptides. Amino acid sequences of the recombinant polypeptides of the present invention are provided herein as SEQ ID NO: 31,565 through SEQ ID NO: 63,128.

As used herein, the term "polypeptide" refers to an unbranched chain of amino acid residues that are covalently linked by an amide linkage between the carboxyl group of one amino acid and the amino group of another. The term polypeptide can encompass whole proteins (i.e. a functional protein encoded by a particular gene), as well as fragments of proteins. In one embodiment the invention is a recombinant polypeptide which represents a whole protein. In another embodiment the invention is a recombinant polypeptide which represents a sufficient portion of an entire protein to impart the relevant biological activity of the protein. The term "protein" also includes molecules consisting of one or more polypeptide chains. Thus, a recombinant polypeptide of the present invention may also constitute an entire gene product, but only a portion of a functional oligomeric protein having multiple polypeptide chains.

As used herein, the term "recombinant polypeptide" refers to a polypeptide produced as a result of recombinant DNA technology. The term recombinant polypeptide as used herein is not intended to encompass molecules present in their native state.

In one embodiment the invention is a recombinant polypeptide involved in one or more important biological properties in a plant. Such recombinant polypeptide may be produced in transgenic plants to provide plants having improved phenotypic properties and/or improved response to stressful environmental conditions. In some cases, decreased expression of such polypeptide may be desired, such decreased expression being obtained by use of the polynucleotide sequences provided herein, for example in antisense or cosuppression methods. See, Table 1 of U.S. application Ser. No. 10/767,701 for a list of improved plant properties and PROTEIN_NUM for the recombinant polypeptide whose expression may be altered in transgenic plants to impart such improvements. A summary of such improved properties and polypeptides of interest for increased or decreased expression is provided below.

Yield/Nitrogen: Yield improvement by improved nitrogen flow, sensing, uptake, storage and/or transport. Polypeptides useful for imparting such properties include those involved in aspartate and glutamate biosynthesis, polypeptides involved in aspartate and glutamate transport, polypeptides associated with the TOR (Target of Rapamycin) pathway, nitrate transporters, ammonium transporters, chlorate transporters and polypeptides involved in tetrapyrrole biosynthesis.

Yield/Carbohydrate: Yield improvement by effects on carbohydrate metabolism, for example by increased sucrose production and/or transport. Polypeptides useful for improved yield by effects on carbohydrate metabolism include polypeptides involved in sucrose or starch metabolism, carbon assimilation or carbohydrate transport, including, for example sucrose transporters or glucose/hexose transporters, enzymes involved in glycolysis/gluconeogenesis, the pentose phosphate cycle, or raffinose biosynthesis, and polypeptides involved in glucose signaling, such as SNF1 complex proteins.

Yield/Photosynthesis: Yield improvement resulting from increased photosynthesis. Polypeptides useful for increasing the rate of photosynthesis include phytochrome, photosystem I and II proteins, electron carriers, ATP synthase, NADH dehydrogenase and cytochrome oxidase.

Yield/Phosphorus: Yield improvement resulting from increased phosphorus uptake, transport or utilization. Polypeptides useful for improving yield in this manner include phosphatases and phosphate transporters.

Yield/Stress tolerance: Yield improvement resulting from improved plant growth and development by helping plants to tolerate stressful growth conditions. Polypeptides useful for improved stress tolerance under a variety of stress conditions include polypeptides involved in gene regulation, such as serine/threonine-protein kinases, MAP kinases, MAP kinase kinases, and MAP kinase kinases; polypeptides that act as receptors for signal transduction and regulation, such as receptor protein kinases; intracellular signaling proteins, such as protein phosphatases, GTP binding proteins, and phospholipid signaling proteins; polypeptides involved in arginine biosynthesis; polypeptides involved in ATP metabolism, including for example ATPase, adenylate transporters, and polypeptides involved in ATP synthesis and transport; polypeptides involved in glycine betaine, jasmonic acid, flavonoid or steroid biosynthesis; and hemoglobin. Enhanced or reduced activity of such polypeptides in transgenic plants will provide changes in the ability of a plant to respond to a variety of environmental stresses, such as chemical stress, drought stress and pest stress.

Cold tolerance: Polypeptides of interest for improving plant tolerance to cold or freezing temperatures include polypeptides involved in biosynthesis of trehalose or raffinose, polypeptides encoded by cold induced genes, fatty acyl desaturases and other polypeptides involved in glycerolipid or membrane lipid biosynthesis, which find use in modification of membrane fatty acid composition, alternative oxidase, calcium-dependent protein kinases, LEA proteins and uncoupling protein.

Heat tolerance: Polypeptides of interest for improving plant tolerance to heat include polypeptides involved in biosynthesis of trehalose, polypeptides involved in glycerolipid biosynthesis or membrane lipid metabolism (for altering membrane fatty acid composition), heat shock proteins and mitochondrial NDK.

Osmotic tolerance: Polypeptides of interest for improving plant tolerance to extreme osmotic conditions include polypeptides involved in proline biosynthesis.

Drought tolerance: Polypeptides of interest for improving plant tolerance to drought conditions include aquaporins, polypeptides involved in biosynthesis of trehalose or wax, LEA proteins and invertase.

Pathogen or pest tolerance: Polypeptides of interest for improving plant tolerance to effects of plant pests or pathogens include proteases, polypeptides involved in anthocyanin biosynthesis, polypeptides involved in cell wall metabolism, including cellulases, glucosidases, pectin methylesterase, pectinase, polygalacturonase, chitinase, chitosanase, and cellulose synthase, and polypeptides involved in biosynthesis of terpenoids or indole for production of bioactive metabolites to provide defense against herbivorous insects.

Cell cycle modification: Polypeptides encoding cell cycle enzymes and regulators of the cell cycle pathway are useful for manipulating growth rate in plants to provide early vigor and accelerated maturation leading to improved yield. Improvements in quality traits, such as seed oil content, may also be obtained by expression of cell cycle enzymes and cell cycle regulators. Polypeptides of interest for modification of cell cycle pathway include cyclins and EIF5alpha pathway proteins, polypeptides involved in polyamine metabolism, polypeptides which act as regulators of the cell cycle pathway, including cyclin-dependent kinases (CDKs), CDK-activating kinases, CDK-inhibitors, Rb and Rb-binding proteins, and transcription factors that activate genes involved in cell proliferation and division, such as the E2F family of transcription factors, proteins involved in degradation of cyclins, such as cullins, and plant homologs of tumor suppressor polypeptides.

Seed protein yield/content: Polypeptides useful for providing increased seed protein quantity and/or quality include polypeptides involved in the metabolism of amino acids in plants, particularly polypeptides involved in biosynthesis of methionine/cysteine and lysine, amino acid transporters, amino acid efflux carriers, seed storage proteins, proteases, and polypeptides involved in phytic acid metabolism.

Seed oil yield/content: Polypeptides useful for providing increased seed oil quantity and/or quality include polypeptides involved in fatty acid and glycerolipid biosynthesis, beta-oxidation enzymes, enzymes involved in biosynthesis of nutritional compounds, such as carotenoids and tocopherols, and polypeptides that increase embryo size or number or thickness of aleurone.

Disease response in plants: Polypeptides useful for imparting improved disease responses to plants include polypeptides encoded by cercosporin induced genes, antifungal proteins and proteins encoded by R-genes or SAR genes. Expression of such polypeptides in transgenic plants will provide an increase in disease resistance ability of plants.

Galactomannanan biosynthesis: Polypeptides involved in production of galactomannans are of interest for providing plants having increased and/or modified reserve polysaccharides for use in food, pharmaceutical, cosmetic, paper and paint industries.

Flavonoid/isoflavonoid metabolism in plants: Polypeptides of interest for modification of flavonoid/isoflavonoid metabolism in plants include cinnamate-4-hydroxylase, chalcone synthase and flavonol synthase. Enhanced or reduced activity of such polypeptides in transgenic plants will provide changes in the quantity and/or speed of flavonoid metabolism in plants and may improve disease resistance by enhancing synthesis of protective secondary metabolites or improving signaling pathways governing disease resistance.

Plant growth regulators: Polypeptides involved in production of substances that regulate the growth of various plant tissues are of interest in the present invention and may be used to provide transgenic plants having altered morphologies and improved plant growth and development profiles leading to improvements in yield and stress response. Of particular interest are polypeptides involved in the biosynthesis of plant growth hormones, such as gibberellins, cytokinins, auxins, ethylene and abscisic acid, and other proteins involved in the activity and/or transport of such polypeptides, including for example, cytokinin oxidase, cytokinin/purine permeases, F-box proteins, G-proteins and phytosulfokines.

Herbicide tolerance: Polypeptides of interest for producing plants having tolerance to plant herbicides include polypeptides involved in the shikimate pathway, which are of interest for providing glyphosate tolerant plants. Such polypeptides include polypeptides involved in biosynthesis of chorismate, phenylalanine, tyrosine and tryptophan.

Transcription factors in plants: Transcription factors play a key role in plant growth and development by controlling the expression of one or more genes in temporal, spatial and physiological specific patterns. Enhanced or reduced activity of such polypeptides in transgenic plants will provide significant changes in gene transcription patterns and provide a variety of beneficial effects in plant growth, development and response to environmental conditions. Transcription factors of interest include, but are not limited to myb transcription factors, including helix-turn-helix proteins, homeodomain transcription factors, leucine zipper transcription factors, MADS transcription factors, transcription factors having AP2 domains, zinc finger transcription factors, CCAAT binding transcription factors, ethylene responsive transcription factors, transcription initiation factors and UV damaged DNA binding proteins.

Homologous recombination: Increasing the rate of homologous recombination in plants is useful for accelerating the introgression of transgenes into breeding varieties by backcrossing, and to enhance the conventional breeding process by allowing rare recombinants between closely linked genes in phase repulsion to be identified more easily. Polypeptides useful for expression in plants to provide increased homologous recombination include polypeptides involved in mitosis and/or meiosis, including for example, resolvases and polypeptide members of the RAD52 epistasis group.

Lignin biosynthesis: Polypeptides involved in lignin biosynthesis are of interest for increasing plants' resistance to lodging and for increasing the usefulness of plant materials as biofuels.

In one embodiment of the invention, the function of a recombinant polypeptide is determined by comparison of the amino acid sequence of the recombinant polypeptide to amino acid sequences of known polypeptides. A variety of homology based search algorithms are available to compare a query sequence to a protein database, including for example, BLAST, FASTA, and Smith-Waterman. In the present application, BLASTX and BLASTP algorithms are used to provide protein function information. A number of values are examined in order to assess the confidence of the function assignment. Useful measurements include "E-value" (also shown as "hit_p"), "percent identity", "percent query coverage", and "percent hit coverage".

In BLAST, E-value, or expectation value, represents the number of different alignments with scores equivalent to or better than the raw alignment score, S, that are expected to occur in a database search by chance. The lower the E value, the more significant the match. Because database size is an element in E-value calculations, E-values obtained by BLASTing against public databases, such as GenBank, have generally increased over time for any given query/entry match. In setting criteria for confidence of polypeptide function prediction, a "high" BLAST match is considered herein as having an E-value for the top BLAST hit provided in Table 1 of U.S. application Ser. No. 10/767,701 of less than 1E-30; a medium BLASTX E-value is 1E-30 to 1E-8; and a low BLASTX E-value is greater than 1E-8. The top BLAST hit and corresponding E values are provided in Table 1 of U.S. application Ser. No. 10/767,701.

Percent identity refers to the percentage of identically matched amino acid residues that exist along the length of that portion of the sequences which is aligned by the BLAST algorithm. In setting criteria for confidence of polypeptide function prediction, a "high" BLAST match is considered herein as having percent identity for the top BLAST hit provided in Table 1 of U.S. application Ser. No. 10/767,701 of at least 70%; a medium percent identity value is 35% to 70%; and a low percent identity is less than 35%.

In one embodiment of the invention, the protein function assignment in the present invention is determined using combinations of E-values, percent identity, query coverage and hit coverage. Query coverage refers to the percent of the query sequence that is represented in the BLAST alignment. Hit coverage refers to the percent of the database entry that is represented in the BLAST alignment. In one embodiment of the invention, function of a query polypeptide is inferred from function of a protein homolog where either (1) hit_p<1e-30 or % identity>35% AND query_coverage>50% AND hit_coverage>50%, or (2) hit_p<1e-8 AND query_coverage>70% AND hit_coverage>70%.

Another aspect of the invention comprises a functional variant which differs in one or more amino acids from those of a recombinant polypeptide provided herein as the result of one or more conservative amino acid substitutions. It is well known in the art that one or more amino acids in a reference sequence can be substituted with at least one other amino acid, the charge and polarity of which are similar to that of the native amino acid, resulting in a silent change. For instance, valine is a conservative substitute for alanine and threonine is a conservative substitute for serine. Conservative substitutions for an amino acid within a polypeptide sequence can be selected from other members of the class to which the naturally occurring amino acid belongs. Amino acids can be divided into the following four groups: (1) acidic amino acids, (2) basic amino acids, (3) neutral polar amino acids, and (4) neutral nonpolar amino acids. Representative amino acids within these various groups include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, tyrosine, asparagine, and glutamine; and (4) neutral nonpolar (hydrophobic) amino acids such as alanine, leucine, isoleucine, valine, proline, phenylalanine, tryptophan, and methionine. Conserved substitutes for an amino acid within a polypeptide sequence can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Examples of conservative amino acid substitution groups are: valine-leucine, valine-isoleucine, phenylalanine-tyrosine, lysine-arginine, alanine-valine, aspartic acid-glutamic acid, and asparagine-glutamine. In one embodiment a recombinant polypeptide of the invention may differ in one or more amino acids as the result of deletion or insertion of one or more amino acids in a native sequence. See for example, U.S. Pat. No. 5,500,365, which is hereby incorporated by reference.

One embodiment of the present invention is a variant which has the same function as a recombinant polypeptide provided herein, but with increased or decreased activity or altered specificity. Such variations in protein activity can be achieved by mutagenesis or may exist naturally in polypeptides encoded by related genes, for example in a related polypeptide encoded by a different allele or in a different species. Variant polypeptides may be obtained by well known nucleic acid or protein screening methods using DNA or antibody probes, for example by screening libraries for genes encoding related polypeptides, or in the case of expression libraries, by screening directly for variant polypeptides. Screening methods for obtaining a modified protein or enzymatic activity of interest by mutagenesis are disclosed in U.S. Pat. No. 5,939,250, which is hereby incorporated by reference. An alternative approach to the generation of variants uses random recombination techniques such as "DNA shuffling" as disclosed in U.S. Pat. Nos. 5,605,793; 5,811,238; 5,830,721 and 5,837,458; and International Applications WO 98/31837 and WO 99/65927, all of which are hereby incorporated by reference. An alternative method of molecular evolution involves a staggered extension process (StEP) for in vitro mutagenesis and recombination of nucleic acid molecule sequences, as disclosed in U.S. Pat. No. 5,965,408 and International Application WO 98/42832, both of which are hereby incorporated by reference.

Polypeptides of the present invention that are functional variants of the polypeptides provided herein will generally demonstrate significant identity with the polypeptides provided herein. One embodiment of the invention is a polypeptide having at least about 35% sequence identity, at least about 50% sequence identity, at least about 60% sequence identity, at least about 70% sequence identity, at least about 80% sequence identity, and at least about 85%, 90%, 95% or even greater sequence identity with a recombinant polypeptide sequence described herein. One embodiment of the invention is a polypeptide having an amino acid sequence provided herein (reference polypeptides) and functional variants of such reference polypeptide, wherein such functional variant comprises at least about 50 consecutive amino acids having at least about 90% identity to about a 50 amino acid polypeptide fragment of said reference polypeptide.

Recombinant DNA Constructs

In one embodiment the invention encompasses the use of recombinant polynucleotides in recombinant constructs, i.e. constructs comprising recombinant polynucleotides that are constructed or modified outside of cells and that join nucleic acids that are not found joined in nature. Using methods known to those of ordinary skill in the art, recombinant polynucleotides of the invention can be inserted into recombinant DNA constructs that can then be introduced into a host cell of choice for expression of the encoded polypeptide or to provide for reduction of expression of the encoded polypeptide, for example by antisense or cosuppression methods. Potential host cells include both prokaryotic and eukaryotic cells. One embodiment of the invention uses a recombinant polynucleotide of the present invention for preparation of recombinant constructs for use in plant transformation.

In plant transformation, exogenous genetic material is transferred into a plant cell. As used herein "exogenous" refers to a nucleic acid molecule, for example a recombinant DNA construct comprising a recombinant polynucleotide of the present invention, produced outside the organism, e.g. plant, into which it is introduced. An exogenous nucleic acid molecule can have a naturally occurring or non-naturally occurring nucleic acid sequence. One skilled in the art recognizes that an exogenous nucleic acid molecule can be derived from the same species into which it is introduced or from a different species. Such exogenous genetic material may be transferred into either monocot or dicot plants including, but not limited to, soy, cotton, canola, maize, teosinte, wheat, rice, and *Arabidopsis* plants. Transformed plant cells comprising such exogenous genetic material may be regenerated to produce whole transformed plants.

Exogenous genetic material may be transferred into a plant cell by the use of a recombinant construct, also known as a vector, designed for such a purpose. A recombinant construct can comprise a number of sequence elements, including promoters, encoding regions, and selectable markers. Recombinant constructs are available which have been designed to replicate in both *E. coli* and *A. tumefaciens* and have all of the features required for transferring large inserts of DNA into plant chromosomes. Design of such vectors is generally within the skill of the art.

A recombinant construct will generally include a plant promoter to direct transcription of the protein-encoding region or the antisense sequence of choice. Numerous promoters, which are active in plant cells, have been described in the literature. These include the nopaline synthase (NOS) promoter and octopine synthase (OCS) promoters carried on tumor-inducing plasmids of *Agrobacterium tumefaciens* or caulimovirus promoters such as the Cauliflower Mosaic Virus (CaMV) 19S or 35S promoter (U.S. Pat. No. 5,352,605), and the Figwort Mosaic Virus (FMV) 35S-promoter (U.S. Pat. No. 5,378,619). These promoters and numerous others have been used to create recombinant vectors for expression in plants. Any promoter known or found to cause transcription of DNA in plant cells can be used in the present invention. Other useful promoters are described, for example, in U.S. Pat. Nos. 5,378,619; 5,391,725; 5,428,147; 5,447,858; 5,608,144; 5,614,399; 5,633,441; and 5,633,435, all of which are hereby incorporated by reference.

In addition, promoter enhancers, such as the CaMV 35S enhancer or a tissue specific enhancer, may be used to enhance gene transcription levels. Enhancers often are found 5' to the start of transcription in a promoter that functions in eukaryotic cells, but can often be inserted in the forward or reverse orientation 5' or 3' to the coding sequence. In some instances, these 5' enhancing elements are introns. Deemed to be particularly useful as enhancers are the 5' introns of the rice actin 1 and rice actin 2 genes. Examples of other enhancers which could be used in accordance with the invention include elements from octopine synthase genes, the maize alcohol dehydrogenase gene intron 1, elements from the maize shrunken 1 gene, the sucrose synthase intron, the TMV omega element, and promoters from non-plant eukaryotes.

Recombinant constructs can also contain one or more 5' non-translated leader sequences which serve to enhance polypeptide production from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al. (1996) *Plant Mol. Biol.* 32:393-405).

Recombinant constructs may also include, with the coding region of interest, a nucleic acid sequence that acts, in whole or in part, to terminate transcription of that region. One type of 3' untranslated sequence which may be used is a 3' UTR from the nopaline synthase gene (nos 3') of *Agrobacterium tumefaciens*. Other 3' termination regions of interest include those from a gene encoding the small subunit of a ribulose-1,5-bisphosphate carboxylase-oxygenase (rbcS), and more specifically, from a rice rbcS gene (U.S. Pat. No. 6,426,446), the 3' UTR for the T7 transcript of *Agrobacterium tumefaciens*, the 3' end of the protease inhibitor I or II genes from potato or tomato, and the 3' region isolated from Cauliflower Mosaic Virus. Alternatively, one also could use a gamma coixin, oleosin 3 or other 3' UTRs from the genus *Coix* (PCT Publication WO 99/58659).

Recombinant constructs may also include a selectable marker. Selectable markers may be used to select for plants or plant cells that contain the exogenous genetic material. Useful selectable marker genes include those conferring resistance to antibiotics such as kanamycin (nptII), hygromycin B (aph IV) and gentamycin (aac3 and aacC4) or resistance to herbicides such as glufosinate (bar or pat) and glyphosate (EPSPS). Examples of such selectable markers are illustrated in U.S. Pat. Nos. 5,550,318; 5,633,435; 5,780,708 and 6,118,047, all of which are hereby incorporated by reference.

Recombinant constructs may also include a screenable marker. Screenable markers may be used to monitor transformation. Exemplary screenable markers include genes expressing a colored or fluorescent protein such as a luciferase or green fluorescent protein (GFP), a glucuronidase or uidA gene (GUS) which encodes an enzyme for which various chromogenic substrates are known or an R-locus gene, which encodes a product that regulates the production of anthocyanin pigments (red color) in plant tissues. Other possible selectable and/or screenable marker genes will be apparent to those of skill in the art.

Recombinant constructs may also include a transit peptide for targeting of a gene target to a plant organelle, particularly to a chloroplast, leucoplast or other plastid organelle, see for example U.S. Pat. No. 5,188,642, which is hereby incorporated by reference.

For use in *Agrobacterium* mediated transformation methods, recombinant constructs of the present invention may also include T-DNA border regions flanking the DNA to be inserted into the plant genome to provide for transfer of the DNA into the plant host chromosome as discussed in more detail below. An exemplary plasmid that finds use in such transformation methods is pMON18365, a T-DNA vector that can be used to clone exogenous genes and transfer them into plants using *Agrobacterium*-mediated transformation. See published U.S. Patent Application 20030024014, which is hereby incorporated by reference. This vector contains the left border and right border sequences necessary for *Agrobacterium* transformation. The plasmid also has origins of replication for maintaining the plasmid in both *E. coli* and *Agrobacterium tumefaciens* strains.

A candidate gene is prepared for insertion into the T-DNA vector, for example using well-known gene cloning techniques such as PCR. Restriction sites may be introduced onto each end of the gene to facilitate cloning. For example, candidate genes may be amplified by PCR techniques using a set of primers. Both the amplified DNA and the cloning vector are cut with the same restriction enzymes, for example, NotI and PstI. The resulting fragments are gel-purified, ligated together, and transformed into *E. coli*. Plasmid DNA containing the vector with inserted gene may be isolated from *E. coli* cells selected for spectinomycin resistance, and the presence of the desired insert verified by digestion with the appropriate restriction enzymes. Undigested plasmid may then be transformed into *Agrobacterium tumefaciens* using techniques well known to those in the art, and transformed *Agrobacterium* cells containing the vector of interest selected based on spectinomycin resistance. These and other similar recombinant constructs useful for plant transformation may be readily prepared by one skilled in the art.

Transformation Methods and Transgenic Plants

Methods and compositions for transforming bacteria and other microorganisms are known in the art. See for example *Molecular Cloning: A Laboratory Manual*, 3$^{rd}$ edition Volumes 1, 2, and 3. J. F. Sambrook, D. W. Russell, and N. Irwin, Cold Spring Harbor Laboratory Press, 2000.

Technology for introduction of DNA into cells is well known to those of skill in the art. Methods and materials for transforming plants by introducing a transgenic DNA construct into a plant genome in the practice of this invention can include any of the well-known and demonstrated methods including electroporation as illustrated in U.S. Pat. No. 5,384,253, microprojectile bombardment as illustrated in U.S. Pat. Nos. 5,015,580; 5,550,318; 5,538,880; 6,160,208; 6,399,861 and 6,403,865, *Agrobacterium*-mediated transformation as illustrated in U.S. Pat. Nos. 5,635,055; 5,824,877; 5,591,616; 5,981,840 and 6,384,301, and protoplast transformation as illustrated in U.S. Pat. No. 5,508,184, all of which are hereby incorporated by reference.

Any of the recombinant polynucleotides of the present invention may be introduced into a plant cell in a permanent or transient manner in combination with other genetic elements such as vectors, promoters enhancers etc. Further any of the recombinant polynucleotides of the present invention may be introduced into a plant cell in a manner that allows for production of the polypeptide or fragment thereof encoded by the recombinant polynucleotide in the plant cell, or in a manner that provides for decreased expression of an endogenous gene and concomitant decreased production of protein.

It is also to be understood that two different transgenic plants can also be mated to produce offspring that contain two independently segregating added, exogenous genes. Selfing of appropriate progeny can produce plants that are homozygous for both added, exogenous genes that encode a polypeptide of interest. Back-crossing to a parental plant and out-crossing with a non-transgenic plant are also contemplated, as is vegetative propagation.

Expression of the recombinant polynucleotides of the present invention and the concomitant production of polypeptides encoded by the recombinant polynucleotides is of interest for production of transgenic plants having improved properties, particularly, improved properties which result in crop plant yield improvement. Expression of recombinant polypeptides of the present invention in plant cells may be evaluated by specifically identifying the protein products of the introduced genes or evaluating the phenotypic changes brought about by their expression. It is noted that when the polypeptide being produced in a transgenic plant is native to the target plant species, quantitative analyses comparing the transformed plant to wild type plants may be required to demonstrate increased expression of the polypeptide of this invention.

Assays for the production and identification of specific proteins make use of various physical-chemical, structural, functional, or other properties of the proteins. Unique physical-chemical or structural properties allow the proteins to be separated and identified by electrophoretic procedures, such as native or denaturing gel electrophoresis or isoelectric focusing, or by chromatographic techniques such as ion exchange or gel exclusion chromatography. The unique structures of individual proteins offer opportunities for use of specific antibodies to detect their presence in formats such as an ELISA assay. Combinations of approaches may be employed with even greater specificity such as western blotting in which antibodies are used to locate individual gene products that have been separated by electrophoretic techniques. Additional techniques may be employed to absolutely confirm the identity of the product of interest such as evaluation by amino acid sequencing following purification. Although these are among the most commonly employed, other procedures may be additionally used.

Assay procedures may also be used to identify the expression of proteins by their functionality, particularly where the expressed protein is an enzyme capable of catalyzing chemical reactions involving specific substrates and products. These reactions may be measured, for example in plant extracts, by providing and quantifying the loss of substrates or the generation of products of the reactions by physical and/or chemical procedures.

In many cases, the expression of a gene product is determined by evaluating the phenotypic results of its expression. Such evaluations may be simply as visual observations, or may involve assays. Such assays may take many forms including but not limited to analyzing changes in the chemical composition, morphology, or physiological properties of the plant. Chemical composition may be altered by expression of genes encoding enzymes or storage proteins which change amino acid composition and may be detected by amino acid analysis, or by enzymes which change starch quantity which may be analyzed by near infrared reflectance spectrometry. Morphological changes may include greater stature or thicker stalks.

Plants with decreased expression of a gene of interest can also be achieved through the use of polynucleotides of the present invention, for example by expression of antisense nucleic acids, or by identification of plants transformed with sense expression constructs that exhibit cosuppression effects.

Antisense approaches are a way of preventing or reducing gene function by targeting the genetic material as disclosed in U.S. Pat. Nos. 4,801,540; 5,107,065; 5,759,829; 5,910,444; 6,184,439; and 6,198,026, all of which are hereby incorporated by reference. The objective of the antisense approach is to use a sequence complementary to the target gene to block its expression and create a mutant cell line or organism in which the level of a single chosen protein is selectively reduced or abolished. Antisense techniques have several advantages over other 'reverse genetic' approaches. The site of inactivation and its developmental effect can be manipulated by the choice of promoter for antisense genes or by the timing of external application or microinjection. Antisense can manipulate its specificity by selecting either unique regions of the target gene or regions where it shares homology to other related genes.

The principle of regulation by antisense RNA is that RNA that is complementary to the target mRNA is introduced into cells, resulting in specific RNA:RNA duplexes being formed by base pairing between the antisense substrate and the target. Under one embodiment, the process involves the introduction and expression of an antisense gene sequence. Such a sequence is one in which part or all of the normal gene sequences are placed under a promoter in inverted orientation so that the 'wrong' or complementary strand is transcribed into a noncoding antisense RNA that hybridizes with the target mRNA and interferes with its expression. An antisense vector is constructed by standard procedures and introduced into cells by transformation, transfection, electroporation, microinjection, infection, etc. The type of transformation and choice of vector will determine whether expression is transient or stable. The promoter used for the antisense gene may influence the level, timing, tissue, specificity, or inducibility of the antisense inhibition.

As used herein "gene suppression" means any of the well-known methods for suppressing expression of protein from a gene including sense suppression, anti-sense suppression and RNAi suppression. In suppressing genes to provide plants with a desirable phenotype, anti-sense and RNAi gene suppression methods are preferred. For a description of antisense regulation of gene expression in plant cells see U.S. Pat. No. 5,107,065. For a description of RNAi gene suppression in plants by transcription of a dsRNA see U.S. Pat. No. 6,506,559, U.S. Patent Application Publication No. 2002/0168707 A1, and U.S. patent application Ser. No. 09/423,143 (see WO 98/53083), 09/127,735 (see WO 99/53050), and 09/084,942 (see WO 99/61631), all of which are hereby incorporated by reference. Suppression of an gene by RNAi can be achieved using a recombinant DNA construct having a promoter operably linked to a DNA element comprising a sense and anti-sense element of a segment of genomic DNA of the gene, e.g., a segment of at least about 23 nucleotides, more preferably about 50 to 200 nucleotides where the sense and anti-sense DNA components can be directly linked or joined by an intron or artificial DNA segment that can form a loop when the transcribed RNA hybridizes to form a hairpin structure. For example, genomic DNA from a polymorphic locus of SEQ ID NO: 1 through SEQ ID NO: 31,564 can be used in a recombinant construct for suppression of a cognate gene by RNAi suppression.

Insertion mutations created by transposable elements may also prevent gene function. For example, in many dicot plants, transformation with the T-DNA of *Agrobacterium* may be readily achieved and large numbers of transformants can be rapidly obtained. Also, some species have lines with active transposable elements that can efficiently be used for the generation of large numbers of insertion mutations, while some other species lack such options. Mutant plants produced by *Agrobacterium* or transposon mutagenesis and having altered expression of a polypeptide of interest can be identified using the polynucleotides of the present invention. For example, a large population of mutated plants may be screened with polynucleotides encoding the polypeptide of interest to detect mutated plants having an insertion in the gene encoding the polypeptide of interest.

In one embodiment of the invention, polynucleotides of the present invention may be used in site-directed mutagenesis. Site-directed mutagenesis may be utilized to modify nucleic acid sequences, particularly as it is a technique that allows one or more of the amino acids encoded by a nucleic acid molecule to be altered (e.g., a threonine to be replaced by a methionine). Three basic methods for site-directed mutagenesis are often employed. These are cassette mutagenesis, primer extension, and methods based upon PCR.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones.

Arrays

In one embodiment of the invention, the recombinant polynucleotides or recombinant polypeptides of this invention may be used to prepare arrays of target molecules arranged on a surface of a substrate. The target molecules may be known molecules, e.g. polynucleotides (including oligonucleotides) or polypeptides, which are capable of binding to specific probes, such as complementary nucleic acids or specific antibodies. The target molecules may be immobilized, e.g. by covalent or non-covalent bonding, to the surface in small amounts of substantially purified and isolated molecules in a grid pattern. By immobilized it is meant that the target molecules maintain their position relative to the solid support under hybridization and washing conditions. Target molecules are deposited in small footprint, isolated quantities of "spotted elements" of preferably single-stranded polynucleotide preferably arranged in rectangular grids in a density of about 30 to 100 or more, e.g. up to about 1000, spotted elements per square centimeter. In one embodiment of the invention, the arrays comprise at least about 100 or more, e.g. at least about 1000 to 5000, distinct target polynucleotides per unit substrate. Where detection of transcription for a large number of genes is desired, the economics of arrays favors a high density design criteria provided that the target molecules are sufficiently separated so that the intensity of the indicia of a binding event associated with highly expressed probe molecules does not overwhelm and mask the indicia of neighboring binding events. For high-density microarrays each spotted element may contain up to about $10^7$ or more copies of the target molecule, e.g. single stranded cDNA, on glass substrates or nylon substrates.

Arrays of this invention may be prepared with molecules from a single species, preferably a plant species, or with molecules from other species, particularly other plant species. Arrays with target molecules from a single species can be used with probe molecules from the same species or a different species due to the ability of cross species homologous genes to hybridize. It is generally preferred for high stringency hybridization that the target and probe molecules are from the same species.

In one embodiment of the invention, the organism of interest is a plant and the target molecules are polynucleotides or oligonucleotides with nucleic acid sequences having at least about 80 percent sequence identity to a corresponding sequence of the same length in a recombinant polynucleotide having a sequence selected from the group consisting of SEQ ID NO: 1 through SEQ ID NO: 31,564 or complements thereof. In another embodiment of the invention, at least about 10% of the target molecules on an array have at least about 15 consecutive nucleotides of sequence having at least about 80% and up to about 100% identity with a corresponding sequence of the same length in a recombinant polynucleotide having a sequence selected from the group consisting of SEQ ID NO: 1 through SEQ ID NO: 31,564 or complements or fragments thereof.

Such arrays are useful in a variety of applications, including gene discovery, genomic research, molecular breeding and bioactive compound screening. One use of arrays is in the analysis of differential gene transcription, e.g. transcription profiling where the production of mRNA in different cells, normally a cell of interest and a control, is compared and discrepancies in gene expression are identified. In such assays, the presence of discrepancies indicates a difference in gene expression levels in the cells being compared. Such information is useful for the identification of the types of genes expressed in a particular cell or tissue type in a known environment. Such applications generally involve the following steps: (a) preparation of probe, e.g. attaching a label to a plurality of expressed molecules; (b) contact of probe with the array under conditions sufficient for probe to bind with corresponding target, e.g. by hybridization or specific binding; (c) removal of unbound probe from the array; and (d) detection of bound probe.

A probe may be prepared with RNA extracted from a given cell line or tissue. The probe may be produced by reverse transcription of mRNA or total RNA and labeled with radioactive or fluorescent labeling. A probe is typically a mixture containing many different sequences in various amounts, corresponding to the numbers of copies of the original mRNA species extracted from the sample.

The initial RNA sample for probe preparation will typically be derived from a physiological source. The physiological source may be selected from a variety of organisms, with physiological sources of interest including single celled organisms such as yeast and multicellular organisms, including plants and animals, particularly plants, where the physiological sources from multicellular organisms may be derived from particular organs or tissues of the multicellular organism, or from isolated cells derived from an organ, or tissue of the organism. The physiological sources may also be multicellular organisms at different developmental stages (e.g., 10-day-old seedlings), or organisms grown under different environmental conditions (e.g., drought-stressed plants) or treated with chemicals.

In preparing the RNA probe, the physiological source may be subjected to a number of different processing steps, where such processing steps might include tissue homogenation, cell isolation and cytoplasmic extraction, nucleic acid extraction and the like, where such processing steps are known to the those of skill in the art. Methods of isolating RNA from cells, tissues, organs or whole organisms are well known to those skilled in the art.

Computer Based Systems and Methods

In one embodiment of the invention, the sequence of the molecules of this invention can be provided in a variety of media to facilitate use thereof. Such media may provide a subset thereof in a form that allows a skilled artisan to examine the sequences. In a one embodiment, about 20, about 50, about 100, and about 200 or more of the polynucleotide and/or the polypeptide sequences of the present invention can be recorded on computer readable media. As used herein, "computer readable media" refers to any medium that can be read and accessed directly by a computer. Such media include, but are not limited to: magnetic storage media, such as floppy discs, hard disc, storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable media can be used to create a manufacture comprising a computer readable medium having recorded thereon a nucleotide sequence of the present invention.

As used herein, "recorded" refers to a process for storing information on computer readable media. A skilled artisan can readily adopt any of the presently known methods for recording information on computer readable media to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g., text file or database) in order to obtain a computer readable medium having recorded thereon the nucleotide sequence information of the present invention.

By providing one or more of polynucleotide or polypeptide sequences of the present invention in a computer readable medium, a skilled artisan can routinely access the sequence information for a variety of purposes. The examples which follow demonstrate how software which implements the BLAST and BLAZE search algorithms on a Sybase system can be used to identify open reading frames (ORFs) within the genome that contain homology to ORFs or polypeptides from other organisms. Such ORFs are polypeptide encoding fragments within the sequences of the present invention and are useful in producing commercially important polypeptides such as enzymes used in amino acid biosynthesis, metabolism, transcription, translation, RNA processing, nucleic acid and a protein degradation, protein modification, and DNA replication, restriction, modification, recombination, and repair.

One embodiment of the invention provides systems, particularly computer-based systems, which contain the sequence information described herein. Such systems are designed to identify commercially important fragments of the nucleic acid molecule of the present invention. As used herein, "a computer-based system" refers to the hardware, software, and memory used to analyze the sequence information of the present invention. A skilled artisan can readily appreciate that any one of the currently available computer-based systems are suitable for use in the present invention.

As indicated above, the computer-based systems of the present invention comprise a database having stored therein a polynucleotide sequence, polypeptide sequence, or both of the present invention and the necessary hardware and software for supporting and implementing a homology search. As used herein, "database" refers to memory system that can store searchable nucleotide sequence information. As used herein "query sequence" is a polynucleotide sequence, or a polypeptide sequence, or a polynucleotide sequence corresponding to a polypeptide sequence, or a polypeptide sequence corresponding to a polynucleotide sequence, that is used to query a collection of polynucleotide or polypeptide sequences. As used herein, "homology search" refers to one or more programs which are implemented on the computer-based system to compare a query sequence, i.e., gene or peptide or a conserved region (motif), with the sequence information stored within the database. Homology searches are used to identify segments and/or regions of the sequence of the present invention that match a particular query sequence. A variety of known searching algorithms are incorporated into commercially available software for conducting homology searches of databases and computer readable media comprising sequences of molecules of the present invention.

Sequence length of a query sequence may be from about 10 to about 100 or more amino acid residues or from about 20 to about 300 or more nucleotide residues. There are a variety of motifs known in the art. Protein motifs include, but are not limited to, enzymatic active sites and signal sequences. An amino acid query is converted to all of the nucleic acid sequences that encode that amino acid sequence by a software program, such as TBLASTN, which is then used to search the database. Nucleic acid query sequences that are motifs include, but are not limited to, promoter sequences, cis elements, hairpin structures and inducible expression elements (protein binding sequences).

One embodiment of the invention, provides an input device for receiving a query sequence, a memory for storing sequences (the query sequences of the present invention and sequences identified using a homology search as described above), and an output device for outputting the identified homologous sequences. A variety of structural formats for the input and output presentations can be used to input and output information in the computer-based systems of the present invention. One format for an output presentation ranks fragments of the sequence of the present invention by varying degrees of homology to the query sequence. Such presentation provides a skilled artisan with a ranking of sequences that contain various amounts of the query sequence and identifies the degree of homology contained in the identified fragment.

Having now generally described the invention, the same will be more readily understood through reference to the following examples which are provided by way of illustration, and are not intended to be limiting of the present invention, unless specified.

Example 1

A cDNA library is generated from *Sorghum* tissue. Tissue is harvested and immediately frozen in liquid nitrogen. The harvested tissue is stored at −80° C. until preparation of total RNA. The total RNA is purified using Trizol reagent from Invitrogen Corporation (Invitrogen Corporation, Carlsbad, Calif., U.S.A.), essentially as recommended by the manufacturer. Poly A+ RNA (mRNA) is purified using magnetic oligo dT beads essentially as recommended by the manufacturer (Dynabeads, Dynal Biotech, Oslow, Norway).

Construction of plant cDNA libraries is well known in the art and a number of cloning strategies exist. A number of cDNA library construction kits are commercially available. cDNA libraries are prepared using the Superscript™ Plasmid System for cDNA synthesis and Plasmid Cloning (Invitrogen Corporation, Carlsbad, Calif., U.S.A.), as described in the Superscript II cDNA library synthesis protocol. The cDNA libraries are quality controlled for a good insert:vector ratio.

The cDNA libraries are plated on LB agar containing the appropriate antibiotics for selection and incubated at 37° for a sufficient time to allow the growth of individual colonies. Single colonies are individually placed in each well of a 96-well microtiter plates containing LB liquid including the selective antibiotics. The plates are incubated overnight at approximately 37° C. with gentle shaking to promote growth of the cultures. The plasmid DNA is isolated from each clone using Qiaprep plasmid isolation kits, using the conditions recommended by the manufacturer (Qiagen Inc., Valencia, Calif. U.S.A.).

The template plasmid DNA clones are used for subsequent sequencing. Sequences of recombinant polynucleotides may be obtained by a number of sequencing techniques known in the art, including fluorescence-based sequencing methodologies. These methods have the detection, automation, and instrumentation capability necessary for the analysis of large volumes of sequence data. With these types of automated systems, fluorescent dye-labeled sequence reaction products are detected and data entered directly into the computer, producing a chromatogram that is subsequently viewed, stored, and analyzed using the corresponding software programs. These methods are known to those of skill in the art and have been described and reviewed.

Example 2

The open reading frame in each recombinant polynucleotide sequence is identified by a combination of predictive and homology based methods. The longest open reading frame (ORF) is determined, and the top BLAST match is identified by BLASTX against NCBI. The top BLAST hit is then compared to the predicted ORF, with the BLAST hit given precedence in the case of discrepancies.

Functions of polypeptides encoded by the polynucleotide sequences of the present invention are determined using a hierarchical classification tool, termed FunCAT, for Functional Categories Annotation Tool. Most categories collected in FunCAT are classified by function, although other criteria are used, for example, cellular localization or temporal process. The assignment of a functional category to a query sequence is based on BLASTX sequence search results, which compare two protein sequences. FunCAT assigns categories by iteratively scanning through all blast hits, starting with the most significant match, and reporting the first category assignment for each FunCAT source classification scheme. In the present invention, function of a query polypeptide is inferred from the function of a protein homolog where either (1) hit_p<1e-30 or % identity>35% AND query_coverage>50% AND hit_coverage>50%, or (2) hit_p<1e-8 AND query_coverage>70% AND hit_coverage>70%.

Functional assignments from five public classification schemes, GO_BP, GO_CC, GO_MF, KEGG, and EC, and one internal Monsanto classification scheme, POI, are provided in Table 1 of U.S. application Ser. No. 10/767,701. The column under the heading "CAT_TYPE" indicates the source of the classification. GO_BP=Gene Ontology Consortium—biological process; GO_CC=Gene Ontology Consortium—cellular component; GO_MF=Gene Ontology Consortium—molecular function; KEGG=KEGG functional hierarchy; EC=Enzyme Classification from ENZYME data bank release 25.0; POI=Pathways of Interest. The column under the heading "CAT_DESC" provides the name of the subcategory into which the query sequence was classified. The column under the heading "PRODUCT_HIT_DESC" provides a description of the BLAST hit to the query sequences that led to the specific classification. The column under the heading "HIT_E" provides the e-value for the BLAST hit. It is noted that the e-value in the HIT_E column may differ from the e-value based on the top BLAST hit provided in the E_VALUE column since these calculations were done on different days, and database size is an element in E-value calculations. E-values obtained by BLASTing against public databases, such as GenBank, will generally increase over time for any given query/entry match.

Sequences useful for producing transgenic plants having improved biological properties are identified from their FunCAT annotations and are also provided in Table 1 of U.S. application Ser. No. 10/767,701. A biological property of particular interest is plant yield. Plant yield may be improved by alteration of a variety of plant pathways, including those involving nitrogen, carbohydrate, or phosphorus utilization and/or uptake. Plant yield may also be improved by alteration of a plant's photosynthetic capacity or by improving a plant's ability to tolerate a variety of environmental stresses, including cold, heat, drought and osmotic stresses. Other biological properties of interest that may be improved using sequences of the present invention include pathogen or pest tolerance, herbicide tolerance, disease resistance, growth rate (for example by modification of cell cycle, by expression of transcription factors, or expression of growth regulators), seed oil and/or protein yield and quality, rate and control of recombination, and lignin content.

Sequences of recombinant polynucleotides are provided herein as SEQ ID NO: 1 through SEQ ID NO: 31,564 and sequences of recombinant polypeptides are provided as SEQ ID NO: 31,565 through SEQ ID NO: 63,128. Descriptions of each of these recombinant polynucleotide and recombinant polypeptide sequences are provided in Table 1 of U.S. application Ser. No. 10/767,701.

TABLE 1

(of U.S. application No. 10/767,701) Column Descriptions

SEQ_NUM provides the SEQ ID NO for the listed recombinant polynucleotide sequences.

TABLE 1-continued (of U.S. application No. 10/767,701) Column Descriptions

CONTIG_ID provides an arbitrary sequence name taken from the name of the clone from which the cDNA sequence was obtained.
PROTEIN_NUM provides the SEQ ID NO for the recombinant polypeptide sequence
NCBI_GI provides the GenBank ID number for the top BLAST hit for the sequence. The top BLAST hit is indicated by the National Center for Biotechnology Information GenBank Identifier number.
NCBI_GI_DESCRIPTION refers to the description of the GenBank top BLAST hit for the sequence.
E_VALUE provides the expectation value for the top BLAST match.
MATCH_LENGTH provides the length of the sequence which is aligned in the top BLAST match
TOP_HIT_PCT_IDENT refers to the percentage of identically matched nucleotides (or residues) that exist along the length of that portion of the sequences which is aligned in the top BLAST match.
CAT_TYPE indicates the classification scheme used to classify the sequence. GO_BP = Gene Ontology Consortium - biological process; GO_CC = Gene Ontology Consortium - cellular component; GO_MF = Gene Ontology Consortium - molecular function; KEGG = KEGG functional hierarchy (KEGG = Kyoto Encyclopedia of Genes and Genomes); EC = Enzyme Classification from ENZYME data bank release 25.0; POI = Pathways of Interest.
CAT_DESC provides the classification scheme subcategory to which the query sequence was assigned.
PRODUCT_CAT_DESC provides the FunCAT annotation category to which the query sequence was assigned.
PRODUCT_HIT_DESC provides the description of the BLAST hit which resulted in assignment of the sequence to the function category provided in the cat_desc column.
HIT_E provides the E value for the BLAST hit in the hit_desc column.
PCT_IDENT refers to the percentage of identically matched nucleotides (or residues) that exist along the length of that portion of the sequences which is aligned in the BLAST match provided in hit_desc.
QRY_RANGE lists the range of the query sequence aligned with the hit.
HIT_RANGE lists the range of the hit sequence aligned with the query.
QRY_CVRG provides the percent of query sequence length that matches to the hit (NCBI) sequence in the BLAST match (% qry cvrg = (match length/query total length) × 100).
HIT_CVRG provides the percent of hit sequence length that matches to the query sequence in the match generated using BLAST (% hit cvrg = (match length/hit total length) × 100).

10423 SORBI-28MAY03-CLUS11043_1 41987 14485487 source="GENBANK_PROT" polyamine oxidase [*Hordeum vulgare* subsp. *vulgare*] emb|CAC42119.1|flavin containing polyamine oxidase [*Hordeum vulgare* subsp. *vulgare*] 1e-115 285 72

All publications and patent applications cited herein are hereby incorporated by reference in their entirely to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (63128 sequences)

SEQ ID NO: 1 - DNA, 1332 bp, Sorghum bicolor
  Clone ID: SORBI-28MAY03-CLUS20_1
tgcgtccctgcaggcgtcgccaagtttgatccggcgacggggaagcagttcaagtccccggccaagacgctgtcctacaccaactacttcgccgagtctctgatcgcggaggcggagcaggacagcaagatcgtggccatccacgccgccatggggggcggcacggggctcaactacttcctccgccgcttcccgagccggtgcttcgacgtcgggatcgcggagcagcacgccgtgacgttcgcggccggcctcgcctgcgagggcctcaagcccttctgcgccatctactcgtcgttcctgcagcgcggctacgaccaggtcgtgcacgacgtcgacctgcagaagctccccgtcaggttcgccatggacagggccgggctcgtcggcgccgacgggcccacccactgcggcgcgttcgacgtcgcctacatggcgtgcctgcccaacatggtcgtcatggcaccgtccgacgaggccgagctctgccacatggtcgccaccgccgccgccatcgacgaccgcccgtcctgcttccggtacccgagaggcaacggcattggcgtcccgttgccgcccaactacaagggcactcccctcgaggtacgtactgcacatacattggtggtcacttttgctgattttattatcaaatcggggatcttcaatcaattttgttaatcggcattcgtatataatttaggtcggcaagggcaggatcctgatggagggcgaccgggtggcgctgctggggtacgggtcggcagtgcagtactgcctggccgcggcgtcgctggtggagcgccacggcctcagggtcaccgtcgccgacgcgaggttctgcaagccgctggaccacgcgctgatcaggagcctggccaggtcccacgaggtgatcatcaccgtcgaggaaggctccatcggaggcttcggctcgcatgtcgcccagttcatggccctggacggcctcctcgacggcaaactcaaggcaagttacgacgacgatacctgctccctcagtccgtcgtcgccctaatgataatgaaacattcgttctgaactccatcgtcagttcaggctgacaagtgatgaactcggcttttgtttgggtggtgcagttcttgccatcatggcagtgccgaacgcgtagaaatttgtggtgatctgggcctatagagatgcttgtacattttgtcgttaagtagaatggcagcacgatcgacggagattagtcttgtttggatgaaaatgtcgcgggaacaacagtaacggttttcgctatgtattcttctgacattaaaataggaatgagatgttcttgcgtcagtttgc

SEQ ID NO: 2 - DNA, 655 bp, Sorghum bicolor
  Clone ID: SORBI-28MAY03-CLUS17422_1
gccggccgggccgggaccaccttcctttgcatcccagcttcagcttcacaccttcacatctttcgtacaccagcgaactccgcaagaaactcgcagcaggtccggacatggcagccgagaagcgcaccattggcatgggcatggactactcgccgtccagcaaggccgccgcaaggtgggcggtcgacgacctgctcaaggccggcgacaggatcatccttgtccatgtcctccccaagggggcggacgccagccacaaggagctctggaagagcacgggctcacctttgattcctctaccggagttcatggagatgaacgtgcaggcgaggtacggattgaaccctgataaggagatactggagatcctgcaggctgcatccaagtccaagcaggtggaagtactagcaaagatttactggggtgatgcaagggagaaactctgtgaggcagtggatgatctcaaggtgaactcctttgtgcttggttgcaggggcttagggccactgaaaagggctctccttggaagtgtcagcaactacgtagtcaacaatgcaacatgcccagttacagtggtgcgcggaccaactggatcgagtgcctgatcttttcttttcagcttaaaggtggaacttctgtagtgcaaggatcattt

SEQ ID NO: 3 - DNA, 1010 bp, Sorghum bicolor
  unsure (1)..(1010): unsure at all n locations
  Clone ID: SORBI-28MAY03-CLUS10080_1
gcacgagggagaggccgagagagagagaggccgagagccgccgccgccgccatgaagatcctggtcgcggtgaagcgggtggtggactacgccgtcaaggtgcgcgtgaggcccgaccggacgggcgtggagacggccaacgtcaagatgtcgatgaaccccttctgcgagatcgccgtcgaggaggcgctccggctccgcgaggccggcgccgccgccgaggtcgtcgccgccaccgtcggccccgcccagtccgccgacacgctccgcaccgcgctcgccgccggccgcgaccgcgagaacggagcgagagagagaggccgagagagagagaggccgagagccgtcgccgtcgccaagatcctccgcgccgtcgcgctccaggagaagcccggactcgtcatcctcggcaagcaggcaattgatgacgattgcaaccaaactggacaaatgctagctggattgcttcagtggccacaaggaacctttgcctccaaggttatattggacacagaaaaacaaaaagctactgttgagcgagaagttgatggtggaattgaaaccatctgccttgatttgccagcagtgatcaccacggatttgagacttaaccagccaagatatgcaactttgcccaacataatgaaggcaaaatccaaagttattaagaaagtcgccacgcgtccgctcggtgtagatattagatcagacatggaggtcattgaggtcaatgaaccaccaaaacggaaagcaggggtgatactttcatctgttgacgaactccttgacaagttaaaaaatgaagcaggtgtcttgtaacaatttgtatattattcctcactgaatgtggtctgacgttcatttgtataagttacaataaagatgtctctccaaaagttcagaccatttacaaataaaataagtgtttccatgaactaattaagacgctatttcaactacccattacctgctgaattagctacaaaanaaaaaaaaaaaaaggcccctaa

SEQ ID NO: 4 - DNA, 696 bp, Sorghum bicolor
  Clone ID: SORBI-28MAY03-CLUS10107_1
cgcgcctcccctcttccccgccagcacgaggcagcaacgcacctccacggccccacggcgagccccgagccccgtgcgcgcgcgaccagctagccagcagccactacccgccgacatgatcactggggctctgcaggtcgccgccggcggccagccgctcctgctcacccgtcggggccagcagcggcgccgggtgttccggccgccccaagcagtggcgtccgacgccgctgccgccgccacggcgaacgaggagggcggcaaagtggcgctgggcgggtccggcgtcgccgtcaccaagctcggcgtcggggcctggtcctggggcgacaccacctactggaacgagttccagtgggacgataggaaactgaaggccgctaaaggagcatttgacgcgagtatcgactgtggaataaccttttttgatactgctgaagtgtatggagcagggatatcaggagcgattaattcagaaagtttactaggaagatttatcaaggaaaggcaacagaaggaacaggtagacgtggctatcgcgacaaagtttgcagctcttccatggaggtttggtcgtgggagcgtcatttgtgcgctgaaggcctcgttggatcgccttggcgtctcttcagttgagctctaccaacttcattggccagggatatggggcaatgaagattacctggatggccttgg

SEQ ID NO: 5 - DNA, 821 bp, Sorghum bicolor
  Clone ID: SORBI-28MAY03-CLUS10089_1
gtttgcccctacataacccaagtttgctgatgaggacaatctcttgttcctcgctgagaactgaaatttcttctccctatccctttgatcttgtctggctatttcccgtgagaaactgtcctttgaccttataattagggccttattgatgctaaaggttaattagattatggtagaagtaggaggcattatatattcacgtcagatcctctcgaatttgcttagttaaagatagttttcatcctaggtgaatgtgtttgcttttcccttaatttcagtaggtacgttccacattcctgtaagctatggatgctttcctcattttctcttatgagtttttgtgatgttcatttgtaatgtgtgatcgcactgatagtttaggaacagccacattagctaatgaacttcctttctgaattggccagtgaaaaagcaatcacaaattaggaaaaaaaagatatgtctaaactgatgatagtgtatgagaatttgataggctgtgcctgtggcaatttatggtgcaatgctgaagctgctattgtgcccttttttctgtagttttccaggtttaacttaagatattgcagataagttttcatacagaggttttgctgacactaaaacaatatatttttcttgattatttagttattgtctgttgttatgtcatcttcattatatttttctataactgaaatagagtgaaggtctggtactgtgacggcggatctttcactggtgtggttctcatgcagttagtgaaattctgtctccactcgtggtatttcttttcttattagtttcagaccacaaactaaata

SEQ ID NO: 6 - DNA, 354 bp, Sorghum bicolor
  Clone ID: LIB3478-010-P1-K1-B4
ctctgcccctacataaaccaatgtttgtaaaataatatatagactgactgtggactgtgctatatgtttgcttttgttacaatgatgatattcttgactaacatgtctgcccctgcataacccaagtttgctgatgaggacaatctcttgttcctcgctgagaactgaaatttcttctccctatccctttgatcttgtctggctatttcccgtgagaaaagtattgtcataagctgcatttaaaattgatattcacttagtcatttgtcgagtggagctaagtgaaatctattttttatgagattattcacttagtcatttgtcgagttaagggaagtgaaaatctgtttttta

SEQ ID NO: 7 - DNA, 644 bp, Sorghum bicolor
  Clone ID: SORBI-28MAY03-CLUS10095_1
gcaatatttttgttgtgaaagacaatgttatctctactcctgccattaagggaacaatactgcctggtataacaaggaaaagtatcattgaagttgctcagagcaaaggcttcaaggttgaggagcgcctggtgtcagtagatgagttgcttaatgctgatgaagttttctgcacggggactgctgttgtggtgtcacctgtagggagtgttacatatatggggaaaagggcggaatatggcaaccaaggagtcggtgtcgtgtctcagcaactatacaagtcacttacaagcctccagatgggcaatgttgaggactggatgggttggaccgtgcaactgaatcagtagcaggttctccacagatattgccttggcagatccccagatcattacagctaatgggtgcgatagtttgtttacctgtcagttgagttgggttcctgaggtagactacagacctcacgcatatgtactgtatcagtatctgtttcccttgcgaccacagcatatagtagagcagtaagatgaatgtgctgctgcttactagccctctgagctcctgaccataagaacactgaacagtcttgttgttattttgctgatctgttgtttcaaagcaatgaaataaaatctgtggttgcc

SEQ ID NO: 8 - DNA, 778 bp, Sorghum bicolor
  Clone ID: SORBI-28MAY03-CLUS10066_1
tccggccgggccgggacctccgccctccctccctccctcctctccatgcatccaacagccgccgcctctgccggccccaaattaaccatcgccgatgtgcctgtctaacgcgatgcaagcttgccaatcccaccgtcgccctctatcttcccatcacccagggacagattgagccagggtgttgcgattctcaccagcaagtgcaaagattcaggcagcagagcttctattccgatcggatctggcagcagcgcgaccctgttcccttcctgtgatgccactcttggagagagcgagtgcctgtatgtgcggcgcaactctcgagtggtggcaccgtcgaccttgcttcaacgctcttaatagtgatttctgaaaatggacatgctaggggtgttgtataggccatttgtgcagcttgtctccatctaaagatcaattttcattccaaagatgtataaagcttagaagtgtttaagctggtggtagtaagttgtacaaatgtttccacataagtctaattgcacgcaccttaccatttgggaccgagaggactcctgctggtaatcttggacgagcaacagaggctgatatggtgttgctggagtaacttatgtaattgtggaagagaacatgtatgcgatgctagataaaaacttgtatgtgatgttagttaaaaacgtatgtaacttgagactttgtattttggtgatgctagatggaaggaagggagtcataatgccccagagaaatttgacagtgcacagaacgatcatccatg

SEQ ID NO: 9 - DNA, 251 bp, Sorghum bicolor
  Clone ID: LIB3478-009-P1-K1-G8
ctccctccctcctctccacccatccatcagccgccgcctcccccggccagtgcgttccactccactagcgtatgatgcacggaggcaaacggcagcaccctaccacaggcgagcgcttgcccatcccaccgtcgcccttctatcttcccatcacccagggacagattgagccagggtgttgcgattctcactggcaagtgcaaagatttaagcaggagagcttcaattccgattggatctggcagcagcgc

SEQ ID NO: 10 - DNA, 430 bp, Sorghum bicolor
  Clone ID: SORBI-28MAY03-CLUS101550_1
aacgccttcctgttgagtcccagcccagcagccgcaaagaatgcaattacctggatcaacatcggcagcatggccggtgacggaggtgatatttcggcgatggggctgcgtcggagggatgttacggtgcggggctccgggccggggtcgtgggatcccaaaaagcttggggctgaaactgttggtatgttaagggtgcttgttggtgttgggagtgaaggtttgaaaaagtatcggtttgatgatgttgaaaaggggtgggaggataagggtagggataaagttgtttttgtgtttggggaggaaagtgaaaagttgaaatagtggtatagggttggtacaagcggatgagtatggatagaatatgagacgtgtttatgaggaacgataaagagatttattgactaactattagtttccgcaaacattt

SEQ ID NO: 11 - DNA, 635 bp, Sorghum bicolor
  Clone ID: SORBI-28MAY03-CLUS90266_1
tggatcgtcgctgcttcccatcacgcggagcaggcaggcccggccaccccgccggcgcggccttgctcttccaggtgaggcgcctgggtgcgcatccttcgcagttcggatccacctccatggctgcggcttcccacctcctctccttcttcctcctcctccttctccccgcttctaacgccatctactgcgacgaagacgactgctacgacctcctagggcttaagcaggacgcgaacgcgtcggacatcaagaaagcgtactacaagctctctctcaaataccatccggacaagaacccggatccggagtcgcggaagctcttcgtcaagatcgccaatgcttacgagattctgaaggatgaatccactagggagcagtatgactatgccattgaacatccggaggaggttttttataacacagctcagtactatagggcatactatggacataaaacggatcctcgtgctgtattgattggtcttcttctaattgtttcagcatttcaatacataaatcagctaacaaggtataaccaggccatggaaagtgtcaagcaaactcctgcttacaaaaataggttaaaagctttggagtttgagcgaacaggaggaatagctagcacaaagaag

SEQ ID NO: 12 - DNA, 846 bp, Sorghum bicolor
  Clone ID: SORBI-28MAY03-CLUS90302_1
gcacgagggtgcaggtgggactacgtgcaggacgggaatagcacgtaccgggacatggaccggctgacggccttctccaggcgctctccacatgggcgcgctgggtcgacgccgacgtcgacgcctccaaaaccagggtcttctaccagggcatctccccaagccactacgacatgtcgaagcagcagcaggagagccaagcagcagggatggcaccggggctcgtcggaggaggaggcagctgcctgaagcagacgcggccgctgcaggaagccacggacgccgccggcggcggggggacgacgacgagcctgctggccccggtgcaggccgtggtgcggggcgtcatcgacgccatgacggcgccggtgtcgctgctggacatcacggcgatgtcgcagctcaggatcgacgcgcacccgtccgtgtacggcgggccggggcgggatggcatggactgcacgcactggtgcatcgccggactcccggacgcctggaaccacatcatgtacgccatgctcctgcagcagacatagatggatgatgatgaaccaataattattctttcgaaaaaaatgaaccaacaaacctcctctgtgctttattcttctcaattttctagctgtgacgccgtttgacgcacggtgaattttttttaatttatttgtgagcctctaattaggcatttatttaggtgttgctagccttcatggaagatcattgcgtgtttagcttctctatctacctagatttactgaaatgtgacctcacacgtagtgcaagatggagtgtgaatgataggtttaatgtatggactgctcattttcagaattattgcaattgcac

SEQ ID NO: 13 - DNA, 637 bp, Sorghum bicolor
  Clone ID: SORBI-28MAY03-CLUS71066_1
ggcctcctgctcgctcacgtggcactgcttccatgccgcggacctgcctctgtggttcgcatctccgcgctggtgatggagggtcgcttctctgctccttcgctgcctgttggggcactcccgccggttcgtcgtttttcctccatgggggctcgggcgcgctcgggtccgcttggccgtcgcgcctcggctgctggggcttcggctccgtgcgggctgcgagcctttgcgggcgctgctgactccggtggaccgcggccgcccattccccgcggcgcttctgttccactgggcgatgccggcagctgggttgcgatgcccctgctcagccttttggtgtacgccttccgctgcgacgtggatgctgcaagtgtgcactgtctggcgggggtccggtgctcagacgctgctcggttgctcgatgcagggggtgctgccggccggccgtcggggccggcagcgctccctcccgctggccgccagcgtccctgcgcccaggctcccctgggcccctggtgctgggcggccgctgcgcgccgtaccgtctctgccgcgccctgctctaggtcgtttactgctccgtggtgactgtcactctgcaggtttttgcgcgcgtcaagagctgatcatttctcgg

SEQ ID NO: 14 - DNA, 656 bp, Sorghum bicolor
  Clone ID: SORBI-28MAY03-CLUS46306_1
aagagcagttagaaggagagcaaaaaatgttaactctcctgagaaaatggatattaatgttgaagtaaaagtgggtgttaatggtgaagtcaaagacactgataaagatagctgcattgatttggacgatctattccgttctcctgatgctgcttttggggggttctcagttctccatgacccatctacctttgaaccagattcagtttctttgctgcgtgttggaattggtgctagaaagttaggctctggttcacttttcctctatggattaataatgagaaagcatgtagttgtgttggctgcaatagagggtgatgaacagcggttgagtacaatgtaccgagattttgggtcaaacctggtgggattggatagcttgggtcacgctggggaaagccttatttctcggataaaggctgccgctaggaaataatacctaagtcagtatgttggaatgatttactctcccctgtaatagttttcagcctgagtgctgagcttttatgctcagcatagttactgacctctgtaattcatttcatttgatcaattacttcatatctcttgactctcatcaatgcataagtcctcccatgttgttctaaactgctgataaaacagcagataatcatgaaagatcatatcaccacatc

SEQ ID NO: 15 - DNA, 418 bp, Sorghum bicolor
  Clone ID: SORBI-28MAY03-CLUS30785_1
tgatgtcaacagtgaatgtcatgcttagtagtagtacggtgaccctccaagctccatctagaccggcgttttgcatcccaaagagtggcttctcagagatgaactcagaagggtacccgccaggagcttcacagtccgcgagcagatcgcctatgtcgctgaatgacgtttcaatcactgagcttgagcccagatgatgatgattctctttgaagcagtggcggaacagtaggtatattgagggtacgtcgtccttattgaatattgtgttttacctgggccgagcacgtaagtgtgatcggtatacaaaactagtaaattaccaatatggtgaaatataacgtctattattagttctacaattacttatgtatctatatggcattgcctttacaatgtagagagtgtgtaaaaaata

SEQ ID NO: 16 - DNA, 531 bp, Sorghum bicolor
  Clone ID: SORBI-28MAY03-CLUS10012_1
gcctgttgttgatgggtcagcaacatttaatcgagcaattgtgaattctccctttcttcggacaccattgacgaattttgcgggtacaattcaagtcatatccaacagactatgcatcagttcaatggaaagcagggttgggaggaaagggagattgtcaatgaaagggaccctacctcttaaaaatagcgagccatctgccaacgataagattgatttgaaatgtgaagttctggacatacgagcaaaaaatattttgagtggccaagtagacagccagctgcaagttacaggctcaattttgcgaccagatctttctgggatgatccggttgagtcatggtgaagcatatttgcctcatgataaaggcaatggtgctgctgtcactaggttgacttcaaacaagtcgggttatcttctttctggttttgaccaatcaaccacttcacaggatgtctcacgaattctggggtactgtcaacatctgcagacagtatgtattcagttaaatttgagcttcactcatatatt

SEQ ID NO: 17 - DNA, 609 bp, Sorghum bicolor
  Clone ID: SORBI-28MAY03-CLUS100245_1
cctctgagtatgctcgaaaatcagtcttcgcggaattgactttgtaaatgcaacagacttttcatagaccagatctgaatcaacaagctcatcttcactcagaacaagtgccctgccactgtcaatggcctgctccagaagacataacaatccctctatataggatggaactttagaaccactaccttttataccatcgtttcttttcctctttgtctccaaattataatcatccggacaatgttctgacttctctaccagacctctattttcactgttgcttgttgggatactttggcacttcagggatggatccataatatcacatactggctttaatggtgaatattccaatggagtgtctgctgagggttcagttctagatatacctgtagaatggaacaatgcaggaacttcctttgcagaattcagtaccgtatcactggcaatggaatctttaaatttttcttgaccttcacccaagttgcagttcttgtgagatgttgcaacactgaccaactcaatctgggtcagaacatttcctgaatgtgtaaccttttcattagattctttgccacttaaactttcctagtctcgagggggggcccg

SEQ ID NO: 18 - DNA, 868 bp, Sorghum bicolor
  Clone ID: SORBI-28MAY03-CLUS100159_1
cgctgcttgaccaaggcgctgaggttaacgcgcagggtggagtgtacagcaacgcactacaggcagcttcgcttagaggctacgagcaggtagttaagacactgcttgataatggcgctgaggtcaacgcgcagggtggacggcacggtaacgcactgcaggcagcgtcatataggggccacgagcaggtggtcaagatgctgctagaacaaggcgctgaagttaacgcgcagggtggagagtatattaacgcactgcaggcagcgttatatagaggtcacaagcaggtggtaaagacgctgcttaacaagggcgctgaagttaacgcacagggtggattctatggtaacgcattgcaggcagcttcagctagaggctacgagcaggtagtcaagacgctgcttgataagggcgctgaggtcaacgcacagggtggacactatagtaacgcactgcaggcagcttcagctggaggctacgagcagttagtcaagacgctgcttgatgagggcgctgaggtcaacgcacagggtggatactatagtaatgcactgcaggcagcttcagctggaggctacgagcaggtgattaagacgctgcttaaacaaggtgctgaggttaacgcgcagggtggacggtacggcaacgcattacaggcagcgtcacttatgggccacaagtaggtggttaagatgctgcttaaccaaggcgctaaagtcaacgcgcagggtggatactatggcaacgcactgcaggcagcgtcacttatgggccacaagcaggtggtcaagattttgcttgatgcaggtgctcatcaacccaagggagacgagatagtagaggatctcaaatcaccagcattgtcata

SEQ ID NO: 19 - DNA, 446 bp, Sorghum bicolor
  Clone ID: SORBI-28MAY03-CLUS100177_1
acaaaggttctcaacaagggtgacgtgtttgtgttcccccaaggactcatacacttccaattcaacccagtccatgacaagccagctgtcgcgatcgctgcactaagcagccagaaccctggggctattactattgccaacgcggtctttggatcaaaaccacccatctcagatgatgtcttggccaaagctttccaggtgcaaaagggaacaattgattggctccaagctcaattctgggagaacaaccacaactaagtaaattgagactcacttcattgttcgaagataggcttatacatgtattttgcatactcccgtgtgtattcaattacgacattctaagctgatatgatagaataaatgggaagtttatgtaaccaatcactgtttttgtgtatctgctacaagatatacccccatgttctttttgaatatttgaattg

SEQ ID NO: 20 - DNA, 909 bp, Sorghum bicolor
  Clone ID: SORBI-28MAY03-CLUS100009_1
gcacgaggcacgacctagttccgccgaaccccagataccagttcactctttgacacacagtactgtttcgtgatgaacctggacgaagagatcgaaagcatcatttatattggccgtgaagtcatggtatacaagatcccaccgctgaaagcaaatgaaggccaccgcgcgggagattggggagacctggcccagccgctatggaaaggccgcctgcggattgttgaaaaggggaaagaagtcgcgttactttttgaggacccgaatactggcgacttattcgcccgtgcgccatatgatcccgcaaagccatctgtcgaggctgtgttggactcatctcgatactttgttatacgagtcgaagacgggggccgaaaagcatacatcggaatgggttatgcagaacgcgcagacagctttgatttcaacgtagcccttcaagactacacaaaacgctggcgagcggcccagaatcctccatcgccgacatccgaggacgggccttctccacacgttcctgtgggaccgaagaaggactattctctcaaagaaggccaaaccttttcaatttcaatccctggtcgcgcagcaaagaacagctcaactactactggcagcggtactgacctccttgggggtgcatcgacgacagcaacttccaccggtagcggcggtagttcaggatttatgccgctcttacctccgcctcccagcgcacccaagcgtcggtagtggcctgttgaaagttcaccaggcctccttccccggatattagccaagctatcgcagactatttttcctggtttcttaccctcggtcgtgtttcgaggcgatgtgatctagttgttatgtcatttttaggttgcgcaatcgacttcaatcttgggacttcgtcggtccacaaacgcc

SEQ ID NO: 21 - DNA, 394 bp, Sorghum bicolor
  Clone ID: SORBI-28MAY03-CLUS100294_1
aacactacccggggagcggcagtgcttttctctgcttgtccaacttcgcactattcccccaacatcgcggcgctatttctgcaactcacgtcgcctgcgatcattgtttgtatttcttgagccggtctgctgcatgcatgattcgataagccgcgtcgaatgtggagtaacgaaaggaataatatcgttgaggatttattgagaatcgcccaacccacatgcatattttattacaggctgtatgcccaaacttaggtagcctcagggagcaagaaaacatcggcccttgacataaggtgttaaaaataacctaagtaaagagtcccctaagcttagtctagagttacctaaatattttcatcgcctagagacaaggtcctgggttttctttcct

SEQ ID NO: 22 - DNA, 606 bp, Sorghum bicolor
  Clone ID: SORBI-28MAY03-CLUS100302_1
ctacgactacaacatcgtcgagctggcgtcgcctgtgacggcgtacgcgccagtcaagctgctgacggccgacccactcacgtacgccggctccacggccacggtcatgggctggggtaccacgtcgtcgggtggctcgcagtccagcgtgctgcttcgcgtcaacgtgccaatcctcacggacgccgtgtgcaaggcttcgggtctcagcggcaccatctcttcgaccatgttctgtgccggcggtgcgaccaacaaggactcgtgccagggcgactcgggcggtccgatcatcctcgagcagtcgggtggtgatgtgctcatcggtgccgtgagctggggtgacggatgcggtgtggcgggcaagccaggcgtgtacgccaaggtgtcgtcggtcaagagctggatcctgagcctcgcgccgaacgccaccttcgtctaagcgttgaggcgtcttagcggcgacggatagtaccagaaagtggtgttgtgtcctagcgctggggtcgtcgtatccgatatcggatggcccttgttttgagactcgtagctaggaggcagtcatagtgcagtgtaaaaccaatctcgatgtcctatttttttctc

SEQ ID NO: 23 - DNA, 778 bp, Sorghum bicolor
  Clone ID: SORBI-28MAY03-CLUS100312_1
gcacgaggcctcagcatcgtgtgcacgggccacagcctcggcgcgtcgctggccacgctctgcgcgttcgacatcgcggtgaacggcgtgtccagggtgggcggcgccgacatccccgtcacggccatcgtgttcgggagcccgcagatcgggaacccggagttcaagaagaggttcgaggagctgcccaacctgcgggcgctgcacgtcaggaacacgcccgacctgatcccgctgtacccgagcggcctcctgggctacgccaacgccggcgacgtcctggccgtggactccaagaagtcgccgtacgtgaaagacgactccaccaacctcggggactaccacaacctgcagggcatcctgcacacggtggcgggctggaacggcaaggacggcgagttcaagctgcaggtgcagcgcagcgtggcgctggtgaacaagtcgtccgccttcctcaaggacgacaacctcgtgccggagtcatggtgggtggagcggaacaaggggatggtcatcggagaaaccgggctgtgggagctcgagcctcctgccgaggagaaccttcccgtaccgccagtcgtgaccgggaacgggaaggtcatcggtgacgatgacgctgctgccaccactaccactaccactgctacggcggctagtatggagacaaagacaccggcgaaggataagaaggggcctgggaccaagcttttctcagcatgctttagagttagaggggtcaattaatctgttcgtaattgaatggttgaatgtttggagc

SEQ ID NO: 24 - DNA, 786 bp, Sorghum bicolor
  Clone ID: SORBI-28MAY03-CLUS100328_1
gcacgaggcctacacatccattcaactcgttcagactcgacccaacactccaccatctacccacaacccactcaacaccatcaagatgcgtttcacctacattgccactgccctcttcgccgctggcgctgccaacgcccaggtcgacagcatcctctctcagatcacctcggccgtcggtagccttccctcaggcgcagcttctgctgccgaaagccttgccagcgacctgacatcggccgttggtggagtcccctccaatgctgcgtcggttgcctcgagcatccgctccgaaatcacctctggcgctggcgctctcccatccgacgttaactcacgcctttcgagcattgcctcgagcgttgcctcggctggctcatcgattcgctctgaggccgaatctgctgcccgctcggccacatccagtgctggttctgctgcttcgtccgctgcctcatctgcaggcgctggagccactgcccagcccaacgtcctgcctgccatgggtgccgtcgctggtggtatcttcgctcttgccggcctcctataagcgggtcgccagagtctctcttcgataatcatctcatcagcaccatcatcatcgtacatattttccctccgataattcttgatcggtcagcgacaatcggctcacagtcgaggttgctttgcctcgtacacacaaggcatcagggataaagaaacgggtttacggcgaaagtggagtgtttccagaccgtctatacgattgtaatacgtccaatccaatgaaattattcaacctcc

SEQ ID NO: 25 - DNA, 856 bp, Sorghum bicolor
  Clone ID: SORBI-28MAY03-CLUS100353_1
gcacgaggatcccttcgattttgtctgattggtcaaaatcataagcatttccgtaagccctgttcaggtaattcttgagcaactgctcgctggaaatgaactgcgccgcgacgtcaagaccacagctctccggcgagagtcgctcagtgagctcttgcgcgaattcgacgaccatggagttgcggtaccatggtgcgaagtggactgtaaatccatcactcggggctcagtggaaaggttgggcttcccgccatgccagagtctcaaatcgcgtatgatgatgctgccctttttgactactggttgcgaaggtggcctgatctctctacgagcatcgagcagatgctttttgatcctgccacttgcacggtcgccatgctcaccctcttggtcggcaatagtggtgtcgttgtgggtgccgagccagacctcagtagagccattctcgggagtcatggttacgagaggaacgttgacgacaagggcaaatgggattgagaggtggtcgaagtctgcgtcagtgtgtgtgggctgtgacatgggtggcgatgtctcggtaggaggcagagctgtattgccagacatgaatcgcaaagaaggcttaggtccaagtttagtcgaagtcacttgagtgacgattgggtctgcgacatgatatcaatatatttgggtatatccacatgggggagcagcagtgatgcttacggatgaatatctcgttgctgaaccactcctctgtcatgggcggatcctgctgtatatttcccttgttgtaattgaaagggctatccttcctggcttgcaattcatatgcatcctggaccatttttgtgttcaaccggtccaggacggcatg

SEQ ID NO: 26 - DNA, 578 bp, Sorghum bicolor
  Clone ID: SORBI-28MAY03-CLUS100431_1
cggcgaaaccccagctgcgccggagcaaacctggacctgaactacccgtccttcatggtcatcctcaacaggacaaactcggccacacacacgttcaagagggtactgacaaacgtcgcagcctcaccagcaaagtacagtgtgtcagtggcggcgccagcagggatgaaggtgacggtatcgccgacggcgctgtcattcagcggcaaaggcagcaagcagccgttcacagtcacggtgcaggtcagccaggtgaaaaggaactcatatgagtacaactacattgggaactatgggttcctgagctggaatgaagttggaggcaagcatgttgtgaggagcccaatagtctctgcatttgcccaatgatcgaggaagacatgttagcataacaggagcaaaaataagactataagagcacgacagtagaaaagataattattatatttacgattaatcctgatcaggaacataaagaaaaatagactgaagaaagggggaaaagcctctgacagatactaaattactacagttgacaagtgtatttatacctgataaatcaaattataggtttctcc

SEQ ID NO: 27 - DNA, 444 bp, Sorghum bicolor
  Clone ID: SORBI-28MAY03-CLUS100461_1
aacaacaactggtcaggcgctgacgcctcttgccttgtctccgccgccaagaacctcaacatccccggtctccgagtctgcgactctgagaacacttgctctatcatctaccccggtggcactggcaagaacgcctacctcgctggcatggaggctgaagacggcattggtatcaacactcctctcaagcaggtccgcctcaccgttgacattgactactccgcttaagctatatcatagcctgtggtttagttcatttgagagctaggcctctgcgtaaaacttgattttatagaattgggcttattctatctatacctggtgtttacggtgctcggaatttagctatccagggcgatcctggatcttggctttgggatctatctattataccttctaacatacatatattcatagtgttatgacatatattcatttctcctg

SEQ ID NO: 28 - DNA, 575 bp, Sorghum bicolor
  Clone ID: SORBI-28MAY03-CLUS100515_1
tttccgagacatgggtttttacaaaatcggagaaattcccatatacaatggaggtccaaggacgcccaatcatggatgttttccctttgcttcgaagcctttcccagtcccaatttggattacaccatctgtttactaggttcatgatgttgtgtctaacatcagaagcaaagatcttgtatatggacagccttttctggagcaattaaactgaatggaggagacacttgggaaagtagaaagagctggagacctagcgagagctagcagatatgttggaaatcagcatcagtactagtggttttgctgttagcgcagggtgtagtctgtttctgctttgtttttttgttctgacccctgtgtgtgaggtctggcgttgtatcactgtttggtagtaatctctctgcttctcttctgattgcaggcgcctgtgccttgcagttggttaggttgtagttgctgtaaggtgctggttcgtggttggatctttgttagctggtaaccccagcaaaatgttatatactttcgggtataaacagggccaagctttggtctaatcaaaccgaaggaggttc

SEQ ID NO: 29 - DNA, 600 bp, Sorghum bicolor
  unsure (1)..(600): unsure at all n locations
  Clone ID: SORBI-28MAY03-CLUS100560_1
ggccttcaagagactggttgtgccagagcagagaactctttggattgcacataacataccatccttgctctacccggcggccacccaccgcccggtcccttcttccgcgcctgccatgcacgttcttcagaagatgatggcaatgccaaaaaccattgagaataaatcaaggcagcaaggcatttatgaatcaatccaccgtgatttacttgtcgcgttcggaagttgggagtttgatccaatgaacattaccaatccatttcctcaaaatgagggttctgtacacatctggcaaggatacgaagataggttggtgcttgttgagctgcagaggtacatttccaagaagcttccatggatcaagtatcatgaagtaccagaaggtggacacatgttcatgctggtagatggatggaccgaccgaattctcaaggcactcttgttaggagaagagaccctagatgtgtgacagtaggtcaattttcaaactgttgaataactgcagctgccagctgtaattttgcttattaattttgtaccccaagttgtacacttgtattcctacaacaccaagactagtctaattcgggggggncccgg

SEQ ID NO: 30 - DNA, 497 bp, Sorghum bicolor
  unsure (1)..(497): unsure at all n locations
  Clone ID: LIB3480-015-P1-K1-F3
cgctgcacaaggtggaggggcgagcggtgcactaccagatcggggacagcgacggggaggtgaggccggacgaggaggcgcagtacctgacgttcaacgggacgagcctggaggagctgctggagaggctcaaggaggagacggggctccacgacgtcatcatgtgctcgcggagccccatcaacgggaagctcctgccgctccgactgcagctgccgccaaacaacgccgccgtgcatatcgtgcttgtgcaccagtcgtccaaaggtacatatatacggtttagttcctcttctatacataccataccattgcatcggatcgacgacataacacaccagtcgtttttttttccttttatttacaaaactgaaacacaccatatttgtatttcacacatgcactaaacgaagagaactgttactgatacctcatattgaaggaaacttcatgtagtgtagacattattagtagtattgattacctncctttcattt

SEQ ID NO: 31 - DNA, 517 bp, Sorghum bicolor
  unsure (1)..(517): unsure at all n locations
  Clone ID: LIB3480-022-P1-K1-F10
cccacgcgtccggaggagctgctggagaggctcaaggaggagacggggctccacgacgtcatcatgtgctcgcggagccccatcaacgggaagctcctgccgctccgactgcagctgccgccaaacaacgccgccgtgcatatcgtgcttgtgcaccagtcgtccaaagtggcaaaaagttttgcttgatcaattgaccatcccgttcacaaaatcatctgatcgaagatggtggaagcaacggcttgtgtatcaaatgcagaattggtctcacctaatgtgtatatattaactttctgattaaacctgttccggtggctaacataagcaagtgtacttcttctgcctctagcggttctcattcgtcatcatattttctttgtctgtagatgtgttccatctaattctcaaggttcatagtgatgtttgtagcaagaccctttgaaatttccatgctatttattntctaagttcttgaaaggattctttgaaagtttctatacatattggttccctg

SEQ ID NO: 32 - DNA, 482 bp, Sorghum bicolor
  Clone ID: SORBI-28MAY03-CLUS100618_1
caactacgaccagacagcgatgatgctcgacccaatcgtcgtgaacgatcctgccatgcccgattggaacgcaccaaatgatttggatttcagcaacttcatacataatcaagtgggcgcgtgatgtggtccaggctctacgttcaattttccgttggcttctgtcgagcgttctagcgtccaagggaagacccgaattgggtttccacgtctttttggtgggtgggtctcggcgttaacggagtaacatggtcaaaattattcatgaggtcaattccaggcgaaaggatcggtagcgcacagctggcctccgatggcattgtaaggttcaccatgacgtgggcgactttggccgatctgggcctcggcggctcggaccttgcagacatgtgcgcgaccctgcaagatgggagcactggtcagaatgtcggattgtaaatagttgaatacgtcgaatgacgatgaattaatatgtaccatcc

SEQ ID NO: 33 - DNA, 496 bp, Sorghum bicolor
  Clone ID: SORBI-28MAY03-CLUS100627_1
cctttactgcacggagcatcagggggatcgcctgaccaattccataacacggacacggcaactcccaggcaaatttattccctcagaatcatccaatgttacgggcctgacgaaatgtcatggaagaagaacattctacatcggcaatatgacagggccgacgtcgtcggcagcgctaacggccataggccaagtgcgatacccggctagagttctcttctgttgtaccacaagtgtcctggtccgaacaaatagaagcggagcccttgagagcaggggagtacgtagcggtgtccagcgcaacgcgacgcatcacttccaggtcaaggtggagaacgcgtacggaagaaggtttggaggagatgaaaggctcttcggtgtcataggactctgttttgctgtttgacctgtcccgattcggaggaggagtgatctccaacggaagatccttgtaattattccctgttgttgcaccccccagcgtgtatatcgttgt

SEQ ID NO: 34 - DNA, 697 bp, Sorghum bicolor
  Clone ID: SORBI-28MAY03-CLUS100660_1
ggaggccatgcggctgcacccgtcgacgccgctcagcctcccgcacttctccttcgacgcctgcgacgacgacgtcgccgccggcggctaccgcgtcccggccaacacccggctgctcatcaacatctgggccatcggccgggacccggcggcgtggaagaagcccctggagttccggcccgagcggttcctgccgggcggcggcgccgagaaggtcgacccgatggggaactgcttcgagctcatcccgttcggcgccggcaggaggatctgcgccgggaagctggccggcatggtgttcgtgcagtacttcctgggcacgctgctgcacgcgttcgactggagcttgcctgacggcgaggagaagctggacatgagcgagacgttcggcctcgcgctgcctaaggctgtgccgctccgcgccgtcgtcacgccacggctcgtgccggaagcctacgcctgagctagctgtcagtggttcgcgtgtgttgttgttgccttcctgcatacgtacataacttgttatgaatcctacacttgcattggttgcctagtaccaggtatttgaaattatatacggaccttgcatggtttcagttttttgacacaaccgatgatggttgatcagaagacggatctgtagagttgttctttaacaatgcgctaacctatatatcaagggactgtttggttttcc

SEQ ID NO: 35 - DNA, 328 bp, Sorghum bicolor
  Clone ID: SORBI-28MAY03-CLUS10069_1
gggtgatcagtcatgacactgtaaccatgtgctaactatgaagtcgatctacaacaaaggcagctgttggcctccccgaccaccacaccatgctcatatttacatctaattaattattgccctctttcaaattgttgcttctttagccggcttccaatgggaggaatcagttaaagagatggaagaagtactgtatcttttggtagcaaggtgaagacagactttattttctttttgtagggcagctgcaatagactatgttttattaagattaatttaaatgggagcttcggctatttatcaaaaaaaaaaaaaaaaaaggccccta

SEQ ID NO: 36 - DNA, 463 bp, Sorghum bicolor
  Clone ID: SORBI-28MAY03-CLUS10075_1
atagttatctatgcgtcggtctctgaagcttcgttgcccttatccttcctttgctgcctttccagctactttgtttttggcctgttaaaattcatctgtttgtaagggggaaaagttgggggtttctaaggaatttgggtccaaattatgccttagtgcttttgtgcagtcgtatcatcagttcagtccttaattatactatgcaatatgtcatttgattgtgatctcgacggcttaggtggctctccatcaattttattagctcctgcatccaatttgagcgatttcgtcttttcgaccacttcatttgttgtagtctgtgattgggttctataacatagtggtaattaggcctccaaaaaattctttagttttttgagggcttggtgtgtttccaaaatcttgttctacattttgtttctccataatatatttacgctccttttccaatatgccacattat

SEQ ID NO: 37 - DNA, 601 bp, Sorghum bicolor
  Clone ID: SORBI-28MAY03-CLUS10079_1
ggttttgattcttcaaaatcgatgcgactgtcttggcatccaagggtcttcttgtatgaaggttttctttctgacatggagtgcgaccacttgatatctatggcacatggtaagaagcaatcatcattagttgttggtggcagtgctggaaataattcccagggtgcaagcatcgaagtgttcatggctcatagcaaagacacaattgtttcaacaattgaagataggatatcagtatggagctttcttccaaaagattttggagagagtatgcagattttgaagtatgaggtgaacaaaagtgactataacaactatgaatctcaatcaagcagtctttttgatttttgtagaacagttttgatgtatctttctgatgtctctttgttcaacaatttagtaggagtattttgtctgtgattaaattatcatctatgagctatgatgataattaacaaatgtgcacattaccagacaccaatcaaatgaaactgaaattctgcccctttctggttggcaacccattaaataaatgtgtatttcttcatgattatttacagtctgcagtagtatatcatagatgttaacatatcaacataac

SEQ ID NO: 38 - DNA, 907 bp, Sorghum bicolor
  Clone ID: SORBI-28MAY03-CLUS100753_1
gcacgaggttatctcattacacactcaagcacagtatcacatcatggcggtcaaagcggcattcatcggagcgtgcggcgctactttgcggcatgtgctagcttggacattacttgatggtcataaagcagccgctcttgttcgtaatcactcgaaactgaaaaagattctcttggatctcggtgtatccgaaaagatccaacagtcacaactcatcgttgtcgaagggtcatcccgcgatgtctccacagtccgcaatcttcttctcaatgaccctgagattattttcagtggcatcacaagcacttggaaactccgatttaatccgtttcacccgattgctatggatgatgccagtatcaccggtgactctgctgctgcggtgatgcaagctttaaaagatcttgtttctacaaacagtatcacaaatttacccatctacgctccaatctcatcgactggacatggctctcatcgggatcaaccacgtagcctcatgccgctctactggtggttgttgaaagaggctcaggccgacactgcggttctcgagcgtgttactcgtgaggcggcgacgcagaagcaatcttgtcttggtggatatgtgatgcttcgacctccactgctgacagatggggagatgaaagggacgaaagaagtgcgcgttgggtggatttgggaagacgatatctttcggaagagtgatgagcaagaaactggcgtcaaggtaggatatactatcagcaggatggatctggcaagatggatgtttgaagagctcatccaaggagatttccggagttggaatggaaagtacgtaaacgttacatactagaacatctcgttttgtctttcagttgtgttaattattacccgtatctaattttaatatccataacttgactcg

SEQ ID NO: 39 - DNA, 491 bp, Sorghum bicolor
  Clone ID: SORBI-28MAY03-CLUS1008_1
gaatagcaacacagaaagttctggtagtcaccacttggagaggactaaatgctcaaaatcatcaggaaacattgaagaacttgctgttgcagctacatcaggaatggattgtacattatctaaaggaagtcatttgagcatggaggaactccggatgatgcatgttgtgaaatggaggaaagtctaccaacataacagattgtgccattggggtgttaggagatgtcctaaaattcagttgtttcctgagctaaggctacaaaagtcctctgcagctataacttctgatagtatgtcaactccaacaaaagaacagtcatctcagaagagcacaggaagccttgatatcaccaaacttctggatgaactagagataccatctcgttctcagaatagcatatcgtcttcagttttgcttgtgaagaagcttctgcagtttgaataaagttctaagccagcatactatggtacctggagaaaagagagttcta

SEQ ID NO: 40 - DNA, 863 bp, Sorghum bicolor
  Clone ID: SORBI-28MAY03-CLUS100813_1
gcacgaggaagcaaactactgaaaaaaagagtgaacctacagttgaaaaaaccactgtcacctctgttggtaaatcaacaaaggaagttgttaaaggaaagagttggggtagaattatttttagttcatacattactcttgtagtattgttgattttattcttgatccttcacctcgcacacaatcacttggtttaccaatcaaatcttgtcactcaacatgactctagattgaagagattgtacaaggaaggagaaagagctgcacctctcttctctcaaaatgttaatgttcttccacctgccattgttaatccaatcaatcaagtcatcagattaattaatgataatccaaaagttaaagaattgaatattaatattcctctcttcccaattaatgaatttgttgaaattaatattagagtttcttcaatcccattcattgctttactcattgcttttgcctacacaatgacttctaaagttccagtcattttgggtcaaatcattgaaggaaatggtaaattggacaatgatactccaagagaacaacaatccaagttgactggattcggatcaagagctttgggtgctcacaataacgcattcgaagctttgattggttttggtattattgttgctgtcactttgctcagaattaatggtgattctagtgaacgtgcctcattgttggctctttcattggttaaggaatcaatttgtttcattgctgctagaactgtcttccaaattgtttatgttttgggtttcccaggatttattagaactttggtttgggctttcggatggatttctgttctctcattgtacattcaaaatgctgtttattaaattgttaaatta

SEQ ID NO: 41 - DNA, 445 bp, Sorghum bicolor
  Clone ID: SORBI-28MAY03-CLUS100880_1
tgatctcaactttgcagttttcgacctcgtcatgctcatcctcgctattctcaccgttggtcgattcctccaggatcagaagagcaactacctggaaggctttctgctcatcattctttacgttgctattgctgttgcggccttctactatccaaacccaactggccatggatccgagggggctgctgaaggtagttccgagggcggacattgataggatcctcaccgattcgcttcgagtctaccggttctttttttaacctattacgatgttatgaccaggagtcactttccagtttgatattgctcagggatagcatgcctgtataaatacacagagttgggtcgttggagcatgtatagcatactgttgtttatacgtacgttactcgaactctgattttatagagttgccaaagaatcccaaaaaaataatctatcctct

SEQ ID NO: 42 - DNA, 467 bp, Sorghum bicolor
  Clone ID: SORBI-28MAY03-CLUS100869_1
ccgggcgtggtgcgcgctgaacccgaacgccaaggatctcggcaagctcggtgccaacatcgactacgcctgcacgttcgccgactgcacgccgctggggtacgggtcgacgtgcaacggcatggacgtcgccggcaacgcgtcgtacgcgttcaacgcgtactaccaggtgcagaaccagaaggacgaggcctgcgatttccagggcctcgcgctgcccaccgagaccgacccgtccacggcgacttgcaacttcaccatacagatccagaccggggcggcggccatggcgtcgctcggcgcccggagcgctggagcggccgcgctggtgttggcgttgctgcagctcctggcgatgtggtagcagtgcttgtgtccacgtggttgccggaagaagagatcgacgttgtacggttgattgattctgtgcatttcttatatgattcgattaaaaaacatgcttttta

SEQ ID NO: 43 - DNA, 569 bp, Sorghum bicolor
  unsure (1)..(569): unsure at all n locations
  Clone ID: SORBI-28MAY03-CLUS100905_1
gggatggctcgatatgatgcattggctgggaggggaagatgttgagagtctgcggttgttgttcttgaattgatgtcttagcttgctgcccatcaaagtagaggagtagggcttggtccagatcggatgacatgtcatatccttcaggatcccttctcatgctgccatggagggatgaagaagcttggaccatcccggaggtagatggataagccattcagatgcttccttgaagacagaacccagctctgaacttgcttcttggccacttcagactgaattgacacatcttgaaatggagtgaaacatcctaccagaccaaaaagcaatcttatgtttcttcttcctcttcctcgtcctcttcctcttcctcttcttcacaacagggctgctatgatcgatgaacggagataaacaaaaaggaaactgatcagcagcagccgtctttgttcccctttaattttcnctgtgcctgatcgaaatcagtttgtgtggcttttcttctgaccagaaggtaacggatgacttttggcttggggatggaggagtggtgtgcagggggggcccgg

SEQ ID NO: 44 - DNA, 571 bp, Sorghum bicolor
  Clone ID: SORBI-28MAY03-CLUS10092_1
gcgcttgctccttcttgccccatggcgctgctcgccatccagggcatggctatgtccaccgccgccgcggccctcccatcccacaaccacggcgccgtctcctcttctgtatccacttcctcctacgcgctcgcagcctctgccgccttcccccgggtccgagctgcgttcgccgtcggcgcagtcacgtcggccgccgtcactccagttcttgacgtctactgtgggagaggggacaagaagacgaaaaggggcaaaaggttcaaccattcatatggcaatgcgaggccgcgcaacaagaagaagggaactgggcctccgcgtctctttgctcctccagctcctccaaggaaggaccagttcgatgatggggagatcatttcaatcgagattgatgaggacatcctggaataggttgtcctgagatttgctttgctttatatttgccctgagcttaactggcctagcttgtaccaaatcgaatactacatatttcaaagtaattattatttcctcgcctataaatgtcaatgtgcaggatatcacactttcctttggctagtattagtaa

SEQ ID NO: 45 - DNA, 623 bp, Sorghum bicolor
  Clone ID: SORBI-28MAY03-CLUS100970_1
gcacgagggcgacgtgtacagcttcggcgtggtgctgctggagctggtgacggggctgaagccggtgggcgagcacctcggcgacggcgacggggcggtggacctggtgcagtgggcgcgcgggcggagctcgtcgggaggaggcgtgctggggctgctggaccctcgcctcggcggcgacgtgccggtggcggaggcggcgcatgtgctgttcgtggcgatgctgtgcgtgcaggagcacagcgtggagcgacccaccatgcgcgaggtcgtccagatgctgcagcaggcaaagcataagcatgagggaccgggaccgggaccatcacttgctgccgccaccgtgccactgcccgcccggccggcccagcgccatgcacaacgacctgacattgacatgcacttggtggtgcactgccacggcatgtgataggcgcatcatccgatccgatccgatcctcctagctagctagctagctagtcctacaaattaaggttgtgcgtctgcactctgcgctctgcatgcaggccgatgaaatccacttccatccgtcctcatgcatagtagtactgtacctgtactgtactatatcaagagaggagctcgatcgcgaaaaaaaaaa

SEQ ID NO: 46 - DNA, 520 bp, Sorghum bicolor
  Clone ID: SORBI-28MAY03-CLUS100982_1
tacgacttcggctacctactgaagattctcacctgcagtagcctcccagacacacaagccgggttctttaaacttatgaagatatatttcccggctgtgtatgacattaagcatctcatgaagttctgcaacagcctgcacggtgggctgaacaagctcgccgagctacttcatgtggagcgcgttggggagtctcatcaggctgggtccgatagcctggtcacatcctgtgcattctggaagctcaaggattcgttcttcgcgggctcaacagaaaaatatgcaggtgtgctgtacgggctcaatgcagagaatggtgttagtgcacattaagaccctctttgaatttttagctttgtgaatggattgatttagcacagaaagggtgacaactgtgcaagagggctcagtgaaagatcaagtctgtaggttaagtctgtctcactcatttgggtgtatttgggaatgtagtgttcttcggtctgctcattactgaaatagttattctcttttctctttc

SEQ ID NO: 47 - DNA, 477 bp, Sorghum bicolor
  Clone ID: SORBI-28MAY03-CLUS100986_1
ggaaaagaaaaataggctttggcgattacatccgcattgggtcccgacgggcattgcagcatgatcctcatgatgagaggggtaaccaagaattctccgctccttaccttgagtttggtgagaacacggctggagatgtccaagaacaggctgtggagcagaggatgacgttcaaggacgttttcaatctgccccataacccgataccaacagtgcacgagggacagcttgcctttcgtgacggaaagaagatacacggccgattatcccgctccaggactgtgtataaaatgggtcgaattttcggtagcagcctacggttgtaagatgtttgtttaccgtcttcatgttttgctattgtgccacaatattgacggagtgcataatacccgatacatgcttaagttcagcatggtttgattgtatacatcgttgtatcaaaatggacagagactctttctcaatagacccaataca

SEQ ID NO: 48 - DNA, 942 bp, Sorghum bicolor
  Clone ID: SORBI-28MAY03-CLUS101008_1
gcacgaggcttccatcaccctcctctccctcgctcccaccgctaccttcctccacatcccggcctccacctcctcctcccccttcgttgccgctcccggaatcctagccggccgccgggccgcgtcccgcgccctcccgctccgcgcgcgcccgccccgccgcatcaccgtcgtctgcagcgccgctgcggcggcagccgaggcctcagacgccgcggcgccagtcgagaagttccggctggacaacctgggaccgcagaaggggtcgcgccggcggcccaagcggaagggacgcggtattgctgcaggccagggcgcgagctgcgggttcggtatgcgcgggcagaaatcgcgctcggggcccggcgtccggcgcgggttcgagggagggcagatgccgctctaccgccgtctccccaagctacggggcattgccggcggaatgcacattgggctgccgaagtatgtggcattcaatttaaaagacatagtgcgtggtggattcaaagatggcgacgaaatctcactggagaccctgaaatcacggggtctgatcaatccatcaggcagggaaaggaagcttccactgaagatcttaggagatggggatgtatcggttaagttgaatatcaaggctggagcgttttcagcttcggctaaagagaagcttgaggcagctggttgttccctgactctgttacctaaacggaagaaatggctttcacaaaattatctgaagaaccaagcccgtgcagaagagtactttgccaagaaaaaaggtggtgctggtgaatctgatagcggcactgtgtagacttcctatgtgatgtactcctcttctctttcttttagcatatgcttattgctcccctttttgttcttaattttttgtgtaccatgaattttgtatctatgtcatgcaattatttcatcccatcttgt

SEQ ID NO: 49 - DNA, 891 bp, Sorghum bicolor
  Clone ID: SORBI-28MAY03-CLUS101022_1
gcacgagggtgggtgggatgaacttggtggcagcggccgtggtggatctgaactgagggatgagtttcttggtgatggacgtggccgtaaaaagagtggtgacgctgatggcgctgagagtggagaggactcgggtgttgaatcactgtacattgagtgagaaatagaatcagatatgaaggctctggacatcaagttgcaagcttgattctgagcaggcaccccgttccctttggacaaggtgatgagttcagaactatcagcaaggaaatcacattcatgaacctgcaatgagtcaataataagatggagcccgaggaaaaggctaaaggcctccgcataaagggagctgagaagtttttgcttcaaataagatggagaccgaggaaaagactaaaggcctccgcatgaaggggcaaattagcctgagaagtttttgcctgaacgtgtaatctacaaggggactgcaaaccacgatatgttctgtaaatgcccagaccattctcctagcattgatgtatgaggcatcagacctgcaacaacagctagaaagggaactacaacgttcatagttactattgcttcaaggattctgaaacctgttatcagatatttgttgttcaacaaggcaagctttgtattgagccttgccttttgcacagcctttgcctgaaaaatgatacagtggataggcaacttttttttttcagtatcattctggtcagtaggccactgcaaatataatgtaaaagctcagaccaagagccttgcaggaaatcagattttgatagctagagcagaatcgaactaactgcttgtgcaaaactaaaatggaacaaaatcgaactaactgcttgtgcaaaactaaaatggaacaaagataccattttc

SEQ ID NO: 50 - DNA, 459 bp, Sorghum bicolor
  Clone ID: SORBI-28MAY03-CLUS100607_1
tataagctgctcgaaaggagcttcctctacgaaggaggcttggatggtcgagactggttcaagcatgttgtgtttgcgcctggtatttggacagggtattctggagctgttttccctggttgggttgagagcattgacgccaaggactcagtcaacggtctcaagtggtccgccattatcggacgctctatcaaaaacgccattgatagcctttcggattaggctgctttggttcaggaactaggatctattatctatttatgctcaaatgtgaaattgattagcgagtcttcgtgccatcacattaagagcttgcgatagaacaatgctgtgttttctataggccacatgacgggacatagttgtctgtccgtctaccgggaatttacctgcctttttaaatatctaagtatggcatcataggtttagggctcttgtcataatattagtggtttagcc

SEQ ID NO: 51 - DNA, 612 bp, Sorghum bicolor
  Clone ID: SORBI-28MAY03-CLUS101039_1
ccattcgcccaggaaactttccagggtcctcaggtttccaagcttcagttcgaccgcatcatgagctacattgaggatggtaagaagtctggtgccactgtcgaaaccggtggtaagcgcaagggcgacaagggttacttcatcgagcccaccatcttctccaacgtcaccgaggacatgaagattcagcaagaagagatctttggccccgtttgcaccatcgccaagttcaagaacaaggaggaggtcatcaagattggcaactcgacctcctacggtctcgctgccgccgtccacaccaccaacctcaccaccgccctcgaggtcgccaacgcgctcagggccggaactgtctgggtcaactcatacaacgctcttcactggccactgccattcggtggttacaaggagtctggtattggccgtgagctcggtgaggcggcgctggagaactacgtccagaccaagacggtctcgatccgtctcggtgacgtgctcttcggttaagcgtctttcttttcctggtttgccctgatgcctgtgtgctctgtatagcgcgatgttagcagcgaatctggaaagtaaagaatcatgacactgacacttcttgtc

SEQ ID NO: 52 - DNA, 787 bp, Sorghum bicolor
  Clone ID: SORBI-28MAY03-CLUS101055_1
gcacgaggcgacagtacgggtcggccagacaggtactgcagccgcttctccgggtggagaagaagaccatgatggagttaatggcggtctcgtagctgcaggcgtaattgctggtatctttggggcccttgcctgttatcttggtttctgtgcctggctctatcgccggcaagtcaacgcctacagacagcacctcgcagaatcaaaccgctactcagttgcgtcccactctctcctcaacccttcagccctcgctgctgctgctactactcgccccaagcgtgctatctcccagcgcagcctctttggctgggtcggccctagccgtgatcagggatatgccacagagcccaaatggagccctgaggatgaagatgataccacgccaggcgctcccgggtccagcagcgggtctggaggtgctaagcgcagtgaggacatgagacctggaacgagtcatagcgggggctcgactgaagggctactcgaaggccaggaaccgagtttcttcagcgtcgtcatgggtcctcgccgggcgttgcgggttgtcaacaatgcagagtaaaccgcgcgtgtacgaagggaggcgtttttgggtaaaggaacggatgggatttaatggctcctttctgagatgtgagatgagttggactggttggttatgattaccgagatgtatgaataactggtggccttgtatcggcacagttgcattcactgataccccatgtttcttaatgtccccggtaaagggagccttggggcaagaaatacgaatgaatttttg

SEQ ID NO: 53 - DNA, 320 bp, Sorghum bicolor
  Clone ID: SORBI-28MAY03-CLUS101117_1
ccccgaccaaaggcgtcgaagtgggcatcttcattgtcaaaaaaacaaagactacaaatgcagctgcgcaataacactggtaggcaggcgcctgcgcgaggtccaaggtggccaactcaaagcaaaaccgaccgggctatgggagcccacagatctctgaattttcttgtatgacattgcgagtacccattctctgcatagcattgcgcggcgttagcaacattcgagacctgtctggaacagtacaaaaggcaaagacatgtaatattaatatcctgtgacgacttagcgcataacaatacagcaacgtttcccgactt

SEQ ID NO: 54 - DNA, 526 bp, Sorghum bicolor
  Clone ID: SORBI-28MAY03-CLUS101192_1
tatcaaccagatccaagcaactctcagataggagttgctttgggcggagatgactcctctgtcaactcaggcaactcgaaaggcaagggcctccaaggggaggagtatgagatgacacccgtggaaaatcctcatgcgggcatgggaatatatcagaccggcatcaatccctatggagagtcaagtcggacgactgctccgcagccaggttactttccagaagggatcacccatatgaatcagtcatacggataccctaacccgtatggacatcacgaagacaatggccgaatgggtcgtgagccgtaggctcggctgtgctacgagcctgataaaatagttgtcgctctgtatttttctctcgttagcttggcgttgaaggatgggataccactattgaagtgtcacgatttgaactgaatgaaatatatatatgtatatagctccactgcggacttgcacttgcaggatgatgcgcagggcagtctaagtagctagagccacctaatctcgaaagtttccactg

SEQ ID NO: 55 - DNA, 542 bp, Sorghum bicolor
  Clone ID: SORBI-28MAY03-CLUS10122_1
cggacgcgtgggctaatgcacgcgcgcctcctcgcgactcctcctctccctgcacgactcgcgaacaactcctctcctacacgaacgaagctctagcaggacaccaggctaggccgccggccaccaagcaaggacgccaggccaccggcgaccaagcctcgtcaagcagctcatcgccggcttcctaaagacagcgtgtgcagtgctcttcagtcgcacggcggcgacatcggccacggcggcttcttcatgcggtggcccatggcgcagcgtcgtggatccactatggtgtggtgagccttcatcacgccggcagccaaggcagaagcagcgaccaggccagacctcggtctcaccacggcggcctgcacaggaggatgtcggcagcgcgcggacgcatgtgcaagaggggaagtggggaactccgggcagcggcggcaccaaatcactgatgctggatcaggtactaatccactcattcatgacttggtttgggatttagttttgattgagcaaattagggtttctggaatttgcggaaa

SEQ ID NO: 56 - DNA, 537 bp, Sorghum bicolor
  Clone ID: SORBI-28MAY03-CLUS101256_1
ctgaggtcataagagaagaatactataatgaaaagatcgacatgtggtctttgggtatcacaattatcgaaatgatggaccgtgttcctcctcactacgccatcaaggatgaggaagaactgtttgatatcattgctactgaacctagcccgacattcacatacagttatcctaccatgtatatgcgtggcctcgtagcctggctcttggatgaagaaccagagacaagaccaagtgctcgtgatgctcttttagagattgaagctcacgttcaatccaacttgttaccttgttcatcagctcaagatcttgttcgattcctgaatcatgtcttaccatctgaacactaagctttacctcccctatgtttatatatatatttatatgttcttgtatttcttctcttatgcatctaccattcgtatccttctttggttacatctttaattttttttcatccttgtcattaatttatacattatgtcttgtatgtttgaaacaacaacaaaataaaaaatagtattatttcaccctttt

SEQ ID NO: 57 - DNA, 860 bp, Sorghum bicolor
  Clone ID: SORBI-28MAY03-CLUS10131_1
caaactcatgcttgcccatgctgccagtgcacaaggaatttcagttgttgaacaaatctctggaaaggatcacatcctaaatcatttaagcatcccggccgcatgttttactcatccagagattagtatggttgggctgacagagccacaagccagggagcaggcagacaaagaaggatttgaggtaaatgttgtgaagactagctttaaggctaacactaaagctttggcagaaaatgaaggagatgggattgctaagttgatttaccgacctgacacgggtgaaattcttggggttcacattttgggtttgcatgctgctgatctcatccacgaggcctccaatgccattgccctaggaacacgtgtacaagacatcaagtttgctgttcacgctcaccccacattatccgaggtcctggatgaactcttcaaagcagcaaaggttaattccggtgtttctcattctgtaaatgaaccagttgcagcctagagaagggcgggatagcaagccaaggcagccaccccaaccgctcctgaaggtcctcagcttcctcacgaccctgttttcttccccaaaacgagatcggcaacggtaaaggggaggttgttgttgtaggtagtatctgtaggttacagatttgaggaaagaaattattcatcagtgtcgaaaatacatacaagcacacaaatgtttcttttttgggggtccagattatatgtagagggtcttctgccgttggggtgggtttttgttggcttcgttattgcaatatttgttgttggttgccctgtaagatgaagtgacgagactagctcagctcagcttgtttgaaataataatccatgtaccatgattc

SEQ ID NO: 58 - DNA, 720 bp, Sorghum bicolor
  Clone ID: SORBI-28MAY03-CLUS101322_1
gcacgaggaagcgaagtagccagccatgctcggcctccgcggcctccccgccgcgccaccggccgccgcagcaccgccgaaggggcgatgcagcgccgccgccccgccaccagcgatgacaggccggctgtcgctggctgtcccggcggctgtctcgctctcgctcgtcctctggtccagtccagtgaacgccggcatcctgtccggcttctcggggctggagtcgactccaggccccgacctcccccggctcgagttcctggagaaatggaatgcggagaaccagaagaagtacgccgagttcgataacaggttcaagaagtccaaggtgctgcaggacctgctcgagaagtccaagaagaacaaagagaagaatgagaggatgatccaggacaagtactgcctgcggggcgccgagtggggcgtcggggactgctccacggagggcatgcccgaccaggagagggaggacttcatttcggagctcaagaagagaaccggagcagaatagctagctgagcccatcattcagtttcagcaggggaaatacccttaccaggggaaatacgcaaacaatttagaccagccctaaggcccctaggagtgcgagaatgttccccaaaataatgggagctccgaatttgcaaaacatatgtacccattgtaaaatgcacttggccccagtaaattaccatctactctaattttcaagagccccct

SEQ ID NO: 59 - DNA, 781 bp, Sorghum bicolor
  Clone ID: SORBI-28MAY03-CLUS101316_1
gcacgaggctacatgaccccgcagtccaccaatgcggcgccgccgagccccaccgccccgcaaacctacgccggcgtcggcgtcggctacggcgtcgcgggcgctgcgtctgccgcggcgagcggcatcctccccgcgtcgtacgccgcgggccacgtgtacgcccccatgccggcgccgttccccatcgcctcgcacagctccagcgggctacagtactacgcgccccacgagggaacaacagcggcggcggtgtcggcggggacgggggcggggttgccgacgacgaccgcgacgggcgaggccgggtccgggtccggcgcgggcgtcgtgcttgccccgcgcgcgcgctacgccacgcaccagctggcggccgagcagcccgggggcgccggccgcgacgacctgatcgacatgctcaactggaggaggggctgccacggcaccacggcgtcggctgccgccaccaccgcgtcgcccgccagcaccaccacgacgctcaccacctcctgcgccggcggcgccggcaacggcgacggcggcagcagcaacaacgacgacgacggtggcgagctcgacctcaacctcagcctctagcagtccgttccgtcgtcatcgtcgtctacctacgccaaggttattcttaatcatgtgccgccggcctatccgtacgctacgcgtgtcacttaattagctcttagtagccacgttaattactctccctctcttcctctctctcctcccttgtatgccgtcatgtttttagtacgtctcgtcatct

SEQ ID NO: 60 - DNA, 1001 bp, Sorghum bicolor
  Clone ID: SORBI-28MAY03-CLUS100845_1
ctccgctgcgccggttctgctcacctgcgcctccccacgcctccgccgcccccgattcccagcccccgccgcggttgccttctcccatcatggacgcgcagttcgagctcttccgcgcgcagctcgacgactcttccaccctccgcgaccgcatccgcgccgtcgtcgccgagatcgagtccgcctcccgcgtcgccaccgacgctctcctcctcgtgcaccagcccgtccccctcgcagacgtgctcgtgaaggccaaggcgcaggtggaggtgatcaaggggctgtatgcccggctggcggaggtcctcaaggagtgccctggtcagtactacaggtaccatggtgattggaggaccgagacacagatggcggtgtcgatgcttgcgttcacgcactggctggagactgggggcctactcatgcatgctgaagcccaggagaagctaggattgtcctctggggagtttggccttgatgttgaggactacctgacaggactctgcttcatgtccaatgaatttcctagatttgtagtaaatcgcgttactgctggtgactatgactgtcctaaaagggttttgggcttcttgactgatcttcatgcttcatttaggatgctgaacctgcgcaatgacttcttgcgtaagaaatttgatgggatgaagtatgatttgaggagggtggaagaggtctactatgatgtgaagatccgaggacttgtacctgtggagttgaaacaagagactcaatcgtagaatccttggtaacgttaacatactttgtggtttggcttttgccatccataacgtgttcatctagctacaatgccaaaaatttctgttagaggtatgtgttatggactgaactggtgtcttgggggcactcgcatgaccttggtcatttcttttgctgtggcgccacatgttcatgcatttgacggtatgtgagttagatttcgtgaactccggagagaataatttctctctcaccttgccttt

SEQ ID NO: 61 - DNA, 528 bp, Sorghum bicolor
  Clone ID: SORBI-28MAY03-CLUS101345_1
caagacatcccccacgtcgtcgaagaaggtgccaaagtcatcagagagaacaacgagcccagcatcgccaaccgcatccaattccaagaatacgacttcttccagaagcaaccagtcgtcggcgcggatatctacctcttgcgccagattttccacaactgggactttgaaaactctgtcaagatcctcaaaaacactgttgagtccatgggtcagaattctcacgtgttgatcatggactttgtggttcctgagcctggcactgtttcgtctgtgactgagcgtgttcttcgatctcgtgatgtgggtatgatgcagctattcaattcgcttgagcgagatcttgagggctggaaggcgattttggaggcggtggattcgaggcttaagattaatgctgttaacacgccttatggtagcttcatgtctgttattgacgtcgttctagggtaggggattaatagatttggatatacagttttagttatttgatcaagattagaaatacgataatattgatcgtctctt

SEQ ID NO: 62 - DNA, 192 bp, Sorghum bicolor
  Clone ID: SORBI-28MAY03-CLUS101376_1
ggaagggctttgggacatctgccgctgcaagcagcctgaggtgtactggaaagcgaccatctttcccagacattgccaccacaacataaccggacatgcaggctcttgtgattgtcccggaggagcgcaaccaccatcaccgccaccctggtgcccgtagcaagtcatcgggtccacacttttcatcaccgc

SEQ ID NO: 63 - DNA, 649 bp, Sorghum bicolor
  Clone ID: SORBI-28MAY03-CLUS101373_1
gcacgaggaccatctctactgcttgcttccaccatcgataccactcttaccgcctctacaacttaccaaccaaccccgtcaatatgcgcagcaagttcaaggacgagcatcccttcgagaagcgaaaggctgaggccgagcgcattcgacagaagtactctgaccgcattcccgtcatttgcgaaaaggtcgaaaagagtgacatcgcgactatcgacaagaagaagtaccttgttcctgccgatttgaccgttggtcagttcgtctacgtcatccgcaagcgaatcaagctctcccccgagaaggccatcttcatcttcgttgacgaagtgcttcccccaacggctgcccccatgagtagcatctacgaagaacacaaggatgaggacggtttcctatacattacctactcaggcgagaacaccttcggtgatgcttgggagtaagctgcgtggaatcggttctatatcccacctcgagaatgatgaaggcgttacggtcgtgtttgggtgaatattcgttggtcactggttatgttcacgttatcttttgagtccgtacttcagatctcgctagagagtctgctactctttctggcaacacgtctgtatactcgctagatccggcaatgcagctacggtccgaagtg

SEQ ID NO: 64 - DNA, 422 bp, Sorghum bicolor
  Clone ID: SORBI-28MAY03-CLUS101382_1
gcacgagggtttactttcatatctttttgtataggctcagcaacaagcaacaggctgtgttatcgtagttgctgcttctctcccaaagtaacctgattgtcgcctttcccccttgcaatcgccaccgcaaagctccaataccgcagacatgtctgctgtcaacggcgctggccacagcagcacctccaaggccactgatcaagatggctcctcggctcccggcttccagccccagaacaagatgacggtccagccgcctaggggagaagacctccaggttagctatgccgctgaaattggaggcgaggccaaccccaagggctggtatggcagcatgatcaacaatcttggcgcatgtattggaacatgtggcgcaattccctgctgcatcctttgccccaacccttataagcacgttaacc

SEQ ID NO: 65 - DNA, 362 bp, Sorghum bicolor
  Clone ID: SORBI-28MAY03-CLUS101385_1
gcacgaggcggcaagctatcgccgagtcaccgacacagcatggaacccacgccagcggcgccgcgcgtccacctccagtcgccgcaaactgccgtgccgacgcgggcggtcgagccagggtgtacgcgccacatcgccgtggcctcgcccccgctcccggcggccgcgctgcagcggcgcactcgcgtggtgctctactaccgcgtggacggggcctcggcgtcggcgcggctgtgggaggaggcgatgtggacgaaggagtcgctgagcgaggccgtagccgaccacccggagatggccggtcggctccggcgccacgcggacgggtcgtgggaggtgaagctgaacgacgccggcgtgag

SEQ ID NO: 66 - DNA, 139 bp, Sorghum bicolor
  Clone ID: SORBI-28MAY03-CLUS101389_1
gcacgaggtataaacagacccgctaatcttcttgtggcgcaagcctggagacgaggccgagagggaaagcagaggtcgaccgacggaggcgggctcactcgaacaggagaggcatgccaggctcccagcgcgtcggcgc

SEQ ID NO: 67 - DNA, 534 bp, Sorghum bicolor
  Clone ID: SORBI-28MAY03-CLUS101394_1
gcacgaggcttgaattgaattgcattgcattgcattgcatctgtctaattgttgactttataactcaaagttagctctctcgctttcactccatcatttattagttacagtacaaagatcattcacacaccaccactaactaccacacatccaagatgaaggctactttcttcctcgctgctgctggcctcgttgccgctcaggactttggtggtcaacccgagtgtgctctcaaatgtctccaggagaacatccccaaggccggctgcaagctcgaggacaccgcctgccaatgcgccaccgatttccaggagaagctcctccccattatcaccccttgcttgaccaaggcctgcgaggcccaagacctcctcaaggctcagtccgctgccgccgaggtctgcaaggagttcgctaagaccgccggctccggctctggcaagcctaccgctacttcagctgctgccacctccggcgccgtcaccgtcagcatcgacacctccgtcacaggctccgccagcgtccccgccatct

SEQ ID NO: 68 - DNA, 506 bp, Sorghum bicolor
  Clone ID: SORBI-28MAY03-CLUS101466_1
ctgtcactcctttacagcactacgctgataacactctcttgaaccaacttaccttacaatccttataaaggcaaaaggaagtattccggaaatacaaccgattaccaaaagccgtcactcttccaacacaacatatacacaaatcactcaaaatgaaggtctcttcttccgttgtcattctggccgccgccctcggcgtctctgcccaccccagcggccacgctcaccagcgtgctcacgccaagcgcgacttcgttgttgccaacaagcccgtcacagttattgagtacgctactaaggtcgtcaccgctgacgccgcccctgctaccgctgtcgctgaggctcccgcctctcccaaggtcgatgccgacaccgttgtccccaaggcttccaccagcgttcccgcccctgctgcctccgctcccgccaagaacaagggcaagaagcacagctccggttccggttacaaggccttctgcggtggcaagaaggccaagcgtgccatt

SEQ ID NO: 69 - DNA, 505 bp, Sorghum bicolor
  Clone ID: SORBI-28MAY03-CLUS101736_1
gcacgagggacaagtccctttgcgctgtaagccacacgtctcttcttcattcgccctgaacgtagagaaaaagaagcagaaggcagaaatgcgccgccggaacaggacatcttaatgacaatgtcaggccttcaaaacggcatttccaatagcgaacaccctgtcgtcgaaacaccagtcgctgtctctacttcgtcccttgacaatgccaacaccgagtccgagattcgtgaagcgctcgcctccctgcatgcccacgaggcttctataacgtcccgcctcgatgctctcgtggcttcgcaggctgatctatcccgcgatctggggcggctggatctgctgcgggctggactcggagcgcaggtcatcgccgcacgttccattgggaatgatatgctagcaacggcagcagatacggctggtcgactgagtgacagagtcaaagagttggaccttgaaaagagtagagtcgaggaaacgctgggtgtggtggaacaggtcgcgg

SEQ ID NO: 70 - DNA, 465 bp, Sorghum bicolor
  Clone ID: SORBI-28MAY03-CLUS101029_1
caagaaggccgctgccaaggcgtaaatgacgctgagcagtattgaactttaattaatgacggccacggcgttaaaggatctgttcacggcaagggtacggaaagtacggctactgctattttgatggtttggttcggagcacgggattatcggctgtttgtttacacgtgcacgcggagactcgcgtctgtatgattctaccctcagccatctcattatgttggaggtggtacactagaagtgagggttatttctatgcgattttgtcccctgtattatcttatatgacatgacagagtcttgttacggtgtgtcatggttcgaaacagtgctggagggacggtcggcgtgtttttggagagggcaaaagtctcggttgtgggtgaggaagggttggttgcttgcgattataccactgtcgctgttttgagttattcgatttgagctacgcaatgaacaattttg

SEQ ID NO: 71 - DNA, 528 bp, Sorghum bicolor
  Clone ID: SORBI-28MAY03-CLUS101474_1
tcacatccttcgaagcctacctccatcatatgaggattatatattgactcgccaagttatgtgcctggctatgctgtttgacatgcattttgatgaggaatacgagaaaagaaaagttacttcagtgatcgatgttggtctctgcaaacctgttagtggaactatgcttactagatcggttaggggaagagtccgaaggcagactatttattggagaggtgctgattgctcgtccagttacttgtagagtgtgtgatcttgactggtctacattgattgccctctggagaaatcctttcctggcactggagaactgcttgtgtaacattagagctgacacagatccttggttatcactacagtattgacaacaatagctcggaagatttctctctgcccataccaactagagaaattatttgctgtgttgatggtaatcactatatacacttatttgcccctgtaggaaaaactataggtacagttaatcaccccaaggcttactgcatgaatttgtgctgttgagta

SEQ ID NO: 72 - DNA, 614 bp, Sorghum bicolor
  Clone ID: SORBI-28MAY03-CLUS101477_1
tcaaacttaatttcctcataaagctcaatttcttggtcaggggaaaatccagccatttcgtttagttttgccagtatttctgaaggtttgcccaaggccttcacgaaaagcctacccataaaacgaagttcttccttttccgggttgtagagtttgaagaaaagaagaatatcttccttgcccttctcaggaggagggagaggccgcaaatccagcccaacttctacttccaaaaacagctttaactcagcattgtgtgccttatttgatacctccctcagttgccccacagattgtgtttcctcatgaagggtcaatggacgattagggcggtatgtatggttttgcctcttggcccacaaccagaagcgctgaaactgcacagggatgccatattccttggcaacttcctccttgaaagaactaaaaggcatttgtttctgtatacggaaattacggactttttcatggtccaccaaatcaaaatacatatcctttccaatttgttccttcaaatcctcatctcgagctaccttaattatggtataaagatgagcttcagctttttctttctttttgtgttccgtctcttcttgttcttttttcaaccttac

SEQ ID NO: 73 - DNA, 597 bp, Sorghum bicolor
  Clone ID: SORBI-28MAY03-CLUS101493_1
atgcctttgttccaaggagttccaatatggagagctccggttcgagggaccctgtcgccggctatgggtgctcgagattgattgcaactgcaggttaaagactgttaagtttcggggtacttggttttcaatgccacagcttgaggtgctcaagatccgctgccaaaataatgtgtcgtccttggagttttctgggctacagcagcttcgcaagctcagggaggtctcgctcaccggatcctacgatgacaaagtgaagcaacagttgaagagccaacttggtgagaaccagagggacatcaagcctgttttgaagcccaactagctagtttcgtccgcccatatatatggccgtacgttcgcattggcacacggttgttgctgttcatttcattctatctgctactctctttccagtcctctccatccggtatatagaagatacatgcaacatgcatgttcttctatgatttttcatcccaaaatactcggcagtttggctgcatccagtccatgctagttcactgaatcaatgatgtagtatgtatttactagctagtactagtgtacatgcaatggatttatttttgtcaagct

SEQ ID NO: 74 - DNA, 723 bp, Sorghum bicolor
  Clone ID: SORBI-28MAY03-CLUS101553_1
ggcggcccagtgaagagcggcgacgatgacgacgatgaagacgacccatctccacccaacggggcccaccaccccgccgtcgcgcccccgcagacggagggcatcactctgtccggcctgctcaacttcatcgacgggctctggtccacctgcggcgaggagcgcatcatcgtcttcaccaccaactacaaggaccgcctcgacccggcgctgctccggccgggccgcatggacatgcacgtctacatgggctactgcggctgggaggcgttcaagacgctggcccggaactacttcctcgtcgacgaccacgtgttgttcccggagatgcaggagctgctctcggccgtggaggcgacgccggccgaggtctccgagatgctgctgcggagcgaggacgccgacgtcgcgctccggggtctcgcggagttcctccgggagaagagacggaggacgaggaaagaaacagagggcagagaaacggaggacaagaaggacgcggcagaggacaaagaggaggtggcagagaaagatgtgtagcgtactgtgttcttcaggttcctccatggatcatttttatttctggagcaaagaatcgagtgattagcacgagaataaatagctaggcttttaggagtacaagccagtagcgttatcctatccccggttgctgcatgtttttattgctcgtctgcttttctgaacgctagtacgtgcctaata

SEQ ID NO: 75 - DNA, 523 bp, Sorghum bicolor
  Clone ID: SORBI-28MAY03-CLUS101561_1
gaaggtctttctcaaacttccctgccaaagcatcagtcaatagaatggaatcatcctgcttctcactagctttccatatcttcaaactaggagggaagtacccattgctgttccatttccgcagctgtatgactgagaaaggaccttggattttattagaaggatccatgtacagccagatcttctcagagtcgttaatgactgattcagatgcagcttttgcccctgaacctatgttagtagctaaaattccagatgaggcaccaggtgactcttgtggagcactgcgcgtggtgccttccagtttaactgtttgtgcaccaatgttcgggctctctgatttacttgtataaccagcaatttcgccttgagaagaaaatgtcgacctccgtgaaaggggtgattccatatgagaactcgattcagcccatgtgtttcgattagattcccagttagtttttggatctcgctgtacagcatttctaccatctcctttacctggagacacaagattaccatcttt

SEQ ID NO: 76 - DNA, 178 bp, Sorghum bicolor
  Clone ID: SORBI-28MAY03-CLUS101662_1
atcgaggagctccgcctccttttccgcgactgaagagagtctcactcatgctctgtgagtcgtgccgaggcaagggcaccgagcgcttcccgacggctgatggctgcctccaccccctctttttataggccttcccgttccctcttcttctcctgtcctgatgtacagcgtcaaatct

SEQ ID NO: 77 - DNA, 512 bp, Sorghum bicolor
  Clone ID: SORBI-28MAY03-CLUS101683_1
tatcttagaagcaacctatcctgctgttgcaaagagacttcatggggactggatactggatccagcgatacctgttgttactggattccttgggaagggctggaaatcgggtgctgtaactactttaggccgaggtggtagtgacttgactgctacaaccattggtaaagccttgggactgagagaaattcaggtatggaaagatgttgatggtgtactgacttgtgatccaaatatctacccacatgcaaagactgttccatacttaacatttgaagaggctacagaacttgcttattttggtgcccaggttttgcatccacaatcaatgagacctgctagagaaggtgatattccagttagggttaagaattcatacaaccctaaagctccaggcacccttattaccaaacaaagagacatggataaggttgtactaactagcatagtgctcaagtcaaatgtcactatgttggatatcgtgagcactcggatgcttggtcagtatggtt

SEQ ID NO: 78 - DNA, 585 bp, Sorghum bicolor
  Clone ID: SORBI-28MAY03-CLUS101706_1
cggggatggggctggtctccgtgttcgggaacgacgtagacgcttactacgaccgcctgctggccggggagagcggcatcgggcccatcgaccgcttcgacgcctccaagttccccacccgcttcgccggccagatccggggcttctcctccgagggctacatcgacggaaagaacgaccgccgcctcgacgactgcctccggtactgcatcgtcagtggcaagaaggctctcgaggccgccgggattggcctcggctccaagcccatggaaaagattgacaagacccgggctggtgtgcttgtgggcactggtatgggtggcctcacggtgtttcaagatggtgttcagaatctcattgagaagggatacagaaaaataactcctttcttcatcccatatgctataacaaacatgggttctgccctgcttggaatggacattggtttcatgggtccaaactactccatctcaactgcctgtgctacctcgaattactgtttctatgctgcagcaaaccatatccgtagaggagaagctgatataatgatagctggtggcactgaagctgcaattattccaattg

SEQ ID NO: 79 - DNA, 436 bp, Sorghum bicolor
  Clone ID: SORBI-28MAY03-CLUS101685_1
gcacgaggatgccggcagaggacgagatggtcttattagcggcagatgaggcgtcatggcccatttcctcgccgccgccggcgtggttcgccgccctggtcgccatcggcctctacatcgtcgtgcggtccgccgccaccttcctcctctggctccaccgcgcgttcctgcggccgggcagggacctggcggggtggtacgggacgtgggcggtggtgaccggcgccacggacggcatcggccgcgcggtggcgctggagctggcgcgcgcggggctccacctcgtgctcgtggggcggagcccggacaagctggcgcgggtggcgaaggaggtcctggccgccgcgccgccgtcgtgcaaggtgcggaccgtggagttcgacctcgccgtgaccggggacgacgacgcgcggcgcggggtggcgcgggtggtggc

SEQ ID NO: 80 - DNA, 941 bp, Sorghum bicolor
  Clone ID: SORBI-28MAY03-CLUS101332_1
gcacgagggttctggatgcataattcgatagaggggattttagttggatttcaaccggcagcatgcggaggaccctgcgccctgctgtgtaaatcctttctcctaactctttccataccagttatttaggtatctttctgttttcctgggtaagtcgcttcatctagtttagactgtctggaacaaaagagagggacataactcaaaccggaattcgaatgaaaaatgagctctctatctgcaatcattttgttcttgagcaatggatgaatggcaaatgccgtatctcttcatgcaactcattgaattcaggtagcttctgttatggaatccaatcggctcgttcttttttcagtgcatgaacctagagaaatgcatcagtatcatccactgaacaaatgttgcccccaacagtgcttatctcaatcctagtgatcctgcagtggtgattgtgttctcattatacagtgcctatcacaataaattgttgtttcatctaacggaatgggtggtagttgatgcagtcatcttatttgcatgtgaagtagaagctctttgttaagacactggatttatcattgtccacaaggttgaatatgttccacaagaattactggtatttgttgattgaattgattgtaaaccagagagagtatcatatccattcacaaccgagtgcacttgtgcctgtgccacttgtttgagtgtttaccttcattggaattttgaccaatcagcatgggccgttacttgctatctcgccaaaagttgggtaacgacaagtgtgttggtacttggtagtccataaggcaaactgttttatttaccttcattggaatcttggccaatcagcatgggccgttacttgctatctcgccaaaagttgtgtaacgacaagtgtgttggtacttggtagtccgtaatggaaactgtttaaagtt

SEQ ID NO: 81 - DNA, 911 bp, Sorghum bicolor
  Clone ID: SORBI-28MAY03-CLUS101341_1
ggcacgaggctgcatgtctactgtctctacatatatatctagtagctgcagccagccgtttccgagcaagatggggaaacgcttcctccaccagctgctcgccgtcgtccttgcactctttctctcgccggcgagatcgggcgactggcttccggccaccgccacgttctacggtggcgctgacggctccgacacaatgggtggcgcgtgtgggtacagcgacctgtacgagcagggctacggcatcaacaacgcagcgctgagcacggcgctcttcaacgacggcgcgtcgtgcgggcagtgctacgtcatcatctgcgacagcagcaagacccggtggtgcaagcccggcaacaactgggtcgtcgtctccgctaccaacttctgcccgcccaactgggacctccccgccgtcggagacctccccgccggcggctggtgcgccccgccgcggccccacttcgacatgtcccagcccgcctgggagaacatcggcatctacagcgccggcgtcatcaacgtcctctaccagcgagtcaagtgctggaagagcggcggcgtgcgcttcaccatggccggcttcaacggcttctacatggtgctcgtcaccaacgtcgccggcagcggctccatccagagcatggcggtgaagggcaacagcacggattggatccccatgtacaggaactggggcgccaactggcactgcctctccggcgggctcgtcggacagggcctcagcttcgcgctcgtctccaccggcggccagaacctcgtcttcaaggacgtcgtgccggcgtggtggcagttcggacaaacatacaccacctaccagaatttcgactactaaactgcactgcttcataattatatacagtccacaacaatataaactacactggtttgtcttc

SEQ ID NO: 82 - DNA, 718 bp, Sorghum bicolor
  Clone ID: SORBI-28MAY03-CLUS10175_1
caaaaccactgctggagacatcaaggagaggataccttgctgcaatttcagcatctagttattcttatgtttctttacttcaacacttccttcccataatgaatccaggaggtgctagtatctctttaacttacatagcttctgaaaggataattcctggatatggtggtggtatgagttcagccaaagcagcacttgagagtgatacaagagttcttgcttacgaagcaggtcgaaaaggcaaaatcagagtgaacacaatatcagcaggtccattgggaagccgagcagcaaaagccattggatttatcgagaagatgatagagtattcttatgtcaatgcaccactccagaaggaattattggcagatgaagtggggaacacggcagcattcctcgcgtctcctttggcatcagcaatcactggttcaactatttacgttgacaatgggctcaacacaatgggacttgcacttgacagccctactttatccacatgagcacatttcagctgaacgtggtgcagttaggtttgtaccggagtagtacgtccaggtctgagcaaggcagtcaaattttggaattagtttggaggatggtagattttgcagattccgtttttttcgttctcattaacttggactgtcaattacccgttagaaataggaactgtaacaggctccagtctcctggtctatgcaatgcaataatgcagatt

SEQ ID NO: 83 - DNA, 445 bp, Sorghum bicolor
  Clone ID: SORBI-28MAY03-CLUS101771_1
tttttctggtgctgtcaccttgtattatgctactcatactagaccatcccctcaaaagtatgacagaatggaagttttacctgctggtgaacaaatcatcaacatgatgctccctggagaagttcattcttattatttctctgttggtggtatttctgccgctgattacacaattactatttccacaagtcaagttccagctactttgagagatggtgtatccatgtattggacttatgttccacaatattactacagacaattctactttgaagctgatgattttgaccaaagtgatgtttccattactgttgacccaagacttggtgatgttgacctgtatgtcagcactgaagactatttcccaaccaagactaactatacttggagcagtgatagatacagcaaggatacagttctcattaagtcaaatgatcctcttgct

SEQ ID NO: 84 - DNA, 507 bp, Sorghum bicolor
  Clone ID: SORBI-28MAY03-CLUS101776_1
gcaccacggggtactcgtcgtcatgaaaaaccagtccacgccaacgccactgccagatacgccgacgccgacgacctcaggagacgcggggacaccaggaggaggaggaggaggaggacatgagcaggccacggcatcgccccgccggctcgccgcgctcctgccaagcaggggcagcagcagcagggggacgatggcgaagcggccgggcgttctgtgggcagccgcgttggcggtggtggtgcttgcggcgtgcacggccgccgccgccgccgtgaccatctcgcggaagcagcaccatcgcggcgggtcgtcggcgtcgtcggcggcgcggtcctgcgcccccttcgcggcgtcgggcgcgtgggtggtggacgagtcgtacccgctctacgactcggcgcggtgccccttcatccgcgacgagttcgcgtgcgcgcgcttcggccgccccgacaccatgtacctcaagtaccggtggcacctcgacgcgccgtgcgctcagcc

SEQ ID NO: 85 - DNA, 300 bp, Sorghum bicolor
  Clone ID: SORBI-28MAY03-CLUS101806_1
gcacgagccccaccccgaaggtttccttcctcttcctctttgctcttgctctctctcccctcctcccctgctcggctactcgtcaagccaggggaagaacccagccccgccccgcacgcacagggtcgcccacgccacgcatacgcagccgcagcggagggccatccgatgggctgctgtggctcctcgctgcgggcggggaggcacccggagaagaagccgccgggcagggcggacgggggcgcaccccccgcaccgcccctcctactcgctgaaccagcaccaggcgccgacaccctc

SEQ ID NO: 86 - DNA, 528 bp, Sorghum bicolor
  Clone ID: SORBI-28MAY03-CLUS101841_1
gcacgagggccgcctgggagtgcatccgccccgccgccaacgccgacgggccatgggccaactgcatccaccggtacccagtccacattcccgacgtgctcaagcactgagccaccatcaaaacgaaccgttggaacagtgattggttggaatctgggatcgacggagaggacttgtcgtgtcaattacatgggctcaaggcggcggggtggtcgtcataaaggaggcggggtcggaccaggctccagtcagtcagtcagtacatgtgcgcccggggaacggaacggatgtgttgtgtctcggtccggggcgtttgtatactacatacactcgtttcgtggtgtgagtgacttcgtgtcgcgttgtgttcacatttctttatctactcttataatatacgtatgtttttcctatttctttcaaactcattattcatccagtataccataaggagagatatgacatgagctactagtagagacaagccgagcaaaagctttcatgtacggagtaatttcacctactctt

SEQ ID NO: 87 - DNA, 769 bp, Sorghum bicolor
  Clone ID: SORBI-28MAY03-CLUS10187_1
gaaattcatacggtgcaaggcttggtctgtctggttctcagcaaagtagcaaatcacatgaacaagcaggtttacgtgatcgactcctcctattctctgttggggtgagcattggtattctgtcgtcttctctgtcaaacaagaaggaatttgatacgttgaagggcacactgaaacaaatggagaacttagttcaggatttacaagatgaactggagatgaaagagggtttaactgtgaaagaattgcctaatgaaacttctagcgaacatgatgagccaatgagcaaaatcgaagctgagcttgaagctgagcttgcaagactggaacttaatatcacttcaaaacgtttgcaagaagaaacatctgactttaatgaggttgacgaggagttcattggtgacattgtttgtggggaactgaaagctgatatgatccctcgtgaccacacagattacagcagtgaatgtgaccatggcagggacagcagggaaagttcccctgattacacatgtggagcaaactatcctgtctcacctagagatctcagcattcgtctccacaaggtgatccaacgacggcttgaagaccggatcaaggagcttgagttagcaattgtccacagacagaagcagacgcaagtgcagatgatggtgactgatcaaatattctctgaacgaatacgctcaaacagtgagtcaagttcttcaggccagggaagtcccattttcatacaagaaactagctccttggcagaaccatattgtct

SEQ ID NO: 88 - DNA, 456 bp, Sorghum bicolor
  Clone ID: SORBI-28MAY03-CLUS101914_1
gcacgagggcgacgtcatttgcctttacaaagacttacttctctttccaaattttgtctttagacactcttcactctacaactgattgaactctgtttctgttacagattcttgtgtcacagccgctgcttactctacaatcactacaacgtcatcacatctcagcgcatttcatcgactgtgattctgtctggatcaaatcattgcgttcaataaatccaaaatatcttcaaatccttccatcatgtcgactccccgtaccaagcgccaattcgctggtgcttcagccgatccctcccagcgacaaatcacctctttcttcaatgccagtggaagaacttccgctgaatctccagttgccgcagctgagaagcctatgcagcctacccttccttccaatgtccaggcaaaccttctcagcgttggcatgcgagtccgcaagtccgtccccgaagg

SEQ ID NO: 89 - DNA, 293 bp, Sorghum bicolor
  Clone ID: SORBI-28MAY03-CLUS101924_1
gcacgagggcggggccaagcatgccgttgagcgcgcaggcgcaagatgactggcagggctgggcacgcggcgaggcctgtggtggtccaggatcaccggcggggtccagcacgcggttgatcgcacaagcgcaagatgaccggcggggctggacacgcggagggtcttgtggctgtcgcgaacactggcggggccaagcatgcggtgagcgcacaagcgcaagatgactggcagggctgggcacgcagtgaggcgcgggaacgtccttggtggggtcagaggaacaaccaagc

SEQ ID NO: 90 - DNA, 389 bp, Sorghum bicolor
  Clone ID: SORBI-28MAY03-CLUS101934_1
ggccaacgtcgctccaacctcgacaccaccattcgaaatgtcggaatctcagaccaagaagttcgcgaagggggagcgctccataccgcacccctctcagaaagcgagcaaattctacccagctgaagattcacaggtccccaagaaggctcgcaagtccatccgccctgctaaggtccgaccctcgctcactcccggcaccgtcgtcatcctccttgctggccgtttccgcggcaagcgtgttgttctcctgaagcacctcgagcagggtgttctcctcgtcaccggtcccttcaaagtcaacggcgttcctctccgaagggtcaacgcccgatacgtcattgcgacctcgaccaaggtggatgtttctggcgtgggcgaggatgtgt

SEQ ID NO: 91 - DNA, 558 bp, Sorghum bicolor
  Clone ID: SORBI-28MAY03-CLUS101946_1
gcacgaggcttaagcctgctccaacgcctccccgttgacacgaacccgctacaactttgagcactttacaactgctcaaactcctcaccaaactcgacccgcctttggtctcttaaaggcaccgccttcaccacggctcctccggccgtgagcttcgtcagtgacaaagatttcagcctctgcaagccctctcacatcatcaacgcgatcccccctcccgctgctattgctgctcgacgataagctcctcgatctctccgtcttgcacgaccctcgatccgactacactcccccgtcgttcttcgacacccgtcagctgccgcataggaggtttacagaggttcttcctctagccgaggaagagtcgaggaggcctcgccagtccactgagggatcagtctgctaccgctcacgaccgccctaacaccggctgaacacccccgtacgttcaagcttcactctactatatatacttttcaataaagtatcgtctttctctagtccacggacttaaatccctctctcaacttcccaacgaacccccgcaactgtttggga

SEQ ID NO: 92 - DNA, 420 bp, Sorghum bicolor
  Clone ID: SORBI-28MAY03-CLUS101949_1
gcacgagggccaatcttccctcttctcctgctcctgttcgcaactctaccgcgtaagcaactcattgttcagttctcaagtcgtagctaacgtgtcttgccattaataatctgtccaagcccgcctacgcctccgactctgactccgatggtcaggcccgaggtggtcgccgcagccagaagcagcaattcgttgttcctctgcccacctccactggtctctcacagcctgctggtcaactcctcaagggtgccacagatgagaacggtgctcagaagtccgctgccctcctcgtgggtatcaagctcgaccttgaggccgaggttcacttgactgcccgcgtcaagggagacatcgtggtcggtctttactagacaggagtgaattccaacactgagattgtacttggtggttggtcgc

SEQ ID NO: 93 - DNA, 502 bp, Sorghum bicolor
  unsure (1)..(502): unsure at all n locations
  Clone ID: SORBI-28MAY03-CLUS101978_1
gcacgaggcggcctttcactcttcagctgccgtcttccgctcactgctgagcgacatcttactcgcattgcttgcgctgctctattttgcatgcgctccagccgccatcgttgctgacgcatcgctgcccgctacccctcccacttgacgagggcatctaggctgacggccgacacttgtcctaccatcgttgcgcccgacctgcaatcacccttcgttcgcagccaacaccatctccattgatacgcctctcagtcttgcgctcagttccacacggagcgcgcgtctccaccacatcgtccggtcgtcaagttcgcaattccgattagccttcccatcgccatctataccctccaaggttgcatacaacccacgaacctctggtgcgcgccgatacacaaccacacgaacttgcgaaccatcttagaagtcatggcctcaaatggcgcctcgggcgcccctgcgccgcanacgcaagcccaagtacaaccgtgtcgataca

SEQ ID NO: 94 - DNA, 796 bp, Sorghum bicolor
  Clone ID: SORBI-28MAY03-CLUS10198_1
ggaggatgttaaggtcatagagaaaacagcaatgtataggtccacagctagagatgaggatgctcgcattttgaacaaggcaccaaaggatgagaatttggacaccagcagggatggggcttctgatgtcatatttagtcagaatctggttgtcagaagcttccctcagtcagctcctgctgcaccaacagaagttggaggtgttaacttcaaacgtttcaggaagagggaaacagtgtctggaaacagcttcaaggaccttattccatttgcgcgggaaccatacagagaatcggactacgaacgtggcacattgaacgatttcatgcgggaggagaaacagcggaaacaaatggaagccattgcagatgacctcttcaacaatgcaaagtcgaagaaaagagcagctgctggaagttcgattcacaccctacttaccggctacagatgagagccagcaggagatcacatttgtatgcgctctgccggaatcttccttgaagggctagagaactgcatcatttgttaaccagacaaaagagagcaacagttatcttcatggcaccttccattctctccactcactgaaggttttctggaggcaagagaagcctgcgtcgcagggtttctttttcctttttcagccatggcgagagacgccggcttagtttaggtagacgtaggatggctgtcctgagagattttggcattacacgctgggcaagcttagcatagtttagaatttgaccaaacatgaggatttttttgggttaaatgttgcgtggctagtttctta

SEQ ID NO: 95 - DNA, 536 bp, Sorghum bicolor
  unsure (1)..(536): unsure at all n locations
  Clone ID: SORBI-28MAY03-CLUS102013_1
cacgtccgcgccagccaagcagagaggggatcccgcatccatggaggtggtgggcggcgtttcgctgaggccgtcgccagcgccggcgcgtatccgacggaccaccctgtcatgcgtcgacgtaggccgacgcctcgttctcaggcccgcaggggcgccgctgggccagctgccggcgaggcgcgcgctggtagtggaggcccgggggaggagctggtcggaacggcagatgcagcagcagcggcgcatgccgcagctgcccaagatcgaggacgacggcaacccgcgattcgtcatcttcatccgcaccgccaatgtctacttctggtacccgctcaacatcatcacgggcgggacgacggcgaagatcatgcttgctgctaaggacaacttcctcggcaagtacatctacaaggacacgctcgccaggaacctcgctgccgtcatttacaaagatgaggatgagattatagacacagcaaaagagcagtaccgtgtgctcaagaccgaanatgagtttcggtatggctacaaag

SEQ ID NO: 96 - DNA, 428 bp, Sorghum bicolor
  Clone ID: SORBI-28MAY03-CLUS102021_1
gcacgagggtcgggtccctcctccagaacagcgaggcgccgaagcagcaaccgccgctcccgagtccgccgccgccgccgccgcgccactccaactgatggcgggtaagggtattcttcattttgatggtgcttcaaaagggaacccaggaaaagcaggtgctggagctgtgcttatgactgaagatggtagagtggtatctcggattcatgagggccttggtgtcgctactaataatgttgctgagtatcggggcctgaccttaggactgaaacaagcgattgatcatggattcacgagtattaaagtacatggcgactctcaacttgtctgcaatcaggtatccttttcactataagttatcaaagcttcatcccttacttggttctctagcttctctgttttgtcatgatagacatgtcgccctg

SEQ ID NO: 97 - DNA, 518 bp, Sorghum bicolor
  Clone ID: SORBI-28MAY03-CLUS102023_1
gcacgaggctccgactccgatcctcctccagcctacaactctgcagctagctagccggcaggatcggagctcggaggaggtagctagggtggtgctggtgcagaggcacaggagatctgaagaacaaggccggccggccggccagccagccaaagcaatccctatatatatatatatatatatatcgagcaacaacaagcagaaagccaataaggcaaggaaattgaagggagaagatgagcaaggagtgcgtggtgaacgcgttgctcagctgcttcatgcacgtgggcctggcgctggtgctcctcgtctacctccccatcgccttcatcggccgcctcctgaaacgcctcttcgtccgccccttcgccaagggcgaggacctccggggcaaggtcgtcctcgtcaccggcgcgtcctccggcatcggcgagcacctggtgtacgagtacgcgaggcacggcgcgtgcgtggcggtggtggcgcgcacggagatcgcgctgcgcgccgtggccaag

SEQ ID NO: 98 - DNA, 362 bp, Sorghum bicolor
  Clone ID: SORBI-28MAY03-CLUS102033_1
gcacgaggcaccgcctaaacctttagacacagcacataatgtgcagctattcaagtcatcagatttggcgcctgtttcttcgatctttgcctcaccacatgttaatccagcaaaggaaactaaagttttgatcagggatgaatctgttcagcttcctcaagaattgcactcacctagcagtgtcaggactcgaatatgtccctcaggctcttttagaatgatcagatgcaaagacattgtgtcagagagttgcaatatcacttgtcaactaaacgaggcatctattgattcttcagatcatacatcaaactctacaggccaattgagtcaatccatacaggatgctgctggcagtatggaaa

SEQ ID NO: 99 - DNA, 919 bp, Sorghum bicolor
  Clone ID: SORBI-28MAY03-CLUS102045_1
gcacgaggcccgccgcggcggccgaggagcacgtggcgtacccgcggatgtctccggaggacatcgccccgccgccgccgcctgtcgtgccgccggccggcgccaacccctacgtgctctccgccccgtcgtccaacccgccctccaagggcgctagggagaatctgagggacatgttcggcatggtggggaagaagttcaacgaggccgcgcgcaagaccgagggcatcgccggcgacgtctggcagcatctgaaaactggacccagcattgctgatactgccatggggaggattgctcagatatccaaggttatatccgagggtggctacgacaagatatttcagcagacctttgagtgctcgcctgatgagaagctcaagaaggcatacgtgtgctacctatcaacgtcgcatggaccgatcatgggtgtcctatatctctcgactgtgaagattgcatttggtagcgacagccctgtcaaatatgtgactgaggacaacaaaactcagtcatccttttataaggttgttttaccacttcctcacctgagatcagttattcccacagcaagtcagcaaaaccctgcagagaggtacattcaggtcgtttcagttgacaaccacgagttctggttcatgggtttcgtgaactatgatagcgctgtaaagaatcttcaggaggctgttcgtggtgttcacggggcctagagattgcccattatttatcccctatgtggatgtagtatggccgtgtaaatgtatttgtccatggcacctgtatagttgtgcatatttgtgttgagactggtacacatcattaagtagcgcattcagatccttagcatgtgtactgaacgaagttgactgaaacccagtattgtttggtatactctatttgattgcttgtttcccgagtg

SEQ ID NO: 100 - DNA, 800 bp, Sorghum bicolor
  Clone ID: SORBI-28MAY03-CLUS102062_1
gcacgaggtcgcggttcgctcaactggggcccgacctcttggctcaacgccgtctacaagacctacggctggtggaccatgcgccgcgactcgtacgacaaggccttccacacctacgcgcttgagtggaccgaggactggatgcgcatctacgtggacacccgcctgcaccacatgctcgacctccgtttcaacaagcctttctggcaacgcggtgacttcccggctgtcatccagaacggctcgaacagtgttgcgctccagaacccctgggctgccaacttcacggtcccgaacgccgcgccgttcgatcagcagttctacctcatcatgaacgtcgctgtcggtggtaccaatggatggttcccggacaacaagggcgacaagccctggatcgaccagtcccgcactgccatgtatgacttcgccaagtcccaggacacctggtacgagacctggccccagggcgcggacatcgaggaccgcgcgatggtcatcgactccgtcaagatgtggaccgagtgctaagctgtttcttatctttgttcggtggatggaccttgtctcgtttctcatcttttgcctcatttgcctgcactccccatccatccctttacacgatcacttttccacttccttcagtattatggtgatggacactcgaacgcccgctgtacatgtatgccacccatctttccgccttttctttatttcctgtcgttacaccgttggtggctgcctcacatagacgtactatatgcaaatgatattagttgggcgacaactggcgcctaacattg

SEQ ID NO: 101 - DNA, 428 bp, Sorghum bicolor
  Clone ID: SORBI-28MAY03-CLUS102078_1
gcacgaggtccccccgtatccatctcattttcccctttccccaggcttgtctttgccagaactcgctgtgcgagcacattcaccaccatcatgaagtacagcctgatcgccgcgctcccggctttggccgccgcgtcgcccaccttctcgactgagacgattcacaaggacgctgctcccgtgctctcgtcgacgtcggccaaggaggtccccaacagctacatggtcgtcttcaagaagcacgtcaaggatgcctccaagcaccatgactgggtccagagcgtccactccaagaacacgcaagagcgcatggagctgcgaaagcgctccagcgacctgcctgtgagcaacgaggtctttgctggcctcaagcacacatacgagctggccggcctcaagggctactcgggtcactttgacgacgagac

SEQ ID NO: 102 - DNA, 473 bp, Sorghum bicolor
  Clone ID: SORBI-28MAY03-CLUS102145_1
gcacgaggcagtgaccatgttgtcttccaagtcgtcctatgctgccgcagctgtcgtgctcgccaatctcgccgcagttgcccacgctcagtcgtcgggagcgtcggcattcacgcccctcgcatcccagagctttgcgtatacggctctcccataccaggcagacacgggaacaggtgaacgtggtccccagtctggctacaacatttgcaactcgaccaccgagaaccaacagtccttgtgccagacggccattatcaacagcattgacgacttttgcctctgggctccccaggatccaaacagtttgatcggaaacgtcgaaggcgagtgcgttgcctggtgcacaaagcccggacatggaacgcgcttgattcctgctggcgccctcaccgccgtccaatttatgaagacacctgattacgtccaagtcactggtctcatcaaccaggcactcatcaacattgcctcca

SEQ ID NO: 103 - DNA, 607 bp, Sorghum bicolor
  Clone ID: SORBI-28MAY03-CLUS102180_1
ttgagacttccgttccccatcgcccggaggtttgtctcgggtgatcggaaggggatggagttcacggaggcgttcaagcagacgggcccgtgctccttctcccccgactcgcgcttcctcgctattgccgtagactaccgcctcgtcgtccgggacgtcgtctcactgaaggtggcacgaggattttcatgtgtggacaagataagctctgtggagtgggcaccggattcagaatatattctatgtggactttacaagcggcccatggtgcaggcttggtcgctgagccagcctgactggacctgcaagatcgatgaaggtcctgcagggattgcatatgctcgctggagccctgacagtcgtcatatactcactacgtccgagtttcagctccgtctcactgtgtggtctctcgtaaatacagcatgcgtgcatgtccagtggccaaagcatggttctaaaggtgtttcttttaccaaggatgggaagtttgctgcaatctgtaccaggcgtgattgcaaggattacataaatttgctctcatgtcactcctgggagataatgactgtctttgccgttgacacggtagacttagctggtgttgaat

SEQ ID NO: 104 - DNA, 511 bp, Sorghum bicolor
  unsure (1)..(511): unsure at all n locations
  Clone ID: SORBI-28MAY03-CLUS102293_1
gcacgaggccaaggccaagtccacctatgcctcctctgctgacctgggatggagctttgacgacaccgagaggctgtacaccattcccttcagcaagttctccggtctcaacacggctaagctcaccaccatcttgttctctggctttaccggcactacttcctttgggcccatggccttctactgtggcacctcgggagagtacgttccgccgcctccggcatccgaccctggtgcttcagccacggttcccgctcctagcaacccttcggctaccggtctggtcattgacaagtttgccaacgccaacaccaacgctatgggcaactggcacggcggtgacgagggaatgactctcaagtacaacaacaataagcttaccatcacgtcccccgacgccgactacgccttctacacccaggtgtccagtggatgctccgacttcacaaagtacaagggatcttatctccacattgcctactcgggtaccacggacttcactgtcgctntc

SEQ ID NO: 105 - DNA, 566 bp, Sorghum bicolor
  Clone ID: SORBI-28MAY03-CLUS102297_1
gcacgaggcacggctcttcccttgcgcgtgtttcgaaattggctgtgacagttactgttgtttttgttggcgcctaaaagttcagctcatttcgggaacgtttgcagctaccttaccacattcctttggaatctttggtaaagcaccttaccctgtgagaacgacgatttcgcgtttcgcatccccatcactctcctcagaagcatttcattgcttgtcccggcgtgacggcgtcttagaggcttgattcgcatctgtacgaacacttttcggagtccaattctcggttatcagattcatattctttaaggattagactcggcgtgaaggtcttgcgatccaaaaatagcgacttacttcgttgtgctttcggtactcgattctctgacgctcttctacgacttttttacgacgtgtacgagtttactacccacgtcttcttttattgttgctctgctctgtaaagccctgcaacatcttgctttttccttgaacatataaagctcgtgcttggttcttgactctgcgcattatggatttcgccggtgtcccccccaacaacgcag

SEQ ID NO: 106 - DNA, 935 bp, Sorghum bicolor
  Clone ID: SORBI-28MAY03-CLUS1023_1
ccggatcgaccgcacgcgtccgcatggccttgcttatcttcaccatgaatgcagtccgcgaataattcacagggatgtgaagtcaaagaatatcctcctagacaaagattatgaggctcatcttgctgactttggtattgccaagagcttgtgtgtatcaaagacgcacacatcaacatacgtgatgggcaccattggctacattgaccctgagtatgcacgaacatcccggctcaacgagaaatcggatgtatacagctacggcattgtcttgttggagttgcttactggcaaaaagcctgtcgatgatgagtgcaatcttcatcacttgatcctatccaaagccgcagagaacacggtcatggagatggtcgaccaagacatcaccgacacgtgcaaagaccttggtgaggtcaagaaggtgttccaattggcgctcctttgcagcaagaggcagccgtcggatcgaccaaccatgcatgaggtcgcgcgcgtccttgacagcctagtctgcccaggtccgctcccgaagcaggcacagccacaggcgttggagaagtcatccacggctccgagctatgtcagtgagtatgtcggcctacgaggcggcagcgccctctcctgcgccaattcatctagtgcgtccgatgctgagctcttcatgaagtttggcgaggtgatatcgcgaagcacggagtaggtcgatcgtctgtctgaatgatgatctcaaagagttaaacctgcagtttgcagcattttggttacaaatttacaagggttatctggcgccctgtgagtctctgtaaatatgctgccttctccttgggacttcactaggcactagctatttttctccgttatttcacatccttttcacctgtggtttgggactgtgcgaagtgtactaaaataggagtggagttttgctgggaaaa

SEQ ID NO: 107 - DNA, 487 bp, Sorghum bicolor
  Clone ID: SORBI-28MAY03-CLUS102302_1
gcacgaggtcttcagcagccgctacatgcagctgtgtgaggtcttcacattcggtggcagtggcgatgctcggtggagaggaaagaaggccgctcaggatcgtgttgatatgagcccgctgagcagagtcgtcatcgatggagttgtgtattttctcttggacgaggatctgatcaaccgacaagttctaccaaaaggcattgcttcctttgaccttctgacagaagagtggaggtcaattctccgaggacctgtaagcatccctgcttactattctaatctttctctggctgcccttaatggatccttagttctggtccattgtatgttacatgtttcgatggacctgtggtttctggtggacactgaaaagaacttatgggtcagaaaacataccgtagagatcaatttgagtatccatgatgaattccttgcacatcctttggtgatactgaagaatgggagtatagttacttatattggatct

SEQ ID NO: 108 - DNA, 453 bp, Sorghum bicolor
  Clone ID: SORBI-28MAY03-CLUS102379_1
gcacgaggcttcgctatccattctcccacaattcaactctcttcatccgtcacccaaaaatctacatcaaccaacaacctcactctactctcccctacaactaaaccgctactgcacttctccagtaactattcctcgactttttggatcttgtctactacgactacctaaatcgacgactctctcaaacacttgcaatttcttcttgtttgtgtttactcgctccaattaatcccgcaccaactccggtacgcacgcacaaccgcgactcacatcatgtctgcatactaccattacaacgcccaccccgcccccgtgtcgcacaaccaccatggtggccgaaatcgcagagctccccgtctttctgtgtcccaacaagctcaacgccagttccgcggtgtccgcagcatgaaggaactcaacgagactgcttccctcacagccttccgaacc

SEQ ID NO: 109 - DNA, 433 bp, Sorghum bicolor
  Clone ID: SORBI-28MAY03-CLUS102404_1
gcacgaggatcaccttgttattcctacaagagattatatgtttgctccttcacttgtggatattaatcaagctattgatttcattcatagtaagtgagccgcacatagttgtttattagttgaccatgctaaagtcgttgatagttgttggtcaactgcgatgccgcttcctttttctcagcaactttccttctattttaatatgaagattttcattgacatttcagcacttattgattaggaaatgcatcttgtgggaaaataacatatattcactgcaaagctggaaggggacggagtacaacaatcgtcttgtgctatttggtaaatttaattcttagtaagaacgtcactgtgtaacatgtcaaaatctgagctgagaacttcagttcataatgagaaataattatagcatgctgcctgcttggaatcg

SEQ ID NO: 110 - DNA, 482 bp, Sorghum bicolor
  Clone ID: SORBI-28MAY03-CLUS102409_1
gcacgaggccgcggcggtgctgtccccgccgcatccgcccctaggagccggtgatggccccgaccgcggagccgtcttcgccgccgccgcagcggcgcccccgcacgggcccacccccggggctgaagaacctcggcaacacctgcgcccgcggcagcgtcctccagtgcctcgcgtccacgccgcccctcgccacgttctgcctcgcctctcgccactccatcctgtgcaagaaggtgttcccgaacagggacaaggagtgcgcgttctgcgtgcttgagctgcagatcgcccggctgcttcgggcggatgcaggggcactcgattccccagcaaaggttatccgctgcatgcccctattcgccgagcacttcaggtgggggcgccaggaggacgcgcacgagttcctccgctatgttgtggatgcctgtcacactgctggcctccgcattcgcaagcggctacctgcagcaggtgccagt

SEQ ID NO: 111 - DNA, 590 bp, Sorghum bicolor
  Clone ID: SORBI-28MAY03-CLUS102487_1
gcacgaggatgttgcgctccggcggtggttgggtgctgctgctgctgcttcatcatcatcgtccgtagaccgtagctgctggcctcttctcatcttgcctaggaggaggagagggagaggaggagcacgcgggtcgtcgtctgtgtgatggaggtggtggacgaggtggtgcgggcgctcggcgccggcttcgacctcacgtccgacttccgcctgcggttcgccaaggccagcgagggccggcgcctggtggagctcggcgacgagacgagggacgtgccgctcccgggcggcgccggggccacgctccgcggggtgccccgcgacgtcggcgtcgacaagggcgaccgcatccgcttccgctccgacgtcctcgagttcaaccagatgtcagaattgcttaatcagaaatcttcagtccaagggaaagttccgtcaggctattttaacgctctctttgaattaagtggagcttggttgactgatgccaaagagaccaagcatctagcattcgatggatatttcatttctttgtacaacttgcacctaaaggcttctccattagttcttcgagatgaagtaaaaaaggc

SEQ ID NO: 112 - DNA, 474 bp, Sorghum bicolor
  Clone ID: SORBI-28MAY03-CLUS102508_1
gtttggaaggtaggcttattgtagtacttttggttttatttgacaattattatttaattatagactaactaggtttaaaaaattcatctcgcaaattacaggtaaattgtgcaattagttatcttttttatctatattcagtgtttcatgcatgtgccgcaagattcgatgtgacgaaaaatcttgaaaagatttggaaactaaacaacgccgtagttttccgctgcctccggttttccctgaaagccacttttccgctgcctccagtttgcgggaaatataatcaggaacaactgaacataaatcatacatacaacaatgctcgaaacaccatatcaatcactactcaccgtaatttggtcaagcctatttatttgagcttatcagccaaatctatcgtcattcaataatgtttttctctcacaacaatcattgatttttgtcatgacttatcagtcaaaaaaactgtggaga

SEQ ID NO: 113 - DNA, 423 bp, Sorghum bicolor
  Clone ID: SORBI-28MAY03-CLUS102520_1
gcacgagggtccagtgcaacctctcacgatttttcccccaaaaccctcaatcgacttcgccctcgatctcgccctcgcccatctcccccggagttaccccctcaattgagccaccaccagccattcaaaatgctcattcaactctccagggcttcgcgcgctcgctccgctgttgcggctgtttctcgtgtcgccagacccaatgccgctcaggtgaggggcttcattgctcccactgtctcccggaaagccgactttgtccaggagctttatctcaaggagctcaaggcctacaagatccccgccgtcaaggagtccgatgctgagggcaacgtccagacattcaacgtccccaagacacctgcctctccagaggagaccgacctcgccggcaacctgaaggagtacgagagcatggccgtt

SEQ ID NO: 114 - DNA, 447 bp, Sorghum bicolor
  Clone ID: SORBI-28MAY03-CLUS102513_1
gcacgaggtgcaattccggacaagacattcgtatttcacaagcagagccgtccttcttcttgttgtcttgtttgctggctgtatgatcattcaagcagccatatgtcgttggcacatcttcaactccttattcagcattagcctactggcgttgacactgccggctgcctcctctactacactcatatacgtgacgtcgtatgccggcacagtaacaaccctcaacctcaccacgtcggtatcaggcgacagtggcttacagacaacccttgcacaagtggctgtttcacacggctgtgcaggcaacacgtcgtggttaacactagacccaacaaatgatatcctctactgtttggatgagggtttcggattgcccaatggcacactcgttgcatttcggacatcggataacgggaccttgacacagctcggtgaagcgccgaccct

SEQ ID NO: 115 - DNA, 416 bp, Sorghum bicolor
  Clone ID: SORBI-28MAY03-CLUS102535_1
gcacgaggctctcgagtcacctgcctctagcaatgaaggcgcctccatcttctcccttcctattgttgctactgctgttcttcccttcaagcggccttgccgcccccaaggatttcaactatgaagtgcaagttcttatgacgatcaagagcctcctcaaggacccccatggtgcgctgaaaaactgggacccatactctgttgatccctgtagctggtccttcatctcctgctcaccagagaatcttgtcactgcactggaagctccaagcaagtacctttccggcccgctctccccgagcatagggaacctgacaaaacttgagatacttctgctgcagaacaacaacataattgggccaatcccaacagagattggcaagttagcaaagctcaggacacttgttctgtccagt

SEQ ID NO: 116 - DNA, 440 bp, Sorghum bicolor
  Clone ID: SORBI-28MAY03-CLUS102579_1
gcacgaggcgcatctctcaatagctactacaccagcaaacaacccttcacagaaattcatacatcaatcctccatttcaaactcgcacatcacaatggccaacactcagatccctagctggagcctcgagggcaaggttgccgtcgttactggctctggacgcggtattggcaaggagatggcccttgagctcgctcgccgtggcgccagtgttgctgtcaactacgccaacgccaaggaagctgccgaggatgttgtcaagcagattgaggcgatgaagactggcgcaaaggccgttgccatcaaggccaacgtcgccaatgtcaaggagacacaacatctcatggacgaggtcgttaagcacttcggcaagctcgacatttgctgctccaactctggtgtcgtttctttcggtcatttcaaggatgtagacgaggcgg

SEQ ID NO: 117 - DNA, 563 bp, Sorghum bicolor
  Clone ID: SORBI-28MAY03-CLUS102635_1
gcacgaggaacagttcgtaggtcagcaaatccattactagtaccgatattcctccagctccctgaagagaaaacaccatctttggtatataccatggtctaatcggctatggacgtcaccggagatgccagcggaggtcgccgccccaacttccctttgcagcctcgggggaagaagaaggaggaacagccttgctccacgtccccagcagctgttgtgggtgctggggctaatgggtcggcggggtcgggagagatgctgcagatgaagaaggtggcgccgccaaagcgcacatcgaccaaggaccggcacacgaaggtggacgggcgcgggcggcgcatccggatgccggcgatttgcgcagctcgggtgttccagctgacgagggagttggggcacaagacggacggcgagacgatcgagtggctgctgcagcaggcggagcccgcggtgatcgcggccacgggcaccggcaccatcccggccaacttcacctcgctcaacatctctctccgctcctcgggctcttccttctccatcccagcgcacctccgtgctgccgg

SEQ ID NO: 118 - DNA, 434 bp, Sorghum bicolor
  Clone ID: SORBI-28MAY03-CLUS102654_1
gcacgaggccggctcggtaagtttgtggaagggacgcttgtttacagacagcagtttgtgatcagatcctacgagatcgggcctgaccggactgccaccatggagaccctcatgaacctcctgcaggagacagcactgaaccatgtgatgtgctctgggcttgctggagatggtttcggtgccacacttcagatgagcctcaggaagctcatatgggtcgtcacaagaatcaacatccaggtcgacaagtacagcagatggggagatgttgtggagatagacacctgggtggcgtcatcagggaagaacggcatgcgcagagactggatcatccgcgaccgcaacaccaagaacatgattgcaagagccacaagcaactgggtgatgatgaacagagagacccggaggctgtctaagatccccgacgaggtcag

SEQ ID NO: 119 - DNA, 471 bp, Sorghum bicolor
  unsure (1)..(471): unsure at all n locations
  Clone ID: SORBI-28MAY03-CLUS102655_1
ctccggtgcgctgcccgacacacggtgcctcctcaagccgtcgacgccgccctgcgacgtctgttccatgggcgtctccctccctccggagcggaaccccaactacaggctgaacacctccctcttgatagactattgccatgacgaaacccacaagtacatcctaatcgacattggcaagaccttcagagaacaagttctccggtggtttgtccaccacaaagttccttccgttgattcaatcattctgactcatgagcacgcagatgctgtcttaggccttgatgaagtctgggtggtacaaccaaggaatggaagaaatgacattgaacaaattcctatttttctcacacaattcaccatggacagtatctcgagaagattcccctacttgattgagcaaaagccagaggatggcgatgaagatgcccaagcagcgaanattgactggaagataattgaggatgatgt

SEQ ID NO: 120 - DNA, 493 bp, Sorghum bicolor
  Clone ID: SORBI-28MAY03-CLUS102940_1
gcacgaggcgaacaaccagtatcctgactgtcttgctcagtctacacaccacttcaacacttgccaaaccctctaagcccgttgaaataagcagagatgtcgccatcattggaggcggcgcatcaggtacctacgccgcggttcgcctccgcgaagacctgaacaaaaccgttgtcgttatagaaactagaccaaacctaggcggccacacaagcacctaccatatcccagatagcaacttgactgtcgactatggcgtacaatcctatcttccctacggcccggcgacatctttctttgcacgctttggcattgcgactgagatatttgctccagagagactaacaccactcaatgtcgacgtcgagacaggcaaggtgctaggagactatcgggcaccgagcaccaacggcacaaatgaagctcttgcgcgctggttggctatcacgtcgaaatacagtgactatctagagcctgggtactggaactttcc

SEQ ID NO: 121 - DNA, 486 bp, Sorghum bicolor
  Clone ID: SORBI-28MAY03-CLUS102098_1
gcacgaggctgacatcttcacacactgctctcatcaacaccttttgatcctttactcagcccacaactcacactctctcctcctctcagctcccaacaaacacctcttgtcaacctccccttctcccgtctccgccatgtctgcgaacggccaacacggtggtgagttcttccccggcatcaacaagatccaatacaaccccaaagccgcccccaccgacaccctcgtcttccgccactacaatgccgacgaagtgatcctcggtaaacccatgcacgaatggctccgcttcgccgcgtgctactggcacacgttccgaggtgtcggactcgacatctttggtggtggcaccatcaaacgcacctgggacgatggcactcagtcggtcgacaatgccaagcgacgcatgcgtgcagcattcgaattcttctccaagctcggtgtgaagtactggacattccacgacagagacatatcaccggaggg

SEQ ID NO: 122 - DNA, 364 bp, Sorghum bicolor
  Clone ID: SORBI-28MAY03-CLUS102659_1
gcacgaggcatcctcccacatcatacacaatgcttaagagcggcttccagcggtcgctgcgagcggcaagcccggccctgcgccgagcagctttccagcccatcaggaagaacttcgcgccctcgttcgcggcccgctacgcttctacggatgctgccaaggacggaaagattcaccaggtcatcggtgccgtcgtcgacgtcaagttcgataccgagcagcttcctcctattctcaacgccttgacaaccgacaatggcggccaaaagctggttctcgaggttgcgcaacatttgggtgagaacgttgtcaggtgtattgctatggacggtaccgagggtctcgttcgtggctccaaggccac

SEQ ID NO: 123 - DNA, 485 bp, Sorghum bicolor
  unsure (1)..(485): unsure at all n locations
  Clone ID: SORBI-28MAY03-CLUS102681_1
gcacgagggtttaatcattttgaaatgttagcaacacagaaaataattttttctttcattttatatatggtactctgggatgtcagtgtctactatttcgtttggaatggactttctgtagttgcctcaaactccatatgtttgacatctatgtgcagaattttgatattttttctttgaacaattgaccactcaggaatatacgaggccttggagttgagggatggcagacctgataatcttggcagggtgttcttaagataagcttggaacttgctctgtacttgtggttcaggatgaattatgatatttcaccattgcccttgaccattacttcaagtatattagtaactgggtctctgacagattagtcaaatagtcataccataaccattgcgtcttggctagcctaaatcaccttcgctctaccaatatggttntgagaaagtagtgcctacaaccataacaccatcatggaactttgt

SEQ ID NO: 124 - DNA, 456 bp, Sorghum bicolor
  Clone ID: SORBI-28MAY03-CLUS102677_1
gcacgaggctaagacatagtagagctgcatatctattatattaagaacagataatgtgttctctactatgttaaaaaccatttagcctataatcagaagacactggtaggaattctgtaaccctatttagacaaattgatattagattcacttgttaaaatgtttacccagtataccatgagttttacatactggctatttattacgaaatctgaatggcatacttgaacatagatgatagttactgtctatgttccaaattataagtcgttttcacttttctcaatacatggattttactttgtatctaggcatagtgtatatttaggtccatagctacgcaagatgtatctagaaaagtcaaaacgacttagaatttggaacggaggtagtatttcttatagcttagctcttttttctggttttcacccatagttctgctctttgacccgcatt

SEQ ID NO: 125 - DNA, 203 bp, Sorghum bicolor
  Clone ID: SORBI-28MAY03-CLUS10269_1
gctccgcctgcttcccgtgtgggcgagcggcatcatcttcgcggcggcgtacacgcagatgaccaccaccttcatcctgcagggggacacgctggacccgtacgtgggcggcttccgcgtccccgccgccgtgctctccgtcttcgacaccctcagcgtcatgctgtgggtgccgctctacgacccgcggggcccctgcgcgc

SEQ ID NO: 126 - DNA, 497 bp, Sorghum bicolor
  Clone ID: SORBI-28MAY03-CLUS102683_1
gcaccacgcgggcttgatgaaatggatagtgtcgtttctggagcaaactttttgttgcagaatattcctggtgcagccttcacacacatgaatggacagaggaatccagtagatgtttccccaaacaatttgtttccttatcttcttgtcaacattggatcaggagttagtatactgaaggtcactggaaataaaaagtttgaaagggtaactgggacgcacattggtggtggtaccatgtttggtttagcaaaacttttaacaggctgtaagagctatgatgagttcttgcaattaagccagaaaggggacaactttgttcttgatctaattgtcaaggatatatgtggagagcttgtctgccagaaacaaggactttcaacatcaactcttgcttctagctttgggaaagttattacttctgagaagaagctgacagattacaagcctgaagacattgcatctacattgttgagtgcctttacctacaacattgc

SEQ ID NO: 127 - DNA, 472 bp, Sorghum bicolor
  Clone ID: SORBI-28MAY03-CLUS102690_1
gcacgaggccggccacaaagactcccaagcatcgacactcgacatcctctccgtcacgtcaccatctcaattccagcttatctaccgaaccatctctcagggaacgcgaccccgtagcaaccatggctgaccgaggcctctcccagattctctcccagctaaagcagtctccccagatgagctatcccgaggccagcgccctcctctccaaggccaaactcagtctcctcagcctcaacgctctgactccgaccccctcaacaccatcgaacctcctcgcccttgccagagagacctatgagcaaggtgctctgttctccattcgcgccaaaaacgccgatgccttcacgcgctacgttcagcagctgcagcccttttacgagctgccgtcagctaccctgccgccaaacctccctgaacgcaacagggtcacaggtctgagcctgttgctgctcctcactcagggtcgcta

SEQ ID NO: 128 - DNA, 454 bp, Sorghum bicolor
  Clone ID: SORBI-28MAY03-CLUS102773_1
cactggttttgcagtacgttttcaaaggccaggtatttgaacatctccaacaatcaaatcggcggagggttgccagccaatatggagcacatgtcggtagaacgactcttgattggttcaaaccaattaactggtccaatacctcccatgccaattagcctgaccacgttggacttgtcaggaaaccttttgtcaggacctttgcagtaaaatcttcaacctccttgccagtgattatgcttgctatatatttttctagtttacaccgttgcttgttttacaacaaatgcatttggaatgtataaattgtatgtcttcagttagttccgagtgctgacaaccactgtttatttggaatgtcgtcattggtttcttgtaatgtttttttctcatcacgtgttttagagtgtcatcctttgtcatttctactgtgaagaataataatttatttttc

SEQ ID NO: 129 - DNA, 494 bp, Sorghum bicolor
  Clone ID: SORBI-28MAY03-CLUS102786_1
tccacggtggtagcgcctggggtgctggtaccttcgctggtgccgacggttctcgccagcccaccgctctcgagctccagatcgccgaaactcagggcaaggccttttacgaggccgttgccaaggtcaaccaccagtgactatatggcagtgccgagtcgaagcccgagactccggcccccgctgccggtgcggctgctcagaagcctcagcagcccgtccagcagcagcagcagggcaaccgggaagcggcaacggatagggacagcgaaggcggaccatgcggcttacccaagaagtgtactattctgtaactgattgggtcgtgctggttctctctgcgcctgttcttgtttcctttgtggtgccttcctgggggcgttctcgtaggcgtttcgaatttttgacgacatatgaatatatatgaccaccctcgatcctagagacttctcctagataaaagctaattcaaatccgaatggaaagttctcgtc

SEQ ID NO: 130 - DNA, 355 bp, Sorghum bicolor
  Clone ID: SORBI-28MAY03-CLUS102807_1
gcacgaggcctccccgagcactctttgcaactcaacttctacactaggctgtgcctatttttattgctttaattaattcacgtgctgtgcactacctgcaaaccgatacccactaaaaccaaaaaaatccatattgaataatccgcacaatcgacaacatgcgttccgcattcatcgtcgccacattcgctctcagcgctcttgctgtaccagtcccagttgccgagcccaatctaccatcatcaatcaaagcatacgtccaggagcgagggcttcacagggcgaatgacggtagtcttaccaacacacgggatgctcaggaagacgttttagaagtacgatctgtaaaggagga

SEQ ID NO: 131 - DNA, 447 bp, Sorghum bicolor
  Clone ID: SORBI-28MAY03-CLUS102810_1
gcacgaggctttacctgggcattttccctaagggccatcagattaaaagcaagagcctagtgagaagattaaaggctgaaggattagtcaatgaaggctgtaaatgttttgatgagttgattgaccggtgtattgtcgagccagtgcagatctgcaacaattcggtagttgccaaaaggtgtcaagttcacagtgtagtgctagagtacatcattcaaaagtcagtagctaaaaatgtggtcactcttattcaagaccttgagcccgtacttaaaggaagcactgaggcctgtgtccgccgactctctattcagtccagcaccaaagaaagatttgatgaactggatgatgacaagtctgctttaaggtcgttaacaatgttcaacaccgagccttgtgatttacagaagtgcaagatgctgcggatccttgatcttgaaggttgca

SEQ ID NO: 132 - DNA, 588 bp, Sorghum bicolor
  Clone ID: SORBI-28MAY03-CLUS102484_1
gcacgagggattgtttgatacattcgtatcttatttcgtatttcttatttacaattcgccttattctcctaccatcacaaccacattcacaatggctactcccattacctcaaggacggagactctccagaagtatctcaagcttgatcagaagggcatgatcatggctgagtacgtctgggttgatgccgaaggtggcactcgttccaagtctcgcacactgcccgagaaggaatacaagcccgaggatcttcccgtctggaactttgatggttcttccactaaccaggcgcctggtgacaactccgatgtctacctccgtccctgcgcagtctaccccgatcccttccgcggctctcccaacattattgttcttgctgagtgctggaatgccgatggtactcccaacaaatacaacttccgtcacgattgcgtgaaggtcatggatacctacgccgacgacgagccttggttcggcctggaacaggagtataccctcctcggctctgacaaccgaccttatggctggcccgccggtggtttccctgctccccaaggcgagtattactgtggtgtgggcactggaaa

SEQ ID NO: 133 - DNA, 479 bp, Sorghum bicolor
  Clone ID: SORBI-28MAY03-CLUS102823_1
ttcggcacgaggcccacctcctcctcctcctgtgcatttggcagcgcagatcccgccgctcccgtccagctagccgatcctcctcttctctgttctccccttgcgctactactaggccttgactgttctcgactcccctaatcaccagcggctcggtcggtctccctcttcctcgccgcgttcccttcggtctccgctccaacacgccatctgctgccgcgcaaacaccgggaaataccttggcctttctggtgtaaccgtgtaagcgagtttcgactccccaagtttgctgcttttggccaatcttttctgggctttcaggtctcagcatcacctgccccgcttttaccgcgatctttctgtccgatcactgcaattttcagcttcgagtacctcctttttcgggaaattcagtctctgctgataaagctgttgagtgagcggctcatgcaccacaccaccagtagcttcagctaaga

SEQ ID NO: 134 - DNA, 719 bp, Sorghum bicolor
  Clone ID: SORBI-28MAY03-CLUS102829_1
gcacgaggcacgagtgtgtcgctggccgcaccaacagccattcggccccagtctggtgtgtggatgcgaaccagcggcgggcaagagctgcgtcagattgggctcgtgaagctgccgactcggatcagcggctcggtaactctcgcgttcggattagctcatcgctatcacgtggattatcgaagccgcactgtcgcagtcgggcgatcgtctgggcttgtgttcgtgtttttgttcgatgttcagtcggacgtcagcacagcatcgccagcagcagctgcagcgacggatggcccagctgcttggccgcgtcattcaagcgctcgaactcgtcatgggcatatttgtacaaccaccactcacactcggccggacggtcgggattgagccgcagcgcctcgaccaacgccgcgtcgatgcgagtctggtccactgcctggttgttgtacagaaacaagtcctgcagcgacgagttgacgcgcagcgccgccgccacggccagatacgtcgccgagccgagctggttgaacgacaagcccagggattcgacggtggagctggcggccaagtaacgagccagcttgacgcctgtcttgtccgtcagctgattgcgccccaggtgcacatgcttaacgccgtcaggatgggccagcagacagtcggccagctcggccagctctgcgtccgtgtgctggttgtcagataaatcgatgaattcg

SEQ ID NO: 135 - DNA, 768 bp, Sorghum bicolor
  Clone ID: SORBI-28MAY03-CLUS102839_1
gcacgaggcatgcatgtaccgcccaaggctgtcttcttctcgcaaatctttggctcgttcatcggagtgcccatcaattacgctgtgatcaagtgggttatcaacaccaagtttgactacatcacaggcgctaccgaagacccaacgcaccaatggaccggccaagagctggcttcctcgcttaccattgcagtacaatatgtgctactggggccgaagagactgttcgagatcgacatgttccgtccattgccttatggcttcctggttggtgctattgctcctgtcttcatctacgggctgcacaggctatttcccaagcaaaagttcaggttgtggaacacgacaatcttcttcagttccatgtcttccttttacggaaatatcagcacaggcaacttctcgtccttcgtcggcgggtttattgtcatgtactgggcataccgctaccgttacgatatgtgggcgaggtggaactacatcctggccgctgcttttgacgcgggcttcaacctcaacatgcttcttattttcctgttctttggcgcaggcaaggtcattagcatgccgaactggtggggcaacgacgccgagagctcagaaaaatgttacgcgttggatgatagctgaagagagaaagtatgtcgaacgcgcaggaccacttgcgctcttgccttggtgtcaacttggaagtatcacaggggtgacgctggggaagtcaagactatttgtacaacacaatgcgaagaatacaaacctgctccatgt

SEQ ID NO: 136 - DNA, 573 bp, Sorghum bicolor
  Clone ID: SORBI-28MAY03-CLUS102854_1
gcacgaggcagagattaagaaaatcaaagaagctaatgctgatgatgaagaatttcccgatgaggtggagacaccattagatgtcccagcaaagaagcggtttgcaaaatacagaggactaaagtcatttaggacatcatcctgggatcctaaggagcccgtgccaccggactatgcaagaatatttgcatttgataattttacacgaacacaaaagcatgtctttgctaaaattgccgagttagatggaggcatgaaggattgtgctcaagtgggatcatatgtaaggctttatgtgaaaaatgttcccactgatatagcatccaaactttgtcaaccatcaagaagaatacctgtggttgtttctggtcttcttcaacatgagtccaaaatgtcagttcttcacttcagcataaagaaacatgactcatacgaagctcctatcaaatctaaggagcctttgattttcaatgttggattccggccatttacagcaaggccattgttttcatccgacaacatcaactgcaataaacataaaatggaaagatttctacaccatgggcggttttc

SEQ ID NO: 137 - DNA, 388 bp, Sorghum bicolor
  Clone ID: SORBI-28MAY03-CLUS102875_1
caaaagagaaaaaaaggcactgcatgattggaccaaagactagtagatgtagaggtagagtggtaatagcatctacccctagtaaatatacttatatatatcggcatgtactgtaaaatatagattaggtgtggaactggtggatcggccatgaataatatgttaagacaaaagagctgcttccatggtggtttgtcagtttgccggccgttcattgttcttggccgttctgcatgcagcctgggaacctagtgagccacagtctaactgaatctgaccagcacgcaggggtcgcgtgcattcacaactgagtgcaacggctgccgtcaaacactggcttcttcgttgaatgaatcttattcagaacgaagcagctgaattttcaggc

SEQ ID NO: 138 - DNA, 374 bp, Sorghum bicolor
  Clone ID: SORBI-28MAY03-CLUS102903_1
gcacgagggtaagcactcacccacctacagtcccatctcttctccacaaacatgtccgccaaatccatcctcgaggccgacggcaaggccatcatcaactaccacctcacccgtgcccccgtcatcaagcccaccccgctccctccctccgccacacacaacccgccctccaagcttgcatcgctgcactttgcccagggtgccgatgtcaagggcgtgctcgaccaggccgaggccacctacccgtggttgttggcttcgggagccaagtttgtcgcaaagcccgatcagttgatcaagaggcgaggcaagagcggtctgctggcgctgaacaagacatggcaggaggcccgcgagtggatcgaggcgagggc

SEQ ID NO: 139 - DNA, 469 bp, Sorghum bicolor
  Clone ID: SORBI-28MAY03-CLUS102902_1
gcacgaggcccgatcccgccaccggaggcgatggcggcggcgccggcggtaaggttcccggtcttcgggctcgtgcggctgctgggcttggccgccgcggcgggcatactcttctgggccgtccactaccgcggcggcatggcgctctccaccgacgaggagagcaagctgcccctcttcaacgttcacccggtgttgatgctgattggtttggtggccttgaatggtgaagctcttttggcctataaaactgtgccaggaaccaagaaactgaaaaagctagtgcaccttgccgtgcagttccttgccatgtttttgagtctgattggtctctgggctgtctggaagttccatgatgaaagaaaaattgaccacttgtatacacttcactcgtggttgggccttacttgcttcatcttcttcagcttgcagtgggctgctggattttggaccttttggtaccccggtg

SEQ ID NO: 140 - DNA, 601 bp, Sorghum bicolor
  Clone ID: SORBI-28MAY03-CLUS102916_1
gcacgaggcccgccccccccgccccgcgcccgccgcctccctccctccgtcctccggggccacacacgccgggctcggcttgcccgccgtccccctcgcccccctcctctcgcctccccttgtggcgtcggggggaggcccctccggctcccgcgttgattgtcttggcggcgctcagcgccatggcagcactcaagggtacgcatgtcgccgtggctcctttgccttccgcgcgcttttcgtccggatgtctgattgggcctgtccgggtggccggttcatgtgatccccccctcccggaggcgcctcccgcagttcttcgcctggtgtctcgctggatgtccgtatcgccattgactgctggcgttgcctgagtgtaggttgtctggctttgccggctgctccgctgtatggtctgtctgccgctgtatgtccttgctccatcgttttcgccagtagctcatctgttcagctagctccccatcctctctcggttgctcgcctgactagcgggctgcccgccgcccctgcggtccttgcaatactaatgggcatggagcagctcatgctgacaatgttatcaaaagtgctactcaagccc

SEQ ID NO: 141 - DNA, 415 bp, Sorghum bicolor
  Clone ID: SORBI-28MAY03-CLUS102935_1
gcacgaggcacctgcagtaagcttctcgtctaccactactactcaacccaacccatcgcttctccccgcacctgcttctacccaacccacgattcagttctatgttcgttctagattcttcagtttggccaggcaggcgcttgctattacgtgatcccaccatcgtgttctagtccatgaatcagaggcatttgcagtgaatccagtagatcagtaggccctggttcgtgtcaagatgcttagcgattcagtgctagtagtactatttaattgaaatccagtgctactactatttactaattgagattagtgctagtagaaccactaatttaatcagcacgttgacttgtaatactccaattggcttattggttgggaagcttatcatatacaccaaccaacaacttgtttgggc

SEQ ID NO: 142 - DNA, 424 bp, Sorghum bicolor
  Clone ID: SORBI-28MAY03-CLUS102948_1
gcacgagggcccagtaaagagagtttagctgctgcaacagagttcagtgaggtggggagcatctcaagaacaagcgaggtggatgccaccttgcggaaacccaccgtgtatcagagtgaggatgatgatttgaagtcgaagcttaaaatcaagccaaatattaacctgaaaatgaggaaagatatgaacgaggacttaacgaatatttctctccttcaaaagccagatgttgcaaaagatacttctaatccagagcaggacaatgcctctgctagccctgccacagtttctgctacagaggataacagtgaacttgagccagaatcaaatggtcttgatgaaaaattagtaactgaaaatgtttatgaatcatctgggcttgatgatgattctactgcaggactacagccatcaggtcaaactt

SEQ ID NO: 143 - DNA, 386 bp, Sorghum bicolor
  Clone ID: SORBI-28MAY03-CLUS103013_1
gcacgaggcggcggcggagttcaagaagtggctgaagcagttcgacgccgacggcgacgggcggatcagcaggcgggagctccgggaggccatccgccgccggggcgcgtggttcgccagcgtcaaggcctggtgcgccgtccgccgcgccgacagggaccgcaacggcttcgtggacgactgcgagatggagagcctcgtcgagttcgccgagaacgagctgggcttcctcatttccaaggagccgacgtcgacgcccaatcgacgggcgcaaccaccactgcggtggtgaaccgtctgttcctctgctgttcatcttcatcacttatcagcagcgcctctccgtccaccctccgaataatttgtgtggaaggatcggatcgaat

SEQ ID NO: 144 - DNA, 406 bp, Sorghum bicolor
  Clone ID: SORBI-28MAY03-CLUS103020_1
gcacgagggttcgacaacccaagtgtgccttgtcttcacccacccgtgtggataagcacgcttaagctcttcgaatcctctctcacttttccccccgaaaggtctgcgagtttcgagagtttccagagctcccaactttccatgaacgttgcgtcacactaacctgtccactctttacgagaccctcgtcgctcgctccgtcgctcgcttcagcatgttcggaaaacgctctttcgctagttcgaaggacaaggaccgttcaggcaagatcaccaagcagccaaagagatcgatgcgcgaagcatccaagcaaaaggccatggccgagaagctggatgcccgcagggacagccccatgatggacggagcgtcgccccagctgacctctgccatcgtaacagtcgtc

SEQ ID NO: 145 - DNA, 602 bp, Sorghum bicolor
  Clone ID: SORBI-28MAY03-CLUS10295_1
ccggggcccccggcccagcgcttctttaacgtctataccagacaacgccaccccgcccgtcgacctcccgatccctctcctcgctcgctcccaagtcccacaactcccacccactacccacccagccgatcttttcttcctatctcctctcgcctacgtactgaagaagccacatctgtatcggagagcagcagggaggctcactgcatggccatggcgccgcccaccaacgactcggaggcgccatgcacgcagcggctgcccgcggaggacgagctgctgcagcagcagacgccggctgccagctgcggcggcgatcgggcgccggcggcagggacgtcgtggaccgagcccgaccaccaacaggccgaggcggagggcgcggagaagaagagcagcagcgcgttggcggcgggaagcggcggcggggagccgatggcggcgcggcggacggaggagatcagcgcgcgggagcgcctgaagcggcgccgcaccgaaatggcggggcgggtgcggatcccggacatgtggggacaggagcggctgctcaaggactgggtcgactgcgccgtcttcgaccgcccgctcgccggcaccacggg

SEQ ID NO: 146 - DNA, 844 bp, Sorghum bicolor
  Clone ID: SORBI-28MAY03-CLUS103028_1
gcacgaggcccattcatccataccccgtgagagcatccttccatacctcaaaaactctcacagactcacacaatgggtgatgtggtactctcagcctttctgcaagtcctttttcagggaattgcacataccatgaaggaggagctgaagaaatcagattgtcttgagaaagagaggggactcctgacttctaaagtggaaatgatacaggccgttcttagaggagctgagaatatgcagctttctgagccacagaaattgtggtttggtaagctggcacgtggcagctacgacgcaatggaggtattggataagtacctctatgaagatcatcgacgtcaacatctttccagtgtgcgcaataacaaagtaagttctgccatgaatcctaagcgtcagtactttaggatcaccatggcaagggagataaaggatgtagctatgaggattgatgatctgctgaagactgcagcgggcttcaagttccaagtggaggtccatggccagacaagtctacagactcaagggagtagcagtagcagtcatccgagcagctcttttcctccacctgacgctcactgcagacaagaagatcatgagcgtattgtcgagatgcttcttagttctgatcagaatcacaaggttcaagtcttgccaatagttggggaggcttgcatcgggaagacaactgtcgctcagctcgtcatcactgacgagcgaattttattgcacttcaagctgaggccttgggttcatgtctcaaatgagtttaatataagaaggatcacagcagatatcatagaatctatagaaggctcttcacctcgtttcaacaacctggata

SEQ ID NO: 147 - DNA, 452 bp, Sorghum bicolor
  Clone ID: SORBI-28MAY03-CLUS103055_1
gcacgagggcggcatcccgcgccgtctcggccgcaacggacggctccagctggtcgacctctcgtccaacaggctcaccggcaccctcccgccggagctctgcgccgggggcaagctggagacgctcatcgcgctcggcaacttcctcttcggctcaattccggaatctctggggaaatgcgaggcactctcccgcatccgcctcggcgagaactacctcaatggctccatcccggaaggcctcttcgaactgccgaatctgacacaggttgagctgcaggacaacctcctgtccggtggcttcccggcggtggccggcaccggcgcgccaaatctgggggccatcactctctccaataaccagctcaccggcgcgctgccagcgtccattgggaatttctcaggtttgcaaaaattgcttctcgaccagaatgcattcaccggcgcagtgc

SEQ ID NO: 148 - DNA, 427 bp, Sorghum bicolor
  Clone ID: SORBI-28MAY03-CLUS103085_1
gcacgagggccccatccgccgccggcaccaccatgccccttcttcgccgagtgggaggcgacagatccgtctcctagctcttgcggcaccgtgcgaggagccggccggcgaggagcgcggctccggtggccccacgcgtggaaggagcgcgggctccggcggcccgacgtgtggaaggcgagcccgtctccggactgaggacaccgaaggccgagcgcaccggaggccagtaacctgcagcggcgtgcggagctcttatctcggcacaatccacccctcctgacgggatagaatccgtgggataagaggagcaatacccttttgtttgtctgctaaatttgagtacacaagtacttaagctgctggatttggagtggcgaacacggcccttctcagtgtggggagattaggggtgtggggagatgta

SEQ ID NO: 149 - DNA, 472 bp, Sorghum bicolor
  Clone ID: SORBI-28MAY03-CLUS103237_1
attaacggccgcgaggcggagccaatcaaccgcatcaatggtcgcgaggccgagcccatcaaccgcatcaacggccgtgaagcagagccaatcacccgtattaatggccgcgagcccatcaacaggatcaacggtcgctcaactacctggaccagcgggcttatcgaggctttgaaggcacgcggctttagcagcgctgctctcatcaacgagcgccagcccaactgaactttcacgacgagatgttacgataccctatggttttcgccctggctccacatagccaccgacctttgacctgtctaggcagaaggcagacaagtcgtttcgcaatactcctacctttttttctacagttaatgtacatgctttgaagagcgagatacgtaccaagaaagacgagtgcagctccgaagtggaacggaaagtgtagatagctatgtagattaccagctatcgaatcccgtccccc

SEQ ID NO: 150 - DNA, 676 bp, Sorghum bicolor
  Clone ID: SORBI-28MAY03-CLUS10322_1
gcacgagggttgcatatgttgggaaacgaggaattggaaaatctcctgcaccaagccttacaggaaaaggtacatgattcaaaggatccatcagctccagaagttgatctcccaggtgcaaaagttggaaaagtctgtgttcgttttgccccagaacctagcggttacctccatattgggcatgcaaaggctgggctattgaacaaatactttgctgaaagataccaagggcgtctaatagttcgatttgatgacacaaacccttcaaaagaaagcaatgagtttgtcgagaacgttttaaaagatattgatactttggggatcaaatatgatgttgtcacatacacatctgattatttcccaaagctaatggaaatggctgaaagtttgataaagcagggtaaggcatatgttgatgacacaccaaaggaggaaatgaggaaagagaggatggatggtattgagtcaaggtgcagaaataatactgtggaggaaaatctgtcattatggaaagagatggttaatggaactgaaaggggcatgcagtgttgtgtacggggtaaacttgacatgcaggatcctaacaagtcactcaggatcctgtctactaccgctgtaatactgatcctcactcgtgtgttcaagacaggctatcacatatacttgctgccattgt

SEQ ID NO: 151 - DNA, 438 bp, Sorghum bicolor
  Clone ID: SORBI-28MAY03-CLUS103248_1
gcacgagggggtattgatcttgagcacaagcacagaaagaacaagaacaggtcgtcccccaagacggaggatccctacctgcttctgctcgtcaagctctacaggttcctcgcccgcaggaccggcgctgacttcaaccgcgtcgttttgaagcgcctctgcatgagcaggatcaaccagcccccgctgtcgctcatcaagctcgcccgtttcaccaagggcaaggaggacaagatcgccgtcgtcgtcggcaccgtcaccgatgatgcccgtctcctcaagttccccaagctgaccgtgtgcgccctgaggttcaccgagggtgcccgcagccgcatcctcaaggccggcggtgaggtcatcaccttcgatcagcttgccctccgcgcccccaccggcggcaacaccctcctcctgaggggtcgcaagaccgccagg

SEQ ID NO: 152 - DNA, 227 bp, Sorghum bicolor
  Clone ID: SORBI-28MAY03-CLUS103262_1
cgcctccaccccaccgcggcgcgccatgtcgcctcctcctccgcccgccgcgcccgcctgggcaccgtccgcgcgcagtccgcgccggcggcggcggccgcgctgacgcacgacgacctcaagcggctcgcggcggtgcgcgccgtcgagcaggtgcagagcgggatggtgctcgggctcgggacgggctccaccgccgcctttgccgtcgccgagatcggtgcgct

SEQ ID NO: 153 - DNA, 803 bp, Sorghum bicolor
  Clone ID: SORBI-28MAY03-CLUS103314_1
gcacgaggggcccactctgcagacatcgccaatcaagatcaaccaaccggatggccgccgagacgaccgacctggcgccaccgtctcctccgccgccggtggcacccactgccgcgccaagccgtccgagactgtcggggttcgagcagctggacgggcgagtcaaggagctgacctcgtcgcaggcggagttgctggagaggatccagaagctgaaacaggaggtgcagaactggcgttccaacatagagacgcaggtcaagacatgccagaatgaactccagggtctgaagaaaggactcgactctgaagtggaacagctgaaatcggaaatgaaggcgatgaggtctgcaatccaggaagagaagggcaatctacctgcacaaattacaagtttagagagcaatgacgatacagaacaagcctggcagacccaagaccaagtactgaaggttactactgatgctagtatggaagatcaaacagcaacacaagcgtgaatcagtgcttccttgcagaggtgaaggctgttctgctggatagtcagctcctttcaatgaatcaaaaagggctggcagatacactgaatcacatgaagtaaatattatttttgaatccataccagcaagtttccaagtgcaaatatctctattctctataacagtgacagcaaattgaagtgtaacatttcagaccaatcttgtcaaatgatacattacatgtacaagaactgtttgttttgtaacaattccattactactattacaaattctaattttaaataaagtctgcacaactggctc

SEQ ID NO: 154 - DNA, 515 bp, Sorghum bicolor
  Clone ID: SORBI-28MAY03-CLUS103348_1
gcacgaggccttgccaatgaaggaggagcacaagctattccttgcccgtgctctcatccccctgcacaagcccaaatctgttgggatctaccatcagcagctgtcctattgtattgttcagttcgttgagaaggactacaaattagcagatactgtgattaggggtctgctcaagtactggccagtcacaaattgccagaaggaggtgttgtttctgggggagcttgaagaagtgctcgaggcaacgcagcctgcagagttccagcggtgcatggtgccattgtttaagcagattggtcgatgccttaacagttctcacttccaggttgctgaacgggctttgttcttgtggaacaacgatcacattgtaagcttgatagcacaaaatcgtggtgctatatttccaattatatttgaagcacttgagaggaatatacagagccactggaatcaagctgttcatggtctcactgcaaatgtgcgcaaaatgtttttggacatggacagtgaactat

SEQ ID NO: 155 - DNA, 578 bp, Sorghum bicolor
  Clone ID: SORBI-28MAY03-CLUS103362_1
gcacgagggtttttcttctgtggcgccgcctccgcggggagagcgggtctgctgggttgcgtacaggcgaaaggcacgcgccgccgccgctgccgcgcgagcctccccgtcccggccgccgccgcgcagatgggctcgtcgtcggagccgctgtcgaggggcctgtacgcgctggtcgagccctacgactccgggttcctcaaggtctccgatgtccacaccatctactacgagcagtccggcaacccccagggccatccggtggtgtttctccacggaggtcccggagccggcacgtcgcccggcaacaggaggttctttgacccggagttctacagaatcgtgctgtttgaccagaggggtgcaggcagaagcactccccatgcctgtttagagcagaacactacttgggacttggtagctgacattgagaagctcagggagcatcttgacatccccgaatggcaggtgtttggtggttcatggggaagcaccttggcacttgcctacagccaggagcaccctgataaggtcactggccttgttctgagaggaattttcatgcttaggaaaaagga

SEQ ID NO: 156 - DNA, 479 bp, Sorghum bicolor
  Clone ID: SORBI-28MAY03-CLUS103372_1
gcacgagggacaacctcagccgtgtcagtgtctgtcactctgtcagagctcggcgcgcggatctaggggcgggggccgtgccgactgtcgacgccgcgatgccgatctgctcgccgtcgtccgactcctcctcgtcgtcgggctcgggttcccgcgcgtgggtactccacgggctagtgctcggcgcggcggccgcggccgctgccgcggcgtacctgtaccggcgaccgagcgggttccgcagccgcgccgtggggatcatacccgcgcgcttcgcctccacgcgcttcgagggcaagccgctcgttcacatcctcggcaagcccatgatacagagaacatgggaaagagtgatgctagcttcttctttggaccatgttgttgtggcaacggatgatgagagaattgcagaatgctgtcgaggatttggagctgatgttataatgacatcagaatcttgcaaaaatggatctgaacgc

SEQ ID NO: 157 - DNA, 735 bp, Sorghum bicolor
  Clone ID: SORBI-28MAY03-CLUS103389_1
gcacgaggcgaggacatcaagccccaacgcaaccctggctctggtatcatgccgacctactctgtcggacgagctgttctgtctgatgctgtcacacttgtgcgatcagacaggttcaacaccattgactacaccgtgtcaaacctcacagcctggggttacaacgaagtccagcaagactacaagactctgggcggttcaatgctctacaagctcatccagcgcggtgtaccgcacggggtccccttcaactccattgcagtcatgcagcccatgtacaccaagaaggccaacgagcagatcgccaaagagatcggtactttcgaccagtacactctcgacgatcctaaggcgccccccaaggtcgccgttctcacttcggggcccgctatcaagcagatcctcaacaacaccaagcaatacgtcgtcccctggctcaagcctctcaacactctcttcccggggaagaaggactttggctggttcatgcttgcgggcgatcagcctcagaattatacccaccgcgccaacttcgccaaggcgatgatcaagattcccaacatgcacaatgctgttcacgattttattgagcgtgagggtgccaagctcatcaaaaaggagacctttactctcaagaagggtcttgatcagattgacatcatccgcgatgtcgctatccctcttaacacacaactcctcgctgatctgttctactttgatctccgaaccgatgag

SEQ ID NO: 158 - DNA, 562 bp, Sorghum bicolor
  Clone ID: SORBI-28MAY03-CLUS103444_1
gcacgaggattaattggtttggtatttttatgcttgacatctgttatttgaaacaatcctaatcaatctaacattcacaattgcaacctggataatcattcctgtggctacttatgttgtttgaacacgattaaatttagtggacagattaagtaggtttggatgttgcagacttgttccatgtccttatataacactaggcatttttacgtgtttacatgtacaaactatgtcgactttaggaaccagtaggaatttatgtaaaaactatagcagtagtttgttgaactttttttatcagtaccaatttgtatatagtttagtttgtttgtctgtcaatggatacttgtccttggaatggtaaatcctggcctgttgactcattttgaactaatgttaaacgcatgcctttcaaattattagtaactgatcaagaatcattgaatgtatcaagttggaatttccatgcagtagatagacagtagtaaagcttggtttaggtgcttaacttcgtatgcaggttatattgtataggcaaacagttgccaaaataatggccatt

SEQ ID NO: 159 - DNA, 477 bp, Sorghum bicolor
  Clone ID: SORBI-28MAY03-CLUS103461_1
gcacgaggcccaactctgctccaggcttgcagccgcctctgctctcgattctcccgctctcccacagccccgtgctccccattccgccgcttcttccctccccaacctccccatccgcctttggccggcaactgtcggccctcgccgccgatggactcccactcttccccctcggctgcaccgccggccgccgctgaagcggggcggtacacgtacagcccaaggctgcgatggcagccggaggtggaggagtacttcgccgcggcgtacggccgcgaccacttcgcccgcatctccgaggccctcgcgcatccttcttgttattcttgtattcgtgtcaatactctgaagtcttccactgatgctgtcatgcataaactgatggatctagtatgtgaaaatgagctctctgctgcaatcaatggtgtggaggctgttgagctgaatggtggagagcaaccacatgaagggagctct

SEQ ID NO: 160 - DNA, 645 bp, Sorghum bicolor
  unsure (1)..(645): unsure at all n locations
  Clone ID: SORBI-28MAY03-CLUS103492_1
gcgagtgggctgctcgacgctcccaagggcgccaccctgccgatgagcgtcttctggctggtgccgcagtacgccatccacggcgtcgccaacgccttcatggacgtcggccgcatggagttcctgtacgaccaggcacccgagagcatgcggagcacggcgacggcgctctactggctgaccttctcgatagggagctacctcggcacgctgctggtgaccatcgtgcacgacaagacgcggcgaagcgggcagtggctcccggacaaccttaaccgagggaagctagacaactactactggcttgtcgtggctctggaggtggtcaacctcgtctacttctttatctgcgctaagtactacacctttaagccattggagatggttagcggagaggaggtcgagctccaccaccatggcaatggcaatggcaccgacgatgccaagaagcagggtgcaagcttcaagtagcttaagcttagagtgtcctttgatcttaatgccaacaagaaagatttgggttgggttgaaataattgtacttcgacaactctgccttttcttaaatataagcattcactcttctagttctgtttttctagtaacatactccctccatcatgtaatataaagcattgtagtatcn

SEQ ID NO: 161 - DNA, 772 bp, Sorghum bicolor
  Clone ID: SORBI-28MAY03-CLUS10364_1
atcttcgtcctggcagctggcaatgttgacaatgaatcccttcaagtggcattggtgctgactggacttttcctgtgcttttttggtttactgtatggtggcttctggagaattcagatgaggaagagattcaacctgccagaaaacaacttctgctgccacaacccagatgcatcagattgtttccagtggttgttctgctgctcatgctcacttgctcaggaagtcaggaccgcagattactacgatatcacagaggacaggtcacccacagggcaagtaactggcgaaaccccccgcgtaatgatgtccccattgcagcgtgaagatggtctggcccttttcaagtcaagtccaagttcgccatataggagcggcaatgctagtccatcgatctttatcctggagagcccgtcagccccacgcaggtcatctggttcctcgcctcagggtggttcaccgacaatgggtgatagggtgatgaaggcaccagctccatctgttcttcaaagagaaggtggaccagatcatggcaaaggggtgatccaatgaagcagttaccggtcgcatgagatgtgtatatttttttgtaaaggaaatacatcctcggcagaaaattttctgtgctgttactctttcttattctcaagaaatgtatagactgtccagttctgttatgcatttcagctccgtcatgcacggttggttttgatgtgaggtgcaattattgtatagatctctcatttgttgttcagtatctgctggtgtgttc

SEQ ID NO: 162 - DNA, 494 bp, Sorghum bicolor
  Clone ID: SORBI-28MAY03-CLUS103635_1
gcacgaggcccccgcccaaaccaagaagaaagcgcgagcgcgccgcgaccgccagcctgccggccggcgactcggcactgagtggggacgattccttcagttcgctcccaacaaattcgtgggggaggacaggggaagagggcggggtcgtaagccgccggttctgtagtcagtgaccgtcgaggagcacgcaagttaccagcatttgaggcagaaaaatggagctctgtacagcttgtatctggacttcagcacagtggtctcacacaataacgaccaaccggcgactggcataccatggatttgcaaattcgagtttctcagcgccccaaaggaggaggcgagcagcactctatgtcatgaatgccgcatcgaccggtgctccaatatcacgtcaaaacataacgcaacttccacgcaccaatggcgcagttaccaaaagtatatccactgacaaacccagcagtgcaatggagcaacttgatatcgaacgt

SEQ ID NO: 163 - DNA, 413 bp, Sorghum bicolor
  Clone ID: SORBI-28MAY03-CLUS103658_1
gcacgagggggcggcaaaaccctacgactgcaggtctacgaccactgacttcccgcgcgcgccctcccgctcccggctcccggctccagccccatccccaggaccccattcccatcccctcccgcccccagccgaagcagacccaatgtcctgcggcagcggcagcaccggcgaagtcgaagggggcaaatcggccgccgcgatggcgtcgtggcacgaaagcttggcggcgccgcctcgcgtcctcatttcccaccgcccttctgatgccagcagtcaagggactgttctgtcacttcaacatccaagatcaggagatgaaacagggtatctatttattgatggtcaacttcaagagatcaactggttcaaagagcgttatggtgcttggttcttgggggattatgtttgtg

SEQ ID NO: 164 - DNA, 424 bp, Sorghum bicolor
  Clone ID: SORBI-28MAY03-CLUS103659_1
gcacgaggctatcttccatcccaccagacacggagatcttctttcggaaagcgacactgacgtatcactcgtacgcagccgagaaagttctcgacaacctcaacaccattccccgaagtacacacgcctgctgctatggcagagattcttccagctgtgggagccgtagctggagttcttcgcgtgacatatcaactgattaccctcgccatcgagagtggccaagtcagtgacgaagtgcgccggagccttgagctggtccgcacctgcgagcgagaccttcaacaccttgtcgggttgcgcgaggaatatctggatatcctggagcgaaagcccatagagcttgatcgcgttaacaccatcatcagggccgcacaccaagggctcgccgaagtatgcaagattgtagagaagtgcaggccag

SEQ ID NO: 165 - DNA, 545 bp, Sorghum bicolor
  Clone ID: SORBI-28MAY03-CLUS103668_1
tgcagatgatgttgttgatagactttacattcattacgataacagtaaggccagaaaggacaacctagtcaagtccttaactccatctttcactcccagtttgaacaagacaacccgtcgtattgttcaaagaatcgcaaataacagacagaatgattattacgataatcctcaccatcatcatcatcatgaatttgctgatgctgaaagcgtcgctatgcctaatagcgccagaagaaacgaatctagctccagcgatatggaactcttgggcattctcaagcaattcaacacaatgctcaagcaaaaaaatgaaggacctattaaccttaaacagttgaatgctttgatggcaagttgtgctgaaaagagaaaaggaggaagaaatcatgaagatatcgaagaacaagaagagaactccgattttgagcaagatcaagaccaagatgattctctcaatagaagatgtgagactgaaccttcacaaatgactgatagcaatgtgagaaacatcgaaagaaacctcgcacaattacaaaacaatc

SEQ ID NO: 166 - DNA, 971 bp, Sorghum bicolor
  Clone ID: SORBI-28MAY03-CLUS10367_1
tccatcttcatggacgacttcagcagcaccaagcgcaacatcatcggccacgtctccgggtggctgctcagcgactcccgcgacgacaagatcgacgacttcgtgcaggagatggagatgaccaagttctggccgctggagcgccgtgaggccatcgccgaggtcctgctcaagaacgtcgacctcaagaccaagttccactgccccgagaagtacgagaacgaggagcggttggctgatcacaaggagcagtgcagcttcaggcccgtggtgtgtcccaacgacggctgccgcgcgaaggtctctgtgaggtgcatgaaggaccatgacgccgcgtgcttgtacaaggtgcttcagtgcgagcagggatgcgagaagaagctgctcaggagggatatggatcgccactgcgtcactgtctgccccatgaggcccatgaagtgcccctttggatgtgattcctcgttcgctgaccgtgatcttgagaagcactgcgccgagcttcttcaggaccatttggtgaaggtccttaaggcgattcataagaagcgttcagaagaagagctcaaggagattgctcagaagctggaaaagtttgatgcagatggtaaactagctaaagctctggatgcaagacctcttactaatcttgtgaaggacctcgaggcgaagatgaaaggttaccactcgagttaaaggggtcttttatacagacaaactaaacaggaaggataatggcattgtttagtcgaagggatgatcctacacgcagcatacatacagagaagaatataagttctgttttattcttatctcctttttacgatttttgcttcactttctttccccctcacaatcaaatcaattgtcagtatgtatagtccgctattgctttgtatcttcaattttgtacgatgacattatattatttgttttggtatataaatcgaaaatcgggtcatgtttgtagc

SEQ ID NO: 167 - DNA, 868 bp, Sorghum bicolor
  Clone ID: SORBI-28MAY03-CLUS10369_1
gcaaagtgttaagcttggcccctgcctactaggggatgccccaaaaataaatgtcatccctgctgggaatgaagtgaacaaggaagaaggctgctctgaaggttttccacctataagaatctatgatgaagatgtgaacatgaaatttcttgtctgtggagcaccatgcaccctggatgcatgtttgttgggcgcactagaagatggtttgactgcgctgttgaatattgagattcgtgcgagtaaacttcagagccgatccagtgctactccacctcttcaagctgaaaatcttccacatggagttgttacaatgcgctgcgatatctcaacttgcagttctgcacacgtgtcatttcttgtttctgccagtgcccaaacacgttttgatgatcagcttctagagagccgtatcaagaatgaaattattgagaagaggcagttagttcgtgctctatcgaatactgaggataacaagccatcatatgaacctttgccttccatgtgtgtggcttgtggagcttctacttttgaagtctggataaccctgcctaaatgggcagcacaggtcttgaaacagcttgcgccagaaatctgttacagaagcttggttgcacttggaattgcttgggtaaatggtacaccagtgtcctcatttgataggcaggatgctgatcggctgcttttcttttgctctaaccagtgcaaagataaagctattcaaaatgtctcatatgcccatctatcaagctggtcagcatcccttactaaggatagaactactggaagcatcgagtcaaaacagatgtcatttggtgccaaaggagttggaggggataataagatgtccctatcatcattgaaacca

SEQ ID NO: 168 - DNA, 499 bp, Sorghum bicolor
  Clone ID: SORBI-28MAY03-CLUS103740_1
gcacgaggcaggaaacacagttctggcaggtggcatcagctatgctcgattatataatggggataccaaacatccttgcttggggtaatgttcttaatgccacatgctctgcagtcaagcacttctgttcccatgcacctaggatatcctggaggctgcagacagataagtggttgtcattattagtttccggtggaattgagggcttcaagaacagtgagatatgtttgattgatcttttctgtacaatgttgaatcattctgagccagagcaacgttctgttgctgtacagcagcttgggaggattattaacaaaacaagttctactgaagctgatttgaaatatccaaactatgaccaaaatttcctcatatcgggttcaacagtaacatcccttttggtaactcatacatgggacagagtagcagcattggctctccatgactcttctatgctattaaggaatcatgcaatggcattgcttactgaatatgtgcc

SEQ ID NO: 169 - DNA, 663 bp, Sorghum bicolor
  Clone ID: SORBI-28MAY03-CLUS103748_1
gcacgagggcgcgtacacagcagcagcagcccacacgtaatcctttccctccctttcacacttacccctctcagctcccagctccttcacaaatccgggcctcgaggagggtcttatatacgctgcgccgtggaattagcgtctcttccgaggggctcgccgcgaaaacgatcccgccccaaattttgctacggccacacgagcagcagccgccgccccgaggcgcgcgctcgctcctgctccccgcgtctgcctgggtgtcggggaccggcacccccactcctgcccggtaggccgccccgctgcggctggctgccccgatgaggccgccggaggtggcggtcgtcgcggtggcggcgctgcttctcgtggcggctgcggccgcggcggagtcggcagcgccgttaccggcggcgctacggctggagcgtgcggtgccgcacaagggggtggcgctggaggaactcaagcggcgggacgccgcgcggcaccgggtttcgaggaggaggctgctcgggggcgtggccggcgtggtagacttccccgtcgagggctccgccaacccgtacatggtcgggctttattttacccgggtgaaattaggaaacccggcgaaggagttcttcgtccagattgacactgggagcgatatactgtgggtaa

SEQ ID NO: 170 - DNA, 510 bp, Sorghum bicolor
  Clone ID: SORBI-28MAY03-CLUS103779_1
gcacgagggtcatattaaaccggcgatttatagagtactgcattcttgcttgggagaatctccctcggattcttctcatgtacttccacaacgtaatacaaccccaggaaggatatttccagtcagtcatctgcaactcgctggacttccgcaatttcactgtgaacaacgacttgaggttcatggtgcgggatgattccgctgaggcaaagccccttttcctgagcagagaacattacggccacatggtggatagtggggcaccttttgcaaggccgtttcaggagaatgatcctctgctggaccagatcgacagcaacatactcaagcgttggagccatggaacagttcctggtgcctggtgcacaggtaggaagaggtggttcagtgatccatgttcccagtggggcgatgtgaatattgtgagaccaggccctcaagcagtgatgttgcaacagtatgtaaatcggaccttagaagaagcaagtctggcagcaactcatgcaggcg

SEQ ID NO: 171 - DNA, 620 bp, Sorghum bicolor
  Clone ID: SORBI-28MAY03-CLUS10381_1
gcgggctagcgcatttttctgaacctcggcgcttcgcagccgagtggaggcgaggacgatggcagtcgccgggcagtgctcctcctgctactagacgtcacccaccctgcagctgcagctccagctccaccgacggcacggccacctgccgcagcagccccaagccgcacgaagagcgcggtggccgaggttgcaggtggccgcagctgccggcggcgggtccatcaaggcggccacggacgccgagttcttccagccttccgacaccaggcccatcatgctcttcgacggcgtctgcaacctctgcaacgggggcgtccggttcgtgcgggagcacgaccccaacaggagcatcaggtacataccgctgcagagcgagtccgggaggaagctcctgcagaggtcagggaggtcccctgacgacatctccagtgttgttctcgtcgagaaagacaggtcattcatcaagtctgaagcagtgctgaggataatggagtacctcaacctgcccttcccgcagctcgccatcttcctcaactttatccctctgttcttgagggacttcgcctacgataatgtcgcaaacaacaggtacgccatgtttggccgctccgaaacag

SEQ ID NO: 172 - DNA, 445 bp, Sorghum bicolor
  Clone ID: SORBI-28MAY03-CLUS103814_1
cagccgtactctcctcctcctcatcaaccatactctccgcaaacacaaggacgcctcgcccgctgccgcaccgcgccaggctaccgctgcggccgggacactcggtgctgaggtgtctcccgaaatgcgactcggggaagccggtcggagaacgcgctgggttgttgtcggcggctcggaaggcggcccggccagggggtcagggagggtcgtccaggcccgcgcagttcgacgcgtcgtcgtgcggaatcgcgctcgcgacggtggtgggggtgataatgctccacgcccacgggtcgcagcaggcgctcgccgccacgcagttctccggcctgcagccggctgacgtgctcggggatctcggggacatcagtacaggttttgcttcagctttcctgttgatcttcttttctgagctaggggaccggacattctttattgcgtt

SEQ ID NO: 173 - DNA, 434 bp, Sorghum bicolor
  Clone ID: SORBI-28MAY03-CLUS103820_1
gcacgagggtgcacacaaagtatctacaagagatctgggaggccgacattgagctagactccaggatgcttgacgacaacatgtgcattaaaattttcttcatgatcgcttctaacaagctgttgtttccttcctcggacaacaacatcagggcgaaagatgtttatttggctaggaatttgtctcgactacccactatgaactggtgcaaggctgttaccgatgaaatccaagaagctgcacgcacgtggcgtcttgatagaacaactaaagtttcgccttcaattacaggatgcgcgttttttctgttgagtagtgtatttggataatttacgctgcaaacaccagatcaatcacaaggacattccccgtgccaagtacttcaatcaagatttgattaaaaaaataattgctgctgacaagacaaaggacga

SEQ ID NO: 174 - DNA, 497 bp, Sorghum bicolor
  Clone ID: SORBI-28MAY03-CLUS103847_1
cgccgccgccgcttcctcctccgactcagattcgtcagtccaggacctcctcgcgctcatctacttcggctccctcttcgacgtcaagcagcaaagcgacttcgtctctttggtttacgcgagcgagctcgagcggagcagctgcatcacttatgactacgtcggggatgagccggaggacagtctcgcggagaccgatctgaacgcggtttctgcccttgcctccctcgccgcggcgcgccctccagctgcagccggagtctcgcaccgtgacgcccttcaggcttgtgcccatcacgcccgcctctggctccgccgtgcggatgaacccatccaccctgactccaccgtcacatatgctggggtgagggcaaagctggataggatcatggcatcgggctactacacagctcagctagaaatgaggccaccattggatctggctgctgcagtggcaagctttggagctggaggtgctcagatgcaggagagtatgg

SEQ ID NO: 175 - DNA, 634 bp, Sorghum bicolor
  Clone ID: SORBI-28MAY03-CLUS103876_1
gcacgaggctaggctggactctccgtattagaaccaaaagctttgcaactcttcaaaagctttctcctctccccgacaacctttttttctcttcttcccttcctgctctgcccggcccgctggctttctccccggcccccttcctcccctccacacgcctctccccccgcccgcccctgagacccgccaccatggaggagattgctccggagtacgacgtcatcgtcctgggcaccggcctgaccgagtgtatcctttctggtgtcctcagtgtcaagggccgcaaggtcctccacatcgaccgcaatgaccactacggcggtgaggctgcctctgtgaacctcgagacgctcttcaagaagtacggcaacttccgcgacggcgaggagccctggaagcagtatggccgcctcaacgactggaacatcgaccttgtccccaagttcctcatgtcctccggcgagctgaccaacatcctcgtctccaccgacgtcacccggtacctcgagttcaagcaggtcgctggcagctacgtccagcagggtgcctccgccaaggccaccgttgccaaggtgccctctgatgccgccgaggctctgcgatctcctctcatgggtatcttcgagaagcgacg

SEQ ID NO: 176 - DNA, 591 bp, Sorghum bicolor
  Clone ID: SORBI-28MAY03-CLUS103919_1
gcacgaggctcccgacggcatctgtggcgcccttccccatcccggtggccttgtatgcgcaggtgtcggtaacgggcagccatccttaggctctagatttgtgcagagcggatgtggtggattccctcggttgcgtacgcgtcatgggaggcgcaccttcccctggaggtgggcacgcacatgatgtgctggtggccacgactagatgctccaaccggtcaaggtcatcgagcgccacaagggccgtgcttcctcttccccctctaactacgagtaccacatccaatacagcagcgcgtggtgccggattcttatccacaacgtgcaagcagtgcgagccctcgctatgcgttgagcgagcaagatgtgcttggcagcggtgtacgaccttgtgcgggtgaggtgagttcagcagagccatcgtctcttttcccctcccctcaaatttttaattcagattcagccgagcaaatacatggctggtgctaaataggcgatcttcatagtgcagtaagtcgacggcagtggatcctaaccactaggagcatctccatatacttgcagggcttcctttggaagcagccatataat

SEQ ID NO: 177 - DNA, 608 bp, Sorghum bicolor
  Clone ID: SORBI-28MAY03-CLUS103931_1
gcacgaggccaacctctcgccgacagcctcaatggacgaggcttcaaaacagtgatcacgactatttccagcactggcaagactcctccagacagcccaaacatggatgatgatatcgcgaacatcgccaaggaccttgctcctgtcgttgaggaagcaggtgatgaaggcgtcgttgcagtcatgcactcagcaggtggctttattgggagcggtgccctcaaaggcctgacttctcaagccaggcaggattctgggaaggctggaggtgtgaagaagatcatcttcatcacagctggggtggcacctgagggctatgaacaagggccaatggagttctttgactaccatgtgagaccttccatttccttctcatgcccctgtttctaaccggtctccaggagtcaaacggtacgcagtcttgtaaagaccccaggagcttgctttacggtgacttctcagacggagaggccagcgagtggcttccaggtcttcaacatcaagctgacagaggttgggcgaccaaggttcagtactgcggttggagagaggtaccaagtgtctacatcatctgcgagggggataggatactacctgttgagctgcag

SEQ ID NO: 178 - DNA, 482 bp, Sorghum bicolor
  Clone ID: SORBI-28MAY03-CLUS104056_1
gcacgaggcattcgagggacgactaacccccgcggcacagcaaaacaacaaatcttcgccgaccggtttgaggatttgagctgcccttctttccttttctttaattccccccagaaaagacggttacgatgtcgagcttcgagcaagttgtcgtcatcgatggcaagggccacctccttggccgactcgcctccattgtcgccaagcagcttctgagcggccagaagattgttattgtccgctgcgaggctcttaacatctctggcgagttcttccgtgcgaagctcaagtaccacgcccacctccgaaagatcacccgttacaaccccacccgcggtggccccttccacttccgcgctccctcccgaatcttctacaaggctgtccgtggcatgatcccccacaagaccgcccgtggtgccgctgctctcgagcgcctcaaggtcttcgagggtgtcccccctccctacgacaagaccaag

SEQ ID NO: 179 - DNA, 613 bp, Sorghum bicolor
  Clone ID: SORBI-28MAY03-CLUS1035_1
cccacgcgttcggctgtgtatgtgccatttttagtggatgacttggctcaatttcttaatacatactcttcaccagattttgctggcttcagttgcacaattcctcataaagaagctgctgttaggtgctgtgatgaggttgatcccattgccagggacattggagctgttaacacaatcgttagaagacctgatggaaaacttgttggctataatactgactatgttggagctatatctgctattgaggatggaataagagcatccgaacaaacggattcggacacatcaccactggctggaaggctttttgttgtcatcggggctggtggcgcgggaaaagcactggcatatggagcaaaagagaagggagcaagagttgtaattgcaaaccgtacttttgcacgtgcacaagaacttggcaacttaattggtgggcctgcattgactctggcggatttggaaaactaccatccagaggaagggatgattcttgcaaatacaacagccattggaatgcatccaaatgtgaatgaaactcctttatctaagcaagcactcaaatcttatgcttgtggtttgatgcggtctacacaccaaaagagaccagact

SEQ ID NO: 180 - DNA, 977 bp, Sorghum bicolor
  Clone ID: SORBI-28MAY03-CLUS104141_1
gcacgaggcttggttagtgtagtatacaatacgttgatgacaaaggggggttcccctccgtaggttttggattgctactgcttgttcagaggggagatttgaagggtgacatccttttaacactactgaactagtgattagtgaaagtaaacgaataccaatatatggtgaggagatatgtaattcaaacacacagttaggtggaaaagtgcaaaacgatttggctagtagttagtacaccaattgtttctgggtatattcgagatgtaattctcaaactctacctatgtggcctttgaagttcaccctgtactgggaataagaaactgaaaaaatttcttatacatgttaaatcaaatgaagtttcgttgctatccacaccaagcacagcttggtttttccgtatcttgtttggaggttgaatttcaaatggtcttacaacatatagtgcatcttgcatattttttagcgcgtggctcatgttgatttgatatccaaactggaagtctcttcacctaattctgtttttaaattgcaatatgcatctctgcttggatttctactgcttgtttaaatcatgttcagcttgctcatgttgaaaaattgtctgtttccccatattttgatatttctgaccccacaaaatgcttacatgttactgaatttagacaggtgtaacattggaaagtgatccctcaaaggggactcttgttgatgtcggattaagtaaggtattatggatcttctagtgtccttttctttgttctgtgtcacttttctggggaaaggtgtttactgagtttgaaaatatgttgaaagactgggaaagcctatcataccttacaatctatgggagtatataaatggacacaaccttatgaaaatcttaaatatcattttgcttatgttaattgacttattttctgcaaataagggtttttaaggcagacagtgaagttaggaaaaacaaaatccca

SEQ ID NO: 181 - DNA, 591 bp, Sorghum bicolor
  Clone ID: SORBI-28MAY03-CLUS104108_1
gcacgaggggcggcccgagcggcggctccacggccgcagctctccccgctatctggcggcggtggcgccacaatctccagtctcaccctccaaacactggccttcatctcccccctccccacacgccgccgtcgccgctgtgtgctccgctccaacgcctcgtcgtccccgtctccgccgccgtcgcaggagaaggaggcagcggctgaggtggtgccaacagctgagtcctgcgtcaacctcggactccagctcttctccaagggcagggtgaaggatgctcttgaacaatttgagaatgccttagagctgaatccaacacctgttgaggcccaagcagcactgtataacaaggcatgctgccatgcatatagagaagaaagcaaaaaagctgcagaatgtttaagggaagctttgcgagactacaatctcaaatttggtaccatacttaacgatccagacttggcgccattcagagcatcaccggaattcaaggaacttcaagaagaggctttgcgtggtggagaagatattggttctggtttccgaagagacctgaaactcattagtgaagtacaagcaccatttcgt

SEQ ID NO: 182 - DNA, 550 bp, Sorghum bicolor
  Clone ID: SORBI-28MAY03-CLUS104151_1
attcggcacgaggcgttaatgctggcaatataatatggcattaactgcacttccttcagaagagtgtttgagcatttgacaaagcctcgcgggttggctgtaagaggttgttggtgtctcagatcactggggggctcacatgctgctccatctctttccagactttattgtattgattgcccttctttagatctggcaggtgcagtagaatctatgtcattcaaccttgctggagacctctacatatgtggctgcattctggcagccgattcgttcattaatggcttgccacacctgaaatctctttccattgcatgttgcagaagcttcccgtccttatcgattggccacctgacctcccttgaatcattatctctacttcgtctccccgatctgtgctctcttgaaggcttgtcttcctggcaacttgatggcctaagtttgatagatgttccaaacctcactgccaagtgcatctcacagtttcgtgtccagaaatggctcagcgttagtagtttcgtactgctcaaccagatgctcaaggctgaaa

SEQ ID NO: 183 - DNA, 446 bp, Sorghum bicolor
  Clone ID: SORBI-28MAY03-CLUS104164_1
gcacgaggccacaaccacgcctctgccgccgccgtccgccccctcggtcccgtccccgtcccccgccgctttcctcccctctccgccctcctccatcatcgccgcggcgtccctccatacgggacccgccgcagcccctaccccgcagatccgctgggttagcgctccgggaaccggtcggggtatgtcgtcgtccgcttccagcgccgggggcgagaccgccggcgagttcacggaggtcgtcatcgtgcggcacggagagacttcatggaacgcctcgcgcatcatacagggacacttggatgcagagcttaatgatattgggaggcagcaagctgttgcggttgctcatcgcctttctaaagaagtgaaaccagttgccatatactcttctgatctgaagcgagcagcagagactgcgcaaacaatcgcaagaatttgcaatg

SEQ ID NO: 184 - DNA, 556 bp, Sorghum bicolor
  Clone ID: SORBI-28MAY03-CLUS104233_1
gcacgagggccactcccgcgcaacacgacgacggccagttgatttcccgatttggttgccctctctactgttgtagtctgttcgttcccccctccctccgcgccgcgctcccttgtccttctccttcttcgcccgtcgcccactcgagagagctgcagggaggtcgccaagtccgacgacgagaggagagaagcagctgccgtttcggctccagcgtatggcggcggccgccccggtggcgcccgggagcggctgcctcagccgcccgcgccatcgcccgccctgggtgcggctgcgcggcgcgagggtcgccgccgcggcggcggccgcggcggaggggccgtcctgcctcttcgtggggccaatcgagaccgccagccaggagaagctcgaggcgctctaccaccaggccagggattcctactacagtggccagccattgatcgtcgacgacatgtttgacaaagtcgagctgaagctccggctttatggctccaaatcagttgtaaaatacccccgctgcagcatcatcaggcaatcgacctacgctgacgcc

SEQ ID NO: 185 - DNA, 339 bp, Sorghum bicolor
  Clone ID: SORBI-28MAY03-CLUS104275_1
gcacgaggccgcaatcgcagggcaccgggagcgattaaaaaaggcatcctcctctcccgcaaaggtaaaaacaaacaaccaccaccgcatcgcggcaggcaaggcatcgctcgccagccaccgagcggagggggaagcaaaagctcgataaaaaggagaggaggagacgaggcgtgccgtccgaacccaagcaacttccttccccccaccacctccctcccatgcccgcatcgagatcttagcgggacagcgagaggagaggcgacgcggacgcgggcgccccccgatccctcctcgccgcccgtcgccgccgccgccgccgaccgaccgaccggggga

SEQ ID NO: 186 - DNA, 840 bp, Sorghum bicolor
  Clone ID: SORBI-28MAY03-CLUS104278_1
gcacgaggaggagatgaccgtcgaggacgtgaagctgcaggcggctaaggcgaacggcggcggccatggggccaaggaccagttccccgtcggcatgcgcgtgctcgccgtcgacgacgatcccacctgcctcaagctcctcgagaagctcttgcaacactgccagtaccatgtgacaacaactggacaggcagccacggccctaaagctgctgagggagaagaaggaccagtttgaccttgtgatcagcgatgtccacatgccggacatggacggcttcaagctcctcgagcttgtgcgcctcgagatggacctcccggtcattatgctgtctgcaaatggggagacacaaacagtcatgaagggtattacccatggagcatgtgactacctgctcaagccagtgcggattgagcagttgaggactatatggcagcatgtggttagaaggaggagttgtgatgccaagaacaatggtaatgataacgatgattccggtaagaagttgcaggtggtgagtgctgaaggtgacaatggtggtggtaatcgcaacaagagaacttcccgcaggggtagggatgataatggagatgacggtgatgattctgatgagaacagtaatgagaatggagactcatcaacccagaagaagccaagggtcgtgtggtctgttgaattacaccgaaagtttgtggctgctgtcaaccagcttggcattgacaaggctgttccaaagaaaatattggatctcatgaatgtcgagaacatcacaagggagaatgttgcaagtcatctgcagaagtatcggctgtatctgaaaagactcagtgcagatgcaag

SEQ ID NO: 187 - DNA, 481 bp, Sorghum bicolor
  Clone ID: SORBI-28MAY03-CLUS10437_1
ggctaatccgagaaccaaagactactcctgcttggctgctttcatcaactccggcgacttggagaaggcgaagttccagaatccgatcggaagtttggtgctcgcgcgttgagaggttgatttcggtgcggcgatggggcaggctttccgcaagctgttcgatgccttcttcggcaccagcgagatgagggttgtgatgcttggtctggatgccgccggtaaaaccaccatcctgtacaagctgcatatcggggaggttctgtcgactgttcccacgattggtttcaatgtcgagaaagttcaatacaagaatgtgatgtttactgtttgggatgttggtggccaagaaaagttgaggcccttgtggaggcactacttcaacaatactgatggcttgatctacgtagttgattcattggatcgggagagaattggtaaagccaaagctgaatttcaggctataatcaatgatcctctgatg

SEQ ID NO: 188 - DNA, 465 bp, Sorghum bicolor
  Clone ID: SORBI-28MAY03-CLUS104373_1
gcacgaggcacgtttaccttcgctcaactcaaagcaccagatctcatcttagagaaagctcgcccctaaattagtcttcgttcttccagttgtgctcctcggcttggtgctccaggcgattctccggccaccgcccccaaaactctgtggctcaccaggtggccctcctctgacatccccgaggatcaaactcagggacggaaggtaccttgcatacagagaagatggagtgcagaaagacaaggccaggtacaagatcatcacagtgcatgcgtttgatagcaccaaggacttccccttacctgtttctaaggagcttgtggaagaattgggaatttacatccttgcttatgatagagctggatatggggaaagtgacccgaatcccaagcgggatgtcaagagtgaggcactggatatcgaggagcttgctgaccagctggggcttgggcagaagttctatgt

SEQ ID NO: 189 - DNA, 1037 bp, Sorghum bicolor
  Clone ID: SORBI-28MAY03-CLUS10375_1
gttggtttgcagttggccgtatccttcagtggagaaggttcaatacttgccattggtggtgaggatgggcatttaagagtctggaagtggcctgctatggggtctgttctcacagaaactgatactaaaacatcgattaaggatcttaccatcagttccgatgagaagtttcttgctgtgaataggagcagcgggccatgtagagtttgggatctgcagtcatctgaagttgtagccagtctgtcaagagaagcaggggaaatatttggattctgcagattctgtaataagactgacaacagtcatgtcctatttataacagtgatgcaaggtgattatggaaaaatagtatcttggaatactacctcatggacgagaatcggttcaaagaaaataactcgtgaggccatttcagcttttgctgtgtcacccaacggcgctcttcttggaattggaacaattgaaggaagcatcatcatactgagctcaaaagacatgcggacacttgtaacagttaaaaaggctcatcttggtattgttactacactggccttctcccaggattcaagaacattgctgtcaacttcctttgactcttctgcaagggtgacatctgttgggtccccgaagagtaatggaacaagcatatggcccatgctactagttattattcttgcaattttggtgtactactgtatgcagcacaaagaagacatcttggcaatgttgccgcgttgagatagatttatgttcagccctgactgatcaactctactgcaattttgcttcagagattgaaaaatttttggacttctaggtcgacttcattattttctcaaggacaactatacagcaaaaggcattgagccctgtcatgtctgtagtaaaaagggtatgttgtcaaagttttgtaagttgatggccgcaagtgatagtcatctgtaacaatgtttcttcatgctgcacttatgaattgcaaggagattgtctcaagagtccaataagagagttcagaaacaattatttgtagcgaaaac

SEQ ID NO: 190 - DNA, 500 bp, Sorghum bicolor
  Clone ID: SORBI-28MAY03-CLUS104484_1
gcacgagggcattgtagggttttttgtgtggagttgttcccttctctttctagcagccgttccgtgttgtttaacgcgcttgtcaggattttcaatttcagtatttgagtgttttcgatcatctctaaaactacataaattcataaaattctgccaaaaatctggtaatattttaagatacttcaacatgagatattgtttttttcttctaatttttagacctaaacagaattttgacacgatttgtgactacaatatttattgagcataagaatatagaagaagatatgaatttagacaataaaacacatgcattacagtaatatatgaattttcagttttttcattcggtcacccctcaaattactaaaattcatatattttctatgaattttcgtcaaaattttgaaccctgacgctcttaagaatttgcttttttttttttaccttaagtgattagataaagctcctactgactattaaaaaaaaagggctactgt

SEQ ID NO: 191 - DNA, 479 bp, Sorghum bicolor
  Clone ID: SORBI-28MAY03-CLUS104469_1
gcacgaggcttaaggcttggatagcatgtatgtatggcaatcttccgaaggctattgtcactgactattgtaggggcatccaaagtgctgtagctgaggttattccgggagtccgtcatagaatgtgcttgtttcagataatgaggaaggccgcagaacgtttaggtgggctgtcagagtacagagctatcaacaaggcgatgcataaggctgtgtatgattcattaaccatcgatgagtttgaaggagaatggaatactctaattacatatagtgggcttcagggcaatgattggctaagatcactttatgaatgtcgatcttcatgggttcctgttttcattaaggatacattttgggcaggaatgtctgctacacaaagaaatgaaacaatcactcctttttttgatggatatgttgatttaaaaaccaccttgaagcaatttcttggcaagtatgagatggctttgcagagtaaa

SEQ ID NO: 192 - DNA, 554 bp, Sorghum bicolor
  Clone ID: SORBI-28MAY03-CLUS1045_1
tggaacttggaagttggaagcagaggatgcagtaatagtaagtgcagatagcaagatacacagccatggttgttttgccaatattgtttctcttgttgggttctccaacttcccgtgcagctgatgaagaactcgagctcactgtcgtggacgtgagcttgctgcaggaaccgcgtgccagctgctccggacacagggtgatgccaccccacccctacaacaacagctgggtgccgctgtttcgtcctctcggcccgtgctcgccgtcgttcaaggctgcggcggcggcggcggcgaggacgaagccgtcgctggccgacgtgctccggcaggaccggctccgcgtccaccacatccatagaagggtgtccggctcctcccgcggtgcgcgcgcgagcaagggctccttcaaggagcccgtgtctgtcgaggaaacccagctccaccaccaggccgccatttccgtcgaggttggcacttcacagacgagctccgagcctagtagcggcattcatccggcggcggccaccgacggcagctcaagcccgccggtg

SEQ ID NO: 193 - DNA, 563 bp, Sorghum bicolor
  Clone ID: SORBI-28MAY03-CLUS10451_1
atagcgcgcacaatctctccttccaaagttccaatccccaatccaccgcccgcgattccacaaggcgcacccgccaccgccgccggagcatcaccgtcgaccgatctcgcgtcctccgacacccagccccgcccttccctcgctccaaccctcgctccaaccgccgctgcgctgcccgtgcccgagaccaccggggaccgcgtcgaccggcgcagcagctacaggaaccgggactgtgacgtgtgggagagaaggttccccccccagccatggcgagcgcggatctgctgcggagggaggaggagttctactcctcctgtttgattccgcaaaggcgaggcgccaagtcggctacagtgtagagagagatgaagtctgggacatggcaccaggcagaaccggagatacgaagggtgatgaccgtgtgattgaactgtcccgcttatgttgaagaaataaaggccttttgcacctcaccggggtgagaagacccttgtagattctgaggacagtgttggtgaatgggatgcctaagagcatgcatggagctgagcagattgatg

SEQ ID NO: 194 - DNA, 375 bp, Sorghum bicolor
  Clone ID: SORBI-28MAY03-CLUS104542_1
gcacgaggctttccttgaggaaaacaacgtcgacctcgcaaatgtcaagcggtgctccgtggacgacgacgagtacccgtcgttcaagaagccggcggcggcggcggcagaggcgcccgccccagtggccagcaccgaagaaggcgatgcacacgctgaggctgaggccgagcaaccaccagtggtggagctgcccgcggtggacatcgtgaaggaggaggccacggacgtgcaggagccggcgaagatgatgatggccagccggcggccgtcgttcaagtggtcgacgccgacgggcgcgcgcatcgggtgcctgcagaactacccggccgacgtgcagagcatggcgctggagcaggtcaacctgtccccgag

SEQ ID NO: 195 - DNA, 532 bp, Sorghum bicolor
  Clone ID: SORBI-28MAY03-CLUS104545_1
gtggagcgcagggtaccgcccgcccccgtcgcgcagtccaaccacaaccagggtgggctaccgccgccctaggccagatgccgaggccttcgtcggtcggtctctccggcggcgacgagcaccctccaccagggcacaagaccctcccgtagttggctgtataaattcaaggctgcatccacagattggttggattcgtgaacacagaggagtgtgagatcacaattgcacttgtttgttaggtcgcgccgcagtcgggatgtctaataagcgccgggaacaggatggccaaaacccgcgcgtcgccggcggcggtgacaagaagccgaggcgtggtcgggagcacctctatctcctcttggatgactgggacaaggggttcagcatccacaagatcgacgccgacagctttgacactaccaccaacgacggcctgcagagcggggtcgccgggcacctcccggaacctccggccctgcggttagagtcaccggctggccacgtgccccgcaatggcatgtccttcgccgcc

SEQ ID NO: 196 - DNA, 633 bp, Sorghum bicolor
  Clone ID: SORBI-28MAY03-CLUS104584_1
tcagcagcgactgcagcgacgtccccatcatcaaggcgctgcagagaggggtcagggtcatcgagctcgacatgtggccaaattcaacaaaggacgacatccacttcctgctcggcaggacactgaccaccccagtttcgctcatcaaatgcttgatatccatcaaagaatatgcctttgttgcatctccctatcctgtcatcataacgcttgaagaccaccttccctctgaactccaggaaaaagttgccaagatggttcttgatgtatttggtgacatactgtactacccgcctgactccgatcacctcaaagaattcccatcacctgaacaactcaagggccgtgtcctcctctcaacaaagccccccaaggagtaccttgaagccaaggctgatgacaccatgaaagagggtgatgctgacctccatcttgccaaaggggctaatgatgatgccgcgtggggaaaagaagtaccggattttcagactgagatccagtccgcaaaaaagcacgacgatgatgccccaggacaccaaagagaagatgatgacgacgacgatgatgaggaggaagaaccggaaatgcaaccacatttagctccacagtataaacaccttatcacaatcagag

SEQ ID NO: 197 - DNA, 640 bp, Sorghum bicolor
  Clone ID: SORBI-28MAY03-CLUS104642_1
gcacgaggaaataaaccaactcgcgccccaggcacacacacacaccatggtgatggaggaggcggtagacggtgagatgagcttgtcgaacatggtgctgggcttcatggaagatttcgagagggaccatcagcgacggttggagaacgacgacgacgacgacgagggctccagcggtggcgacaccgccgagagcaaggccttctggcagacacaacattcccagctgcatgaggctctggccaagacgagcccggccgagagcaggatccgcgcggacacggaggaggccgtcaagagcatgcgcgccgccgcggcctgctcctgcacgggaaggggaagacccgccgcccgggactgccggctgtgcatgctccggcacgtcgccgaccggctgcgcgacgccggctacaacagcgcgctctgcaagtccaagtggacgcgctcgccggacatcccttcaggcgagctccgctccgcgcggcgcgtcgtgctggcccgctcttcattctactgtacctgtacctcgtcaccggtttttcgctgaaatcacgacgatcacaaacgcaacagtagttaggaatgtccaaattattatggaagagggagattcttgtatgtgcaagcaaacctttttctc

SEQ ID NO: 198 - DNA, 485 bp, Sorghum bicolor
  Clone ID: SORBI-28MAY03-CLUS104735_1
cgcccgccgcccgcgccgctttgcaccgcttttttcgaacgcttctttagcttttacttctctttttctcttggcttccactcctcgcccacgcctcctcctcatcctcttccctttcgtcgtcgcttccgttcccgtgcgaatcctctgaccaccgcggagccgtccccgaaggaaaccctagcgcagccgccgatcaccgccgcgcacagcatggcgtccccggcacgccctaccgctgcatccgtctcgggcgccttcggcctgtcgcccgaccccaagcgctgctccttcgaccaggcgctccggcagaaggattttcaagagaacagactgttgatgtcatttgttaatttccatgagcaagaaaagatttctaaagaaatcgtaacagacgctatagaaagctgtatgaagaaacaagcagataacttgttgaattcactggaagttatcagcggtaggctgtcacaactggagttata

SEQ ID NO: 199 - DNA, 610 bp, Sorghum bicolor
  Clone ID: SORBI-28MAY03-CLUS10407_1
ggaagcttttatatcacagttctcttcatggacaaagcttcaacacttttttaggcaaagtaacgaatggagatgcccagactgttctgattgttaaagatagagaaggatcaatttatggtggatatgcatcacagccttgggaaaggcacagtgatttttatggtgacatgaagacattcctcttcaaattatatcctcaagcatccattttccgccctactggagcaaacaggaatttgcaatggtgtgctataaacttcagctctgagaacatacccaatggtattggatttggagggcagccacatcatttcggactctttttatctgcaaatttcgatcaagggcactcatttacttgtagcacgtttaccagccctcccctttcaaagacaaataggttcaggccagaagtcattgaatgttggggtatacaaatgagaggagcacaagatgaaaaactggagctagtcaaggggacagtcctcgagagattcaaggaggaccggaacatgctgaagatggttggtttggcaaatgcgagtgattgacagagatcacaatgatgtacatgtttgagagcctgtacagcacatgtttataagaa

SEQ ID NO: 200 - DNA, 638 bp, Sorghum bicolor
  Clone ID: SORBI-28MAY03-CLUS104821_1
gcacgaggtctctctctctctgtcctccctctaaaaatccagaggcttcggccccccttgtcgagccttttcgcccaattccccaatcggaccaaaccctaggagatcgatcggaaatttggcatggcaatgtccgatctcacagccaccatgatcccaaagccagacgaggccgacgacgacgagtcggtggagatccgggaggggtgggcggacaacctggaggaggagttcgcgctgatccgcgacatcgtcgacgagttcccgttcgtcgcgatggacacggagttcccgggcatcgtctgccggcccgtcggcgccttccgctcccccgccgactacaactacgccaccctcaaggccaacgttgacatgctgcacctcatccagctcggcctcaccttctccgggccgcgcggcgagctgccggccctcggtgctggccgccgccgctgcgtctggcagttcaacttccgcgagttcgacgacgcgcgcgacatcttcgcctccgactccatcgagctgctccgtcgcagcggcatcgacttccgccgcaacgccgagcgcggcgtcgatgcgcgacggttcgcagagctcctcatgtcctccggcgtcgtgctcaacgattccgtatactg

SEQ ID NO: 201 - DNA, 607 bp, Sorghum bicolor
  Clone ID: SORBI-28MAY03-CLUS104787_1
gccgacgccgacgcgtcggagtacgacgccgtcaccgggtgtctcaaggagcccaacgagatcgcgacgctccacaactcgctgctgcgcgacgccgtcgacgagcgagctccgggcggagcaccccgacgtggccgtcgtccacaccgacctcttcaaccacgtcacggagatggtcatgtcgcctgagcaattcgggctggaaagagacgttcttacggcttgctgcggagggagtgggaggtaccactacaacctgtcagtggcctgtggcgacgatgctgcgacggtgtgtgagtatccatccaaaagcctcttctgggacggtgttcacctccccgaggcgccttaccactacatcgctaaagactggctcaacaccattctgagcagcgtgtctgctgatgcaagagctactattatggcctacgcctcaatataatgggatgatacatggacacacgtaaggttgctgaatatgtataagtaattgcactgttgcagtcaatgaaatccatatgtatatcactgctgcaacattcaataagatgattgctgtaataaaatgtgtttcagtggacatctgaataaaattgttatattacgt

SEQ ID NO: 202 - DNA, 1067 bp, Sorghum bicolor
  Clone ID: SORBI-28MAY03-CLUS104858_1
gcacgaggcttcgccagatatcttaccggaagttataggaggccccaatcggatactgcatccatcctctcaaagaaggatacagcggatggtgatgatgctgctagtgtaaaggagactgagtcaaacgatgatctacctttgaaagacaaggacttgacgaacgcggttctggagctcaacagttacttggctggaacacgtgctcgattacaacgggtgattgatcctgttactggaaacctgaaacctcaaagtgatcgaaatggttcaacagaagaaatagcagagaagttcctgcgcatagggctcgatgattctgagaagaaacttgaggaggagctccgaaacacctttcgtttagtcgacacaactttgttccgagcatacatgttttctcgaccaactctagcaagctctctgtttcgaattcccaacttctgcgaccctaatgtagtcaacgaaaagcttttggaacacaatcgctatactgagctggtggatttcttctacggtaagaggctacattaggaggctttagaacttctacgacgatttggagccgctcaagaacccgacgaggccgcaccaacacttcacggaccgcagcgcaccattcaatacctcaaaaatctgccaccgtcggaaattgacctcatccttgaccatgcagaatggaccctcaaagccagtccagatgaggccatggagatcttcacaggcgacacagagaatgcggagacccttccacgagaacgggttgtctccttcctgcatgatgttgatacacagttggaaggacgctatctagagcacatcatcagcgagcttgaagatatgacaccagaccttcacgaccgattagttgagctctatgtagaaaacttgaagaagatggacaagggtgacaagtgggatgaaatgatgactcacttcatcgagttcttgagacagccggggcaggtttacagtctcagcagggcgtttagattgattcccagagatgacccagtattttacgaagcacaggctgtggtattgagcaacatgaaccagcacaaacaagc

SEQ ID NO: 203 - DNA, 723 bp, Sorghum bicolor
  unsure (1)..(723): unsure at all n locations
  Clone ID: SORBI-28MAY03-CLUS104999_1
gattacctgtgcgcctgtcaaccaatcgcattattgaacttgttcaactccgggacatcactaggcctgttatattggcaggttcaaaagcatctgttactcgggcattgcaaagagccgagaggtaccggactgaactgcttaaacgaggcgttcttctaattcctgtgatctttggtgcttctcagaaagaccaaaccaaaccaaggggttttggtacaagaagagcagctgcatcagttccttccgttgggggtgacttcgaaaagcgtactgaatctattgcagcaaagtcacggttgaagtctgaggttcgatttaaggctgatattgtctcccctgaacaatgggaaagttggatacgggaccagcaagagtccgaaggtgtcactcctggtgaggatgtctacataatccttcgtctagatggccgtgtcagaagatctggaataggtatgccaaactggaatgacatattacaggaactgccacgacttgaagatctgatgagcaaacttgaacggtgaaaaagaatacaaacagtttactatgatggaccatgtggaagcgaggttgccaaggggtttcattatgctctcctgtttctggaactccagtgcagatgatatgcttttcacaaannacgtacttggagttgttagaactactatagcactcgatctattttgatgagagcatctatctctccacattacaaagttc

SEQ ID NO: 204 - DNA, 923 bp, Sorghum bicolor
  Clone ID: SORBI-28MAY03-CLUS105018_1
gcacgagggtgaaagccgcttgaacaaaattaaagattttatgcagaagatggagaaggagaatgtgtggacactggacgtaaggcaggctacctcagagactattcttgaaagcatagacatgaaatgcattttccactgtcccgaaaaatttgatgagcaagacaagctggctgaccatagaagtcagtgcaagtttagagtagtggactgcaaaaatgatggatgctcaatttcactttctgctattcgtatcgaggagcatgactccatctgtccatttaaggccctgccatgtgtgcagctgtgcgagcaacatgttatgcgttgtgagatggaaaaacattgtgcaacagtttgtgctatgaagcttattaactgtcctttctaccatgttggatgtgaaacagcctttccacaaggtaatcttgagaatcactgttcgaagctacttcaaacgcatctgctgtatgttctccaagcaagtacaagacaaaatgctgctgttaatgatatgaatcaacgattacaactccttgagaaggctcagtcacttaacgaaatctctggggctttagatgttaggtccctcactctgataataaaggagcaagaagcaaagatcaagaatctcgagagtggtataaaagtacaagaggcaaaggtgaagaagcttgagaacgagtttaggtcaaggaatgcatgataactgttgtaatttatacttcctacacaacccagagtggcataatttaggacatgtaaataatcagtagcaccaacatacagtttgccattatgttttgtttgttcatgtaaaaaatatagataactgtagggtttagaatataagcttctcttgagctatctttttaatttgatgtaattgatgttttgaccttttttatacaataaatgttcgg

SEQ ID NO: 205 - DNA, 688 bp, Sorghum bicolor
  Clone ID: SORBI-28MAY03-CLUS105082_1
tggtggggtaaaaccattttatccaaatgctggaatgcacagtgacaatgtttggatccaaacaactcagatgaatgagacaatgcagctgggcaacacaccttactacacacagcttccaggatatagcactgaagttgtagggagccgttatgaacctgaaggcttgcagatgtccgggtacctgtctggttttgagcctggcattgagtcaataaatcaaagaagtacagtaataggacagcctcctggtagacacatggaaggaagcttccagagttcggtgagacgacaatctttcccaccttcaagttacaagaaatgagtgtacataccggtagctgccctgatgtacagcataagaaaaggaaaagatgagcccctggaactgatgttttttgtgcagatattgactgtagagaacgaagacttgggggtgttttacttgccctctgaatgcctctttggatttttggcattcggttaactgaaaggtgagaaacccaatattgactgtagatgcagggtatcggaagtgccatctcattgcccattggctcgtgtaatggaaggacgggactaacaaacaagttctggttcaatgttgaatactggaatcgcaccaaaaaatatactgtgatactgatattggtacacgtgtaacacctaaatacagagacttagaaac

SEQ ID NO: 206 - DNA, 657 bp, Sorghum bicolor
  unsure (1)..(657): unsure at all n locations
  Clone ID: SORBI-28MAY03-CLUS10505_1
gcacgagggtcctgggttcctgacagaggattggcttatgatctgtcaggtttagcaagttatcttgcatagcggcaatttgtggagatgagtctcggctttaactgctgttgtttaactgttttcatttaatctgttattatcccatttttgtgtggaacacatataagttgaaaaaagtgcaaaaaccgtgtataaaacacacaccacacactcccacaagaaaaggaaaatattgcctttaataactgacacattaacaaatgatctggatccaatgaggtgggtcaccttcgctacatggcacaaggtgagcctatgttaagattaaattaggtatgttaagattatattagctatctatgttctgtaaatgtgaagattcgtgaatgaatatgaagctcatgttattaggcatctgtattctccagatcttactaatttgggattgaattctaagttaatttatgtagctcttgcaaaacatattctttctcatatgaaagactgttagtaatagatagtcgttgcatttattaactgctagactgctggtaacctgccctgctagtatgtcattctatcttatagntggagatgtcttggtttatgtcacgggaaggcaatctcaatgctcatacaagaaaatggggtttg

SEQ ID NO: 207 - DNA, 240 bp, Sorghum bicolor
  Clone ID: SORBI-28MAY03-CLUS105102_1
gtggatcgctgctcccctggtggcggtgggtcttccccggcgggggggtgcccggagttgtagtggacccggatttgtcgggcggtggtcggggaaacgtccgtgtttgtgtcgattgcccttttgggtttttgatttgaatcgtggggactcgggattggtgcgggtgccccgggtggcaatatttccccgcgtccattggattgtcattgtcggttacttggctcccgtcagcgggtc

SEQ ID NO: 208 - DNA, 625 bp, Sorghum bicolor
  Clone ID: SORBI-28MAY03-CLUS105122_1
ggtggtgccaatgggaccgacagcttggcgctggccttccgatccgactctgctcaaccaatcgcgttctttgaggacggcttccctggttcttcactggccgccgcgttgcttctgaacatcctcctgcccgccgtgacctcaccaccgagccccgacacgccgcccgtggaccaccgcatgctcaccgtgatcatgtgcgtggagctcgtcgtggcgttcggcgtcgcgctcagctgcgtgttcctgtctgtgtatttcgtggcaaatcgtccacgcgagaagcgaccagcgcgtgcgtcgactgccgaaaccaggagatccaagaggaacacgcgcgagccacgatccgaccgatccgacagcctcagcggcgcgctgtcctcgagcgtcgcggactcgcagtcgtcatttggcagctctgcggacctggaggaaggacttctttcggaggaagaggaccaggcgtacggttcgttcaaccgccagcgcgcgacccaaggcgcatcgtctccaggcggaacctggcaggtcgtgaaggaggcgcttgcatccatcagtccatggtagcttctatctagatctcatctctaaggtcaatccactcaatctattacacaccagc

SEQ ID NO: 209 - DNA, 412 bp, Sorghum bicolor
  Clone ID: SORBI-28MAY03-CLUS104391_1
gcacgaggcaaacaagtagccttcaaccctacaactacaaggcatagtacatctcatcagaaactcagatacacctacaccgctacacggaccacactgcttgttgcacattcgaagatgatcggtgatgaactggattcagaagttgttgtacgctacttcagaggcaagagcatcctgatcactggttcaactggcttcctggggaaaggtacggtacctctcttcttcatgcatgaatgaatgaactcgtccagctattactctttcagggtgtctgcagtgtgcacaatgcatgtctgatattctcagcgtgggtgcttgctttctgcgttttcgtcgtctcttcgtagtgcttgcggagaagatactgagggttcagccggatgtcaagaagctcttcctccttatt

SEQ ID NO: 210 - DNA, 926 bp, Sorghum bicolor
  Clone ID: SORBI-28MAY03-CLUS105185_1
gcacgaggcaatctttaccgttacttagagtcaaaacaaaactctttaagatgtcacaactccccgaagctctcgccctcactcaagaggatgcccgtatgatgcttgcttgcaacgtccacattggttctaccaacttggactctgctatggagcgatacgtctacaagaagtcctcctacgtcagagagaaggaacgtgaaggtgcttacattattgaccttcgcaagacctgggaaaagatcgttttggctgcccgcgccatcgtcgccattgagaaccccctcgacattgccgtcgtcaccgttcaaggtactggcgagcccctcgctcaacgcgctgtgttgaagttctctcaatacaccggtgctgctcactacgccggtcgcttcacccctggtaccttcaccaatcagatccaaaagcaattcgccgagccccgcttgttgatcgttgctgatcccttgaaggaccaccaacccatcattgaagcctcttacgtcaacatccccgtcattggtttctgcaacactgactcctcgctccgtcacgtcgacattgccattccttgcaacaacaagtcgcgtttctccgttgctttgactttctggctcttggcccgtgaggtcttgcgcctccgtggcaccatctctcgctctgaaccttgggacgtgatggttgatttgttcttgatgcgctctgctgccgaacaagagaaggctcaatctcaagctcaagcctctcaacaagtccaatctcagcaacaagctagctacgacgagttcattgccaagggtactgccactggtactggcatcgttggtgcctccactaactgggctgatacccacgaggatgctgatgagcccccagctgactacgaataagatcccattctagcgaaacgaaaataataaaaaaccttt

SEQ ID NO: 211 - DNA, 735 bp, Sorghum bicolor
  Clone ID: SORBI-28MAY03-CLUS105200_1
gcacgaggctaaattctcccgtccagctatatataaattgagtgcgcaggatcagtagctagctacgcatcatgagtgggttcctgaattcctgaattatatatactacatggaggccgccggcgctgccgccgtggtgttcccatggcgatccgccgcttggtcatcagcagggttgtcgtctagagctcagcaagcagcagcagcaggaggaggaggaggaggaggatcggtgctctggatccatatcgtcgctgtcgccgtcaatgctgcaccgagggatcggatcggagctgctgtggcgtcgccggcgccggcgccacgccccatgctgtcttcctgctccggtcttcgattcttccccggaaccgaagaagctagcgagctgagcagtgcgcgcgaggtcggagcaggcgtctgatcgatcctctcagctcggctcctccattttctgcagggcaagttgaatcctttggcatgtacgtatgtagtactactgatgatgcatgtacacgatcgatgatgatatctaactaactcttccaccattcgtttcctgaatcctgatcctatatattgtgtgttctgacttctggacagacgacagaacacgaaagatatatgatgcactggtgcattttagacgacgacgacgacataaataaatcttgtaaaactctcttctcggtttcctgaccgtgcgttcatcaagtgctactaatagtctgatgaatt

SEQ ID NO: 212 - DNA, 624 bp, Sorghum bicolor
  Clone ID: SORBI-28MAY03-CLUS105211_1
gcacgaggctactctcgcgaccaacgtccaacaccaactaacccgagcagctcagtcaaatcaccaagccgctacaatggttaaccacagagtcacctaccgccgccgcaacggctggaacactcgatccaacaccacgagaacaattcgtacacctggtggtgagctccgtgtgcttcacatcaagaagcgaggcaccgtccccaagtgtggtgactgcggctccaagctctcaggcattcccgctctccgaccccgcgagtactctcagatctccaagcccaagaagaccgtccagcgcgcctacggtggttcccgatgcggcaactgtgtccgcgaccgtatcgtccgagctttcctcattgaggagcagaagatcgtcaagaaggtgctcaaggagcaggagcagagccagaagaagaaataaatgcaatctccattgctaggttaggctttgtgtgggaaaggcaaggaactctgaggactcggttcattgctttggtgttcattaggcaaaaagggactgcatgatacatcgggccggtgccaaatggttggccgtccgccgtcttaggactgctactatcctcttggtgacttgaatgagaaagaacatcaagctgg

SEQ ID NO: 213 - DNA, 976 bp, Sorghum bicolor
  Clone ID: SORBI-28MAY03-CLUS105209_1
gcacgaggaacaaactcaagcaacaaactctacaacgatcgatcacaacactataactctcttgcacactgcaaccatctctttctcatacacactctcgtagcaaacatcaacgcaaacacaatggctttcttccctcgcaacttctacaactccgatgcttcctttactcccctcttccgtctcctcgacgacttcgatagctactctcgtcagggacaacagaacggtggtacccgtcgaagcggcctcacccactggcagcccaagttcgatgtccgcgagactggcgaggcctatgaactacatggagagctccccggcatgaacaaggagaacgtccacatcgaattcactgagcctcagaccatgaccatccgcggcaagactgagcgcacatacactgccggcactcctcccgctggtctcgtcgagggctctcagtcccaaggcgccattgccgagggcgagagtaatgatgagaacaagaactctcaccacgccaaggttgaggatgaggccgaggccaaggctcacgagagcaccgaagtcacccaccaccaacagtccaaggaggtcgagaagaagcccggtgatcaatccaagtactggctcaccgagcgcactttcggcgagttctctcgcagcttcaacttccccactcgtgtcgatcaggacaacgtctctgccaagtttaaggatggcatcctgagcattgttgttcccaaggccaagaagcacgagtctcgccgaatcaacgtcgagtaaacacaaccacacaccacaaccccggaaccttgacaacgtcattattcagctcccagatttcacgacaagtcaagatcagtaatgactcatatttacgactttagcattgcatggatcggtgtttgaaagtctcttagcatgatagcattgtaggcctgacgtggccattcgctccttgtacaacagcaactaataattcaattgcttt

SEQ ID NO: 214 - DNA, 666 bp, Sorghum bicolor
  Clone ID: SORBI-28MAY03-CLUS105236_1
gcacgaggcccccgtgttgagaaatacacatgagttgagcattgttgagttggagagggaggttgctagcgctgctaagaaggctcgtgatggcaagcttactatggaggacatggagggcggaagcttctccatcagcaaccccggtatcttcggctccatgttcggaactcccgttatcaactacccccaggccgctgtgttcaacatgaacggtatccgtcaagaagtcgtcgccatcaagggcgaagctgtcatccgacctatgatgtacatcagtttgacctacgaccaccgcctcattgacggcagagaggctgtcaccttcttgaacaccgtcaagaagtacattgaggatccttcgcgcatgctgcttgtctaaaaagttgttgtgttagagtagagtagagagttcatttgtatgctagagcgattgggtttagacggaggaatggacattgttctgcatggctggcgcttttgtagagttggactaatgcagatgcttactacgtcgcatgcatgtgtttatcgtgtgcttgaggaggtggagagatctctttattgaacgcggggccgtgcttcgatatctggttgagtctgtaatgtgtagattacactctatgccgtgatctcgctcttcatacaaaccgtcccatccttctc

SEQ ID NO: 215 - DNA, 670 bp, Sorghum bicolor
  Clone ID: SORBI-28MAY03-CLUS105250_1
gcacgagggtcaatacctgacgcgcatactctcaaagtgtaccagtttaatagtagttcataatgcagttcacgaccatcgcccttgccgccctcgcaggcctcacatccgcagccgtcgttccccgggcggactttgggtcctgggccgtcaaatggaccgagacctcgctgaccgccaactacacctctaccgagctcgaggaacccatcatcacgtcctgtacttccgaacccgggtccacgcccgtttgcgacactccgttcttctatagttttgggaccaacgagacgagccataaaaagaccatctctttgcgacagacggtcccactctttggtgagacggttacggtgtttggtgacgcggatgtggtggaagagggatctgcgacggtttttgttacgcgggcgattgcttaagtgaaagtggcgccgagggttatttgtatgacgagaagcaatggtgattcaagattatgctgcttgtcatatgtcttcacgatatctcaacggcactatctgttggtgtgtgatttcgagcaagtactcttctttgtacatatccagctacgtaacaagatgagttaaccgcaaaggtgtgcaaaggtcagtctggcagtttggcgccgaactgttgttacgcatcaatccagaaaaatttaaacggt

SEQ ID NO: 216 - DNA, 315 bp, Sorghum bicolor
  Clone ID: SORBI-28MAY03-CLUS105259_1
tcgatgatgatttgcggcgcgtgcatgatgatgataagcagcagcagcagtgaaccgatcgagcaccgcccaccactgcagataataccacgtacactccatccacctcagctcgcgtacgtcgccagtaacacatgcatgatgatcctccgatcctctagctattttctggatccggagggttaagttagttgttcgtgttcccatcagctaatcaatcaatcataggcttattgatagggtagtccaaatagccgtagtttgatccctagccctggatccatccatccatgtatatttttgtgcatgcatgct

SEQ ID NO: 217 - DNA, 993 bp, Sorghum bicolor
  Clone ID: SORBI-28MAY03-CLUS105276_1
gcacgaggctcgctgtacatgtttaacgctggagccttcagttcaattacagatggaaacaagtctacagtagatggacatggtctcggcaagctcaccgaagacgccttcgttcaccacttccaaatcagcccccagaatccaatggtgggcgttgcatcaagaattgagctgctaaacaactttggaaagtctcttctttctatcccggagatttttggagaaactggtcgtcctggacttcttgttgactacttactcaaggatggcaaagacaaggagctcaactatgaagctctctggagcatccttcagcgcattctcctccctgcgtggtcatcaaaccgcccacgtatcaacgaccagccaattggagatgcatggcctcttcgtgtgctacaggacaagtctggcgacagcggaaatccaactgccggaattcatccattccacaagctgactcaatggcttggatattccctcactgtgccgtttatgaaggttttgaagctgaaatggatcaacattgaaacgggaaccggcctgcccgaataccgcaatggaggactgtttgtcgacatgggagttttgaagctaaagcccgaagtgctcagcaaaggaattgaggcctcaggccaagccttgccgctcttttcgtccaccggagatgtgattgtggaatggcgagcaatgacggtggctctcttggatgagctgcataagcttgtcaataatattttggcgccgcaaggggtttccctctctcttcctcagttgctggaggctgggtcttggaagagtggcagagagctggcggccaagtatcgaccggagaccaggtccagcccgatattaattgatggagatggaactcttttctaatgggtttgggagcgcatgccaactattttcattctaatagatgatggtttgggtatctagctagcaataatccgattcgtcaatggctgccaattgatctttacttacctt

SEQ ID NO: 218 - DNA, 658 bp, Sorghum bicolor
  Clone ID: SORBI-28MAY03-CLUS105301_1
gcacgaggggtccctaacgccaacaagaccgacaaggcatcgatgcttgacgagatcattgattatgtgaagttcctccagcttcaagtcaaggttcttagcatgagccgattaggcggagctacagccgtcggccctctagttgctagcatggcatcagagggcaatgggaacggaaatggcacaagcgacagcggaaatggcaatgccgccaacggtgagaatggtggtggcagcctgcaggtgacggagcaacaggtggccaggttgatggaggaggacatgggcaccgccatgcagtacctgcagggcaaggggctctgcctgatgccgatctctctcgcctcagccatctcctccgccacatcgtcgtccctcctatctcgcccctccatgggtgcaatgggaggcgctaggggtcccctgcacgacggcggtagccctgcgtcgccgccactggtgaacggtggtgatgattccaggaccatcaaggatggcggtaagcagtgaaggcagtgttcttgtcttgagaggttgtgtgttcagaagggaggtcttgttgtagggttggaattgtcaagtggcccagcagggcttttcccctccacctttcctgccccccttttgtttgtttataagaaatgatgtttaatcatgc

SEQ ID NO: 219 - DNA, 627 bp, Sorghum bicolor
  Clone ID: SORBI-28MAY03-CLUS104779_1
tgcaccgcttcctattccacattgagaccaaaacctactggtggaacaccgcacattaccttcttcatggatgccaccataagcaccctatggactcactcaggcttgtttttcctcctactgcaacagcaattttgtgtttcccgttctggaacctggtcgcattcttcgcaactccatctaccacacctgcattatttggaggtggtctgttgggatatgtgatgtatgattgcactcactactacctgcaccatggacaaccatccacagacccagcaaaacatctcaagaggtatcacctcagccatcacttcagaatccaagacatgggctttggcattacctcatcgctttgggacgctgtctttgggacattgcctccatccatgacacctgggaagaagaactgacgcacataacacagttcttggcatgagaaattctaggggatccttatcaaaaaaaagaaagaaattctagcggatctgtaatatatattcaagccagggacaatcctggatctgtcttcgtgcgatgggttgacatgtccattcagttcaaagttcatgtggtgtactgatgtctggtgatctatcctgaatgtgaagatagtatttcgctgcc

SEQ ID NO: 220 - DNA, 917 bp, Sorghum bicolor
  Clone ID: SORBI-28MAY03-CLUS105324_1
gcacgaggatcctgaccctcaaaccagccctctcctcctttctctcacgcagcggctcttctgcgcctggtagcacatcatgttgccttcttctatgcgccgagtcgtctcctcagccgtctcctcgacccctcagaccggtgtcgtttccgtcctcgcctcagccacttcaaagaccactcctgtctttgttcgaaatcagcagcgacgatgttcttcttcaaaaccctcgaaatccgataacggtgccaacgagatctcggctggccagtcggtgcctgctgctacatcacccaagtctggcaatgagaagcgaaagcgaaagagcagcaaggatgcttccgatcgagcggcttcaatgagaaagttgccaagcgttcccaacacgcatcacatgtcacaagaagctctgggactatcaagtttcttctcactacataggcccatctcggttactcagaccatgccccgagcggtttccgatgagcacttcgcctccatctttgcctcccgaaccagaagcaataagatggccgatacagattccactctctccagcgctatcgaacagttggaagggcctatggctcaaatgaccattggtggaggacacgagggccaggaaggaatgcacaaggttgatatcaagaaccccgatggtaccgagtccagcatgtacctccagatcgacaccatgtcaggtgaattcctgcctttccgacctccacctctgcctcaaccccaggctgctggtcaggcagatagtgccgttgccgatatcgaagctgccgaagacgttccccaacaccggatgtacaaggctcttttcaccatcgaggagtccatcgatccggatggccaagtccgcatcatggcccacagccctcagattgtgcaggacaaccaaccgcgaagtt

SEQ ID NO: 221 - DNA, 922 bp, Sorghum bicolor
  Clone ID: SORBI-28MAY03-CLUS105325_1
gcacgaggatgaagcttaacatcgcgaacccaaccactggtgcccagaagtgctcgacatcgatgacgagcacaagctccgtgccttctacgacaagcgtatgtcgcaggaggttgagggcgacatcctcggcgacgagttcaagggcttcgtcttccgcgtgtcgggtggtaacgacaagcagggcttcccaatgaagcagggtgtgctcaccaactcgcgtgtgcgtctcctcctctcgaagggcaagtcgtgctaccgtcctcgccgaagggtgagcgcaagcgcaagtcggtccgtggttgcatcgtcggcccagacctctcggtgctcaacctcgtcgtcgtcaagaccggcgagaacgacgtgccaggcctcaccgacgtgcaggtcccacgtcgtcttggcccaaagcgtgcctcgaacatccgcaagttgttcaacttgaccaaggaggacgatgtgcgcaagtacgtcattcgccgcaagttcgagtcgaagaccggcaagaagaacgacaaggcgccaaagatccagcgtctcgtgaccccacgtgcgctccaccacaagcgtgagatccttgccgccaaggccgcccagcgcgagaaggtcaagcgtgaggccgccgagtactcccgcctccacgcccagcgcgttaaggagcagaaggaacgtcgtgccagtgaagtcgctaagcgccgcagcagccgcaagtcgtcggtcaaggcttaagcgtaatttcaactgcgtcactacgtcgctttcggtcagtcgttggtcctcctcggaggacttgatgaccagacagatcgcaacaactggagtcttgcgcgggcgtcgcagtgctctcacgggcgccgctgctcgcgcgctcctatgaacttgtagagttcatgaacgggacaataaacgaaccaactct

SEQ ID NO: 222 - DNA, 556 bp, Sorghum bicolor
  Clone ID: SORBI-28MAY03-CLUS105347_1
caacttcaatgactacccaagtggtatggttactctgttcaatttgttagtgatgggcaattggcaaatctggatggagagctatgcacacctgactggaagttcttggagcctggtttattttgtcagtttttaccttatttcagtattactgctgcttaatctgattgtggcatttgtgttggaggcattttttgctgagatggaactagagaaagctggagaagctgatatgcaggattctccccccgaaggaagaaacaagcggcgatccatgcgtgtgaggacgaagggtacgatggttgatattcttctgcaccatatgttgagccttgaacttgatggatcccaaaactcggattgataactcatattaatggtaccagactactagtactaccctgcttttctttaatttcgaccacggcttccattgtgaacacctgtctcatctctgctctacagcatatgcatatccaaagacttcgattggtagtatatatcccatttgtatagcttaaaaagtgacaactgatattgacacactaccagaatt

SEQ ID NO: 223 - DNA, 704 bp, Sorghum bicolor
  Clone ID: SORBI-28MAY03-CLUS105369_1
gggaccaatctactatcagaaactgaagcacatggttcttgataagatgcatgctcgagctagtggaccacgggtgttactgaccaggcaaccaactgaggggcgaagccgtgatggaggcttgcgtcttggtgaaatggaacgtgattgtttaattgcatatggtgctagcatgctaatatttcaacgtctaatgttgtcaagtgatccttatcaagtccaggtttgcagaaaatgtggcttgttagcctactacaatcataaactgaagacatcatactgttcaatgtgcaaaaatggagaaaatatggcgaagatgaggctgccatatgcttgcaagcttttgttccaggaattgcatgcaatgaatgttgttccacgcttgaagttaactgaagtgtaatacacgatagatgctggaactggaccagaacgttgctatccaaaacaaaataccgggaaagtggccaattttaactgaagtatgataaaacgccccttgtaaattaaagtcctctttgatagggctttgcaacgggtcaagaagccagataaaccacgtaggtgcgggcttgtcccgcgaaggtgtagcagatttatatttggacgcaattgttgtatatatgtaagcatgctatgcctaaatgatatgtgtaacttttcccccattactatgttatcatatatgaacgaatttttttgtg

SEQ ID NO: 224 - DNA, 788 bp, Sorghum bicolor
  Clone ID: SORBI-28MAY03-CLUS105377_1
gcacgaggctcaaaccacttcctgccatcttcccgccaggccttgccgctgatccaggcaatcggggagtcctgcacactctatgggctcgccaacgcctggcagccatagatcgcgaggtagccgacgagcttcgcaataatgctgagggggtgggtgttgagatggccctcgccgagaggcaatggattctcgacacatttatcaacacgcctcaacttcccagtgattccatccctctttctgtagccactcgttcacctacgggccgcttgggggacaagctcaaaggtctcaagctggccacgtcacctgctgatctaacaccgagcacgacagcgaacacctttatgagtcccgattagccaatctcatccgtttcaacccagagggcgtgatatcgctgtgtcgtcccatgaggccatggccagcaacgcatctacaggtcccatatcgctgaatgctgcactacatggcgacgtggcaacagctacctcggcccctgtcagacctttacggcgagatgatgacgacgatctgtttgctctgcccatgagcccacgtagcccagatatgaagaagagtcctttcagcgcgctatgacagggagacgcgagctttgtcttttttattactcatggcgccattgaagaggattaacaagtttgtgcggcttttaaagtcagtaacatagatacccaggttggataaacgagcgttggtgatagtgagcaacattcaacggcatatccgccccagctatatcgcatgtaacagtttgtcgtgtt

SEQ ID NO: 225 - DNA, 602 bp, Sorghum bicolor
  Clone ID: SORBI-28MAY03-CLUS10541_1
caacatcgaccaggctaccggggagcgccagtacctctccgcgggggcctccgcgctgccctccttctacttcctcttctgcctcgcctacgccggcctcgccgccgcctgggtcgccatcctactccgcaagcgggccgccgtcttccggatccactacttcatgctcgccgtgctcgtgctcaaggcgctcaacctccttgccgaggccgaggacaagtcatgcatcgagcgcaccggcaccgcccacggatgggacgtcctcttctacatcttcagcttcctcaaggggatctcgctcttcacgctcatagtgctcatcggcaccggctggtccttcctcaagccctacctggccgaccgagagaagaaggtgcttatggtggtcatccccctgcaggtcgtagctaacatcgcgcaggtggtgattgacgaatctggaccctatgctcgggattgggtcacctggaagcagattttcttgctggtcgatgtggtctgctgctgtgctgtgctcttcccgattgtgtggtccattaagaacctccgggaggctgctcgctcggatggaaggctgccggaacctatgaagctacactctt

SEQ ID NO: 226 - DNA, 468 bp, Sorghum bicolor
  Clone ID: SORBI-28MAY03-CLUS105416_1
tcttcaccgtggcgtcgctgctggtggagatatcggcgcgggtcgagggcgtcgtggacgccgtcgacgagctggcgaccctcgcgagcttcaagcaggtcgacgacgacgacgatgatgccgacaagaagggagagaccgagatgacgatcaaagtgcacccgttgaacgagccggacaccgacgaggagtcaccggaaaacaagacgaggaaggcttgatcgatcgataaacatgaaaaatcctcgatctatctccaaaccaggacggcagatcagacacgacgacgaactcgacgagatttagcttggccacaccatttgattattactacatatatattatttgaaggcctcttcattattattttcccgtggatcggatgagttcacggctgtatacaagggaataagagcataagaccgggccggccggaccatcatatatagcagttgtgtacagggtttt

SEQ ID NO: 227 - DNA, 669 bp, Sorghum bicolor
  unsure (1)..(669): unsure at all n locations
  Clone ID: SORBI-28MAY03-CLUS10542_1
atgatggcaccattattccaacatgaactccactagattgttaccaccacctacttgagtgtaaagaaccataggaagcttcatttgtgagctttttttttgtatatgaacaaaacaatgtttggaactgagctgtcatttgccaggcaatttgattccatgctttgaggttcaaattgatctgtgggtgtgggtgtgggtgtgtgtgtgggtgttttgagtagctccagaatttactgattggcttggcttcagaggtcttcaatcttggcatgcagcgttgcatcaatatctcccatccgcatttctcctcctttgctgttactctatattattttgtttcggaaacatttttttgtagagaagatagtgaggcaatgccaagtgtacgcctatatttagagggctccagattcgatgggccccaggagggatgtaaaccgctgctaacatggccacagcatgtggcttttggtggagggcggcatcagtagtttgagaagccaagcttcagaagcagaaaagttgtaacctattgttgaattgagattttatctcaatattgactttaatgattgattgcatttgtcaatttgtgcctgttcattgttgttttcaagcaatgttgattacaatttttgtgtttggacggtgaaaactacaatatnc

SEQ ID NO: 228 - DNA, 766 bp, Sorghum bicolor
  Clone ID: SORBI-28MAY03-CLUS105471_1
gcacgagggcgcgtggtcctgacctcgtcggcgggctccgtgatcgtcaggccggagctgcaaggcgacgggcatgtgctcgacgaggagtcctggtccgacgtcgagtacctcaccgccaacaagtccggtctctgggcgtacccggtgtccaaggtgctcgcagagaaggcggcgagcaggttcgcggaggagcacggcatcagcctcgtcaccgtctgccccgtggtcaccgtgggcgccgcgccggcccggagcgcccgccccagcgtcctcaactgcctctcccttctatcaggcgacgaggcagcgtttggcgcgctgagagccatggagatgtccggcatgctggcgttggtccgcgtcgaagacctctgccgcgccgaggtgtttctcgccgaggaggaggcggcggccgccgggaggtacctctgctgcggcctcaacacgaccatcctccagctcgcacgcttcctgtccgagaagtacccgcagtatactgtgaagacgaatctgctcgccggcgagctgcttgagaagccgagagtgtgcctctcgtcagcgaagctggtcggagaagggttcgactacaagtacaagacgctggatgggatgtacgacgacatgatcaactacggcaaggccttgaggattctgcccggaaaatgacgggcctcactaatttctactaactggagagtgcttgtttaggagatcttccaacgagccattttcagacaaacaatttacagcattcactttttgt

SEQ ID NO: 229 - DNA, 802 bp, Sorghum bicolor
  Clone ID: SORBI-28MAY03-CLUS105474_1
ggactcgaccaccaccgtgacgcacacgcggacgctcaccagcgtgggcggcgcgggcacgtacaaggtgtcgacggcgctcgccgccgccaagggcgtggcggtggacgtggagccggcggagctggagttcacgaaggtgggggagaagaagagctacacggtgaagttcacgtccaagtcgcagccgtcgggcaccaccggcttcggccggctcgtctggtcggacgggaagcacagcgtggcgagcccgatagcgttcacgtggacctgatggacggacggataccataggacggtgatttttggcgcctcaacgctaaaaaaggcccataatccatgtgatggccacgtacgtacactacactacactgcttcagtcaaaagggctgctggagtgtagtaggatgggaaggtgaaaatttggaggtttcttctgtgttgttattactgctaataaggtgattaatcctaccagtgtctgtagattgtgatttttggatggaaatgggatttggggtgatggttggatggagattgatggtgcttggttgattggaatggaattattagagaggagaaaatgtaggttggattggatgattggggcttgcaagttggactggactagactggactggactggaccagagtgcgggtgcaaggggccaaggcagctagcttcacaatgactgattggaaccttctgtgggggactatcgcctatgagaattgttgtccacaaatgtttttcgttctacctttttgaaaagtcttaaattattacattttttgtggctgt

SEQ ID NO: 230 - DNA, 345 bp, Sorghum bicolor
  Clone ID: SORBI-28MAY03-CLUS10516_1
cgaccattcgagcaagcaagcaagcagcgcgcggcagctagctcacgcaattaataagccttctcctagctttagccaatagccatggcgctggctagccaggtcgccgccaaccagccgccgctgctgtcctccccggcccggcgcctcccaagaaccagcagcagcaatgcgttgctgctcctccagccggcgtcgtccgcggtcctcggcggccggaagaacctgaggctggcgccgcctgctgccggcgcgcggagggcgctgctggacgccgtcgtcgtctgtgcgggcgtcgtacgaggcgaaggcggcgacggagaccaccaagtcggagggaaccgc

SEQ ID NO: 231 - DNA, 906 bp, Sorghum bicolor
  unsure (1)..(906): unsure at all n locations
  Clone ID: SORBI-28MAY03-CLUS105504_1
gcacgaggtatgcttctctcattcaacttctgtcaactgctaaactgccaaagaaggctatttactacttggaaaaaatgaaagttgtgaaattgctgtcagactgtatcccgtactctgtggtaattagtagctttgctaagattggtgatctacgaatggctgaatacctatttagagaaatggtcatgtcaggggtccgccctgatgtttttgtctactctatcttaattgatgcatacgctgaagttggaaatgtccaacaagcttcagcatattttggtttaatgaaaaaggatggtttatgtgagaacgttacgatctacaattctttgataaagctctacacaaaagtagggtatgtggcagaggcccgagaaacatataagttactcaaatcattggatgccaatgccatcctttatgcatctaattgcatgattgatctctatagtgatcattgtatggtgaaggaagcatgtgaggtttttgaaggtttgaaggttaggggaattgccaatgaattctcacatgcaatgatggtgtgtatgtacaagaaagttggtcgctatgatgtggctcacaggatttgcaaggaaatgcaagctttaggacttctaactcagttactaagctacaattctgtaatccaaatgtatgcatctggtggaagaatggaggaggctcttaaaatattcaagaagatgttggcatcgaacacagcaccaaatgatgcaacattccaggcactaaaggttattctagtaagaagtggagtcacgaaaaatgagacaagaaagttagaattgttaagaagaaataacactcatgattgcttgcgtcagtggtacagggcgctatcttacagctgtaagatccaagtgcaaattcttttcnaaacatagt

SEQ ID NO: 232 - DNA, 681 bp, Sorghum bicolor
  Clone ID: SORBI-28MAY03-CLUS105523_1
gcacgaggattgtctggagtcagatcctgcctacggctggtgctatggtacctaaccaggctcaagtgtttgcgcaaacactggattggtatctctccccagcaggcgagaaatatcgccccgaactagcccgcatcgccgccctcgaaacaggcgacgagacagacgccttgctcctcggctacgcaatggaaggcatccgcatggccggaacattcggtctctaccgcgaagccacaggccccgacacaatccacgaagacgacggccgcagcatccccgtcaacgccggcgaccgcgtctgtgtatcgttcgtccaagcagcccaagaccccaagatcttccctaaccctggagtcgtggacccgaagcgtccgctggataagtacatccactatggcgttggaccgcacgcgtgtctgggacgggatatcagccaggttgcgctcacggagctattcagagcggtgtttaggaagaagggtgttaggagagtgccgggcgcgcagggagagttgaagaaggtgccgagaccgggcggtttctttgtctatatgacggaggattggggcagcatttggccgtttcctacgagtatgaagattacctgggatgagtaggcaactggtagctgtagtgatgtaatggtggatgggtagattgtaattaatctctttgttc

SEQ ID NO: 233 - DNA, 564 bp, Sorghum bicolor
  Clone ID: SORBI-28MAY03-CLUS105641_1
gcacgaggcgatggtataccttccctcttggttgcctggaatctggttttgaggtccccatcaacctccacttcgcttcaatgtcccccatccatcgatatacccgacatcttctagcaaattccaagccagccgcatcattcccatgtcaatatctcatgttttatcttgctcgccattgggaaatcgttcaaaacgccatctcgatgatttgccagctcatcattgggtcctctccctcacatctcaactacaccctctcgccagtaacacagtctcagtcgcccacccaaaaatcatccacccactatcagagcatgaaatatcctgctccccgttgatgacatttcgtagatcctattctttgatagtgatgtgaggaggaggaggaggtctcgcggccggccaacaggcacacgcagatctacgtagcctgcctcggaactttttggctctatcaccaggcatgtaccagctttgatgccctacgtactgacttaccctgtggccttgttgtatctaggatttgctggtttacgtttaataagctacaacgggacttgg

SEQ ID NO: 234 - DNA, 685 bp, Sorghum bicolor
  unsure (1)..(685): unsure at all n locations
  Clone ID: SORBI-28MAY03-CLUS105671_1
gcacgaggccgccacctcttatcctgttcgtcacttcctctggcccgacggcaccgcgagcccgagatttagccgtggtgtgtccttgcttccttcaagctccagcagcggcgcgtgcccctacctcgccatccgctcctgtagtcatggaaccttcctcagccgtggccccatcacctacctaggttgccgcccacgcgctctatctgtgccgcgccgcgccgccaccgccaccgccaccgcagtggctgctggctacgtgctccctgcgtggcgaactgggctggccagtagagttgcagtctccgcgtctccaaccttcttcagcggttgtgcatctatcgtgcaaccaccagagcaccaggatgtcatctgttgcctcaaatcctaccgatggcagcagccaacccactaagctgaagaggaattctgatgatatcggttgggattatggagtgttggtggatccatccaacttgaatatcatcaagtgcaagctatgtggtctacaggtgacatcagggatatataggataggctggacagcccattacacttggctgcatattttttaaacccatattatagctacagtgatgattccatatttaagaatgatcagattatggatggattaatgactgctgtggagactttttttncatggtgactatgacaagcagaa

SEQ ID NO: 235 - DNA, 716 bp, Sorghum bicolor
  Clone ID: SORBI-28MAY03-CLUS105739_1
gcacgaggggaatctattgtttgtaagttgaaaatgttgaagacagcatcatcatttgtcaattcccgtttacatgcagtcaaggcccagactttggtgctagccagtggaaatgatgaactgttaccaagcagccaagaggctgagaggctccgtggtgctctagagaaatgcagaacacgtcttttcagagataatggccacaaaatcttactggaagccgattttgatctcgcaacaaccattaagggagctgggtacgcccgccgcaccaggaagacagacttcgcttcagactacctacctcctactccagatgagttccaacaagctatcaatcacgacaggatcctaaagcttgtcactgacccagtgatgctatcaacactgcctgacgggaagatagtgaggggcctggcagggcttccaagggagggccctgccgtgctggttgggtaccacatgctcatggggtttgagcttggacctatggtcacagggatcctgagcagcaccggaatccacatccggggcttggctcaccccttcatgttcgacaagagcacggagctgctgatgcccgattcggcgcacttcgacctgcaccggatcataggggcggtgccggtcacaggtgccagtttctactagctgcttgcagataacgagattgtgctgctgtatccaggaggtgcgcgggaagcgcttcacagaaa

SEQ ID NO: 236 - DNA, 747 bp, Sorghum bicolor
  Clone ID: SORBI-28MAY03-CLUS105742_1
gcacgaggcaggccactttcgcgcgcccacctcaccgccgtacccgccggcagccgccccgtctcaagatttccgtccgctcctcccatcgctcgctgcctgtcacagccagcctactactctctcccgcatctgtcaccggctgcaccgtgggagcttcccggttcttggatctctggacggccggcgcttggcacgatggatggaggccgcgcgggccccgaaggctcagatcacaacatggacctagaagaaggcaatgctgccactagggtcaaaagggcaaaagcaacaaattggcccagggtgatgtcaaagtttttgcttgattggtaccttgacaagaagaagggaatgccccccaagaccaagttcaagaagaatcaccacgtttggtgcacatctgcagtaaatgctaaattcagaacaacttactctgttgatcaggtccatcgccattttagacgtttcaaggagatctggatcattgtgactcggtatgtcaatgagagtgggagcaggtttaacaataaacacaaaatgcttatacttcctcctgccaaaatggctagtttacctatagcggagcgtgctatcctcgctaagcccattccattcttcgaccatctgcttcatcttttcaatgatggccagctagatgcagtgtgcatgagagaccctattacgactgatgattctgatgaggaattggaagcacagattgccttgaacattattgcctccggc

SEQ ID NO: 237 - DNA, 518 bp, Sorghum bicolor
  Clone ID: SORBI-28MAY03-CLUS105767_1
gcacgaggatttcctttgcatccatttccggggggacagagcggaggggtcgcctgcgttgcttcgcgtgggtagcgtgcttcgtttagtaggcctctcgccaatttccgaggtcgacggcgacgtgcgctcggcggacgggcagacaaaatctagagagccttgggcttgttgccaggcgcgcctgtacgtaacgtacgcgccgttgtgggagacagccacttgctctcgcctccaatggccgagatctgctgcgaggaagccaagtccacgccggcaaccgccgtggctgcggcttcagtctccgcggcggccgccgccgtggcagtcgcctcctcggcgttggagaggaggcgacgcaggttggagatgaggaggttccgcgtcgcgactgatcccgaggcgccggtcgcggaggacgtccgcgctaccaagcggcagaggctgctggcgcgcacggtgtccggctcctgccccgacgcgggctcggactccgacaggccggccctgccggagcg

SEQ ID NO: 238 - DNA, 544 bp, Sorghum bicolor
  Clone ID: SORBI-28MAY03-CLUS10580_1
gcacgaggcttcttccagatccttccttccttccgctcacccacgcggacgccggtgggctaccccacgatccttcggggtgcaggggagcatgcggaagaaggggcgggcggtgccggagtggctcaacagcccaatttggtccgcgaccccgcctgcgcccaccccgccggacccctacggcgtcgacctcgccccgccgccgcccccaaagccgccgccgccagctgtacccccgccgccgtcgtacgagcaggccgtaggggtgggtggtggccgacgggatgaggatgagtacgagggcgccggggcggtgatacgggcgcacctgctctccgacttcaaggccgcgctgtcgaagaaggtggtgaacatgggagagctgcagcgcttagcctgccttggcgttcccgacggcggtggcggtgtccgacccgttgtctggaagcttcttttggggtatttgccaactgatcgttccttatgggcttatgagttagaaaatgaggcggggtcaatatagtgcatacaacagaggagttct

SEQ ID NO: 239 - DNA, 747 bp, Sorghum bicolor
  Clone ID: SORBI-28MAY03-CLUS10586_1
gtaaatggacatagttgacaagttttttgtgttgtgttccacagatggtcaggctaagagtagtgctatcggaaagggatttgtaaagattttggattcgatctccgctcccccagcttttgcaggagaattcccagctaaccaccgcaaatccttggctcatatttctggagcgcgccccaacacactccatgtttctgctgaagtgatccgcataggaagcttagctgttccttctggcgcagacaagtgggctctgcaaaaggatcaaggcatggagctgctcttctctgcagattttgagcctgatacccgtatacactgtggctgcaacaccattaccgcggtgctgcgtggtggcttctgcctttcctccgtttcggcaataatgctcttagtgagctacgaggtgggcatgtgcatccatggcaagtagcagcctggtatcggattaagttaaatttcaagacatttaggttaatcctgtgttttgaggcagactcaactggggcctcatgcgcttttaagtgtattgcattgcatgacatggacctgtggggtgattagcactagcagtaccattttgcagctcgagagctaatggtgtatgtatgaattaagcgctatttagttatagtatgcgaattgcctcattggtgtctgatgatgccattttccatgcttctggttgtagtggacaatgttagtgcaaaatcctgtatatatatttcagatccgccagggaaa

SEQ ID NO: 240 - DNA, 482 bp, Sorghum bicolor
  Clone ID: SORBI-28MAY03-CLUS10581_1
aaaaaaaaaaaaaaagcaaatcatatctgccaatgcaggtatttctacgacagaatcccctgtttttttgctccatcatccggcaacatcacatcacacaaactgtgctatacgtttagcatttgatagaattcagacgatcgacatgccgctcgccctccagctgcggcttccactgccacgtgtcctcgtcgtccagcggtgcaggtgcaggctgcccccctcacgcctctctgtaagggcagaagcggcggccggggtggcagtggcggcagcagcagcaccatcgtcagtcgttcatgatgaactgtgcatgctacccttctcgccggagctcgcttcccaccaccgtgagctcgccgctgctgtcgcctccgtcgagcgagcctgccgtctatgtgtcgatgtgaaggcatcgctgctttcaggtgacaagaaagttcttgaaaagaatgacgaaactcctgtaacaattgctgatt

SEQ ID NO: 241 - DNA, 1102 bp, Sorghum bicolor
  Clone ID: SORBI-28MAY03-CLUS105314_1
gcacgaggcacagccaaatcagaccagtcgagctcaatcattcaaaatgcgtgtcttcgttaccggtgcaactggcttcatcggccaagccgtggtccaggagcttctcgatgccggccacagcgttgtgggcctcgctcgctccgatgcatcggcagaggcgctgaagtccaagggtgtcgctgttattcgcggttccctcgaagaccttgaggccatcaagcagggggcctccgagtcagacggtatcatcaacctagccttcaaccacgactttaccaagtttgcagagaacgctaaggtcgagtacggagcgatcatggccatgggcgacattctggcaggatccaaccggcccttggttctcgcctcgggcaccatgatgctgcccaagggcgagctcgctacggaggattctcgccccgacatgaactctcccgtgaatgtacgcgcagcgagtgaacaagagctggacatacttgcatcgcgaggcgtgcgcgcctcggctattcgtcttgcgcccacagtccacggagacggcgatcatgggttcattcacatgatcacccaagtcgcacgcgccaagggtgaatcgatctacattggcgaaggcctcaaccgatggcctgctgtgcatcgccgcgatgctgcacgcctgttccgccttgcactggagaagggcgtagcgggcactagatatcatgctgtggccgaagagggtgtggaatggaaggatattgcagaagccatcggtaaatctgccggtgttccaactgtgtcaaagacattcgagcaggctatggcgcactttgacggcagcttcatcgggtttgctttcggcgctgataacccatcttcgagcaagaagacacaggagcagctgagatggactcctactgcgcccactttgcttgctgatatcaaggcgggagtgtatacgcaggatgatggtgtcaataatggcttcgttgcttgatcagaagccctatcgagggatatatttcgaaggatttggattttgtccacttccatctagtctcagaatgacactctctagctatgagttccatatgtgcgcaattgagcaaggctttgtcctagt

SEQ ID NO: 242 - DNA, 530 bp, Sorghum bicolor
  Clone ID: SORBI-28MAY03-CLUS1060_1
gagattgccagacccttctactcctaacctaaagattgatttgttggctgaaatttcaatagcaccacgaatcatgtcggatgttgatggtgccctcaaatcaaagcagttgaagactgaggttgatgaatatctcaagaggccggagggctcttcctttctaagtgacctgaagcaaaaattgctgctgcctcagaatgaagcaactgttgccgggacacgctacaacgtgcctctgatcaattcacttgttctttatgttggcatccaagctgtgcaacaactgcaactgaacaaggctaatgcatcagcatcagtacagcagattaatcatatgcctccgatggacattttccagattgaaacagctaccgagatgttcagaaatcttataacaagtttggatacagagggccgctaccttctgttgaatgcaatcgctaaccaactgcgctatcccaatagccatacgcactacttctccttcatcattctggatctatttgctgaggcttcccaagaaattattc

SEQ ID NO: 243 - DNA, 690 bp, Sorghum bicolor
  unsure (1)..(690): unsure at all n locations
  Clone ID: SORBI-28MAY03-CLUS10605_1
gcacgaggtgccttatcttttcgcactcatcccgcgtgctctctctctcgtggcgaccactgggcgagcgccgccgcactacgacgggtgcccaggcctccgtcggtcatttcgccaggccatcgtcgcgggctcttcgccggcgacgagcaccaactgttgaggattggtcctctacaagcatggtcataatggtagagaacggagttcagctgacactgacctccactttgaagagcacaggcaagacaaggatcagtgcagacgggctgaataatggaaatggatcacaaactaccaaggagaagcatgaatataatggcactttacaaccatcaaaaggccagaagccgcagctgtgcacaacatgtgcaaaagggcatacttgtcaatcggtcattaaccggacaagacaaatgcgagctctaatcgactcaaacaagccctaccaagcacactctgtattcaagcacttaatggaagagggacacaaaccttcattggtcacatatacaattctactgaccgccctgacaaaccagaggatgtttgagtcgatcccatcactgcttgctcaagttgaactagctggaattaggccagactctatcttcttcaatgccttgataaatgcgtntgttgaggcgaagcggatgggtgaagcaataaacacattctggaaaatgaagc

SEQ ID NO: 244 - DNA, 827 bp, Sorghum bicolor
  Clone ID: SORBI-28MAY03-CLUS10610_1
gccgaaatcccacaggcagatggggaaggcatagttctggaatacagtgctgggcatgagatcttgaccattggcgatggagcagatgcttggaaacggaaggctaccgtggacccaccttatgctatcagtgccaatactccgattcgtctacctgggttcttctactgtagtgctctgcactgcatcaccaggcatggcatccgcaaggtcagttcacatgtcatcctaaagtttagcttgcatgatgaaacgttcaccgtgcattcccacccgccaacctatgggtttctaaccaataatgacaccctgtgcaatcttggtggtaagctatgctatgttgggtcttcctcgccgtgggaagtggaaatttggttggcagaggatggtccaaaccttgcttggctgcggcattgttgcatctgcttgccagtgccaaggctactgaaggtttttgcttgtgcttcaggcgatagaaacaagatattcctgtcaattgatgcctttcgccttttgagatgtgatctgcgcgatggatctctcgaggaaataatcgagatggcacaggacttgttgtatgaccatcggaatggaataaaattcagcactggactccattctgttgcccattacatggttccctgtgtggaatcgcttttgtgtatcagaccatgataataatgagcgggcagattattgtatgggaccaataatagttgttagctcagatgcacctagcaaggtgccctttgtgtgtgtgtgtgtgtgtgcaagtctttgtaacctgagtttgtaaaagcactattataatctatgatttacttatg

SEQ ID NO: 245 - DNA, 620 bp, Sorghum bicolor
  Clone ID: SORBI-28MAY03-CLUS106112_1
gcacgaggggtacatgcgctataatttgattctggggagaggagctttcaagactgtttacaaggcatttgatgaggtcgaaggcattggcgcggcgtggaatcaaatcaacatagatgaggtgatgcaatgtccagataatcttgataggctctacacagaagttcatcttctgaagtctctcaagcatggaaatgttatgaagttttattattcgtggattgatgaccagagtaagacaattaatgtcatcacagagctgttcacatctggaagtctcaggcattaccgtcagaaacatccacgtgttaacttgaaggcaataaagaattgggcaaggcagattcttcatgggttggattacctgcatagccaccaacctccaattatccatagagacttgaagtgtgataatatttttgttaatggaaaccatggagaaattaagattggagatcttggactagctacagtaatgcaaacacctagggcaaggagtgttattggtactccagaattcatggcacctgaactttatgacgaaagctatgatgaacttgttgatatatactcatttggaatgtgcttgttggagatatttactcttgaatatccataca

SEQ ID NO: 246 - DNA, 703 bp, Sorghum bicolor
  Clone ID: SORBI-28MAY03-CLUS106209_1
gcacgagggatatgcttccccacttccattcaagaacatccagtggtttgagcaatcctgcgggtctttggtgctccgctttgactctattgcagatgtcacattcagccacgtgtcttgcaatatctgccttcatattcttccaccaaaaatgcttcttcaagtcctggtacatctttgagcctccagggtgaaggcaatacttagaatcgtgagcttctgataatatctcctttcgcagggcagagttgtcaggtacacaaattctgtctttaaaccagatgactcctttctcatcttctctgaactcaaggctatagcctagcttcatcagcccacggatatactctatcttctcacaatccttctgggcttcatggattcgatcagtgagatcgtactcaactcggagctcatgcaacaagccatgtggtagtatctcaagctgggaatcatagatttctcgcctcaactctggtggcatagactcagtgattagagtgtggcaatagcttttgcggctgagagcatcggcgaccacattagcttttcctggatgatagtgtatctctaggtcataatctttgattagctctagccatcggcgctgcctcatgtttaagtcttcctgagtgaagaagtacttcatgctcttgtgatcggtatagatatcacatttgttgccaatgaggtagtgcctcca

SEQ ID NO: 247 - DNA, 439 bp, Sorghum bicolor
  Clone ID: SORBI-28MAY03-CLUS10627_1
gcacgagggaaaaaagaaagcctaactttattttccccatctgtggaattctccggttttttctgacgagatgcctgcgctcgccgtcgacgccacaacacccgtggcgcacgccatcgcatcatgcgacgcggcggctcgcttccctgccccgcccgtggtgggccccgccgctgccgcagccgctgaccccgtcccgtggtcggccgacctctccgcggcgctctacaacgtggacggctggggcgcgccctacttcttcgtcaacgacgacggcgacgtcgccgtgcgcccgcacggccccgcgacgctcccgggccaggagatcgacctggccaaggtcgtggccaatgccgcgggaccgcgcgagggcggtgggctcggcctgccgctgcccttgctcgtgcgcttccccgacgtcctgcgccaccgcgtcgag

SEQ ID NO: 248 - DNA, 691 bp, Sorghum bicolor
  Clone ID: SORBI-28MAY03-CLUS10635_1
acaagatgtacgaagcatctgccacctgctcggacaggagcgccgatgcatatgccgcgtagaccgacatcactgacgtagcaaatgccactctgtcagacaagatggaggaggaaaattctgatctgaaggacatgatgtatgaagagtgaggtggtggggtagccagttttgaaatagaggtagacctgtgctgtctagccacatattccgttttggaacatcatatattcaactctgttaccacagatcaaggctgataacatgcccccccaagaggtgtagccgtgggcagaaccaaggttgacgtatgatggcctatgttcctgcggttaatgatggtgaaagtttgttcgctaccatcttggccatgctttgctgataaatgtgccttttcttccaaccaacggcgtctccatgtatcccacatgtgtgtaaaagtgtaaactgtagagattttttggcagtttgtctgaatcactcagatatcagaggccctgtgcagcttctcaacagcttacggtgaaaaaaaaatcagttcagttaatttagcgtgcacaagttccaactatagttgtctccgtagcataacacagctggaacgttgcttttgtatacttgattgactatattgtaattttggcacaagcgttagatttttgcagatttgatagaccttattggtctgctg

SEQ ID NO: 249 - DNA, 1036 bp, Sorghum bicolor
  Clone ID: SORBI-28MAY03-CLUS106357_1
gcacgagggaacaatgcactgattgcgttgtatgagcacatggatcaagatgatgtctgaaagaagcagcatcacacacattgaaatagagccattgagtatcttaggggttgtatctggacttattccatatccacaccacaaccaatctccacgtaatacttatcagtgtgcaatgggtaagcaagcgatgggaaatattgcatataatcagttgttcagagcagattcactactgtacttactagtgtatgcacaacgtccactgctaacgacgaaaactattgagttggtggggtatgataaacttggtgctgggcagaacgccactgttgctgtcatgggatatagtggttatgatattgaagatgcaattgtgatgaacaagtcatcccttgaccgagggtttggccgtgcccgagcctcgtacaggtacacagttttaaaggacaactatgtagatggtgtatcggataggattgttaaaccccaaagagataaagatggtgttttgatgaagcagaatatgagagcattggatgatgatggaattgtcgcacctggtcaaattattcgcaatcatgatatctatgtgaacaagcaaactcccatgaacacttcaaaaggtataggtaggccattgacagacagttgctacaaggactcccctgccatttacaaaggtgttgatggtgagactactgtcgtagatcgtgtaatgctgtgctcagatacaaatgataagttgtccattaagtgtattattcgtcacactagaaggccagaggttggtgacaaatttagtagcagacatgggcagaaaggtgtttgtggtacgattattcagcaagaagacttccccttctctgagagaggaatctgtcctgatttaatcatgaatccacatggtttcccaagtcgtatgacaataggtaaaatgattgaacttcttggtggaaaggctggtgtttcttgtggtcgatttcactatggcagtgcatttggtgagccaagtggtaatgctgacaatgttgca

SEQ ID NO: 250 - DNA, 591 bp, Sorghum bicolor
  Clone ID: SORBI-28MAY03-CLUS106442_1
gcacgaggagaaagcctagcattttctctcattcctctgctggaaggagctagtgagacaaacaacaagagtgcatccaacagagacacacagaggtcaacctcacagcagtcagtcatattctgttgctgcgtttcttacacgcttacaatagggacccaaccggtgttggcagccgcgctcgtgaaccggtcagcatggacgccgccgcgagggaagcgcagagtggtctggaatggcgggtgaccgtgccggagggcgcgacggtgaccatggaggagcacgaggccggcggcgctgccgccagggcgtgcgcgtggctgctggcttgctttgccacggcgtggagctgggtcgccggcttcgcgaggaaggtgtggaggattgccgcagatgacccccggaaggcggtgcacgggctcaaggtcggcctggcgctcgcgctcgtctccgtgttctactacaccaggcccctgtacgatggcgttggtggggctgccatgtgggccatcatgacggtcgtcgttgtcttcgagtacactgttggtggcagcgtgtacaagtgtttcaacagagtcgttgcgacggcga

SEQ ID NO: 251 - DNA, 607 bp, Sorghum bicolor
  Clone ID: SORBI-28MAY03-CLUS10649_1
gcacgaggcagaggcgtctgaaggtgggaaaggagggaccctgtacaatgagggtggcaggaaggagttggagcagtatgaggctgcagccatgggaggcacagggacaggggtgagggaggttgatccagatgatgagtatgatgatggcatcgatgcgcaggatgatttggaggatgctcacctgcattcatctgatggtgggaggaagcttggtggtggcagccatgagggtgctgagaaggacgaggtcgccactgagaggcacacagaagcaggtggagggagcactgatagtcatcatgatattagtagcccagacaaaaagaaggcttcaggtactggagataagaagcgtgtgtccaagaagaaaccgaaacgtaagaagtctggttcaacttgtgaaatgaagtttctcaattcaactgctcaacttgtggagcctgcgagaaatgagaaattctctagttttaatttggagtatgcagaagttgaagaaagacctgttggatcagaatattgggaaccgagatttgccgtccaccaaagtctgcaagaaagagaggagtcatacaaagctcatgaccaacagctgaaatgtgctttt

SEQ ID NO: 252 - DNA, 507 bp, Sorghum bicolor
  unsure (1)..(507): unsure at all n locations
  Clone ID: SORBI-28MAY03-CLUS10653_1
tgccgatcaacctgtagttccatcagtatctttgagtcaaaggcaagaaattgccctgaaacaagaacaagattctcccgatagcctattctccttcgccattgatatcttcgaagaagaaggtgaggaagcaagctcctctcgggcaattgggactgtatcggtagaaaccagggctaagctggaggagctatcggccatacttcatcaagacactgctcaactggtcaacgattctgacccagccaaggccttgttcaaaacccttagaggccaaattcctgccgatgctgaagaaacgctcttccatgctgcatacctagaaagccgccagctacagtaccagagagctactcgacgccttgccgatagagccgctcaaatccagctctctgaggagatgatgaaagaaaaactcttagccgacgagaaacatttnaatcntnncaccttatagcctatgtgatgcactgaacagaagtatctgatctatcgcaaagagaactt

SEQ ID NO: 253 - DNA, 574 bp, Sorghum bicolor
  Clone ID: SORBI-28MAY03-CLUS106538_1
gccccacgcccggctctcccacccgtggcaggtccgccgcccgcctccttggcggccgtcccgggcccctccccgggcccgtccgcggccctgctcgccctgctccctggggtgcctccgcaacgtcgcgcctcgcacccgtcgccgccgcccctgctccgccgcccccgctcgcccgcgcggcgcgcgggcagcgccggcccccacggcggcctccgcggcccccccccccgcccctgccgccaccccgggcgccccggccacttccggtgccggccccgcctcgcccgcgcgccacggcgccctgtccgggctgcgcgccctccggccggcggcgccgcgcccggcggcccccgtcgcctacctcgccctctgcgccgtgtccctcctcggcgggcgccacgccgggctccccggcgacgtcccctgcgcgtcgacgccgggcccccccgtccccgccgcgcgggccgcccgcctcgcccactccgcctccctggaggagggcgtccccgccggcccgctcctcatcgaggtcgcctgcgcgtcgacgccggaccacctcgtcgccgtcagg

SEQ ID NO: 254 - DNA, 613 bp, Sorghum bicolor
  Clone ID: SORBI-28MAY03-CLUS10652_1
aatattggtttcttgctttgcagcagagttagtatccagttttcacttcacatgggttagtatcatataacattctggattgcagattgctttaaatatgatacataacaagtggcaataatttattaaatggtagtcttcagtaggaaaaaaaataaaaagggcacaaaatgctaatatggttgttgtcaattttttttatcctgcaaattagtgagtactcaagttccaagataatgagttactatatagtgcttgcctgtgccactactgcaagtctgcaactatatggcattattaggcatttggatatctgtgttatctctgccagtactgccaacatcttccttacttttttgttacctaagggaccaaccttgcttgggggatacaccgtctgaatccatgcaccaatcgtcaagttttggcatgcaaccatctcataacaaagcataaactaaagcatggtctgcccacaaccaagtactcaagtatatgaaataatggtcattcctgaatattttcaagttcataattttattggtaagtgatcatatctgcttgtagaattaacttctacttacaaatacaaatttcttgaaataataaacat

SEQ ID NO: 255 - DNA, 531 bp, Sorghum bicolor
  Clone ID: SORBI-28MAY03-CLUS106566_1
gcacgagggaaaaaactagctggagctctgtgtcatcgtgcacgaaagcacagaagaaacagaaaaatacggtcgatgggcatgacaacgacgacgacgacgaggctgatgctcaccttggccgcggcggcggcgatgctgcagctgctggcctcggcgccggcgccggcgtccgggcagcccggccccggcgtcgtcgtgggcgcggtgtcgtgcacgacgtcgctggtcaccagcttcacgccgtgcctcaacttcatcaccaacggcagcgcgtccccgaccgacgactgctgccggtccctgggcgcgctgacgaaggcgagcgccggctgcgcctgcctcatcctcaccggcagcgtgcccctcggcgtgcccgtcaaccggacgctcgccgtcacgctgcccagggcgtgcaactccacctctctccagctgcaatgccgaggtgatccatccagctgatgagcatgcattcactgacttagctatagctactgtcgtccattgcagctagcattgctaaagtat

SEQ ID NO: 256 - DNA, 822 bp, Sorghum bicolor
  Clone ID: SORBI-28MAY03-CLUS106607_1
gcacgaggtgtggacagccctatacaagcagagcctgcacctaaagatgaaactcctatcagcgcatctagctttgtgagcaccctctctgaaattggggatgctgactttgcactactactcaaacttgaacacagtgatgaagataaatatgaggatggtaaccttgaaaagagtggtaagattttaagtcatgcttgtcaatcgaggtaaactttctggtgccccattacctgcgcttactaatgctcagtatgcctccactgctgctctttctccatcgtccactgcagccctctcacctgcccctgctgctccaggtgcttttgctgctgcgtcagcctcaagaaggtctttaccgaaaggagactcaggcagagagcatcaacataatgcttcaggtgactccaagaagaacaaacaggttgatcttgtggatttggattcaccgggtggtgagggctcctctggtgcggcctgaagatgggaggctgtctagttccgttgcggctttattgggttcctttatccttttggtcttagttacctataaggtggtctgacgagggttgtaattccttaatacctgtggctcaaactattaggtgttggttggtgacccaaaggtgatctgatgtgggttgttttacctatggctcaaactattaggtgttggttgtaattccttaatactgctctgaattttcattgtgccatctgccagaaggatgtcacgtgctgctcgctgtttcttctctcgttgtaagacttgtatttccattatgtcataatggaaatgaggagatcccttgtttttttttt

SEQ ID NO: 257 - DNA, 1072 bp, Sorghum bicolor
  Clone ID: SORBI-28MAY03-CLUS106610_1
gcacgaggcttctatgctatttcttttcccatttatgagaagattcctagagagttcaaatgttaaggtcataacgatcatgatgtggtggtctcagcctcggttatttgttggcagagggatgcatgaaggtgcattctccctcttcaagtataccatgttctggattattcttttagcaatgaagttgatagtaagcttctatattgagatcaaacctctggtacagccaaccaaagatataatgagagaacctatcaggacattccagtggcacgagtttttccctcatggaactaacaatattggtgttgttatatcactctgggctccaataatcctggtatatttcatggacacccaaatttggtatgcactgttctctactctgattggtggcatctacggggcttatcgtcgtcttggtgagatacggacattaggaatgttgagatctcgctttgaatctttgcctgaggccttcaatgaacgcttgattccttctgatgcaaataagagtaaaggtctccgtgctgcttttttgagtagacccaaggttcctggtgacgaaagagagagagagaaaagagctgcaaggtttgctcaaatgtggaacgttattattacaagcttccgtgaagaagacctcattgacaatagggagatggatctgctactggttccatactgtaaagaccgtgaacttgatatattccaatggccgcctttcctacttgctagcaagatcccaatagcactggatatggcagcagacagtggtggtaaagaccgtgatctgacgaagaggataaaatcagatccatacttttccttcgctatcagagaatgctatgcttcattcaagaacatcatcaataccttagtgtttggtcagcgggagaaggatgtcctagcaaagatttttacagttgttgatgagcatatagaagatggaactctgataaaggatctcaacatgaggaaccttcctgcactgagcaagaagtttgttgaattacttgagttactgcaaaaaaacaaggaagaagacttgggtcaggtagtcatttgt

SEQ ID NO: 258 - DNA, 459 bp, Sorghum bicolor
  Clone ID: SORBI-28MAY03-CLUS1067_1
cgccgccgcatcttcctacacccaagccctaaacaccaccgccctctcaaatctctttcccctcgatccatggccgccgccgccgcctccaccgcgccatcccgcaagacggagacctacaccgacaccaagcgccgcgacgatgtgcgcggcgccaacatcgccgccgcgcgcgccgtcgccgacgccgtgcgcacctcgctgggcccccgtggcatggacaagatgatctcctcgggcgaccaggcgcaggaggtcatcatcaccaacgacggcgccaccatcctctcccgcatggcgctcctccagcccgccgcgcgcatgctcgccgagctatcccgctcgcaggacgccgccgctggggacggcaccacgaccgtcgtcgtcctcgctggatccctcctccgccgcgcccagtcgctcctctccgccggggcccaccccaccgccgccgccgac

SEQ ID NO: 259 - DNA, 600 bp, Sorghum bicolor
  Clone ID: SORBI-28MAY03-CLUS106701_1
gcacgagggatcgctaccctaagtaaatgagacgcttagtggatatatcacgaatcaaaaaggagcagtggtgtaactctatttttttgccttctttgtgatcaatcaatcattagcctgtacgttgaggaaaccactggttctcgtcttttttcttctatacttattccccctttggtcctccagggcatgaagtgcgtgcgtgtaccatcagccttacacattgccttcgtaacgttctccactatatctaattatctagattattcaatgtcgtacctacgtggagcaaacgggtggacgcaggtcccaggctgaggcatcactgaatcatcgttgtacccatttttcgtgccgactgaagcgggaagtatactagtgggtgagcgagatgttgaagattcatctaaaatattttcatgtgattggaatatcatgcggtgatgaaagcatctatagacacgtcgaagagggaggtgcccacgtgtaaggttcaagatggatgcacctatatcacctataggagattatatttcatcaaataagatcggatggaacaagaataggaacattattcgcccgaaaaaaaaaaaaaaaaaa

SEQ ID NO: 260 - DNA, 718 bp, Sorghum bicolor
  Clone ID: SORBI-28MAY03-CLUS106703_1
gcacgaggcgcgttcctctcgtccgtacgccgccgctgccgcctggctcgcaccgccgccttacgccaggtgccgaggccctcgccgatctcttagccggcaaagagtggccactagatccgctcctgatggacaacgtcgagtctgcccctgactcgccggcgcaggcgccgccgtcatccgcctcttctctccccaaggaacaatcgcaggtggagttggagctgaggctgcttcaggctctcgagttctaccctccatcaaaactcaaaggcattcatcggcactttgttctctatggcctcatggaatttttgcgaaaaagccttgatcggcaattctctcctgatgaagttttacaactcttggaccgcttctttaacctagaaatgctgaaaccagaggacgatgaaaaggacaacttcagtcagggggaagaattttccttgccagagagttttctcaacaaggaagaataatagcaagtagtagcttggtaatttcataggaggtactttgggcgtcgtctggaagagagatcagaacgctggtttcccactttttctagtagcattgtcgtccagaacatcggttgcgaggagacactgaacactgaagtaaaaaaacacatttcctaagctgtggttgtgtttactggctgtacatcttttgttcacttctagtgtaatcgatgggctgttcagttctcatttgaggc

SEQ ID NO: 261 - DNA, 433 bp, Sorghum bicolor
  Clone ID: SORBI-28MAY03-CLUS10672_1
gcggccttggtcaatacctaagacgactcaacgccgtcacatgccccaccttcggcccacttcaacgcccgcaacatcactcgtgggcacgatgctttgcttcgatgctgctggaagccatccgggatgccgaagatggactcgtcagcttgccttatagtgaggtcagagcgcagctcaagcgtcattgggatcgtttggattcggtatcagaggcgaggttgaccgtcactgaattgcctgccgatggtgtggtcttcgacgagaggtcaggagaggtcagagggctggtcgattacggaagtgcaatgtgggcggatccgatgttcagcgactgttttgttcgggcatcggaaggctttatggaagggtgcggtgctgctgatggttactaccacaaagtcagactgctcttggacatcgtgtaccattt

SEQ ID NO: 262 - DNA, 609 bp, Sorghum bicolor
  Clone ID: SORBI-28MAY03-CLUS10676_1
gcacgaggatcatcactacacaacacactacaaacacaccaccaggaagcagcagctagagctagagtagtagatagatagatagccggcggccaaaaccacctctccctttcctctcctctcctccctctcgatctcgccttctccagctaacacagctttctagggcttacaccggccgccgcagtcccgagccggccggtcgtcgatccacatcaccattattccatctcctgatatcgatcgagctcctccctccctccgggctgaggcgccggacgaattccggcgcgtcgagctcgctcgcttatattagcgccggcgcggcggcagccggggccatatctatagccggagggggccatatggtggaagctatttgatctctgatctgagctgagctggggaaggaagtgtgtcgtcgccggtaatttgatgatgcttgtgtgatcatgagcggtggctagcttaataaagagatgataagcggcaatctcaccaatgaagagctgggggccgggtgcaccaaggccgaggggccgaccgcgggctccggcgccggcgccgtcgtcgcaaagagtcccgtgctgtcgagctcccggcactggc

SEQ ID NO: 263 - DNA, 933 bp, Sorghum bicolor
  Clone ID: SORBI-28MAY03-CLUS106849_1
gcacgaggccggacgccgaccggatgaagaaggccgtcgacctcgcgctgtcggcggcggcggcggcaggtgggcggctcgggtgcgtgctgtcgaccgggatgaccatcgcggaggccgcggaagcgctcggcgcgtgcggcgccgacccggccgccttcgacgcgctcatctgcagcagcggcgcggagctctgctacccgtggagggacgtcgccgccgcggacgaagagtacgcggggcacgtggcgttccggtggcccggcgaccacgtgcgcgccgccgtgccgaggctcgggaaggccgagggcgcgaaggaggccgacctcgccgtcgatgaggccgcctgctccgtgcactgccacgcctacgccgtcgcgggcgcgtccaaggtgaagaaggtggactcgatccggcagtcgctgcgcatgcgcgggttccggtgcaacctcgtgtacacgcgcgcgtgcacgcgcctcaacgtgatcccgctctcggcgtcgcggccgcgcgcgctcaggtacctgtcgatacagtggggcatcgacctggacaaggtggccgtgctggtgggcgacaagggcgacacggaccgggagcgggtgctcccgggcctgcacaggacgctggtcctgccggagctagttagccacggcagcgaggagctgcgccgcgacgaagacgggtttctggcggaggacgtcgtcgccatggactccccgaacatcctcaccctcgccgagtaccaggcggcggccgacatcctcaaggctatctgagagtccgagatatttgtctgtatcatacatgcatgctctgctctgctccgaccttccagctgttggtttcgttggttctacccacaccacactctgctggggttattttggacggccagttaaattttcacagaaagtgactgcaaacttttgc

SEQ ID NO: 264 - DNA, 442 bp, Sorghum bicolor
  Clone ID: SORBI-28MAY03-CLUS10686_1
gttagaaatataagtgtgaggactggggtattagatgagaaagctgctgcaacacaggctattggttttttcgcactacacacagagagtgcctatgctccgtatctggaggagtcactgaagattttgatcaggcacagtagttatttccatgaagatctcaggctgcaagcagtcatttctttgaaacatattctaactgctgttagggcaatacctcctacacatgctgatgtactagagaaacagaaggatgttcttgatactgttctgaacatttacatcaagactatgacagaggatgatgataaagaggtagttgcacaagcttgcatgagtgtagcagacattgtgaaggaatgtggttttgctgcaattgagccttacatgctaaggcttgctgaggtaacactggttcttttacgtcaagaatcaagctgtc

SEQ ID NO: 265 - DNA, 546 bp, Sorghum bicolor
  Clone ID: SORBI-28MAY03-CLUS106905_1
gcacgaggctacttcctcgtccgcacctggacggcggcgctcgagaggttcggcgtcgtctccaagcccttcaccaagcaggagaacaccgccagccagacatgcgtcgtcgcctgctacggcctcgccttcagcggggggtttggaagttatatgcttgcaatggatcagagaacctatgagcttattgggccagattatcccgggaacagggccgtggatgtcaagaatccttcactgggctggatgattgggttcatgtttgttgtcagcttccttgggctatttagtcttgttgcactacgcaaggttatggtaattgattacaagctgacttatcccagtgggacagccacggctatgttgattaatagtttccacacaaccactggagctgagcttgcagacaagcaagtcaggtgtcttgggaagtacttgagcattagtttcatctggaactgctttaaatggttcttcagcggtgttggagattcttgtggtttcgataatttcccttctttgggacttgcagcatttaagaatacg

SEQ ID NO: 266 - DNA, 1147 bp, Sorghum bicolor
  unsure (1)..(1147): unsure at all n locations
  Clone ID: SORBI-28MAY03-CLUS106910_1
gcacgagggcgaggtggacgaggtcgactaaagagaaggcgcaggccagccaagattgaccttgaacttgtcgacgcaagtgaaggtgaaggaaactccggccggccgcctgccttccaaattccggttacaattccaattggatggaggccaaggcgatccagctccagagcaccctttcctccctgcgtctccgtcgattcggatttggactggattctcctgctgctgcaccacctgcaggtaaaggtgcctgctctgctcaatccgtccatccatccatcgacgaccatctcctcctccttggctcccggcgtgctcagctccgtccatcccaaatcccttccatcagattgactgaggctatgagcagctgctgcttccattcattagagcttctcctcatcaattagttggtacaagatggttgttttgggtggcgctgatgatccgacacacaaacttggtgacattgttgatcacacacgccaacagcatgcaacaggattaccggagaaacccagtaatgtcagttgtcacaatggaaatgggcacgctccccggcgaagttcagcctctgattcatacaagtattactatgatgctgatgcaccatccgagtccgattggcagtccacctcaccagcttcctcttcctctactcgacaaatgcttggagatgggcacagaaataatggctcctctttccgctcgtcgtcgatagcatcatcccagactcagagaccatcatcttcttcttcttcttcaagtcgacgtttcacggtgcccttcgtgaagaagatcgactggggctctctgtgggacaagtccaaggaatggattcggaaccccatgaacatggcgctgtctgtctggatcctcgccgtcggtgtctcaggtgccatcctcttcatggtcatgaccgggatgctgaaccgcgtgctgccaagcaagccgcagcgagacacgtggttcgaggtgaacaaccagatcctgaacgcgctcttcaccctcatgtgcctctaccagcacccgaggaggttctaccacctcgccctgctgtgccggtggagagccggcgacatgcatcagctccggcaagtatactgcanagatggaacctgcaagcccaacgagagaaagcata

SEQ ID NO: 267 - DNA, 659 bp, Sorghum bicolor
  Clone ID: SORBI-28MAY03-CLUS10694_1
ggaaaacagcaacggtacctagcaccatggctctcaccacaagcactaaccaagctttgctcgacgctcagctcgagctctggaacaccaccttttcccacatcaagtccatggcgctcaaatccgctctggacctccgtattgccgatgccatccacaaccatgccggcgccgccaccgtccccgacatagtggcgacggtgaagctccacccatccaagatcccctgctttcgtcgcctcatgcgcgtgctcgcagccaccggcgtcctcagcgcctggaacccgtcgggcagcagcactgagctcgtgtatgcgctcacaccgttgtcccgcctcctcgtcggctcgcataacctagttcctatcactgccatgatactccatccaagctttgtctccccgttcctcgagcttggcacatggttccagcaggagctaccgggtccatgcgtcttcaagcagacgcacggccagacagtgtgggagcaagccgcccgtgacgcatcctttgacgcgctcgtcaacgacgggatggtctcggacagccacttcatcatggacatcgtcttcgaggggtgtgcagatgcctttcaggggataagctccttggtggacgtcggtgggggtctcggcgcagctgcacaggccatctcaaag

SEQ ID NO: 268 - DNA, 257 bp, Sorghum bicolor
  Clone ID: SORBI-28MAY03-CLUS107018_1
cccgttcctgatgttccaccgccacgagtaggtgtggggctcggacgccggcgagttcgatccgctccggtttcgggacggcgtgggtagggcggcggcgcacccgaacgcgctgctggccttctccctgggccaacggtcctgcatcgggaaggacttcgcgatgctggaggccaaggtgacgctggcgctcatcctgcggcggtttgccttcaaggtggcgccggagtaagtgcacgcgccggccgccttcctga

SEQ ID NO: 269 - DNA, 407 bp, Sorghum bicolor
  unsure (1)..(407): unsure at all n locations
  Clone ID: SORBI-28MAY03-CLUS10702_1
tntgagtgggattggtggcatctgagacaagcattaccatcagctaatgcattctgaaactttgccttcactcggtgccatttacaagctaagaactgacgggaagtactgaaatcaagatcacatctgtgatctgttgatgaacagaaggttcatacaagtggacaagctcgttgatttttggagtaggtgaattctgggcaggacgccctgcctatctttgttcagtctacacgaacgtggacagtttcacgactatggtgtaatatatgtaaacattacatatatgttccctgttcatacttatttacttgtttgtagatataaacagatgaagtaaactcgtttcagatgacactattgtttcagaggttaatactgattcatctatcaaggcgtttatgttt

SEQ ID NO: 270 - DNA, 383 bp, Sorghum bicolor
  Clone ID: SORBI-28MAY03-CLUS107021_1
ccgggtcccgtaaaagcaaaagcgagcacgcagaggcaggcaagcttttgaacagtgcagagagcacatgcaggcaggcagagtgctggaggatcagagatatcgacaggctttgtgcgcggcgcaagcgcaataagcaaatccacgccgcaatgcggcaacgttaaactgcagcaggctgccaagctctttagagcatgatgcaatgcaatgcaaggacggccggaatgcatgtcatgagctcgcttttagtccgagaagaagagatcgtacgcacgcaggcgaggcgatgaagcatgcaggcagcgtgcaggaggaggtggggtgggggagacgaggcgaggcgagggacgatgcagccagcggggaagtgggagcagctg

SEQ ID NO: 271 - DNA, 693 bp, Sorghum bicolor
  Clone ID: SORBI-28MAY03-CLUS107046_1
gcaacgaggcggctttgcgcccatgttcgctggacacgccgcggccatgccggggctcgagctcggcctctcgcaggacggccacatcggcgtgctcgcagcgcagtcgatcagccagttctaccaccaagtgggtgctgctggcggcagcggccagatgcagcacccgcacggccaccagcatcaccatcatcagcagcaggaggacggggaggacgaccgcgaggacggcgagtccgatgacgagtctgggcagtagtgtagttgttcaacttcaaccttgcgttttctgggtctttcctcaagtcaaggaggggaaggagagaaaagtgtatgcgtgcagccacgggatgcttctgctactcttggattgttgttcgtcgagttgtgatggatttttatcttcatttttttctcgtgtggtatccaaactcaacggaggcctctcttgctctgaggacttgccgcctcgagatcatcctcagttcttcccacaatctcatggggtggatgatcgccacagccttctctccgacttccaggtgtataatagctgaaaaacttgatggattggatcaattgcccttgagtgagtgctttatttgttattgcaaagtgtgtagatattcaggtaattttgcagttagagaggtgttctttttattggagtaatgatccatgttttaaagcaat

SEQ ID NO: 272 - DNA, 484 bp, Sorghum bicolor
  Clone ID: SORBI-28MAY03-CLUS107092_1
gcacgagggattccccagcattggcagcagcggacgttggcatggcgatcggtgccggcacagatgtggccattgaggccgctgacatcgttctgatgaagagcagccttgaggacgtgatcacggcgatcgatctctcgcgcaagaccctctccaggatccggctgaactacgtgtgggccctgggctacaacgtcctgggcatgccgatcgccgccggcgtcctgttcccgttcacgggcatccggctgcccccctggctcgccggggcatgcatggctgcctcgtcggtgagcgtcgtctgctcctccctgctcctgcagctctacaagaaaccgctgcacgtcgaagacgcgcccaggcccgaggacggctcggatttggtgtgaggagtgaggactgatccctcgatctcgatgtactaacaagagcttgctggcgtcactgacgcgtgccgagccagcactggcataccgggtgatca

SEQ ID NO: 273 - DNA, 597 bp, Sorghum bicolor
  Clone ID: SORBI-28MAY03-CLUS107126_1
ctcaaacactttcaactctcgctacaaaaaacacactctcgctctactacatctttcttcttacaagaaaccaccaaccgcaaacatgaagttcaccatcgccctcgctgctctcgtctccttggccgctgccactccccttgatgcttccaccaagggctgcaagcctggaacttactcttgcactcccgacaagactggctggcaggtctgcgatgtcaacggcaagtatgttgctgccggtgtctgcccccccaagacctcttgtgtcttctacaagccgagcggtagcccctactgtgtcccccctggattcaagttccccaaggcttaagtggtattttgatcttatgacctgatagctatgggagtcacggggtgcttgaagattctcgaaaatatcttctatcttggtctgatactggcttttgaggttgggtttggattggaattgaggcagtgcatttggtcttttcttgttttcatgccttgcatgaggtcattccttagaacaaatattagatatgggacatagctggttgggtacatacatatataggcacttagcatgcatctgcaatttactgcattgccttg

SEQ ID NO: 274 - DNA, 445 bp, Sorghum bicolor
  Clone ID: SORBI-28MAY03-CLUS107150_1
gcacgagggcccaacgcgcccagcctccctcgcagtcgcagcttcgaattccgctccgcccctcgacctcggcgccgcaaccgcaaccccgcgaggagcgttcacaccgcggaccctagccttatccgtccgagcgcgcgcccgcccgatgcagacggaggcgcgcgtgggcgtcgtcgtcgacggcggcggcggcggcgcaggcgcagccgtgggccgttgccagaggcagcgccacatcagcacggcggggcaccttgccgctggagggttcgcgggcgccgtcagcaagacgtgcaccgcgcccctcgcgaggctcaccatcctcttccaggtagctggtatgcattcagatgttgcgactgtaaggaagtatagcatatggcatgaggcttcacgaatttttcgagaagaagggtttggagccttttggaaaggaaatcta

SEQ ID NO: 275 - DNA, 388 bp, Sorghum bicolor
  Clone ID: SORBI-28MAY03-CLUS107193_1
gcacgagggtcaacgactgagcatatattcgccgccagcgaccctgcaacccttttcatcttccttccgtcaaggcgacacgatgctccgaaatactctagcacgttcggcttggcggacgagccggcgggcggtcaatgtctcgcgaaccttcacgacgacaagccagcgcccggccgaggtggagctgacaattgatggaaagaaggtctcgattgaagctggttctgctcttattcaagcctgcgagaaggcgggatcaacagtccctcgatactgctaccacgagaagcttatgattgccggtaactgccgaatgtgtctggtggaggttgagagggccccgaagcccgttgcctcttgtgcttggcccgtacagcccggaatg

SEQ ID NO: 276 - DNA, 433 bp, Sorghum bicolor
  Clone ID: SORBI-28MAY03-CLUS107199_1
gttgctgtttcatacaaagtacgatctttgctggaaccctcgatcaatgtgactggtccaaatggcgaaagaatgtcaaggagaaactcatctggtatcgtccatccccacacaagtttcgaccaaggaggttccgggttttctactccggtccactcagatcatgaggatgagcttgcagaaatcaagtcggctcagcaactttctttgaacatatcgccaattcagtcaagtccagaagctcaccgctgcgtccgtcagattattaggggaaactacgtccagtttgcagaagacgctaccaaaggactgcgaaggcagcgtgtatacctcgtctcgacagatctgagcgacgaggctgcatacgctttggagtggacaattggtaccgtcttacgagatggcgatacgcttcttgccgtctacgccgtag

SEQ ID NO: 277 - DNA, 467 bp, Sorghum bicolor
  Clone ID: SORBI-28MAY03-CLUS10725_1
cccacgcgtccgcggacgcgtgggctgaagcccgccaagttctgcgagctcgcgctttcgttgcccgaccatgcccgtatctacgacgatggcgtctaccgcgccgtcgacatctacctcaaggcacacccacggctaacggcggaggagcgggacagggtggtgggggtggtggactgccggaagctgacggtggaggcgtgcacgcacgcggcgcagaacgagcggctcccgctgcgggcggtgctgcaggtgctcttcttcgagcagctgcagctccggcgcgccatcacgggcacgctcttggcgtcctccgccggcggccccccgcgtgcaagcaccagcgaggcggtggcgtggcgtggggcgacggcgctggcgcatgagagccaggtgctacggctagacatggacagcgtggccagccgggtgcacgagctggagcgcgagtgctgcagcatgcgcag

SEQ ID NO: 278 - DNA, 377 bp, Sorghum bicolor
  Clone ID: SORBI-28MAY03-CLUS107288_1
tgaccaacctcacctatctctggatggacagtatgaacctcaccggagagatcccggaggctttctccaacctcacggagctcactactctgtccttggtgtccaaccggctcaacggctccatcccggcatgggtgtggcagcatcagaagctccagtacatctacctgttcgacaatggcctctctggcgagctgacgcccaccgtgacggcgtcgaacttggttgatattgatttgtcgtcgaatcagctcaccggagagataccggaagacttcggcaatctccacaacctcaccttgctgtttctatacaataaccagctcaccggtaccatcccgccgagcatcgggctgctacgacagctcagggacatc

SEQ ID NO: 279 - DNA, 404 bp, Sorghum bicolor
  Clone ID: SORBI-28MAY03-CLUS107221_1
gcacgaggacccagcagcagccgatcggcctcggctagatctcgccggccgcctccaattggtcctccgctgtcgccgagggctcgttctctaggcccgcagatctgcgctgctgcgccccgtggaaacctccgctcctagctatccgtctattggatcgatcgatcttcccatctcccccgcacgagtccttccaaggaatcgaaaatttccagccggcccggcgcgggggttattctgctatatcaacagctccgctgggcgctgaggttctgtaggagggcggtgcgctgatcgggggcaggggagcgagcatgatgagggggcaggcgtggctggcgctgctgctcgtggtggcgctggccttggcggacgcggcggcggggaggttcgtggtggagaat

SEQ ID NO: 280 - DNA, 406 bp, Sorghum bicolor
  Clone ID: SORBI-28MAY03-CLUS107289_1
ttcggcacgaggtcagcgactgccagttggacctctggaagcagtcctacgtggcggcgtgcgccgccgtcgacgacgagctccggcgcagccgccgcttcgacgccgtccagagcggctgcaccgcgctgtccatcgtcaagcagggggacctcatggtcgtcgccaacgtcggcgactcccgggccgtcctgggcaccacgtccgacgacggcggcggcgccatcgcagccgtccagctcaccgtcgacttcaagcccaacctgccgcaggagaaggagcgcatccggcggtgcaacggccaggtgtactgcctcgccgacgagcccggcgtgcaccgcgtctggcagcccaaccgggagtcgccggggctcgccatgtcgcgcgcgttcggcgactactgcgt

SEQ ID NO: 281 - DNA, 458 bp, Sorghum bicolor
  Clone ID: SORBI-28MAY03-CLUS107290_1
gccggccagcgcacactccattaattagcaaggaagtcttgcaagatcaagtgagttaaccagtgattcgtaactaggttatcattagtagaatagaaagctgcagtggcggcagccggccggcaaagcaagagcgatcgagcgcaatgggaggcgtggcatcggagctggtgggagccagcagggagaggcagagtaggaagaggaagcagttccacacggtggagctcaaggtgaggatggactgtgatggctgcgagctcaaggtcaggaacacccttgcccgcatgagaggtacgtatccatttcttgttttgcctgaatcttaatctgttgcccttcttcaattaatattgtaaccatgtactatataccatgcatgtagtagactaaaatactagcacgcacaaaactaaaagttttctctctactctttgtatatatcatgcttagcattc

SEQ ID NO: 282 - DNA, 537 bp, Sorghum bicolor
  Clone ID: SORBI-28MAY03-CLUS10731_1
gcacgagccgagttccagagtcgagactaccgcccctccgccgccgcctctcgctccctcgcagtcgcagctccggccgccctgttttgcggttgattttgtttcccctcatgggtcgcaccatcaagagggccaagaaggccaaatccaagaaggccaagaagaaaactgaagcgtcctcttcgtccaatcctgcggttgcctctggcccggctaaggtctggcaaccgggtgtagatgcactggaagatggggaggagctgcagtttgatcctgaggcttacaattatctccgaggttttggcattggctggtcttgcttgagttttgatgttgtgcgtgatcaacttggactcgtccgatcagagttccctcatacattctatggtgttgctggaacgcaggctgagaaagcttcatggaattatattggcgttttcaagctttctaacataagtgggaagaagcgggaacctataccagcttcagcggttgatggtgacactgatgtggatagcgacagcagcagtgatgaag

SEQ ID NO: 283 - DNA, 279 bp, Sorghum bicolor
  Clone ID: SORBI-28MAY03-CLUS107318_1
gagagtttggtcaaaggtgtcataatagcatacggacggtcatcacagaacatggggggagagggaaaaggaggaataggggcgatgggtgaaggggggaaaggaacggctggatccgctcgagacaaagcttttagtgcaccataacctcgggctgggcctggtgggaaggcttgccagactcgtccttctgctcggagtcgtcgcccatctcgacgtcctcatcgccctcaccggcctcatcctcgtccagctcatcatcgtcgtcctcactctcct

SEQ ID NO: 284 - DNA, 439 bp, Sorghum bicolor
  Clone ID: SORBI-28MAY03-CLUS107342_1
gttttggcagctcaaaaacccagctttgatcagagaagctcacgagttgcatcattatctgtcaggatgctgagagcaacgcatttcgctttcaggagggacaagggtacagctgcgggagccgccttgcgtggcctcgtcggtggcttctcgacggcgtcagactctcagaggctcgccggcaaggtcgccctcgtcgccggcgcggccagcggcatcggcaaggcgacggccgccgagttcgtccgtaacggcgccaaggtgatcctggcggacgtgcaggacgacgccggccgcgccgtggccgccgagctcggcccggcggcgtcctacacccgttgcgacgtgacggacgaggcccagatcgccgcggcggtggacctcgccgtggcgcggcacgggcggctggacgtgctgtacagcaacgcgggcgcgccgg

SEQ ID NO: 285 - DNA, 502 bp, Sorghum bicolor
  Clone ID: SORBI-28MAY03-CLUS107366_1
cgcccagtctcgctcccatgagctgctcgccgcaataggatggcctcttctcccccagcagcagctgctggttgtggtgccactcctcgttctccctctcctctgcctgctgtcggcgtcgaggcggcgacggcggaggagcagagagcaaggagcagcagcagcggaacgacggcgtgctcctcccccggggccggcgaaacagctgccggtgctgggcaacctgctgcagatcggcagccggccgcaccgctacttccaggccgtggcgcggaggtacggccccgtcgtggaggtgcagctcggccgggtgcgcacggtcgtcgtctcgtcgccggacgccgccaaggaggtgctccggaccaacgacctgcactgctgcagtcgccccaactcaccaggcaagtcgtagaagctctcgatcaggcccacttcccattctaacaattttggagagtcaaagtattttcacgtttgatcaaaattatagaaaaatactata

SEQ ID NO: 286 - DNA, 522 bp, Sorghum bicolor
  Clone ID: SORBI-28MAY03-CLUS107367_1
caacacaaggaggatagacctcgatccgcacacctcacgcctgaaggccagatctggccttcttcttcctctcgcccaaggacaaggattgcctaacatcaaacaacaagaaccaaagaaaacacagcaagagcatcgtcgctctcttaagcaaaacaacgcgcaccacgcacgccggccacttgcacagcacgcacgcacgtagcaggacggacgcgcgcatcggtcggtgcatggggctcctggaccagctatgggacgacacggtggccgggccgcgcccggactccggcctcggcaagctccgcaagtacgcctccttctccccctcgtcgtcatccgcggccgccgtgccgccgtcgccgaccgcagagggagcggcggcggcgggctccggctccggctccggctccgcgacgcccgccgtgacgcggagcatcaccatgctgcggcccgcggcgctgtccgtcatcacctcgccgcgcagcgagtccagctccgcgccgtcgtcgccgtcgccgg

SEQ ID NO: 287 - DNA, 437 bp, Sorghum bicolor
  Clone ID: SORBI-28MAY03-CLUS107448_1
gacatcgccgaccagatccgcaacggcgagactggtatcgttggcgtcatgatcgagtccaacatcaacgagggcaaccagaaggtcccacccgagggccccagcggcctcaagaagggcgtctctatcaccgacgcctgcatcgactgggaaaccactgttgacacgctcgagaacctcgctgctgctgtcgcagagaggcgagcaaacaaggccacggccaacggtacacactagactctttgccatgggtcagctgtggttatgcgtgtatgaacaatgggacttgtatatctatctggtatctggcgttttcttttcgtttttccttccttctcaccaaaaacaaaaatagttggggtttgaagtaagtggttcggcgctgcgatgaagtttatgaaacacgactttgaaaatagatttgacttttctttccc

SEQ ID NO: 288 - DNA, 520 bp, Sorghum bicolor
  Clone ID: SORBI-28MAY03-CLUS107374_1
ctttcagctccgccccgcccgacctcggagctactttctgcatacatctgcgcccgcagctgagtcaattgacttggactctcgacacaaccatacaacccaccttacctctgcgccttccgcactgacaggcaacccagcatcctgcagccgtgccctagtcaatttgcaaagcaatcccgccagttacacggccagacacacactccagcaacatggcttcccaagatcaggctgccagcgacgatgtgcgcgtccttggttacgacccgctgattcctccccagctcctcgcccaagagctccccatccctgcccacgcccagcagaccgttgtccaaggacgcagagaagccgccagcatcatcacacagaaggatgaccgcctcctcgtcatggtcgggccctgctcgctccacgacccagaattggccattgagtactgccaacgtctcaaggccttagccgacaagctcaaagacaacctctgcatcattatgcgcgcctacctcgagaagcc

SEQ ID NO: 289 - DNA, 532 bp, Sorghum bicolor
  unsure (1)..(532): unsure at all n locations
  Clone ID: SORBI-28MAY03-CLUS107513_1
gcacgaggcacacctccgccagcatacagcaggcacacccggaaagccatggctcctgttcagacacaaaccatgaccacgcaccagttcgacaaccccgtcacagtcatccgggcctctggacggatatccaagcccccggcgcgctcgacgcgcacacaaacaaaggcccttctctcacactcgccccaaatccccacggcacacccagacatcaacatctcactattgcgcaacaagctgctcctgcaatgccggaaatacctcccctcggacctcctccatgaagccttggcagacggcctctactcacgcgccactcactggatcacgccgtgttcgagcgccgcgtccaagtttggcaagcggaaaagatattacgtgcttgactcgtccaccttcatgtttcagtctctgggcagcgcgtgggaggcgcggatcctctcgggtggcagccagccgattgatgccggcaacggagtcgtcatcttcgtcaaggagagaaaggaatggaacgcctttatggcggngt

SEQ ID NO: 290 - DNA, 422 bp, Sorghum bicolor
  Clone ID: SORBI-28MAY03-CLUS107550_1
gcacgaggcaccgcctccctctccgctctcttcctcccaacgactcaaaccgccaccgtcgcgcgcggctccctgaaccaccaaaccaacgctgctgctgctgctgcagagagggggcgggcgcgatgggcaactgccaggcggcggaggtgtcggcggtcatcatccagcaccccggcgggaaggtcgaccgcctctactggtccaccaccgccgccgaggtcatgcggaacaacccggggcactacgttgcgctcgtcatcctccgtgttcctgctgataatagcaagcccgccgccggggacgccggggcggcgtcctccggcggtggcggcggcgccaagatcaccagggtcaagctgctcaagcccaaggacacgctgctccttggccaggtctaccgcctcatcaccgcgcaagag

SEQ ID NO: 291 - DNA, 637 bp, Sorghum bicolor
  Clone ID: SORBI-28MAY03-CLUS107551_1
ctggtttgcctgccctgtcttgcccagttgcccagttgcccctgtcggaatcagtccaggttcaggtcggcagtgggcagtggttcaggtcgaggcctcgacgacgaatcgcgctgcgtcccctcctccccgcctgcttcatcatggaagccgacgtccccattgccgctgctacccccaggtacggagcaagcctaagccaatagctgcacccggagacacagatttggagtattgagctggctctctgttttgtcggttgtgtgcttctacttcatagaaaagagctgcattttcttcttagtgctttggatgctggccagatgaagagtagtagatttctgttcctttgtgcaatgttctgtcttatggctcggctgggagctgccaatgtcgtgctaatggggaataatctgaccctgtccttcgatgacattgaggcgagcttttctccaggagtgaaagggtctggagtcagtggagtagtttatgcttctgaacctttgaatgcctgcagcccattaacaatcaaaacagtcaatggccctccatctccctttgcgttaattataagaggcgggtgcacatttgatgagaaagtaaaaaatgcacaggatgctggattcaaagctgcaat

SEQ ID NO: 292 - DNA, 658 bp, Sorghum bicolor
  Clone ID: SORBI-28MAY03-CLUS107572_1
gcacgaggaatcccttgcagtggcaatccaaattccttccacgcggtcactcaagcttctatccaagtcctaattaagacctcaatcattcttcacgtcacacacctggcacagcaccactcaccatgtcaaacgaatccctccaagaaacaaacaacaaggctctcggcacaacagccggcacattccctatcgtcacactccccgatggccgaaaactacccaccggaaccgttggtgccctgctggtcaatatcaaatcctacgacgaggcaacggaagagcgacgcgctgagttggagccagcgatccagtcggctatcccgacattggtgaaagtcggaatgtttgatctgtttacgccacaggagtgggcatcgcaacgtagtccggggcggagtttggtggggaagttggcgagggagttccttgaggcaagtcaatgagatgataggtaccagggcttgttgagcttggatggatagtcgtgactttctagtccgacagaaggttccattaatccggcatgggcatgcataggggttaatgaacatcgtccttgcatcaccggtcgactattgcgtcttgataagcagcccgtgataaccatggggccgaagagcccagtcatttctcaatgacattatttctgagtttt

SEQ ID NO: 293 - DNA, 582 bp, Sorghum bicolor
  Clone ID: SORBI-28MAY03-CLUS107585_1
acttgtctccaccaatcagtataaggtattggtcgtcccatgtggcgcattcagggtatggatcacccagtccacacgtgagttcatcctacatctccaattctgggtatggttcttcaagctactgctatctgggactgggaggctccagccacagccagcatgggacatacctaaggcgctgtggagaatcggggccaagcctgtgtaccatggtgccgcagcagttgcagtgggagactaatgtagcagcaggtgcgtcgtcagcaaagtccctgcggcagtcctcctacctgagacactgtggcgattcagacgccagtttgtctgacatgacgtcagcccagtcgttgccgaggtgctgagggggctctggatttgtgatttgtgcattacacagtgaggagtgtgtgacataacattactacattggctgtggtgtggagagaaacatgcatagcaatagaacatacacatagtagcacatagtagggttttgttctcttgtttctgagatgagatgtgttcttgtgctcgcgatgcgtacatatggcaagtaacatgcatgagggaataatattt

SEQ ID NO: 294 - DNA, 523 bp, Sorghum bicolor
  Clone ID: SORBI-28MAY03-CLUS107595_1
tcatcttcgtcaaggagagaaaggaatggaacgcctttatggcggggtacaggaggcagggcaagagagcggggcagttgatgaagctgaagcagaaggacacggagagagggtggagagacgcctggaagcgcaagtgcggtatggaggagagcagtggcaaagaagtcaatgccggccccatgtgggtgctggtcaagagcgcggttgcgaagattgtcaagggcgaggcctgaaacggtgagatggatgaccagtgtttttgcactttgtgcagtcagagtgaggcggagagggcaaaagcctgggcgagcggggtgcgggtggacatcagcaggtcagcggcatctgaagggctaggcctcggcgtttttctcctttgcatcatttcttagcgagcattttttagacacgaccttttatgatggctgggggcggtaagcgcgtgcgtagcgccaacatcgccctctcgagagtagatattagagcatctatctccactaaaacaaacacacaaaagtct

SEQ ID NO: 295 - DNA, 699 bp, Sorghum bicolor
  Clone ID: SORBI-28MAY03-CLUS10777_1
gcagtttccaaaatatccaagcagaagttgggtcagagaaggtaaatgtacccttattgcacgtaggtgcacacgaaggataggattggatagtagttcaccggtttttttaaggtactcgaatgtggagacgaggagctgatgcagagggttatgctgcaaacttcgttgaatcagagcagatagatgcagtcaaaagggtttacagcatcctatgtacaagttcgaggttctatgccattcttgtgggagcagattgttgatttgacatataaacctagttttgacgttgttagacaagaggaggcggtttaattctttatctcattccttgtttaattctttatctgttgctttaatggcactatgcctttctgtaaaattatatgctatctgtttctgctgttcagcctcgtgtacttgagaggcacttccatgacttgcaaaagaaatacggagctgtcttagctgttgatcttgtcaatacaagtggtggagagggtcgcctccgtgaaagatatgcaaaatctattgaacctattcttagtgaagatataagatatgtgcactttgacttccaccgagtttgtggtcatattcactttgagcgcctttctcagttgtatgatcagatcaaggactatcttcagaaacataagtacttccttataaatgataaacaggaaaaaattgagcagc

SEQ ID NO: 296 - DNA, 596 bp, Sorghum bicolor
  Clone ID: SORBI-28MAY03-CLUS107847_1
gcggccgccgcagtgcgtggtgttcagcgtggggaagctgaaggtgaacgggatcagcgcactgtgctcgtttggggtcgcggccgccaccgtctgcatcttcctcgtcggcggcaggctgcagcatcaccaccacaggcagcaggagcagcagaagatccagctgcagttctacggcgatgataagaggatccagcaagtggtgcagcagacatcgaggctgaaccaggccatgtcgtctgtgatgggggcaggaggagcttccacgagggccaacatatccttcggtggcttctacgatggattctgatggatcagaacagagtatcatcgtcattcatcaagcacaaagttgccgtggtagcagactagcaggtagcaactttagttgtgctacggccaagtgatgtgaaactctgggtgtatactaatactgccacgcacgtacctgcacataccgtgtggtggatgtaaataattgggttgttattagactttggtttaattaagacagataaggatggattataggtttatttattcacgttgatataggttatgcttaatggagaagttactaactaaacgttgacccc

SEQ ID NO: 297 - DNA, 511 bp, Sorghum bicolor
  Clone ID: SORBI-28MAY03-CLUS107873_1
ggagctaaagccgccgccgggatggaagcctggagatccgatcacgctgccacctgatgagatactacctggtatcaagggcgaagagccacaggcccctgtgccacagccacatgttccagtgcgaccagtggcgccaatgggcgcagagccaatacaggtccagcctgtgcagcttgattttgatagcagtagtagtgatgagtacagtagtgacgttgggagctcagaagaagatgatgaggattagtgcttggtaagctgctcctttttgttggctttcaattgtaattgccttctatcatatgcttgggcttttcgagtagaatcttctatgctagcgattttacctcctcatgtcttcctgactacttatgaactttaggtctgatctcagatcattgtaagggtgctttatcctgaacttcataaatcagtgtattctaccattgattttacttattatatatgcctagtatcaattgtttaccttaaaaaaaaaaaaaaaaaa

SEQ ID NO: 298 - DNA, 582 bp, Sorghum bicolor
  Clone ID: SORBI-28MAY03-CLUS107889_1
gcacgaggagcagcagccccctcatcagccatggcattcaagtacatcgtgttcgccgcctgcgtggccgtcgtccgcgctggtgtgctggctcccgcacccctggcctacgccgccgcccccgtcctcgccaaggctgccgtcgccgtcgacaccgactacgaccccaaccccagctacaactacgcctacgacatccacgactccctgaccggcgacgccaagtcccagcaggagtctcgccagggtgacgtcgtccagggctcctactccctcgtcgagcccgacggcagccgtcgtaccgtcgagtacaccgccgaccccgtcaacggcttcaacgccgtcgtgcacaaggacggccccggcgtcgctgtggctgctgctcccgtcgtcgctaaggttgctgctccggttgcctacgccgcccccgcccccatcgcctactccacccccatcgccaaagtggccgcccccctggcctactctgcccctctcggctacgccgctgcccctgccatctaccaccactaagttaaacatgcacctattatttctcacctaaaataaaaaaaactaaaattt

SEQ ID NO: 299 - DNA, 695 bp, Sorghum bicolor
  Clone ID: SORBI-28MAY03-CLUS10791_1
gccggccgggccgggaagtgcaggtttggttgaataaattgacacaagcaagaggccaaagcagcttacagagaacgaagctatagctagctgaaatggaggctaggagcttactggtggtgatcgtcgttgggtgctgtgcctgctggggttgccgcgcgcagatcccgatcccggcaaggatggacgggttcgtgtacggcgggaagccgccgccggcgtggggcgagacggtggtggtagaggcgttcttggaccccgtgtgccccgacagccgcgacgcgtggccggcgctgaagaaggtcgtcgaccactatagcaaccgtgtgtccgtcgtcgctcacctcttcccgctgccttaccacagctatgccttcattgcgtgccagtcaattcatgcggtgaacaagctaaatccgtcgttcgtgtaccctctgctcgagaaattcttcaaggaccaggaaggttactataatcggccaacctacggaaaatcaagagctacagtagttgacgaaataaccaagaaccttgttgcgcccatcatcggtgaaactaatttggcggcatacaaagcaggtttcaatgattcacaatctgatatggccacaaggatatctttcaagaaacgctgtgcacgaggtgtgactgggacaccctactttcttgtgatggcatacccaatcacgattccg

SEQ ID NO: 300 - DNA, 1059 bp, Sorghum bicolor
  Clone ID: SORBI-28MAY03-CLUS107895_1
ggcagattttattgtggaggaagatgaaatcgatgggaatggacaagttgtaaggaggaagaaatataaaaagaaggtgccacggcaagcagcaggtgtatcgtcatctgctctgcaagaggcccaagacatttttggtgatgttgatgagttgctagcactaagaaagcaagagcttgagagggaggctgctaactccagtgagttaagaggggcgaggcttgaagatgagtttgagccatttattcttgcagagaagtatatgacaacaaaagatgagcaaataaaagaaaatgatgtccctgagaggatgcagttgtctgaagagttgactgggtatcctccaacggataaaacgatgattgaggaagagagtttatggatacacagccacctaactggtgatggatttctgtccttttttggcaatgagcgcatgaacaaggatattgaccagaaggacattgttaacgtcgtgaccatgttgcatgtcaacaaatttgaaattccattcattgcaatgtacagaaaagagaattgtccaaccctattaaaaagccttgattctgatgagggcaatacaatcatagatccatatcatcagctatcgggtgttaagtggttgagagagaaaccacttagcaagtttgtagatgcacagtggcttcttattcagaaagcagaggaagaaaagctcctcaaggttaccgtaaaattgccagaagatgcaaagaaaaaactcatgtctgaagcacgtgagaattatctaagtgattgtgtcagcaagtctgcacaactgtgagatgcgaccacgcgcgatgctgccggatgttgtcaatcgagaccgcgtggcaggacgatcggcttattcaggtggataggttagcttatcgatgagctctcgctttcgagtgactggtgaaggaaatggaccgcgcacaccatgtggttttgtacatatcgcatcagtaggcatcgtatcattgaattctctgaatcaatcatttgcgctatactgattagctgtgttaataagccagtgaaaatcggttttttgct

SEQ ID NO: 301 - DNA, 277 bp, Sorghum bicolor
  Clone ID: SORBI-28MAY03-CLUS10792_1
gcgccaagttacagccccacctcaccagtttatagccctacatctcagcatacagccctacatctcccgcatatagccccacatgggcatcttacagtccaacttcgccatcttatagccctacatcaccatcatacagcccaacatccccctcatacagccctaccttcccctcatacagccctacctgccccttatacaggcctacctccccctcgtacagcccaacatcacctgcatacagccctacttcggcaggatacaggccaacatcatc

SEQ ID NO: 302 - DNA, 491 bp, Sorghum bicolor
  Clone ID: SORBI-28MAY03-CLUS10810_1
gcgggatggtcacatgcagtgatgaccaaacgttaaagatatgggacaccagcgctgatttgtctcaaccaaaaactggcgaaggccatgaatcttggcaacacctttctactctcacaggatatcatggacgaacgattttttcagcccattggtcaagcgaggatattatagctagtggtgcgggtgacgatgcaatctgcctttttactgaggagaagagtaccatggttgagaggccctcatacagattaatattaaagaaagagaaggcacatgttatggacataaactctgtgcgatggtgtcctcaggacccaaggttattggcatccgcgagcgatgatggcatggtgaaattgtgggaactgagagggaatgtactggattgagtttgttctatttactgtagtgtaccttgagattatagaacagattaggcatcacctttggattctgttttactgagctctgctcactgagtccatact

SEQ ID NO: 303 - DNA, 589 bp, Sorghum bicolor
  Clone ID: SORBI-28MAY03-CLUS108137_1
gcacgaggcgccggtccgcacccgcccaccgtccccgtcatcctctgccgccgccgccgccgccgcgatgagctactacggccagcagcagccgcccgtcggcgtgccgccgccgcaaggttatcccgggaaggacgcgtacccgccgccgggctacccgcccgccggataccctccgccggcgcagggctacccaccgcagggctacccgccgcagcagggctacccaccgcagcagggttacccgcagcagggttacccgccgccctacgcgcagccgccgccgccgcagcagcatcagagcagcgggccctccttcatggagggatgcttagccgccctttgctgttgctgcctattggaagcctgcttctgagatccaagctgcgcacagcttgttctggaaaaccgcttggcacacttgatataactgggattggcttgttagtgaagaaccgaagataccatgagtccataacatctctcccatctcctatcgttctgtttgtccgttgaaatgtttggtgtacctagcatcatcttatagtttatgttttccaatggaattcatggaatcattggtttagct

SEQ ID NO: 304 - DNA, 437 bp, Sorghum bicolor
  Clone ID: SORBI-28MAY03-CLUS10822_1
gtggctttcctcaccggtcacaggcgagctccgcaaaaaatcgcatggcgttgccgttgcagcacgcaagtccaggtagctccacactgaccaccaccggccgtcatggccggagctccgcagccgtcctccgtcggccaccgacggattctagcagccgttggagggtgcacgcgcagaagcccgccgcgggatcccgtggcgcgggagccgagacgacgaccgcgacgtcgtcgtcgtcgtcctcccgctcggacaacgccgtcctcaaggccgcctggtacggctcggagctcctcggcatcgccgcgtcgctgttccgcccgcgccgcgtcgtttccggaggggggcgctgccggtggcggtgatgcggagggaggcgcggcggcggggacggcactggatcgccccggagtggtcaaggccgtcaaggcgga

SEQ ID NO: 305 - DNA, 634 bp, Sorghum bicolor
  unsure (1)..(634): unsure at all n locations
  Clone ID: SORBI-28MAY03-CLUS108232_1
aggcgggcgacgagacggcggcaccagcgcgtcgggcaccgtccgtcgcactcgcaggcgctcgtcccggtgcaggacaagagcgtggtgatcagcgaggagaaggagaggcggcacctccggcgagccgcgacgacggacaggcggccaccgccgcctccgccgccgtcgtcggaggaggagatgatcgacgagaaggagagcgagtactcgaggctgtcggacgaggagctcaaccggcgcgtggaggagttcatcgccaggttcaaccgggagatcaggctgcagctggagaaggaggagcaagccgccgccgcctgacgcgacgcgactgacgccatgcgcacatgcacaacaaccacttcgatcgagtccgttctccgttccatggcgcgccgccgccatgtccggccgccagtcgtttgtatagcagagcactccatgtcatgtcatgtccggccgccatgtctggctgctaggatcttgcagatcatcatctcttttcncatgtgtgtgtagcagagcactccaagatgatcgatcttgtagttgtagcagagaagatgatgagtagtgaggatttttgattttgtaagcaaggcgcgcacgcgcgcgtgggaataaactaaggatt

SEQ ID NO: 306 - DNA, 508 bp, Sorghum bicolor
  Clone ID: SORBI-28MAY03-CLUS10828_1
cgtccccggagaggaaagcgtctctcgctagcgcgttcagtagaaaccctaaaaaaaaccccgcttcctcgcctcgcccgcggagccgcactcccctcgacgggggtaagggctacgtggtcgccgcccgccatggatgcgttccggaagcagctggacgtgctcatgggcgcaaaccgcaacggcgacgtcgaggaggtgaaccgcaactactacgaccgcgacgtctgccgcctcttcctcgcgggcctttgcccccatgacctcttccagctcacgaaaatggatctcggtccttgttctaagattcactcgcttcaactgcggaaagattatgaagaagcgaaagcaaagggaacagagaattttgacagagaactcgaggatatgatagaaaggctcattgtggagtgcgacaggaaaattcagagggccctgaaacggcttgcggatgatgatgccaaggctgctattgcaatatctgtctctgaggttactctgacggaag

SEQ ID NO: 307 - DNA, 614 bp, Sorghum bicolor
  Clone ID: SORBI-28MAY03-CLUS108304_1
gcacgaggccgcatctgcgacggccacgtcgtggtcggcgctgccgcgtcctcgcggagtctggtctgtcggcggtgcgtactcgacctgctgcatcgacgccgacgagtcacagagctcaccgggaaccgagggcgacgacgccgcggcgtccatgccatcctgaacgcccgcacgccacggctggtggttggcttccgctgctgcgtttgcctgttgtgaccccaggttgttgtcggccgcggcgtccgcctgctgcgcaccgccggcgtcgccaaacgggtgcacgggctggacctgaacgcctggccggcggctcggcgtgggcttcgggtggttgtgcgcgcccttgtagatgatctccgtgatgtgtccctcgtgcgagcgctccaccttcttcttcaccgtgggcaccggtgccagatgcaagacggctaagcttgaagtcatgaggaccgccgatgttcatattagtctgcacattgtgattctcctggttcagttggcccagcaaattagcttcttgtactagctgagtcttagttttagtcttgacagaaacctgcgtattttgttcctggtggagcaaatatgaattaactcgtaacgaagtg

SEQ ID NO: 308 - DNA, 621 bp, Sorghum bicolor
  Clone ID: SORBI-28MAY03-CLUS10829_1
cgtacacacacaaagacaacgaacactggagcgagtagagatagtaccggcttgttgttgtgtgtgtttgctgtcatctcgacgacgacggtcatggcgaaggcgcaggtggcggcggcgaggttcatgacggaggtggcgccgccgccggtggtgtcggtcatgcggcggaggaagcaggcgccgtggtgcctggacaccatcgccgaggacaccatcgccgagcagctggtggcgtgcgggtcaccatcgtcgacggactacggcttcgcggcggcgtggtcgctcaagaggatgccaccaccgcatgcgcatgcgcagccgcgggagcgcgcggccgggtttgtgggcaagtacttctccgacgcccatggcagccagcagctggtcagccgccggcgagacgtgcatgcgcaggagttgcacaaggtcggagcttgaagacaagagggggagcatagtagcaatataatgagccaagcttgttgggagagtatatttttagtttataccacttccccacgtgcgttcatgcacgataatttagcaaagtgcgcacctcaacgattctctatgcacctccttattattcatgtactagtgatgcacatattgatatgc

SEQ ID NO: 309 - DNA, 737 bp, Sorghum bicolor
  Clone ID: SORBI-28MAY03-CLUS108436_1
caagaatcaacaccgtcatggccacggccaccacgtgccgcctcgtcctcctcctgcctctcctctcgctcctcctcctccacaccgtgtcggcgttcgactccggcaaccagccccagccgagcgcgtacgagatgctggaggggttcgggttcccgaggggcatcctgccggagggcgtgacggggtacacgtaccggccgtcggacggcgcgttcgaggtgttcatgggcggggactgcgagttcgaggtggacggcggctaccgcctcacgtaccggcgcaggatctccggcaacgtggagggcggcagcatccggaacctcggcggcgtctcggtgcgcatgttcctcttcaactggggcatcgaccgcgtcgtcatggaggacgcggaccgccgcctcatgttctacgtcggacccatctcgcaggcgttccccgccgacaacttcgtgcagtccccgcagtgccgccgccacggtggagggaacggcggcgtggatgccccccccgtgggcatggcggcgatgtaggatgcctacgttgggtatgtacgtgacggaacggaaaaaggccggaggaagatcgaacgatcgagatgtgttgattcaattgtacgtacgtgtacaaattcaattttctttgttgcaaatgatgaggcgctttatttggctatgaagagattagtgctagctttgcctctaatcgaagtgacaatgattattgcgtaggtgttt

SEQ ID NO: 310 - DNA, 743 bp, Sorghum bicolor
  Clone ID: SORBI-28MAY03-CLUS108450_1
gcacgaggcagcgttctggtcgcagaatcgcctcttcctgtccgccgtccgccggagcaccgccgcaccggaaccgtcgtacgcctccgtgccctcgctggcggaggcctcggcgcaggccgcagcgtggttctgactcggtggccggcagagctgctgcctggccacaagaagctgtccccctcccagctttgtaccggttccgatcagagtatccgcaccacggaggagcccccgcctcaggagtctctcttagccgcgatgaaggtggagctcaccgcgcggacctcccagacgagcaaggcgggggaggagaccccgccgccgtccccatcagcctctgctgcgtcgcccccggcggaggatgcgccgctcctccccgatgcgggcgtgcggcgccggccagcgtgcgggcggttctcgcagcgcagcggctccttccgccgcgaagtcagccgggccgccgccgagaccttcctcctcacaaggctcactttgatcctcctccgctacctcgggataggctacagatggatccggcagttcctagccctctgctgttataccctcttgctgatgccaggttttattcaagttgtatattattatttcttctctagccaagttcatagaagtgttgtatatggagatcagccaagaaacagactggacctgtatattcccactagtacgacagggttaaagccagttgtggcatttgtgactggtggagcgtggatcat

SEQ ID NO: 311 - DNA, 460 bp, Sorghum bicolor
  Clone ID: SORBI-28MAY03-CLUS108453_1
gcacgaggcgacgacgagaccaccgggatgagcatggacgaggcctacgcgctggcgctgcaggcgcgccggcggccggagcgggagagggaggaggaggccaggaggtccgaggtggacgccaaggccgatgagttcatccgcggcttcaaggaggacctgcgccagcagcgcctcaactccatcttcaactacacccagatgctcaagcagcgggcactcggcggcgccgccgccgcccgcaggcagccagatcagctttgagtcacgtgatcgatttgttcatttatttaagatatattggtctgcgttttcagggagaccaaatcagttttgagttgctgttctagtgttctgtacatagacatagggctgctttcaacagattgtttgtatagtttgaacatattgtttgcatggttttatttcttcttctttcgcaaaaaaaaaaaaaaaaaaa

SEQ ID NO: 312 - DNA, 354 bp, Sorghum bicolor
  unsure (1)..(354): unsure at all n locations
  Clone ID: SORBI-28MAY03-CLUS108464_1
gcacgaggctgtcccgcatctctctccgagtctcctctagtcgctcccgccggccgcccgcacgcgcacgcgcacgcgcccgccggccgctgctcctcctcgcccaccggcgacctccgcccacacacgcctaaaccctaaacccttccgtattccactgtccgtatcccccctttcctgctgccggcggcagcggcgcagagaagaggcagtccgccggcttgatctgaagcatggacaaacaacctgatgcgcggggggcggagaaggttgctgaggagaagcaacttgatgagaaagagttagagaggaagctgtnnaananaaaaaaaaaaaaaaaaaaaaaaaaaaaat

SEQ ID NO: 313 - DNA, 731 bp, Sorghum bicolor
  Clone ID: SORBI-28MAY03-CLUS10855_1
gcacgagggggcgctcttctactggctcatggaagcctccggcgtgccggcggactcggcgccgctcgtgctctggctcaacggcggacccgggtgctcttctgtaggctacggcgctatggaggagctcggcgccttccgcgtcaaccccgacggcgcgacgctctcgttgaatccctacgcctggaacaaagtggcgaacgtgctgttcttggactcgccagccggcgttggctactcctacaccaacaccaccaatgatctgtacgctgccggtgacaacaagacagctcatgactcgtatgctttcttgataaattggttggagcggttcccgcagtataagtatcgtgatttctacattgctgtccggagctatgcaggccactatgtccctcaactgtctcgggtagtgtatcgaaacaataaaggaaccgagaatccaaccctaaacttcaaaggtttcatggttggaaatgcggtaactgacgattaccatgactacatgggcacatttgagtactggtggacacatgggctaatatccgatgaaacttatgtgaagttgtggtcgacctgtaaatatgatgcggctcagcacccctccgaggaatgtcaaaagatctatgaagttgcatatgatgagcaaggggatattgatttctatagcttatacacgcctacttgtaagaagacttcattgcttaagcgcaggcaaataagaggaagaa

SEQ ID NO: 314 - DNA, 452 bp, Sorghum bicolor
  Clone ID: SORBI-28MAY03-CLUS10870_1
cggacgcgtgggcaaaaaccaaaaaatgccgccgccctccgccgccgccacttccaccaccgcagccgccagcgccgcgagggacgacatgtccccggcggaggcccggctggcgatgatggagctggcgaacatggtgtcggtcccgatggcgctgatggccgtaatccggctgggcgtccccgccgcaatatgggctggcggcgccaacgcgccgcggtcggcggccgagctcctcccggcgggccacccggacccgtcggtcctggagcggctgctccgcctgctggcgtcccgcggcgtcttctccgagtccacgtccacgtcggaggaccggacgacgacgacgcggcggttcgcgctcaccgcggtgggccgcacgctggtgccggagggcgcctcgggcgcgtcgtacgccgactacgtgctgcagcaccaccaggacgcgctgg

SEQ ID NO: 315 - DNA, 726 bp, Sorghum bicolor
  unsure (1)..(726): unsure at all n locations
  Clone ID: SORBI-28MAY03-CLUS10867_1
gacgactggtgggctaccgccgccgccgccgccctacaccaggtgcccaggccttctcggtctcttcgccggcgacgagcacccaccaggatctacagggaccatggatcaagaacaaaaactagaagtatctgatgccgtgtacacttacaagcatcattgtagcgtaggagttgatgtccacgaggtctttgttaagaggagcagattgcgggttgttctgtcatacattggcattattttccttcttgcaaatgtatgccaaccattgctggcaaaggagagcctatctcttggatcagtttggaatattacctttgccgttcttgttgccaaatgtttgcaatataaacctgtgaagagagaatcagtagtgataatgccagcttttggggttcagctagagatacatttttggaggtatgcgtaatcctgatctgaataatagatcatgctccattttgttcccttactgtctgtcctattctctatcttatatgcacatccatggtcctcgataattggagaatagaagcttattgtactttttggagtagggactgtacactgtagtataacatgcattaaatagaactccactcagaanagaagagagaaagaaggtactctctccattcaaaactatgagtcgtttcggctttctaagtgtgtaatttttgctatgcacctggatatacgctatgtctacatacataacgcaagtta

SEQ ID NO: 316 - DNA, 559 bp, Sorghum bicolor
  Clone ID: SORBI-28MAY03-CLUS108799_1
acggagacgcggtgggaagagcttcactgccgccggatcagttcattcaatccttcaagaagcccctgcagacgcctgttatccagtttactccacgactgcgaacaacgcggcgcaggcactcggggggggctggccccatgaggagcgcacgcctggcggccaaaagcgggcacagggagcccaagccggaagctcaagcacgcaagatcatgatgaagaaactgggcgtgcacgttcagaccgaagcgcctgatgaagcgtccttcgatgagtttcagacggccttcatcgagccggtgcagcaaacccctagggaagcgatggatgccttatttcaagtcaggaagcagcggcccctggggcccgttagcgccgactaggcctcccccatgctgttcgtcgtttctttttgtgcattatgttgccaaatcagattttcttttggaatgtgcgcggcctaaattcgagggcgtgtcgtgatgtagtgcgcgagttcttgttacaggaacgcgcctctgtcgcctgtctcactgagactaaaattgttgtactccgg

SEQ ID NO: 317 - DNA, 536 bp, Sorghum bicolor
  unsure (1)..(536): unsure at all n locations
  Clone ID: SORBI-28MAY03-CLUS108815_1
gcacgagggttgattgatgttgtgggtcgcgttaaggaagttagcatggatcaatatggaagccggtttattcaacaaaaactcgaaattgcatcactgnngatgttcgggaaaaaaatatttccagagatattatccaatgccattgctctaacaactgatgtttttggcaattatgttatccagaagtttttcgagttcgctacagaaagtcagttaatccaattggcagataaactcaaaggtcacattttggaactcagcctccagatgtatggttgcagggtagttcagaaggttttggaggtagttgatatggatcgaaagatcgacattgttcatgagctcaagaattatgttctgaaatgtattggtgatcaaaacggtaaccatgtgatccagaaatgcattgagtgtgttcctgaagaccgcattccgtttgttattgatcctatactttcacaaattcttgttctatgcacccatcaatatggctgcagagtcattcagagagttctggagcattgccatgatcc

SEQ ID NO: 318 - DNA, 590 bp, Sorghum bicolor
  Clone ID: SORBI-28MAY03-CLUS108852_1
gcacgaggcagcgatcaccacccagatgaaggtgcagctcgtggaacaggagggctccaagaggatgggctcttccgggtgctcggagatcgtcgaactggtggacgagccgaaggatgctcgtccgggtgggcttacccacctgagggtgagggtgaagccagtggggcaggagcatggggcgcggtcgtgctcggtggaggatgatcttgaccagctcatcagatcgatcaacgtgcgcacgtcggcgagggcttctgggcagacgagcacggatcggcggcttattgcgctcgggaagtcgccggtgtcgagctcggagattgtggagtctgtgagcctgaagcaggccctgaggaagatgtgcatctcccaggcgtcggagatggcagccatgaagaggctttcgaagccgacaggggtgtccaccccttctgattctgggccaatcaagaagctatatggctctgttgcagttcaaatcaacgaggagcaagatgacaagagtaaggcggggaaagtttctatgctgcctgagaaattggcaggaagttcagtgggtaagccaagtggaatcggtaaggggcaga

SEQ ID NO: 319 - DNA, 629 bp, Sorghum bicolor
  Clone ID: SORBI-28MAY03-CLUS108873_1
gcacgaggaacaaggcagcgcagcagcaacagcgaggctgcgtgatggaagaggagatggaggcggcgctcctgccgcggccagagtcgccgctctgcgcggtggaccacctcggccgtccggcctcacgcggcgactccggccgttggcgtgctgcgctcttcatcatcggcgtggaggcggcggagcggttcgccttcttcggcgtcatgggcaacctgatgatctacctgaccggccccctcgggcagtccacgtcgtcggccgccgcggccgtcaacgcgtggcttggcaccgcgctcctgctgccgctgctcggctctgccgtcgccgactcctggctcggtcggtaccgtaccatcgtctgcgcgtccatcctctacatcatagggctagggatgctcaccatctcatcagttcttctgccatcagagtctgtgggcaggccgaagtattcgtcttctgttcctatggctctcttctacctgtccctctatgtggtggcatttggtcagggtggccataaaccttgcgcccaagcatttggagcagatcaattcgacgagaatgaccctgcagaactggcctccaggagctctttcttcaactggtggtacttcgctgcatat

SEQ ID NO: 320 - DNA, 501 bp, Sorghum bicolor
  Clone ID: SORBI-28MAY03-CLUS10914_1
cttcctcaggaaaacaaagacagagagaaggactaggcgtggaggccaggggcgcgctcctgccatggcgctctgatggccggcgcgggcggtctagccagggggctcgcgaccttctgcggggtgtggccagcgtggcccacgaccctggcttgtgtggccccggaggtggcctgcggctccagcggcgcggctccgacagcccggccagaggcgcgggcctggctcccggcggtggcctgctcggccaggggcacgagcggcggcggggccctctcgtgggcgcggtggcccaggccagggagcgcgcggccctcccctgcgggcgcggttcccgggggctggcagggcgcgtggctcgcccatggccggcgcgggtcgttcgaggggtcatggccctccaggcgggggcggctcaccctcagccacggtgcgcggcggccagccggccagctcgcggcctggcgcgtggcagtggcggccggctcggctgggccaggg

SEQ ID NO: 321 - DNA, 599 bp, Sorghum bicolor
  Clone ID: SORBI-28MAY03-CLUS10793_1
cttggatagcataaatgtacaaacacatggatttagcagggatggaattcctgaagctggtgcacagttcgaatagatgtgtttggaggctttgtattgcaaaggattacaaaagaaaaaagctttttcagggcaatagctaatatggatattaagctagattttgttccaccatggttgatcaacttcatatcgaggcagctaataggcagtgggcataagctgtatcaaaaggctgtcagtactgtggccactcatgatgatgactacaggaaagctttgagaggaccactctatgtcaggatccgtgaataccaggattctgatgacaaggcaaaggtgaccgcagcagaggaaaatgctactgaggtgccctctgctaatgccactatacaaaatcatttgtcactaacaaataccatatcgaatagcgagattgtggaggagactgaacagaacacatccatcaatgtggataatcttacaactagccatccctatgaaccagttgaacaagcgcaacaggtcgaaaataaaccttatatcagtcctgaggtagagcgcgcaatgtgtatactggacactgctattgcagttct

SEQ ID NO: 322 - DNA, 230 bp, Sorghum bicolor
  Clone ID: SORBI-28MAY03-CLUS109193_1
gcacgaggatcatttctccccagagcgcacacgaacgaaactcgctcatccttcgcctcctgcagccgatccgtatttagtttccgtgcccacccaacccaaggagatcgatcgatgggaaactgctgcctcgagaggcctcgccgcggtggcggcggcagtgccggcgccgtgcattacgccaggacgaaccccgtgtgggtggaggaggaagtgaggggtaggaagga

SEQ ID NO: 323 - DNA, 392 bp, Sorghum bicolor
  unsure (1)..(392): unsure at all n locations
  Clone ID: SORBI-28MAY03-CLUS109228_1
gcacgagggttggagccacggcagccactgtggcggctgtggccagacaccgccgttctggccaccgcagccgcctgtctggccgcctccgtgggccggctgcaatgtcgtcgccgatgagcacgcgtgccctgcctggtgatcctcggttcgccatgcattggcctgttgctgctgtgctgcgattagtgctggacctcgcagacctgaataataatctgacactaagttcggtcgtcggtgccattcgtgtgcattatacgaattaaacattttgtcatgccttgttttgtacacgtagtcattgtgtgctagcttccaactacgtacaattaatttgccctttgtaatgtgatattcatgtcttcgtacgagtttttcgtaangggggg

SEQ ID NO: 324 - DNA, 372 bp, Sorghum bicolor
  Clone ID: SORBI-28MAY03-CLUS109307_1
gcacgaggccatctcgcgcttctttgtcctctgtctcccttgctccatagcaggaacgcccgaggcgaccgcatctccaagatggtacgcttcctgatccggccgcccgcgtgtttgtgtcgcttcctcatcccgccgccggtgtgtgcctctcgttcttttccgcttcgcggtgcgcccttggaaatcggagcaggtgctgcagaacgacatcgacctgctcaacccgccggcagagctgcctcgtccagtctcccaactctttcttcatggtatacctttttatacctgttcatttatgaccttttctcattctgcgtgataggatggtgcaaatcatggccctatgccaagaataaagcataaatttgt

SEQ ID NO: 325 - DNA, 500 bp, Sorghum bicolor
  Clone ID: SORBI-28MAY03-CLUS109315_1
gcccgacgctgggatctccggccccggatcgcgctccgcgtcgccgagggccgcgcctacctccccgacgtcggcgtggcctcccgctcccacggtccttgcgagcccgtgcgccggcgccgcggcgcggactgccgcgcgccgagcgcgcacttcgccatggctttgcctccgggccgcgggttctgctctccgcgggccgcgctcccaggagcctggggtttgcgtgcccccgggtgggtggctggtctgccgagctccctggatcctgggctcggtggctttgccagcgtcctgctgctggttgtctccgggagaggggcctgttggtgcatccaggacgaggaggatgacaggccatcgatggcccaaagacactggaattcctccggttccgttttccttcatgaaccttattgagggtgagagcagcagtacattttcggaagaagggtaatattttttttactgtatatgggtacaattgattaagatatggt

SEQ ID NO: 326 - DNA, 473 bp, Sorghum bicolor
  unsure (1)..(473): unsure at all n locations
  Clone ID: SORBI-28MAY03-CLUS109321_1
gnaaaagcagaccaatagccaccacggacacagcagcctctcgccgtgtaacgcaacaggcagcggcaagcaccagtgctaagccaaaacaccccacaacacacgcagatctcgatcactaacgaccccatactaccatgggttctctcggcagcgccgcgcagcagccgcacgccgtgtgcctgccgtacccggcgcagggccacatcaccccgatgctcaacgtggcgaagctgctccacgcccggggcttccacgtcaccttcgtcaacaccgagtacaaccaggcgcgcctcgtccggacccgcggcgcggcggccgtggccggcctcccgggcttccgcttcgccaccatccccgacggcctgcccccgtcggatgacgacgacgtgacgcaggacatcccctcgctgtgcaagtccaccacggagacctgcctcgagcccttccgccgcctgctcgccgacctcaac

SEQ ID NO: 327 - DNA, 276 bp, Sorghum bicolor
  Clone ID: SORBI-28MAY03-CLUS109331_1
gcacgagggagcgcctgcccgtcgtgtggtgcgccaggtgcgcctgcctgatgggctgggggccggctggcggtgcatgctggccatcgtgctggcaggctgccgttgctgcctttctctctggtgtgtccccgtggtaccctgttgccccctcgcggccacttggaacgctggggtgcttcttgctgggagcgtgtggcctggctccgcactgctaggtggcatgcagggtgcctctttcctaggtcgctgttccttttggccgtggtatcacgg

SEQ ID NO: 328 - DNA, 561 bp, Sorghum bicolor
  unsure (1)..(561): unsure at all n locations
  Clone ID: SORBI-28MAY03-CLUS109334_1
caaattccccttccgcgcctggctcgccgctggggtttctaggctaccgcgtgccgtcctctcctctcgccccccaccaccatggccgaggaggcccaggctccgccgtccgccaccatggcgaaggaggcccagtcgccgccgtccgccgccgtagcggaggcgacggctacgccgcagctcgtgttattcaactccttgacgaagagggaggagcccttccagccccgggtggaggggaaggtanggatgtacgtctgtggcgtcactccatacgactttagccacatcggccacgcgcgtgcctacgtcgccttcgacgtcctctacaggtaccttaaattcttggggtatgaagttgaatatgtccgtaatttcacggatatcgatgacaagatcattaagcgtgcaaatgaacgcgatgaaacagttacaagtttgagtagccggtttatcaatgaatttcttcttgatatgactgagctccagtgcttgcctcctacctgcgagccacgggtaacagagcacattgagcatattatagagttgataacaaagata

SEQ ID NO: 329 - DNA, 319 bp, Sorghum bicolor
  Clone ID: SORBI-28MAY03-CLUS109349_1
gcacgaggcgctgtggccctgccgtacttcccccccgcgccgtggccccgcccgccccggtgcccccagcggaagaagctcgcggcggccaagtccgtggtgctcttcgctccgccgcctcccagccccgatctgcccgtcgaggcggttctcgagttcctcagcgctcctgacatggtggtcgccgctcactagcctggctcgcccgtccggcgcttttcttgttagcttagtgtgccgtaaagttttcgttgtttctttgtactgatctggatgtgaaaacaaagacatatacagagaagcatgcttgctatgtagt

SEQ ID NO: 330 - DNA, 622 bp, Sorghum bicolor
  unsure (1)..(622): unsure at all n locations
  Clone ID: SORBI-28MAY03-CLUS10938_1
ctgaatgtagcacaaggtcaggccactttgacgatgaaaggggtggaagatgatgaagacgatctgaagacactaaacatggagcttaagcgggactggtctagagggaccaatgcattcgagttggctttccgtaggaacaaggagatctctgcattcttggatcagaggcaaaagacaaaagtgccggaagtacaagcagctgctgaggaaagtagtgaagaattgagctccttgtcagaagtagcaactgatgttcctgctcctgtatctgatgcctcttctcaggtggtaatcgaggattctacttctgtggcaactgctgctgagggccaaactgtagaatctgaaagctcacctgtaattagtgttgaactgtcctccaacgggatcccagatagcactagtgtgtctccagtttcagaaactgcggagaaacctgctgaacctgaagaatcttcagcagttgaagaggtccttgtaactgcaagtagcgaggtggagaaagaaccagctgctgctgctggagttgcacaaacaagcaccacgacagccactatttctcctgcccttgtncagcaattgcgtgaggcaactggagcangcatgatggactgcaaaa

SEQ ID NO: 331 - DNA, 344 bp, Sorghum bicolor
  Clone ID: SORBI-28MAY03-CLUS109467_1
cgccaagcaggagaaccagacgctgcgccctttcttcgacgaatggcccaaggccagccacccgggccctgcgcccgcccagctctccctccccggcccctcggccaccccgctctcctcctccaccccctccgcgtccccggacggctccccctccagctccacgtcgcccatcgggatcccgtcgtctcctccgcgtaccgtgtggcgcccaccgtctctgcgccgccgcgtctttcgtgctcccctcttcgcgtcctgtggcctgaactaatgctacttctctcctcggacgctcctcccccgtttgcgatcgtatctatttatttgaccctttcaatttg

SEQ ID NO: 332 - DNA, 599 bp, Sorghum bicolor
  Clone ID: SORBI-28MAY03-CLUS110308_1
ctgctggggcacctgcccctgttgccggtggcgctcgacggcctgcagatccggtcggcggctgacctggccgcgccggctgcttctctagccgactgccaggagccggctgctccgctcggcccccggctgaaagcggccgccgatttccgtgggctcctccccgtgcccgaggcccggggccctgacgcggccgcgccctcgcccggcgttgcggtgctgtgccagccggcggctgcacggttgccctcccggtctcgtcgtgggcccctcccagggttctctgcccccgtcggcgagcggcgcagcggaacccgtgtcccgtggctcccgccccgccgtggccgggctcagcgtgccgtggccgtccccccctgctcctgcatggtttccctcacagtttggtggtgtgccagtctcctgatgcacgcccctcgttggcttggggggcggcgcatctgtggtgccctggcgtccgccgcatgattgctgtgatgagattgccatgatcttccaccacatgtcatatatagttaagttaatagtttataggtgagcaaatgttcatatgcatgctgtttatagagttggttggtgaa

SEQ ID NO: 333 - DNA, 524 bp, Sorghum bicolor
  Clone ID: SORBI-28MAY03-CLUS109496_1
attgccaagcagaatgttacaagcttgcataggcacaacttcccagccgactgtttctttgtaggatccgatggaaaaattaattctcacaagtctagttacctttgccttaccactgttgttcagccattggatgtagtagggatgcgggtgtggtttggtgttgagggcaagcttctgcaccatatcgctgcttgccaagttgttgcagctacctccatcaacacactttgtttggaataaaatgtgtcgctgattttgctccgccatctccatttgtgcactaagcactcgctgcacgatcaagctctcatagtggtccgcttcacctgcattaatatgttcttctatttgatcttcattacgtgtatcctcatcaaaatcactagcagatgagtactgaccatcatccctgacaatcataactcgcttgtttggatagtcacgcatcatgtgcccatatcccttgcaccggtgacattgtatgttgcttgttatctcgcagcaggcttttgcatcgtctt

SEQ ID NO: 334 - DNA, 749 bp, Sorghum bicolor
  Clone ID: SORBI-28MAY03-CLUS109739_1
gcacgaggccagagtgcaggtgcagcaagccgtctccagagacagcctactatactgctagcacactagcacagcatggtttccgctgcgaacttcctggccatggttgtgacctgcgcactcctcatgaccagccgcgacacctgccacgcggcgcgccacttggccgacacgaccgccgcggccgcggctcccgctgctgctgctgctgccgtcccgggcctccccgccgtgccgaccatgccacaggcggcgctgccacccatgccggccgtgcccgcagtcaccgttccacaggtgacgctgccacccatgccaccggctcccaaggtgaccgtgccgcaggtgacgttgccgcccattccggcagctcccaaggtgaccgtgccgccgcaggtggcgctgccgccaatccccgccgtcccttcgtccgtgctgcccaagctgaccctgccaccgatgcccgccgccgtcgttccgtccgtcggccccaaggtggccttgccgccgatgccgtctgtcccagccgtgaacgtgcccatgccgttcgcggcgccgccaccgtcggcgtagacgcgcgcgctcctgcagttttgcgttcgccgtgtccaccatgcattggtggtggtgagtggtgtacgtacgtcatcgtttgtgcatcctgtttgtaccgtgtgtagtgtgcacgtgcgtcgcgtgtctcttttcgtgcgtagcgttgtaccattgtccattgtacgtatttatgt

SEQ ID NO: 335 - DNA, 426 bp, Sorghum bicolor
  Clone ID: SORBI-28MAY03-CLUS10967_1
atctacacagaccacagctgcagccagaggcacccaccttatcatcatcctcgcctcgcttcatcgccaacaccagcgcctccttcttccccgccgccgtcgacatggctgcgcaagaggagaagactgctactgctgtcaccacagaggagcctgcaccggcggcggagcctcagcctaagccagctgcggcggcgcgcagggcagggccgtcggcgtcggccaaccccttcgacttctccaccatgatgaaccttctcaatgaccctagcatcaaggaaatggcggagcagatcgccaaggacccggcgttcacggagatggcggagcagctgcagaagacggtggtgttctcgcggcaaccgtagcagcagtaggcggtttctgtgctgctgtggctcaactggacccgcataagtacgtggc

SEQ ID NO: 336 - DNA, 539 bp, Sorghum bicolor
  Clone ID: SORBI-28MAY03-CLUS109763_1
gcacgagggcgtcccttgctctcagccatggcgaacctcgcgccgacctgggtcaccaaagcgggcctcggcgtcctcaccctcaactccggcctggccatgtaccgcgcgaggggcgacccggcctccatcctcttcgtctcaggttcgtacgccaccctgctcctcctcttccgctgcctccgggactacgagcgggcggcccccgggtccccggcgagggagcgggcgaggcgcgccgtgtggccgctcaccacgctgctcaccttggccttctcgtggaaggtggcggcggtcatgccttccgccgtcgcggccgccgtcgtctgggcgctcgccgtcgccaccaccgccggtggcttctttgctctgttcgttcccggatgaagccatggatttcgctcagatgcatgcttcaggccggccgggtgcgtgtgtgtgtgctacttatgcgtgtatggtatggactgagaaggagactgcagcaggacccctgtatttttgtactaacagtatgtgtatatatattgtagatatgt

SEQ ID NO: 337 - DNA, 447 bp, Sorghum bicolor
  Clone ID: SORBI-28MAY03-CLUS10974_1
cccacgcgtccgtctagctggtgaaaatcatgttgaagagatcaataatcatgtagatttcacatgctatgctcctcgtatttttgcaacactcaaggccattgaaagtgttatgatggctgcccctgcggcattggtgcggaaaaaagcttttgttgctttgaaaaaggttatttcaatggtgccatcatctcagagatttgacatcttacaagctcttgtaaacaatagtacatctccatccttgactgcaattctccttgatctagtgagggaggaagtttcgagagagagtctccgagctgacaatgattgtgttgaagatgatggattttgaggtagcgggttgccctgctgggcattttatgcacttggattattggagcttattttgagggccttcagaaggtggtcctttttgcctttttcgatcacaaggaacaggtg

SEQ ID NO: 338 - DNA, 579 bp, Sorghum bicolor
  Clone ID: LIB5048-006-R1-XP1-D10
ccggcgcttcgatcagaaccctagctgctgtcgtcgtgctggccgttccgcgatccgccggcggcatccgtcagcagcgccaccgagcccctcttctcgcgttgttgctggtcaatcagtgagctgcagcaatggccgcgggtgctgcgccgaccaatttgcagaaggagcagatgtttggattggcggagaaagagatggagtatagggttgaccttttcaatcggcttacacatacatgttttgacaagtgcatcgagaagaggcacaaggatgctgagctcaatatgggagagaacagctgcattgaccgatgtgtttctaagtattggcaggtgactaatctagttggacagcttcttggaaatcagcctaaaatgtgaactgagatgaaattttgttcgtggtgtacttctacaattttggttttagggtttgatggattactagttaaactagtgatacatgataaattcaagagagaaattatctctcaaattattagcattgtattgtttggacatgatggagaaacctacttgtgaggctttggtacaaattctacatgcaccttttgtt

SEQ ID NO: 339 - DNA, 490 bp, Sorghum bicolor
  Clone ID: LIB3478-021-P1-K1-B7
gtcgtgctggccgttccgcgatccgccggcggcatccgtcagcagcgccaccgagcccctcttctcgcgttgttgctggtcaatcagtgagctgcagcaatggccgcgggtgctgcgccgaccaatttgcagaaggagcaggaatttttgtcagctgatggttccaagtgatgtttggattggcggagaaagagatggagtatagggttgaccttttcaatcggcttacacatacatgttttgacaagtgcatcgagaagaggcacaaggatgctgagctcaatatgggagagaacagctgcattgaccgatgtgtttctaagtattggcaggtgactaatctagttggacagcttcttggaaatcagcctaaaatgtgaactgagatgaaattttgttcgtggtgtacttctacaattttggttttaggggttgatggattactagttaaactaaggatacatgataaattcaagagagaaattatctc

SEQ ID NO: 340 - DNA, 848 bp, Sorghum bicolor
  Clone ID: SORBI-28MAY03-CLUS10978_1
atcgttttgaaactaaagcatcacctactgaactgagagaccttagaaaccggctggagtctatgttgtcaagtgaagcatcatcatcaaatcagtcaaagtcaattgcttatgttggtcgtgaaggagaaggaattataggtgctattgctatatcagatattttacgagaagatgcaaacttaactgtggagaggttgcagcaagaaagcattacaacgtttctactgtcaggggatagggaagaagcagtgacaagcatcgggaggactattggaatcagggatgaaaacatagagtcttccctaactccgcaagacaaagcaagcattatatcaactttgcaagggaagggacacagagttgcaatggttggtgatggaataaatgatgcgccgtctttggcagctgcagatgttggaatagccatgcgaactcactcaaaagagaacgctgcctctgatgcagcttcagttgttctattaggcaacagactttctcaggtggtagatgcactatccctgtcgaaggcaacgatggcaaaagttcaccaaaatttagcctgggcagtggcatataacatagtagccattccaattgccgctggagtgttactgccacaatatgatttcgccatgacaccatctctctcagggggattgatggcccttagctccatctttgtcgtcagcaattctttgcttctgcagctgcatgggtcgtttcagaacacagaaaaacggcagggtgatttgagctcaagattaaactgaattattgggtttagtttgacccagccgaaggacagtgcttcaggatggtactggatgatagagtgtgctgtactg

SEQ ID NO: 341 - DNA, 945 bp, Sorghum bicolor
  Clone ID: SORBI-28MAY03-CLUS109802_1
caaaactctacaccagtaactttcaagcatggggtaagatctatcgcgctgaaggcgttcgtggtatcttcacaggttggagtccaaccctctttggctactctgcccaaggcgccttcaagtacggttggtatgaatatttcaagaaaacgtactctgatatggctggtcccgaggccgcacataagtacaagactggtctttatcttgcagcctctgcctctgccgagttcctcgctgatcttgccctctgccccttcgaggccgtcaaggtccgtatgcaaggctcgatccctaacccctacaccggaacagttcaaggtataagtgccatcacaggcaaggaaggtgtcgctggcctatacaaaggcttatatccgctatggggccgccaaatcccttatacaatgatgaagtttgcctcgttcgaaaccattgttgagatgatctacgatcgtctgcccgggcaaaagagtgactatagcaaggctgcacagacaggtgtctcctttactggcggttacctggccggtatcttatgcgccatcgtctcccaccctgccgatgttatggtcagcaagttgaattccaaccgtcaacctggtgaggctttcggcggcgccatgagcagaatatacaaggacattggtttcggtggcctatggaatggtctccccgtgagaattgtcatgatcggtactctgaccggacttcagtggatgatctatgactacttcaagatctttatgggtcttcctaccactggcggtgctccacccccagcccagaaacaggagtaggttatatcggctccccttgcaaatgcatatgagtcgcttgtgccatagttgtcagggacttttttggtgtgtattcgttttctgttcgttcaagtggattgggagcaagagacaatgttgataggccaataaaaactttcctacg

SEQ ID NO: 342 - DNA, 801 bp, Sorghum bicolor
  Clone ID: SORBI-28MAY03-CLUS109831_1
gcacgaggccgcagcgcgcctcgcctctgttctccctctcgttttcccacaaaccctagcagcaggcggcggctgtcggcgggcagcgcgtgggccgttggcgcgaggcggccgcgggcacagggctgcggggcgcgggcggtggccgcacccgccgtggcccgtcgcgcgagcttccacttcagggccactggccgacacaccgaggagctactgaactagtgaactgtgaaattcaatatgacctgtttcatacaagagctaataattgctacaaattagctccagtgcatccaaacagagtggtaatagaacacagcgatggacggacaaccaggtgctgtgacggcgtgtcttggtacgagagtaaaagcaaacctggttcttggatctgaatcgtttgctatcagccccgagtcgggtatcctgtcagagcagctggctgcgatgaaggagaagagcatggcgatcctcaaggaatacatcaccaagcacaatgctccaaacgatgtccctgatgagcccgttgagggcgaatctgacggtgagggtgaagcgcttgtcaacaacccgccaaagaaatttaagaagcagaagtgaccatcctgaacttggtcagatttattattaggcacagctagtctctctccagttatgcttttgactcaggaagacaagattgttgtttggcacacgtcttgcttatgttagaccaaattgttagccacagtaacaatatgcaggtgtaagcacttgttgttcataccattatcatgcaattctacccaccaattctgcctc

SEQ ID NO: 343 - DNA, 573 bp, Sorghum bicolor
  Clone ID: SORBI-28MAY03-CLUS109852_1
ccgagcccatcacgctggccgagtactcgctcgccggaaccggcggcgaccagttcgacatctccctcgtccacggcttcaacgcgcccatgtcgttcctccccagcggcggcggcggcggcgccagcaggtgcgccaggggagcagggccgtcgtgcccggtgcaggagatcacgttcgactgcccctccgagcagcggcgggtggccgggtgcggcaacccgtgcgacggccagagcagcagctgcggccccaacaacgggacggagtacttcaagaaggcgtgcccgcagacggtcacgtaccccagggacaccagcaacaccatctttacgtgcccggccgggacgagctacgagatcaccttctgcccgtgaaaaatgacgagcttgcgatctgaaagtttcatgtttgcgtgtagtacgtacaaacataagttatatatatctagatgataaataaaaaggtggccagatgtgtgctgtgtttacatatagtgtgatgtatagttgtatacttattaaacatatgtactactgtacgtattgtgtagccggtaaacacgtgagtaat

SEQ ID NO: 344 - DNA, 535 bp, Sorghum bicolor
  Clone ID: SORBI-28MAY03-CLUS109859_1
gcacgaggtttacatccccagcaaccgtcaaaatggtcaagaagagaaagaacaacggccgaaacaagaagggccgcggccacgtcaagcccatccgatgcagcaactgctcgcgatgcacccccaaggacaaggcgatcaagagattcaccatccgcaacatggttgagtctgctgctattcgtgacatctcggatgcctccgtcttcgcggagtacaccgtgcccaagatgtacctgaagctgcagtactgcgtctcttgcgccattcacggcaagattgtccgcgtccgatccgtcgttggccgacgcaaccgtgcccctccccctcgcgtccgctacaacaaggacggcaagaagatcgtccctactacccctaaggcttaagtggtgggttgatgtgtcttgtcttgggatggagtccggttatgatagcatcattcaaaaaataacggatgggataaataccgttgggattatgagtctaagagattccaaaattcaatcggacgacgtttgatgtccacacgtcattg

SEQ ID NO: 345 - DNA, 491 bp, Sorghum bicolor
  Clone ID: SORBI-28MAY03-CLUS10993_1
cgcggctttcctctacctcgccgggttcttgtccgactcatccggtggtgccagtgtgctcacagagacggagaagaccaccgtcctcaagctacaggttggcttgctgggcatggcacggtcatttcagaaggagcttgatcaaatagctgagaaagcagatacatctaccccggctggcttgagctatgtgttgacagagacaacattggcattacttcggcatccggattgttgtatctcagcttactcatcggtggatgtgaaacgaagcatggatgatggtgagaaacgtttcaatcagctttcaattgaggagaggggcaagtttgatgaagagacacttgtgaacgtgaacagcatcaagaggaataaaggaggcagccaaagatcaagtggttttagcaacgagtacattgtgataaccatattggttgctgctgagggagtacataagctgccagttataaatagcagcaatgacttaaaga

SEQ ID NO: 346 - DNA, 821 bp, Sorghum bicolor
  Clone ID: SORBI-28MAY03-CLUS109952_1
gcacgaggatcccctcaaccaagtctctggtgcctcggcaacagcagcagcctgcccccggcccccgggcgtggtgtggcggcgctttctcctctccggcacggtggcggtgtcatcccggctcttccgagcggttgcggcggccgtctcctctcctgcgatcctcctgccgcgcacagcctgaaaattgtagctgaggtttgttcgagaacaagcaacaactttgtgagccattcgcattaaaggagaaactgtagccgaagtaacaaacagaagggcacaatggcactatcacgaagtatgagaacatgtttgcagagtggaaggcttgcccttcttgccatattggtctctagtggaattgtcttgcaaatcttggcttgtgctctctataacaactggtggccaatgctaacagttctgatgtatcttatcctaccaatgcccctcatatttttcctgggttcggatacttcctcaatcatgtctaatgggggagacagttgggtgaacttcacaaaattcttgacgggcgcatcaatagtggggagcattgccattccgtcgatcctgaagcacgctggcgtcattggatggggagccctgacgatggagctatcatcctttgtggtctttggcgtggcaatcctgtggttcatccagatgaacggtgaagaggacgagtacagcggtgtgttttagaccaaacctgctcgttctctttccagcgtgatacctttgcaaggtagttgtgaactcagctgtacagcaacctcggaccttatttagtgataccacataccaatacatgtttggtctgc

SEQ ID NO: 347 - DNA, 521 bp, Sorghum bicolor
  Clone ID: SORBI-28MAY03-CLUS109985_1
tgggctccgccgccaacctgatcgtgtgcgagcaggcgcgccggtcacagcactacggctacacgctctccttcttcacccacctccagttcggcttcccggcgacgctcgtcgtcaccggcatcggcctgctgctcatcagaacctactgatggtgatgctgatggatgcatggccgccgcccacgccaggcgccagcagcagcagcagcagcagatcatggacattagtgtcaagggatccaagatgcatggtctcggtctcggtctgggcctggggaagaagaatgcatctggattctttctcagcatcgatcgatcgtcacagtcagacaggtcgttttgttctagtagtagttgttgttgtttgtattgaatttctgcaagcaagattcgtttgggaagcgtagcaccatacagatagagatcagcatgcacggtgcttgctcggctcggagcaggaggcattttaatttgggatgtactgtacatacacactctgctagtaagtacgtactactg

SEQ ID NO: 348 - DNA, 755 bp, Sorghum bicolor
  Clone ID: SORBI-28MAY03-CLUS109962_1
cgctcgcccacgagccgtcctactcctacccgccgggcaccgcggacggttcttggtgcgcgtacggcggcgccggccacggcactggcgccagcgccggcgccggcgcgagcatgggtggcgcgggcgagcagctggagcagcagcaggcgggcgcggcgcgcgacgagcggaaggcgaggcggcaggcgtcgaaccgcgagtcggcgcggcgcgcgcgcgcccggcggagggggcagctcgacgagctgtcgtcgcgcgtggccgcgctccgcgccgcgaacgcgcggctggccgtggagctgaaccgcgtggcggccgcgcgcgcgcgggaggcgcgggagaacgcgcggctcagcgcggaggctggcgcactgcgggagaggctcgcggccgccgaggccgccgctgctgtggcagcgggggccagggacgcggcggagaagggcgatgaggaagcggcaacgccggcggccgagctaagatgacatagtaattcactgctaggacaagaaggatttgagggagacgaccaattgcatgcctttgtgcatggctggttgtcgtgtgttcgtaaatcgtaagtatgtagtcgtggagctctgagatttgctcattccgaatctcccaacactctgcaaggtacgtacagtaggatactcgatctggcgatcggatcgtccacaaaggtcgagattttcatatacgactgatgattttggaatctaatacagttacgaggccctgtttttact

SEQ ID NO: 349 - DNA, 599 bp, Sorghum bicolor
  Clone ID: SORBI-28MAY03-CLUS11002_1
gcacgagggtctctactcgagcaaaccatccttattctcagcttcagcagatcttcaagcaagtgggagtcgtcgccgttgttggtgctttgtctcgcaaccttgcttatctacaagatcatcaaggatacttagcaaatatctatgattacccatcactcatcttgaaggatcccgtcatagaacaaataaatcattcagtacagaaactcacacactccacaagctttctgcaatttttagggcaacatgcacttatcgttccggaggatatgcagagtggctcagatctcgatgatgacaaggattaccatttcctgtcactgctgctaaacttagtaaacacgtttctgtacatggttaacacatacatcatcgttccaactgctgatgactattcagtgagcctcggagctgcagcgactgtttgcggtgtgattatcggatcaatggcagtcgcccaaatcttctcctcagtatatttcagtgcctggtcgaacaaatcgtacttcagacccctggtatttagcagcattatgctatttctggggaacctggtgtatgctttggcatatgatcttaattccctaactgctctt

SEQ ID NO: 350 - DNA, 485 bp, Sorghum bicolor
  Clone ID: SORBI-28MAY03-CLUS110023_1
cgccggacctgctcaactacgagggctgcgagctgctgctgatcgcggcgtcggacgacgtcgaggaggagctcgggctgcagctggagggggaagtggatgtggaggacggcgagggtgagactcagcagcccgcggcgagctgctcggatctggtgaagatgtttggcgaggtggccgacgtgaagccgctgctgagcgggagctgggactaaacgacgactgatccgctcatctgatgccgttgtacagcgttcctaggtcgtagccaagtgttttggtttgctagcacgctgcttataggtgtctgttcctgtactggaccgactgcttgtagtgtttactgtttattagtttgctgcatagtcctttcttgcacaagtttaaagcttcacatggggtgacgaggatcaaatgaccggtagagtgccggagacgaaattttcccgctcgttttttcgtcccatccgctgaatgaactagtt

SEQ ID NO: 351 - DNA, 648 bp, Sorghum bicolor
  Clone ID: SORBI-28MAY03-CLUS110034_1
cggcgcgcgcacggcgctgtccctgcaccacgagctcgacccggccaggctccctgctgcgtccgccgccgtcaggccgcacgggcacacgcccagcggccggtacgtcctggcgggcggccgcgccgacgaggaggacggcctgtgccaggcgatcacgccgggcgcgctcaagccccgggtcacgtaccgtgtcgccgggtggatcagcgtcgcagccgccggcgccggggtgggaggaacgacgacggcccaccatcatcccgccgtgcacgtcagcatccgcgtcgacggcggccgctgcgtcatggacggcggcgctgtcgcctgctccgccgccgcctccgacgacgccagcagcagcaggtgggcggagatcaaaggcgggttccggctgaaggagagcccccgcagcgcggcggtgcacgtgcatggtgcgcccgccggcgtcgacgtgaaggtcatggacctgaggatcattgccaccgaccgaaaagcgcgcttcaggtacctcaaggacaagacggacaaggtgagcgagccgcgcttcttgttttcatttatttacgtctggaaatgaacaacttaaccaactggttgaattttcaccgaccagctaggctatattatccacaaccgttgttatta

SEQ ID NO: 352 - DNA, 587 bp, Sorghum bicolor
  Clone ID: SORBI-28MAY03-CLUS110065_1
cttcacttcaccttgctctcctgactagcactactttgcttcaacagatcataactctggccagtgatctccggtgcgttgctgtagtaagcttgtgcgcagctcgagagcggatgccgccgctggcgccgacgacgacgtcgtcgtcggagccggaaccgccgttccggccgcgggagaagatcctggagaagcagaggtacttccagagcgtccgcaggccgacgtacctcaagggccgccacgacgtgatcacctccgtcgccatcccgctcgccctcgcactctccagcatgtacctcgttgggcgcgggatttacaacatgtcccacggcatagggaagaaggaatgagctctcgtagatgatggcgatcgcgctacgtcggtgctactgttgtctctgatattactgtgtgtgtaatgtaaatatagtgagtactcgaaggccatgtatattattgtgtccacgtccatgggagagtggtgccttgtgagtttgacagaggagtttgggtgcaacaggagcttgtattgatcagattaagaatctaagccgttgagcaaataaaaaaaaaaaaaaaaaaaa

SEQ ID NO: 353 - DNA, 429 bp, Sorghum bicolor
  Clone ID: SORBI-28MAY03-CLUS1101_1
ccggtcgaccacgcgtccgcgccgaccaggcggcgcacatcgaggccgaggcgcgggccgtcgccgccgcgcgcgcggaggtcgaccaagtccacgccgacgtccaggtgctcgccgcggcgcgcaccgacctcgtcaaccgtcttcagggcctacgggagaagctcgcgcacaagaaggctgaggcgagtaagactgattccgtccgtgcgcagattgaaaccatgcgccgggagatccagaagggcagagctgcggttgatttcgaaaagaaggcacactctgataaccttgaacaaagtaaagcaatggagaaaaatatgatttctgtggctagtgagattgagaggcttcgaggagagcttgcaaatgctgaaaaaggggccaccgctgtcaacccagtagcagctgtggtaactctggtatgct

SEQ ID NO: 354 - DNA, 824 bp, Sorghum bicolor
  Clone ID: SORBI-28MAY03-CLUS110104_1
gcacgaggggacgtagaagcaagatcagggagagcgagaagagagcagcaacaagtagttcggctcggccatggcaatggtggtcaccatgaggaggaagaggggagggcttgttctaccggtggcggtgatcatggcggtggtgctgttcttggccgtgctcggcggcggcgcggaggcgcggcccttgagcggcggcgacggcggcggctgggcggtcaccggggacgcgccgctgccgacgacaggcggcgtcttcattgtcgagacgctccggcggctgtacctgcagcagctcggggcgggaccgtcgtgccagaccaacagccccaacaacggctgcccgccgccataggatacggcgtgggtggtgtgggtggtgcccgacgacgacgacgacgacgacgacaacgccgtgtgtctgggtcgtcacgagctctaatgatctcgtcttgtgccgagcgcgcggtgcgtggagtagggtgtcacgttccagagatccacgtacgaccaagctagggtgccatcgctctgctggttctcccatgcatgcatggttgcgcgctcgctcgctcgacgatgttcatgatgatgatgatgtgttggacatcaaggttttcccgtcggcgtcgctgatgaccgacggttggatttaatttgttgattgattttgttcgcggtttctcctgtgtaacttttgatttgaccacgtacgcatggtgtgtgggcacggcgtgcgtggcaatttgtacagcaacatacatgtataagaaagtctgaatactattgtatatataggaaataaatgtacaaattcttatctt

SEQ ID NO: 355 - DNA, 345 bp, Sorghum bicolor
  Clone ID: SORBI-28MAY03-CLUS110327_1
ggacgccctgcagctgaggctcaacgccgatgacgacgtcatccgctccaccagcttcaaggtccgccagcggaaggccgtctagacgcctgggttggaaagcttcatcaggccttgaatgaatattttgttcataccatacaagaattctgctgtactgcgggtagatgtatgcctcctttgccatgattgagaaggaaaatgttttggtctttttcttgtcttgtggacttgtggttcttgaaaatggacgtctgatcgtcgttcaccaaaggaacactttagcagattcaaatgatgatcagacagtctgttgaacaaatgcagcataatctataacggtac

SEQ ID NO: 356 - DNA, 656 bp, Sorghum bicolor
  Clone ID: SORBI-28MAY03-CLUS110329_1
gcacgaggatcagtcttacatctgcacagtgaagttgcagtgttcacctttttcttcatcaccatagtcatttgtagcgctgttttatttcctttgttgtgctattacacgagaatctgccggtggcctttttcctttagtgtttgcatggcgtaccacaagcagtgtgcgggaggagtactgaacttctggctattgaggctctgtagaaatttcattgagagccaggagattattacaacttccgaacgaggagttcgtggagttcaccaacaaaacaggaggtaaaccgaatcaaattacaactaccggtatcttttattctttgaaagaccacaattactggtgtccaagtggtgcctggctcatgggtaacgttgcctggagccctggactagcatccattggcatgtgcagacgtgccatgttacaatagttatatacggactactactactttgcatgattctccgtacagaggtcgcaagataggtcatccagcactgccttttcttttcaattgtaaggagcattactgcgctcctggcattgccatggctacgctgtaccgtgtacagtacagccatgcctatgtggccagcgcacaattttgttgcaggaaccaaataaaggcaggcatttgggcgaccgattcg

SEQ ID NO: 357 - DNA, 538 bp, Sorghum bicolor
  Clone ID: SORBI-28MAY03-CLUS110373_1
ccgacatcaccatcggcttctacgccgggtcgcacggcgacggcgagccgttcgacgggccgctgggcacgctcgcgcacgccttctcgcccacggacggccggttccacctcgacgccgcggaggcgtgggtggccggcagcgacgtgtcgctttcgtcgacgtccggggcggtggacctggagtccgtggcggtgcacgagatcggacacctcctggggctcggccactcctcggtgcccgacgccatcatgtacccgacgatcaggacggggacgaggaaggtggagctggaggccgacgacgtccaggggatacagagcctgtacgggagcaaccccaacttcacgccgacgtcgccggcgacgagcagccgcgagatggacagtagcgccggcgcgggattccgaccggatggagtcttcgtcggagtagttgcggcagttggactgctcctagtcatagtgccgtagcccgtagtagacctctagtgcttgtcatttttgccacgtccttcgttacatcgatttcttgctcg

SEQ ID NO: 358 - DNA, 753 bp, Sorghum bicolor
  Clone ID: SORBI-28MAY03-CLUS110380_1
tccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccagcagccgcggtaattccagcaacccctgtcgtcgcctgggagggcgcctgcacttcacttatgctgttctcacccgctcaatctccagcacctccagtcccttgccgcgccactcgccagattggtcttcctcttcacgcctgctgcacactccccttcctccctgtgcaggcacgacagcagcatattccaagaccagttgcccagaatgagcacaggacgcaggaggaaacgtgttcatgtgaccaactcatcccaagatgggagaattcaattccccttcaaaccgagcaacccgccaattttaggcgccccagacacaggctgtttgcagcttccaggaccaaaaacgaaaactcagcgcgctccccatgcaatggacaattggacatcgccataagcttttacccctctgatgttaacttttttttcccattagtgatcatcgtcttctgtgtcattctactcgctgcaaaacatgtattgttcagatgctctcaacctacctttgcattagcgcagtttccttattgcctaaagacagcatgccgacctaggttttgct

SEQ ID NO: 359 - DNA, 1083 bp, Sorghum bicolor
  Clone ID: SORBI-28MAY03-CLUS110392_1
gcacgagggttgcgagaaacgcgcccgcagcggtaacgcctcccgcgcgcgattcggcggccatggcggcgcggtcgactatgctgcgcgatctgctcggagtaaaccttcggaagatgttcgtgcaggaagtcggttcaggtggcaccctcttcgcgacaacacctcgtgcgcgcgattcggcggccatggtggcccggcctgctatgctgcgcgatcccctcggggcgcaccttcggaagaagggattccacatccatccgccttaccttcgtttgtcaaggtccatgaaagcaagtgaccagttcaaggctggctccaggaacttttcctcgttcaacaagcaaaggtctgtgttccgatcctctgtgacagttgaggagattaaaatcaagctcaaggcatttgcaaagaattgctgggatggtcttgacccaaggagctctgcccaggtgtggggttcacaagaaatttgtcttcatcatcacagccccctctgtcagtggtagtttggagtacaaaatgttataattgatggagcaggaaaaggcgtgatagtcatggtatcaagccatgggtatcttctctacctgaagtccatgtcagagaggcaaaccaagcttgaagcatgcctagctgaaattaaagaggacagtgagaaggctattgctgagctcaaggctgaggtgaaatctctctcgatgtaccacgaggagttcatggcaaaacatcaaaagctggagactgatttgaaagagctgaagttcctcaaggacttatggatgtcagtagtatatgaggaaagctccaaggcgtattttgaagtcaagaaggaatgaccatggtgtggaggatgagtgaatcactattcactattgtatctgggatcgttgtctgagtgactattaatctggatccatgctggctgagtgtagtagcctcaataggacatgcctgagtaataggctcattaggactatagagcgttgattgaggagggaaattttattgagcgttgattgagggaggcttcattgataccagttgtgactttgaaaaccatccccaaataaatcaattttt

SEQ ID NO: 360 - DNA, 771 bp, Sorghum bicolor
  Clone ID: SORBI-28MAY03-CLUS110410_1
gcacgaggggatcatcagctcaatggagccaggagagcagcaggtgtccgcgtggagcagcttccttggagcatgccggctgcaccggaacgtcgctcttggcgagattgctgccgagcggctgttcgagctcgagcctgacgaggcgagccattacgtgctcctgtgcaacatttactccgccgccggcctatgggagaagtcatcagaggtgcggagcaggatgcggcagaggggcgtcagcaaggaacccggctgcagctggatcgaactcgacggcgtgatccacaggttcatggctggcgagtctgcgcacccagagagcacgctggtgcacgcgcacatggacgcactctgggagcggatgagagaccaggggtacacgccagacacgtcgtctgtgcttcacgacattgaggagagcgagaaggcggcgatcctccggtaccacagcgagaagctcgccattgccttcgggctgctgcggacgccaccgggcgccaccatcagggtggccaagaacctgagggtgtgcaacgactgccatgaggctgctaagttcatctccaggatggttgggagggatattgtgctgagggacgtgaggagatttcaccatttcgtggacggtgcctgctcctgtggggattactggtagaagaaacccgttagagacttacagggcctactaattaaattgtttgttactagctcatactacaccacactaggaacaaccgctctggctataaaaatgtttggataaacttc

SEQ ID NO: 361 - DNA, 609 bp, Sorghum bicolor
  Clone ID: SORBI-28MAY03-CLUS110411_1
gccagtagtcatatgcttgtctcaaagattaagccatgcatgtgcaagtatgaactaattcgaactgtgaaactgcgaatggctcattaaatcagttatagtttgtttgatggtacgtgctactcggataaccgtagtaattctagagctaatacgtgcaacaaaccccgacttccgggaggggcgcatttattagataaaaggctgacgcgggctctgctcgctgatccgatgattcatgatatcttgacggatcgcacggccctcgtgccggcgacacatcattcaaatttctgccctatcaactttcgatggtaggataggggcctaccatggtggtgacgggtgacgaacctggactacatcgccacgtgcatcctcgtcaagccctgggcccacaagccaggggccaggctcatcacccagtgcgtcacgcccgaccgcgtcgagcgcttccacgacgccatggtggacatgaactagcagctggcggcaccgccagcctgccgttttgttcatgggtttcttgcttttttttttctctctctctctcctctcatcactcatcagttaccgtggtaattagcagtgggtatatatataattact

SEQ ID NO: 362 - DNA, 628 bp, Sorghum bicolor
  Clone ID: SORBI-28MAY03-CLUS110493_1
tcgtcatcctcctcgccggtcgcttccgcggcaagcgtgttgtcgtcctcggccagctcccgtcgggtctcctcctcgtcaccggcccgtacgtcatcaacggcgttcccgtccgccgcgtcaaccagtcgtacgtcatcgcgacctcgaccaaggttgagctgccgcagggtctcgacctcgccaagttcgacgacgcctacttcaccaaggacaaggcctcgtcgcgcaagggcaccgagggcgagttcttcgacagggagtcgaagccggccgagaaggagctgcccgccgagcgcgctgccgaccagaaggcgctcgacaagcagatcctcggtgccgtcaagagcaccccggttctcgccaagtacctcgccgcctcgttcggcctctcgaagggcgagttcccccacctcctcaagttctaagcgcgttatcgcgatgagaattcgggttggggtgcaagcgggtggtgcacgtcggacgaaaaacggggtcgccgaaaggaggaggatgccattccccttcccttcctctctcctggaaacctcccctttcttctagacgcgcgcatgtaagatgagcggtgcgagattgtagctgcgcgtgagagcgtgcaattttttcc

SEQ ID NO: 363 - DNA, 693 bp, Sorghum bicolor
  Clone ID: SORBI-28MAY03-CLUS110484_1
gcacgagggcagcgcgtgccgcaacctgcatggccacgcgctgcgcggccgcgagctccgcgtcggcctcgcgggccgggcaggccgccgcggcgtcggcgcccggggcgagcacgagcccgtcggcctggaggacgccgtccacgccgcgtcgctcgtcgccgggacgccccctcccgactccgtcacgcggttcctggcggcgcggtcggcgcgggagctgcgggagattgtgggccagctggagggacacggccccgacgccctgaggctgcttcaggagcaggtcccggggctggccgccgccgtggaccttgcgcgtcacctgatcgacatggtggccgcggacgccgccacggaggaggccaggaacaagaagcggaccggcgtggaggggtccggctccgacgacggcgatcaccgcgccaagctcaggaaggtggatctggaagaaggcggcggcttcaaggaccacggcgcggtttttgcagctagggtcatgtgcttctgatgatctgctcctgtctggagctggaattgtttcctggtttttcgtcctgtagatcagtcgattaggagaaaacagatgtaattccacgttttttctgctccagcagagtttatcaaggatattgtatatgtatgattatgcctttactgaataacgaagaaattttacttgtttaacccttg

SEQ ID NO: 364 - DNA, 552 bp, Sorghum bicolor
  Clone ID: SORBI-28MAY03-CLUS110557_1
ccggctgccactctaggcccctagtctggcctctgactccgagcgtgtgtgggcgctggcagctgggcgatcgtccggtcgacgagcgagcagccgagcaggggacacggcaggagaggcaggggcggccagccatcctggtggccagggcacggaggccagagcagcggagctggggcaacaggcgagggcgcgggcgcgggcgcaaggcgtgctgcttgcggcggcgtggacggtggccgcgcaaggatcggtggccgagtgcagcgctttctcttccgtagttttctctttaacgggcttctttcttggaccaaaatgaagagttgctgctgaaatttctaggccacgactagagctatggccctgctggccctaggtctgggcccgcccgtggtgtgcactaacctcatccactactcaaaatgtaaaattttctagcaaaaactacatgtgtagtagtttcttttattaaagaatagagcgcttataattgtacatcaatatagatatgttgtactgtttaggtacaaatatataattaaattatct

SEQ ID NO: 365 - DNA, 534 bp, Sorghum bicolor
  Clone ID: SORBI-28MAY03-CLUS110584_1
attcgtagttgcttgttgtgcaactggagctggagaacacttgattagaggatttgctgcccgtgaatgttgcatctcatcatcattgtcacaatctggtcctgcttctgcatgcactaaaattctccgctctgtggttcaaggcagcagcaagatgtctcatgacacaggggctgggttgttgctagttcaggctgatgttcgaaagggaggggatttgtctgaactggaagctgctgagctggttgctgcctattcctcgccatcatttggtgttggttatttcggaagcaatatgaataatcctaaggttctgatgcttaaaacaccagaaggtccatccaaaacggtcaaccagttcgcgacctgcgtcaagtttgatagagaatcatctgaacaatgacaacgacccagaccatgcaaaagcacttgtaactttttcactatgcatcctttgaacgatgaacggtattttttggagtgtttgaacaacatttgaatttgtaggaaattcgagaagaaaccatttttttt

SEQ ID NO: 366 - DNA, 635 bp, Sorghum bicolor
  Clone ID: SORBI-28MAY03-CLUS110615_1
gcccgcctgaaagagcccgtggccgggcttggtagtccctcaccggggctcgaaccacatagcgactcatctctctgtcccgtggcattcctgcgtcgtctctcccgccgcaggatgagaaaactgccgtcagcccatatgagttgtatgagaaacttagcacatcttatcctgcactgctgcagcctctcatacacgaacgcgacatgttccttgcatggtcgctgaagcggagcaaggctgtgaacaagagcaaaactgttgtcggagttgtagggaaggggcacattaatggcattgtgtacgcgctgatctctgatcaaggggatttgagattccgagaccttgttggtagagcatcatctgatacatgggttagctcactcatcaagggtctggtaagggacactgtaataggattggtcctctgggctttgtatgaacagttgcaggctgtgctatagatggttcagacttccacaaggcacacaaactcacagtacagcactgaactttttactagctgaaactgaaactccccattcttcacaaagtcgatgacttgatcgaagtacctctagattgaagccattgatctgtcaagtgcagctatcttctgaatatatctacacaag

SEQ ID NO: 367 - DNA, 527 bp, Sorghum bicolor
  Clone ID: SORBI-28MAY03-CLUS11060_1
gcacgaggcaacaataacagcacaagcagtgcaagcagcacgggaagcactaatagcagtgctctctacaaagttgatcatgaagcggattgtctggattatgagatcctgtgggaagacctcgtcattggagaacaaataggtcaaggctcttgtgggacagtataccatgctttgtggtatggttcggatgtggctgttaaagttttctccaagcaagaatattcagaagaagtgatactgacctttcgacaagaggtatcccttatgaagaaactacgccatcctaacatactgctcttcatgggtgcggttacatctccacaacgcctttgtattgtaacagagtatctccctcgtggaagcttgtttcgcttacttcaaaagagtgctaccaagttggatgtgagacgacgtgttcacatggctttagatattgcaaggggcatgaattatcttcaccattccagcccacctatcattcatcgagatttaaaatcatctaatctgttgggtgacaggaactg

SEQ ID NO: 368 - DNA, 188 bp, Sorghum bicolor
  Clone ID: SORBI-28MAY03-CLUS110648_1
gcacgaggcaggcatggagccatgggatccaacccatcgtttggcacttcgatggttgctgggttactgtactgaggttggagcctcagatgagggtgaaggatctcactgttgtgtgggtggggatctccctgttgtgtgggtgtggatctctttgttcatcagtggtggattttcacgcttgcctc

SEQ ID NO: 369 - DNA, 415 bp, Sorghum bicolor
  Clone ID: SORBI-28MAY03-CLUS110709_1
gcacgaggatcttgcccagctcttcttcctccgtcgcatcgcagtccccatacattcctgcgctctgtcgcctccctcccccacctcgctgctccgatccagcaagagcagcaagtacagctccatcttcgcgcgcagggccagggaggtcagatggagttcgtgctcatcatttcactgccgctgctcatcctgatcatcatcgtcgccgtcgtcctctgcatcatctgccgttaggctgaacatgcacatagaaaaatattcatcagccccgtctctgctgtgatgatcatatcatcataccatgtgctagtgctaaattgactttgtacaacatgacctgataaaaccctttttttctctgcattaccatgtgattaatcggctgtagctctataaaaaaaaaaaaaaaaaa

SEQ ID NO: 370 - DNA, 506 bp, Sorghum bicolor
  Clone ID: SORBI-28MAY03-CLUS110811_1
gcacgaggccacctcgtcgacctcgacggcggcgccctggcggcaacagccggcgccggcgccgcgcaccaccaccatcaccaccacgtccacctgcacctcccgcgcttcgtcggctgcttccgcgcctgacgacgacgggcccggccgtcgaggtggttgattagcttttaatttggtttgctcatcctccctccctccctccctctctcgcgttgttttgctttgtgagggttctcatcgatagtagaacccgattggtttgaagctttgtggcgagagacatgcacgcatggatgggaggacgcgcgatgcatctagctagctagttgttgacgatgatgacgaaaaatttgtgatgatggtcgatctcaagtgtaaagatctatagagaggatgatgttcatctttagctttagcttttctttttcctttgcttatacgtcaatatatactttgctaatacaactatatatatactctgcgaaaaaaaaaaaaaaaaaaaa

SEQ ID NO: 371 - DNA, 809 bp, Sorghum bicolor
  Clone ID: SORBI-28MAY03-CLUS110830_1
gtgaagctggttgcagttagtcttcctaatataggagaatcaactgccgatctcatgaatgcaatgtacataataatggagtcccaatttaaagggtataatctttggcagttagatggccgacctatgagtggcgacattggccgaggtgcaacaagggagacagtttcttttgccactcatgtggcttcaatgtcagaaagacctcctggcttctatcagttggccggtggcaccaactcatacactattgactgcttaaagaaagctggtcttttccaatctatttctgttgcagggaccgcagcctctgaaatagccagttctccccaagctttaatcggagggattgcttatggtggctatgctcgcaagatcgttggacgggctttgcgcaaaataccagaacagtttggtcgtgtgcgcatcgaggatcatccggatcatctactggaggcactacaagaagccatgtcattaataggccctgtgaaggattataatccagtccttccaagcctttcccatgacacaagttgacagacaataaaaagaagatagctccagtcctttccaacccagttttgggtctgcactgccatccagaaggcgaagaaaaagcgcagcatattgtacccgtggcagtgatgtcaatgtggtgatcaccccccaggaaactaatgctagctgttggtcgatcgctcgttctagatggatcaagggctccctgtggaacgtggagtgccgtggtcctgcaaacatctcacgtttccttctgtctttgtagatgcagcagttgaattttttgg

SEQ ID NO: 372 - DNA, 818 bp, Sorghum bicolor
  Clone ID: SORBI-28MAY03-CLUS110950_1
gcacgaggggacagcactgaggcttctgatggagacttaggttctacagaagaagtgtgtgagtttatggtccctgcagacgagaggcaaagtatctgtgcactatgtggggaaccatttgatgatatatattcttttgagaaggggaactggatgtacaaggatgcagtgtttttggattaccccaaggaagaaagcagctgcggaaacaatgttgagcctgaagagcatgtgcccatagtccatgtaagatgtatgccaagaggctcaaatgatggcatggaggttaactagaatgattgttcttcacagcagctaagctcttttggggccttgaggtggatgagcctgaaagctgggggtgtttgcacgggaaatgtgcaactgttgcaattgggctgatgagatacatgtaggatgattggtggcaggcgttatcagaaacaaaactttggtgaagatctgaaaccgtccatggatttccctgtgccccttactaagtgcttgcacaaagaataaagctccagagctttggccatggagtcagaattgtcaaaatcttcatattttgggtcaccatctgataaggatctttatgttgatagaaaaagagcttgtaggtgcatgtcaaaagaatgtatttctttacgaggaaaaaggggtattataccctgcatgtaagtcggacactgctgttttctgacgatacatttctcgtcttttggagtaggaatttttgtacttagaaactgataatagaacattatagaggcaggactaaacaagttgtggttgatttgctgtcgaccgtgcaacgt

SEQ ID NO: 373 - DNA, 858 bp, Sorghum bicolor
  Clone ID: SORBI-28MAY03-CLUS110956_1
gcacgagggttgttggagaggcagagtggtgtgacattgaaggatgcagaaacgtgtggtgttggtgagcgcggcggtggccgtgctcggcctcgccgccgccgccttggggttcgtcgcggagagcaccaagtccaaggcttttgtaggcttcgtcgggcagcgctgcgtgtaccagcgcacgccggcgctcggctgcggcgtcgcggcggcgctgctcgcgctgacggggcttgccaccgccaccgcggccagcggatgcctccgacgacgcgacgcgcccgccgccggccgcaggcgcgccgtcgccgtcaagctgtccatcatcgcctgggtggtggtggcggtggcgccggtgatgttcctgtacggcgcggcgatgaaccggggcgggacgcgggacgtctcggcgagcaggccgggccggcgctacggccgcggctactactacggctgcaccgtgctcaagagcggcgtcttcgccacggcgtccgtcttgtccgccgtggccaccgggtgcgccatcgcggcctacgtctacttccagcggacggacgagccggcggcgccgggccagttcgtcgcaccgggcgtcgcgatggggcagccgcagtgggcgcagccgtatcctccgccgccctacccgccgcctatggcttaccctgctcctccccagtacgggcacggcggctacggccccaagcaacctgcgggcacagcttgagctcgatgcgttccgttccgtggagttgcgcggtgtcaccattagccgctcatggtttccaccttttgtgcttttcctttgtctatactgcatatctcttttttttttggtacaatgctacgggactttttttt

SEQ ID NO: 374 - DNA, 797 bp, Sorghum bicolor
  Clone ID: SORBI-28MAY03-CLUS110996_1
tttgttcatcatttcagctctgcctgctgatcgatcaacgaacgtccaattctgaaacgtgggacgccgcatacacttaggacctcttctctagagtagtagtcgtcgtcttcctgctgctttggaatttggtccagacctcgctcggggtgtctgcctctgcagcctgccgctctcgtgttctgatttctgaaccttctcacctacctcgccgcctccactccaccggctatatcatagcatagtagtgtcttcgtctccttcttcagtagctgcaaatctctgtctgatacaggttgtggttgtgtgttgctgtgggaggggatccgcctttgttcgagagagatggcaagcttcaaccaagacagcagagcagccccacaaagggaggaggcacctgtacagagcaagtacggaggcatttctccaaagaaacccctcatcaacaaggaccacgagcgcgcctacttcgactccgcagactgggtcctcggcaagcaaggcgcgagcagcaacagcacgacgacgacaacgacgacagtccccgccgccgagcccctcaagcccaagctgcagcggacggcgtaccaccagcttccccctcgacggccggcgtgcacgtcagagtagctcggcgaacgatgactactcgctggagcatcgtagggagctggaatgcgcggaggtggcaccaattgggttgtacatactgtacgaggatgccatggatcatgtatgctatccctagtgtggagtactggagtttgtatgtgaaatgaagcggccagttcactcgt

SEQ ID NO: 375 - DNA, 381 bp, Sorghum bicolor
  Clone ID: SORBI-28MAY03-CLUS111007_1
gcacgaggggaagatatcaagagcattctcctccatattgagctgagcgagaagctgcagcagcccaagagtacaggggcctaaagacaatgggaacaccccgtctggccatgtagagacgctgagaatagatgttaatcatttttggcatgagtttttgtcttggatcgttaacaaggcgatatttttttcttctctattgccgcatgtccaacagttagggatttagtgctcacagatagttctgacaggtttttttgcatactgaaaggagcttggggtttcccccgtgtaagtccgaacttggaatcacatggccgtgctgccctctgaaagaaaggcaatgttctaaaaaaaaaaaaaaaaaaaaaaaaaaaaaaa

SEQ ID NO: 376 - DNA, 451 bp, Sorghum bicolor
  Clone ID: SORBI-28MAY03-CLUS111123_1
gcacgaggccatttcctggggttcttgccgcgggggcccgtgccgccgtcgggcccctcgcggcagcacaactccatcggagcgcaggaccaaagccatccctgacgacgacgacgacatgccggtgcgatcgatgcatgggaagaacgaagccggcagccggccggcctgcctgccttggtgccaatcgatggaggctgatcgaggaagatatagtagagtaagatctcgaagagagttctcgcatcatcatatcatatcatggattaattagattcatggttggttgccaattgtagctaagcaattaagctcgtagcagtattgattagttagttagttagttagttagtatacgtagcagtagcagcaatatatacttatgtatacttggagggaacgaagaggaacaagtaaggaggcacgtttttccccaaaaaaaaaaaaaaaa

SEQ ID NO: 377 - DNA, 527 bp, Sorghum bicolor
  Clone ID: SORBI-28MAY03-CLUS111245_1
gcacgaggggctcgcgggaactctataaaagcaatgaaatgcaccgtgaagctctccgactactcaatcagttagttgaagaatcaaaatctgaaatggagaatgcagattttaataaaaaatttaaccctcaaatgatacttgaatatctcaggcccctttgtagatctgacccaatgctggttttggagtcttccttgtacgtccttgagcgcaacccatcagaaactattcagctctttttgtctgaaaatgttccagcagatttggtaaattcatatctgaagcagcatgctccaaatttgcagtcaacgtacttagaactaatgctctcaatgaatgatactgggatcaaccctaatctgcaaaatgagctggtgcaactgtacctttctgaagttttagactggtacaagattctgaaggaagagggaaactggacagagaaaacatattccccaacacggaagaagttaatatctacattggagagcaattcatgttacaatacagacttacttcttaag

SEQ ID NO: 378 - DNA, 629 bp, Sorghum bicolor
  Clone ID: SORBI-28MAY03-CLUS111293_1
ccggtcaccacctcgccggcccgcccctctccgtgccgtcctccgcgtgcgcccgctccaccttgcgtgcctgcctctactacctgctgacacgccgccggcgggtcgtcctcgcccgacgccacggggctaccccgggaaccaggatcgtctgccgctgtctgctcgccccttcctgctcctccagctccatcggagatccgtcctggcgtttcctcccgtttcagcacctattgatggattagagatgtaagactgcttcaactatttggtttgaagaaaacaagttcagatgggctccattctaagtgcggcaaatactacggctaagtctatggatcatcatgagacatctgggacatatcctaataagagggtgaaggtatctacttatgagtatgggtcaaacccaaggattatcccgactcttcctgatgagatctcactccagattctggcaaggttaccacggattcattaccttaacttgaagatggtttctcaagcttggaaggcagcaatcattggttctgaactttcccagctgaggaaagagcttggcgtaagtgaagaatggttgtatgtactgacaaaggttgaggcaaacaaactccattggtatgccctcg

SEQ ID NO: 379 - DNA, 540 bp, Sorghum bicolor
  Clone ID: SORBI-28MAY03-CLUS111296_1
gcacgaggcggccaccgtgccttctccaggccgcgccgacgccccgcgaagaagaagacctcggttgcgctggcgcccgtcgcgaagccccctccggcaagaagctccgaaagcaggcggcggaccctcaagctcgtgcgctggctcgcggaagctaagagggttgtaagagcatctgccgcgggaacaaagggctagtacttttcaatcctttgctctgcttgttcagtgccagattataccgaattgcatactgtagaaattggctaggactatcctggtccgccactggtcatggcgtgtgctgcttacagtatcagaggccctctcaagctcgctgcaaggcaccgcttggatgtgttgactagtaacaactcgtgcaatggcttcaagtcttcagtgtcataccccgtcgctcagaggtggagcagcaactgctcatccatcacaatgcggcatgtcgcctcccatcatcacttgattgttaaggcttcagcaatgttgcactcaaaagcttcagcaactgatgcagccacggct

SEQ ID NO: 380 - DNA, 518 bp, Sorghum bicolor
  Clone ID: SORBI-28MAY03-CLUS111307_1
gcacgaggcggagctcggcgccggggacgagtcggagccggcggcgaccaacagcgttgcctccgacgcgccctcgtcgctggcagcggaccgcgtcatagtggtctcgaaccagttgcccatcgtcgcgcgtcgaaggcccgacggccgaggatggtccttctcatgggacgacgactcgcttctgctccagctccgcgacggcattcccgacgagatggaagtgctgttcgtcggttccctccgagccgatgtccccgtagcggagcaggacgaggtgtcgcaggcgctgctcgaccgattccgctgcgcaccggtgttcctacctgaccacctcaacgaccggttctaccacggcttctgcaagcgccaactctggcctctgtttcactacatgctccccttctcatcatccgcgtctgccgccaccacctcttcctccgtcgccccttcgtcaccaggcaacggtcgcttcgaccgcagcgcttgggaggcgtatgttctcgccaacaagttct

SEQ ID NO: 381 - DNA, 571 bp, Sorghum bicolor
  Clone ID: SORBI-28MAY03-CLUS110420_1
gcacgagggcaagatgttctgattaaaatcttgtgcaaggtgaatcacagtgatctgaggcagctcctcctggtgtcaaaaccagtcaacgaagcgacaattgttgctagggagctgcatttcaagttttcaacgccgtcggcgaagtctgtttttagagacgaggaaaccggcgacgacgaggacggccccggcgcgcccaagcaacgcagggttgcaaggtcgcgcctccggggcaagaacctggagggcatcgccgtcaacctgtcggcgtcgtttgagagcttgcgctccgaggtctagatgtacatatatcacatcaaagattggtctcgactgaacaagtgttgactgcatcgatgctgagaaaatctcctgggctcctgaatcgatgctgataaatccaggtgtcttgactttggtctttggatggtggtgccagttctgttgttaccacaaatgcttttgtctgaaagtctgaataagtgacttctgttcttattgcggataccacgaatgcttctgtatgaaagtctgaagaagtgaatccatgacctattgctcgttcttc

SEQ ID NO: 382 - DNA, 827 bp, Sorghum bicolor
  Clone ID: SORBI-28MAY03-CLUS111308_1
gcaaaatttgcaaaattagaaataaaagaaaagagtgatgcttaaatactttaagcgatttttctatcgtaaccagaaaagcttgctcgttctaacctcgctgggcttcgtgactgctttctgggccaagccggtctatttcctattaatcgaatcagagcgtccggaatacaaacaaaatccacaacgacaacaatatctaaaagaaacagaggcaagacgtgagctcataaagaaaaagtacaagcagtataaagagagcactgatccagaggagagaaagcgactcaaagaagagctagatctaattcataagcagcgattgtttcagcagcaaagagacgcctttaaaggactgggatccggaaatccataaagagctatcatgttcacatatcagacagatcaaactagcccgatagagagatatttgactatcgcttgcgccaccatactcgagttctttgtctcatctatactcatttattttattgcattcaccttcggcgcttatctagtagagaatatgaccgagacgtttgtgtttagcgcttatatgagttgtctatgcgtcatgcccttacttttactcactcctcacaccaatccgtttcaaattatagagcgagttttgatcaagagtagctatcataaccaaatagaaagattgatgcgtcaagtggcgtacggcgcggtgattggcgcatggctcggcgctttagtcataccactagactgggaccgctggtggcaagaatggccagtatcgtgcatcataggatgcactggtggttcgattgtagctttcaggtatgaaactttctcct

SEQ ID NO: 383 - DNA, 400 bp, Sorghum bicolor
  unsure (1)..(400): unsure at all n locations
  Clone ID: SORBI-28MAY03-CLUS111369_1
cgtgccggccttcctcgccgcgctggtgcagtgcttccactgggcggtgcccatcccgcagggccagtccacggcgccgcccttggacatggaggaggaagcggggctcgtcaccgctcggaagcaccacctcgtcctcatcccaacaccgcgcctcaacccactgccggtgccggtgccggtgccggcaacaggaaaagctacctagcagctcgatcgatnncgtacagcagatcctcggatgttcatcatctccgccatccgcacgtcttttatttcccatcgcactcttaatttaccaccactctgcatgcagttcgtcttcgatacgtgtaaaccgctgaaactatgctatgggtgagaatcttaataaatctgattgtttgttttgttttttttt

SEQ ID NO: 384 - DNA, 563 bp, Sorghum bicolor
  Clone ID: SORBI-28MAY03-CLUS111429_1
gcacgaggatcacactcaaacttttgttctgttcacagagaagcaaagcaacatgtggttcaaaactacagtgctagctattggcattgcatggagcctggcgggaagcaagacaagctcccgtccaagggtcaccgtcaagaacggtacatacgagggcacctactctcctgaataccaccaagacttcttccttgggcttccttatgcccagcctcctgttggcgacctccgcttccgcgtccctaggcctctgaacagttcttttgagagtatccatgacgcaaaggcctacccggcggcatgtgtcggctatggtggcgatgcaatgttttacaatgaattatctgaagactgcctgtatctcaacgtcatccgcccagctggctaccaaggtgagaaactccccgtggcattttggatgcacggaggcggtttcttccaaggagctacgcaggacaagagatacaatctcagtttcatagtccagcaatcggttgagattggacaacccatcattggcgtttcagttcagtaccggctcagtgcttggggcttcctct

SEQ ID NO: 385 - DNA, 823 bp, Sorghum bicolor
  Clone ID: SORBI-28MAY03-CLUS111439_1
gcacgaggccaagaagaagccccgtctggaggacggaacgatcgatcactcaggttctaagcctgccggaggtcacaagcttgggcccaaagcgaatcaaggagctatcaacgccggacttcgcgctctagatcgctcaggcaaaccctgtcgccgatgggccaagggagggttccaactcaaaagcttcactggtgtggcatgggagatccctcgctgggtggcacctcaaaagaaggctcccgaatccagcgctgaggattctactgctgcatcagccgagggcagcagtaaggagaataaagagaacggccacgagagcaacagtgctagcaatagcaatactgctaatgacgtggagatgcaaagtgcgcccagtaaccacgcctcgtcgccggcacctcttgctattgccgctgcttcataaaaacccaccctacgatgctacctattttccttttcattttgctcctaccagagaatattttacagcgcgagatactacgggcgttctaggttggcagacgactcattcttggcctgtcagtgagactgagatgctcccagacagagcatgaccgttcattcattcgaaatctttttttatggggggttttttttttttcttcatccaaaaagcgacgctggtgtcgctgggcgtcacggaacagcgaggatggaacgctgtggaaaaggattggcattaaaccgtaccaaggctggcggagcatatatttgatgtataattactgttacgatgaggcaatgttagatacctatactctggtaattctctgaaatgagcaatcaaattttgtttttt

SEQ ID NO: 386 - DNA, 615 bp, Sorghum bicolor
  Clone ID: SORBI-28MAY03-CLUS111485_1
gctggcttacccgcctggtgctcccgcttcaatgcggtaccagccggagtgccccccgagattggctcaacgcacttccaagagattgccttcatcaaacagaatcgtgtgggcggtggccaaggctactacatgccaccagttccgcctttcaaaggcaaaccagacagttacacgcagttatccaagctcatgggcatgacgtggatcagtttcgtgctgagagatggatcccaatcattggcgcaaagtcaaaaagtctcgggcgctggagctgccagattctccaagatggccaacctatcagaagggatctttggagattgtatgggatccccgtgtggatggtctggcttatgtggaaacggacacttatcgggcggcggcgatcgatcttattaacagagcggccgcaacagtattcgaccgttgatagtagctttcagaagtttagtaagcatatttggcgtcatcccgtcaattggcgaagagaagggagaaggagcatgcttgcctcgcaaactggcgagaggaagatgcggtgaggtaccaaccaaagcttatgccccatgtcatatgccactcctgagttataaatagacaccctgcttctgt

SEQ ID NO: 387 - DNA, 1047 bp, Sorghum bicolor
  Clone ID: SORBI-28MAY03-CLUS111517_1
gcacgagggtcacctcgctggagtatccgtgtaatactagtacagcacgggcgggcgcgcgatcgcacccacgcaaatcgcgacaatcccccagtcccccaccgtcccaactcccaacgccctcgcccgtgctcgcagttggtagggttctagccatggcgtggagcgccgccgccgtctccaggttcgccgccacctccccggccgcggcacccatctccgtcaggctcggagccgccgcctcccgctcctccctgtccttctccagcgggcgacgccgctccgtcgccgcgtccctctcgacctccgccaccgctgtaaaggaggctgttcagacagagaaggcaccggcagctctaggcccttattctcaggccatcaaagcaaacaatcttgtgtttgtttctggagttcttggcttgaatcctgagaccgggaagtttgtatctgaaaatgttgaggagcaaactgagcaggttatgaagaacatgggcgagatattgaaagcaagtggtgctagttattcttcagttgtgaagacaacaatcatgttggctgatctgcaggatttcaagaaagtgaacgaggtctatggcaaatatttcccggcacctgcacctgcacgttcaacataccaagtggcagcgctgccactgaatgccaggattgagatcgagtgcatcgcggctctctaatcagatcattcaaccactcatcaaaatcatcaataagcattcccaccgtgtctatgtagttcactatcctggaagcccctgaggcatttgtggtagaagtacttctagtgtcaatcgaaaaaatgagacttgtaccagtccagttcctgaaaactgcggataataaaccttggtgtccaggataagtgatgtgtgtgtgaacagtgcatctggtaggagaattgttgggtggttcgttactcggattcttcgctctttaagagtacgatggatcaacatcagtagccttaggttttatagtgagacttgtaaaagcaacaaacaaacacaccgtaaggcttgtttagttctc

SEQ ID NO: 388 - DNA, 739 bp, Sorghum bicolor
  Clone ID: SORBI-28MAY03-CLUS111532_1
gcacgaggccaacccaacgctcccatcccatgccgtcacccccgcggctgcggccgccgccggcgagtgtgcgggccttcctggacgcgcacttcgcgtcccccgacgacctcgcggccgcgcccgcgctcgcggagctcctgcgccgcgagtgcgccgggctcgacgcctcgctccgccgcgccgaggcgcgcctcggtgccgcggccgcgtcctggctcgcgcgctccgccgaggcccgcgccgacctcctccgcgtccggtcacgaggggtgcgcgtccgagcggaggacgacggcgccgaggcggccaggacggtggggctgccggcgcttgtgcgggagatccaacggatcgacaccatccggctctacgcggttgacggagtgaacgagccggaaaacaagaacgttggagacgagtaccgcgagtttgatgccgaggacccggactgtcagcaggagtttgccgaggacgccgacggagaggaagatccggacttcgatcccgaagtggcgttcgagtaaggtcgtgtctgcacccaactaagcctgtggcattgggacttgtcagatgttcggttgtgatatcgtttgtttctgggtcctttggacctatgttgtattttggtgtcttattattatagcgtgccttcattgtccacgcttatcgagactactgcgctgaaacttatctgatgtaataaatgtgttactagcctcctgggacctagtattgt

SEQ ID NO: 389 - DNA, 721 bp, Sorghum bicolor
  Clone ID: SORBI-28MAY03-CLUS11162_1
gcaatgcttcttgcattcaaagaggcaataaaagattacactacacctccaaataaaacactcagcagagatcttactgcaaaaatcagcagttatgtgtcatttcttatcgagtgtaggcctctttcaatcagcatgggtaatgctattaggtttctgaaaagcaggattgcaaagctaccacatgcactgtcagagtctgaggccaaaactcgtcttcagtctgatattgatcgttttataaatgagaagatagtccttgctgacaaagctattgtcagccatgccatcacaaaggtcagagacaatgatgtcttactgacatatggatcatcatcagttgttgaaatgattttggagtatgctcatgaacttgggaggaactttcgagttgtagtggtagattctcgcccaaagcttgagggacagggattgctgcggagattagtggcaaagggcatcaactgcacatatacacacataaatgccatctcatacatcatgcatgaagtaactcgagtcttgttgggtgcctcatcaatattatcaaatgggacagtttattctcgagttgggacagcatcggtggctatggttgcacatgcatttggagttccagttctggtctgttgtgaggcatacaagtttcatgagagagtgcaacttgattctatatgtgctaatgagcttggcgatcctgatgtcattttgaaaattcctg

SEQ ID NO: 390 - DNA, 333 bp, Sorghum bicolor
  unsure (1)..(333): unsure at all n locations
  Clone ID: SORBI-28MAY03-CLUS11164_1
ctgaaatgttggccatcaaagaagaattttcaacattgtgctcattgggaagtgtatctatgttactgtaattcacatagtacctatgtaacagttgcacatcgccgtatggataaagatttgtacaaggcagttgatcagataggtatatgtagccagggacaaatatgtattagtacttttcctggtataagaaactggtgcagtacttggaatccgtactaagtgtcaacactggctatattactaagtgtggtatggggaaacaataccaagtgtcaataacagtacgcatgatcgtttcttccgaatgaataaatataaanaaatana

SEQ ID NO: 391 - DNA, 674 bp, Sorghum bicolor
  Clone ID: SORBI-28MAY03-CLUS1109_1
caaagcattttgctgctgggacagaaaaaggaattgtatcagttatcaatgtagaagatgctacaatcttatatcaaaaacagtttgagtgtcgactatctggtggagtcgcctctttgcaatttgaaatctatagtcataatcgacgcgtccgggacattttgatagcagctatggaagattcatctatttttattatcgaggaagaaaatgggaaacttttgaaccccaacccagttcagactgacaaacccactaaagcccttcttctgcagatgttagagttattgcccaatgacacaccaggagtttcagataaccacgatacagtatccaaggaatcattgctgttactttgcactgaaaatgcgatccgcttattttccttgagccacgcaattcagggcacaaagaagataatcaataagaagaaattgaacagtagttgttgtttcgcctctcttattcatagttcttctaatgacattggacttatacttgtcttctccaatgggaaaattgaaataagatccctggcagacttatcgttgttgaaggatgcatttttacgaggttttgtgttctcaagaaacttgaattcaactagttccatagcatgttcatctgatggagaaaccatcttgttaaatggagaagagacctattttttctct

SEQ ID NO: 392 - DNA, 441 bp, Sorghum bicolor
  unsure (1)..(441): unsure at all n locations
  Clone ID: SORBI-28MAY03-CLUS111660_1
gcacgagggccggccaaaaccaatctcggcgcttccttcccggaggaacccctccggaagtcagccgatcccggatcacccaacacaccgcacttggtttctcccgcaccggcgcgcaaaccctcatgcgactagggttgcagcgatctcgtctcgctaccgagcgggccggctgcggaacgggccacccacgccacgcactcctctgcttcgatagacttcacccgccgctgaaactgcgctttgcgctgtcgccactagaaagccctcgccagtcctttgcctcctcactccgtcagggtcgggcgccgtcagcccgcagggttttgttcctaactttttagcctctatttttgtcttgaatggctacatctctggatgttccactggatgatttgattaagagcagaaatgggaggggaaggggaaggggcangggac

SEQ ID NO: 393 - DNA, 481 bp, Sorghum bicolor
  Clone ID: SORBI-28MAY03-CLUS111739_1
acggcgccgccatgtccttcgccaagaaccccaagcagttcgggtttacagaggggccactgcggacgtgctgcggcggcggtgggccatacaacttcaacccgaaggcgagctgcggcgtgcggggctccagcgtgtgcacggacccgtcggcgtacgccaactgggacggcgtgcacctgacggaggccgcctaccacgccatcgccgacagcatcctcaacggcccctacaccagccccaggctcctctgatccgaatgagaagctcatcatccatcggcaggcagcagctcatatctcacctgtagactgtagcggtgccaagaatgtgcccgtgagctgctagctgtggtaattaaacgactgttgtatgtacgtactactagtagtgtgacggtgttgggactggtagggtgactcgtaaaactaaaatggtggagttttgcgtccgcttctcgacttgtggcattggtgtactg

SEQ ID NO: 394 - DNA, 1174 bp, Sorghum bicolor
  Clone ID: SORBI-28MAY03-CLUS111665_1
gcacgaggcacactcacataaataacatatcagtcatgtttgccactgtctttaccactgttctcgccgtctcttccttggtctccgctgctccttacacgctctccaacgagcgccgttcctatgctcaggatgcggccatcctcgagccgtaccacgactataacactcgttacattgctcttggatgcaacactcagcatggcaaacccttcttcgatcaatgctgccaccctctcctcaagaccgtaagcctcccttctgcttgcacaccttctccatcagcttcggtctctgcttccgcagtagatgcgactcaaactcctccccccggtactgtagatgatgatgacgatgaggactgtgatgatgaagacgatgatgaaacatcgagtgctcctgctccttcctcttcagtccagcctaccaccgctgctgcacacaccgctgtccccgtaacaagcacaaaggcacccgagaccaccaaagcttctcccacatcctcgaaagcccctgctgcaactcaaccctcgtcttcttccaactccggtggctttgcaacctggttccgtcaaaacggtgttgccggtgcatgtggtaccgttcacggcgagtatgatttggttgttgctatccagaaggaccgttatggtaaccttggtgcaaaatccaagctttgtggtgaccaggtcaagatcaccaacaccaacaacggcaagtcggtcgtggccgtggttgctgatgcatgccccagctgtgtcaactccaactcgattgatctttctatgggtactttccagaagattgctactctcgatgatgggatggttcctatttcttgggaatttgtttagacaatgattaatcatggtcccatcaactcttttttttgtcttatttctatattcctcttttctcctgatacgttctttccatttttcacgttgattcaagcccaacggaccttccaatgcttcaaattctttgtgcatattgcgttggttctattcttagttgtaaagttccccaagcattcagctcttggatgaacaggtcgcaaggcttttggtccttgttgactttgttctgttcttagccggacaatttttttatcattgattgagtacaatagttgttcgggcatgctctcttcatttaactttgtttactgctt

SEQ ID NO: 395 - DNA, 517 bp, Sorghum bicolor
  Clone ID: SORBI-28MAY03-CLUS111945_1
gcacgaggggataccgggcccaagccggcccgactcgagggaccaggccgtgtctgggctgccacctaggcacgtggcacgacacgggcacggcccgttccaacgatcggcccggtgaacatgaactgttggtgtagttataatttgtatatatgtgctgttaattgttatattcgtgaaaatgatgaataattggtgacaatgataaaaatatttcagtatttagtgaaaatattaatgaaaatgagatgttgtcggtttgatgggccgtgagccggcacgacacgaaaactagcccgcaggccgtgccttgggccgaagcccagacacgaagcccgtagaggcacggcccgctaggcacgacaacccgtagcggtccggcgatctgtggcacggcactacacgacgttgagctggcccggcacgacccgttggacatctctattagtgatgcacgtgcaggtgcaacataaaagatattacaaactatataaaaataatcaaaaaaaaatgttat

SEQ ID NO: 396 - DNA, 567 bp, Sorghum bicolor
  Clone ID: SORBI-28MAY03-CLUS111946_1
ggttcacagaaatgtgggaatatgtaggaaaaactatgcatctttgatttaagtagcaaaagagggagcttgaactcattacctgatccatcacaactttcttctctgcaatttgactacaggttgtgcccctgctaaagggatcatgcacagcaggttagcagctgtgagtgagagacaaccataccacctcttcatcacaattgtgatttgtgagctgaagctacaaatacgaccttcggcgcctctgtaaaagcggaacaatggcaagacacagacatggagcctcttacagatatgtgtctgttcattacagttgaccataagaaattgcagtcctggatgcatctcggcaaactgatgtacctttttggaaatttgacgaaaagagtgtagggccttgcaagctccacagctaggtgaaaagaagtgcaccactgtgaatttatctctggccatcagaagctgttcatcaaaatcgtcctgtgatttgatatttatcacgttggccttcatgtctatctcccaccactttgttgtcatacggagctcgggtgatctgccaac

SEQ ID NO: 397 - DNA, 371 bp, Sorghum bicolor
  Clone ID: SORBI-28MAY03-CLUS112026_1
gcacgagggagcaatgtctcacgagttgcataaacttcaggtagaagaagaagcaatcatgcacaaactgtatgaacttatgtctgcagaaggtctccttccaaagcacaagaaagaaaagcatttggagagagatgtcaagcaatcaactgtggcaggaaaacaaaggacggaaccatagaaagcaaacttcaaattgcaatatgatctgactttgagttcagctgaagactagatggtgcctatcttctccaatgccatactctgccaccgcagctcaagtttcttctatgatttagaaatttggtggagacttcaaatgtttgtatgatctagtattttccgaactgcatgatggaaactggtatctg

SEQ ID NO: 398 - DNA, 723 bp, Sorghum bicolor
  Clone ID: SORBI-28MAY03-CLUS11204_1
ggttatcttctggattgaatgagtacctcatttctgataaaagaaatgctgatataatcagccagaataaggagggcatttatagcatcctcggtaaaaaaatacagttctacgtagtttgtcatttattttctgaaatgctgagaaacatacagccgttcaaccttcttagcatgaagatgcaggcataaatgcaggatactggggtatgtttctaattggtgtttctttgggtttctatctgttcgttgacactagttcaaagggcaagaacaggaacactcaagtcatgaaaatctgggttcttgccgcatctttttggtttttggcaatcatctttgatagctatattgagagagtttctcggcgaatgtgcaacttcgcttatgttatgcttgtttttggccagaattttcaggttttatctatcctcacattagctgggttcgcctcatataaaaagaacctggttcttgaagatgcactcaatcaaaacatgcttggttcattccttttggcaaatatccttactggtctggttaatctttcagttaacacgctttttgccttttccctcactgccttcatgattctgtcagtatacacctttactttgtgcatggttaccggccttgcccatttttgtggtgttagaatgaagttctggtgaattgtaaggtaccgtttgatatgatgcttgcttgaaatataatgaattttttt

SEQ ID NO: 399 - DNA, 432 bp, Sorghum bicolor
  Clone ID: SORBI-28MAY03-CLUS112141_1
gcacgagggccccagccgccctcttgcttgcttcacacgagcgacgcgattaccaaatttttttccttttccgggggagtggttgttcgtcctgtcggcggcgggcggcggagggatggagacggcggccgcggcgatgctagaggccggggtagggcggttctcgcgggcgccggcgatggccacggcgctgctggcggagatgtgggcgccgctggccgtggcgctggcggcgctggccacgctgcccagcctgctgcgccgcctgcaggtcatcgtgctccgcctccggtcccgcgggaaggaggtcatccagtcgcacatcgggacctactactcgtcctgcgacgaggaggatggctccgacgacgaagacgagagctccgacgacgaggacgaggacgccagctcctccggcgacgacggggaggg

SEQ ID NO: 400 - DNA, 906 bp, Sorghum bicolor
  Clone ID: SORBI-28MAY03-CLUS112308_1
gcacgaggcgagcatcttgttagatcaggaacactcccaaaaggaagagctttggttcctggatgtggaatgggatacgatgtggtcgctctggcaagtcctgaacgttttgttgttggcttggatatttctgatctggctgttaagaaggctaagcagtggtcatcctctttgcccaatgcagattattttacttttctggctgaagatttcttcaagtcgataccgagtgaaaaattcgatcttatatttgattacacgttcttttgtgcacttgacccgagcttgagggtggcttgggcagagacagttaaccggcttctaaaaccagatggagagcttcttaccttgatttatctgataagtgatcaagagggaggaccaccttacaataatacagttgctgattatcagaaggtactggaaccgctgggtttgaaggccattcttatggaagacaatgaggtagccattaaaccacggaagggctgtgagaaaattgggaggtggagggagatgtgcacaccaatcatctctgtgagacaaagcagtggtattttcctaaacaaacaaagaaaagaagtagaccatgtcgctgcctcaattattggatgctttggtgctcctgctccgtcaccttcggacgtcaatgagatgctagcttcaattggggagatgcatagagatctcggttgcctagaggtgtcgcctttagtggctagttgtgccactacattcgttgcttctcttagagttgatagtggttcggtcgagaattgtatgtgtgtgattcatccctgtgagactagttttgcaggtatcctgttggttttggtaagccttagtaagttagtttactaagactatttgttgtaatcttctttcctcttaatgaaaaacatgctt

SEQ ID NO: 401 - DNA, 474 bp, Sorghum bicolor
  unsure (1)..(474): unsure at all n locations
  Clone ID: SORBI-28MAY03-CLUS112343_1
gcacgagggacatcctgatcctggacgacagagacctgctgcaggcggaatctaccaaggcaggcagcccatacctctcggctaaagacgcagcctaagatgatatggtccatcgtctccgccaattggtcacacatgatgcacagattatcttcctggaggccatggcgccaccttctgtctgccgtccagcacttcttgtgcaagacaagccaaaagaacagcttaacacgcggaggcgctgaggttttccaaatctgagttgctcccaagggtctagttttacagaggcaatggcaattgttcttgtcctaaagtttagttcgcaaggtcgctgtgactcgaacagttcctgagctggaccagcgttgtgtgttggaaatactttgatgttgtattgggcaagcctgcttgtaacctgtttaagaactgaacatcaagattgcattttgcatttgccatttgaaaaanaaa

SEQ ID NO: 402 - DNA, 549 bp, Sorghum bicolor
  Clone ID: SORBI-28MAY03-CLUS111329_1
gctctttggacagtggtcagataaaaagatacaactccgaagaggacacatgggtaactatcttgccacaagtcccggttaatgacttcactgatgcagaggccccttatttactcgccggtctccatggaaggctccatgttataacaaaggcggcaaacaacactcttcaagttatgcaggctgtagtacagaataactcggataacgcggtatctggagaaaatgtggtatggaccactgtggcttctaggaactttgggacggctgagcttgtcagctgccaggttctagatgtttaaaatgtgggtcacaagttacactttgtagagcatatagtatatcatagaccatcgttttaaccaacaaatatatagttttttttcccttttgtctgtgtgtgtgtggagcaagcgtttaatttgatgtggagagagatcaattacagatatgtgtaactgtataagttaactcagttgctgggagtctgggacacagtgtgtatagacatacatcgacctgttaatgtacagtgatcaattttagttt

SEQ ID NO: 403 - DNA, 1001 bp, Sorghum bicolor
  Clone ID: SORBI-28MAY03-CLUS112482_1
gcacgaggctgcgacgtgctcaagcaatgcccactgctccaggatgtcccgctgccggtgccggcaaggggtaactggggtcgcatcctcacaaattttgacgccaactgtttgcgggacgtaactatcagccgaaacaaagactcgatcaagtatgttgagttggaattcttgtcacgagaagagctgaatgccacccctgtttcctacactgactgggtgcgcaataactcaaggaaataccaggtcatccgtgatggctggaaagccacaacatggaacatggcaataccagttggttcgccggagggctggcaccgtgactgtgtagttgacgttaaagacgtcaacatggaggctagtgacccatgtctttctgatctcatggctatgctgagcagcaagaccacacgaacattgaaggaacttcctgtggcataccccatcctaagcatggatgatgatgttgtttacttgctttctcgaaccagaacccagggagatggacaagttggcactgatgtttgctattgatttgaggaaggcaacattgcgaggattggctgagcttgatgtccagaagttcattttcttatgtaacttctgcacaagtgagatctgcaggggtacctgagcaatattaaggtagaagcgaagcactgaagcgagctgaaaagtagctatcaaacaaactgaacagggtaaaccactaaaccatctgaggtgcatgcaagaactggctaggacaaagaagcgtcaacctgtttgttgaaacatggtacaaagaatctggatgcagacattggagattgaacttcttgagttggtttatgaaaattatgtgtaatgcaactatctggattatgttgctgtatgcagatacagatactttattatgtactagtggacttgtgtgggctaaatgttttggttgaaccatgtttttgtgttttgatttggttttactttttctgtatgcacttttctctcttcttcctggc

SEQ ID NO: 404 - DNA, 687 bp, Sorghum bicolor
  Clone ID: SORBI-28MAY03-CLUS112559_1
tccatctctcctgatgtcattttactatttgattcatacttttatatcgtgattcactatggctcaaagattgctcaatggaggaagcttggctatcataaggacccaaaccacgaaaatttgcggaagctccttgaagcaccagaagtagatgcagaggcactactggtagaccgtttccctgtaccaaaactcataaagtgtgaccagcatggtagccaggccaggttcttgcttgctcggttgaatccatctgtgacacagaaaacacagctttcagagggatctgaagtcattttcactgacgatgttagtttgcaagtgtttattgaacacttgcaggagttggctgttcagagctagaaagtcatgtagcctgactatgtcagttgctattccactttggtccatttaaggtccttaagatatagctttaagagggaccagacttcatattcacagatgaagtttacttgcaagtttttattgaacacttgcagtaattggttgcgcaggattaacgtgttcatgtggattatttatatgcaattttctgctcacttgcaaatactggggagctctacagcctggaggagtgagatctccctgatttgtacattgctcaagctccagtttgatgtaagccaattacttttactagttttgtaagcagtggttttatccgct

SEQ ID NO: 405 - DNA, 474 bp, Sorghum bicolor
  Clone ID: SORBI-28MAY03-CLUS112592_1
gcacgaggtggaggtggaggacggcaacgtgctcgtcatcagcggcgagcgcagcaaggagaaagaggacaagaacgacaagtggcaccgcgtcgagcgcagcagcggcaagttcatgaggcggttccgcctgccggagaacgccaagacggaccaggtgaacgccggcctcgagaacggcgtgcttaccgtcaccgtgcccaaggccgaggtcaagaaacctgaggtgaagaccattgagatttctggttgagcgaccatatatgggcgctggatgatgaagatgtggcgggaagcgtgatgctgttttcggtcggttgatgatgtgtgtcagatggtttgctgcaagtgaagtctattgcctgtccacgtatttctcttaccttgttggttgaataatctgtaatcagtgttctgcatgtgtaattgtcttgagactttataaaagtaaataaagcatcttctgtaccttcc

SEQ ID NO: 406 - DNA, 540 bp, Sorghum bicolor
  Clone ID: SORBI-28MAY03-CLUS112604_1
gcacgagggaggacccgatggagaagaaggatctgctggccgtccggaagaagctgcctgcgtcggcggcaaagcggaggcgcaaggtggtggcgcccgctaaggccggcgccggggggcggctcgcgaaggtgatcgctgcgtacctcgcggccgactcctacatgtacgcgccgctggtctccgctccgccgtcgcccccaccgccgcctcgggcggccgcggtggcgccatccgcggcgcctcctatatccactcctgagaaagaagtcacactggtgcaaaaatgcagaggctctttgcaagcaacattcactgcctactagaagtatttgtggacatgttcttggagctgttcggagctgtgtgcttcttgttctagcatgacctttaagagctacaatagttgtttctgtgctctgttatgttaatgactagatattgtggctttgcaatctaccttcttctggagttctcatgtgattgctcaccattttaatatggattgtaagtagttttattgtgtgagctatgttcact

SEQ ID NO: 407 - DNA, 535 bp, Sorghum bicolor
  Clone ID: SORBI-28MAY03-CLUS112620_1
gcacgaggctcagccgccctcatcaacttccttcgcttcaggcatgattgctcacagcccatcgccaaagagtacagcccgcttgaggaatggctgaagaattgctaagatcaccgagctcgagaaggcgaaagaagaccatttgcttaaggagcaggtggaggcaccatggtccagcagctcgagaaggagttccatgccatcaagcggaggcttcatgattacaacagagagcagctgtcgctacgtgttgcatcaaaagccatagaggaaaagataggaaggtgttgattcctatcttgcgttgcatttttcctttcttttgattagaatggtgcttgggcttttccttggtatgttttttattcttatgttctgtgtgatcgatgaaaagcataggcttacaattaatgtgggcttttgtttacgtatgtcaactttgaacctcctgcatattttggctgctgtcaataatcttggcactactaccttgctgccttaaaaaaaaaaaaaaaaatccgagggggggcccggg

SEQ ID NO: 408 - DNA, 332 bp, Sorghum bicolor
  Clone ID: SORBI-28MAY03-CLUS112636_1
gcacgaggctctcgcgcgccgcgcgggtgctctcctgcggccgccgctcctactgatgccatgtcatcgtccgtgctcgcatatatatatatatatatatatatatatatcacatccgaatcgtcctcatgtgttcccgtgttcgtcgtagctgtgtggtgtggggtggtagctctgtcgtcgacgatgcatgcactcgtgtgttaattgtgtgtacatattcttctgtatatgcatctatgtgtacttgtaataatatttaaacggcagtatagaccgtttaacacactgcggtacgctgtttttatttaacaaaaaaaaaaaaaaaaaaa

SEQ ID NO: 409 - DNA, 548 bp, Sorghum bicolor
  Clone ID: SORBI-28MAY03-CLUS112655_1
gcacgagggtacaaagaagcacgatagcaagcaacacttgcccttaatctctcgacccacacgatcgacgacgaccatgagctccacggcggcggtgacgacggcaccggggagcggcggcgccaagacgtcgtggccggaggtggttggcctcagcatagaggaagccaagaaggtgatcctcaaggacaagcctgatgccgacatcgtcgtgctgcccgtcggctcgaaggtgaccggtgattatctgcctgaccgcgtccgcgtcttcgtcgacaccgtcgccgagacgccccatgttggctagttgccaccagctcccttttactccagccacaactgaataaaagaaacaaaatatatgtgtagtaaactcaacataataactcagaagatgccatgatcgatctatcatgtaccctgttcatgcatcttccgaatggttccggatgtgtgttttactttctttgaatggtaacatattgtactactaaataacaataatgctcatctgctcctctagtaagcacaaaaaaaaaaaaaaaaaa

SEQ ID NO: 410 - DNA, 816 bp, Sorghum bicolor
  unsure (1)..(816): unsure at all n locations
  Clone ID: SORBI-28MAY03-CLUS11275_1
gccggcccgggtccannaaanannnnnnaaaaaaaaaaaaaatttcaaaaaaaaaaaaaaaaaaatttctttctttctttctggttggctccactcattcctccaccgaccaccgggggccctgctcacaagattcaggttgttttcttgagctgctgtgcatttgtcagacacaatgaaagctagagaacccaagaaagcaaggggtcgtgtcaaatgggatgaggagaacttgaatgacattgagtcaaacaaaccagaaagagagaagatcacggagcctaagacaccttaccaccctatgatcgatgaagatgaagggcctgtttcaccgttacatctcagtgaagatccagtggatcaatctgctcatgctgatgccataaagactgctctagctgaagctgtttcaagtgggaagatttttgacagaaatagttgggatatgtgtgacagtgaagaagccataaaacatgggaaagcttttgaagagcaccggaaggttcactacgacgagtaccataagatgaaggaactgcttcagaagggaaccatgaatgatgacgcagatgaagatgagagtgaagtaggcaacaggaaggcttgacggttctgtcccggtctgaactcgggaacgtgacttagaaaatccacggtatcatgagaagtgtgttagagtactcaaggactactactagacttatttgctatgcataactgcttcgccattttctgcataaaacttgccagttccctcccttatcatagtaataaggaagttatgccatgacttaagcatctttgtaaatgcaaccc

SEQ ID NO: 411 - DNA, 698 bp, Sorghum bicolor
  Clone ID: SORBI-28MAY03-CLUS112755_1
tttcacgcccgcgataatcccctcgttcgctcgcgccgccccgtcccgtcccgtcccgtgctgcagcccgtccgccggggagggggagtggcggaacgagcgcccgcgccgaaccggcagcgcgcggcgaaaccagacaccaccgcaccaaacgcaacgcgcccacgggacgcacggcccacgcgcgtcgccgtacaggttggaggaccccgcggccccagtccagtagtacccgcgctgatcgcctcgtcgctcacgctgccgcgggcgctgctgtggctggggtgggcgtggctgggtcggggtggggcgcgggcgcgggcgcggttcgccgacgctggccccggctccggcctccagctgccgtgcctgcctgcctagtgcctacgcagcctgcctgcttcctccggcttcggttggtcgatctgttcaacttggcttcatggaatcatgggcgtgacctgagcttcaccaccgcctcgtttccgctgtagactggttaggaacggtgtccgttacacggctagcacgtacggagcatgtagcactagaggaaaaacaaatcaaagagccatgatttccagttgcgagtgaaaaccacgatgccaggcaaagcacaacttccagtgtcttgttttccggaatgaaaatacggtagaaactgtatattctatgtaaaatatgaagactatgttttt

SEQ ID NO: 412 - DNA, 820 bp, Sorghum bicolor
  Clone ID: SORBI-28MAY03-CLUS11276_1
ttcgggcttgccggtgtgcccaaaggtggaagacgacgaccatggccaagcagcagaatcccatccccatggcgctgtcgctgcccctcgtcctcgtcgcgctgcttcttccggccgcccgcggctccggagagacgccgcagtatacgacggtgcacgcggagtcggacttcgaggtgcggctgtaccgcgacaccgtctggatgtccgcccccacccccgacatcccctcgttccacgtcgccaccaagctcggcttccacagattgttccagtacctgatgggcgcaaacctcaactcttcgaggatcagaatgaccacccctgtacttacaagtgtggttccaggtgcagggcctctgcactcttcagcctactttgtccggttctacttaccaacaaagttccaggcttcccctcctgttcctctcccagaactgaacctgcatccagatacatggccaagccactgcattgcagtgaggagcttctcgggttatgcacgggacaagaatgtggttgaggaagctgagaagcttgccatgagcttgagtcgatcgccctgggctaactccacaaactaccccagcaatagcgcttactcagttgcacagtacagtagtccattccgcatcattggccgtgtcaatgaggtgtggttcgacgtcgactgcaaatctactggtgttgagacgtactgaaatgtttatacagtgtgtcgtcggctcgtcgctgaaaactaagtggaatgtgcatcagcaccatgtgaactatgcacgcttttgtgtactcctatatgttgtataatgcaatcgttgat

SEQ ID NO: 413 - DNA, 725 bp, Sorghum bicolor
  Clone ID: SORBI-28MAY03-CLUS112863_1
gcacgagggccttccctggagcacgacaacgaggtcaggggcgagagcctggacctgatcaagtacatcgacagcaacttcgacggccctaccctgctcccagaggatgctgcaaagaggcagttcgctgatgagctgatcgcgcatgccaatgcgttcaccaaggccctctactcgcccttgatggcccacgcagccgtgtcagatgaagttgttgctgctctggataaactcgaagctgagctgtcgaagttcaacgacggcccgttcttcctaggccagtttagcttggcggatatagcctatgttacaattttggaaagggttcagatatactattctcatcttaggaactatgacatcaccaaaggcaggccaaaccttgagaaattcattgaggagatgaacaagatcgaagcatatacgcagactaaaaaggatcctctgtttttgcttgatcttgccaagaatcatcttaagattgcctgaagacgtgacagagcggcattagtccgttgataggagacaaatcactcaccagtgtcaatttgatcaataaaatacggcatgctatatataagggttgttttgtgttattgataatatactgtactactgttcagttactgtactgtatttcttaggtatgtcaagtgcagtgtaagcttttattattttgaattccattattgcaaaaatagaaagacaaaaaaaatttacgcgtc

SEQ ID NO: 414 - DNA, 899 bp, Sorghum bicolor
  Clone ID: SORBI-28MAY03-CLUS112900_1
gaccgccgctgaccgcgcgctacggctcaaggcaaacttcgcggcgcgcgggctccgcaccagcgtccatggcgtcctcctggtggagctgttcgatcacccgcacctgctgctgctgcaggtccggaactcctcctttctgctccccggaggccgcctcaggcctggcgaggaagaggtccaaggcctcaagcgcaaactctccagcaagctctcctttgtcgatgcagatgatgatcagaccattgaagaagaggatgactggcagattggagagtgcatcgggatgtggtggagatctgaatttgaggccatcccatttccatacatgcctccaagcttccgtgcaccgaaggaatgcatcaagctgttcctggtcaggctgccggtgtctcggcagttcatcgtgcccaggaacatgaagctcctggccgtgcctttgtcccaggttcatggcaatgctcaggtttacggtccaattatatctggcattccgaatctactgtccgggtcccccttctccgtcatcagtgactgaaatatgggaaccggaatctgagggtttagtagacagacgtgcatatttggctaatcgtagtcatagagcagtatgcgataccgatggaagcatgtatcgattgagaagtagcttatccgtactgtgtgtttgtatagcgtatccccccaccccctcgctgatacattgagatgtactgtgtgtatttcttgcgacatgtgttcgaccgtgagaggatgattcggttctgtacaatatctcaagtagttatgctgctcgccgaccgcttgtcccttatgttgtgtatacctttctaaaatttgtatggcttgtaagccttgtacattgatatgtattgtacagtgtttctactgtttttttt

SEQ ID NO: 415 - DNA, 204 bp, Sorghum bicolor
  Clone ID: SORBI-28MAY03-CLUS112976_1
gcacgaggcttccttctggttcctcgtccgctcgtccgtcccttcgcgcccctgaaattgctcgaccgcgtggcgactcgggtcggagtaacggatgccggtcgacgtcgaggcggcgatgggcacacctcagccggcatcggcgtgcagctcgtcgtcgataggcggggacagcgacgagtgctcgccgccggggaaggagag

SEQ ID NO: 416 - DNA, 533 bp, Sorghum bicolor
  Clone ID: SORBI-28MAY03-CLUS113_1
gcacgaggagcagcttcacgggccgcttcgcgtccaagctgccgtggaaggagacgctgtcgttccgctactccgacgaccagggcgacggcgacgtcgtcgtggactacttcgtcgacaagctgggcgatgcgtaccgtcaccacggggaggtgtacggccgctactgctccgagatgagccggctgtcgctggagctgatggaggtgctcggggagagcctcggcgtgggccgccgccacttccgccgcttcttccaggggaacggctccatcatgcgcctcaactactacccgccgtgccagcggccctacgacacgctgggcaccggaccgcattgcgaccccacctccctcaccatcctccaccaggacgacgtcggaggcctccaggtgttcgacggcaccggccccggcaccggccggtggcgctccatcaggccccacccgggcgccttcgtcgtcaacatcggcgacaccttcatggcgctctccaacggacgctacaggagctgcctgcaccgcgccgtcgtc

SEQ ID NO: 417 - DNA, 601 bp, Sorghum bicolor
  Clone ID: SORBI-28MAY03-CLUS113095_1
caagatccaagccgacgtcccggcccataggggccttggcatatttgtgcttgtgctaggcattttgcagatcctggcaattttcctgaggcccaataaggactccaagtaccgcaagttctggaactggtaccaccactgggtcggcaggctcgccctcttctttgcagccatcaacattgtgctcgggatcaaggtcggcggcgcaggcaactcttggaagatcggctacggtttcaacctggccatccttctgatcaccatcatcacgctggaagtcctgctctggacaaggtggaaaaacaacagcggttccacgggggcatattagcagcgacttaccgatttatttaggtgttcgtgatggtcactgaaggagatccatattcttctttcaatgttttcaagtgtaatgttcgcgtgtgctgcaggatctgttttatagcggcaaagatctgcaagcaagacgagtatgcgtgatgcgttttggtgtttgttagaactggtcagaaaagcttgataggatgtgcgacgggcttgccgttccgttgccttttgtactgcacggagtggagttggaatgatatttccgcattccctt

SEQ ID NO: 418 - DNA, 596 bp, Sorghum bicolor
  Clone ID: SORBI-28MAY03-CLUS11311_1
acgcgctgcaggtgctggtgctcgtgatgatcgtgagggacttcgtgccaggacggaacgcgttcgaagcgctcctgggcgagctgagccggcaggggcggtgggccgacgccatggccgtgtacgccgccgcggtgaagcgcggcgtggtagtctcgtggaagcacctcggcagagaggcgctcccgccggaggagcccgtccggctgggcgtcctggtcccgcagtgaccgttcgtctttgggcgggattacatccttccgaggctttgcggtgttggcagacttggaagcgggcttccaccattctgcttcagtgcttccgttgctgaagacgaacagttctgcaagtttgagctgcttgcagatggcatcatgaatctctctgactctctgaggaacaggggtagattttggcaaatgttggagagaccgcaaatgtaccaattttatgtgaatcatttgtgctcggattagccggacggcacagcttacgagttaccgagcataccgtcgcttgctcagtactgccattcttgttcataaatcgtaccttgtagatcacccaaaagttcaaatggtttgccattctgcacc

SEQ ID NO: 419 - DNA, 533 bp, Sorghum bicolor
  Clone ID: SORBI-28MAY03-CLUS11312_1
cggacgcgtgggcaaaaatttttggtttacaagaatggggtaatggtggttcaactggcacagatggttcacagcagaaccttgaagaaacgagtttttttcgtgctgatggaggctattgggatacaccatatggtcactttttccttgaatggtattcaggaatgcttctcctccatggagagaggttatgcatgacagctgatgcaatcttctctggtaccggtgtgaccatatcagggaaggttgctggcatacattggcactattatacttgttcacatccatctgaactgacagctggctactataatacactattaagagatggctatcttcctatagctcaaatgtttgccaaatacaaagctgcattgtgctgcggttgtttcgacctgagggacgtagaaagaacaaattctgagagcagtccagaaggtactctccggcaccttgcaggtgctgctaaaatgtgcaatattccactttatgcgggaaaattctgtgacaaggcttggtgatgcatcactgac

SEQ ID NO: 420 - DNA, 1030 bp, Sorghum bicolor
  Clone ID: SORBI-28MAY03-CLUS113255_1
gcacgagggtgcctctccgtcaccgcccggtctctccaatggctgtgcagggcgccgcagcccgccgcctactcgcgctcgcgcccgcccgcagcggccgcgccttctggtcggcctcgtgggccggcgccgacccggccgccccttccgcctcgtcgacgtcccccgacaacaacaacagcagcagcaggaagaagaaggcgccgtccgggtccgggcaccaccgcctcgccgccgtcatggacgccgtcaacgagcgcaagctccctcccgagctccgcgggcgcggaaacgcggtaaggtctgaaactgacattgtaaatgtcgttgaacaaagaatatggcattcaatggaggaagggcacttcgaaaatctaccagggaagggcaaacccttaaacctcacttcaaatcctcatgccgatcctgctgaggacaccctttacaggatactttcaaggaatggttgtgcacctgaatgggttgagctgaataaggaaatccgtggtatgatcataggctggaggttggcattaaggaaggcatgggcaaaccgctctgaaggtgatgattctaactggaatgatgactgcagggttctacaggagcaaattcgccagataaatgataaggttttccggtacaacctgatagtaccctttgggcggcagatgtttggtctgaactgggacaaggaggtggacaagttgaagtaagaagggtcaaggaggtggacggatcagtgaagaacatagcatggagtacttttgttgtatcaaaatgtcctgtaacttggaatatctggtaggacagacacatatttaagaaaccatgaaagctgatataggtatttcacgtaggcttttattagtttagatgctttggaaaactaagttttccagtgctgtagcccatcttgtggtaacactcgatgtatgttacgtgtgcaaatcctgagcttatttctcagcgattgaatttctcaaacacgtaggagaattgtatattattactgctgttgttttattgt

SEQ ID NO: 421 - DNA, 549 bp, Sorghum bicolor
  Clone ID: SORBI-28MAY03-CLUS113264_1
tgaatactagatatgacccaaaataacaggggtcaaggtcggccagtgaggcgcgggggcctgcccgtccgcgtccggacccaccctgcccccaccccccccgccggcccccccacggccgccccctgcccaccgcccgcggcgggccaggtcgccccggacgcccccccggcgccgccctccccgctgccgccgcgccgccgccccccggtcgagcgcccctgcgccgtcgacgtccgccgcgaggcgcgcgcccggagctgggccgcggcggcggcctccgcgggcgccgcctcccccccgtcgccgcagccgacgcagcccgcgggggccgtcgggggtgcccccgcggcggtgccccggaccgcggtcaggcggatggacgcgatcaagcaggccctgctgctcttcgtccacagcaagctcaccatgtgccccgaccaccgcttcgccttcggatccctcggcgagacgttctctatggtgaagaagggcttcagcagtgacgctggttcagcaatggaggcgatccattccttgtctgcttca

SEQ ID NO: 422 - DNA, 535 bp, Sorghum bicolor
  Clone ID: SORBI-28MAY03-CLUS113277_1
gcacgagggtttgccgccgccggtggtcgcttcagaaggaaatcatcatccgatgcatatgagagggcaaccccaccagggactaccagccaacctcctcccttcgaagtgtgaactgactgcaccctcgcacttgttttgctccttgatgacaattaatcatctacttcacctaaggtagacagggaggagagaagatatcaagacgggaaaagggatgagttgcgggtttacctctactgtgatatattgtagatgccgctatgtgtattgttttctatctactatgtggcatatgttgtataataataatgttgaaagctcatggtcccgtgctgtgtcaataaggtgctatgtgcgtagagtggctcatggtcagggctgtgtgtgggctttcccccagctttctgtgctgctccctgtgtcgtgtgtgtttcctcctgctgctatgtcataacggatggtgtgtggaggatggggtcatgcatgtaatgttagctgggtttgaggtggactacatgtagttttgttccaa

SEQ ID NO: 423 - DNA, 491 bp, Sorghum bicolor
  Clone ID: SORBI-28MAY03-CLUS113132_1
gcacgaggaccgagtggggcgtggggatggaggtcgacggcgacgtgcggcgggaggctctggcggcaacgatacgggaggcaatggccggcgacaaggggaaggagatgaagcggagggcggacgagtggaaggaggccgccattcgggccacgcagcctggcggcacggcgttgaccaacctggacgacctaatcaagaatcacgtcctgctacctaagtgctgacggctctttcctgaaaaataattttagtttctatacttagccaaactatctaaagtttgactaaattaataagagtaatatggaaaagtaaaaaattaattatacttatttggtttcaataactatgatatttttagataaactttgccaaaacacaaatgctagtttcatgtaaagtcgctctaagccctattgaataagctgataagtgttggtgtacttatatataacaaagggcacaagaaagtaaagggctgctttttc

SEQ ID NO: 424 - DNA, 543 bp, Sorghum bicolor
  Clone ID: SORBI-28MAY03-CLUS113764_1
cacggacgtgcccttctccgccaccgccaagcaggtcttcgatgtcgccgtcgtgctgtccaagaacatgggcgccagcttcatctcgcctgagcacctcgccatcgcgctcttcaccctcgacgatccaaccaccaacaacctcctaaggagtttgggagcggatcccagtcacctagcatcagttgcggtcgaccgtctccaagcggagcttgcgaaagatggcagagaacctgccgaaccggcggctttcaaagtcccaaagaaagcccctgctggagccggaagatctgccttctcccactccttgactaaaaagaaagataagggtgcactggatcaattttgttcggatttgaccacacaagctagtggaggtttcattgatcctattattggccgtgaagacgagattgaaagagtagttcagataatatgccgacggacgaagaacaaccctattcttctgggtgaggcgggtgttggcaaaactgcaattgctgaggggctggctcttcgaattgcaatggagatgtccccatt

SEQ ID NO: 425 - DNA, 665 bp, Sorghum bicolor
  unsure (1)..(665): unsure at all n locations
  Clone ID: SORBI-28MAY03-CLUS113337_1
aaacatggggaagtcactgaggaggagctcatcaaggccgcaaaggcagccaatgcacatgagttcgtatcaagccttccccaggggtatgacaccactgttggagagaggggggttcagctatctggtggccagaaacagcgggtagccatagcaagggccatactaaaagatcctaggattctacttcttgacgaggcaacgagtgccttggatgctgagtctgagcgcatagtgcaggatgccttggatcatgtaatggttggcaggacaacagttattgtggcacaccgcctctccacgatcaaaagtgctgacattatcgcagttcttaaggatggtgtgatagtggagaaaggaagacatgaggcactcatgaatatcaaagatggattctatgcttctctagttgaacttcgttcagcctcatcatagtacctaggttaagaatttgttctgattattaggcattatacatactttacaccttttgtagctctccttactgtttctgtagtttgggggtagtatgaagtcattgagatttgaagaagaattcgagaagttaacatttctttgtaattatcactcacagtatgactgtaaggcatgattttgtattgtacctatgtcattgctgtgtcaatatcaccatagagtctncc

SEQ ID NO: 426 - DNA, 592 bp, Sorghum bicolor
  unsure (1)..(592): unsure at all n locations
  Clone ID: SORBI-28MAY03-CLUS113339_1
gacagctaaccaggaagggaaaagagcagaatcgcaaggccggattctcagggtggtactcatctactgccgttcctctantaagccacagcatcagtggcctgtgaggccaaagaatttcacccttgacataatctatctccatgacaagccaagtgctgacaactgcccacagatggtatatgatgccttggttgatgctcttgaccatgtcagccagtatgaggggtacattcttgagactggtcaagggcttgctcgtgttctctttcgtcagatgtgcattcttctatcccatcctttgcaacgttgcatccaagatgaccttgatattcccaaacaagtcgctaagaaaactctgggaaccgaagctgcacagaatgaagatggcacgccagtctccagccagcagtagggtcttctagctgaatggtatgcaaatatgaaattacttgtaagcgcttggcattaccgttctactagatcagaatgcctgttgtgtgtgatggagattccatctcagaatttgtgtactatgctgtaattgtccaaggagacatccttttgttactgtccccttgtttgactgggt

SEQ ID NO: 427 - DNA, 506 bp, Sorghum bicolor
  Clone ID: SORBI-28MAY03-CLUS113356_1
gcacgagggcgacagtggcggctggcgttggcgtctctgcggggagcagccatggtggcacagccgcgaaacaggagcctgggcctgagttgaatggtcaggagatggacagtatttggtatgatgtgtgggacgagctggacgcgataccaggcgctgaaatggaccggcgagaagcagacaagggcgtggctggcttcgacgtcgaggatttcagtggacgcccttgcggttgggatgatgactgctcgtatctcgcggagccgatgcagtttgtggagcactatgactagaggtgcaagaattgcttgatctggagctggagaggaatatgcttgttcatagcttccccatattaggattctgccaactgaaattcgtccagtatatataggaataggtacagtgggttgtttaactcgcagtttagtgtgatagttttgtggtgtatagcgtcagctctgacttctgagaacatatcgagctcaactatgacgccaaaaaaa

SEQ ID NO: 428 - DNA, 625 bp, Sorghum bicolor
  Clone ID: SORBI-28MAY03-CLUS113403_1
tctcgctccgccgtgcgacggtgcccagccccagcgccaggaccgtccgcgctccgccgccgcctcgtctgcgggtccggtcctcgagccgttcacggcgcctttccttggcgagccagccgtctgtctggtggtcttggcccgacgaagggcgaggagggagggagtgagagcgagatgccgcaccgagcgcgcccgatgacggggctgctggtgttcatgggcgtcaacctcgcgctcttcaacaccatcagccccgtctacgacttcgtctgcttccacccctactgggaacgaaggagagaacgccgccgaagggaacttgaaggtctgcaagcgaagggttctctagaaactactgactgaattctcctagagtcggcatctgagatgacctctttgattttgtcggcgtcatacagcccttgctccttcaaggcgtgctcaagctcttctttagtgatgtacctgtgagataaatgaatatattatatgtgttctctgatatatatgttgtccagaattgaggtaccagctaccagctgtatcattttaaccattcaacttacccgctgttgtccttgtcgaaatactggaatgctgtgtaaaggtgctctctctgtcc

SEQ ID NO: 429 - DNA, 700 bp, Sorghum bicolor
  Clone ID: SORBI-28MAY03-CLUS113537_1
cccgactggggcaccgggttcatgatgccggcgagcgctgcgacggcgccaaggacgccggagaggtggcccgcgctgccccgaactccggagtacgcgtcgccggacgtcaaggccagccggaaagagaagcgaacgcggttcgtggcgctgccagatgagataatcgcgtgactttttctccctgatcggatcggatcggatcggatgaaacgagggcggcggcccgcagggtcagaagacgcactcactgtgccgtggtggtgatggtgactgtcagagagccagaagatgtagactcatccgcagggtccgagacgctcctctgtcccatggtcgttttcctcggttgcgggctgggaaagagcaccacctgctgcgggtcgccggtggctggcggcagcttcctgtctcgcctccgacgacagggactggagtgtcatcttcttcttctttctaatggtgtgtggtctatgtatctttaaaggctctcttgctcatcgtcttcgtctctagatgtaggtagctgaagaagcttagagtataaatagttcttacatgtatatgaacatacttttgtggagacgatgacagctaccctatgtagccaccagcttcgcgtgtcatcatcccgatcatgattctgtttgtgtaaatatcccgtcacagaggaataaggaattgcatattttggtggttc

SEQ ID NO: 430 - DNA, 532 bp, Sorghum bicolor
  unsure (1)..(532): unsure at all n locations
  Clone ID: SORBI-28MAY03-CLUS113598_1
tgatcgtctccatggagagagttgcgtcgagctgcgccagcctcctagcacaaaggaggggctactcggtggccgcggccgtggtgaaggggatcagcgggcggaaggccgtggagaaggtggccaagcgcatcatgggcaaagaggtgaacaccgcggctgcggcctcggtgtcggcggcggagaagacgccgtgggtgccggaccccgtcaccggctactaccgcccggcgggtggcaccaaggaggtggacgccgcggagcttcgcgccaggctgctcacgcagagggtcgccaactaaatcaatgatctatagcggcatgcagtccggctggtttaattaactcgaacgctttaagattttgcgctcgttgatcgatcgcttgggcctagagcatgacgtacggtgctgtatctttgaggcataatatagctatatacaggaagtgctccaacctagctagtcccattgtatntgaagaatgtgaaattaatatatgtgatatattgtaaaaaaaaaaaaaaaaaaaa

SEQ ID NO: 431 - DNA, 629 bp, Sorghum bicolor
  Clone ID: SORBI-28MAY03-CLUS11366_1
aatcggaacccttatacttcaggattgtgcagtgggcttgctgtttgctctccttcctgttcttggaggtgctagtggcattttcggaggagtgatgtcaatggcgaaactgttgcttgtgttatccatatttgtagctgttacgtatatgatgacatggtcaattgttcctcgattcttaaaactgatgattcagttatcttcacagacaaatgaactctaccaactggcctccgttgcattttgcttgcttctagcctggtgactattgtggattgagtcttgaattggggtcattccttgctggcgttatgatatcaaccacagattttgctcatcatactatggagcaggtcgaacccattcgcaatctatttgcagcgctcttccttgcaagcattggaatgctcatacatgttaagttcttgtggaatcatgttgacatattacttgcagctgttatactggttataatagtaaagagcattgctgtaactattgttgtaaaggcatttggatacagcatcagaacagcttttgttgttggctgtcttagctccataggagagttgcgtttgtgctttgagccggcctccatctcatttgtggggggaaatgtttactatact

SEQ ID NO: 432 - DNA, 686 bp, Sorghum bicolor
  Clone ID: SORBI-28MAY03-CLUS11367_1
gaagaacttggtttgccacctttgcttgttgaccagttgaacaaggaaggtctgactgctccaactgaggtccaatccgctgctattcctataatagcacaaaagcatgatgtagtgatccaatcatatactggctcagggaaaactcttgcttatcttcttccaattctttctgagataggccccctgaagaggactatggaacaagataattctgagaaaagatcaggtgtagaagcagtcattgttgctccttccagagaattaggaatgcagattgtgcgagaagtggagaagattttgggtcctagtgataaaagactggtccagcaacttgttggtggagctaatcgttccaggcaagaagaagcattgaagaaaaacaagccactcattgttgttggaacacctggccgtatttctgaaatttcagcagcaggtaagctacacacccatggctgccgttttcttgtactggatgaagtcgaccagcttttgtcttttaattaccgtgaagatatgcatagaattttggagcatgttggaaggagatctggtgccacatctagggatgttcttggcccactagctaggcgatctgagcgtcagactatcttggtttctgcaacaataccattttcagttatacgagcagcaaggagttggggtcatgatccagttctcat

SEQ ID NO: 433 - DNA, 871 bp, Sorghum bicolor
  Clone ID: SORBI-28MAY03-CLUS113718_1
gcacgagggcctctttcttctctacgagcagcagagcaggctacggcctgatcgcgaaaaaaaaaaaaggaaagcagagcagagcaggggccgcccgaggcagaataatcctatctcctaccgagccggagcccggaggctcctcccagtcccgaggatgacgacggcgtggtggtggttcgtcgccatgaacgcggtcgtcgtggctatcgccgtgctgtccacctcctgcgcacggccacgacgccaccgctcctccggggtcacgcggagagcctcctcggcgtcggccgtgctgcagagcctcctctcattctccctcttctccttcccgtcggcatgcctgtcgtcgtacctccagcccgacatcgccgccgcaaccactgaccaagaaacagaagcagaggagctggtggcgtggtcaccaccaccacccatcaagccgtcaccgtcaccgcgcgcgctccagctcacaccgccgccgccgcccgcgccggctgcagatgacgaggaggaagaggaggaggacccgaacgcgatgagcatggacgaggcgtacgcgctggtcctggcgtcgcagcagcggccggagcgggagagggaggaagaggccaggaggtcggaggtggacgccaaggcggaggagttcatccgcaggttcaaggaccaactgcggcagcagcggctcgactccatctccaactacacgcacatgctcaaacagcgtgcgcccgccggcggcggccagatgttctccgggcagatcgctgctgattagctctgcctctgactcgtgtgttcaattcgtttaggtgtttgtcagcttattgaggggagcccaataattatgtttcgattttggtgtttttgt

SEQ ID NO: 434 - DNA, 348 bp, Sorghum bicolor
  Clone ID: SORBI-28MAY03-CLUS113771_1
tcgtgttgtaccagaaggccaggcccggcacgcccgccaccgaggtagccaaggtcgctgtcgcccacggggaccccgccgccggccgtgacccagtgaagcatcctccggaaggctcgcgtgaagccaagtagctcgatcgtaccgtggcagctgtaacaggatgtaatagtgtacagtacttttgttgttcgtgttcagctctgttcctctgcttgtgtcgaggagccacattctgctttgcgaaagactagctagatcgtggtagatccagctgaataagatttctcccgtcgctccagaataaagaaactcaactctttttctcaaaaaaaaaaaaaaaaaaaa

SEQ ID NO: 435 - DNA, 625 bp, Sorghum bicolor
  unsure (1)..(625): unsure at all n locations
  Clone ID: SORBI-28MAY03-CLUS113808_1
tcactgaggagcaaaacgaattaatcgagtcgtctgcagagatgctgtatggattaattcacgcacgatacatcttaaccagcaagggtctagctgcaatgttggagaagttcaagaactatgactttggtagatgccccagagtgtactgctgtggccagccctgtcttccagcagggcaatcagatattcctagatcgagcacagtgaagatatattgtcccaaatgtgaggaacttaattatccaagatccaagtaccaaggcaacattgatggatcatactttgggacgacattcccccatcttttcctgatgacttatccacacttgaagccgcagaagccgttgcagcaatacactccaagagtttttggcttcaaacttcacaagccgtcatgacagagctgtactttcagcagaagcaccctttcacctaggtcttagggagagcaccgtggccttcaaatgttgtggcctattgatgtacgaattcgcgagcttgggtctcgctgtaaaactgctgtgaaatttgtatctgtttttctgatatcactgttngtgtaacctaggttctctctttcactcacttgatcaatgtatgccaacctgtatggtttcaggtc

SEQ ID NO: 436 - DNA, 709 bp, Sorghum bicolor
  Clone ID: SORBI-28MAY03-CLUS113855_1
gcacgaggtggcaaccatcgctatggcgagcagcaggcgcgcaaattgcccaatgccgactcggtgaggcagcgacgaaaaaataacaacttcaccgccttatggcatgaagcttgtaatgatttgtaaacacacgtactaagagtatccattggaggacaagtctggtgccagcacccgcggtaataccagctccaagagcgtatattaatgttgctgcggttaaaaagctcgtagttggacgtaagagccaaggctgtggttgggtccgtctggctggaagcttcggccgaaggctgtcgtgatctgccacaatacgctgaggctctttcatcttgtgggagtggttgcttgccgaagccaccttaactggtgtgtggaagctctttcggagtctctcgctccataaggcacgcccacagatgttactgtgagtaaaacagaatgttcaaagtaatcagcttgctgattgaatgtcaaagcatggaataacaagggatcgaccactgtggcctctttttgttggttttcaagcctcagtgtggtaactccgcgcaggacttctctctgggcttttccttccacgttcctacgtgcggagggggttctctgtagagtcctgttgcattcgggatcaataggagcgcggggagcaatcagtacttcggggtgagaggtgaaattcatagacccccgaaagactaacatc

SEQ ID NO: 437 - DNA, 572 bp, Sorghum bicolor
  Clone ID: SORBI-28MAY03-CLUS113841_1
aggtggccaagcccaagtggtacgagcgcgcgctcgtcctcgccgtgcagggcgtcttcttcaacgcatacttcctcggctacctcatctcccccaagttcgcgcaccgtgtcgtcggctacctcgaggaggaggccatccactcctacaccgagtacctcaaggacgtcgaggccggcaagatcgagaacgtccccgcgccggccattgccatcgactactggcagctcccggctgatgcgacgctcaagcatgtggttgtcgtggtgcgctccgacgaggcgcaccaccgcgacgtcaatcactttgcgtcggacattcatttccagggtatgcagctcaaggagacacctgcgccgattgaataccattgaacaatctggatgcttgagaattccagttcttcatttttactagatgtaggttgatgcttgagaaataaaatccctggctgctatgagtagcaaagatctcgtgggttgttcctaatcttttacgtgtgtgtttgtaagtagagattcagacattgatacgtgcttgacgctggagctcactgaatcttctccctgaac

SEQ ID NO: 438 - DNA, 672 bp, Sorghum bicolor
  Clone ID: SORBI-28MAY03-CLUS113871_1
ctccagaactgccactccgagaccgagctgctgaagatgaaggacagactggagaaggcggaggaggagaagaggaaggtcatcgcggctgccgcggcagccggtggtggcggcggcggagcgggcgcaggaagcagcagcccgagctcgtcgtcgttctcgacggtgacgcacaacccggcggcgctggtggggcagttcggggtggacccggaggaggccgccgccgacctcacctacatgagcgagtacgcctacaacagctacatgaacatgatggacatggacctcgcgcccggcggctacttcggaggagtagtctacgatcacttcaactgatcgcccgatatgatgagcatgaacgaggaaggattgaccggctatcagctaggtattttcgtgttaatggatggatggatcgatcgatttgcagggcgcgcgtagcagtagtttcaagcaatcaagtcactagtattatcagtacgacgtctatcagtcaatgtcctgacggtgattaagtctattcagtaacttgttaagccatgtagattagtagctggtaatctttgtaaatctgtgtggattatcatgcaagcgcagcttatcatgaactaatggtctctgtgatgtaatattggggggaatgggggggtaatcggaatccagaagaat

SEQ ID NO: 439 - DNA, 861 bp, Sorghum bicolor
  unsure (1)..(861): unsure at all n locations
  Clone ID: SORBI-28MAY03-CLUS11389_1
gcacgaggcgcccatggagttcttggcgttcagcagcagcttccatggccgaaccatgggcgcggtcgcgctcaccagcaagtcgcagtaccgggagcccttcgcgcccgtcatgcccggagtgaccttcgtggattacggcgatttggaggcggccaagaagttcatacagtccggtagggtcgctgctgtgttcgtcgagcccgtgcagggtgagggtggtattcacagcgccacacaggagttcttgcaggggctgcgggaggcctgtgatgaggcgggagccctcttggtctttgatgaggtgcaatgtggtttcgggcgcacaggttacctttgggcccatgaggcgtatggagtagaaccagacatcatgaccttagcaaagccattggccaacggtattccgataggtgttgtcttggtcaaggagaaggttgctgcagccataaactatggcgaccatggtacaacgttcggcggcggccctcttgcctgccagactgcgataaccgtgtttgacaaaatcatgaaacctgggttcttggctgaggtgtccaagaaaggggaaaacttcaagcagctcctccgcactaagctgagtggaaacccacacgtaaaggaggtccgtggggttggtcttcttgttggcattgagctagatgtaccagctggtcctctggtcgacgcatgcttggacgctggcgtcatagtgctgacggccggcaaaagcaatgttgtgaggctggtgccaccactcatcatcttanaaaaggagctggagcatgccgcggatgttataagggattgtctaccggtgcttgatgttgctgctgcttaatgttcgcactggtcttttat

SEQ ID NO: 440 - DNA, 723 bp, Sorghum bicolor
  Clone ID: SORBI-28MAY03-CLUS11394_1
gcctactgctccaccattcgaaagatccgtccatccaagatttttctactctgtccctctctcgcgcgcgcgctctcctcacaacacacacaagacagtctcgatctcttctcctcctagccaccaacatataaagcaagctctcacacacacacagaacccacaagctcaaaccaaaactcagcggaacgacagtctgcaatcgcagcagctgatctgcttctaagcatatcagttattggatggccttcttcttcatccttgcttgcaccctcatttttctagccatcgcctactacttccagtacgcacgctggcagaaggggagaggccgctccggcggcggccatgagaagcaggcttcttcttccttgaagtcgctgcctcctggctccatgggctggccttacctcggcgagaccctccagctctactcccaggaccccaacatcttcttcgcctccaaacagaagaggtacggcgagatcttcaagacgcacctcctgggttacccctgcgtgatgctggcgagcccggaggcggcgcggttcgtcctggtgacgcaggcgcacctgttcaagccgacctaccctcggagcaaggagcgcatgatcgggccgtcggcgctcttcttccaccagggcgactaccacctccgcatccgcaagctcgtccagggcgcgctcggacccgacgcgctccgcgcgctcgttcctgaggtcg

SEQ ID NO: 441 - DNA, 574 bp, Sorghum bicolor
  Clone ID: SORBI-28MAY03-CLUS113954_1
ctggcagaggagggcccccactgaagtgcatgccgccgaccttgacagttattgccgagcatgactggatgagggatcgagcaattgcttactctgaggaactccgcaaggttaatgttcactcgccggttcttgactacaaggatacagttcacgagtttgcaaccctgcatgtgttcctaaaaacaccacaggcacaggcctgtgctgaggatattgccatatggatgaagaaatatatctccctccgagggcatgagttctcatattagctgtagcaaaaatcatgcattgtgaaataggccctttacagggaagcatcaacgtgttcttttcaactggtggaaagagggatgttggattgcactcaagtaaccagttagcttaatgtgagtactgaatccttcagtgatttttttgaatgtagtgtgcaaagttgtagactgtaatcaaaagatactcttcgccttgtagagctcaattctttcattccttttgtgccctttgtgtattatggaataactggtgcttgaggttaccattttttgagaagaaatatcagtctcagactctc

SEQ ID NO: 442 - DNA, 601 bp, Sorghum bicolor
  Clone ID: SORBI-28MAY03-CLUS113893_1
gcacgagggcggctcatccatacccaacaatggccctccctattaactggtcagtgcacgtacgtcagcacggcgagagcgacgtcgcggtgcatcaccataaataggtacacacacatatgacacaacacaattcattcatgctgtatacttttgctagcttttagccgctatccgtgccttgaagccatgcatgtcgtcgtagtagttttggcgacgctgtacacgccatgttccatcgtctccatccatgcagtgcgggtggcggctgcaacttgcatgcaattggtgcatgaactctatacttgatctgcacgctccatatatacacggtatgatctatatagatatatataaatttgttatcaactgccaaagatttatatatagcactcctacttgttattagttcatcctatcgcatatatatgtactctattgatagaattaataaaaaggtagcttgatccctgaatagtgaaccgatgtgtagatattagggtgctactttgtcacacatgcagtaatcgatcagtaagagactaaggagtacacaccaagagatacaccaagactaaagatatatagtaaacaggatcgc

SEQ ID NO: 443 - DNA, 837 bp, Sorghum bicolor
  Clone ID: SORBI-28MAY03-CLUS113956_1
gcacgagggtaatcttgatcagtggcttcacggtgatgttggggaagtgagcccactaacatgggacatcaggatgaacattatgcttgcaaccgctaaagggctggcctatcttcacgaggggctggaaccgaaggttgttcaccgtgacatcaaagctagcaatattcttcttgaccagcagtggaacgctaaagtatcagattttgggcttgcaaagctattgtgctcagagaaaagctatgttacaacccgtgttatgggaacctttggttatgtggcacctgaatatgccagcaccggaatgttgaacgagaggagtgatgtatatagctttggtgtactcataatggagatcatcactggtagatctcctgtagattatacaagagcagctggagaggtgaacttggttgagtggctcaagaccatggttgcagagaggaaagcggaggaagtagtggaccctaagatgactgaaaagccttctcccaaaacactgaagcgagcgcttctggttgcgcttcgctgcgtcgaccctgatgcgaacaagaggcctaaaatggggcatgttattcacatgctcgagatggatgatcttctattccgagatgataagaagcccgggagagatgtccatcctcagggttcagacagatacagttccaaggaggaagggagcttcagcaagcgtgagcaccaccatcatcggtacagatgatggaccgaccgacatatgaggttgtatggattgccattagagagtagcaatattaaccatgttcccatcactacattctttcccctctctttcaatctcactgggtttttgattgt

SEQ ID NO: 444 - DNA, 1066 bp, Sorghum bicolor
  Clone ID: SORBI-28MAY03-CLUS113978_1
ggctccggagcctccacagccaggccaaggtcgtcggcacagtctgcaccgtcgccggagccgtgctgatgatcctctaccacggccccgtcgtgccgttcccgtggtccgcggccggccaccaccacgcctccgccgccgcggcggcggcggcgagccagagcagcgcctcctggctctacggcaccgtcatgatcattggtagctgcctgtgctggtccggcttcttcatcctccagtccaacacgctgcagagctaccctgcggagctgacgctggcgacgctgatctgcttcctgggctccgtgctcaccggcggtgtggcgctggtggcggagcgccacgacatgagcgcctgggtcattggcttcgacacccgcctcttcaccgccgtctactccgggatcgtgtgctccggcgtggccttctacgtgcaggggatcgtgacgcaggcgcgcggcccggtgttcgtgacggcgttccagcccctgtgcatgatcatcaccaccgtcctgggctccaccatactcaaagaggagaccaccctcggaagcgtgattggcgcggtgatcatagtggtggggctctactgcctcatctggggcaagagcaaggaccacctcggcagcaacggcaagcccggcgccgcggccgtcgccggcgagctgcccctgacctcggctcccacggccaacaacggtagttacggcaagcacgccgcgctcggcggcggccaccatgtcgtcaccggcgtcgagacgacgccgccgccgccgccgtgtgtgcccaagtgcgttcactgacgacgccgggccgggatcgacctccatctccatgatgcatgactactccttctccggactgttcactgcacacgtactagtagtgcattgccggtggctgtaagccacatatgatcttgaaggaacttggatcatcgctctgctctcgtagaggcgcgtccgatgccccgattgttgcgttttaaccactttaattttgatgtagctctgctgtaccaccagtccaccaccactaatacttgaagctttgttcagtttttgcg

SEQ ID NO: 445 - DNA, 763 bp, Sorghum bicolor
  Clone ID: SORBI-28MAY03-CLUS114001_1
gcacgaggacgagacatgctgacgacgctgcacgccaggccgccggtggcgagcgccgtggacgccggcggcgaggaccactgcgagagctgcgccttctactgcttcgtggcgtcctgcgtctcgctgctgctcttcatcgtgctggccgccgcggtcagcgtctcaagggcctgcgccatcgccggcgccgtcgtgctcctgctcgggctcgtcggctggctcgcgcccacggggaacgacggagccgccggtggcggtgcggcgcagcagcagcagcacgagcgccaggctgccgtgcgccaccagtgcgtgtgcggcggcctagcggacgccgcgatcgccgcgctcatgccgacgttcgcgtacgagccgcccgcggcggcggcggcggacaagggcggcgacgacggcaagccgcgcggcagtacttccgtgctgtgcgcggtgtgcctggaggacgtgcgggcgggcgaaatggtgcggcagctgccggcgtgccgccacctgttccacgtcgactgcgtcgacgcctggctccgcgctcaccggacgtgcccgctgtgccgctgccacctctcccccgggaacgtccacgctaaggcgccggcagccgtcgcggagtcatcggtggatgcgttgccgccggtgtgagcgtcgtcactcgccggtcatcgatcggttcatcgaaagttcgccggtgcattcgtaaattgtattgtatttgtactggaccacactgtacatttttaacaccaggtag

SEQ ID NO: 446 - DNA, 615 bp, Sorghum bicolor
  Clone ID: SORBI-28MAY03-CLUS114060_1
gcacgaggcttcaccgttcgttctgcgaggtgcgacgtgcgagacaccgccggcaggcatcactgctcgagaggatcaacaatggcggcttcctccaccgccaccaccataatcagctgctgctgctgctgcctcgggcctcccgctccgcccaaagaatcctctgcaggcgctcgcaggccgcaggcgccggcaggcgtgtcagtgtcgtcgcacgcgctgcgccgggcgtgcgtggctgccgcggcgtgcgcgatggtggggatttcgggcggcggcggcggcgccgacatggcccttgcgctggcgcgtggcggcggcgcgttcgcctccaggaccgacgtcgtcgccgtgtccgtgggcgccgcgcgcgccaaggcgccgccgcggtggagcgaccgcaggcagtgcccgccgtggcgcgccaactcgctggagaacatcgtgccggagaacctgccccgcccgtccgcgcccaggaggttcgacagcgtctcggcctcggcggccgcgccggacttgtcggcgccgccttctttcctggcgctgcgacccggcacgggctgcttctcactctgacgcagtcggcaacagtgtaattaaattcgaagttgt

SEQ ID NO: 447 - DNA, 555 bp, Sorghum bicolor
  Clone ID: SORBI-28MAY03-CLUS114099_1
ttttagtgttctcccagagacagacctgcctaatgggattggccacatgacatcgcttcacacacttggatattttgatctcagtagtaattcaatagagaatgtacagagccttagcatgctgaccaatctcgtagatcttaagctaacctgttctacaggtcagccacaaaatatgtataacaaaatgcagttcttgctgacctcaattcttggcagactcagcaacctcaagtctcttactcttgtcccaagagcttccactaataatgcaaaatctacagatgacgctggtgctacaggcatggccatttctggtggcttcagcagtttgtcctctgccccaggccttcttcagagtcttgaggtttcgccacagatttgcatattctactggatccccaagtggatcgggcaactccacgagctccgaatcttaaagattgggcttacaaaaatagacagggatgatgttgatgttatcagaggattgactgctcttgctgttctctccctgtatagccagaccaagcctgcagcaaggatagtcgttgg

SEQ ID NO: 448 - DNA, 527 bp, Sorghum bicolor
  Clone ID: SORBI-28MAY03-CLUS114243_1
gcacgaggctcacgcacacaacacagctcacgaccagcgacagagcaagcaagaaagcaagcaagcggagcaatggagtactggtacccctgcaacggcagcagcggctgcagcaaggagaagaggccgccgctcaagaggggccagctcaaactgcagatcgccaggaccctgctcggcagcctcgcggcgccggtcgccaagaaccgggatcgcggcttcgggagttaatcagtggtaggaggagtagagtagagtagctcatgccggcgagggggtgcttgtaatagggaatgtgcaatctgatgaattttcctctttagaacaggatgtgttggtgtcaagttttgccgcgttcgttcgttatccttgcgctcttgctcaccttcagcctcttggttggctcctgctagaacagagcaccaagcttaagagccctgttcttgaatgaagcaatgtaagtagagcgagaggactacagttccttgctcttcttgtctacagctaccaagatctaacagtctaca

SEQ ID NO: 449 - DNA, 528 bp, Sorghum bicolor
  Clone ID: SORBI-28MAY03-CLUS114248_1
gcacgagggaaggtcatcactcctagcagtctggtacagctggttgtgaaggctcgattcgtcccccctggctgtacgcaggttcctgcagtcaacgagctcgacctcgaggacattgaccccgacgaggatgatttggatgccttgatgggtcggaagccggctaagaaccgtgccaccaaggttgttgatggcaagaccgtggagaacaaggtcgagactgtgcaacctcctcttgcgcacgctccttacttcgctcgtgaccactcacctcgctggcacattttcctggctgacgccaagcaaggcaagatggccgtccctcccttcacctttaccacctttgacaagccgattctcgacgaagccggcaagcccacattcaatgtccaaaccctcaaaatgcagttccaggctccaccgcaggtcggcgacttcacctttgttatgcatatggtttgtgatagctacctcggtctcgacaacaagatggagattactctgcatatcgacgaccctgccaaggcg

SEQ ID NO: 450 - DNA, 550 bp, Sorghum bicolor
  Clone ID: SORBI-28MAY03-CLUS114249_1
gcacgagggcagctcgatcccagtaacctcgaagctcagcttctggacttatccaatatgacccctaccacttcccagatttcttggccaaccactactgcctccctctgcgagctactcaatatcgatactgacgtaaaaaaatgccatgccttgacgcagaagaaggctcgttgccagcatccagtcagcaaagccaactgggctcatatctcttgtctcttggagaaagcagttgctcaagggagcttccctgctgctcaggctacactccaagaagtctcttacttgatcatgtgtccgcggtatgaacatcgagatgagagcccccatcgtttgtcagagtgggagacagtcctcaagccccttaaaatggcgcataccaagaatgaagacaaggaagatactctcaaaaccgagaaagaaacagataatacatcaccaaccactcctgttatttcatcgcaacaacagattcaactcaagagcaatacatctataactacttcaactcctcgtcgcagatctcaatcgtccccttctactccaa

SEQ ID NO: 451 - DNA, 424 bp, Sorghum bicolor
  Clone ID: SORBI-28MAY03-CLUS114260_1
gcacgaggcatggttcagccatcttatcaaaacacccctccttttggtgtctccaatataccagttatgggtggaatttctggtgcttttggtattgttgatccttctcgatcatctggttttggtgatccttttcgacgtatgaatgtcccaagtaccggtgcatctgcaacaagtggttcagctgctggtactaccaccacttctgaaggagctatcaacgggaaccgccaagatgcggcaagaactcaaggaggtaacccaccaggtcacccggctgcaacacgtggattgccaaccagaacagttgttgctgctgttccagcacggtcctcagtcgaggctccaaaccatgtctttagtgttatcctgcctgttcaagtgaggggtcaagttgcagtgcctactcagtcctctcaaggtt

SEQ ID NO: 452 - DNA, 474 bp, Sorghum bicolor
  Clone ID: SORBI-28MAY03-CLUS114268_1
gcacgaggggcaatcgtaaggggaaagagagccctgcggctcaaaacccttatgctgcccctccagcaaatgatccctacgcccagccgcctccctcatactcttctggtagtcaggacaactcctaccgtcaggagaagacaccagcagtgaccggcccaggccagagctacggacagcgacctggtggctatggtgctcaaggaggtagctacggcgcccagtcgggatacggaaacgaccgctacggtggcggtgcccctcagcgccctggcggttacggcgggcttggaagaactgcctcagatgataccatgaccaccgacgctggccgcaacgagcttttcggcaatgctgcccaacgacaacaagcacgaccccaacaagagtctggcgcatacggacagagcggtgcttatggagatagccagagcggaggatatggtggcggtgctggtggttatggctctgccc

SEQ ID NO: 453 - DNA, 468 bp, Sorghum bicolor
  Clone ID: SORBI-28MAY03-CLUS114269_1
gcacgaggaagtggcccaacatcgtcatccaattcgaggacttcaagaaccccttccccgccctcgaacgctaccagaaccagtacgccatgttcaacgacgatgtccagggcactggtgccgtcattgttggtggtttcatcaacgccgtcaaggcgtctggtgttcccgtcaaggaccacaaggccatcttccttggcgctggaagtgctggtgtcggtgttgccaagcagattgttgagttcttcatcaaggagggtctgacagaagaggaggcccgccgcaagttctggtttgttgactcaaacggacttgttacactcgaccgcggcgacaagctggccgaccacaaggtctacttcgcccgcgacgacaacaacggccgtcagtaccagtcgctcagccgcctcatcgactacgtgcagcccaccattctcatgggtctgtctaccattggtggtgcattca

SEQ ID NO: 454 - DNA, 560 bp, Sorghum bicolor
  unsure (1)..(560): unsure at all n locations
  Clone ID: SORBI-28MAY03-CLUS114274_1
gcacgagggcgtcaccggagctggagggttcatcgcctcctggcttgtcaagcgcctcctcgagaagggttacacagtccgtggcacggtcaggaaccctgtcgatccaaagaacgaccacctgagggcccttgacggcgccgccgatcgcctcgtcctcctgcgtgccgatctgctggatccagaaagccttgtcgaggccttctccggctgcgacggcgtcttccacgccgcctccccggtcaccgatgaccctgagatgatgatcgagccagcaatccggggcacacaatatgtgatgacggcggcggcagacaccggcgtcaagcgcgtcgtgttcacgtcctccatcggcacagtgtacatgaacccctaccgtgaacccaacaagcctgtcgacgacacctgctggagcgatcttgagtattgcaagaatacacagaactggtattgctacgccaagacaggtggcggagcagggcgcatgggaggtggcgcggaagcgaggcctggacctgatcgtggtgaacccggtgctggtgctgggtccgttgctgcan

SEQ ID NO: 455 - DNA, 540 bp, Sorghum bicolor
  Clone ID: SORBI-28MAY03-CLUS114281_1
cccgaacgcagaagatcccgtgcccgtgccagcggcggcgacggtgtgtgtggtgtggactggtagccatcatcaatccaggcatccccgtccacccgtaaccccgccgcccggcccccgcggacgccggcaatggcgcggctcgtgctctccgagtgctgcggcctcgcgccgctgcgcctgcgcgccggccgccggggcgccgccattgcggcgccgtcgcccgccgcgctctccgtggcggcagcggcggtggtcccgggccgccccgcgtccgcggccatccaccgcgactgggcgctccgcgtctccgcgcccacccgcctcacctccgccgtcgaggaggacaagaggagctccccgctcggggaggagggcgtggcggacagcggcgccgcgggcggggacgggttcgacccgggggcgcccccgccgttcgggctggcggagatccgcgcggccatccccaagcactgctgggtcaaggacccctggcgctccatgagctacgtgctgcgtgacgtcgtcgtcgtcctggga

SEQ ID NO: 456 - DNA, 606 bp, Sorghum bicolor
  Clone ID: SORBI-28MAY03-CLUS114323_1
ccgcgctgctccacgccaacaggcttccgctgtgggggacgcttatcaaaccaaaacccaacatgttcatgcaccttcaagctcgaggatatcatggggtgtcagagaagagaaacctgcgggaccacaaacgtagattgcttgcagaaaaatatgagctgaggggaaagctgtataaggctgtctgtagggaccctgatcttccattggatatgcgggagaagttccgctataagttgtccaagttgccaagaaatagctccatgacacgccttagaaaccgctgcattttcacaggccggtctcgcgctgtgtacaagaaattccgcatgtcccgtattgtgttccgcacattggcaaacaagggtgaactgacgggcgtaaagaaagcatcatggtagatgctaatgagccagtagaaaaaaccgctagctctgcagtagtccaggaaaataaggttgtttacatgcaacctttcagtgtgtgatccctgaaacaagctttaaagtttctgaccagcagccagttttatttaaatgttttagctgaatcagtgtactgcactgtttttttggatattatgcacttattatgaagttaaaggat

SEQ ID NO: 457 - DNA, 602 bp, Sorghum bicolor
  Clone ID: SORBI-28MAY03-CLUS114381_1
gacgatgccacgagctattaccacgtcgatgacatcggcgcggacgggtgtgagcagctcaggttcccggcggaggtcgaggtgcagaaccacggaccaatggacggcaagcactctgtcctcatgttcctccggtggcccaatgcaacggatggccggccggtgagccagctgatcgggttcacgagccagcacatcaaggcaggggagaaggccaacgtcaggtttgatgtcaggccgtgcgaacacttcagccgggcgagggcggacggcaagaaggtgatcgacagagggtctcatttcctcatggtcggcaaggaagaggtggaggtcagctttgaagcctgatgtatgacaggaaaaaggattacgatttacaggtggtgcagagcaagtctttggttggtaaacttcagcaactcagcataggacacaagaagttaagtaatttattataattcattcatatttgcctcaaaaagtcggggcttttacatgtaatttattattaagcatatctatctatctatcaaaaatgtaatcatggttacctgtaaaatatagttgaattattattgttatttaaataataataattttcc

SEQ ID NO: 458 - DNA, 640 bp, Sorghum bicolor
  Clone ID: SORBI-28MAY03-CLUS114390_1
cagacaacccatgtcgtcggcacgatggggtacctcgccccagagctggcgaggtcagggacagcgtcccctctaaccgacgtgttcgccttcggggcgttcatcctcgaggtcgtgtgtggccggagacccgtggagcagagcatgaccgacagccggctcatgctggtggactgggtgctggagcactggcagaagggatcgctcgccgaggtgatcgacgcgaagctccagggttgttacgacgacgaggaggccatgctggcgttgaagctagggctgctgtgctcgcacccgctgcccgccgcgaggccgagcatgcggcaggtgatgcagtatctcgacggcgacatgcccttcccggagctgacgccgtcgcacctcagcttcagcatgctggccctgatgcggagcgaagggttcgattcgttcgtcctgtcggcgtccacgaatccgtcgtcgtccacggcgatgagcatcgggaccatgactggcctctctggcgggagatgacatatattactccgtattgacatgtgcgttgtcttgttggagcatgtacagttacactagatgtcgccagttcattagctagtgctactagtctgctctgctgtagagttgccaattttccaaaaga

SEQ ID NO: 459 - DNA, 802 bp, Sorghum bicolor
  unsure (1)..(802): unsure at all n locations
  Clone ID: SORBI-28MAY03-CLUS114421_1
agaagcaaaacgttccaaaacaaataagtccagtaataataatggcagtctaagaacagaggctgaaactgacccaagaagtgctggcaaggctgttagtaaaagccttccagcagcagagccaccaaaacaagattatatccatgtcagggcaaggaggggccaagcaactgatagtcatagtcttgcagaaagggcacgacgtgagaaaataagcgaacggatgaaagttctccaagatctcgtgcctggatgtaacaaggttattggcaaagcatcagtacttgatgagataattaattacatccagtcgttgcaatgccaagttgagttcctgtccatgaagcttgaggcggttaatgcccacgcgaaccagggagttgaagcatttccagtcaaagattatggtgctgagacatacaacacagcccctgggctgacatttgatacgcaaaccagtagagaatacgcccagggcacgtcgacctcagaatggcttcacatgcagattggcagtggctatgaaagggtttcatgaacgagantgaatccagatagcggctaaataaagtgaaccatgatcaatcatggccgtgcttgtagatcatttttttcatttttattttttgatttgaaaaccatcatgttccagacgcagttttattcatgcttggagctgtaattccagtcggaacatgtattttgatgaggcgctcatttttcccccatctgaatctcaagactgtttctgctattcatgtattccatggaatttctgtagatcgcattcgttatcagaaga

SEQ ID NO: 460 - DNA, 694 bp, Sorghum bicolor
  Clone ID: SORBI-28MAY03-CLUS114522_1
gtggcgtacgcgtcgcagcacgggcacgcgttctacccgaacgccgggacggtgctgcagggcaacacgagcctgggcatcgggatccggaacgactgcgccaggggtagccggctggacaccggcgccgggcggtgcgaagtggtgtcggtggagtacctcggcgtcaaggagccggcgtgggtcgggttcgagcgcgagtgggggccgcgggaggagtacgacatcgggcgcgagatcaaccgcgccgcgaggatcctgccgcgttcggtgagggagcggctagccaagctggtggagaaggtgctcgtcggggaagggccgacggggcccaagatgcatggtaactggagaaacgacgagaaggaagcctgacagcagattaaggattgcctgcagatgcatggtaaccgtgcaattcgtgaggaatatatatacggatcagacggttcgcgattgaccgacagcagattaaggattgcatgcatgctgattattagaggaggtaaaaggattggttgtgttgtgttgtgtatttcgatctcagctgtatgtattcgatgtcctcttgtttggtttgctgtttattgctttgtatacgaccatgtgagatcttcatttgtaagcacgagcttcacaatttgaacaaaagtgtaatgtaccgtggggttttttaaaaaaattccgcattctt

SEQ ID NO: 461 - DNA, 523 bp, Sorghum bicolor
  Clone ID: SORBI-28MAY03-CLUS114533_1
aatctgcgaaggcacccaaggttttcagcagaaaatttgcagaagaccaatcaaatttatctgaaaatggaagagctggccaacaaacaccggtgcagccctgctcagctagctctagcttgggttctgcatcaaggggacgatgtgattcctataccaggaacaaccaagatcaagaatcttgatgccaacattgactccttgaaggtgaagttaacggacgatgatctgaaagaaatcagcagcgagatacgcgaagaagatgttgctggtgcgagacagaacacttcttttgggcctactaattggaactatgcagatacaccaaggaaatagagttgctaaaataataaaatgttgtagcaacagatgagctattctccctgcaattctgttatattatggggacagtatcttgagaacactctgttccagataatgtacgacaatgcatgatgcctcgtctcatcaggaaatattagtaatagctagttgattttaaaaaaaaaaaggagggcccgga

SEQ ID NO: 462 - DNA, 513 bp, Sorghum bicolor
  Clone ID: SORBI-28MAY03-CLUS114524_1
cggagtcacccagagatcctgcacaggtccaacataacaatgcagttagaagtgtcgaacaggacccactcagcaacattgaagtggtgatgcctaacaatgaagctataactatagagcatgagccgctgagtgcctatgtaccgttgcaatctaatggggattctacagatgtgaaggaggcaccaagtaatccctcaatgatgcagggtgaggaatcagaaaccacaaggcaagaagcacctcacactggtgaactggttcaacctaactaggaacctacttttgaaggaagcaaatctttctgaacgggaaaaccaaaatgtaggaaatgcatgcgttgctgtaggcaaataagtccactgttgtgtctgtggaggaatagaggagagtatgtgaaccgagatagctagtttatgtttgttatcattagccggttgtatttggtcaggttttccctgtcatattggtgacctttgcttacatgtgcaatgaatttgaggtagccgatcc

SEQ ID NO: 463 - DNA, 569 bp, Sorghum bicolor
  Clone ID: SORBI-28MAY03-CLUS114555_1
gcacgagggcccttcggcgtcgccacgcccatgctcatcaacgcctggcgccagggccacgacgacggcgccgccgacgccgacctcgacctcgacatcaccgtgcccagcgacgaggaggtggagaagatggaggaggtggtcagggggctggccacgctcaagggccccacgctgagacccagggacatcgccgaggcggtgctcttcctggccagcgacgagtcaagatatatctccggccacaacctcgtcgtggacggcggcgtcaccacctccaggaacctgatcggcttgtgaatgtgatccgttccatggctacgcacgcactctaattagagaagggaaaaaaagagtagttgtacttgaagtgatcgatttcatttggttgattgattcatcaacaaaagtgttgggcttgatcatctgatagattagcattgatgctgctgctgctgcgtttcatcagcaattgcatttgcatatctcgagcactgaattgtctgatttctcctggtggtcctgccacgtgaatgaggaaccatttgttggatgattgaataaggccc

SEQ ID NO: 464 - DNA, 724 bp, Sorghum bicolor
  unsure (1)..(724): unsure at all n locations
  Clone ID: SORBI-28MAY03-CLUS11457_1
gccggccgggttgggagactctccgccgccacttctacctccggcttccacaaggcgaaaccctagcacccgagtccctccctccccagctcccctactcccacaaaccatggcggcggcggatgtggcgtacgcgccgccgatgaagtcgggcaaggccgggttcgaggcgggcctgatggatccgcagcacaggatccgcatcacgctctcctccaggagcgtcaagaacctcgagaaagtctgcggcgatctggtgaagggtgccaagggcaaggatctgaagatcaagggccccgtgcggatgcctaccaaggtgctccacatcaccaccaggaagtctccctgtggcgaaggtaccaacacctgggatcgctttgagatgaggattcacaagagggtgattgatctcatcagtacaccagacgtggtcaagcagatcacctcgatcaccattgaaccaggtgtggaggttgaggtgactatcagcgacgcataatgtggtagtctgcaccttatcatataatgatgaacaggatgttttcagtttctagtgagagaacttggtgtaacagaggaattccctcctgatcgataagctttttgcatcagagttaagtcttatcgaggttttgtggcacgatatggatgtagcctgtttcaatggatggtagtgcatgaatggaaaatggttaatggatgatccccctaatgcatngctttt

SEQ ID NO: 465 - DNA, 826 bp, Sorghum bicolor
  Clone ID: SORBI-28MAY03-CLUS114571_1
gcacgaggcatcgacgtcgatgagttcatcttctccccagactgggctgggtcgagcaagccgaccaaatccatgctccggtccgttgtcaccgccgtcaagcctaacatcgggcaggtcacgctagggtgcaaagatttcgggccctcagggcggaccaagcaccccaaggagggagtcacccaagggtacacgtgccggaggcgagccgaggagcgccacaagtcactcgttaggctcgactctgtggccccatcactgatgaactctgtccaccatttcaagcttcggcccgagttcaagtgggagcgatcgagggctgtgagggtgaaccactacaagtaccaggcttgggatgagttcaaggtcaagttccgccgccgtgtgtccacctatgtggcggactggaccgaccgggtcaaccatgggtccaaggaccgcacacccggcctagggttcgaggcggttgaaccagccgggtggccacacaagttctgcgaggtggaggacaccctgctccgggacgtgacacggaggtggtttggtgttggattcaccaataagcttgctcatcaccggccggttggagggacaactcacagcagctcatagtattagttttggtatatactctttattaattggacacggaaacatacatgtatattatacagagtagattagggagaattcattttgattctttcaacagacagggttttgttaatcattttttatgtgatttaacaaaggatgtacaaagacaggttaggaggaggtgtaacttccatgtgattatttatgcctttcttgttgcagcgagatt

SEQ ID NO: 466 - DNA, 597 bp, Sorghum bicolor
  Clone ID: SORBI-28MAY03-CLUS114589_1
gcaccacggcgcccaaactttctccccggggaaacgagaagggaaccgaggatctcgttcctgcggcgcggcgggcagagcagaggcctcgccgagggagatggccggccggcgagagtcgcccctgatgcgcgccggcggggccgggccgccgctgtctcgcgggtcccgcatcgccgcggcggtcgtggtcggcgtcgcactcggctgcctgtgcgcgtttctctacccggacggcctcttcccccgcgcccccgactccgccatccattggccccgccgggctgaatcagttgcctgtgatacatctcgggaagttggcagactaaagtcacggctggtattgttggaaaggaaaaatgctgaattcaagaagcagatcaatgaattgtcaatgaagcttcaattgtctggacaagggaaaaatgaggccctgtataaggctggtccatttggtacagtgaaagctctgagaacaaatccaacagttattcctgatttatccatcaatcccagattggccaacatattggaacaggttgctgtgaagaaagaactgatagttgcattggcaaactctaatgtgaaagagatgct

SEQ ID NO: 467 - DNA, 648 bp, Sorghum bicolor
  Clone ID: SORBI-28MAY03-CLUS114647_1
ccactgcttatgcgcaatagtgaaagtagccttcccataatcatatccgagctatcactggagtttagagcgattctgcaaactacgaacacgaagtgttgtgtggttagagatagatttagtcagtacacattggagacggacctggagaccatggaaaaattagttgattttgtctatagcataaggagaagtcgtgacatcacggacgacgccgagaccctagaacacctgtcggagtttaccaaaggggtaggaaacgactggtcaaacgtacaatcagaagcctactcaagctcgggacctgctacaaccattgcgtagcgctcttctttacatataagcacatgacgtaagagatggagagaaagctctggagaactgcgactgtaacgtaggtttgtttgtcgtgccagtccagaggagataccccagataatggatacatcatcccacttcagacctctcaggcaatgagttttcagccaaaatgctgtggttcaaatttcctttgaggttccaggcgccaatcaaggtcgttcttctggtgtcgctaaaacatatacgaaaatcttatttgtaacttagaatcagtggtaggatatatgagatgacgaaggtccgacgtatagtgaaggccagtcacgg

SEQ ID NO: 468 - DNA, 676 bp, Sorghum bicolor
  Clone ID: SORBI-28MAY03-CLUS114656_1
gacggccacgccgctgcgtgcctccacgcctgttgcccggagcccaatatcatcgaggtcgtccaccccagcgagaagacgccaggaagggcccgtgggcgtgaccaccgccgccattgtagggacggcgaccgagcaggtagcgccagcaggcgaggtcggctgtgtcggcgaggagcgcaccgtggttggtcatggtcatgcccccagcgtggactcgctggagtcccgcgcggcagcctgggatgaggctgaacgggccaagttcatggcgaggtataaacgtgaagaggtaaagatacaggcatgggagaaccatgagaagagaaaagctgagacgaagatgaagaaaatgcagatgaaggccgatcagatgaaatcacgggctcaagagaagctgtccagccggctggcgacgacgcatcggatggccgaggagaagcgggcgagcgccgaggcgaagctcaatgagcgtgcggcgaggacatcggagaaggccaactacatcaggaggacagggcacctgccgtcgtccttcaagatctcttgcttgtgcggctcaagctttgagtgaagccagcatcagttgtgacactccgcctcttggtagtagcctcgtcatttgttcctctcacgttaaagaacatcgagctgacggccggccatagcccaacgt

SEQ ID NO: 469 - DNA, 491 bp, Sorghum bicolor
  Clone ID: SORBI-28MAY03-CLUS114667_1
gcgtcgcggacatggtggacgagtcggtggccatggcgttcgggtacgcgtgcggaagcaactacgtgcgcatccaggccggcaaggcgccggcgccgctccaagcagccaccgcatccgcggcagcgggagccatgcttgcgcagcggaacgtggagtcggtgctgttccgggggcggaggctgtcgcagcggaccaacgccgagaaggtggacgcgctggccgtggagcttgttaaggagcaggatcggcggcggcgcagcccgcttccgaacgtggccatcaagcaggtggctccgccgcggctgtcgtcggcgaccacgacgtcatcgggtaccgtgacggcaaggaccgcgtcgacgatgccgtcgccggcgtcgtgggattctcggagatagtcgagttaattatgccgtgacgcgatgacgagtttttgttttccaaatgcatgtcactaaacgagggtagagcagtgacgtgtgtgttatttt

SEQ ID NO: 470 - DNA, 546 bp, Sorghum bicolor
  Clone ID: SORBI-28MAY03-CLUS114757_1
catctgccaggaatctcgttcgctgctgcttcctgagagctcgtccactgctcggcaccggccgcgcgtccggagcacagctgcgcccaagagtcggtagcccacgtgccccaggttcctacggcgatctcgtgattcggagcggtcggctacaccgcctcccccttccgctgtctgtagcaaactcctgcggccacctggaggtggggatggctcgcccactgggtcgccccgcagcacatgcagccggaatctgctgcgccctcatgtggccgctgaggccatgcccaatggatgggtcgcctcggcgcggggcctgattcgccatggcagtgctgcggccgctaaggcttctggctttgtgcgtggcgctgcagcgccggctggtaggagccctcacagagcggcagtcgcttatggttccaaccttgggcgtgccatcggtactccctctggctgctacccccgaacggcccagtcctctttcggtgctggcctcgtcgtgccatctggaggccctttgcccgccctgccggactccaaatt

SEQ ID NO: 471 - DNA, 563 bp, Sorghum bicolor
  Clone ID: SORBI-28MAY03-CLUS1148_1
gtcgacccccgtccgcctgccttctcagatactacttgtagagggccgggccggcgagggaggagaaagagagcgactcgctgcgtgcttaattagacgaccctagctactttgccaggccaaccagccaagcagccagccaaggctccaaagttcgcagcgcattcaccaccagctccactcccaactcccgctgatctcacgctcaccaccagcccgccccacatcttctctgcctataacagattcacatcgcccgcgtgattcatgataaaaatcctcctccaaatcggagtctagcccgtgcccaaaaccctagcgaccgccggagagcttgcccgaaccgaggccgccggaacgggaaattagatcgcggctggcgatggagagccccgcgaaggaggaggccggcggggagctggcgatggagatcgagtcgtcggtcacggcggaggactggcgccgcgcgctctctcgcgttgtgccatccgtcgtcgtcctccgcacaaccgcgccgcgcgcctttgacaccgaggtcgccggcgccagctacgccaccgggt

SEQ ID NO: 472 - DNA, 723 bp, Sorghum bicolor
  Clone ID: SORBI-28MAY03-CLUS114760_1
gcacgaggtgcagctgcaagctgctgtgcgtggcctccttgcacgtcggcgggtgcagaagatgcgcgatctgccgctgattcagccctgcacctatttgcagctccaccatgtggaggactgcgatctcatccgctgcgtcggggattttcagaatgtggttccgcccacgggcagcgtgcatgctgtttttcccgcgggtggtgtactcaaagtcttcggcgtcggcagttggaagccctatgctcttctatgtgcggtgcagaccagcagccgtccagcaaggagaaggcatggtgtcatcggtgggagcgcactgcctagcgccgccagattccgccaccgaccaccgcgagggcgccttcgctggtccctgttgcgaccacttcctggaggccacacacaagcacgtatttcatccagatggtctccatgggatccaggtggatggtgtccgccttatgtgcaggggttaaaattatttctagttgagaataataaaacaagccgagatgtaaaaagcttgtttttaggtgttatgtttgtgtcttgcggagtcattcttagtgtcgtcgttaagttgcagctcgaggacgagctgcatgtccaggtggggtgtagtgttagaagagtcaaggacctattgggccttagcccattagggttaattagtcgcttgcttaggggtcaagtaagtcttgcttgtaagtcaagtaaacctct

SEQ ID NO: 473 - DNA, 588 bp, Sorghum bicolor
  Clone ID: SORBI-28MAY03-CLUS114813_1
tacttgatagcatccatcagagcagaagcggcgcaaaatctgatcccaagagagcgcaccggaagctgttgtttgacactgtgaatgagcttctgcttcagaagtttgagaaggaaactgcagtttattcggtcagttcctacaccagagcgaaggatccaccgtctaagactcctagcgggcagcaactgctgaagctcatatcttcaggaatcgaagacctggacatggagcgatcatctatctggcagaaggaaggcagcgtgatacctgatgcagagatcctgcagaggctgcagggatggtcgagcttcagcaaggagttcccagggatggtgctggagatcgaaaggtcgatattcaaggagctggtggacgaggtggtgcatggggagtctgctgacggcccggagatgaaggtggcaggcaggcggagaaggcggctctttgcttgatacggtttgtttgaccatcaccatccaccaggttgtccaagtggatgggcctgatttgtgaagctataactttgtttgttttgccatgagagcccttttcctataaagagaggtacacaagttgtataagcag

SEQ ID NO: 474 - DNA, 559 bp, Sorghum bicolor
  Clone ID: SORBI-28MAY03-CLUS114820_1
tgttcctccccaacggcggtatagtccagaacttcggaagcgtccaagaaatcctcttcctcgaagtcgccctcacagagaactggctcatcttcgtcacccgcggcggcaagacctggccatcatggcaactcgtcggcgctatcctaggcgtcgacatcctagccactctcttcgccctcttcggctggctttctggcacaggcgaagtccccgccatccacgacaacttcaagcagagcagcaacggctgggtcgccatcgtcaccgtggtcattgtgtggctgtactccttcggcgtgacggtcgttatcgctattatctactttatccttaacaagatttcttggttggataatcttggtacaaaggatcgcagacataaggatactaagttggagaatgttctgggacatttgcagaagcttgctattcagcatgaggttgatgagaagacgggcaagagcaagtttacgcttgctgagaaggcggctgatgatgatgaggatatctagatgctatttttaggatgtgcaggagtctttgtttagtttatgtt

SEQ ID NO: 475 - DNA, 532 bp, Sorghum bicolor
  Clone ID: SORBI-28MAY03-CLUS114881_1
gcacgaggccgcagcatccccatccgcaaggacgacgaggtcaccattgtccgtggctccaacaagggccgtgagggcaaggtcacctccgtctaccgtctcaagtacgtgatccacgtcgagcgtgtcacccgcgacaaggccagcggccagtccgttcccctgggcatccacccctccaacgtcgtcatcaccaagctcaagctcgacaaggaccgtgagagcatcctgtctcgctccaaggtcggccgtgagctccgtgtccccaacaagatctctgcttaaattcataagcaaaaatcttaaaattgggtgagacgaggagatgaattctttttttttttcaacttaacagtttttccatgtgatgcatccatggcacaatgatgggcaaggaatgggcatatatactccggcgttttagcgatacccgagaccctgcaggtccggctttctcagcagggtagatgaatcgagaattttacaattctcaatggccgtttcaccaacttgttgtggaaatgctccatgg

SEQ ID NO: 476 - DNA, 577 bp, Sorghum bicolor
  unsure (1)..(577): unsure at all n locations
  Clone ID: SORBI-28MAY03-CLUS114924_1
gcccccctgcgcggtggcgactggcggcgcttgcaagggtcatggggagaccgaggacgcgcggtcgtgctgcttcgagccaggctgctccggcggccgcggaccacaggggccggtggaggagtgcaggtcgtccgccggcggcgaggcgtgcgtgctgctgctcccgtgccgccacctgtgcctgtgccgcgcgtgcgaggcccccgtcgacgcctgcctcgtctgcgccgcagccaagaacgcatcgctccttgtcctggtctcttgatccgaaaaaatttcggatttcgctactgtagcactttcgtttgcttgtggtaaatattgtccaatcataaactaactaaagtcaaaagattcgtctcatgatttatagacaaactgtgtaatatatttagtgtttcatgcatgtgccacaagattcgatgttacggggaatcttgaaaactttttggatttcgctggaaactaaggtcttgtttagttccaaaatttttgcaaaacaggtactgtagcactttcgtttgtatttgacaaantattatccaatccatgtactaactaggctcaagat

SEQ ID NO: 477 - DNA, 454 bp, Sorghum bicolor
  Clone ID: SORBI-28MAY03-CLUS114977_1
gcacgaggccaagaagttcttccttgtccctgatggttctggtagcgccaccagttacatctccatcccaaacatctctcctgacatggccgtgtacggacttaactgccctttcatgaagtgccctgagaagtggacctgtggcgttgagggtgtctcccgtctttacctcaacgagatcaagcgtcgtcaacccgaaggcccctacatcatcggtggatggtctgctggcggtgtcatggcctacgaggttgcgcagcaactcatcaacgctggtgaggaagttgagaacctcgttctcattgatgctccttgccctgtcgctcttgaccctctccctgctcgcctccacatcttcttcgaccagattggtctgctcggtaccggcaagcccggcggtactccctcatggctccttcctcacttcgcctccgccatccagaacctcaaggac

SEQ ID NO: 478 - DNA, 254 bp, Sorghum bicolor
  unsure (1)..(254): unsure at all n locations
  Clone ID: SORBI-28MAY03-CLUS114995_1
gcacgaggcactagttcactccctcctacgctctcatctccaagaaaagagcacgctaggcagctgacaaccttgcgacgatctagctagcattagcaacatgtgcggcggcgcgatcctcgcagagctcatacccagcgcgccggcgcggcgcgtcgtcacgccgggccacgcgagcggcggcggcggcggcgatgacgacttcgaggccgcgttccgggacttcgacgaggactccgacgaaggcgcggnca

SEQ ID NO: 479 - DNA, 605 bp, Sorghum bicolor
  Clone ID: SORBI-28MAY03-CLUS115014_1
caaccccccatggaccccaagtctgctcctcctgtccttgccatctggtgcaccgacggagtctgccccaaccccgaggacccccgccccccaccaggtgagggagaggacccagctcccatgaagtggcttctcaacaaccgtactgatttctctgacaacggctgggcccagctcttgcccaaggagaacttccagtacgctgtcatgggtggcaaccacttcaccatgatgaagggtgatcacggtgtcacacttggaaagctcattcagcagggcctcaagctataagcactttgtgtcttgaccatgttggactgtaacaactggatattgcatacatctcttttctttcaagggttgaaatgagatgccggcgttggcattttcacttctttgtttgtatggtatttgatatatcaattactactgatgttagggttaagataaaaatatttgggtcgcgggctggcgttgaggtcttgaacctttttgttcttattagacatctacgcacacgacttgattggcttctgtttttatgtttacgcaccgttatgattactgttagtttaagctttgtacttaatgttttggcttccgca

SEQ ID NO: 480 - DNA, 584 bp, Sorghum bicolor
  unsure (1)..(584): unsure at all n locations
  Clone ID: SORBI-28MAY03-CLUS115079_1
ctcgccgcttccccctcctctacccctgcctctgcctgcctgcctgcctcaacgattcctccgcttttcctttttcaaaatcgcccttttctcgtgcgcgtgtcgactccttcctggttcctgctcgccggcgggtctgggctggggggacggacgctgcctcggatgaggccgcgctgaccggagccggaccacccggcgcccacccatggcgcgtccgcagcgagtgtacgaggcttggaaagggaacaataaattcttctttggtgggaggctcatattcggacctgacgccaagtcactgatcctctctggtttcgctcattgtgatcccggtattggtcttctgcggatttgttgctcggcatctccgccaccatttcccggattacaatgcaggatatgcgattcctgcggtggctgtggtgtttatgatttacgtgctagtcctgctcttggttacatcagcgcaggatcctgggatcgttccccgcgcggcccacccgccggaggaagagttttcttatgggaacgccttgtctgggggcacgcctgngaggctgcaattcccccgtgtgaaggaa

SEQ ID NO: 481 - DNA, 511 bp, Sorghum bicolor
  Clone ID: SORBI-28MAY03-CLUS11512_1
ccagatctccccattcacacacagtctcgcgcgcgcacagatacctccaaggccaagcgcaagcaaagcaaagcacccaccccaacccatggcgcctctcctcctccttttcctcctcggcagcatctgcgccctcttctccctcaccacctcctcgcgcgccagcggtaagaagagcgacggcaaggagcccagatgcagggacggctgcgtgccggaggagacgacgcagcagcagcaggaggaggaggaagggaagaagaagcaggcgcgggccgacccggagaaggacctgggcatcgtcttctccacgttcgaccacgacggcgacggcttcatcacggcggtcgagctggaggagtcgctgcgccgcctcggcatcgccgtgtccgccgacgaggccgcggccatggtcgcgcgcgtcgacgccaacagcgacgggctcatcgacatccacgagttccgcgagctctacgactccatacccaagaagaggaagcaccagcaccct

SEQ ID NO: 482 - DNA, 552 bp, Sorghum bicolor
  Clone ID: SORBI-28MAY03-CLUS115158_1
gcacctggcttcctgcctgcctggacgtggccgttgctcccaggcacagagctagccgaagacggaggccggcaagctagtgtatacgttaagcttcagcagcagggtgcaagaggggagccttgcacgttgcactagacagtagaagacacacgcaagatatggccggacgcactacggagggggctcgctgcagcggggagacgacggtgtgcgtgacgggcgccggcggctacatcgcctcgtggctcgtcaagctcctcctctcccgcggctacaccgtgcacgccaccgtccgcgacccgggtgatcccaagaacgcccacctggggcggctggaaggggcctcggagaacctccggctgttcaaggccaacgtgctcgaccagaacgcgctggctgccgcagtctccgggtgccggggggtcttccatcttgcctgtccggtgcccacggataaggttcttgatccggagtcagaagtactggctcctgctgtgcaaggtaccttgaacattcttcaggcttgctcaaataataatattcagaaag

SEQ ID NO: 483 - DNA, 696 bp, Sorghum bicolor
  Clone ID: SORBI-28MAY03-CLUS14289_1
acagccactgatgacataaaccatctcactcattctctgtagaagtgtagccaggtagctgcagctagctagctagatagacataaacacatcccactcattctctgtagaagtgtaggagaggccatggataccaccagcaagaaagcctatggggttgccatcatcatacagctcatatacaccggcatgtacgttgtctccaaggcggcattcaaccatggcatgagcacctatgtcttcatcttctaccgccaggcggcggccactgctctattgctgcccctagccattgttcttgaaaggaggaatgcaccacccatgtcattcaggttgtttctgaagctgttcttctatgcattgcttggcaacacattgagcatgaatctgtacaacataagcctcaagtacacctctgcaaccgtggcatcggcaacaagcaactctgtccctgtggtcaccttctttctggcagtcctgttaaggctggaagtggttcggctgagaagcccgtcaggcatggcgaaggcggcgggcgtggcgctgtgcctggccggggtcctgaccatcgccctgtacactggtccctcgatgagcccggtgaaccaccaccgcgccttcgccgagcaccatcctcaagctcatgccgatggcggcggcggcaaggggacatggatcaagggcacgttcctgatg

SEQ ID NO: 484 - DNA, 698 bp, Sorghum bicolor
  Clone ID: SORBI-28MAY03-CLUS115197_1
cttggccaaagttttgagtcctggcataaaccaaggcaccgctgattgtgtcgtaggctcagttggatttattgcaccagagtacatgaaaaatggtacattctcggtaaagaccgatgtgtacagctttggtgtcatggtccttgaaataatcagtgggaaaagatggactcggccacttcagagaacatattaccaagatctactcacatgggccttcaataggacaacatgttacggcaacaaaatggtgcaaaggctcaagggtttcatgcacccaacgatgcacagcatcgcgttctgcggcaggacagtgccacggtgcctctcgttgccgacgaggaggagggtaatgtcaaagcagagggagatgaggaggtgtgtccgggtagccctgctctgcatccaagagaagccggagcgccggccggacatgccggaggtcacgaggatgctgatgacctccaggaagcctgctgtgccgtttcctcgtcggccaggctacgccaccgagagccctatgtatgccggcgataggagcacgacgccttgagggtgctgccttatattgatgcttgtatatggtagtctgcgctagctagctagaatttgcaagccactctgactttgcatggactagctagaaaacaaaagtactcaatccttctcaaaattgtaaagtcgtttgactttttaat

SEQ ID NO: 485 - DNA, 720 bp, Sorghum bicolor
  Clone ID: SORBI-28MAY03-CLUS115235_1
ataaacttttgcaaaatgaatgaggactggtatatggttgccaaggttattgctgaaaagacagccttggaatatgcagagaaaaatggactgaatgttgttacagtttgccctactatggctttaggaccgctcctacggcctatggtcaatgtcagccatgaattcctgctatacattattaaaggaggtcctactgtgatgaggaacattccctggcacatagttgatgtccgtgatgtggctgatgctttgcttctcgtatacgagaaagagaaatcagcaaggagatacatctgcgcgccaaattacatcagtgcgatagatctggtgaacatgctgaagaaggctcatcctaattacaattacgtaaactgcggcaatgatttggttcctaactctatagttacgccaataatgtcggagaaactgaagaatttgggctggaaaccaaggaagacgctacataaaacattgatggatagtgttgaatgctatgagaagatggggcttctgcaagatgttgagggatgcccttgccgtcttcctcacctttttcatatggctatagaaaaatgaaggaaactctgcattgcttctagtgttacctaattacacttaaaacattgttggatatgttctaatcacacaccaacattgtttatgatgttcaatggagagtggttgttttcagataaaatgtgtggattgtgatctaat

SEQ ID NO: 486 - DNA, 570 bp, Sorghum bicolor
  Clone ID: SORBI-28MAY03-CLUS11524_1
aagcaagcaaacaaacaaaagacgaagcagcaacaaagatcacacgagctccgcttactcgacgacccactgcactcgcctccgatcgatcgatccggcgatcacactagtcgagtcgactcgactcgagcgagcgcgcgcccccgatcaatcaatggcggccaaggtggcgtcgccgctcgcgttccgccgcgacgtgcgtggcccgctcggccggcctcatccgagcggcggctgccggagcgggaccgggatgccgggggtgctgtactggagcagcggcgccggcggcagcagggtgctcgcggcgcgggcgcgcgggcggaacaggttcggcggcggatcagggcggactgccaaggacgaggcggcggacgaggacgaggaggaggtcgcggacgtggtgatcgtcgacgctggggacgaggaggagttcgcctgctacgagctgtccgggttcaggggcctggctcttgatctctcctacaggcctgtgaacgacgtgtgctagaagcgcgccatctgtctcgagttcattcgggaggccgatgtgttggagtactatgatca

SEQ ID NO: 487 - DNA, 724 bp, Sorghum bicolor
  Clone ID: SORBI-28MAY03-CLUS115278_1
ctggcttgcagaatcagctcccaaactcagctgtggcttctccgatagcaagtcctggaggaatgggcgttgggtgtctcggtaatcacatggctgatagtcctgctcgggttctcaccccaagccctgttcgcaatattacaaggcgtatccaacaaatggatggcccatcaggaaggttaggggttgcaatgccaccttctgttgcagctgggcatgctttgagggcaacaccaagccctctgatgttagcactgggggagttagagtttgttcggatattcctcatatatgtgtatcatggacaccagaagatagaacaagtactggaggatgtaagttatataaggcatttgaattcactgcccatggattatttcgagtcagaaatctggaacaaatttggaataaagtatataccagcatcggatagaagaaagaaccttgattgggacccaaacaagacaagactctattattgtattattgagaaaaggggtgataacatagcaaccatttttaagggtccatatgtggagaatacaaggactcatctccagaaaattgttggcgatgacaatgttcttattgtgaagtttgcagatatacctgatcttgaaaataatacagacaacttgggtatctactgtcaatattacagccaggttgctgatgatggtatcgttttgggcttacggcggtatcgtttttcattcataaagaa

SEQ ID NO: 488 - DNA, 474 bp, Sorghum bicolor
  Clone ID: SORBI-28MAY03-CLUS115315_1
tcggcacgaggcttccttcctcctccccacgggcacagctcgcgccgtccctgtcccctatctcttctcacccgccgccggcggtcgaatcgacggaggcgggtggctggattgctcgattccgtatatatgggaattgattgattgattgatttggggttgccgctgtgcctgtgcctgtgcctgtgcctgtgcctgtgctgctcaatcgatttggggattaggcaggtgtgtagggtaggtgggatccatcgattcggatgggcgaggaggccatggacgactacgagctccacatggtgtgctacggcggcgacgacgacggccgcgtgatggagtgggagtcggggctcccgggcgccgacgagctgacccctctgtcgcagccgctggttcccccgggtctggcggcggcgttccgcatcccgccggagcccgggcggacgctgctggacgtgcaccgcgcgtcggcgg

SEQ ID NO: 489 - DNA, 696 bp, Sorghum bicolor
  Clone ID: SORBI-28MAY03-CLUS115325_1
gcacgaggcatcgatcgatcgagaagcaaacatggcggcgtttccgaagcatagtagtagcctagcggctgccttcttcgctgtgtccatggccatagccgcaatcaccaccaccgccttggcgcagaacacgccgcaggacttcgtggacctgcacaaccgcgcgcgcccggcggacggcgtgggtccggtggcgtgggacgccacggtggccaagtacgcgcgggactacgccgcgaagcgcgccggcgactgcaagctccagcactccggcgggcccttcggggagaacatcttctggggctcggcggggcgggcgtggggcgccgccgacgcggtcaagtcgtgggtggacgagaagaagcactaccacctgagcagcaacagctgcgacccgggcaaggtgtgcgggcactacacgcaggtggtgtggcgcaagtccacccgcctcggctgcgcgcgcgtcgtctgcgccgccaaccgcggcgtcttcgtcgtctgcagctacgaccctcccggcaacttcaacggcgagcgcccgttcctcactcttgacgccgctgccaagtaattaagagtgtgcgtgcagagtgcagtacgcaaactctaccagctccattccgtctgatcgtgggagcattttgtgtgtacccatatttgtatgcggccgcgtttgtgatggtttttgtggtaata

SEQ ID NO: 490 - DNA, 339 bp, Sorghum bicolor
  Clone ID: SORBI-28MAY03-CLUS115392_1
gtctgaaaactggagagatagccatggtcattggaacacacagcttaatagctgatagaactgatttatcatctttacgtatctctgttatagatgaacagcagcgctttggagtcgtacagagaggcaggtttaatagtaagctatatacttcttcctcaaagttgagtgatgaaaatacaagttcagattcgacctctgattctgaaacatttatggctccccatgttcttgcgatgtcagctaccccaattccaagaacattggcacttgctttatatggtgatatgtctcttactcagattacggacctgcctcctggaaggcaacctattgaaa

SEQ ID NO: 491 - DNA, 624 bp, Sorghum bicolor
  Clone ID: SORBI-28MAY03-CLUS115396_1
gcacgaggcgctagctttaattcctccattgttgtgagctgatcatatcatcatagaaacgcacgaggcacattattgattagaccacaccacaccacccatggccatggagactacgaaccatcctcctctgctgaccccttacgagatgggtgagtttgagcttgagcaccgtgtggtactggcgccactaactcgtcaacgctcctacggcaacggcccccagccgcacgccgccgcggtcctccccccgcgcgccacccgcggcgcccccctcggccccgacgccgcggccgtctcccgcgcggcgcggggctccgcggacgcccccgggctctgggccccccgccccggcccccccgggcggccctgccgcgacgccgtcctccccgggggcgccgtcttcttcggcctgccctggcacgtcgcccgcggcgccaccaccgcgttccagcccggcggcgccgcgcccatctccagcaccgaccgcggcgtcaccccgcaggtcagccacgacggccacgtcgaggagttctccccgccgcgccgcctggagccccgcgagatcccgtccgtcgtcgacgacttccgcaaggcggcacgcaacgccatcgacgcgggctt

SEQ ID NO: 492 - DNA, 851 bp, Sorghum bicolor
  Clone ID: SORBI-28MAY03-CLUS11541_1
gcacgaggcacaaggaatatttcatagccatcattgctgtgagtggtttcattctgacaaccactctagccgttgtggtttggctgcttgtctacaggcgaagcaagaaaagaagaagatcgcgagaagtgttaagtgcttcagctgccgcattggtggcaccacaatggaaagtattcactagtgaagaacttagatcaatcacaaagaacttcagcgagggaaacaggcttcctggtaacgcaaagacaggcggaacctatagcggaatcttaccagatggatccaaagtagcaatcaagagacttaagagatccagtctgcaaaggaagaaggacttctactctgagattcgtagagttgcaaagctgtatcatcctaatttggtggctgtaaaaggatgttgttatgatcatggtgatcggtttattgtctatgagtttgtcgcaaatggtcctttggatgtgtggctgcatcatattcctagaggagggcggagccttgattgggcaatgagaatgagagctgccactactcttgctcaggggattgcattcttgcacgacaaggtaaagccgcaggtggtgcaccgtgatatccgtgcaagtaatgtcttactcgatgaggaatttggttcacatttgatgggggtcggcctttcaaagtttgtaccatgggaagtgatgcatgagagaactgtcaaggccgcatcctatggctaccttgctcctgagtttatatacaagaacgagttgacaaccaaagagcgacgtctacagctttggtgtgctgctcctagaaattatcagtggtcgtcgccctgcacagatcaagtgagtctggtgggtggc

SEQ ID NO: 493 - DNA, 838 bp, Sorghum bicolor
  unsure (1)..(838): unsure at all n locations
  Clone ID: SORBI-28MAY03-CLUS115428_1
gcacaaggcacaaggcttcctacgatcccctccctcacgcgctcccacggccgccgctaaatcgccccactcggaggacgatgagggggggtagccaatctggttttcgttctaacaattttgggagaagaggaggatcagatggggacggtagagaagggctcgtgggtggtgccggcactgacttggagggaggtggaggacgccgggcttcaggtgcggccgctcgctcatcgcagtcacttcagttcggttacacaaacttgaacacatcacgacgagattcgtaggccttcttgcgcttgctctgatgtctctgtcctcttcggtgatgccatcaccatcatccattcccagtgcccccatgaagcaattggatacaccatgacagattcactctgtcggcacaagctatacgccaatatttcttcctcgtgcaaggagctacatctctgatctggtcataacccatacctttcgtaagagtgcgaaagcaagaagccatttttttggtgggacaataatggcatagacaaagcgatcgccatgagcgtgggctacctacgatcggatggttattcctgtcacaacacacggacatgatcataacttgcaatttgatgtcttatcattccttcagttgtggttgctgattaggtagcccttgcaagggcagtcgaagaatggatagcgggtaaggaaatgatggtgtcacccaagcaagagcgtattggaatcctgatccaataatcatgaatggttaagatgatttatttaatatcatcgtgtaaatgtatcacccttcatacatgatattggtnccataatggtatggttg

SEQ ID NO: 494 - DNA, 514 bp, Sorghum bicolor
  Clone ID: SORBI-28MAY03-CLUS115531_1
ctcccgaaaggactggtactcaatcaaggcccctaaccctttcaacgtccgagatgtcggcaagaccctcgtgaaccgaaccaccggtctcaagaacgccaacgacgctctcaagggccgtatcctcgaggtctctctggccgatctccagaaggatgaggaccactccttccgaaaggtccgcctccgcatcgacgaggtccagggcaagaactgcttgaccgctttccacggtctcgacttcacctccgacaagctccgatctcttgtccgaaagtggcagactctcattgaggccaacgtcactgtcaagactaccgacgactacctcatccgcctcttcgccatcggtttcaccaagcgacgaggaaaccaggtcaagaagaccacatacgccgcctcttcccagatccgtgccatccgacgcaagatgaccgacatcatccagcgtgaggcttcaagctgcaccctcacccagcttaccttcaagctcatttcccgagtcattggccgc

SEQ ID NO: 495 - DNA, 629 bp, Sorghum bicolor
  Clone ID: SORBI-28MAY03-CLUS115538_1
tgatgtgttccgtatagagaaagaagggactgcttggagcgtgagagagctgaagagagctatgagcgcggtatcagagaaactccctgtgttggccagtgtggctgatggtagcaaagagccagagccagaagaaagcaagaaaaagaagcccaagacggatgaggaagagatccaagagtgcattgagtacactgcaaacacggacccggaccagatattggagtatgagaaggttgtcaaggtcattgtgccacatgaaaagagtcttccgtccacaaaagatacgcctttccatcacgaagcttactatgccaacctgcatcactatcacaacaagctgcgcaatccgaatgcgtcatttggcaagagtctcatctatggcgaggtagtgacatctaccaatacgctgctcgaaaagaatccctcgctactccggactttacccaacggcttcaccatgacagcaaccacccaaattgctggtcgcggcagaggaagcaacgtgtgggtggcgcccagaggagcacttatgttttctactgttctacaccactccttcgcgctaagccaaagtgcacccgtcatctttatccagtacctcgccgctctcgccattgtccagggca

SEQ ID NO: 496 - DNA, 658 bp, Sorghum bicolor
  Clone ID: SORBI-28MAY03-CLUS115541_1
cgcggggcggcggcggcggcgccctccgcccctccccaatcctgacccagccacaagcgccgccgcgaggcctcccctgccaccgccgaccaccaccacaaggaggataagaaggccaccgactctcacgcgacacccaagggcggaggggaccccgcggccgcggccgcggcggtgggcgacggcgatgtggatgcggaggaactggagatgatgaagatgatgggcatccccgtcggattcgactccaccaagggaaagcacgtgcctgacaccgacgtcagcggggtgcgtgtcgtcaccaagcgccagccgcgccagtacatgaaccgccgtggtggattcaaccgccctctgccgcctgagcgcaaccgctgaggatgggaaaagaggatttaatttggagcaaagaagagattgatgctatttcggcgctcttcgaccggcaatggcaagtacttcatacactaattgctctgccttttccaaaaagaaggggctaaattatatttatatgaatatgttatagtttgcattttataaaccattttacatttgcaaattcattgctcatacaagaagaaaagcacaaaacttttattttctcaaatattgcacaggttcatattccagtggcgatgatactaccttttcttat

SEQ ID NO: 497 - DNA, 520 bp, Sorghum bicolor
  Clone ID: SORBI-28MAY03-CLUS115558_1
gcacgaggatctctcaggatttccgcaggaaggagaggattcagatcgtcaatggcgcacgcgaaagcaggagcgtctctgccggtgcccaacgtgcaggcactcgctcagacttggcatggatcaggcgagccgatgcctgtccggtacgtcagaacagaggagaccagcgccggggaggtcgtcgccggctgcgccatcccagtcatggatctcagcaggttgcttaacccgcggttgtccgaagaggagctcgcaaacctcggctttgcctgtcagcactggggtttctttcagcttatcaaccatggggtgccggacgaggtgatccaggacgtgaagagagacatgatcgagttcttcaagctcccgctagaagccaagaaggtgcacgcgcaggtgccgggcggccttgagggctacggccaggccttcgtctactccgagacccagaaactggactggtcggacatgatctacctcaggatcagccccatggagtcgcgggacttaaggttct

SEQ ID NO: 498 - DNA, 577 bp, Sorghum bicolor
  Clone ID: SORBI-28MAY03-CLUS115560_1
aacgacatctacgcgcagcttcctggatcgccaactaatcccgtcgtcaagattggcggcatcctagtaaacagcagctactctggctcttcgtacgacattgtaacgggcattggtctgaacttatccaacgcactacccacgacatccctcaacctacttgcctcgagtctctccccgccactgaaacccctgactcacgaaaagctcctagcatctatcctcgcacactttgaaacgctgtacgcgtcgttttgccactcgggcttcaaccgtgatatggaggctgagtactacgaccactggttgcatacggatcagattgttacgctcgagagcgatggaggggtcaaggcgaggattaagggtattacgcgtgactggggcttgttgctggcggaggaactggggtgggaggagagaccgacggggaaggtcattacgctgcagagtgatagtaatagttttgattttttccagggggttggtgcaggcggaaggtgtgagggtgtggttgagagtgttccatctgatgtgtccaaatggaggattactggtgtaagtgagtagataaaag

SEQ ID NO: 499 - DNA, 538 bp, Sorghum bicolor
  Clone ID: SORBI-28MAY03-CLUS115562_1
gtgggctccttattaaggaacactggtgttgctctatcactgtctgagtgaaaactgataatagcttcagtggggttcctttgttgaatcagtgaggttattatgtctgaatcaacttagttagccattgttatacaaaatgtttagggtcaagatggttgcaaaagatagtttatcattgctgagctcaagtgaggacaagccagattggattccatagagattcagcacaactcaggaacagtttctgcttgtatggaatcacattacacataaaaagcaaaagagagctaactggctggctcctaaatttgcaagtgtagagctatctggttgttccctaaatctgtgccgatgttctcttctcacttcatctgaaattaacatttagttcttagagaatttgtgactgcacaaatgtggacgctatgtcgattcttcctgctctatagaagaataattatctagagattttgtcaatgtctgtaacacaatgtgtgtgtgataagtttgtgaaggggctcattcatgtacaggt

SEQ ID NO: 500 - DNA, 699 bp, Sorghum bicolor
  Clone ID: SORBI-28MAY03-CLUS11557_1
ggccgccctttttttttttttttttttttttttgtcacaagcatccacgaaacccgcgcacgtctcagcgaagagaagtgtttttattcctcaatacaaaattacaaatgcattgtaacaacagtctatgtacagttgcaggctacaggcctacttacaccaccgaaagaatcgccaccgtcaccatcaccatcacgacactgccaccgcgttctgcccggcctccagttcttgttccgacaccgccacaacgttctggtcgatgaagttgaacagcgcgagccccgcggcccacacgtcgtcgtccatcaccgactcctccggcgagtggctgatgccgccgcggcaccgcacgaacagcatcccgatcttggtgagcctggccatcgccatcgcgtcgtgccccgcgccgctcatcagcacgggcgtctcgccggccgccgccgcagtgcgccccggcattgtcgacacggtcgaccgcgccgcgcgcttcagctgggacgttagctccgggtcacagtgcgtcgccgccgccgagtgcttatgctcgactttgcagtcaaccagcctgtcgtcgcatttctggagaaccagcctcgagaagctcgtgacgatcgtctccctcacttggtcatccatcgcgcggatgtccaccgtgaagttcacctggcccggaatcacgttgctcgcgcttggcca

SEQ ID NO: 501 - DNA, 526 bp, Sorghum bicolor
  Clone ID: SORBI-28MAY03-CLUS115585_1
acccagaaactggactggtcggacatgatctacctcaggatcagccccatggagtcgcgggacttaaggttctggcccactcggcctccctccttcagggactccgtcgataggtactcggccgagacggcgaaggtcacggcgagcctgctacggttcatgcccgtggatctgggggtggagtcggagcgcctcctagaggcgttccggggacagccgcagagcatgcggacgagctactacccggcgtgcaagcaggtcgccgatgtgctgggcctgtcgccgcacaccgacgccaccctggcgctgctgctccacgtcaacgacgtgcagggcctgcagatcaggagggatggcaagtggcacgccattgaccctatcgacggcgctttcgtcgtaagcatcggcgacatactggaggtatatataatacgagagatgttgatgcctgataggcacaggcagttgacccaaaatactcaccctgtttgaatccttgaaattaaattcattttcataattataa

SEQ ID NO: 502 - DNA, 582 bp, Sorghum bicolor
  Clone ID: SORBI-28MAY03-CLUS115612_1
caatcatcacaggcaagtgcaaagggccaaagtttccagccagccaatgctgtgcggcactcaaggaattcgcgtgcccttattatatgtacctcaatgatgagagcaacgactgtgcatcgacaatgttcagctacatcaacctctatggcaagtatccaccaggcctgttttccagcgagtgcaaagaaggcaagttggggctttcttgcgcagatgtcccccagaaggacagtgccactgcaaacagtggttatcacgctcaaagcagcttgcttgtgttgattactgtcttgagtgtggtagtagcgttgttccactgaactataacttcattttccccaaagatggtgtgttacagctgatgaggcttgagttgcaccttttggtgctcatgatgggtttccaggttcttccttttatgtgtaaaatctctctaatgtaattcatggcctactgcatatttttctgaattcgattgatctgtcagtgtcaatgttagcttccatcagttaacggtatcattgtattgcggttgttgtgttaaattaggacgagtatatgtatatatagattatcagt

SEQ ID NO: 503 - DNA, 571 bp, Sorghum bicolor
  Clone ID: SORBI-28MAY03-CLUS115615_1
tccggcgccacgtcggcggtctgcgcgtgcgcggcgcctccagcggcaagacgatggcgcacgtcgtcgccgcggcgtcctcctcggccgccggtggcggcgaggccttcgtggtcgagggctcctacggccgccgggcctgcgccgtgcgcgacgcgcgcggcgacgtcgtggccgaggtgcggcgcaaggaggccgtgggagacgacgtgttcaggctcgtggtgagtccacgtttcggtgtgccgctcgccatggggatcgtcatcgccctcgacgagatgttcgtcgccggccgcggctcggcgcgctcgtggctgcgcatcgggtgctaggataggcagtagtacatacaggtagtaagaagcgaaaggagcccacatgtcagtgttagtgtagacctctctagtttctacagtctacacacagatgagaaaggctccggccccagttgtcagcgtcagcacagttttatagtgcaggcccgcagctgggccaacccaaaagtatggccgtatcagattcatccggcaaatgtgcaaaagagttatcttctagctaattatatagc

SEQ ID NO: 504 - DNA, 528 bp, Sorghum bicolor
  Clone ID: SORBI-28MAY03-CLUS115649_1
gtctgcttcggccaccaggtgatctgccgcgcgctcgggggtcgcgtcggcaaggcccgcgccgggtgggacgtcggcgtcagggaggtggccatcgcggaggcgccggcgccggcgctgccgccgcgcaggttcctcgacgcgctgcgggagtgtgaccagctgccgccccgcgccaagatcaccgaggtgcatcaggacgaggtgtgggaggtgccggagggcgcggaggtgctggcctcctcgcacaagaccggcgtcgagatgttctgcgtcggcgaacacatgctgggcatccaggggcacccggagtacaccaaggacatcctcctcagcctcgtcgaccgcctcctcgccgccggatccatcaccattccctttgctgaggccgtgaagtggcaggtggagaccactgcgccggaccgggagttctggttgaagctctgcaagagcttcctcaaggctcgtgaaccatagagtattagagtttgcacactatggtgtgacctacgaataaaatggttgtaa

SEQ ID NO: 505 - DNA, 705 bp, Sorghum bicolor
  Clone ID: SORBI-28MAY03-CLUS115652_1
cgcagcggattcagagcatcgcggagatcaaacacaaatgtgatgtcttggcccagcgcggagcccagcgcgtggctattggtgggtttggcatcctcgctacatggtggtttacagtctacaagttgacctttgagaccgacttgggctgggacaccatggaaccggtgacgtacttggtcagcttgtctaccctgatgggcggttacctgtggtttctataccacaaccgggagatctcgtacaagtccgcgctggattttacagtcagtgcgcgccagcggaagctctatcaacagcacaacattgatctgcagctttgggaatccctgatcgatgagggcaagacacttcgtcgggaaatcaagagtattgctgctgaatacgacgctgaatgggacgagcgcgtggacgagcagtatgagcgagtcactcaggcgctgagatcagagcggaagcaggatgatcgaaggaagagcagcagtgataaagaagaggacgatgattgaacatggagtcacaaggatcattttctctgatttgtcttcgtattactgagacgcacagcgcctgcatttgttgcatttaaccgcattaggatgccttccacattttccctggagcccgacattagcaagttaagatgcttcacatctcaagatgtcaatatgcaaacgataaaccagaatagagcaatacacagtc

SEQ ID NO: 506 - DNA, 375 bp, Sorghum bicolor
  Clone ID: SORBI-28MAY03-CLUS115668_1
gaagcaagggtccgcaagcgacgccgtcgtcgtcgtttaaaggcgtcgagaggcggggttcgacgtcgacggcgaaacggccgaggcccaacgggtcggcgggcctggaatcggacctgggcctctccggattctgcttcatggtgagtaaggagatgagcaagtcgaaggagaggcaagcggtatgggccagtgacgacggtgacaggagcaccgatggcaagcagaggttgtcgacgagccgcgatgtctccggtggtgggatgtcacgctcactgcagggccaaagcagcaaaaacttgttgcagtgtatggcctctaagtcttgattagagcactgttaattgacttgctggctcgtgccagtcctcgtgc

SEQ ID NO: 507 - DNA, 613 bp, Sorghum bicolor
  Clone ID: SORBI-28MAY03-CLUS115728_1
gcacgaggggccagggtcggcggtggcgcgtcggcggggcacgccccgtggtcgccctgctcctcttcatcggcgtgaccgtcggcttcgcgttcggggtctaccacgcgcgccacagcgggcgcgacctctcgttcgcgatcgtcacctacttcctctccgtcgtgctcgcgtgctgcgtcgccaagctccggcagctgcggcgcgacccggcagccacggcggccgagcggcggcgcgtcaggatcggcgtctgggtcatctcggtggcgctgggcaccacggtcacgtcgcgcgtcgcggacgccatgcccgggctggcgctgaagctcgtcgtgtggggcgtctccgtcgtgctccacgggctcgtgttatatttccttttcgtccgcagaggcgccgagcgctgcgacgcggaggacgccggccgcggcgggctgtccccggaggagagggtctagtgaatcctgtgtccgcgcgcatctattgccaatttgcaacacgatggactagggccttgtttagttcttaaaaaaatttacaaaatttttcagattccacgtcacatcaaatttttagaggtatgcatgaagtattaaatatagacgaaaat

SEQ ID NO: 508 - DNA, 720 bp, Sorghum bicolor
  Clone ID: SORBI-28MAY03-CLUS115692_1
agagggtgctaaagtacattgagcatggcaagagcgaaggagccaccctgctcaccggcggcaagcccgccgccgacaaagggtactacattgagcccaccatctttgtcgatgtcacggaggacatgaagatcgcgcaggaagagatcttcggccccgtcatgtccctcatgaagttcaggtcggttgatgaggtgatcgagaaggccaactgcaccaagtacgggctcgccgccggcatcgtgaccaagagcctggacatcgccaaccgggtgtcgcggtcggtgcgcgccggcaccgtgtgggtgaactgctactacgccttcgacccggacgcgcctttcggcgggtacaagatgagcggattcggccgggaccaggggctggcggccatggacaagtacctgcaggtcaagagcgtcatcaccgcgctcccggactcgccgtggtattgacttgaggttcaggcatcgacgactgccaccgggagcggtggagacagtgtacatgcatgcgtgggtgctcacagctgatcgagttgctgcttgttgtgttcgtctctggtttgattgtggctgatgtgttaaattagctggaacatatatatgaacaagtgttctcgtcacatacgcgctcatttatgttggcgagagttagaggttttcgttctgtgatgtatagtatatatgctaagtacaccatttaaactatttagtgttt

SEQ ID NO: 509 - DNA, 590 bp, Sorghum bicolor
  Clone ID: SORBI-28MAY03-CLUS115773_1
gaccatcaggctcctgttgttgatgctgaacatgtggaggatgaaggcctggtgaatccaactgatgaggttccttcagctgaggcagagcaggagacatttgatgctgatgtggaggatcaggaacaaaaagaccaacaattcacccagcggcggtcttaccagaaccagcgtgggggtggtggtcgtggtggcggcaggaggggctatcctaatggtcgtggagggcgtggtggccgaggcggtgggtaccagaacggccgtggcggtggtggataccagaacggccgtggcggaggcggtgggtactactatgaatctggatactaccagccgaggaactacaacaacaacagaggccggggtggtcgctctggcggtggcaactcttactacaacaaccatggtggaggtgcacagggaggcggccatggcaatcctgggagggttgagcttggtgcaaacgcctagctcgctgactgttttgtttgaggatgtggagcgagggagaagagccattttgttattatagaactaacttagcctgttattacgccaccgttggccccatctgtgagttctttgttgct

SEQ ID NO: 510 - DNA, 579 bp, Sorghum bicolor
  Clone ID: SORBI-28MAY03-CLUS115783_1
cccgaacgatctcaccaataatgtgcatggcattggacactctgaagagaacatcaccgccaataatgtggcacgttccttctcaactgggttctcaattggatcatgggaggacccaaattctattgtgttttccaacccgacaagcaaagcagggatacacaacaatgacgacatcatagctagtattagtaactcgtatgaactacagtttggtgtggcgaaggaggcagcgggcctactgcagatgcagcaagaccaagttccattcagagtacgagccaagcgtggctgtgccacgcatccaaggagcatcgcagagcgggagcgaagaacgaggatcagcgagaagctcagaaagttgcaggcccttgtgcctaacatggacaagcaaactagtacagcggacatgctggacttagcagttgatcacatcagaggactccagagcgagctgcaggctctcaaggaagacaaggagaagtgcacctgccgcggcaatcgtccatcagggagataacatttgctaaaattgggttcgatctcagcaaaaatacagatcgaacggcattgcacaat

SEQ ID NO: 511 - DNA, 558 bp, Sorghum bicolor
  Clone ID: SORBI-28MAY03-CLUS115793_1
cggagatcgcccaccggcccatcacctgcggcggcgttaaggccatcaccgaggcagagctcaactacccgtccctcgtcgtgaacctgctgtcccagcccatcacggtgaaccgcacggtgaccaacgtggggaaggcgagctccgtgtacaccgccgtggtggacatgcccaaggacgtgtcggtgaccgtgcagccgcccatgctccggttcacggagctgaaggagaagcagagcttcacggtgacggtgcggtgggcggggcagcccaacgtggccggcgccgagggcaacctcaagtgggtctccgacgattacatcgtgaggagccccctcgtgattccacccaagggagagcagcagtaggctcttcttttgtgttgctcgtggtgttcagaacgctaattttgcaaccatggtacagaatatatgtttgtatagcgtctctaggctacggcattgcacggcatgtttgtatgtacaggctacgaaactggggactgcagctcttctcgctcgacgtctgctatatcagctgcgattttgttgtgtaaat

SEQ ID NO: 512 - DNA, 488 bp, Sorghum bicolor
  Clone ID: SORBI-28MAY03-CLUS115935_1
tgcaaattccgcaggggctactaccgctgcacgcaccgccactcgcaggggtgcccggcgacgaagcaggtgcagcgcaccgacgaggacgccacgctgtacgacgtcatctaccacggcgagcatacctgcgtccacaggccagcggtgccggcggagcaccccccgcccccgctccccccccccctggcccgccgcgccgacctcctcttcgacatcgacatcgccagctacttcgcgtgaatcgtgatccgccacgtgttgtagctgatcaagggtagtaggggatgtgaccgagccctctgaacccaacagaggagggaagagcaccggacagagctctctgctttcctgggtccatgcagatgcaggcgtatagtactgtaggagatgatgaacaagagtagagattgtgtcttttttattacccctcttttttttgttaaatctttttcctcttctgatgaggccttttttttgctaatcat

SEQ ID NO: 513 - DNA, 345 bp, Sorghum bicolor
  Clone ID: SORBI-28MAY03-CLUS115863_1
gcacgaggcaccgcaccagtaactgcaagctctagtctagcaaccaaaaacaatggcacccggcctgcgcgtgctcgctctcctcctcgtggccgccgcggtggcggtggccgcggacgccgtgagcatcgtggtcaccaacaagtgcgcgtacaccgtgtggcccgcggcgctgcccggcggcggcacggggctcaacaccggggactcggggttcatcgacgtgccggcggggacgcggaacggccgcgtgtggggccggacggggtgcggcttcatcatgaacgggacgctggggcagtgccagacgggcgactgcggcggcacgctggtgtgcggcaaggt

SEQ ID NO: 514 - DNA, 371 bp, Sorghum bicolor
  Clone ID: SORBI-28MAY03-CLUS115941_1
gcaccacgggccctcgctcgccttcgccacgcaattccgatccacgctgcgcgcgggccagttgtgacgactgcgaaactcgtcaaagagagagagaggcgggcggcgatcggagatggcgccggagaagccccggaaggagcaggagcaggagaaggaagaggaggagatgttgctggaggatggaggcatcgaggagagcccgcgccgcagcttcgaggactgcggcgattccgaggaggaccgcggggaggacgatgacgacgatgacgaggagcggcaccgcgacggcgacggcgtcggttcgccgcgctccttccagtctcaaaagtggccgcagagctacagggaaacaactgacacctacacaa

SEQ ID NO: 515 - DNA, 516 bp, Sorghum bicolor
  Clone ID: SORBI-28MAY03-CLUS116101_1
gtacgccgccttcgacccggtcgtcctccccgcctccgcctccgccgccctctcgcgcggccactacgtcggcaagcagctggtcccggaccccacgttcgcctccttcatcccgcacgagcccgtgtccgcgctggcttccacgcggggactcgtctgcctccgcgcccccggctccaacgcctactacgtcgcgaacccggccaccttcgagcacgagcggctcccgaagccggccagcgtccacaccgccaaaggcgagcccgcggttgtcatcgcgttcgacctcgacccgcgcgactccgaccccgagcgcgccgacgccgggtacaagccgttctaccgccactaccacgtcgtcgtcgcgttccccatcggggacggcatctactccttcgagtccttctcgtccaggacggggaagtggaccatgagcgcggacgtcaccgacgccggtttcgtacaccagggatccggcgtcggcgtgctcggatgcgcgttctggcgcacctccat

SEQ ID NO: 516 - DNA, 1042 bp, Sorghum bicolor
  unsure (1)..(1042): unsure at all n locations
  Clone ID: SORBI-28MAY03-CLUS11618_1
ctggggtggaagtggtggcaccatatttgatgacggtgtatacactggtgtgtggcagatcaatttgacacgcgcagtgggaatttcttctattaaggttctgtatgatcgaaatgggcaggcagtatggggtaacaagcatggattcagtggaggtgttatacctgacaagataatatttgatttcccgtcggaggtgttgactcatataaccgggttctatgattcagcaataatcatgggcccaaccgtggttagatctctaacgttccacacgaacaagcggacatatggaccatatggggatgagtatggcacatacttctccacaagttttacaaatggaaggatagtaggatttcatggcagtgaggggtggtacatcgatggcatcggagttcatgttcaggaaggcaagttggcatcacagcgatttgttagcagaccaaagaccgcgactaacccatcggtacagtacaacatgcttgctcaagcgccgagcaatacatatacagacaatgaggttgcttatggcatggtgaaagaaccggttcctatgggaccaggaccatggggtggggagggaggccgggcgtgggacgacggcgtttacactggcgtgaagcaaatctacatcatgagaggagcattcatcgggtcgatacagatcgagtatgacaggagtggccactccatctggtcctcaaggcatgggaacagcggccacataacccacagggtcaagctggacttcccgcacgaggtgctgacgtgcgtgtacggctactacaacatgaacagggaggacgggccccgggtcctgaggtcgctgacgttcatcaccaacaggggcaagtacgggccgttcggcgacgagttcggatcctacttctcgtcggcgacgacggaggggaaggtggtggggttccacggccggagcgggcagcacctggacgccatcggcgtgcacatgcagcactggctcggngacaggaggcctgcccncaagtacgtgtgccaagtacctattctgatcaccggc

SEQ ID NO: 517 - DNA, 635 bp, Sorghum bicolor
  Clone ID: SORBI-28MAY03-CLUS11620_1
gcacgaggcactagctagttaaaaattaggtaatttttttgcttaaaatatatacaagattagctctttagtgaaggataatagatgtgtcaatgttttagtcaatctttaactctttattaactagaatattagccaactagctatattcaaccgtagctggtttgagctagctttggtagggctcctctctggcttggctcctcaaaaggagctctgccaaactttttttagaaaagctatttttttagtaaatagcaaagaaatcagagccattttgactaagccacaaattataacttcttcaaaacggctctagctctttagaggagcctctcgtgagaagtcgtgtcaaacatctccttagtactccctccatctcaacaaattgtaagtcattccaataatcttgaacagtcaaatttttctaagtttgaccaaatttatatgataaaataattgttattataataccaactaagtatcattacattcttctttaattatatactcactgtacgttacaaattttagtatttttctttataattttggtcaaacgtaaaagtactttgactctccaagatttttagaatgagttacaatttgaaatggaggaagtaattgctaattag

SEQ ID NO: 518 - DNA, 586 bp, Sorghum bicolor
  Clone ID: SORBI-28MAY03-CLUS116279_1
gcacgaggctgacctgtgtctctcgagtgtcaaccaacaccgctccagctgcggcgtgcgcagctataaaaaccagagtgccaaacatagtactccttgctaccgcagcaccacgccacatatcatcggctagctccgtttattcgtttccgggaagcaaccaaccaaccaactctcgtttccaggcagccgacgaccttgggccgtgttcgtctgctgccaagagtacagtttgatgcgagcagctagctagttgttcctttcaattcgtgtgcttttgctagtagcttgagatcaagccagccggcgaacgaggatcggaacatcatccatcgcatcatggccgccgagcagcagcagcagcctgccaaggccgccgcggccggcagcaggttcgcggtgacgtgcggcctgctgaggcagtacatgaaggagcagggcggcagcggcgccaccaggtgcctcgcgccggccgtcgccatgggcctcatgccggaagccgacgctgcggcggctgcgaccgaggagaggaccaccgtgctggagctcttcccgcagcaggctggcacgctcaaagacgagcagc

SEQ ID NO: 519 - DNA, 645 bp, Sorghum bicolor
  Clone ID: SORBI-28MAY03-CLUS116219_1
agtgtcaacgatgctccgatgggagcagaacaccatcatatttctgataaacaatggaggatacacaatcgaggtggagattcacgatggtccttataacgttatcaagaactggaactacactggtttggtggaggcattccacaatggagagggcaagtgctacacagcaaaggttcgaactgaggaggagctgaaggaggcactgaaggcagctctgggacccaagaaggactgcttatgcttcattgaggtcatcgtgcataaggatgacaccagcagagagcttctcgagtggggatctagggtttctgcggcaaatagccgtccaccgaatcctcagtgagtgcatcaggtctcctgaattgcgctgtaaatcaatcctctttctggtgatgtccatatcaagaagactcggggatttctgaataattttttttgttttgtttttcactgtcatttctggataatttctccctgtaattcactgatgttgcaagcccttgttgctacttcacatagatgatttcagaaactgatcttgtatagctgtattactgccaataaatctgaaatcatttttttttgttcttcgttctggcaaaaaaaaaaaaaaaaaaaaaaaaaaaaaaaaaaaaaaaaaaa

SEQ ID NO: 520 - DNA, 696 bp, Sorghum bicolor
  Clone ID: SORBI-28MAY03-CLUS116281_1
gacatttcctcaacaatatcagatccaggacctatttgggattgtgaaccaaagtgggacacaggaccaaaatgggatagtgagctaacttgggagcctgaccaccccattgaacttcctggaccacaagaggacatggaaatgggaacaccaatggaacttgtgccaaatttggatgagaaatgggtaattaggaaagggcactttcttggtgtcctagtatgcaaccattcatgcaagacagtgcaaagtctgagttcacaagttattgcacctaaggccacccatgatgacaacagcttggacttactcttagttggtggaaaaggaagatggaaattgctgagatttttcatacttctgcaattcggtcgccatctctctttgccttacgtcgaatatgtgaaggtgaagtcagttaagcttaaacctggagcaaacactcacaatggctgtggcatagatggtgagctttgccgtgtcaagggacaagtactctgctccctggttccggagcaatgcagactgattggccgacaatggagacaatctatttaagcgctgtattgttgaatttcatgggtcttcggttctttccacttctaacaactaatgtttatacagtgatactttctgatgtgattaagcgtgggttgacgttgcagattttgagagtttgaactggacagacaagtt

SEQ ID NO: 521 - DNA, 606 bp, Sorghum bicolor
  Clone ID: SORBI-28MAY03-CLUS11630_1
gcacggcgccggcggcgtcaacaagcaggagaagacgaaggcggcggatcaggccgagcagcagctgctgctgcaccccgtgcctgaggtgcaggacgccaagtgcgagtgctgcggcatgtcggaggagtgcacgcccgagtacatccgcggcgtgcgcggcaggttcgcgggccgctgggtctgcggcctgtgcgcggaggccgtgacggaggaggccgagaagatgaacggcggcggcggcgggacgctggaggaggcgctcagggcgcacatgggcgtgtgcaagcgcttcaacggcttcggccggacgcacccggtgctgttccaggccgaggccatgcgggagatcctcaggcgccgggccaagctcggccccaggtccaggtccagcatcaaccctagggaggtcagggaagtcgccgtcggcgccaaggccggcagcggcggcggcggcactactgggatcgctcgcagctccagctgcatgcccttcatcaccgacgacttcaacgaacgggcaacgtcgtcgtccatcaacaaaaactgattcgatcaagttgttggttgacgatgatgagttttagcatgatggcaagcttgcac

SEQ ID NO: 522 - DNA, 783 bp, Sorghum bicolor
  unsure (1)..(783): unsure at all n locations
  Clone ID: SORBI-28MAY03-CLUS11634_1
gggtggtgcaactgtggttgccacttcagttgttcctgatgaagtggacaagatcaagggcattctgatacaatggagtgatattgaccatgttaacctcattctgacattaggtgggactggcttcacacccagggatgtcacaccagaagcaacaaaatctgtgatacagaaagaagcgcctggtctgacatttgttatgcttcaagaaagtttgaagattacaccattcgcaatgctatcccgggctacagctggaatcagaggatcgacactaatcatcaacatgcctggcaacccaaatgctgtggcagagtgcatggaagcacttctcccggcactcaagcacgccctgaagcagatcaagggtgacaagagggagaagcaccctcgccataccccacacgccgcagcagcacctgtggaccagtgggagcggagcttcagagccgcatcagctggtagtggcagggggtgctcgtgtgatccctgcccacgcgtccgcggctgtgagatacccaccagagtggggaaccaagacgagacagtaggagagctatgttctttgctccagtgcacgactgcgtccagcttgatgttgaagttttgatcttgttcgttgtgatgttatatgaagatgcgggagtctagcttgataccgtgctgttacttgatcgtgaacttctttcactgcgttattacaaataatgtacaatatggttctagtctcaaaanaaaaaataaaaataaaaatttattataattattatatatatattattg

SEQ ID NO: 523 - DNA, 593 bp, Sorghum bicolor
  Clone ID: SORBI-28MAY03-CLUS115617_1
agctgcacggcgccatcggtagccgccgcgaacaccaccgccagcgtcggcggcggctcgttcgtcaaagtgagcatggacggcgccccgtacctgaggaaggtggacctgaggatgtacaagggctacagggagctccgggaggccctggaggccatgttcgtctcctccaacagcggcagcgccaacctgtccgagttcgccgtcacctacgaggacaaggacggcgacctcatgctcgtcggagacgtgccgttcgagatgttcactagcacttgcaagaagctgaggatcatgaagagatctgaagccacaggcctgggatcagcgaggcaatgaagatccatctgatctgaggaccggatcggacaatatgttgtcatgaccttcttgttttttttttcgttttcattatttttgttcttctggttggatccccaagccgaaggatgagcttggtgtttcgaagcgcatacacggatgtgtgcggctttgattctgtaagacgattaggtctttttagcagcacaaaggagatgcatgctgaggttgtttcagtttactataccatgtgtttgtacaaacgaaacaat

SEQ ID NO: 524 - DNA, 606 bp, Sorghum bicolor
  Clone ID: SORBI-28MAY03-CLUS116516_1
cctctgcagagtcccccactccccttgggttgtggggctgctgttgctcggcgtcggcgatgaacggcggcgggtccggaggggcgagcgggccggactcccgcgtggagaccatctcccgcctggcgcagtggcgcatcgacaccttcggcccctgctcctaccgccgctccgaccccttcaagctcggcatctggaactggtacctgtcggtggagaagagccgctccatcttcgtgcgcctcttcccggagcccggccgggtggccaaggagcagccccctctcgcgcgcttcctgctccgcgtctcctgggccggcccgccgcgacgcacctgcgtctcccctgtgcacgaacatcttctgcgtaccagtgatgactttgtctggcaagttgatgcaatgtcccatgggcgttttacgattgatgttgagtttctggacctgaggatagccaataacaatgctactgaatcattgtcggtatggccaaccgaaggcatggtgcagaagattgcgagcaagagcaccctcgggtgtctctcccgcatgctgacggattccatccacacagacgtgaccatcaacacgacggacggcgtcctga

SEQ ID NO: 525 - DNA, 562 bp, Sorghum bicolor
  Clone ID: SORBI-28MAY03-CLUS116532_1
gcacgaggccgcctcgccccgccctcgccctcgccatcaccatccacagacgcgcgcgggcgagctaggggccgggggctctctttgcctcttcggtgcatggcggggctgcagcggtccagcgagacgttccggcggtcgggctcgtcggggctggtgtgggacgacaagaacatctcgggggagatcaagccggcggcggaggacgacggccgcgctcgacccgccgtcgccgcgcgtcgccgtctgcggcttctgcaggctcttcggcggcggcggcggcaaaggcaagggcagggacggcggcagcaccaaagccaaggggaggcgccactgatctttgtgcgtacgtgcctcggtaccatcggcgatcggaacacggtccgaaatttggtagctttcttctgttagtttttccccctccatcctcctctttgtgatcatgtatgtatgtgtctcatgtcctgggtgcaattcatactactggtagcagacagaattacatttgagatgattgtgtaagagtacaactgcacaagtgaaaaaaaaaaaaaaaaaaaaa

SEQ ID NO: 526 - DNA, 542 bp, Sorghum bicolor
  Clone ID: SORBI-28MAY03-CLUS11655_1
tggctcgtcacgaccatgatttggtaacgaaagcagcaggaagccggcggtgtaggcgacccatggcgccacagacgaggagagagaaggcggcggcgaagccgagctcgtcggcgccgacgctggcggggccgggggcggtcgaggtgcagcgccggcgggtgggcggcggttggacgagccgtcggatctccatctacgcctcccgagtcttcttcctcctcatcatgctccagatcccgctgttcagggtcccttgtagagcaggcacatgcacaactcctattcaagtcacatcgtctcagttggtctcaaatgagatattcccaccagctgttgtgaaggccatgctctaccctggagctatcgtgagcagcctaactaaaagcaagacatttccgagttggagtgacctgtttgacatgtacaacctgacagaagccaaaaatgcttctgcagtagttgatcttcagcgtctagagatacttgcaggaagctacttctgtgttgccggagcgctcattggcatcataaatcctggg

SEQ ID NO: 527 - DNA, 366 bp, Sorghum bicolor
  Clone ID: SORBI-28MAY03-CLUS116560_1
cagacgtggaacccgttcctgagctctggatgacggcacacagctgagctgggctaacgtgtgctgtgtgcatggcaggcttcgcgtctgtagtgactagtgaatagtgagcagtttgctttgtcttctttggtttctgtaacttttgatctgcttactgcatatgatctctgccgtttgttagccgtagggtagaaacccacacacaacggataggtggaatgtcttggtgactattagcgcagtaacttttgtacaaaggattgttgcagaaaaattgctaccttgtttttccacctatatatactacacaatctatccctaattataagacatttgacttttttcaaaaaaaaaaaaaaaaaa

SEQ ID NO: 528 - DNA, 610 bp, Sorghum bicolor
  Clone ID: SORBI-28MAY03-CLUS116567_1
gcacgaggcaccaccgcacccccaccgcacccagcaggcagcagcagcagcagcaattctccccggagaggcgcgacgcgagcgagcgagcggtatggccggcggcgaaggcatggtgttcgagccccacgcgggcgcggtggcgggcggcgacgtcgtgttctgcgcggccatcgtgtgcctgtcgctcctgtccatggtcatcttcgcggcgaccgccggctcctcctcctcctcaggcgccgccgaggacgatcaagggatgaagccgtggcggcgcgggcggcgcgccaacgggccggtgttcgtgggcggcaggggctgcggctgcggcggctgcagcgcgggcgccggcgtctgcggcacctacctctcctgatcgccccacggcccccggccccggggcagagcacccgccgcgtcgacgccaccgccgatcgacccggcggtcggcggcgtgcacgcgctgtacatactcactcgcatacgcggcaccggcacgggcacggcagagcatgtcgtaataagaagctcaaacctttgcttcacttcactgagtagttgttcatgggcatggcttttgctgcgcttaatttccctttaattttct

SEQ ID NO: 529 - DNA, 597 bp, Sorghum bicolor
  Clone ID: SORBI-28MAY03-CLUS116598_1
ttcttgtgggttgtcaagggcgccgtcgtggacagggacgacgcgggcgagctcagcgacctgctcggcgagggcttcctgcggcgcgtgcaaggccaaggccggggcctggtgaccaagtcgtgggtggagcaagaggaggtgctcaggcacccggccgtggcgctgttcgtcagccactgcggctggaactcggtgacggaggcagcgagcggcggcgtgccggtgctggcgtggccgaggttcgcggaccagcgggtgaacgcccgcgtggtggcccgcgccgggctcggcgtgtgggccgagcagtggagctgggagggggaggaggcggtggtgagagcggaggagatcgcggagctggtgatggaggcgatgggagacgacgccatggcagagaaagcggccaacgtccgcgaggcggcctcaagagccgtggcggacggcggcacgagttaccaaagcctggcggcgttcgtgcgtcgttgcacggcgtgaaagaagttttctgagggtatgttgtgaaggcttcacaaactgcaacagtgcaacgttgtaattatatgtattaatggaaatgcaagaaatttaagtgtt

SEQ ID NO: 530 - DNA, 553 bp, Sorghum bicolor
  Clone ID: SORBI-28MAY03-CLUS116655_1
gcacggcgcgtgcctcctgctccgctactcctcccgtcttccggcggccccggggaaaggaagaggggagaggggagatgaaggcgtgcgcgaaggcggcgggggagagactaccgctggtccgtgctccgtcaaccagtcagcctctggctcggagctttgttaaggtaagcagattaccctctcaacatgagacgaagtgtcaagtatcctgctcagttagggtgtcagaaaacacagctcgcagaatatatgccacagcagaaaacattttcccggcaatgaaagatcatgtcttgaaagcaactgatgcaatcaacagaggagaagtgattgcggtgcccactgataccatatacgggtttgcgtgtgatgcctgctctgcgggagcagttaatcgtatttatgagatcaaagggcgtatacaaacacggcctctggcaatttgtgttgctgatgtctcagacatatcacggtttgctttagtggaccacttgccacatggcttgcttgatagtctacttcctgggcctgtcactgttgttctaaaacg

SEQ ID NO: 531 - DNA, 603 bp, Sorghum bicolor
  Clone ID: SORBI-28MAY03-CLUS116614_1
gcacgaggggcgcatcggtgctcccgtctgtgactaatcatgcgcacaggaaaagctcctactctgcttcccttctctcacaaaaacaaagattacccgtcaggtagaatttgtccacgcgggtgcggctacaggagcatttttctacccgtgtgcgggtagggtaattcgacgggtgaaatttagacttcacgggtgtgggtattgatagccactacccatcagggtgaaaactcagatgacgacacctgtgggcaccgcttcctacttggaggtgtccatcctgccgtcttagaaatcttgcatcgtgcttagtccctcgaccggtggtggtggcacctaattacatcttgttgagaagtcggaggtgctgtgctgaggtgtcaacgagctcgacaacgatgactcatagttgtgatagtcgtggacagtggacggaacgaggattttaatggtagattttcttaacatgcctagtagttgtttggtgctttgacaaggcttttctctcatggttgatcttttgttgtaaagtttttggtcctggtttcccttataaacaaggccaattttcttcttattaataaaaaaaaaaaaaaaaaa

SEQ ID NO: 532 - DNA, 842 bp, Sorghum bicolor
  unsure (1)..(842): unsure at all n locations
  Clone ID: SORBI-28MAY03-CLUS11670_1
gccggccgggtcgggagcggatttctagctttccttccctttgcctgcctcccatggcctgcaccgagactatcgccgccgctaccctcggcaccaggcgcccgcgtcattcccgcactgccgcctccttcctctccttccgcttccgtccctcaccgcagctatcagtcgccgtagccgcttccgcgtccctccgcggcaaggccaaggctcacgcggagggcgccgacagcaaggcctccgccgccatcgacgaccaacacgtgctggatgtagcagagtcgacctgggatgacctcgtccttggctgcgagtgtccggtgcttgtcgagttctgggcaccatggtgcggcccttgccgtatgatgcaccctatcatcgcggacgtggcgagagcatacaccggcaggctgcgctgcctcaagctcaacactgacaagaaccaggaagtggcgacaaggtacggcatcagaagcatccccaccatcttgattttcaagaacggggagaggaaggagacggtgatcggggctgtcacggacaccacgctagcaacaacggtcgagaggttcttgtagcccacccacaggctattcgctcgccatctgctaagacttagcctcgtttggagcatgtcacacaatgcagcctgaatcaaaagttgcaaacgtgaaaatggactattgcacacaggactcgnctaggggtttttcttcttattattattaaaaaaagaagaagttgctaataattgctgtcgttgttactaataccaccctgtttgcacacatgaaaaaaggagaacccaaaacatcttgctatgcatggggaaagatgttgca

SEQ ID NO: 533 - DNA, 687 bp, Sorghum bicolor
  Clone ID: SORBI-28MAY03-CLUS116708_1
gagagatctcttaatcctggcttggatagcattggagttcgtgtcccggatctggatttcatacgatccattgctcgtggcgctggaagtgcacttgcacttaccagcgccaacttaagcggacagcctagtagtgtcagtgtcaaagattttgagggtttatggccacattgttcatgtgtctttgatggtggagtacttccttctgggcgtgctggttcaacaattgttgatctaataacaccaggagtctacaagatattgagagatggaagctcaaggaaggaaacagcagctgtgcttggcaagtttggctttgttgaagcttcgtgacgacttggtgctttaagaaagttggcacgatcaaagagttgctttcttatccatagcatctcctgtttaattagtgaggtatatcggagctttttttttttttgctgtttgtgcttttcttttacaatcttcaaacgtactgttgtaatgtgaatgcgatcttgagtagaatagcagagttcccattatttaagctgtgtagagtgtgacatgggtttgttttttagcaaatgatgcaactaggttggggactttggatgtgttgtggacgaaaatttggcattttttgtgcctgcgcttttcgcccaattctgcttgttggcttctagatgacgtcaactgtttacataactt

SEQ ID NO: 534 - DNA, 589 bp, Sorghum bicolor
  Clone ID: SORBI-28MAY03-CLUS116784_1
gcacggcgggtcactgcactgggcaacccagcgcagctaacactcctatacaaatatccgagctactactcttagtacaagctacagaggcagatcgaagcacaaattaaagctgcctgtagatagcaaccatcaacagtgaccgatcgaagtagtagtgagcaactgagcatctatcagtcgatctagctacgtacatagaacacacagctgcagcagctcgatctcttcttgctgtccctgcggtgggttttggagtgtaatctgctcgagtagctagctagctgaagaaccatgggctgcgaggaggaagagaggctgctgttcccgtccttcgtcttccccgagagcttcgcggaggccgccacccccggctccggtggtgagcagaagaaggctcggcagcggcggaggcggaagccgcggccggcggcggatggcggcgagggcggggacgagcaggccaagaagcggcggctgagcgacgagcaagcgcggttcctggagctcagcttcaggaaggagcgcaagctggagacgccccgcaaggtgcagctggccgccgagctgggcctcgacgccaagcagg

SEQ ID NO: 535 - DNA, 853 bp, Sorghum bicolor
  Clone ID: SORBI-28MAY03-CLUS11694_1
ggttcagaccaatgacttatcgtggcatagtaacaacagagatgagaccgatacttgcagccagtcaatgtccaattcatactatacatcttcttttgcgcaatcttatggtcttcatggtgttttgggcaagccagattggtttctcaatttcagctactcagagtctcatctagcagaggaatttcagcatgaggtggcgttgtcctacaataatgagtgcaagatatctgatcaacctattcattggtatcaccatcactgccttatacaatcactagatgtccaggtcaaacccccggaaccagtttcttctgagaggttgaagtactatgagcatttttcaacatatggcgaccaaagtgatatccacattttggaaactccagcacatgcgcacaacattcagtcctatacaaggacatctgatctaccacttgaaccttttaagccatcatattctgagaattggggattttatgatgcctatacacaagggaatgctcttgaaaacgataaatattctctagtatctggtgaatatggaggcattggaagcttgttcatttcccccttttatcctggagagacagaatcgtttgagctggtccctggtgatgaacatgcatcctttgagcataattggcataatttgagatacagaaacatgcccatggatgatgtctctctaattactcaaccggctgaggattcctatagtatgatgaatggttcatcctggcctttcgaggaacattcggcatacaatgtatagtccatattgtattgttatctctggacgacttaatacccgcatttatgtatacttgccaaaaaaataaataaacatctg

SEQ ID NO: 536 - DNA, 597 bp, Sorghum bicolor
  Clone ID: SORBI-28MAY03-CLUS117046_1
gcacgaggctcattcaggggttgtccaattcgaggaaaacgttggcttgccctgtggatttgaaggagatgaatcggagcaagtcggtcgagatgagctttggtatttcctcgcagagattgctctacgtcggctgttgaatagggtgagccaactcatctattctaaggactcgattgcatcaacaacaagcctggatccggtggtggcagagcttgactaccaactgagccaatggtatgagagtttaccactgccactgcaatttcctttcactcgaaatgcgctgcaagatccggttcaaactgtccttcgacttcgattctttgcctgtcgcaccattatatatcggccatacattctagcagtgctagacaacgagcaagcagtactagatcctgctgtgcgggagaactgccacaagtgcttggaggcctctattcgacaactcgaacatattcatgaacatcatgccggtcatatgccatacatctggcaaggtgctctatcgatagtatcccaaacgctactcattatgggtgccagcatgtcgccgtcgctgctcagcattctgctgaccttggtgcctcaccgtga

SEQ ID NO: 537 - DNA, 427 bp, Sorghum bicolor
  Clone ID: SORBI-28MAY03-CLUS117049_1
gcacgagcgcctgtctctcccacccgccgccgccccatctcaccccatccccagtcctggtcggtgccttccaaaggaccaaatcccctagcgcagagacgagaaggttcgcgtgcagcgcgtcgaggaggtcgagggcgacgccaaccacatcccttgatgaatccttccctcagagcttcgaagactggcgcgcggcgcgaggaggccaagggcaacgccccacctcagcatcgaccaatccttccctcagtcaactcagacaatgttgagaacgatgccatccccagattcaccgcatctgttcatccctgctcgatttgggaagattccacatgaactgtgtttgtttcttggttgtatttgatggatttcctggatttttgcaggtgcagggcttacctacctgtacaccaagaacagggcg

SEQ ID NO: 538 - DNA, 532 bp, Sorghum bicolor
  Clone ID: SORBI-28MAY03-CLUS117067_1
gcacgaggagcacacagcacccccgaggaaccatcggcatcgagtctgcagtacagcacagagcagagcaagaggccgtcaacgatggcttccgctgcgctgccagaggccgtcgagcccgggaagaagggcaacgtccgcttcgccttcgcctgcgccatcctcgcctccatgacctccatccttcttggctatgatatcggagtgatgagcggtgcgtcgctatacatcaagaaggacctgggaatcaccgacgtgcagctggagatcctgatgggcatcctcaacgtctactccctcatcggctccttcgccgcgggacggacgtccgactggatcggccgccgctacaccatcgtcttcgctgcggtcatcttcttcgcgggcgccttcctcatgggcttcgccgtcaactacgggatgctcatgttcggccgcttcgtcgccggcgtcggcgtgggctacgcgctcatgatcgcgcccgtgtacaccgctgaggtgtcccccgcgtcggcccgcggcttcctgacgt

SEQ ID NO: 539 - DNA, 332 bp, Sorghum bicolor
  Clone ID: SORBI-28MAY03-CLUS117071_1
gaacagtgcagcaactagtggcagtggcattggagtggtcgaggtcgagatgagcggcaggcgcgtgggagtggtcctcgctgcgctcgccgcggcgttggtcccgttgctgtgggcggcgctggtgcgccaggtgtggcggccgtacgccgtggcgcgggcgttcgcgcggcagggcgtccgagggccgccgtaccgcttctacgtgggcaacaaccgggaagcgagggccatgatggcggcggcggcggcgagcggcgaggcgctggagtggagctccaacgacatcgtgcaccgcgtgatgccgcacgtgcgggcgtgggcgtcgctct

SEQ ID NO: 540 - DNA, 287 bp, Sorghum bicolor
  Clone ID: SORBI-28MAY03-CLUS117084_1
gtcctagggctcgcctcgccgccccgatggggggccggcaggggtacctcaccctgccgatcttctccgtggtcgcggcgatcgggtacgtctactacaccaccgtgttcgtggccgtgccgccgtggctgggcctgtccaccgctgcgggggtagccaacgccaccgcgttcactgcgctagcagccgcctgcctcgccacctacgccgtcgccgtgcgcagggaccccgggcgggtgcccccgggcttcgtgcccgacgtcgaagacgccgagagcaccgttcac

SEQ ID NO: 541 - DNA, 1023 bp, Sorghum bicolor
  Clone ID: SORBI-28MAY03-CLUS11716_1
gtaattagtgtttttgaacatccatacatattccatacgttgctaaacccctcttttagattcttctactatactgcaggtactggtggtgctggtccaacaatattggcaacaagttttctgcttcttggggaggatgtaattgcatataacaagggagaagaaatcaaattgaagccctatagtggagctctgaacattgatttcggaaagggggtcagaaagaaaaatgtctacttattgaatttgcctgaagtgaagagtgcttttaagatattaggtgtgccaactgttagtgctcgatttggtactgctcctttcttctggaattggggaatgcaggctttcgcaaactttttacctgttgagtttttgagggatagaaataaggttcagaagttggttcagtctgttgatcctttggttcgagccgttgatggtattgcaggagagcgtgtctctatgagagtagacttggactgttcaaatggccggaatactattggattatttactcataaaaagctatctgtgtcggtgggctatgcaacagctgcatttgctttagccgttcttgagggcaacacacaaccaggagtttggtttccagaagagccagagggaataccgatggaagcaaggaagctgcttcttgagcgtgcatctcaaggaacaagtaccttcgtgatgaacaagccttcctggatggtagaaactgacccaaaggaagtcggtctaggaatttatgtttgagaaggttgaattactcaaattcttgggtgcttgacaaaggcaactaaagcttggggagtaatttttccgactgagagaagttgaatgcgacagccatcggcgtgttgaagcctccaatccccagattgatcgtgatgttctgtatgattggttgggctattttatttttgaaagggttatatatgaaccatggaggttatgaagaaaaagaatacaggtcaatagcacaaatttgttcatcacacaaagcttgtaattttttaaagtatt

SEQ ID NO: 542 - DNA, 603 bp, Sorghum bicolor
  Clone ID: SORBI-28MAY03-CLUS117173_1
gcacgagggttcccttcttactactgcgcccagtctccgaccctatacattccttccttagatacccgtgtcttcctcagacacagcttctgcggctcgagttcccctttccccgcggaccctgcggcaacgtccagtacatcccttcgacccattccactgaacactctttacgcccacacacggtggcaagtaaagaccacgaccgccacgatgcccggccttaacctcccaacgattccgacagcagaggtgcgcacgcacaattccgaaaagtcgtgctatgtaaccatcggtaccaaagtctacgatgtcaccgacttcctcgagggccaccccggcggccctgagctcattctggaatacgcaggcaaggatgtcgaggctattctcaaggatgagatctcgcacgcacattcggattctgcatacgagattctcgaggagaatctcattggcttcgtggctactgagccggttataaatggcgctgtgaggagctccaagccaggagaaattgttcctctgccgccttcagaagctggcgccaaggagctcaaggctatgtcgcagaatggcaagccagtatacgccgcgactggg

SEQ ID NO: 543 - DNA, 607 bp, Sorghum bicolor
  Clone ID: SORBI-28MAY03-CLUS117177_1
gcacgagggttcctgctccccatttccaaacaacaccttccagctcgtccccgaccggaacgactctatccgctgcatctctagttcccttcgccagagactacaaaaatcacgctcacatttagcaacctttcacaatgtctgtccaggatagagcccaggcccagctgtcacagctcgataaggagctgtccaaataccccgccctcaacaactttgagaagcaaacctctgttcctaaggtctacatggtccttggccttgccggcctctacttcttcctcatcttcttcaacattgctggagagtttctcgtcaacgtcgccggattcattgtccccggctactattctctggatgccctcttctccgcaagcaaggttgacgacactcagtggctgacatactgggtgacatttgcgtttttgactgtgtttgagagcgccgtcagcgccagctattggttccccttctactacaccttcaagtttgtcctggtcctgtggatggccctgccccagactgctggtgcccagctggtcttccgctcattcatccaacccgtcttctcccgctacttctcacacagtggctcgactgccgccga

SEQ ID NO: 544 - DNA, 552 bp, Sorghum bicolor
  Clone ID: SORBI-28MAY03-CLUS117189_1
gcacgagggtggagccgacaagtggtaacatggggttaggattggtcctctttgccattcagaaaggttacaggctcattgcagttatgccagctaaatattcgcttgataagcagatcttgttgagattcatgggtgctgagctgtacttaactgatccagcccttggttttccgggcatgtttgacaaagttgaacagctccgaaaacaactgccaaatgtacatgttctgaatcaagttacgaataaagcaaattctgaagcccacttcagattgaccggacctgagatctggaaggacacagcaggcaaggtggacatatttgtggccggttcaggcacaggaggcactgtttctggtgtgggaaagtatctgaagatgcaaaagccaggcgtcaagatcatctgtgttgagcctgcagaaagcccagtgatttcaggtggtgcgcctggcaagcataaaattcagggagtaggaccaggatttatacctgaagtcctggacacctcggtcatcgacgagactgtcactgtgaccaccgaggaggcca

SEQ ID NO: 545 - DNA, 420 bp, Sorghum bicolor
  Clone ID: SORBI-28MAY03-CLUS117265_1
gcacgaggccgtcaccggcgtcaccagcttcccgcaggtgctgctcaccactgcctccttcgacgacggcctctggttccgcatcggccaggccatcggccgggaggcccgggcgctgtacaacctggggcaggcggaggggctcaccatctggtcacccaacgtgaacatcttccgggacccgcgctggggccgcgggcaggagacgcccggcgaggacccggccgtggcaagcaagtacgcggtcgccttcgtcaggggcatccagggcagctctgccgccggcgcggcggcgccgctgcaggcctccgcgtgctgcaagcacgccacggcctacgacctcgaggactggaacggcgtggcgcgctacaactttgatgcccgggtgacggcgcaggacctcgccgacacgttcaaccc

SEQ ID NO: 546 - DNA, 565 bp, Sorghum bicolor
  Clone ID: SORBI-28MAY03-CLUS117219_1
gcacgaggattgaacgccgcaaccatgctgccactccgctgcgctcggtcgccagtggcgctgtcggctcaattgccttccaagcgcgtagccagcttctccacctcagtctgccggcaacaactcaactcggatgtcaggattaccaggactggcaagcccattctcactgtttccggtggacgatcctcactcggaggatacaccgcgactgtcttcggagccactggcttccttggaagatacattgtgaacagactggctcgttcaggatgcaccgtaattgtgccttttcgggaggagatggcgaagcgtcatctgaaggttgctggagacctgggcagagtcatcttcatggagatggatctccgcaacactgcgtctattgaggagagcgtgcgacactctgacattgtctacaaccttattggtcgtgactaccccaccaagaacttcgacctggaggatgtacacgttcacggaacagaacgcatcgtggatgccgttgccaaatacgacattgaccgatttgttcacgtctcttcgcacagcgctcagctcgact

SEQ ID NO: 547 - DNA, 204 bp, Sorghum bicolor
  unsure (1)..(204): unsure at all n locations
  Clone ID: SORBI-28MAY03-CLUS117275_1
caatggcccggtgtactacaagggatggtatcatctgttctaccagtacaacccagacggtgccatctggggcaacaagatcgcgtggggccacgccgtctcccgcgacctgatccactggcgccacctcccgctagccatggtgccggaccagtggtacgacaccaacggcntctggacaggctccggcaccacgctccccga

SEQ ID NO: 548 - DNA, 545 bp, Sorghum bicolor
  Clone ID: SORBI-28MAY03-CLUS117285_1
gcacgagggcccttagatgttctgggccgcacgcgcgctacactgatgtattcaacgagtatatagccttggccgacaggcccgggtaatcttgggaaatttcatcgtgatggggattctctaaatcggaaccagtgggaatccatggtgtgcctggtccagtcagaggctccatgggacaaaaagtctcttgtcaagaatggttctcttaatgtgttccatcttcaggagtacaatgcaacagttgagttctattgggctcctttcctagtggagtcaaactcagatgacccagacattcatagcatcagtgaccgcatgatcaagccaacatcgatcgcgaagcatgcagcgaactgggaaggggtggactacctgatcttcaatacttacatttggtggatgaacacaccacagatgaaaactttgcatggtggatccttttcaaggaaacatgttaagtatgatgaaatagaacgtgtcgaggcataccggaaggtcctcaagacatggtctagatgggtagaggcgcacatagatcccaa

SEQ ID NO: 549 - DNA, 383 bp, Sorghum bicolor
  Clone ID: SORBI-28MAY03-CLUS117327_1
gcacgagggaacagtggcgggaagaggcggctgctgctgtcgcagtggtgggtcgtcctcctcggcagcctccagctcccggcggccgccggcggcagcggccacgtcgtcaggcgcatgcgcggcttcgacgggccactcccgttctacctcgaaaccgggtacgtggaggtggacgagcagcacggcgtgcagctcttctactacttcgtgcgctcggagaaggagcccggcgaggacccgctgctgctgtggctgtccggcggcccaggcagctccggcatctccggccttgcctacgagataggacccttacaatttgttgacgcccatggctacagaggtggattccccactctgcgctaccgacctgagacatggac

SEQ ID NO: 550 - DNA, 143 bp, Sorghum bicolor
  unsure (1)..(143): unsure at all n locations
  Clone ID: SORBI-28MAY03-CLUS117329_1
gcacgagggtgggtccagcccaaaagataagcctttcaaccagtggtcacattcagatttcttcgatttctgcagacagcgagactgaggagaatcccaggaagcagagcttgtgaaacaaggcaaaggcaaggcaaggcnag

SEQ ID NO: 551 - DNA, 516 bp, Sorghum bicolor
  Clone ID: SORBI-28MAY03-CLUS117331_1
ccgctcccctccccactgcccccgcgccgccggctttcgctcccctccgcctccgcctcagcctcagcctctttcccccgcggcgcccacgcgccccgccgtgccccgctccgcctccgcgcattggtccccggcgcgccggagcccgacgcccccgagccgcccgcggctgcgtcctcggccgccgcggcggcggaggctgagcccgagccggaggcggaggcggattccacgacggtggcggcgcagcccgccgcgatgagcgggaaggggcagctggaggacctggtggacaaggctagggcctgggccgtggcggtcgcggccgcggtggtggccgcgttcaggaggttcgtcgactggctggcgtcgagggactggatgagctggtggcccttctggaggcccgaccgccggctgcagcagctgatcgacgaggcggacgccaaccccaacgacgccgccaagcagagcgcgctcctccacgagctcaacaagttcagccctgaagatgtc

SEQ ID NO: 552 - DNA, 519 bp, Sorghum bicolor
  Clone ID: SORBI-28MAY03-CLUS117336_1
gcacgaggctcattcttgcgctcaagaatgtccccgtttggtcagttctactcatcatagctccattgatctggtacctgcttgttcatggcgagaggaagaggaaggagaaggccatccgtttgcctccgagcccaccgaggctgcctctgatagggcacctccacctgatgatcaaggagccccatcgcacactgcagagactggcacagaggatgggcccagtcatcttcctccagctcggcggcgttccagccgtcgtggtgtcgtcgccggaggcggccaaagaggtgttgaagacgcttgatgtacactgctgcaaccggccgtcttcaccaggggcagagatgctgacctacaattaccgggacatcgcgttctcaccgtacagtgaacggtggcgcgagaggcgaaaactcttcatttccgagcttgtaggcagcaagcgcgtgcaatccttctcacacgcattggaagagcaagtggagcaactcatccaatcactctcatgcctgccgc

SEQ ID NO: 553 - DNA, 427 bp, Sorghum bicolor
  Clone ID: SORBI-28MAY03-CLUS117339_1
gcacgaggcgccatcacaccccggtcaccactgagcatcatggagaatctctccctcctttccttggtcgtcctcctggccggctcgcccctcgccgccgccgcgtggtcggagtcggagtcggtcgtcgcatgcggtgggaggagcggcagtagtagctacgtggctaacagcacctacgaagccaacctccggcacctcgccgccgtcctcccggccgagaccgaggcctcgcactatcacagggtggaccgtgccatcgggtactggcctaaccgggtgcaggccagcgcgagctgctggacctggaccgacgccgacggtgactgcgccacctgcatcgccgaggccttcaaggaggtggagcgcgcctgcccgttccgcagagaggccaccttctccggtatcgactgctatctccgtcttg

SEQ ID NO: 554 - DNA, 398 bp, Sorghum bicolor
  Clone ID: SORBI-28MAY03-CLUS117347_1
gcacgaggccgacctcgccgccgccgtcgcgcgggagggcaacggctgctacgtcgtcgcggggctccgccgctcccgccgcgagcgccggggcggacggtcccgccgcgacaggaaggggggagccaacggcggcgcgccagggacgggtgcggtggagaagaccatcctgaagcgcctcccgcccacggatctggcgtccctggtcggccctccccctccgctttcccttcccgcagccccgaccccgccgctcttggtcgacggcgggtggggctacgacgactacgaggcgcggctgcgggagctgcagcgtcagcgcgactggtacctgatgagcaccgcggcggcggcggcgggtccggacccgtcctacttccatttggcggcggcggcgg

SEQ ID NO: 555 - DNA, 520 bp, Sorghum bicolor
  Clone ID: SORBI-28MAY03-CLUS117348_1
ccccgcggccgcctccccctcgcgccgccgcccggcccgctccgccgcccccgccctcgccccccccctcccccccgcccccccccccgcccccgcctccgcccccccctcggcgccgcggcgccccgctgggtgcgcccgggccgccccccgcgccctcgttccggcccccgcgccctggttccctcgcccctcccgcggcacccaggccgcgccgtctccatccgtctcctggtggcaatatctccggaatgcgccttcctggaccctcttcttctggcaggccccctcgtagcccgtcgtgtaccgggggactgggggtgttgctgtcgctcccgttccgcctccgctgggtttgcacccgcgggcttcgcccggtgcgccggtacgctgccctcggcacccgctcggatcgatggcgtagcgcctcaggcccggactgctgctcgtgcccttccgccgtcgtatgacaataactcagtaatgctcaatcctgtaccctcttcaaatggcaataacc

SEQ ID NO: 556 - DNA, 556 bp, Sorghum bicolor
  Clone ID: SORBI-28MAY03-CLUS117355_1
aattctcaaaaaaaaacacttcttctgttgtctattttcctgcactaactgttccctctttgcttcagactacatgacttcttctatttcaccgctgcattaaatgacttgtttttgtccagaaagaatagaatcaatcctgtccatgttacaccaaaacattttcagacgaggctccagcagatatgtccaagtttgaactgaaaccataataccagctcagctcatttcatcaaatccaagaacacaaagccattccacaagctatgcagcaccatcgatgccagtaggttgcgcgatcttgcaaagacccctcccatcaccactccaagaaacactaaaggcatcaccctctgtgcattgaagtgagcgagtgcaaaagcagcagcacttgctagaatcgaccatggaagtggcatgtaccgtgttagagatgggagaaggaatcctcggaacacaatttcttcccatataggtgcacatacggtgactaccactgcatacagggccattgctactggatcacgcgccacaatggactgttctacactggaaa

SEQ ID NO: 557 - DNA, 443 bp, Sorghum bicolor
  Clone ID: SORBI-28MAY03-CLUS117358_1
gcacgaggcaagcacctctctgattgcagacagtgctttgcttcattttgctcttctttttttacttctttttcatccaaaaacaatcgaatcaagttcatcataagaaatggttcttatcaagagcttcgtgctgagcgcccttgctgccaccgtcgcagccaaatccgccgtcatcgaattacttccctccaatttcgacgatatcgttctcaagtccggcaaacctaccctcctcgagttctttgctccgtggtgtggacactgcaagacgcttgctcctgtctgggaggatctagccaatacctacgagtacgcaaaggacaagatccaaatcgccaaagtcgacgccgacgcccagcgtgagcttggtaagcgattcggtatccagggtttccctacccttaagttcttcgatggcaagagcaacaagcctcaggatt

SEQ ID NO: 558 - DNA, 419 bp, Sorghum bicolor
  Clone ID: SORBI-28MAY03-CLUS117365_1
gcacgaggccctctctcctctccactcgtcgtccacccctcgtccctcgacctcctcttcaccttcagctccggatctggaaggccgaggagcagccgcatggtagaagacaaacagggctttcccgtctccgccgcagctctcttggtgagggcgagaattctggacggagaacccgggaaagcctcgaggagaattcagacatggatgggttgcctagagagctgtgcctcaagatcttccacctcctggatcaccagtccctcgcctctgcaccccaagtttgcaggaaatggagtgcgttgacctccgacggtgagctgtggcgcaagctgttcaacgataggtggggggcggacgccgcagcgttctacgcgccggagggcgacaagtcttggaaggacgtcttcgtcgtgcag

SEQ ID NO: 559 - DNA, 463 bp, Sorghum bicolor
  Clone ID: SORBI-28MAY03-CLUS117369_1
gtcgaagcagcagccgaagcaagaggaggtctcgaccgtcacgggctacaaggacaagctcgtcggtggcgtcaaagagaccgtgggcagcctgctgggcgtcgagcggctcgagaaggagggccacaagcagaaggagaagggcgaggccgagctcaaggccgccatggcccagcagcgcgccatgggcgaccgcagccgcgagcagcgcgagaagggcaagggccgcctgggcgaggaggaagagggcgagctcagggtcgactcctacgtcttcctcaagcgccaggccgtcctctccgagctccagcgcatgggcggcttcgagcgccagagccttcgtcttcgtcatgtcgagccgcgcgagcccgacgtgaggaagtacttcacccccaagggccagggcgagaggtggcagcagttcaacctcaagagggtggacatgaagccgctactcgaggac

SEQ ID NO: 560 - DNA, 192 bp, Sorghum bicolor
  unsure (1)..(192): unsure at all n locations
  Clone ID: SORBI-28MAY03-CLUS117373_1
gcacgagggtttcgatgagtttgaagcctccaacaaaaattgacctgcacaagtcctttgatgaaaatgataccactaacaagtccatctcaaggaaagtaagtttgtcttccatcacaatacctgcatacacagtggcagaccttcaggtggcaacaggcagcttcagtcctgacagtcttatcgnngagg

SEQ ID NO: 561 - DNA, 885 bp, Sorghum bicolor
  Clone ID: SORBI-28MAY03-CLUS11747_1
agacgctgtccaaccttgggtccggtcattgcaaggccaccacttaatggctgccattcaaaatcgtttgcaaagcctgttgtcaaggtacagaggtcgatttagacatcacgatgtaaacaatgagatgctacatgggtctttctatgaagatagactgggaagggacattagagcttacatgttcagagaagcacataagcttgatccttctgctgtcctgtttgttaatgattacaacgttgaagatggatgtgacacaaaatctacccctgagaaattcgttgaacaggtcgttgatctccaagaacggggtgccccagttggtgggatcgtgtgcaaggtcatatcagccatccagtgggagaaatcatatgcgattccctggacaagctcgccatactaggtctcccgatctggattactgaattggatgtcacagcagagaatgaacacatacgagctgatgatctagaggtgttcctccgcgaagcatttgcacatcctgctgtagggggaatcatcctttggggattctgggagatgtttatgtttcgagagcacgcgcatctggtggatgctgatgggacaatcaacgaggctggcagaaggtaccttgctctcaaacaagagtggctgacccgtaccaacggcaatgtcgatcgccaaggagagtttaagttcagaggataccatggttcgtacaccgtggaagtggacacgccttcaggcaaggtagctagatcgtttgttgttgataaggatagcccggttcaggtgatcactctgaatgtttaatgtgtgggaaatcatgcacgtgtcctgtattgtagcgaggtactgaggtgttgaacaccgcaggacttacagtgtgtatagaaaaat

SEQ ID NO: 562 - DNA, 149 bp, Sorghum bicolor
  Clone ID: SORBI-28MAY03-CLUS117539_1
gcacgaggggagcaagcaagcaaagacattacgaggaagttgagagagggagcatcacgagcagcgaagcgaagaagcgatcgaggattcctcccagatggaggtggtggtgcctgtcatggcgccaagcgcaccgtgcagaccaagaa

SEQ ID NO: 563 - DNA, 525 bp, Sorghum bicolor
  Clone ID: SORBI-28MAY03-CLUS117538_1
gcacgaggtcaaggttctccgagtctacaacgccatcaacgagagaggaggagcgcacaagctgctgttagcggccaccgtctccatggtgacgtcgtgctgcgtgttcggcctgccatggctggcgccgtgccggccgtgcccgacgacggggccgctagcgtcgccggacgggacgtgccacgcgctgaaccgtttccggcggttccactgcccggcggggcactacaacgacctcgccagcctgttcctcaacatcaacgacgacgccatccgcaacctctacaccacgggcaccaacgacgtgtaccacccggcgtccatggccatcttcttcgtggcgtcgtacgcgctcggcgtgctgagctacggcgtggtggcgccgtcgggtctcttcgtccccatcatcctcaccggcgccacctacggccgcctcgtcgccatgctgctcggcggccggtccggcctcgaccacggcctcgtcgccatcctcggctccgcgtacttcctcggcgggacgctccg

SEQ ID NO: 564 - DNA, 645 bp, Sorghum bicolor
  unsure (1)..(645): unsure at all n locations
  Clone ID: SORBI-28MAY03-CLUS117633_1
atctccggcgcggagctgcgcgagttcttcgcgtccatgggcgacgacggcggcagcctggcgctgctggggctcaacaagcaggacggaggggcgggggaacacctgatgacgctggggttcgacgacttcgtgcgcatcgtggagagcaaaggcggggaggaggaggagcgcgaggacctccgccgcgccttcgaggcgttcgaggccgtcaaggggtccggccggatcacgccgcgcggcctgcagcgcgtgctcagccagctcggcgacgagccgtccgttgccgagtgcgaggccatgatccgcgcctacgacgacgacggcgacggcgagctcgacttccacgacttccaccgcatgatgagccaggactagccagctggctagctagtcgcctagtccggtcgtttcatgtcctgtgaactgtgattcccgtcacttgctagccaccgtcacgaatatttcattttcatttagctaggttttttttttcgcattgccttcggttcgtgtacctgtaacctgtgtgtacttgtgtttgttggtgggtgagcgtgtgcgcatacggcgggcacgtgcatacgtggcttgacttcctggtgtgcctatgtgcgtgcgtcggagtctgattatatntgtgcg

SEQ ID NO: 565 - DNA, 672 bp, Sorghum bicolor
  Clone ID: SORBI-28MAY03-CLUS117642_1
gtgaagctcgagcccggcgtcaattcccatcacggtgctggcttcctggacgactctgttctgatgcagatgcagatgcactgcggccagctgcagcctctcggctgactgactggttttcacgcagaaattacaatggcagaaagaggaaaatacctctcgtctttggccacgcaccagtctgttgcgcgtgtctgttgttggtttcaatcaaacaggcaaataacatttgggtacagcacacaacattcttgctacagatggatggatggttcatgcagacagctccgagctcagcacagtcggcagccgagcgctagcgttctgctgcacctgagctgagctgagctccctgccgtgtgtgttccagagacgagaggaagaggaagaaaaaaaaaatacagtagaagatatacttatggacgatggggtctctgcatttcgcctatatgatgtgtacataagtcgacgcccgcagtgaaataatttcctagtgtaattttgtgttcctgtgtgatgggaggcacactagctactagatgttgtgattacgctagaactttctctattgtaatgatgtgttgatcggttaacgtcatgtatttggatagcaggtagcatcagcagcagcagcatgctgtttagtgttttgtaagggttttttatttatca

SEQ ID NO: 566 - DNA, 397 bp, Sorghum bicolor
  Clone ID: SORBI-28MAY03-CLUS117653_1
gctgtacggcgcggtgccgatgatcgcgagacaggtgaccgcggacgcggacctctgcggcgtggatgtgcccaagggcaccatcctgttgatcccgatcgcgatgcttcaccgcgacgaggaggtgtggggcgcgaacgccggcgctttcaacccgctccggttccgggatggcatgggcagggcggcggcgcacccgaacgcgctactgtccttctccttgggcccgcggtcgtgcatcgggcaggacttcgcgatgctggaggccaaggcgacgctggcactcatcctccggcggttcgccttcgaggtggcgccggagtacgtgcacgcgccggtcgacctcctgactctgcaaccgtcgaaagggctcccgatcgtgctcaagctcttggat

SEQ ID NO: 567 - DNA, 662 bp, Sorghum bicolor
  Clone ID: SORBI-28MAY03-CLUS11774_1
ctggagcgaaactacacagcgactcttcaggttcttctccaccctatccgactcgctcccgcactcccatcggcgccccactacccagcgacgccgtcgtagccgccgccgaccacgcccgccgccagccctctccaccgggcgtcctccctctccaggttctcctccaccctcttcgacacgcgctccgagcacgcccgccgccacgcccaccgccagccccgtccccatctcccacttcttcaacccggagaggagactgcgctcggtcgagcaccatctgaggcccagcatcctcgcgagtcccggccagctccggcgcggagtccgccctctgcagcaccggccaaggtccagctccggcgcggcgtccgccctctgcagcaccggccactcgccaccttggccggcgacgacccacaggacaccaggtattctctccccttggtcatcccttcctgcccttcctgctgtgcgaagccgtgcgcccaaaccttaacctgattcgtaggccgtgtgctcaaatcctaagctaccattcgtaatcagatctggatctaattagaggtatataacagactctaatagatatataatgacatatactaaaaagatggactggattgccatgccctgtttggagcctacaactgtaccagtgg

SEQ ID NO: 568 - DNA, 531 bp, Sorghum bicolor
  Clone ID: SORBI-28MAY03-CLUS117757_1
gcacgaggcacacacatttttcaaatcttgttcgttaagctcaggagctgagctgacagctgagacgatcgccgtttcagctcgatatatcgctagacctctcctagcagcgcttcttcctccaagaacaagaaccgagctagaccgattgctgatatgccagccatggttgtggaggcagcggcggcggcgacgacgacaggcgggcggtacgcgctgctgatggcggcgcacgactcggagtacgtgctgaagaagtacggcgggtacctccacgtcttcgtggcggcgttcggcgacgccggcgagacgtgggacctgtaccgtgcaatcgacggcgagctcccggcgcccgacgaggtgcagtgctacgacgggttcgtgatcagcggcagcccgcacgacgcgtacgccgacgacctgtggatcctgcggctgtgccgcctggtgcgggcgctgcacggcatgcgcaagcgcgtcctcggcgtctgcttcggccaccaggtgatctgccgcgcgctcggggggtcg

SEQ ID NO: 569 - DNA, 617 bp, Sorghum bicolor
  Clone ID: SORBI-28MAY03-CLUS117759_1
tgtaactctgcggctcggcagcaggcgagggcacgtcccgggcagcggcaggcgagcgcgaggccgtgtcccgggcggcggcaggcgagggcacgtcccaggcagcggcaggcgagcacgaggccgtgtcccgggcggcggcaggcgcggcaggcgagggcacatcccaggcagcggcaggcgagcgcgaggctgtgtcccgggcggcggtaggcgagggcgcgtcccggacggcggcaagcgagcgcgagcctgtgtcccgatggggcagcaggcttggggcccaagatacctccggggcggcagatctcgcgttgtctattgtggccggcgacatcaggtcagaaaacaggtataaagaaacgctatttttatcacacggaggaaatgctacgaggtcacccagagttcttgaaccgtgcgtccccgtccctggacgctcggatggacgtgatggccaccgccgtccttgagctcgcgtcggtggctgcagccaaggctatcgccgactggggacggccggcggcggaaattacccacctcatcgtcagcacctactcctccggagggcacatgccgggcgccgacttccgtctggcgtcactgcttggtctgcc

SEQ ID NO: 570 - DNA, 590 bp, Sorghum bicolor
  Clone ID: SORBI-28MAY03-CLUS117761_1
gcacgaggcggacgatacccagcgagagatacacacggataaatatcacgaaacatgcggctggcggcaccaagctgtgctcccttcgcctccgcgagacgaagccagctatggttgcgcgggtttgaaacacaatctctacatgcgaggccgaggtcaattgccctgaaagcttgcctgggaagggaaccggaacaagcagcatcaccagcatctatggaaaggttgtggggggctaggattccccatttttcgccgttcaaagtccccagagcttttgctggacaaggccaggcccggtttttccgaaaggccaattacattgagaaaattggcgataacgagaaggctgaacagatactggagacactcgaagtcaaggatgatgagcgagacgatcggccgcaacgacgtgtgctacacggagaaggcgagaagaccgcgccaccgcaaaagcaggtagaggaatggtcggaacacatgactcagggaaaaatgctgacaacaccatcacggctgttcaaattgattcttcctctgaccacaaccgacaagggtcatgataaggggaatcgaacccattgccattc

SEQ ID NO: 571 - DNA, 470 bp, Sorghum bicolor
  Clone ID: SORBI-28MAY03-CLUS117782_1
gcacgaggctcacagcctcgcctcggaccagcaacaaggtcgccgccggccagggccgacgcccgccggctggaccctgatccctgaacctcggcggcgccgcccggcatcatcgtcgtcgtcttcttcttcctcctcagctagcattcgcgcgcgaggcagggatcagctggcgtctcgtgattagagctcgagatttctcaagagagacccgactactcccgtcgttcttcgtgggttatcgtcgttcgttccaaggtgttgtgagatccggccgaggaggagatgtcgtcgtcgctggaggtggacaaccccggaggaggaggcggcggcggcggcgagtcggcgaaccggctcagcctgaagcgccacgactcactgttcggcgacgcggagaaggtctccggcggcaactaccatgggtccgacgggagctgggccaggacgctgcacctcgccttccagagcgt

SEQ ID NO: 572 - DNA, 528 bp, Sorghum bicolor
  Clone ID: SORBI-28MAY03-CLUS117783_1
cagagctgagccggcgagcagagcagcagcctctgcgcgcgccggcgccagccgacatggctgctacaagtcactgcggcaacatccaggaccaggacgaagaagcttcggctcctggcgccgccgacctctacgccgtgctcgggctcaacagggagtgcaccgacgccgagctcagggtcgcgtaccggcggctcgccatgatatggcatccggacaggtgctcggcgtccggcagctcgccggcgcgcatggaggaggccaaggagcggttccaggagatccagggcgcctactccgtgctctccgactccaacaagcggctcctctacgacgtcggcgtctacgacagcgacgacgacgaggctgacctgtcggggatgggcgacttcctcggagagatggccgacatgatgagccaggccacgccaacggagaccttcgaggagctgcagcaggtgttcgtggacatgttccaggacgacctggacgacgccggcttcttcggcgggcttccgacgacgggcc

SEQ ID NO: 573 - DNA, 828 bp, Sorghum bicolor
  Clone ID: SORBI-28MAY03-CLUS11786_1
ctcgtctctttcaccggcgactccgctctcctccgccgccgccaagagatcgaatccgacgccgagcgcccgatcccccaaatccacgcaccaaccgccggggcgcgcggaagattcagatttggcccctcaccggtaaagggatgggcgcgtggatgtcgcgcgtgtggttcctcatgttcccggcgcgggagtacaagctcgtcgtcgtggggctcgacaacgcggggaagaccaccacgctctacaagctccacctcggcgaggccgtcaccgccgcgcccaccatcggcagcaacgtcgaggaggtcgtcttcaagaacctccgcttcgaggtctgggatctaggagggcaagaaagcctgcgcacctcgtgggcgacatactaccggggaacgcacgccgtcatcgtggtgatcgacagcacggaccgcgcgcggatcaacatcatcaaggacgagctgttccgcttgctccagcacgcggacctggagggcgcagtggtcctggtgtttgccaacaagcaggacctcaaggacgccatggcccctgcggagatcacagacgcgctgtccctccacagcataaagaaccatgactggcacatccaggcctcgtgcgccatcaccggcgagggcctctacgacggtctcggctggatcgcgcagaaggtcgctggcaaggcgaccgcgagctgacgtgcggcgcagcattggttgcggttcgtgaatggatttgttgatgaaggtggcaggatgggtttgtttcttcctgccaccacgcccaatgcttatttatgtttttttttgttaagaaaaaccctcgtgc

SEQ ID NO: 574 - DNA, 586 bp, Sorghum bicolor
  Clone ID: SORBI-28MAY03-CLUS117896_1
tgaccatcaacaacttccagatgtaccggcagatcatggcgccggggtggacggtggggtggacgtgggcgaagcgtgaggtgatctggtccatggtgggcgcgcaggcgacggagcagggcgactgctcccgcttcaaggccaacatcccgcacccccgctcgccctcgccctccctcgccgcccggcgcccccgcgcgccctccttcccgccgatcgccacctcctgccgcggcggcgtcatcagcgcctacggccaggacccggcctccgccgtcgccgcgttccaggtcagcgtcggccaggccggcaccaccaaccgcaccgtcaaggttcccaagaacttcacgctgcttgggccagggccagggtacacctgcggccccggcaagattgttccctccaccgtcttcctcacgcccgaccgccggcgcaagacacaagccctcatgacgtggaacgtgacgtgcacctactcgcagcacctggcgtccaagtacccgtcctgctgcgtctccttctcctccttctacaacgacaccatcgtgccctgcgccaagtgcgcctgcggctgcgagcacaagac

SEQ ID NO: 575 - DNA, 450 bp, Sorghum bicolor
  Clone ID: SORBI-28MAY03-CLUS117909_1
gcacgagggcagagactctcaacatcttcccctcccagccaatgcatcatatcgagccatccccgaagggttccatggcttcttcttcagtggtggcagcacaggtcgctgctgccccttccaagaactcgcaggcgccgtcgttgatgggaggcggcgggccgcttgctgccgccggcaagagctccaaggcagcaatcaagagagaaggcggcaccgctggcggcaagcatggcgccgtgggagcttcgagctcggatcaggaggggccccggacgccggaccccaagacgctgcggaggctcgcgcagaatagggaggccgccaggaagagcacgctgaggaagaaggcttatattcagcagctagagtcaggcaggatcaggttggcacagctagagcaggagatgcagatggcaagaacccatcagggtgcactatggggggcag

SEQ ID NO: 576 - DNA, 544 bp, Sorghum bicolor
  Clone ID: SORBI-28MAY03-CLUS117925_1
gcacgagggtcacgtcgagcagatgaggtgcgcgtgcatatccaactcacggacggagacgaatgaggtcgggagtctgcccatcgccatcaccgattgggcagggacggcgtttgcttgttgttttgttttgccactggtgggccggccgccgcacgccgccattgggagttcctttccttgttcctgcttgtctcttgtgcgcgctctcgcctgcttctagagcagggcagggcagggggccgcgacatcgattgcgatttactcagcagtatttaatttaatttgctacccgggatcggatcgaagtgagagcagttacaataatgcgtttatagctaagcagctaatgctgatgtggagaagaaaagagataaaagagatgatagtttggctctcatgtaagcaccaagctggacacggatgcataggtagtaatgggcccaaatagcaattgttgtgagaaggaatagaaaaaagaagatttttagagataagtatgagacaacttattgtataactgagctcataattacttggttta

SEQ ID NO: 577 - DNA, 849 bp, Sorghum bicolor
  Clone ID: SORBI-28MAY03-CLUS117938_1
cacacagacagaagaatcatttcaaaccgaaaatggcaacagcagcagcaatgaacggacactacagcagggcacccaagctcttcggcagggaaagaacactccacgctgccctcggtggacgcagagccgcggacatcatcctgtggagggacaggaaggcgtcggcgtccatcctcgcggcggcgacggcggcgtggggcctgttcgaggtggcggagtaccatttcctgacggtggtgtgctacgtcgccatgatcggcatgctcgtcttcttcatatggaccaacgcttctaccttgttcaacctgccggttcccagaatccctgatactctggtgtcggagagggcgagcaggcacgcggtccacgacgtgcatcgcaggctgaccaggttggtggagacgctccacgacatcgcttgcggcaaggacatcaagatgttcatcctgacggtgctgtcgctgtacatggcgtcggtgatcgcggactgcttcagctccctgacgctgctctacctcgtggtgctgggcacgatgacggtgcctgcgctgtacgagcggtacgagagcgaggtggaccacctggtggccagaggcgtgcacgacctgcggacccacttcgcggacatggactcgggcgttctcaggaagatcccgagaggcacaggagctgcagcacccaagtgatcaccccccaaacaagagatcacgactgtctgactgactgcctcgtagcgtaaatatggtggtgtacaatactatactatagcacatgtagaagtggattaagaacgcatgtcgctggttttcctcactgaaaggtcccaaaagaatattaaggtcacca

SEQ ID NO: 578 - DNA, 510 bp, Sorghum bicolor
  Clone ID: SORBI-28MAY03-CLUS117961_1
gcacgaggaccacgtcctccaccaggtgctccggctgtacaacctgatcaatgccaagggacggatggcgaagctggcgctcgccctcgcggtgtccgtgttcacgtcggcggggctgtacctcctgccgttcgccgtgccgtgctcgccgtgcgacccggcgttcggcgacgcgtgcccgacggtgggcaagtccggcaacttcaagcagttcaactgccccgacggctactacaacgacctcgcgtcgctgctccacgccaccaacacggacgccacgcgcaacatcttctccacgggcaccgccggcgagttcaggctcgactcgctgctcatcttcttcgccatctactgcgtgctggggctcttcaccttcggcatcgccgtgccgtcgggcctcttcctgcccatcatcctcatgggctccgcctacggccgcatggtcgcgctcgtgctcgcgcgcttcgtgcggatcgaccacggcctctacgccgtgctcggcgccgccgg

SEQ ID NO: 579 - DNA, 905 bp, Sorghum bicolor
  unsure (1)..(905): unsure at all n locations
  Clone ID: SORBI-28MAY03-CLUS11803_1
aaaaaaaaaaagcgatcgccgaagaaccctcgcacgacaaaattgcatctcctctcctcccctcctcttcccgagctccgggcacgcctcctctttccgaactccgggcacgccgcgccacgcgacaatcaggatatctatttcgatatatggacaaggtgtctgaagatactcagcgagatggataagaagaaagcattcgatgacactgaaccaggaccagctccttctcgtgccgtcgacagatttggtttcataaagccagaacaaagcaactcacctgatggaattccaaaaggaaaatctatacatgaacgtgaaagggaggaaagaaggataagaaaatggaggaagatgataggtgttggtggtagtgactggaagcattatgttagaaggaaccctcatgtggttaaaaggcgaataaggaaaggaattcctgattgtctcagaggacttgtttggcagttgatttcaggcagtcgggacctcttactaatgaaccctgnggtttatgagacactggtgatatatgagacatcagcttctgaattggaaattattcgtgacatatcacgcacatttccatctcatatattcttccaacaaaggcatggtccaggccaaagatccttgtataacattttgaaagcatattctgtctatgacagggatgttggatatgtgcagggaatgggatttatagctgggctgctgcttctttatatgagtgaggaggatgcattctggttattagtcgcatngctgaagggagctgtccatgcaccaatggaaggcttgtatcangctggtttgcccgtcgtgcagcaatatctgtctcagtttgagaaattaagtattgagctcatgccaaaattgggaccaaccacttgtgaagaaatgat

SEQ ID NO: 580 - DNA, 589 bp, Sorghum bicolor
  Clone ID: SORBI-28MAY03-CLUS118055_1
ctgctgaccgtcttgtattctgtcacttcatgattggtatcgttggtgaccgtggcagctcggcagattatgatgacgatatgcaacgtgccaaagccgctggcattgacgccttcgccctgaacatcggcgttgacggctataccgaccagcagctcggctatgcctatgactctgccgatcgtaatggcatgaaagtcttcatttcatttgatttcaactggtggagccccggcaatgcagttggtgttggccagaagattgcgcagtatgccaaccgccctgcccagctgtatgtcgacaaccggccattcgcctcttccttcgccggtgacggtctggatgtaaatgcgttgcgctctgctgcaggctccaacgtttactttgtgcccaacttccaccctggtcaatcttccccctccaacattgatggcgcccttaactggatggcctgggataatgatggaaacaacaaggcacccaagccgggccagactgtcacagtggcagacggtgacaacgcttataagaattggttgggtggcaagccttacctggcgcctgtctcaccttggtttttcacccattt

SEQ ID NO: 581 - DNA, 730 bp, Sorghum bicolor
  Clone ID: SORBI-28MAY03-CLUS118110_1
ttcgcgctctgccagtctgctgcctatccatttctttcccggacaccacacacgcccgccgagacgcgcaaaacgatcgaacaccagaggatggcatccgttctcgccttctcccggtgttcgtcgctgcttctcctcctgctggcgacggcgtcacaggccctcaacgtcggcgacctgctcgggacagcgccctccgggagcaaggattgtagccggacgtgcgaatcatcgttctgcatagtcccgccgctgctgaggtacgggaagtactgcgggatcctgtacagcggctgccccggcgagaagccctgcgacgccctcgacgcctgctgcatggtccacgaccactgcgtcgccacccacaacaatgactacctgaacacgcggtgcaacgagaacctgctgagctgcctcgacagggtgagcccagcggggccgacgttcccggggaacgagtgcggcgtcggccagacggcgtccgtcatacgtggggtcatcgagtcggcagtgctcgcgggcaagatccttcacaagcgcgacgacggcccgtagccggcgttcttggaaggagcgcgcgcggttggtactaggaacacacgttacacgtacgtagttgttgcaagcagaggaataaaagccgcacgcgcgcgcgtgggcgcgcggcgcccgtccgtggcgatgcggcgaagcagcatgtgctggattggaaggtcatggacggccggaa

SEQ ID NO: 582 - DNA, 608 bp, Sorghum bicolor
  unsure (1)..(608): unsure at all n locations
  Clone ID: SORBI-28MAY03-CLUS118126_1
ctctcgacccaccaaagcagaatcggctcgactcgccgagtacacgcgacgcgacacgaaaccaaagcgcggaccgaaccctacccctccgccgcgaccccgatcccccacatcgtcggcgatgagttcctcttccaacggcggtaagaagccggctgccagcggcggccgtgggggccccaccatccgcacgctctccgacttaaaccgcgggcccgccggcttccctggcgccggaggtcacggcagcggcagcgacgacgacgagccccaggagtactacaccggcggcgagaagagtggaatgcttgttcaagatccaacaagaagaaatgatgtggatgcgatatttgaacaagccaggcaggcgggtgctctccatggaatgcccccttttcttggtgacgagtcttctggctctaggagcttttcagggactggccgacttcttacaggggagacagtgccatctgctgcacctcaggaaccagcaccagttcgaatacgccacaatatacattntgtggaacaatggctttagtgtggatgatggtccactgagatactacgatgatcctgaaaatgcagagttccttgagagccttaag

SEQ ID NO: 583 - DNA, 953 bp, Sorghum bicolor
  Clone ID: SORBI-28MAY03-CLUS118129_1
ctgactggaagaagggtcactacttcaacgacaacgaaatatgcgacgagttccatgaagtggatctgcgtgatttggacacatgcatgaagatgtgccagggtatcgatgaagtctacgactttgctgcagatatgggcggtatgggtttcattcaatccaaccactctgttattttgtacaacaacattatgatcagtttcaacatggtcgaggctgctcgtcgctctggctcagtcaagcgattcttctacagctcttctgcttgcatttatcccgaataccgtcaattggaaacagccaatcccggtttgaaggagtcagatgcatggcccgctcaacctcaagacgcttatggtctcgaaaagattgttactgaagagctctgcaaatactacaacaaggactttggcattgagttccgcctcggtcgcttccacaacatctacggcccccacggtacttggaagggtggtcgcgaaaaggccccagcagcgttctgtcgcaaggcccttgtgtgcggcgatgtgtttgagatgtggggtgacggcaagcagacgcgctccttctgcttcatcgacgactgcgtggagggtgtgttgcgcttgatgcgcagcgatgtgcgcgagccgatcaacattggcagcgaagagatggtggacatgaacgagatggcgcacctcgtgctcgaattcgcgggcaagaagaacagcaccaagttgcatcacatcccgggccctgaaggtgtgcgcggtcgtaacagcgacaacacgctcattcgcgagaagttgggctgggctccgagcatctcattgaaggacggattgaagcgcacctttgactggatcaagctgcagattgaggctgagaaggcgcaaggtgtcgatgtgtcgcaatacagccaatcacacgtcgtcaatcagaagcccactgacaaataagtactctgctgt

SEQ ID NO: 584 - DNA, 865 bp, Sorghum bicolor
  unsure (1)..(865): unsure at all n locations
  Clone ID: SORBI-28MAY03-CLUS118135_1
gcacgagggttgccctctctctcatgtaatcatcatgcatgtctcgtctccaactccgacgcgctgatctgatcaatcgtcgttgcagctgatgacaccaccatgctggagaggagcagctccaccccttccagcaggactccggcgagctcgtggctgccgccgccacgcagcccgctcggcgtcgacgaggagtacgacagcgccttcaagtccaagtctttcctcgacctgtggtcgcacgcgcaccgccacctcatgcacaccttctcctccgcctccttcaagctcgcatcgtcgtcgtcgtccaagtccggtggcgtcaaggacggcgagcccgacgacgcggcggcagcagccgccaccttggagcagtcgtgctcgtacaccgttcttgacgacttcgtgctggagcccagcccggaggtgctcgggcggggccggcggaggcggaggcgccgcgtcgagaggctgctcatcgagtacttcgacgtgacgcaggaggcctgcgaggcgtgctcctcgctcctcgccgccatcggcgcggcgcggcgccaccaggaggatggtggcgcacgagatgacgcaaggcttgccgccgtcgctggaggaggcgacgccgccgccgccgccgccgtcccaagattagcttcgcatcaatcatctcttatagctagctagttcatcattgtccatatgatcgattctacagtagaaacgagacgaataattgagagcgaattctttttccatgtacagtacgtagtttacgattttttttttntgtgtgtgtgggctgaggtactgatgtacaaagcaactcctttgaacttgttgagatagatatagacacacacacaagaga

SEQ ID NO: 585 - DNA, 639 bp, Sorghum bicolor
  Clone ID: SORBI-28MAY03-CLUS118212_1
ctgggaagcatgagacgatgtcacgggagcttgcaggaacacttgcttacggagcagcaaaagccgaatgtgatgaatcagtacaaaatcaaccagaggacgtcaaccaacaacagtcccgagagaagcaaactactaatagtactgtaaaagatgaacctgtcaccttggaaccacaagttttcgagaaaccgtggagcatcaagcatgaagatactatgactctggctgatgctactatgaaaaaacaaggtgatttgggattcaagagaacgatcaaggatattgaagttgaagctgacatgaagccctgtcagcctaccaagaaggaaaaagcggtaaaagccgcttgtcaggcatcgttgctttcatattttgcaaggaagtaaagtcgcccgataaatagtttgctgtagctaactttaccagtacctagttgtcaaaaaaaaaactttaccagtacatgtcctccatattcgggatgaactttatcgtttcgtttttaattatgttttggctaaggcagaaagagtgagctgtaacgtgtgcttgctcggaagcttgtgtcacatttagtttctcctaagccaagcgtttgtatccttgatcattgattttaaaaaatttatatagtttaca

SEQ ID NO: 586 - DNA, 438 bp, Sorghum bicolor
  Clone ID: SORBI-28MAY03-CLUS118286_1
agaccgcatggttgaaatcagccctgctctggctgcttatgacgttgttgagcccgtcgctctccctgctttgagcaaggtccagctcgtcgaccagaataagggtgcccaggtcactggaacccctctaaagaaggttatcgacaacttttacttcaccgatgttatctcacgaagctctcccacaatggctcgctgctcagcggctaaggctaccggtgaccctaggacaaactttatggctcctggcatggaggaggataagccaatgggccaggttgagtacggcgtatgaggtggttgctgcaaaagaatagaaatatttgctttgttttatgcgtctgggaagttcgtagcatctgtacatataggacgtcggacggaggctgaaggtagatgagctgaatacctaattccttcactacgacgtgcccatcg

SEQ ID NO: 587 - DNA, 302 bp, Sorghum bicolor
  Clone ID: SORBI-28MAY03-CLUS11829_1
gccgcgacttgtttgctggccggtcctcctcccgttcgcttggcttgagcgacggctagggcgaccgccgccgccctacgcccagctgccatgtcttcttcgggccctttgccggcggcgggaacccaccacaccaggaatcgtgcaaacaatcggcgcaagtctggagatagggccgatagggctaattactcctacaacaatgatggggagaagagtcatgttccttcattaaagaaccttcctccaattgttcatcatgaaacattcttcagcaatgttcagaatgactacaatcaaac

SEQ ID NO: 588 - DNA, 451 bp, Sorghum bicolor
  Clone ID: SORBI-28MAY03-CLUS118303_1
ttcggatgtccaatgtcatccaaggctccaatgaccgactggcgaatgcgaagattgattagccgtttgtctaaagatttgtcattcatgcgttttggtcggtgtttgtgggcggctggctgggttttgtgagcctgaggatttgagttttgatgtgtgcgaaacgcaagctgtttggccatataggaccaccaacagccatgcttggtaatcgctgaagcctggaaatgtcaagtccaactaccatcggtttctgtgcacgatttcagataagcgtctcgtccaccaatcgatcggtacacggcatacggggtccgattgcatggaatgctttaggctgtagtgtagcccgaatccggggcgattaatggcaaaacactgtctatccatcgcttgattactccaaccgtgtaggaacgaactatatttttgtcacaataactctgcacgc

SEQ ID NO: 589 - DNA, 225 bp, Sorghum bicolor
  Clone ID: SORBI-28MAY03-CLUS118326_1
gctcggggcccaagcccaagaacctcgtatgggaggccgtcaacacccatggttgatttattttattattttagatgtggatgcagttagtccattgcgtacttagatgagattggatgcaaacatgaaagaagaaacaccattattgttgagtttgctcggccaggcatgcatgaatgaatcgatttggagcaggtacaataacaattgtattgggttggcgtt

SEQ ID NO: 590 - DNA, 511 bp, Sorghum bicolor
  Clone ID: SORBI-28MAY03-CLUS11838_1
ctggctcctacgcatggcgtgacgcgcccgcccggccggccgctccttttccttccacccatctcttcctttactccaatgaagcaacacaagctgctgatccatcgattgatccaccaaaaagctacgtacttctgatccaccatcgatcacttcataattagctaccctcttttccttccttcaattcgattgatcgagcaggaaattaagcaaaggcaaaataagcaaaaagatgcagcggcagcaggacgatgatgacacggtgcacgccgcagccatcgttttggccgccgccgcgagatccacgagcacaggcctcctgcgccaccagcagcagctcgacgaccacgaccacgccagctgcgccgctgcggtacacgttatatacttcctcacggctacctgctttcttttcagaatttctgttgagtttcacaaatcatatcaagaacacgtgaacatgtcgcaagaatatactactagataggagtattgttttctgatccaa

SEQ ID NO: 591 - DNA, 566 bp, Sorghum bicolor
  Clone ID: SORBI-28MAY03-CLUS117825_1
gccgaacttggcctccagcgcattccataattccttggtggtggtgcaaatgatgtagctgtcaacatactttttatcaagtgcactgatcatggtgcctcaaaagaggttattggcttctatgaacttttgctccttcttaggagtaaattgttccggcttcctctctgcaatgtgatagcatctcatagtagccaaccacaacaccattctcgcatgccacgacttatagtttgaaccatcaaaactctcacgttttaaagcagcaacaaaaccacgaatagaaaaatacctatcatcaagttcttggattgtgttgacggtagataaatcctagttttaattgtcaactaaacataaaatggacctatttgcaagcacttagtagatatagggttatcactaacagaattccatgagttttggtgaatatctatttctgtacggagtcagctgaaaataatcaaagatgatccacatgtcagatttacatagagagaacacatgaacttcaacttggagaaggagcaagttgaatctgggatggagggtcaaagattaaaagc

SEQ ID NO: 592 - DNA, 666 bp, Sorghum bicolor
  Clone ID: SORBI-28MAY03-CLUS11843_1
acagcagaaacgtgtccgccactcgcccactccactactagccaataagcattctcctttggtgggggaaatggaggccgccgccgccgccgcgacggggctttcccagagaccggttgtgctgtacccgtcgccagggatgggccacctggtctccatgatcgagcttggcaagatcctcggcgcgcgggggctgcccgtcacaatcgtcgtcgtcgagccgccctacaacacgggcgccacggggcctttcctcgccggcgtctccgcggccaacccgtccatctccttccaccgcctgcccaaggtcgagcgcctccttcccatcaagtccaagcaccacgaggcgctcaccttcgagctcgtccgcatctccaacccgcacttccgcgagttcctggccgccgcgtccccggccgtgctcgtgctcgacttcttctgcagcatcgcgctagacgtggcggaggagctccgtgtgcccgcctacttcttcttcacctcgggccccggggtcctggccttcttcctgtacctcccggtgctccacgaacggaccacggcgagcttccaggacatgggggaggagcccgttcacgtgccgggcatcccgccgttcccggcgacgcactccatcctgcccatcatggagcgcgacgacgcggccta

SEQ ID NO: 593 - DNA, 455 bp, Sorghum bicolor
  Clone ID: SORBI-28MAY03-CLUS118477_1
gcacgagggagcttcaagcacctcggccgctcccatggcgtcatcgtcaacacgctccgcttgctggagcagcgcgccgtcgagaccgtggccgcggggcactgcacgccgcccggcctcccgacgccgcccgtctactgcatcgggccgctcatcaagtcggtggaggtggtgggcaagcgcggcgaggagtgcctggcgtggctggacgcgcagcccagtggcagcgtggtgttcctctgcttcggcagcctcggccggttcagcgcggagcagatcagggaggtggcggccggcctggaagccagcgggcagcggttcctgtgggtggtccgggcgccgcccagcgacgacccggcgaagaagttcgcgaagccgccggagccggacctggacgcgctcctcccggaggggttcctggcccggaccaagggcaggggcctcgtggtcaggtc

SEQ ID NO: 594 - DNA, 548 bp, Sorghum bicolor
  Clone ID: SORBI-28MAY03-CLUS118492_1
gcacgagggtccgtcgacgcaccagcccgtcgctcacgtccttgctccccgccgctactggaatatgctgccgacttggatccgttctctacttgtctgagatttagccgccgccggcccggtaggaagaagaaagctccatgtttgttgttcctggcctggcgcagcgccggtgagatccagtccggaatcggcaacgctgggaggagtcgggtgagatttacggcgagttctgtgccgctctaggaagaagggtcacgtcgaggacgcttttgccgacgcggatctgcctggagccagcgaagcgaagcgccgaatttggggtgtttggccgtgcgaggccaaaaagctctcggtttggctgccgtccgaaaccgcctgacgcgaccaccatcacatggtcgtagtggtccgggtccggcacaagtagggggctcgcgtcttgtgcttggcagttgtgggactcgtgggaagccatggagccgtcgtcgtccatcacgtttgcgtcgtcgtcgtcgtacctgtccaacggctccagcccctgttcc

SEQ ID NO: 595 - DNA, 667 bp, Sorghum bicolor
  unsure (1)..(667): unsure at all n locations
  Clone ID: SORBI-28MAY03-CLUS118574_1
aagctgtcggagaaggcgtgcacgcacgcggcgcagaacgagctcctgccgctgcgcgtggtggtgcaggtgctcttcttcgagcacgcgcgcgccgcggcgctggcgtcgggcggtgggcatgccgccgtggccgccacggcggacctgccgagcaacatccgggcgctgctgtccaacaagtccgggtcgtcggaggacgaggaggcggaccgcgtcgacgagcagcggctccgggcgctggccgccggcgggtcccccggcgacgactggagcgtggagggcctccgccgcgcggcgtccaagatcgccacgctgcggatgaagctggcggaggacgaggactacgaggaccgcgatgccgacgagttcgcgcgcaaggccaggctggcgcgcagcgcgtcgctgcggttcagggcgttctgcgccatccccgccgggaagccgaagcggatgctcagcaagctgtggccgctgggcagaagcggcgttagccactagtagcagcagccattgttaggtcctgtgatctcctgtttttctttttcttcatttttccccctgagggtgatttgtttgtctcttcttctactagtaattcttcttcctctcttttgagttacacttccaaggcaaattgtaccttgcatgtagtagttgtaattnc

SEQ ID NO: 596 - DNA, 750 bp, Sorghum bicolor
  Clone ID: SORBI-28MAY03-CLUS118614_1
cacgaggccggttgatctcagacacatcaattgaaccaccatgaactcgacaatcctccgctccaacgccgcacgctctgcgctccgcgctgccaccaagagctccgctcgcgcaggcgtcgcaaccacctttgtgcgtggcaaggccactctgcccgacctttcctacgactatggcgccctcgagccctccatctctggcaagatcatggagctccaccacaagaaccaccacaacacatacgtaacttcgtacaacaacttcagcgagcagatcgctgaagctaaggccaagaacgacatcaaggctcagattgctctgcagcctctgattaacttccacggtggtggccacatcaaccactcccttttctgggagaacctggcaccaaccagccagggcggcggtgagcctccctctggggccctggccgctgctatcaacgactcctacggtggactcgagaagttccaggagaagttcaacaccgcgttggccggtatccaaggctctggctgggcatggcttgtgcaggacatccagactggcagcatccagatcaagacatacgccaaccaggaccccgtcgtaggccagttcagacctatcttgggtgttgatgcgtgggagcacgcctactaccttgactaccagaaccgcaaggccgagtacttcaaggcctctggaacgtcatcaactggaaggcggccgagaagcgcttccagtaagcgattatactaattgtaggt

SEQ ID NO: 597 - DNA, 857 bp, Sorghum bicolor
  Clone ID: SORBI-28MAY03-CLUS118630_1
gcacgaggcacgacttcaattgaaccttaggtcaatccttcatttgcttgttccgacgcgaatccttcttgccgcgtggataaggaagcaggccgtgggaaagcttattgctcgattctgctcttgtccaatgagccgagcaaagaaatccataacaattcccagaaactaccgcctcgatattgaccttgtatactctggattacacactgcaacacaatcacttcgacactcttcacagtccgatcgatcggcaataaaccagctcacatggtccattacacgcatgcaggcccggaggacctctagtccgaggcgctactacaaactgaagaagggatatagcccttcagagcccgtagagagacagggcaaggatctttcttctttcactattgctgacgcagaatacgcgccccaaaaaaaccttgactgctagacaatgtgcaataggatatgcctctcacaacacgtgccttgaaaccttgcctggacaatgtgacaagccatgtttgtccaaggactgggacctgccatgtggcgccaatgtacctcatgcagaggaaggacccttttcaatcgaaggatctcgccccagccctgtacggcggtcagctgtgcccggccagcagccagccagcagccagccagcagccattattgggctttagactttcatcgatacgagaaaatcagcgtaggaaatcggaaagtcgataagcgacctccaaagacgagcctcgttcacaaacaaaaaaaaaatgccgcactatacgagcagcgagcaagccacatcggcactttgggatcaagtccgcggttcacatacttgatatagaaaaaagtgtacactagga

SEQ ID NO: 598 - DNA, 929 bp, Sorghum bicolor
  Clone ID: SORBI-28MAY03-CLUS118644_1
cgacgacgcacccagcgcccacggcggcgtccaggagccgctggagctcgacgagcgcgacgtcgtctggtcctcctcctcctcctccagcgcggcctcctcgccgtccccgaccccgtccccgtcctcgtcctcgctccgccagcagcctccggaggccgatctccacgtcgtcgcgcgcccggagagacagcacgcgccgcagccgtaccaccagtcggcccccatggccgtgccggcctggcccaaggcgatgacggcggcggacaggcgccgccgggaggcggagctgcagaccgccgcgtactttgacgacgacgatgacgacagcgagcccgtggtgccgccgcatgagatggccgcgcgccgcgccgcggcggcggcgtcggtgatggaaggcgccggccgcacgctcaagggccgcgacctccggcgcgtgcgcaacgccgtgtggcgcaccaccggcttcctcgacctgtgaaaaaggacgtccctttcctttggaggttttcgtctcgtttccttctctggccacgtcactctactccactccacttgagagctgcctcggaccttggcagcttcttgttgcgttgcatagtgctgtgtaagccagccagctgccaggcactgaaaatgccaaaaaggtgggcgtttcattactagttctactaggggcgctatatgaggtgtattttttgtggaggtagctgcagctgcttcagtatttttcccctggaagaaaactactgtgatcagactgcaactagtatgttctaagatctctgcaactctttgacaaagagattttctcggaagatgatgcagaatagctaaaacagttctgtgtagcagacagagctcatgttaatattaataaaacctgtggtctagtgtgcagaagtgcaaaatagagatgtggtgtgttc

SEQ ID NO: 599 - DNA, 566 bp, Sorghum bicolor
  Clone ID: SORBI-28MAY03-CLUS118765_1
gcacgaggccacccaccacttccggcgccatgtcccgcctcgacgcggcctcgctcctcgccccctggccgccgctggcaaagccccacccgcgcggccgcttcctctgcctcctctcctccatgctcgccgtcctcggcgcctccctcgcggtgctcctcttcttcgcgctccagcccgtgcccaacgtggtccctaactacgaggcgctcttcctctccctcggatccaacgacaccgccgcctcgcacctccgagcgctcactctccacccgcacgtcgcggggaccaaggccaacgccatcaccgcccgctacgtgctcgacgcgctctccgcgctctccttccccgcccacatcacgccttactccgtcctcctctcctaccccgtccaccgctccctctccctttcggcgccaggccgcggcgtcgtcacctccttctccctgaagcaggagacctaccccaacgacccctacgcagccgccgcggcggagaccatcccgacgttctacgcgtacgcggcctccggttcggtctccgcggaggccgtgtacgccaactac

SEQ ID NO: 600 - DNA, 971 bp, Sorghum bicolor
  Clone ID: SORBI-28MAY03-CLUS11880_1
gcattctttgacagaccctgtggctatgtggcacgtccgtgctgagattgctcccgcaattcttttggtggttgattttggaggatggtataaagttgactcaaagtccgcaaacagaaactcgtctcgtatgatacagcacacccaagtgtcattgcttaaggatgttattgtgccttacacgcatttgcttccgacactcctcttatcagagaataaagatcgtcccacccttctctacttcaagggtgcaaagcataggcatcggggtggtttagtgcgagagaaattatgggatttgctaggtaatgagcctgatgttatcatggaagaaggcttccctaatgccaccggacgtgaacaatcgataaaagggatgcagacatcggaattttgcttacacccagctggtgacaccccaacttcttgtcgcctctttgatgctattgccagtctttgcataccagtcattgttagtgatgaggttgagctcccgtatgaagggatgatagactacacagaattctccatttttgtgtcagttagaaatgctatgagacccaaatggctaacaagttacttgaggaatattcccaagcagcagaaggatgagttccgaaaaaacttggctcgtgtccaacctatctttgagtacaacaccagttactccatcagcagaggctctacctccattgatggtgctgtgagtcacatatggaagaagattcatcagaaactgccaatgattcaggaggcaatcatcagggagaagcggaagcctgatggtgcgtcaatcccactccggtgtcattgtacatgaacttgccatagctgctgtgataccccatgggatggcttataatgagcaattactccaagttatttcttttttttgtttgtttttattggtagttacaaatatgagcatgtaaagaatggtttatgtttttaacccttttttttaaaaaaaa

SEQ ID NO: 601 - DNA, 777 bp, Sorghum bicolor
  Clone ID: SORBI-28MAY03-CLUS118115_1
gcacgaggctcgatagctgctcgccgactgctagcataatagcatatacatcagctaggtgcctggctacaagtagatcttgtgccggaaaacaacaagaagaaacatgaccacttctgccatcaagcccctgactgtcctattctttttcttggccgtctctcctcgcggtaccaatggtgagccatgcggcacgtccagcatccaggtgcagaccatcaacacgggagcgacggcggccggcggcgacacggtgttcgaggtccaggtgaaaaacctgtgcccatgcagcgtcaggaacgtgcgcgtcgatggcggcggcttcgcgacgacggtggaggtcgacacaaacctgttccgctcagtcgacggcagtgtctacctggtgaacgccggcgagcccatcgcgagcatgggcaccgtgagcttccgctacgcctgggaccacttcttccagatgactcctaggagcttggaggtcgagggccagtgttagctagctaccaaagtcgtcgcaagctggttgccatgcatgttggggtataatgtgtcggctatatgtaagttgtcgtctttgatttacagtgtaaacaataacgcataagtacagtgcaaaagggtgttagctagctagagagagaacgaaaaaccgtctcctccggcctatagcagtgtataatgtataagaattttgcattaaagtgttcacgttcctagagcaaactttcggaatggagtgctatgtagatatatgatcgtacaaacactacgatatat

SEQ ID NO: 602 - DNA, 522 bp, Sorghum bicolor
  Clone ID: SORBI-28MAY03-CLUS118815_1
ctactcccaattcccaaaccagaattattggacggtgcatgccatgacacccctcgactgcgacatgcctcctgcagcttcctgcaagaagcgcctctcgccgtcgcggcctctccctaaccgctgcttgctgatcttgatcgttgcactggcggccgccgccgcggtggccagcgcgcagctgtcgtcggaggactactacgacgcctcctgccccgccgccctcttcaccatccggaccgccgtctcgacggccgtgctcctggaccgccgcatgggggcctcccttctccgcctccacttccacgactgcttcgtgcagggttgtgacgcgtcggtgctgctagacgacacggcgagcttcaccggcgagaagggggcggggccgaacgcggggtcgcttcgcggcttcgacgtgatcgacaacatcaagatgctgctggagctgctgtgcccgcagaccgtctcctgcgccgacatccttgccgtcgccgcccgcgactccgttgcacaactgggagg

SEQ ID NO: 603 - DNA, 624 bp, Sorghum bicolor
  Clone ID: SORBI-28MAY03-CLUS11886_1
tcgttttatgtgcatgctgaagggaattcatcaacttcaaagacaatattagatgcactgcaaagcgccagcaagtcacttggttctgacaatgttaaagtaaaacaagcagcttcatcaaatcctggtgttccaccatcttcattaatgtcattcataaggaagaatacatcaacttctggagttgtgttggaggattttgattcccatttttccaacagattttatcatagctatctggataaccctgtaaacatcaattcttcgtcaatagctgcagctgctgctttggttgccagatcactgtatattcttgctaatgatggctcagttgtcgatctcataacactaaacactataaaagtgaatgtttcattggtcgaagaacttattggatgtctgcttacttgcaatcctggtctttcttgtggccttgcgaaaagattcatttctccaagcaattcctgcccaagtcatctatgcttctcagctcacgatgaccccactggcactggatttcctttatccgcaggagattcgtctcgaagtgaatggaacttcttggcagacagaacttctaatttagcgggcaataaaagctcatgtactggaaagtgtgctgat

SEQ ID NO: 604 - DNA, 823 bp, Sorghum bicolor
  Clone ID: SORBI-28MAY03-CLUS11898_1
gctctcctcgatggcgtacggcaccgtgcctcgtggtgcacgccagtccaacctcaacgcacgaagcatgttgagatcgatctccactttatcaagagcgagttgctattggtaatgttcgagtgctccatgttttgacgacatcccagtttgctgacatcttctcctaaggccttccaacatcagtgttccaagaatttggtctggtctttccggtcttcatgacagcctggtcggcgattcgattgcacgggagaagaggggttagcatgttgaatgtcaggcggctgcctgggattacccctgaccggcatgctgcctaggggctcactcagcatgttgcctgtccccctcccctctttcttagttaccagccaatctattcaacactcaaatgaaatatacgcgagcacactatgctctaatattttgctttattccatctaacttttgttcatgcaattttctagttttttgtattttcttttaaaacaatttgtgtgcatggatgagctgtcaaaattttctgcttatgtttactttgtccaaaaggatggggaacacatttttttaacgattacatgaattttatttggaattttctgagcattgatgccatagtgttattactttcatttcgatcatagagcatgcattttcactggaaatgtaatcagtagagtttgttcataatatttacatttgatatcctggtctgcacttctctttttttgaccctggtagaaaatgttcagcaacaattgtgttttaacttaatggttattctatatgtggcttatttaatggtttctgaattcttact

SEQ ID NO: 605 - DNA, 755 bp, Sorghum bicolor
  Clone ID: SORBI-28MAY03-CLUS119059_1
cctgaaaatgcagagttccttgagagccttaagatgtcaaagtgccctagggagctggtgcctactgatggagaacatgttgatgtttctgttattaaaaggatggaagattacagggaacctgtaaggcctcgatcagctttccagggtgttggaagaaccctgggtggtggaccttccccagatgagagtgcaacacctgctcctgctcctgcaccagcggcccctgctgcttcgaggtctgttggcattgtcgtggatgactcccagccatttacatccatacagctgaggctggctgacggcactcgcatggtcgcccggttcaacctgcaccacaccgtgggagacatcaggtccttcatagacgcatctcggcctggagctacaaggccttatcagctgcagacaggtttcccacccaagcagctggctgacccaatgcagaccgtggagcaagctgggctggcgaactcggttatcatgcagaagatgtaatgcttcggcaatctggggaactcggatgcgtcatactgcatcttttgaaaactgtcgtattatggttgatcatgttatcagatactggtttggcgcatcatttatcgttacagtagcatctgatgcctcattgtgagcttaagagtttataattcatctatgaactgaagtaatgctttctgatctacagcagatacttagtgccgagttaaagtttacacgtctggtcataatgaacaatcgttgcttgcacgact

SEQ ID NO: 606 - DNA, 509 bp, Sorghum bicolor
  Clone ID: SORBI-28MAY03-CLUS118936_1
agctcgtcggtgacgagcaggaagcaggccgcggagatcgccgacgccatggcccaggtgaagagaccgttcctctgggttttaaggaaggacaactggaaggacgacgacgacgacgacgcggcgatcaagaaagcagcggcggcggcggtggatccggacagcggtggcgggatggtggtgtcatggtgcgaccaggcgcgggtgctgtcgcacccgtcggtggcgtgcttcgtgacgcactgcgggtggaactcgacgctggagagcttggcgtgcggcgtgccgaccgtggcggtgccgcagtactcggaccagggcacggccgcgtggctcgtggcggagcggatgggcgccggcgtccgcgtccgcgtccgcgcggacgacgacggcggcgtcgtggtggaggccgacgagctggcgcggtgcgtggaggccgccgcggcgtcggatgccgtggcggcgcgcgccgcggcgttaatgggcaaggcgagggcggccgtggcgga

SEQ ID NO: 607 - DNA, 580 bp, Sorghum bicolor
  unsure (1)..(580): unsure at all n locations
  Clone ID: SORBI-28MAY03-CLUS119083_1
cggtccgggtctggctttttccccctttgttcttttgtttgttgaactctttcgagtcttgtgtctctcgccgctcactcgacgtcacttttcctttttgattgcgtgtacactactccgatcttaaagagaaaaagaaaaccagaaagggattctgattgtcaccattctcgattccgattcttgtctttctgacgtgatgtcttgtgggtacctgacgtgcacttgccttgaaacgtgtttgatgttcaatggaacttgtcgctgtgaaaccaatgccgatggttcatgccagatgtatcagtgatcgagagcaagaggaggaggatgaccggagctgaactgcattcgagttgaatgaggcaggctcgagaagagacgacgaagctggacgatggtcaaaggctcttggtgattgttggatgggaaacgcaaaacaaaaagcaaaactccttgtctaacgagcgaagtttgacgagattaccccttggttatcctccttttttaaagcctggctggatgcaccctggcctggcttgtgtttcattattgtgtatttagcagttgaagagcccatggn

SEQ ID NO: 608 - DNA, 660 bp, Sorghum bicolor
  Clone ID: SORBI-28MAY03-CLUS119182_1
ttttgtcgtagcgttagcacggggcactgtactagtacatatatgagcctacgtatacatacgcaacatataatggtggtcgatattgctttaattgctaacttatttcatggcatggatcggtgatgatatgatcgcgccaaataatgtcagtttattttgaaacttattaggaggcgaacgtggtgatgacaccggctccggctccgtcgaagctgcggtggtggaaccgggagacggcgcaattggtggagaagagaccggcggacaggtacttgggcgcgccgcccatcttggcgccgatgtccagcttgctgacgtagcccgggcggtacgtctaccccagcacgccgtcgacgtccttggtgaggttatggaactggaagccgaggtcaaggtgcacgagctgtcgacgctgcccgtctcgccgtacttgtggatccagtcgtcactgtcggtgatgggcacgacattggcggatatggtgaagacgccgtccagctccaccatgactgtgctgacggtcaagcacagtagatttatttaatatcaattttacctattttttattaaaatattatgatcttggttgtaatagtgtatttttttaaaaaaattgttgaaagcatatagttttgtatagtttgttatactaaaaaa

SEQ ID NO: 609 - DNA, 755 bp, Sorghum bicolor
  Clone ID: SORBI-28MAY03-CLUS119235_1
cgcctggcccccgagcaccgcctccccgcggcgttcgaggacgccgccgacgccgtcctgtgggcgcgcccgcacgccgccgccgggaggcccgtgttcgtgatgggaagccacaacggggccagcatcgcgttccgcgccgcgctggcggcggcggacgccggcgtggagctgcgcggggtgatcctgaaccagccgcacctcggcggcgccgagaggtcgcccgcggaggcggcgtccgtggacgaccgcgtgctgccgctggccgcgaaccacctgctctgggagctcgcgctgcccgtgggcgcggaccgggaccacgagtactgcaacccggaggccatgctcgcccgtgtgggcgccgcgcggctgcggaggctcccgccctgcctggtgctcggccggcgcaaggacccgccgagggaccggacaaggacgctcgtcaacgctctgcgcaaggccggggtggccgtggaggcgaggctcgacggcgctgggtaccacgcgatggagctgttcaaggccaactgcgccgcggagttcaccgcgcaggtggccgacttcgttcgccgccactcctctgccgacaccggcgccagcgccagcgccggcgacgtggttggtatgagcaagctgtgacgcatggtcaaaccgatcgggccgcagtggaggttgctgtacggcaactttggtgcaagttgaaccgatttttaagggccacttatcaatcatattatatcatatcatcatcgtca

SEQ ID NO: 610 - DNA, 520 bp, Sorghum bicolor
  Clone ID: SORBI-28MAY03-CLUS119273_1
gcgatgccttcggccgccgcggccgccgcggcgcctctccaccgcatcgcatgcgcgcgtcagcgcctccctcaaacctccctcttcttcctcccaccccgcgcgctccccaattccgggcgcctcaccgtcccggccccgctgcccgttcacgcgctgaggctgcctccgacggcgacgagggcggcaagccacgacgccgccacgggcgcgagatcgcccacatctggcggccagatgttggtgttcgtcccgccgcacccgctgataaagcattgggtctccgtgctgcgcaacgaacagacaccgtgcgccatcttcaagagtgccatggcagagcttggtcggctgctcatatatgaagcatccagagattggttgcctacaatcacaggagagattgaaacacccgtagctgtagctagcggtgaatttattgatccaagagagcctgttctggttgttccgatactgagagctggtcttgcactagctgaacttgcttcatcagttctgccag

SEQ ID NO: 611 - DNA, 542 bp, Sorghum bicolor
  Clone ID: SORBI-28MAY03-CLUS118420_1
ggagaccattctactcctgttgaatatggtgatcatagcttcgaacccgtcccatttgcaatatgcagactcagagattatgcagcagccattggggaggataatgttataaatacacaacttgatgatttccccctcccttcagtaaaatccggagaagatttgcttgacgatatagaatcaccggagcgcaagcctgatcaactcaaagctttcagtggtgatgctgtgtgtgagttcaacgaggttgccactgcaaggggctgccttggacgattccctggaagtgagatgatgggcatcatcaagaagtttatcaaggcgaagaatgattaatgttggttcaagtgctaactgtttgcgtaatctattgaccataaggctccacttcatgtaataaactaatcgaatgtgggaacatggaagaaccatcttgatctgagatgaataagagatgccttggtggaaaaaaaatgatatctgctcatgtaaattgtacccagtgttgggtcgctttcgggccacatgaatgagattttgat

SEQ ID NO: 612 - DNA, 517 bp, Sorghum bicolor
  Clone ID: SORBI-28MAY03-CLUS11928_1
gagaatataaagctgcaataaaagattatgatgatgtacttgatttggaacttgattccatggataaatttgtgttgcaatgtttgtccttctaccagaaggaaatggctctatatattgcttcaaaggccaatttggagttctctcagttcaacattgatgatgatgttgacccactatttaaggaatattggtgcaaacgattacatcccaaaaatgtggctgaaaaggtttatcgccagccaccattgcggatctcattgagaaatgggcgccttaacaagcaagacttcaaattcacaaagcatcaaacaacccttcttctagctgcagattcaattgggaagaagattcaatacaattgccgtggcttcttaccaaatcaacgtcagtaccgcatggctgggttggctgctattgagattgctcagaaagtgtccaaggcttggcgctttctaaggaatccgaagaacattgcaaagttagttaggaaaagggataaacttaacatgagcca

SEQ ID NO: 613 - DNA, 581 bp, Sorghum bicolor
  Clone ID: SORBI-28MAY03-CLUS119295_1
ctgcagtgactcaccggtgtaatgatctgttcttggtgtctttcgcgtcttggctttccatgtgatacttccgtgctctgtatataacagcttctcaagcttcattcagtctttcctagatctctcacgatggaggcaccgatcatgatgaagcagtacgacactgctccaaaagcagccctccctcatgatcttcccccgaccgagctctccgtccccggccccgactcagtcaccctcgcaaagaagcgctcccaatggtcctgcatcgacgacaaccgcctccgaaacaatcttttcgccgccgtcggttttctcgaactcgccaacgcaggcgactttgccgccaacgtatggaacgacgtccctgtccccatctacgccatcgttttcatggcaatcggcggaacatctgcattcgtcctctcaatctgcgcattttttgattcgagacaggcgtggcggaatattaagttcttgcgacagcagaaacaataccttgaaaccgagaaggagaatctacacgctggagcggactcgagaggtcttgatgttttcatcgagatcacaacgagggaact

SEQ ID NO: 614 - DNA, 647 bp, Sorghum bicolor
  Clone ID: SORBI-28MAY03-CLUS119303_1
tcacaagacctcccggagatcgaacgagaagagaaggcaaaccgaagcgcaggggaggcgcaccgctccgctccgggctggcaatgtgatggcgcaacagcggcagcaacgcaggcgcgggagcggcgccgtcctccgcctcgtcgcggtgctccttgccctgctctcgctctgcctcgcccgcgccgacgccatggccgcgccttcggcttcgacctctctcgcgggtgctgctcctgcctcgttctcggagcatggcgtggcggccgcactggagaatgctctagcacaggaggtggcgcgcgggcactcgacggcggcggcggcggcggcagaggaggacggaggcgacggagacgtggtgctggagagggtggcgatggagtcgaccgaggactacagcttccccggcgccaatagccggcacgtcccgcacccgtgatcgccgaccaccggctggatcgccgccggccgcatgggatgggacccagaccaatcaatcacaggagctgcttccaaccagtgacatgcaggggcaagcagggacacagcgggaagagcagtgtagtcgcagtaaattgtagttcgcgcgtggctactcaagtaactcagcaatcactttgtttgtaaaaccccttttttatttt

SEQ ID NO: 615 - DNA, 329 bp, Sorghum bicolor
  Clone ID: SORBI-28MAY03-CLUS119412_1
gaacgagggccgcctcggccatgtgcacccccgctgcggtccgcggccgcgtgcgcctcaacgttggcgggcgggtgttccagacgacggccgccacgctcgccagcgcggggcgtgacaccatgctgggcgccatgctggacgcctcctggaacgcctgccgtgacgacgcgatcgacggaggcggcgctgcggccgagtacttcatcgaccgcgacccggcaagcttcgcggtgctgctggacctactccgcacgggcgggctccacgttccccctggcgtccccgaggcgactctgtaccgcgaggcgctctactacggtctcctg

SEQ ID NO: 616 - DNA, 818 bp, Sorghum bicolor
  Clone ID: SORBI-28MAY03-CLUS119450_1
gcacgaggcaaagacagagaagaagaaaagactatttttcaagaaagcagaaaacccttctcctgcatatgctttgggtgaaattgaggaaggtgctccaggtgctgacgttgagaaggctggaattgtaaatcaacagaaactagaaaagaaatttgggcagtcatctgtttttgttgcatcaacacttcttgagaatggtgggaccctgaggagtgcaagtccagcttctcttctaaaggaagctatacatgtaatcagctgcggctacgaagacaagactgactgggggaaagagattggctggatttatggatcaattacagaggatatcttgactggatttaagatgcactgccatggttggcggtctatttactgcatcccgaagcggcctgcattcaaaggttctgcacctctgaatctttctgaccggcttcaccaggtccttcgttgggctcttggatctgtcgaaattttcttcagcaagcactgcccactttggtacggatatggtggcggcctaaaatttttggaaaggttttcttacatcaactctattgtatacccatggacatccattcctctcttggcttactgtaccttgcctgccatctgtctgctcacggggaaatttatcacaccagagcttaccaatgtcgctagtatctggttcatggcacttttcatctgcattgctgtcaccggcatccttgaaatgagatggagtggtgtggccatcgatgactggtggagaaacgagcagttctgggtcattggaggtgtttccgcacatctcttcgcggtgttccaaggcc

SEQ ID NO: 617 - DNA, 948 bp, Sorghum bicolor
  Clone ID: SORBI-28MAY03-CLUS11947_1
aaaggattatgacgaggataccacgtttctgtgcagagtctctctgatagatatagattgcaccagtggttggtgttatcttggatgcgatacctgccaaaagtcaatgggcagggccccaagaaagtacaggtgcagccgttgtggcccgattaagaggccaattaactggtacaagctgaagacgacggtgaaagatgccacaggcacaatgaccttgatgatcttctgtgaggtggcagaggagctggttggtgtctctgcagaggagctcgttgatgagatcgaggatgacgaggagtggtacaccctgccagaagaaatcgaggatcttcttggatcgacccgcaccttccaagtattcgacaagcacctaagcgggagcttctctgtatatgcaatcatggacgatgatatcgtcccagtccctgctgcaaccactagtcaatgcaaggaggagagtgtacctgagggcagtgttaacgctgcattcccttctccagccactactctatgcaaggtggagcctgtccttgaagacagtgttggcatggcagcccctgctccaaccatgactccatgcaaggaggagccttttagcatggtagtccctgctccaaccacgaaacatgaatgcaaggaggagccattcgttgaacagtgttaacattgcagtccctctgccaacaactactcaatgcaaggaggaggagcctgtccctgagggcagcgctgtcacgggagaagcaaggttgaagtccactcgtctccagaagcctaacaagcgtctgcgaggggatgactggatcaactaactcgtcgggccacattcacattcagagttcagacactgtgactcatttagcgtactttaggttaatgcatcctctaggatgggtcatgttctcttctagtacctgggaacaattgtatactactgctagtacc

SEQ ID NO: 618 - DNA, 706 bp, Sorghum bicolor
  unsure (1)..(706): unsure at all n locations
  Clone ID: SORBI-28MAY03-CLUS119492_1
cgccaaggacgccggccagcggggctgccgcgccgcgtcggcactcgagtactccgaagaccaagagcgtgcccatactgatgatcgcgaagaaatgctcaagctgccccaggggctgggcgcccgtgtgcgtgctacgggatggggggaaggggtctcccctccgccgagcacgcacgggctcggacactcagccgtcgccgtgccagccgaagaagtttgtgaagaagcttttccagatgacttcgtacaagtcgagaacccctcccgaaactaaagctaccccgccccaggatccatccaaggatgccttttgcaaacaaagaacagcccacaacagaccatggcaagaaattggacatgtgttccactgaagtgctggtttctgatgaggaggattcagaagtgccgatcactgttcatcacccactgaagaaagttgccaagggtaggaaagcttatggtcatggaaaaagagaaagattccctaggatgcttaaaaagattgaaaaggggttctttaacggttgatgctccatagggcactgtccggctcttcaaccttgatccgacttaagacccacctactgaaactgatctatcacagggatagtagttgatcaaacaatagaataaaaatcatttgttcctaagtttgtcctacgagatatgattgttcctatagagaattcttttgctnttagat

SEQ ID NO: 619 - DNA, 820 bp, Sorghum bicolor
  Clone ID: SORBI-28MAY03-CLUS119494_1
gcacgagggagagaaggcggacaagctggacgaagacctctcgcatgtcgaaaagaccgtagcgcgggtcgcacggcgagaggcggacctagagacggactatacggacctagcaacgcagttccgtaagcttgtcccacttgagcctgcagtcgagatgccactgcaggtgtttgcagcctctgtagaggaaaccgcacgcgggatgcacaatttgaaggatcatactgatcagaactacctcggctcgctacgcgatatggaagcgtacatactttccgtgaaggcgttgttgaagacccgcgaacagaaacaactcgactttgaagctctagtggattaccgcaacaaggctgtcgccgagcgtgactcgctcgctgccaaccctgccgcctactatgcctccaacccgcttacatcttcgccagcctccttcatccgctccaagatggaggatatgcgcggcgtcgaccatgaacagtctcgccgcgagcgtgttcgcaagctcgagctgcgtatcgatgaactcactcgtgaagttgagtctgcgaagaccacttcggagatgttcgacgaagaagtcgttcgggaagtagcagactttgagcgcatcaaggcagtggagttccgtgactctctcggcgcccttgccgaggcccatatcgacttctaccagggcgttctgtctacctgggagcgattcattgccgaaatggagggcgaatgctgagaccggccttgacgcggactcccacgccgttgggtcacggtaggcttagcgagtatggatctgagccaaaggagggggggtgggggcaga

SEQ ID NO: 620 - DNA, 744 bp, Sorghum bicolor
  Clone ID: SORBI-28MAY03-CLUS119512_1
cgcggccgttcgacgaggccgcgtcgttcctgagcagcatccaggcgcagctcagcaacctctgcagcgccggcagctcgccggcggcgaccgccacgcactccgatgacatgatggggtcgtctgaggatgagcagtgctcaggggacactgatgtgccagacatagggcaagaacatagctagcgcttagctgaccacgaactcaaggaaatgcttcttaagaagtacagtggatgcctcagccgtcttcgttcggagttcctgaagaagcggaagaaagggaagctaccgaaggatgcacggacagtattactagagtggtgcaacactcactaccgctggccttatcctacggaggaagataaggtgaggcttgcagcgatgaccggtctcgacccaaagcagatcaacaattggttcatcaaccagaggaagaggcattggaaaccatcggaggacatgcggttcgcgctcatggagggtgttgcgggtggatcttctgggacaacactctacttcgatacaggcacaattggaccctgaatcacacaccacttggaatgacaattggccaactcaatcagtagtaagacctggcatgtgaagtgacgatctgcccggtcaaaattgacaataaatctgttgggctagaggttgatcagattagtcagttgccccattattttacaagttcatgtgtatatggtgccatcgtatcaaaacaaactgtatgtatgggcgg

SEQ ID NO: 621 - DNA, 424 bp, Sorghum bicolor
  Clone ID: SORBI-28MAY03-CLUS118811_1
ttcggcacgaggggcgtgtatcgcacagagccagggagcaagcaaatttgatcgatcgatctatggtgttgagggcttgcgcagtaatggaggcgggtactttcagcgtgccgttttacgagtggctcaagccacgatcgtcatcgtcatcgccgccgccgtcgccgtcctcctcctcgtcgacgacgtcctcgacgacgctctcaacgccatcgatcgaccaattagccgccgttgatgagcgccacgccatgacgtgcttgccgcttcttggtaggcttgaagggagggcagcgactcctgatcatggccataataatcctatcaaagaagagctgctgagcaataatatcgctaccaccggcggcgccacgcggagagaggaagccgccgccgctggtgttgacctgaacatcggcttgcc

SEQ ID NO: 622 - DNA, 900 bp, Sorghum bicolor
  Clone ID: SORBI-28MAY03-CLUS119624_1
gcacgaggccgcctccgatcgcgccgtccccggcgccgacgcgaccgaggcgtcctccctccgcctccgccgcgccccctcagccgacgccggcgaccttgccgacgattcctcaggagaccggcgggagaacggcgagccgcaaccgccgcaggagcagcagcagcagcacgagatgctgtactaccgcgcgtcggcgcccgcccaccgccgcgtcaaggagagccccctcagctccgacgccatcttccggcagagccatgctggtcttctgaatctatgcatcgttgttctgattgcagtgaacagcagactcattattgagaatttaatgaagtatggcctattgataagagctggattttggtttagtgcaagatcgctgggtgactggccccttctaatgtgctgcctcactttaccagttttcccacttgttgccctcatggctgagaagctgattagaagaaagctcattggtgaacatgtggttattctactccatatcattattacaacatctgtcattgtctatccagttgttgtgactcttaatcggtgagatatacgtgcgactcagaagtagatctttgaaggtttggacttgaagaaggatctgagtttaagattgcaagcttggaaaagagtttaggcttgtgctcaaccagtcagttgtccctgtggatttggagctttcgcctgaagaacggagtgtctttccgctgtttgctatctaagcacgacttcttcgaccacggctattgtgcccttacgctcggctacctcaacattggcagaaagggctaccaccttgcatgaggactcatcggcttcttctccagccacagcatacacggcgcatcgactgctatgactgcgggggatgttacttatcatctt

SEQ ID NO: 623 - DNA, 643 bp, Sorghum bicolor
  unsure (1)..(643): unsure at all n locations
  Clone ID: SORBI-28MAY03-CLUS11965_1
aacctgaaatacgtcttgtgtttgcctctctgttattggagacagtcttacgtctctctccctctccctatccctatccctctctcacccgacctgacgaggcgacagcggcgtccctcagaggcggcgccgcagcggcccagcacggcggcccgcgcggctaggccgcaaccggtgcggccatcctcttcctcttcttcttcctcctcctcctcctcctcctcctccctcgcgtcgcggtgttgcagccagaccccccgttgccggggattgacagtgtcatgaacctgcggcgctgcgccgcctgttggccttcggcggtgctcgttccggctgctgtgccgcgtgagcgtgccttgctggtcgccgccggtgttcctcccacctcgcgccgcctcctcctgtcggtccacctctgctactgtgctacacgaaaccctagctgatgttgctccgcgaaccacgcctcgtgctgcatcagcggtggtagggaacgcccccacagcgttcggcgctgtgttgggaaaggagggaccacacatcgagcccacctcggtcaggtgtggtcatctgtcccatgcctnctcccccagattatgcattcgcacagctgattgggggtgctacagcctgcgttacctcc

SEQ ID NO: 624 - DNA, 609 bp, Sorghum bicolor
  unsure (1)..(609): unsure at all n locations
  Clone ID: SORBI-28MAY03-CLUS119688_1
gcacgaggcagacatccactccattcaactttattgatataccgcctccacctacatccccctaaacaactccaatacctctttcacactcatcttacgaaaccataaaatccggtcgaacacgtcgattgtatcaaccagcaacatctaaactccctcaaccacatatacacatcatgcctgtccgcgttcccaagctccccgctgccaagccctcggaaatcttctgcatgggtgcggccggtgttggcgttttgacacctctctatcttgtcatgcctggggctgaggagcgcttatccaaccagaccaataagtgggctccacgatgggagaggaacgtcagctacttcattcctcccatggagaagggcgttcaacgcatcgagcctcctgtgtccagaatggtccaacgtgtggaggaccgtcttcccctcgaaaagatggccaagtcagtcgacaagggtatccgaagtggtatcgctcgattcaatggcgagaataagccctaagaacaaatttcatctgtctgcgaccagccttaactgccagggtctttcctttgtacattaccattagcataccccgggtagatgatacgtcgtncac

SEQ ID NO: 625 - DNA, 580 bp, Sorghum bicolor
  Clone ID: SORBI-28MAY03-CLUS11971_1
gctctgactcacttgttggaaggccggcatgtggttgaagcaaatgaagactactccaatgatatggatctggacataaaaccaaagttctggagccagctgcagagcctgctgaagaggatgctggtgggatccctgcctagcagcacaggcagagtagtttcttctgtcagccaggtcagcactaacaacagaacagaagctgctaagctgaaagagatgtatcgtttgtcgctcaaatcttctactctgggccagctgcatgagttgtacaagctttgggtatcttagcaccttcacttgacaaatggttgctgctcatgttttatgtcgtcggcatctgtctcttgaattacacagtttgtatctggtgatcacggcacgcttttgtttgttttgatttctagtcaagttttgaagctaaatacctgtaggctgtagtgtacatttaagtgtaaccatggtatgtcagggaacgggaaacactagctactgcaactgtgtagcagatttgtataaatagcaaataatggcatccgatgtaaagcacccagtgtattatatatgtattgtagatgtc

SEQ ID NO: 626 - DNA, 820 bp, Sorghum bicolor
  Clone ID: SORBI-28MAY03-CLUS119716_1
gcacgaggctgacactaacagcagtgaccgtgagcaccgccaccgccaccacccaccacctcatcaatggcggcgttggcgttggcgttcctagcgctgacggcggtgccggcggtgctgtgccaggcgccggggccggcggcgcccaagggcccgccgaacgtgacggcgatcctggagaaaggcggtcagtacaccaccttcatccggctgatgaagtcgacgcagcaggacacgcagctcaacagccagctgaacaactcgttcgggagcgggtacacggtgttcgcgcccaccgacaacgccttcgccagcctgaagccggggacgctgaacaagctgtcgcagcaggagcaggtgtcgctggtgcagttccacgtcctgccgcagttctactccctcgactccttcgagaccgccagcaaccccgtccgcacgcaggcgtcgggatccgatggcccctacacgctcaacatcaccgccgacagcaacagccaggtgaacgtgtccacgggcgtcgtcgccacccgcctcggcaccgcgctgcgcgccacgcagccgctcgccgtctactccgtcgacaccgtgctgctgcccaacgacctgttcggcgtcaagcccccctcggcggcgccgcccgcacccgccaagaagaagccggccaaggggggatccgtcgccgaggcgccctccgccggcgactcggccgacgcgccgccctccggcgcggccgccgcgcgtgccggatggagctcgctggccgctctgctcctcggtgccgcggcctgctccaccctgttggattgtgagaagtaaacag

SEQ ID NO: 627 - DNA, 686 bp, Sorghum bicolor
  Clone ID: SORBI-28MAY03-CLUS119770_1
tgtcttggcagtctatcaagcagaaagtagtggcactctccagttgtgaagcagagtatgtggctgctactactgctgctacacaggctatgtggctgtcaagattgctggctgagttacttggaagacccgtggatattgttgagctgaaggttgacagcaagtctgcactggccctagcaaagaaccctgtcttccatgagcgcagcaaacacatcagaatcaagtaccatttcattcgaagctgtctggcggatggcagcatcagggcagagcatatctcaactggtgatcagctggctgacattcttaccaaggcattgggcaaggccaagtttgaagagctcaggggaaggatcggcctggaggcaatctcagcaaaggagatcaagaccaagggggagaactgatggtagttggtcatgtatctagtatagcagggcctaagtattgtccactgcacttttgcttttacttctctgttttaaatcatgtggctgtaataggcttgcttgggggtcaagaagataagacccttggcagccaagttaactaggaatctactctagaatatgcctatccaagaggcagccctcagcctataagagctggagacagggcaaggggttttcttgtaaccgagatccattttgcaattcaatcaaaaggccatagcaggcaaacgc

SEQ ID NO: 628 - DNA, 622 bp, Sorghum bicolor
  Clone ID: SORBI-28MAY03-CLUS119791_1
cacgaggacgtagcactacagttgtcatttgctatttggtgcaatataaaaacatgactcctgctgaagcttatgaacatgtccgcttgcgtcggcctagagtattgttagctcctgcacagtggcaagctgtgcaagagttctatcaactaataagagtgaagaaaactgggagatctagtcgcctggacaatcctttaatcaagccaccgttgttccttgccactcacaaccttgttgcctttgatgatagcgcatttgtgatggtctcagaatcagacctcgaagggtataattcggatgcactggcactcaacatgggcagtggattgtgggagataagcttgatataccgtgtccagtttgcgagcaaggcagcttttgctgggttttcgtatttgtggcttcgatgccgtgcctgcaaggaggctctacctgagaatgtggggagagagagctgctctcttgaggttgagcagctaacaactggccatccctgtctactgcaaggtgtcgtggttaatccatgactatcgagtatttgtttttgcccttgcacctgtacatattaaagagaaggatatgcaatgtgaatctgtaacgtgggtccgcagcaaccaaa

SEQ ID NO: 629 - DNA, 632 bp, Sorghum bicolor
  Clone ID: SORBI-28MAY03-CLUS119939_1
gcacgagggagcaatcattttcggccctcaagcaagcactgacttcacctccagttttggccatgccaaatttttccaagccctttgtcatagagactgacgcaagtggaacaggtgtgggcgcagttttgatgcagcaaggtcatcctctggcattcctgagtaaatcactgagtcctcgcttgcagggtctgtccacctatgaaaaagagtatctggcgattctaatggccgtcgagcaatggcatagttacttacagctcgctgaatttcagatactgacagatcataagagcctcgtgcaattggaagaacaacgtcttcatactccatggcagcaaaaggtttttactcgcctccttggcctgcaatatcgtattgtgtataagaagggcgtggataatggagcagctgatgctttatcgagagctccagcagtgcaatgtgccgcaatctctatctctcagcctcaatggttggttgatgtcctgcagtcttatgaaaatgaccctatggctcaagaattgttgaccaaactaacagatacctctgtgccgacacctaattatactctgcagagtggccttattcgttacaagggtcgtttatggattgggaatgatgctgcctta

SEQ ID NO: 630 - DNA, 898 bp, Sorghum bicolor
  Clone ID: SORBI-28MAY03-CLUS119952_1
cacgaagccgacttcctaaaggagactggataccaaaaccgaccacagacttccgcagttcaaaagggcctcaatacggagctgggcctcttcccatggttgaagcagcagccagatctgttgaaggactttcaaagcctcatgggtattcccaaagaaggcaactgtctcgatgtgattccgctcgaatctgccgtgatcagcggccacaaaggtccggtatttgtagacattggtggtaacactggtcatcaagcaaagcacctactgtccaagtatcccgagctggcggatcgagtggtggttcaggaccgtgaggagactatcaaaaacgcttccgattccaaaggattccagctgatggcgcacgacttcttcaacccacagcccgttaagggagccaagtactactatctacgtgccattcttcacaactgggacgacgataaggccgctcagatcctgtccaatattgtgccatccatgtcggctgattcactggtgttgatcgatgaggtcgtcattgcggatcaaggacctcacatctggcctgcaggccttgatttacagatgtacacactgtttggctctgctgagcggacagcttcacagtgggattctatccttgatcgcgctgggctccgcccagtagcagtcaagaagtatgcaccagtcatgggaagttctgtcatctttgctgcaccaaaaattgcggacgcaagcctgagtgaacagcattctttggtagacacatatgtttcccagtccacgacggttacatgcaactgaggtactgcagtcgcctgactttattggatatttgcctggtcaaagtggatgttggaagaagcgcaatgttattaccctatgctgaggtagctctcaatacaaatttagc

SEQ ID NO: 631 - DNA, 704 bp, Sorghum bicolor
  Clone ID: SORBI-28MAY03-CLUS119277_1
ccggtagagtattgactagagcgggaggaaagagcatctccaatccaacgccggcgccgagggagaaggaaaggaggggaacgatcggaacgagcatggggaagggcgtcctggaagtgcacctcgtcgacgccaagggcctctccggcagcgatttcttagggaagctggacccctacgtgatcgtgcagtaccggagccaggagcgcaagagcagcgtcgcccgagaccaagggaggaacccgtgctggaacgaggtgttcaagttccagatcaactccgccgcggccaacgcgcagcacaagctcatcctccgcatcatggaccacgacaacttctccagcgacgacttcctcggcgaggcgacgatcgacgtgacggacatcgtcggcctgggcacggagcgcggcacgtaccacctcaacgcggccaagcacaacgtggtgctccccgacaagacgtaccacggcgagatcaaggtcggcatcaccttcaccgccacgcaggttcaggaagatggaggagccattggaggatggaggcacagtagctttaatcagtgaaaggcggcgaaggccgtggtgatgaactctcaaaagttctttggttgctactagcttggtagtgttttagttgaatgtatagttttgtttatctccacgagcacatctgtaattatgtattgaagagtggttaaaacggac

SEQ ID NO: 632 - DNA, 568 bp, Sorghum bicolor
  Clone ID: SORBI-28MAY03-CLUS119968_1
cccccctcggcaagatcagccacccgctcttagcacgtcacaagacctttccccagatctcactttacctgatctgccctgccctcccctttagcttctctagctcctccatcttatcttcttgtcttttgactcccgttcagccctaccatttctctttccaccacatccatcatgggaaagacggcgattcactttggcggtggcaacatcggccgcggcttcgttgccgagttcctgtacgctgccggctatgaggtggtcttcattgatgtcatggataacatcatcaatgagctccaaaagaccaagtcgtaccaagtcaccgaggtcagcgaaggtggtgagaccaccaagaccatcaccaactatcgtgccatcaactccaagacccatgagcaagacgttattcaggagatctccactgccgacattgtcacctgtgccgtcggccccaacattctcaagttcattgcccccgtcatcgccaagggcattgacatccgctcaacccccaagccactggctgtcattgcctgtgagaatgccatcaatgcgaccgacactc

SEQ ID NO: 633 - DNA, 458 bp, Sorghum bicolor
  Clone ID: SORBI-28MAY03-CLUS119986_1
cttacaggcttgagcttccgccttcatccactgtgcatccagtctttcacgtttcgcaactgaaaaaggcagtgggtgctcgccatactattactgcaactcttcctccagcgtctgcccaatggagcattcctgagcgcatcatccagcgtcgtcacgtcgcacgtggtaagaagttcattcagcaaggtcttattcagtggtctaacatgcccgtttctttggccacttgggaagatctggagcatctacgccaccaatttcctcgcgccagtttgtgcaagcaacatggcgcggaagggagggagaatgtcagcgccactccagctcacaatgatcaggcgtcaagctcgacttcagcaacacctaaccaaaacccaacagcagatgcacgggcttctgatgggctacacaaagcccggccaaagaggtccaggaccggcaacccgcgatactcc

SEQ ID NO: 634 - DNA, 609 bp, Sorghum bicolor
  Clone ID: SORBI-28MAY03-CLUS120002_1
agaagaccattgccgaggcaatgcacgactcgtacatccgcggcgtcgtccgcgacgtgctcaaggagactgcctccctcatcatcgacaagcacgagattgaggcccaggagcagcaagactatgtcgagaccatcatcgcccgtatctccaacccctacctggaggacagcgtcgagcgtgtcggtcgtgcacccctgcgcaagctgagccgcaaggagcgtttcatcggacctgctgctcaacttgccgagcgcggcatgaagtacgatgccctcctgggctccgtggagatggccctgcgcttccagaacgtccaggacgatgaggagagcgtcggcctagccaagattcttaaggagaactcgcctgccgacgcaactgtccaactgaccgggttggagcgtacacacccactcttctcggccgtcgtcaaggtcgtggaccaggtgcagtctgaggccaaggaaaccggccagcctcgcatttaggcgcgtttgcaggtttcaaacggtctacatctttttatctcgcatgggttacggcgaatacacggctgtattatggaattatggaacgggattgagccttttattgtttattaggtat

SEQ ID NO: 635 - DNA, 576 bp, Sorghum bicolor
  Clone ID: SORBI-28MAY03-CLUS120036_1
gagcagacccggttcgccgacgccgagctcgtcctcgccgacgtgctcgccgggaggtacctggcgcgcgaccagcagcaggacggcaagatcgtccggaaagtggaggagctgctggcccggatcgtggcgcagacgtggccgggcggcggcgccaacagcggacgccgccgggacgagagcgggagcgagagcgacgacgacgatgactgggtcgagaaccagatgttggctctcctggacgtggcggtgccgtaccggaagagcagcaagaggctgcccgtgttcgaggagatctcgcctgtctacagggagcaggtggcttgctagaagccatagatcagtagcagcagcatgttttagggccgcgggagtgtgtgtgccgatcgagctccatgcctcatcgagtctcttgtccagctcgagcttttggatgaactccgtggcgctagcagtagcatcagcagcagaaaggtaaagcgtacaagtgtgtgtgcgccttgtgaatctgtggagctgatgagatagcagtgtgcagtagcatcagcagaaaggtaaagcgtgtgtgcgtacagt

SEQ ID NO: 636 - DNA, 502 bp, Sorghum bicolor
  Clone ID: SORBI-28MAY03-CLUS120063_1
cacgatccgagcgcacgccggacggttttgcggcttcccaacatcgcctccgtcctctccccgtccgtcgtccaggcctcagggcgccctcacaggctccagcagacggttttcgctgcgtcctcctcgcgcgagtccgtcggcggaaggtgcctccgagcgtcgcgagtccggggcgtcctccgagcgtcggcggaaggtgcctccgagcgtcgcgagtctgtcggcggaaggtgcctccgagcatcgctgcgtcatcctttcgtccgtcggcggaaggtcgtcgcgagtccggggcgtcctcctcgcgcgtccggggcgggaccgtgcctccgagcgtcgcgagtcctgggcggtctcctcgcgcgtccgggcgggaccggcggaccgcgcctccgagcgtcgcgagtccgcggcgagcggccggtctccgcgcgcgtccgcgccgggccgcccctccccgcgtcccgccgccccggtacgtgcctccgcgcgtcgcgcg

SEQ ID NO: 637 - DNA, 666 bp, Sorghum bicolor
  Clone ID: SORBI-28MAY03-CLUS120067_1
gagctgcggcgagaaggcggcggcgctggccgagaaggaggaggccgtggaggaagaggagacgaagaaaatgatcggggaggacaacggcgcggcggcggtggaaaccgacggcgcagccgagaaggagagcccggaggtcgtggagctgaaggctaagctggcggagaaggacaaggagatcgcggcgctcgcggcggagaatgctgagctgaagaagcaggccggagaggccgcggaggcggcgaagaaagccggagaggacgccgcgtcgaaggcggcacaggccgagcacgatctgaaggagggcgcggcgcgggaggcccgggtgggcgagcagctgagggcgtcggaggcctcgcgggaggcactggacggcgagctgcggcgcctgcgcgtgcagaccgagcaatggcgcaaggcggcggaggcggcggccgcggtgctcggcggggacaaccatctcaccggactggccggcaacggcaacggttggggttcccccgccacgatgcccgacgacggcgacgacgagggcttcggtggcaagcggaagggcgccggcatccgggtgctcggcgacctgtggaagaagaaagggagcaagtgatgaagccttgccgcggaaggggggatcgtgtctcgaatttcgcaatggtgagctcg

SEQ ID NO: 638 - DNA, 702 bp, Sorghum bicolor
  Clone ID: SORBI-28MAY03-CLUS120119_1
caccgctgtccgcttccacctctcttctcttcctcttcttccttgctccaccggctcgacgctagcgcggcaagaatcgcggtgcctgtgagccttgttcggagaagagctaaccgatgcagctcaggctgtgagagctgcggtttacagaggatgggagaagcaggggaggaagaatccgcggccgcgccggcggaggtgagccggcaagcggagctggacgagcagcgccgcctggtggaggcgctggaagccatcagttcgttggtctctgcttccttgtccgcgacgctcttcccgctcaagtggcagctcatcagggaccggctcaaccgcctccacgccggcctcgccgacatcaccgtcccagtgggcgacgagaacggcgaggacaggtgcgatgcgttcgcgaacctcctgcgggacgtcgcggcggccgcccgggaggcgcgggagctggtgccgcggagccaggggcggcactacggcggcggcaagctgcggctgcgcagcgacctcgacgtcctggccgcggcgctcgacgcgcacgtggcgcggctggacgaggtgtacgcgtcgggcgcgctgacgcgggcgcgggcgctggtggtgccgcgccccggcgccggggccacccgcgacgacgtgcggttctacgtgcgcgacctcttcgccaggctcagggtcggcggcgccgagatg

SEQ ID NO: 639 - DNA, 463 bp, Sorghum bicolor
  unsure (1)..(463): unsure at all n locations
  Clone ID: SORBI-28MAY03-CLUS120121_1
gcacgaggcacgtcacggtggcgttccgcccgagcatgccggaggcactgaggatgctggagggggacatggacgtgcccgacctgccggaccggccgcagccgttcggccagaggattgcgttcgacgaaggcgaaactaatttcagcgcatcatcgattctgagcggcggcggcggcccactcgtggactttggagacatgctccggtgatgcacgacggcgatgatggatgcgtgcaggttgcaaggtgaccgacgtgtcaggtcgggatcacacgtacgaactcttattataagatgcgtaacatccacagttccacatgctatgctacactgatgcaagtgttggttaactggatttcagagtgatgtatagccttttcagcntaatgtaaatgcattatatgtaacatatagtgaaaactcaaatacgtgtcattgacactccgacacaaatattac

SEQ ID NO: 640 - DNA, 591 bp, Sorghum bicolor
  Clone ID: SORBI-28MAY03-CLUS12024_1
gtctctctcccggtctcctcctctccttcttcgacgacaaggcgggctaccgccgccgccgccgccctacgcaggtgccgaggccttcaccagtctcttcgccgtcgacgagcactcactagagatgcaggatagaatgagacggcaggggcaatacggtgaagcagatatcaactccatggttgctgcccagttgcatcactaccaggcacagcaaagggtacagcagcaccctgagaatagctacagtggaagagaccctgcacaagcttctggggagcatcagtacactcccccgaaggtgagacagagtcaatgggatcgaggtggaccaaatgtcccaagccaggttccatcgtatgcatataacgaagcccaaggtgctggaggtgcgcaatccttttacgatggcaagagatctgattcaaaggttggtctagagaagcagcccagcaaggaatctagggaccaacctcgtactgatcggactgaaacaagatacgagaattataatcttcctcggacttttgaaggtcttgaacaaagttttcacgaagacattattttgctatccaaggaactacaggatgc

SEQ ID NO: 641 - DNA, 1032 bp, Sorghum bicolor
  Clone ID: SORBI-28MAY03-CLUS120247_1
gcacgaggcttctttcagcaattaaatcaaagaccagagagaacaaagctatactgctggtagtaaccatgtccgctaccgtcaccgaaaccaccactaaccccgtccccgtcgtcgtagcggccgacaacaacaacaccaccagcaaaacccacatcgaagatgccgccaacgacaaggacttccagtccgtcgcacggggaaaccgtgccggaacgctcaagctacgaggtattccgacctttagtgaccctgctgctaagcggcagtggatgaaggagcatatggctgctgcattccggttctttggcaagaaaggatatggggagggtgtgtcggggcatatttctatgagagaccctattctaaaggaccacttctggatgaaccccttcgccaagcacttctccaccatcaaggcatcggatctcgtccttgttgacgcagagggatatgtcaccgagggcggtgctcagctacctatcaacgaggccggattcatgatccactcggagattcacaaggcccggccggatgttattgctgcggcgcatacgcattcaatttatgggaagacgtggagtgcgtttgggaagccgattgagatgcttactcaggatgcatgcaacctctacggaaaggtcggtgtctatgaagaccacggcggcattgcccttgcgcaggaggagggagagcagattgcccgtgccctaggcaaggacaacattgcttgcattttgcagaaccatggtcttctcaccgtgggccgaactgtcgacgaggcggccttcctctacttctccttggacaatgcctgccacacacagttgctggctgaagctgcggccgcgaatggtgttccgaagagaatcatctcgaatgaggtagcgaagtatactgctgatgttgcgcagaatcatcacaacttctataccgaattccagcccgagtacgagttgatcgttgaagagactaacggaagggtcctgcaataaggaacgagttatctgctagcaaaagtgtaccatagtt

SEQ ID NO: 642 - DNA, 498 bp, Sorghum bicolor
  Clone ID: SORBI-28MAY03-CLUS119636_1
cgagcatctcaaggaccgcttcctcgccggcggcctcgagctcaggatacgggccgtgtaccaccggttcctggacctcaacgacacgacgctggcctggatgatggccatcgacgcctgcttcctgctcgacttcatcgagaactaccgccgccgcgaggccacggacgtggtgtcctcgtcggccaactggatcaacgccgtcgtccgcgacgccatgatgctggagaaccagatcccgctcttcgtcttcgccagggcgctcgagctccgccacagcacccgccacgaggccgccaaggccctgcacgccgtcgtcttccgcttcatcatggacgtgtcccccttcaagaacagcgctagcgacgccgccaacaataagcgcggggcggcggccatcggcgacctggccaagcacgcgcacctgctggaggtcctctaccacttcctcgtcccggacgccactctcttggacgacgtcgatgatcaggtggtggt

SEQ ID NO: 643 - DNA, 871 bp, Sorghum bicolor
  Clone ID: SORBI-28MAY03-CLUS120271_1
gcacgaggcccacctctggctctcgcccagagcgtgcattctgttctgcccaacatggcgagcgtggctctgctcttctccttctcagccatcctcttcctcctcgtcctcctccaggcaccgccaacggcaccgggcctcgccctcgccgaccacctggtccgcttcctcgacgggcgcggcctgctggagctgctggcgacgcgcaggaacatggtcctcctctgccacgccatcctcctcctcatcctcagggacgcaggagtcctcggcgcgcccgcccgccgtagcctgggcgaggcaacctccgccgtcgccgccgctggcacagaaaccatcgcctgctacgccgccgctccggctccggatcggccccacgccagcaggagcgccgtcgtcgcgcccgtgcccatgctgcgcgcgcacgacgccgcgggtggtgtcgtcgtcgtcgagtgccggacggcagtactactgacaggtccacagcaggaggaggaagaggccaaacagatcgtcgtcgtggagtcggtcaggaataatgacgacgacgacctgctcgatcaccatgatcgcgcggatgccgtcgaaccaattgagcatcccaccacggcgatcgcggcggacggcgagagggttgactgcgatgatcgccgcatcatcgccgtcgccgtcgccgacgacaacgagaagccgcgcatagacgaccagacggcgggaatggagatggaaatggaaatggaactagccgacgacaggacgttcgaggagttcatcgagagccagaggaggcagatcggcgcgaggagagcctgcagctggtcagatcaggctaccattaccaggcgatagcaacatgtttttagttgct

SEQ ID NO: 644 - DNA, 609 bp, Sorghum bicolor
  Clone ID: SORBI-28MAY03-CLUS120380_1
gcacgagggtcgtcacggcccacgggccggcgctcctccctccccctcgccgcccgccctcctccctcccttcttttattccccacccccgcctcgtctcctccaccgccccccccacatctatccacccgtccgtccgtccgttcgtccgtctccacgcgcaaacgagagagagagaaggctaggtcgtcgtcgtcgtcgtgactcgtgaggcgaagagagatctgggaggagccatggacgggaagttgccgccgccgaacccgaacctgccgtaccgggaggattgctggagcgagggcgagacggccgcgctcgtcgacgcctggggctcgcgctacctcgatctcaaccgcgggagcctccgccagccgcagtggcgggaggtcgccgacgccgtcaactcccgcccgggggcctcggcgcgccgccgcccgccgcgcaccgacatccagtgcaagaaccgcgtcgacacgctcaagaagaagtacaaggccgagcgcgcgcgcggcgggccgtcgccctgggccttctacggccagctcgacctcctcgtcgggcccacgctcaccggcagcaagaagccgtccccgccgcgcgccgcgctgc

SEQ ID NO: 645 - DNA, 266 bp, Sorghum bicolor
  Clone ID: SORBI-28MAY03-CLUS120402_1
gcacgagggtcacacctgccctcccaacaccaagaaaaaaaaaactgatcgcaattagtagttaaggcataatctgagggaggaggagaaggggaattaactaattattaacccaatcgcgagtggcgaggcgatgatgcacctgggggcggctaggagtttggtgaggaggttctcccgtctcgccgccgcggccccggccgatacggcggcgccgagaatgccggcgttcgaccacgtcccgctgccctacgacgggcccagcg

SEQ ID NO: 646 - DNA, 538 bp, Sorghum bicolor
  Clone ID: SORBI-28MAY03-CLUS120514_1
cggcgcacctcgccgtgaacggcgacttcttcatgacgccgggcatcagggtgctccgctccgacggctccaagcggtggacggtgagcaaggagcccaacctgttctacaccacctggagcccgacggagcccggggtggtgttcacatccatgggccccatcttcgagaccacgaaggcgacggtccggatcgcgcgcgtggagttcgacccggccgacctcacggacgacgacagccgcgtggaggtgggcgtcgcgacggtgaggccgctgactcggccggaggccggcaacgacgcgttcccggcggtgtcgccgtgcgggcggtggctggtgttccggtcggggcggacggggcacaagaacctgtacgtcgtcgacacggcgcgcggcgaggacggaggcgtcctgcggctgacggagggcgagtggatcgacacgatgccgagctggtcgccggacgggagcctgatcgcgttctcgtcgaaccggcacgacccggcgaacccggccgtgttcagcatctacctggtgcg

SEQ ID NO: 647 - DNA, 492 bp, Sorghum bicolor
  Clone ID: SORBI-28MAY03-CLUS12054_1
gcacgagggtctctatccgccaccatgtgcggttcttgacatttgaaatatgcactattggtgcactgtcgtggaggacatggaggacgatacatgaatctgcagagctcctaaaggcaacaaaggcagttattgttaatgatggcatgtattggctacttcttaatgaggcttcctcccatttgtgtcgagaaatcctgacgctcaacctgacagatgagaggttctcaaaaattcccatcccagatgctgtaaaaaaccataatttggaactgtttgaaggggaaggaaagcttcgtttgttgtcaacacattctgatggatctaacaatatagtgtcggatatttgggtggcagacttgactcgtcaagactggatccacttgcagactatcattcctcggatgcctgtgggcataagcccaattttccagctcaagactaaaatcttctttggcaaccagaagagactcctctgtgtagatcttcagg

SEQ ID NO: 648 - DNA, 672 bp, Sorghum bicolor
  Clone ID: SORBI-28MAY03-CLUS120627_1
ccgagacccgaggttggagattgatcgagctgcaaaaagctgcccgtgattatatctagagacgatcagactcacccccgcctgacgcgagatggttctggtagcgatcccttgaaagaaatgggacgctctcgttcctcgcgtggatcaccttctatatcccagacactcctaacactcctatggttcgaactcgtcaatgtactatatcaatgcttatggccatatatgggcaagatgcccaaactcgatcttcctcgactctcgacggcttcaatgtccagctgccccacatgcgccctgcttcacttctccaccgtcatgtattaatgcttatccttcacctgcttttttgtctggtcgtctcgcgactccgtggctgccttggacccgcagccggtgtcaaaaaaaaccgtcattgctactttcatagactcctattcggctattattgacttcgactcatgtggttggcattgctttttttttctccttcgaggcgtctttggtgtccaacgatcctacttttacatttattactctcccctcgacgctgtgtggttttcacagccagttttgttctctctttgttggaagcttctcaacggatcccattcgctgctaccgcgccattgcagtgaataccggttagaagaaaggtgcattatggta

SEQ ID NO: 649 - DNA, 421 bp, Sorghum bicolor
  Clone ID: SORBI-28MAY03-CLUS1208_1
gaccacgcgtctcgacttaacccgcccttatgtctacataacgatgattatgagcggtttcaacctattcctgtcaagaagggagccaacttccgtgacctaaagggtgtcaaggttggagcaaacaatattgatgagtgggatccagaaatcgagcgtgtgaaactttcatctgggaaaccactggttcctgactatgcgatgtcattcatcaaagggtaatcactcaagccatttggacgcctgtggtgggatgagacagtttctacagttgtaaccagagcagagcctcacaaccagattatattgcatgcgactcaagctagagttctgactatccgggagaacgcaaggttgcagggctttcctgattactaccgattgtttggcccatcaaggagaagttaatcaagttggaatg

SEQ ID NO: 650 - DNA, 581 bp, Sorghum bicolor
  Clone ID: SORBI-28MAY03-CLUS120822_1
cggcgagctgcctccgatcctgctctatatcagctcagcttcgttctgctgtggctctgagctgagccgccaaggatacatacgatacgatacgtcttgcagctgcgggttgccttcttctccggtggacctcgtcggggttatgcggaggagctggtcgtgcttgtcctgcttgcccatggggacggcggcgctgcccattgaggaccgattcgttcctccggctgggctaccggcggtgcccgcgtcaggttcagaagatggaggatttggcaagggcagcatagaccttggaggcctggaggtgcgccaaatcaccacatttgccaaggtctggtccaccacgcagggcggccaagacggcctcggcgccaccttcttcaagccctcgccggtccccgccggcttctccgtgctcggccactacgcgcagcccaacaaccggcctctcttcggtcatgtcctcgtcggtcgggacacgtctggcaccggtgcagtcctcgccgcgccactggactacgccctcgtctggtccagcccggacggcgccggccacttctggctccccacggcgcccgaag

SEQ ID NO: 651 - DNA, 587 bp, Sorghum bicolor
  Clone ID: SORBI-28MAY03-CLUS120890_1
gcacgaggggtaattccagctccaatagcgtatatttaagttgttgcagttaaaaagctcgtagttggaccttgggccgggtcggccggtccgcctcacggcgagaaccgacctactcgacccttctgccggcgatgcgctcctggccttaattggccgggtcgtgcctccggcgccgttactttgaagaaattagagtgctcaaagcaagccatcgctctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctagtctcaaccatattgtggtcggcacgcctggaaggatactggctctagctagagataaggaccttccgttgaagaatgtgcggcatttcattcttgatgaatgtgacaagatgcttgaatcacttgacatgcgcagagat

SEQ ID NO: 652 - DNA, 936 bp, Sorghum bicolor
  Clone ID: SORBI-28MAY03-CLUS120911_1
gcacgaggcaacaaacgagatcccccaagtttcccacgctcattttgtcgttcgcggtcgaactttgaactttcttctcttcaggtcgctttcttagttaatatccttcttcgaaacgataccccccttctaatcgcccgccatggctacaactaagaacaagtactcggttatcttgccaacctacaatgagcgcaagaacctgcccatcattacctggttgttgaaccgcacctttactgagaacaacctcgattgggaactcatcatcgtcgacgacggctcccccgatggaacccaagaagttgcccagcagctcgtcaaggtctattccccccacgttgtcctcaagccccgcgctggcaagctcggtctcggaacagcctatgtccacggtctcaagttcgtcaccggcaacttcgtcatcatcatggacgccgacttctcccaccaccccaagttcatccccgagatggtcgctctccaggccaagggcaactacgacatcgtcacgggtactcgctacgctggaaacggcggcgtctttggctgggatctcaagcgcaagttcgtcagccgtggggccaacttgttcgccgacactgtcctccgccctggcgtgagtgacctcacgggcagcttccgactgtacaagcgtgctgcgctggagaaggctattgctagcactgagagcaagggatacagtttccagatggagcttatggtgcgtgcgaaggctatgggatgcactgtggctgaggtccccatctctttcgtcgatcgtctttatggagagagcaagcttggtggtgacgagattgttcagtatgcccagggtgtcttcaacctgtggctcaaggtctaagaatgggaatgacatgcacaaaagggacactctgttggagggggcgtttgaggaagtatagtaccgtttaa

SEQ ID NO: 653 - DNA, 621 bp, Sorghum bicolor
  Clone ID: SORBI-28MAY03-CLUS121099_1
cgccgtcacccgcgtggtcctccaaaccgtgcagtgcaaccgcaccacacggcactctcctcacgcacgcgatgccggagccgcccgcggggtacgcgccgctgggcgcggtggatcggcagcggcagcggcggcggcgggcgctgttcctgcagagctaccagttctcggtggagcggcggcaggagggcccggcggagtggctgggcgcgcgcctcgcgcggaggctgcgcgaggtcggcggggccgtggcgagggcggccgggcgcgcgcgctggtgggtgggcgccgggctcgcctgggcgtggcgcggctggaggccccgcgccgacccgctgctcggctgcttcggctcttcccacaagtactacctgcacgactacgcgtgacgcatagcatattcacatcgaccaaggatgtgtgtgtgtgtgtgtgtgtatgcaactggtactacgttacgcggctgcttggttttctcgagtgccaacgtgtgcacatgtgccgtggtgtataccgtatgtatagtgtgtatattattgatttgttgctacgtactgcatactgtgtacttgtgcagtgtctagcacactgtctgtgcgctaccaaaaaaaaaaaaaaaaa

SEQ ID NO: 654 - DNA, 1070 bp, Sorghum bicolor
  Clone ID: SORBI-28MAY03-CLUS121111_1
gcacgaggcatctcctcgccatcacgcctgccggcctcctcctcctcctcctttgcaccgccgctacaaaagaccacactgcttgcgagctagctagctgctcttctgttcatcacaattcacacgacgagacgaccctccgggcagatctttattgacctagccagttcttggcgcgctagtgcaggcgtctcagccacttctatctcagtaatcagtgctagatcattcatccgatgggcgtcgagctcgacctttctgaattggccgtgctccggccgatccagaccgcggcgggcggcgccgcgacgacgacgacggcggctcgaccggcgggcgacgacgccgacggcccggacgccgccgacacgggctgcgtcacgccgacggcgaagagctccctgctgccgcgcatgggcctgggcctaggcggcggcctggacatcgacgccgccgccgccgccgccgcagtcgcggcctgcgtcacgccgacggcgtcgccgtgcctgctacggccggccacggtgtgccctccggcgccgcggaagccggcgaggccggtgctgccgccttccgacaacaagaggaagcgctgctgtgtccgaccgggcctgcagcgcgccttcttccccgtgccgcacgacctctccaccgtgttcgtgccgcgcggccccgcggacaggtcgccgccgccgcctcctcgggccgccaagaagatccgcctgcacgtcgtgggctgatgaatgaagccacgccgccggttcgtcggacggagtcatcagatacaacaggatgcatgccatgccaccacgcgccatgctttcgaagtttcgatcttcttcttcttcttcttccgccagtactgatccatgcggcgccgcgccattggccatttgctgcaagcctgcaagtgcgatcgatcgaggacaaattcaagcttcctgacaggacagaagacacgaaggccggccggccggccggccagtacaatcgccacgcgccaacatttcagcagaggttaccgagtgtgtgtctgtgtgtgcagtgagtgcgcttctcaatcagatgaa

SEQ ID NO: 655 - DNA, 1101 bp, Sorghum bicolor
  Clone ID: SORBI-28MAY03-CLUS121118_1
gcacgaggggcggacgctcgagtctcgacacgccgcgaccgcgcgcgatcggcgatcctgctatatatccgtcgatccatattttccagacatccacccacagcacacgagcagaacacccccactgccgtgagttacagttactacgccgaccgatcgagaccttccgatcgatccatcgattcgtctcctctcccgtgagcgcgccatcatgaagctcttcatgtgcttcggcggcgcggcggcggccgtgatcgacgacgaagcggccgaggtggcggccagacacatgcaggaggggcagcgtcgtcgtggccgccgtagcctgtcgttccgggggaagttcttgcccggtaataacaagaagcagggaggcaacgagaagaaaccgtcggcggcgtcctcaaagaagcgggggatggacgcagcagacgacgtcgtctacggcgtgtccagggcgtcgtcggtggcgtcctcagcgctgctgagctccgcgtcgtcgctggactcgaccacatcatcggcgtcgtcggcgtcgtcttgctcctccacggcctcgtcctcgccgtcggtctcgggggtgctttacccgccggccgtcaagcggcaggcgagtaataataagaggcccgcgtcgtcgtccccggtggcgggcgcggctgccgtggtgctgtgcctcctcatggtggtgttctgcggccgcgtcctggccacgctgctcacgtccacggcgctctacctcttcccgcggcggtggcggcccgcgacgacgacgcgtaaggagaagaagggcgccgtcgactcgctggagtgcgacgccgcgtcgtcggcaagcgaggcagaggaagaggagacggcgaagaggaaggtggttatggaggggtcctcggtgaggaaccgcaacaagtgaagcgatgatacccgttgtttcgttcctgctaatccttttttcttttttgaggaatcactgattctttttgtttggatgagaaggaatagttttgcagtactcactaatattttttgcccaagggtttatgtacttgtaaatcaatgacaaatgtgaccacacttgtattatatacaaaaatgcaaaaatag

SEQ ID NO: 656 - DNA, 676 bp, Sorghum bicolor
  unsure (1)..(676): unsure at all n locations
  Clone ID: SORBI-28MAY03-CLUS121232_1
gcacgaggcaccatcactagctactcttctcttgtcgcttgctctctctctatatatataccagaagcaccagaagttgctgctctctgtgtgccggccggtcgtcgtcgtcgtctgagcatccagctggtgaggtgaggtgaggtgaggtgagtagacagcaatggcggcgcagcagcagcagggaagaggcagtggagctgcggtggtcgttgcggcggcggtgctcctctgcgtgctcctccaagcccacgtcgcggagtcggccgtgttcaccgtcggcgaccgtggcggctggagcttcaacaccaacacctggaccaacggcaagcgcttcaaggctggggacgtcctagtgttcaagtacgactcgacggcgcacaacgtggtggcggtgaacgccgccggctacaaaggctgctccgcgccccgcggcgccaaggtgtacaagtccggcaacgaccgcgtcacgctcgcccgcggcaccaactacttcatctgcagcatccccggccactgccagtccggcatgaagatcgccgtcaccgccgcctgactgatcgacgacaccgccgccgcgtgatatacatatatatacatctatctatcgactagctgattgtcagttcgagtgactcatatggacttttgttattaccatcgttgtttncatgga

SEQ ID NO: 657 - DNA, 596 bp, Sorghum bicolor
  unsure (1)..(596): unsure at all n locations
  Clone ID: SORBI-28MAY03-CLUS121235_1
gcacgagggacgactctgaaccgcgacgcgagacgagagagaggcgcatacaggcgcaggcggcggctgaggatcgtcggagaagacccatcgaagacgacgaagatggcctccgcgtacgcgtcgtggtccaagaggtggatccgccccgaggtgtacccgctgttcgtgccgatggcggcggcgctgggaatctgctcgtaccagctggtgcgcaacatcacgggcaacccggaggtgcgggtgaccaaggagaagcgggcggcgggcgtgctggacaaccacgacgaaggggagaagtacgccatgcacggcctccgcaagttcgtccgcgggaagaagcccgagatcatggcctccatcaactccttcttcgccgacccgcccaaggacggctagctaggcggatccatccatcggcatgcacatccagattttcggatttttatatattttctcatgagatttatcattcattaccaccggcgacggcggcggcggccttgaatccctagtcgtcggtagatttttgttctgtattctaatttcgatcccctatatatataattaaatggaagaacattcatttgaaaaan

SEQ ID NO: 658 - DNA, 1078 bp, Sorghum bicolor
  Clone ID: SORBI-28MAY03-CLUS121268_1
gcacgagggaacaactacgtcggcttccgcgcgcagccgacgctggtccttctcgccgcccgagaagccgaggagcggctggaggagaacggcaccgacatcgcgcggtgcctggcggcgcgtctcccggcggcgacgttcgagctgcaggcgtacgggttcaccaacgacggcgtcttcttcacggggtacccagtggtagggttccagcaccggatccaggcgtcagggacgtgcatcaacggcgacgacgacgacggcggcggcctcctcctctccgcctgcacgtgggactcccgcatcagaggacctttcttctaccagtccggcttcagcgtcgccatgtccaaggtaccggcgttcgtcgccgacatgcagcggctgcgcgacctcaacccgcgcgccttctgcggggtggacgccaagatgggcgtgctgatgcgctacgtgaggtcctcgtcggcgtacctcggcaaggcggaggactcgctggacttcgacgtcacgtactaccggagctacgacgagggcgtgccgcgcgcgcacgccgacgtctacgacgagctcgagcagatggcgctgcggaagtacggcgcgctgccgcactggggaaagaaccgcaacttcgccttcgacggcgccattgctaggtaccccggcgcggcgaggttcatggaggtcaaggacaggtacgacccggatggcatcttctccagcgagtggagtgatcaggtgctcggcatcaggggtagccccaacgtcgtcgggccgagatgcgccattgagggactctgcgtctgctccgacgacgagcactgcgcgccggagcaagggtacttctgccgccccgggaaggtgtacgccgacgccagggtctgcgtctttgagcgacgcacacgactcgtcgacgagctctgacgaatgcaagatagtagatccattttttaagctagctagctacattggttgccattgtcttgtgtttgaaattgaattggtgtagatcgaacagagcaagcatcattttgatagggtgcagcacagggcgggacagggtatgtgtgtttacaaataagtg

SEQ ID NO: 659 - DNA, 604 bp, Sorghum bicolor
  unsure (1)..(604): unsure at all n locations
  Clone ID: SORBI-28MAY03-CLUS121379_1
gcacgaggcctcctctcactccatcacacccaccacctgccctaccttcaaccttaattacaatcgatctcacaacaatggcattattcgcattgtcgtctctgaaaccaacaagcaggcttgtcatcatctgtgccctcctctgcatcttcctgctgtcttcagaggtgagcttggtgcggcaggccacagcactgggcatcaactacgggcaggtcgggaacaacctgccggcgccgccgcaggtggtgcagctcctctcgtcgctgcgcatcggcaaggtccgcatctacgacgtgaacccgcaggtgctgacggcgttcgcgggcacgggcatcgagctgatcgtgacggtcccggacgacctggtccccggcatggccgggagcgcgtcgcaggcgctgcagtggctgagcgccagcgtgcggccctacttcccggcggcgcgcgtgacggggatcgccgtcggcaacgaggtgttcacgggcgacgacgagcagctcaaggccagccttgtccccgccatgcgcaacctgcacgcggcgctggcgcagctgggcatggacgcgtacgtgcgcgtgtccaccgncaactccctcgccgt

SEQ ID NO: 660 - DNA, 465 bp, Sorghum bicolor
  Clone ID: SORBI-28MAY03-CLUS121341_1
cttccgctaccgctgccgcccccgccgccggcgcactacccgatgtggacgagcgccagccccgctgggccctacggcggcggtggcccaggctccatgtcgcagccaatcaacggcagcccggtgccggcggggctctggagggtgccgccccctgctgcgacaaccactactgccatggagaatttcggcatgtccggccggcacggcgctggtggcacggctatcatccagcctaccctggtcgggccggctggtggggaggcggctgcatgcaaggaggagaaggcggcgatgagcttgttgtccccctcgccctcgctctcctcttgctcgtccacgtcgccggagaagaagctaggtaggtgtgaattgggccaccagaaggagagcgttagcttggatctccatttgtaattctttcttgtttatttatttttatttaggtctccgatctccccctgc

SEQ ID NO: 661 - DNA, 554 bp, Sorghum bicolor
  Clone ID: SORBI-28MAY03-CLUS121431_1
gcacgaggctcaatcactcgcttcaacatctacaacaacctttcactccgccttccaaaacaaccacccaaccgcaaccatgcagttctctctcgccttcctcgccgctgtcctctcagccaccagcgtctccgccgcccccaccgagcaagccgtcaacatgatggccgccgctccccagtggaccatcgagagcatgcagcgcagctgtgccaaggacgacagctcctgcacctggaacttcaagatcgacacccacaagggcgctgccaccgcctgcaagttcgtcgtcaagggcagcaaggcctctcagcgcaacggcggccccgtcaagtgcggcgactacaccgtcacctctggctggagcggccagttcggccccggaaatggattcaccactttctctgttgtttcttccaagcgacagattgtctggcctgcttataccgataagcaggtccagggaggaaaggttgttaagcctgatcagtcttatgcccctgccaaccttcccaactaagctgacggcttggtcgatgatgagtgtcagctgg

SEQ ID NO: 662 - DNA, 1069 bp, Sorghum bicolor
  Clone ID: SORBI-28MAY03-CLUS120259_1
gcgattccttacacgctaaggcatagaggcacgcacgcgcacaatcggcgccagccaacgagatcgatcagccaagctaagctctctgcctgctcctcctcctccgctaagctctcggcagccatgaggaagtcgtcgagctgcagcggccatgtcatcggggtcccggtcacctccaaggcgtacgggatagaggaggtgtcgtccagggatccgtcgtccttcaggaagggcgacgccgccggcgatcaccttgctgtctcgttgacgcaccccagcccttatgcgtctttcggctacaagcacagcagcaagggtcaggtgatccactgggtgagcaagctgggcagaagggcgcaagggttcagggagcacgtgaccctggggccgaagctgtcggagacggtgaaggggaagctgagcctgggcgcgcggatcctgcaggccggcggcgtcgagcgcgtgttccggcaggccttctccgccgagaaaggcgagcggctggtgaaggcgctgcagtgctacatctacaccacgggcgggcccatcgccgggatgctcttcgtctccaccaagaaggtggccttccgcagcgaccgacccatcaccgtcacctcccccaagggcggcacgacggcgcgggtcacctacaaggtggtggtcccgctccggaggatcgacaaggtgcggcccagcgacaacgtcgaccggccggaggagaagtacatccacgtcgccaccgtcgacggcttcgagttctggttcatgggattcgtcagctaccagcggtcctgcaagtacatgcagcaggccgtctcggagctgcagctgcaatgatcgaccgcaccgccgtccgtcggggccggcgacctacaggttgatgaggaggtccggacgtgccggttgcgaggctgcccggtcggcacgatgtgaagagaggatgttatgggcttgcttcgccagcttttgtcgcgaagtagccgtagctaggattgccctgtctaattccggatcggtgcaattgttccttccgcgtacgatgttggacacaacacctgtgttgttacca

SEQ ID NO: 663 - DNA, 432 bp, Sorghum bicolor
  Clone ID: SORBI-28MAY03-CLUS12146_1
ctcgcaaggtccacacgctcgtgtcgtcgtcgagccaggagaagatcatggcggcggatcatcaccgtgacagggctctcgtgctaagcaagcaggcaatggcgccgagcaaagagcccgctgctggcagtgatcacggcggtggtaagaaggctggtcttagtctctttgagatcgcagtgttcgacgaggaggatgatcgtcatggctaccatgattattggacaaggtcgtccctcttcgacgatgacaactgtcagtacaatgatgatgaggaagatgttcatcaggaagatggtggtgatgtcgatgatgttcttggtgcgctcgatgatgagccatcggtcatcgaggtcatcaggagcaaccgggaggctgaaggtctggcgttcaatatggacgatgagattgacgaggcttgtgatctgttca

SEQ ID NO: 664 - DNA, 641 bp, Sorghum bicolor
  Clone ID: SORBI-28MAY03-CLUS121539_1
gttcctccatcatcatcaccaaaaccaacattcgttattcctttttcacctacagtcgctattctttcaagtctttttcatactatttttctacacacaaacacttcgccatcatgtcttccacaaccctcagcaccgccagcgccgtccccacggcctgcacaaacctctatgacacccccaaccaggacaacacctgcgccatgcctttcaaggccaaccacaccgagatcatgcagaagtgctgcggcgacgccaagatcgtgagctactacaacggctgcggcctctactgcgtcgccctcgaccagaccatcggcgacctcgcaaagtgcctcttcgccaacggcgcccccgacgccgatgtcttctgcagcggcagcaagaagaccacaaagacaaaggacgccgacgtccccgctaccgcccaggctagcgtcatctccggcgacgatgatgataaggacgatgatgacaagagctctactggtactgcttctggtacctccacggccaccggtaccagctcttctagctccgagacttctactgagagtggaaacgccgctgctggcttcgctcccaagtctagcatcaacacccttggtctcgccattggtgctctgctcttctcctacatg

SEQ ID NO: 665 - DNA, 463 bp, Sorghum bicolor
  unsure (1)..(463): unsure at all n locations
  Clone ID: SORBI-28MAY03-CLUS12156_1
tctggaactgaactctatcggaagcctcctcctgcatggtgaccgcagcagcagcagcctcagcctctccgcgcagcatgctctgcttcgcattgaccgcctcgccgtccggccgccgcgagccttgccgctgccaccaccgaacgtgactcgtccgccgtccgtccgtccgtcaccagcggatcgatcgatcgccctcgacgctctgcagccggccggcgctcgcggtcgcggtcgcggcacgcgcgatgcctcctctgcaggcgccgccgcacggcgagaagagcagcagctccggcggcggcggcggcaggcatcagcggcaggggatggcgggggcggcgtntcagcagcggtcggcgttgntccacgggcgcgggacggagcagcagcggcacctgcagccgctccagaggcagaggcccaagacgctgcctgacgtgctcgccggcgttaggggagc

SEQ ID NO: 666 - DNA, 373 bp, Sorghum bicolor
  Clone ID: SORBI-28MAY03-CLUS121580_1
gcacgaggatccaacgatcttgcagcaagggtcccgcagttcatggtccccaccattttctttccgattagcaatatgcctctgactctcaccggaaagactgaccgacataccctccggacattgggtggtgagatctctgctgaggatgtacgaactttcaaccctcattggggatccaaacaaccacctggtacagccatggaagagagtttaaaggccctatgggcatcaataattcagatccggcccgagtccattggccgtaacgacagcttcctacgacttggcggtgactcaatgtcggccatgcgcctggtagcggctgcgcgtgaggccaaattatatctcacagtcgctactgttttcagct

SEQ ID NO: 667 - DNA, 168 bp, Sorghum bicolor
  Clone ID: SORBI-28MAY03-CLUS1216_1
cattgtcctctctgttgcattgcacactcatataaaccaaaaaaaaagattggagtcaatattatatgcatgttccaactagggttgctacttggggaggtttaaggtttggtcacactcacatgaattgaaaatattggactcactattatatgcatgtttgaacta

SEQ ID NO: 668 - DNA, 455 bp, Sorghum bicolor
  Clone ID: SORBI-28MAY03-CLUS121611_1
cccaaacggaactttacacagccgcgttaatattcccgtcaccagccacgctctcccctccaccgtccgccgcgcgtccccaccggcggccaccgcgactgcgaccgccaccggcccacctcccctccggcacccgggcgctcctcacccccacctttctccgcgcgatggcgactcgcggcggcggcggtagccagtcctacggcttcccgatctactgcgccgcctggctcccgctcgcccacatcctcaagcccgaccctcccgccgccgaggcggacgcggacgcggacgcggatgctgcctcctcctccccctcctctcccccgccccctatggctgtcctcgggggcggcggcggggagggccggagcggggtgccgaacaagctcgtggtggcggccctcgccgccggggaagaggccgccgcgccggccgccctttcccccgagacg

SEQ ID NO: 669 - DNA, 537 bp, Sorghum bicolor
  Clone ID: SORBI-28MAY03-CLUS121639_1
gcacgagggttggcagtggcacgacgtctccatcgacgccaccgcgaccttcggcgacctgaaggtgatgctgtcgctggtgaccgggctgtggcccagagagcagaggctgctgtacaggggcaaggagagggacgactgcgagcacctgcacatggtgggcgtccaggacaaggacaaggtgctgctcctggaggacccggccatcaaggagaggaagctcaggtcaaccaccttggcgcagctcatgggggtgccctgccactccttcatccaagtgtagacagagaaatccccagaatttcttgccagtttttgtttttcctgtcttctttttccagtttgcctgcgtgagcgacagagcgaaggtttcagttcagtctaactgcagtgttcagagcctgctgagtttcagggcttgaattcggtaaatggaatcaagacatttgcaaacaataggatataatatatgatgataaatacatggtgtaaattactgtgaacgggtaatgcaacccccagtgccagtgtgagcca

SEQ ID NO: 670 - DNA, 1004 bp, Sorghum bicolor
  Clone ID: SORBI-28MAY03-CLUS121672_1
ttcactcggcgagattttcaagcagatgtgtcacgaaccccgcccgaagtgcgagcgtacgagaaccttgtgcaatttgaaagaggcattcgtcttcatctgcctcggttccagaagcttttgactgctctccaggatccgcgacggcccccatcttcggcccagatcgcggacgcttcaaaggttcgcaaacgactgatcgattcctttgccaaatacgatgtcgcagctagacgcattcgggacctaccaaccgaatctccctcgcaagagagactacagaaagcgatctatcagaaagccagcaattttttacatctgcatatgctcccactgaagactcttcccaaagtactcaagtctgcacatgccgacaatggtggtaccagccggacgtgctccccaaccatcccgaacaatggacctccgaccgggtcccgcccacccgaaacggcacttgcatccatcaaatataacgagcgagcggccgccagtcgcagtgacagtagcctaggcagcgatgccagtagcgcggtgtccgcgctcgaggcggaagagaaagccctccgtgaacggttgattgtcttggaagagcagaagttttttgtctccgagatgattgttgatgcgaaccgacgacgcaaattcgatgaagtgagcagtctggcggtaaatgtggaggatttgagccgcgagattgacagcgtcaatggaatgctcgcagcgttagactttgaaggggtttacacgggtaccgtctagtcgggttccggtcaccatcttctgccgggatctacacgacgcccactattataagcctctgccacatgcagaggtactcgcggctttgcggggcatttcctccccccttgtattttcttttcattttccttcttggatgagcgttcttgtttttcctttttcacggacattgaattgagtgtgcatagcctggagtcgttgcagtctaaggttattggaggcatagttgactatagccacaa

SEQ ID NO: 671 - DNA, 649 bp, Sorghum bicolor
  Clone ID: SORBI-28MAY03-CLUS121671_1
gtacctcagcctgaggatgacatgaaaacctgcagcaagcagctcaccgtccatgtcaatctatgacattgtaccaggttgtgtgccgccgtcgtccaacaagttcgctcacgtcggcacgcttgagctcaaggcgcggatcgtcaagcggctgggcccctcgccttttgggtccgactgctccggcgcgagcgttctgtcgtcaccgccgccatcgtcggccaagtactactccgacgactggccggcgccggcggtcttccacgcgccggcttctgcctctttgtggggtggcggcccgccatggtccatggagtacctttggctgcgtgaggttctgggcgaaaccttagcccaaatttttagtgcagacgatggcgatgcttcgggtgccgtatacctttttttgaacgaagggtgccgtataccttcttcgaggcaccattcaacatcggattttagacataagcatcgccttagaagcctctaaacctagcggcgatagcatgtcgggggtggtgatacccatggtcatcatacttgtcgctgaagaatgacctacggctcgtcacgaaagcacctgtcatctgtggtatactgttgtgtcgtcggcccactggtggagtacccttgctgtacctgtgtgcac

SEQ ID NO: 672 - DNA, 925 bp, Sorghum bicolor
  Clone ID: SORBI-28MAY03-CLUS120893_1
gcacgagggtgtcccaatgtggtcatggtgaggcttcttctggcacgtctgatatgacggggtgaggcaattgggactatgtaaagtcgtagaccatcagactctcgcgaccgtctcgcgcctctttgagaacgattaccatctcatcatcgaagccaacccagttcctgcggtcttcccactcagcccttggcgccgatgtagggatgcctgcgtcatcggcgacctgcctgctcgtaggtcgtacctcgatgctgctgcctccgccgcggccctccagctcccatacgcggatctcgtctcctcgcgtgctaatgctcacggccttaccccgtggtgtgatctccgcatctgagatgcctgatgtgtggccccagaggcggatacccagggaaagtgataggaatgtcgcagtcgacgtgcaaaggtataggacgagagtgttgtccggtagtgtggcgagaagatatgggtggctgtagcaaagagtcgtaagccctgatcgtgactcattggtttgagtagagtcagcgccgccagaggctgtaatggggagtgtcgatgcgaggcgggaggatattgtgtcgacgccggagccatcggctgacggagctatcagcaagtcctgaatgccaatacaccagccttctcgggcggagaaggtgtaggcgatggaggcgctcacagaggacgacatgcgccgtatcgatagagcgagtggcaagtgggtggtgtgcgacttgagcgacgtgaggagatatggaggcgggagggtcgcgctcggtggtttctctgtcgctgtcgctgtcgctttcgatagcggtttgtcattgacactattcgcagcgtcgtccgaggatttgtcatctggtcggttgaacgtgtatagcgatattaaacccgctgtcgtcgctgttaggacata

SEQ ID NO: 673 - DNA, 789 bp, Sorghum bicolor
  unsure (1)..(789): unsure at all n locations
  Clone ID: SORBI-28MAY03-CLUS121812_1
taatnatgggatagaacttaccctcggtgagcaacagcacccgagacaccctgagcaaccagaacgctatcaccctcggagaagtagcgggcagttccagcgttgctcgcttggctgtccttgccacccttgccggccttcttgtcctgcatagcgtcgatgctgcccatgcctcggtaggccttgacgagcttaccctcacgggagacgaaagaggtactaggagactcggtggtaccagccaacagaccacccatcatgatggtggaagcaccaagggcaagacccttgacgatgtgaccaacgttctggataccaccgtcggcgatgcaaggaacaccgaagcgagcggcgaagcggctgacgctgtagacagcagcagcctgaggccggccaacggccataacctcctgggtgatacaagcggaaccactgcccataccaattcggagaccatcgacaccagcggcgatcaaagaagcggcctgctctcgggtcacgacgtttccgccaatgacatcgacaccagggaactcgctcttaacccacttgatcatctcaatctggtacatactgttaccctgggagctgtccaggatgacaatatcgagaccagcctcaacgagcagcttgagacgctgcttgtcctcggggcgagtaccaatagcagcggcacagaggagctgcttgctatcgggaagcttggaagcattagggaaatgctggtttttggtcaaatcggatcgagagatcatggaaacaaggttggagtccttgtcaacaaatggg

SEQ ID NO: 674 - DNA, 582 bp, Sorghum bicolor
  Clone ID: SORBI-28MAY03-CLUS121813_1
tccaaggttatgtgcatcaaggcaagatcggaggcaacacaggccggcgatgacggcggttgcccagcggatgagtgccgcgtctgcctgtcaaagattcggctcgccgaggctacccggcgtctgccatgtcggcatgttttccaccgggactgcgtcgaccgatggctcttgtcctgcaagcggacctgtccgctctgccgagtttatgtgaccgatgggaacaagcagccggtggcggcgaagcacaccagccgtgaagcacaggcactcgccgacgacctggtgatctggttctccaccgtgctcgtccccggtttctgatgccaaatcccctcttttgttcgctcgatcgaatgcttggtgtgtattcttttatatatttcaacacatgtacgtacctatgttatacttatcgatctttagaacagtttttagaaaatgtgtgtattgtagcatcttgttggatgaattttattcgaacttttgcacttggagctgattactgcaaataagaagtccgagaaaatgttgtcggcatttattgtactatatatggtgttgtttgtgtgtacaaatgtt

SEQ ID NO: 675 - DNA, 518 bp, Sorghum bicolor
  Clone ID: SORBI-28MAY03-CLUS12190_1
caccccggcctcctcctcctcgacgcgacggagacgcaaaccctagcccccacaccatccagccagccaagccaccctcccctcggatcactctccttctctccccgatctctataaaagaccgcggatttcgaaattctttccgcgggatctctaacggcctccactttcccgcgcgaatcggcctcggattgagccgtttcgtcccgttgctgtaggggggattgggggatttcatctggtggtggtggtgggggattcgagcctcggatggcggagccggcgttggacgggagccagccggtggatctgtccaagcatccctccggcatcgtccccacgctccagtaaattgtcaggaccttgctggattgggcggacgccctccaccgaaaaatagctttgggttcgattggggatgaacgccacctgagatcttgctgctcttgagtgtttgcttgtgctctagctggtcgtagttcgctgggcttggtgtatttgattggcggagccagtgg

SEQ ID NO: 676 - DNA, 667 bp, Sorghum bicolor
  Clone ID: SORBI-28MAY03-CLUS121823_1
ggagggccagggccgccgccaagaggcgccggagcagggccagggtgatcctcgcctccctcttctgcggcggtgacgagctcgacgtcgccgtgctcgacggtctgcagcctcgtcggggcgacggggacagggaccagttggtgctcgccccggctctcgagtgggggcgcgagcgcgacgacgatgcctacgcctacaacaacgacgatggcgacgaggaggaggaggaggaggaggctgaggtggtggtggactacggggaggaaggcgacgaggaggtggacggccgcgcggagcgcttcatccagcggttctacgaggagatgaggctgcagaggcagcggtctctggtccagcgccggctctagacgccttctcgtttcgtccgttgctactgtccatcgggtagaatcagttcttgattgtcgctgctatcttagctgcagttcggttaatctcttcgtgttttgcattttgcatcgttcgtgttaccgttgtttttttttaatcatggggtaattctgttgtcgagtctctggtgagacattcgtctcccctgctgtagtcttccatttagtattcatctatctataatccatccctgcgatgttcgtttttgtagtgttttgagtttgtacaattgttacaaaatcaatgcttgctg

SEQ ID NO: 677 - DNA, 570 bp, Sorghum bicolor
  Clone ID: SORBI-28MAY03-CLUS121916_1
gcacgagggcttcgcaaacgaggcacttcgcactctctgtcttgcctacatggaagttgaggatgggttctcagccaatgatcagatcccgacagatgggtacacctgcattggaattgtggggatcaaagacccagtccggcctggagtgaaggaatctgttgccatctgcaggtcggcaggtattactgtcaggatggtcacaggtgacaatatcaacacggcaaaggcaattgcccgggaatgcggcattttaactgaaggtggcattgccatagaaggcccagatttcagaaccaagagtgaagaagagcttactcaactgataccaaagatacaggtgatggcaagatcttcaccactggataagcatacccttgtcaagcatcttcgaactaaactcgacgaagttgtggcagtgactggtgatgggacaaatgacgcgcctgcgcttcatgaggctgatattgggcttgcaatgggcattgccggaactgaggtggccaaagaaagtgctgatgtcatcattcttgatgacaacttctgcactattgttaccgttgcaaaatg

SEQ ID NO: 678 - DNA, 1132 bp, Sorghum bicolor
  unsure (1)..(1132): unsure at all n locations
  Clone ID: SORBI-28MAY03-CLUS121926_1
cctccggccacccgatgcccttcgactccccgcggatgatgcgcagcgccatccggctgatcgccgaccgctggccgtactggaacaggtccgagggcgccgaccacttcttcgtcacgccgcacgacttcggtgcctgcttccatttccaggaggagaaggccatggcgcgcgggatcctgcccgtgctccggcgcgccacgctggtgcagacgttcgggcagcggaaccacgtgtgcctcaaggacggcggcggctccatcaccatcccgccgtacgcgccgccgtggaagatggaggcgcagctcctgccgccggccaccccgcggtccatcttcgtctacttccgcggcctcttctacgacgccggcaacgaccccgagggcggctactacgccaggggcgcccgcgcgtccgtgtgggagaacttcaagagcaacccgctgttcgacatctccacggcgcacccgacgacctactaccaggacatgcagcgcgccgtgttctgcctgtgcccgctggggtgggcgccctggagcccccgcctggtggaggccgtcgtcttcggctgcatccccgtggtcatcgccgacgacatcgtgctgcccttcgcggacgccatcccgtgggcggacatcggcgtgttcgtcgccgaggacgacgtcccgaggctggacaccatcctgacgtccatccccgtggaggtggtgctgaggaagcagcggctcctcgcgagtccggcgatgaagcgcgccgtgctgttcccgcagcccgcgcagcccggcgacgcgttccaccagatactcaacgggctcgcacgcaagctcccgcacggcgatgatgccttcttgaggaacggacagacggtcctcaactggacggctggaccgccgagagacctcaagccatggtagtgggtatgggtagccttcaaattgccatggttacattacattacaatagtgatggactggtggccatcagccaaatacctttttattttttggtatcttcaccatacgtacgtacatctacaggcgttgtaggactagtagtgcatttgtgaatatcgtacccaaaatttacaaggctgtactcctgctgagttctggtgtcgtttaaattagctncc

SEQ ID NO: 679 - DNA, 628 bp, Sorghum bicolor
  unsure (1)..(628): unsure at all n locations
  Clone ID: SORBI-28MAY03-CLUS122008_1
caacaacacatactttttccccaatctatacacatttaatttccttattcagaatcccgggcaatcgcgaggcatgtgctccggaagtacaagccagaactccttggtgccagcagtctagagcagtcagcaatggtggacatgtgggtggaggtggaggcgcaccagctacaaccaccggcgggcgccatcgccgtcgagtgcatcgtcgcgcccgtcctacaaggccgcgagcgcaaccaggccgccattgacgagaacgtggagaagctcaagaaggtgctggaggtgtacgaggcgcggctgagccagagcaagtacctcgccggcgatgtcctcagcctcgccgacctcagccacttcaccatcatgcactacttcatggccaccgagtacgccacgctggtcaaggcactccctcatgtcgacgcatggtgggagggcctcgccgcccgcccggcggcgaagaaggtggcggagttcatgccgcttggctccggcgtgccggagtaacatgagtgatatatatacagtgatgcctgatgcatgtcgtgtgattgttaactacttttnccaggcagtgtgatgtctgtctgtactttgtgtaactttacatatttgtttttta

SEQ ID NO: 680 - DNA, 598 bp, Sorghum bicolor
  unsure (1)..(598): unsure at all n locations
  Clone ID: SORBI-28MAY03-CLUS12202_1
tgaccttccattcacaaataactatggtgtgtgggaggatgaatttaaagatcttggtctagcgagttgtatcgagcacgtctggaaggatactattgtctacctagacaataacaagcccatactgattggccgatcttatggcagggtgcaccgtgacttgctccatgaggagctactgagaagatgctatgaagctggcgtgacatacctgaactccaaagtggacaagatcatagaatctccagatggacacagagtagtctgttgtgataagggtcgtgagataatttgcaggcttgccattgttgcttcgggggcagcatctggtaggcttctagagtatgaggttgggggtcctcgtgtttgcgtgcagactgcatacggagtagaagttgaggtggaaaataatccatatgatcccagcttaatgggtttcatggactacagagattgtttcaaagaggaattctcacacactgaacaagaaaatcccactttcctgtatgctatgcccatgtcatccacacgagttntctttgaggaaacatgcttagcttctaaagatgctatgtcctttgatctacttaagaagagg

SEQ ID NO: 681 - DNA, 551 bp, Sorghum bicolor
  Clone ID: SORBI-28MAY03-CLUS122071_1
ctttcccggcaccgcccccgccgccgctacctgcactaatggcgccgccgctatttcctccacctccgatattggtgccgccgccttctccacctgcactagtggcgccaccacctccagtaccggcgccgccgccgtcgccgccacctccactaccggtgccgtcgctgcttccaccagtccagaactcgtccaggaaacgaaagattaaagaggaaaaggcatcctcatcggcagctaagcggaaggtctctgatgtgaagcaggcaaatgcatcggtgatgtcgatgcattcaccggcatcactattgccactaccaccttctggcgccggtgctgacttgtcaagccacgaagccatacgcctctattctcccgatccaccgacaagattttccttgttcgttgttcctcaactgccgagttcctctgtggtgtcgcccacagctgctgctgccacccctgcaaatcaggatcagcgacacggtgactcatccacagctgctgctaccacccttgcaggtcgggttcagcgacacattgaagcgaag

SEQ ID NO: 682 - DNA, 659 bp, Sorghum bicolor
  Clone ID: SORBI-28MAY03-CLUS12209_1
gtcactcactcactcaccctcccggcctcccctcctccctcgaccacctcaccgctgtgctaccttgctccagtcctatctcgacggccggccaatataacaacaggaagggggtattctgatctcatcgtcgatctcatggcgacgacggagatggagatgggcatgggcgtcgtcgtcggcggcggcagtaacagtaacaatggaggaggcagcagcagcagcagcgggctggtggtgacggagctgagccacatcaaggagctggtgaggcagctggaggtgcacctcggcggctccccggacctctgcaagcacctggcctcgcagatcttctccctcaccgagcgctccatcggcctcatcacctcatccaacctcgacgccggcgccgcccgccggaagcggtccgcgagcgacgccgccgggctcgcctccccactctccgcgacgcccaccagcgacgtcacggacgggccgttcaagaacaacaccaagaagaggaaggtgatgggacagcggagggagagggtgagctcggccggcggcgagaaccccgtcgacgacggccatagctggaggaagtatggccagaaggagattctcggagccaagcacccaaggggctactaccgctgcacgcaccgccactcgcaggg

SEQ ID NO: 683 - DNA, 761 bp, Sorghum bicolor
  Clone ID: SORBI-28MAY03-CLUS122097_1
ggcacgaggcggcgctgtgctgcgggcggaggcggccggcgtgagtgggcaggagagcagcggcgcggggccgcgggtggaggtggccggagaggcgccggcgcagggcggagctgcgggcggaggtggtcagagaggcgtgggagagcagcggcgctttgccgcgggcggagatgcggcaatgcgtgggtatgatctacagttaattaacccaaaaaaaaaaacccgactcggccccagccccacacgcccccgtccgccttcccgccctaaccccgccgcttcgccgcccctcccccgccggcagtcaccaccgtaccgctaacacccatctcccctaactgccggaaactcccgccgccccctgcacggagattcggagaatcaaccaggggcggaggccgaggaacgacagacaccgccgtcgatcgatcagcgctgccccccgcacgaagaatcaaacaggcgtagaggccagtcaacgatagccaccaccgtcgatcgatcatgcacccgccatcgatcaggaaaccacatgtgttgtcggtctgcaatctcgcctcctcactgtctctacttgattgggtggtgtgcctttggatcattctaagctcatgttcttcaatcgctgttttgaggtgctttgtttggatgctttgcttgaagggatgggattagcggcacatcttcacggtttcacccacaattagattaaataatatcgctcttggcttgttgtaataaacttagtgtaccatcaa

SEQ ID NO: 684 - DNA, 597 bp, Sorghum bicolor
  Clone ID: SORBI-28MAY03-CLUS122123_1
gcacgaggcgaccttccgcaaaaaaagcagagcgcacgtcccgttccgattcagaggtccagacagtttgcgagttccccccctgccctctcctcttcctcctcctcccgtcgtctcccgagtcccggcgaagcaggcgagcatgtgccccaccggcaagtacctggggctcgacctctccgccgccgccgtctccggcgctggcggcgacctgaggccggcgttcgacgtgcttgacgcggaccgggacggccgcatcagccgggaggacctcaagtccttctacgccgccgcggaggggcccgcggccggcgagcggttcgacgacgacgacctcgcggccatgatcgcggccgccgacgccgaccgcgacggtttcgtgcagtacgacgagttcgagcgcctgctggccagccgcgccgccgccgccgcgggaggcgccgggcgccgcgccgccatggaggacgccttccggctcatggaccgggacggggatggcaaggtcgggttcgaggacctcaaggcctacctcggctgggccgggatgcccgcggcggacgaggaggtccgcgccaatgatccgcgtcgccggcggaa

SEQ ID NO: 685 - DNA, 640 bp, Sorghum bicolor
  Clone ID: SORBI-28MAY03-CLUS122137_1
tcagagaaaaaaaaagttaatgagttggatcagtacttggaagaagaaacagtgcctgtgacagttgatctagatatcttgcagtattggaagatacactcaacaagatatccagtacttggatgcatggcacgtgatattttagctagacctgcatccacagtggcctcagagtctgcattttctaccggagagagaatagtgagtgattatagaagcaggctcaagagtgaaacaattgaagctctcatttgtcttcaggattggttaagatcggaggatagcacacatgataatatagctggaattatagctgcggacgatgaagattgtatttagatagaagaaacattcaacaagacgctgcggcataagtgtattcccaaatagatgcaccagcacagtagaggagtacgagaggcggaacttctaacaacgtcgaaattcatctctttgggaaccaaaagctttaagcattgctgctcctgatactgtgacttgagaattaaaaagtgatatgtgaagtaatgatgaacggttctacaaagtaacattggttgtagttactattttgatctatgttggatcttttaactgatgacaaatagacctggctcttttaagctgtgtttaagactga

SEQ ID NO: 686 - DNA, 625 bp, Sorghum bicolor
  Clone ID: SORBI-28MAY03-CLUS122157_1
gagcagggtcggctccggcgtggacttcgacccgttcgccgccgcgctgctggaggcaaccaaggcgccatcgccatccccgctcggcggcaaggatgacaggggcagtgtcgccctcgccggatcgccgcccaagaaaccggccacgcgtacggcggcgaggtcgaggagcgccgggtggagaaagtggcggctcagcgacctcctcctgttccggagctcatccgacggcggccgcgtcaacaagcaggagcaccccgacatgaagccagtgcagcagttcaacgtgcctgtcaagaaggcgagcgcgcagccggcgatgatgatcaaagccagcgcaaagggcgacgacatgggcaaggagtggaagcagcatggcaacaggaacgcggccgcggcggcggacagcgtcgccgggtgcgctcggctgagcccgctgcagcggctggccaaagggctcggcgcgtactcgtggcaccaccacggcatggcgccgccggcaaaccaagggtgaagaatcatagcggttattttgcagtatttctctgcccggttattgttcatatacaagttctttttttttgcatagtgtgaaaccatatacaagtgcaatatgcaaaccaat

SEQ ID NO: 687 - DNA, 406 bp, Sorghum bicolor
  Clone ID: SORBI-28MAY03-CLUS122226_1
ctgcaaactactggagtaccagggagagtcctcgctagctagctaagcacagtcatgaacatgactagccccaggctaaagctcttcggcttccacgtctccgaggaggagcggcaccacgagctgcctggcctggagacggaggcggcggaagccgagccggatcaggaggcgccggcgtgcggtaacaacggtggcggcggaggctccgactcgtcgtcctcgtctaccaccaccaccaccacggccacgggcgccgccacggcgggagcgggagccggcgacggccggagggacgagtgccagtactgctgccgcgagttcgccaactcgcaggcgctgggcggccaccagaacgcgcacaagaaggagcggcagcagctcaagcgcgcgcagctgcaggccg

SEQ ID NO: 688 - DNA, 637 bp, Sorghum bicolor
  Clone ID: SORBI-28MAY03-CLUS122228_1
tcaagaaccactggaacacccacatcaaagaagaagctcaagaagatgggcatcgaccccgtcacccaccggccgctcgcgcaacccctggccccgccgctgacgcagcagcgcgatccagctccgcaggtgagagaagaaggagaacgctgcgacgagcccagcaagcagcaggcgtcgtcgcaagggccggcggccggcggcgccgacgaggacgaggacgaggaggagataacaccggcgagcgccgcccagccgcacggtgccggcgcgacgacctcctcccctgcctccgcagcggctggagccgtctcgccgtcctgctcctcctcgtgcgcctcggcctccgccgcgaccccgggcgcggacgtcgccgcctggcccgaccccatcgacctcttcttcgaagtggatggcatcatggacatggactgggcgggcatcctgtcgggctgcggcgatgacgccgccgtggacataggcgctgtcgatctgttcgaccattaccccggcgatggcttcgacgaacaagtctggatgtgacgcttcctgatagcagtacactggcgggtaggatgattagaactgttgtaactcgtgatcatctctatctgttcttgcagtttgcatgtcctgt

SEQ ID NO: 689 - DNA, 709 bp, Sorghum bicolor
  Clone ID: SORBI-28MAY03-CLUS122296_1
cggcgacgagatgtgccaaatgtgtacccagctcttgctcagggaagcaggcctccccaatggtctgcttccattgaaggacctaatcgagtgcggctatgtccaggaaactggatatgtgtggctcaagcaaagcaagagggttgaccacaacttccagagtctaggaaggctggtctcttatggcacagagatcaccggctatgccgagaagggcaggatcaagaagatcaaagggataaagaccagggagctcatgttgtgggtcccagtggaggagattgctcttgatgatccagcaactggaaagcttatctgcaagagcattgctgggattacaaaaaccttccctgcatcagctttccatgtcccagagaaggagaatgtcaagatgaactgtgctgcaccgaaaccagtggtcctcatggagagaactccacgagttgttaagaacaactgatccttctgcacccactggtatttggatttaacggtcatcatcagcccttattcctacatatttaaataatgactgaactggtgctttattgtccgtttatgtacttcgaaagtgatagcccaaagttcttcctatatactgcagttgtatgattgcaggcatctattgtcctggaaggcaaccacccaacttcctttcatgtactatgtagctctatattactaatatgaagcatgctgggacttctat

SEQ ID NO: 690 - DNA, 939 bp, Sorghum bicolor
  Clone ID: SORBI-28MAY03-CLUS12240_1
gtcgctggagcgcagactgctgctgctactgttggagagcaggctgctgcagatgatcttgtggaaggtactaatcaccatgtggtatttatgggaagccaaaaatgacataagatttcagagaaaggactggagtcgagtccttggtaggtacattcatgcgatggaggcacacatcactactcaccaggtttcgctacaaacccactctaccgataacaactacatacatcagggttctcctacccctgtccaaggtacacatcctttcccctgcagaccaaatcgtcgcctcacacacaccaaccagcaacaacttcagcacacaggcgagtgccccaggcagtctgcaatgcaggaaccatggccacaccaacacaacaaatgcaatcagatggggatccaatggaagacagattcttggtccgcactccaggactgctacagggtgtcaaatgctacattgacgcctcaacatcacctgaccaacaaccctctcttcctctaagacctgtaggaactggtctgttcatcatcaacacccaagttcaaccagcgcagacaatctacattaaggcgacaatgactactacaacataagtcctgatggctgaggcggcggcaatcgcgcttgctgcgattgttactaactctctcggtttgcagcagggttaccttcctcaccgacaattagcagctggtgcacttactgaacggccaggaccaagccaatccaccggagtggaggattaaatacttcacacaaaccttttctatcttcacaggtcaaagagatatgagaattctcagaatttagagagatcacaatcagactgctcatgtcttagctaggcaggctcttttagaatctacgcctttgggttcatcaggtttcttatgtacctgctctaatgcagagcatattcagtgcactctagc

SEQ ID NO: 691 - DNA, 711 bp, Sorghum bicolor
  Clone ID: SORBI-28MAY03-CLUS121805_1
gttcacggtggtccagactgcggcgcctcagcttcaccaaccaacgagaccacgaagcacccagccgcgcggccatgtcgtccaatggtcccaccggcgccgcggcggacgcgatggaagctgccgccgccgtcggcagctaccgggtgtgtgacacggtggtgctcgtctgcctggcctccgcctccgtcctcatcgtcttcacggtggccttctgcttccgccgcgccttcgccaacgggtacgcggccgccgccgtggctgcgaacagcgccgaagccaccgctgccaacggaagaagccggtgcgggctggcgccgtccgcgctgtcggcgatccccaagctcgcctaccggaggggcgccggcgccaccgctggcgccgggtgggcgcagtgcgcgatctgcctcgccttggtgcgggacggggagacggtgcggttgctgccggcgtgcgggcacctgttccacgtcgagtgtatcgacctgtggctgcgctctcacgcgacctgcccgctttgccggcgtgacgtcgtcgaggctcccgccgaaaagatcggagtagagcggggttagcactcacggtcaggtggaggctggcacctgtagctgatgtgggacctgagcttgtggcatcctaacacggcatgtgcaaccaaaactcataacgcaattgtttgtatttcttatgctcatgtaaatcacatagaat

SEQ ID NO: 692 - DNA, 599 bp, Sorghum bicolor
  Clone ID: SORBI-28MAY03-CLUS122435_1
ttcgtgctcagcgtcgctcgcctcacacatgccagacggggaggaccaatggcgccagccttgcacaagccaatgtgctggcggctcctccgtagctttcttggtgccaggcggtagcgaggacatggcgtcgaccggagctccattgtctgcctgctcgccgccacaagtgatcgccagcaaagccgacagtgtgcagggcgcagctcactccactgttttcactgccagcagtgcggaatatgaaccatatacctgcaatggctctgttgatatcaaaggcaatccagcatcgaaaaagcatactggaaaatggagagcctgttactcaattcttggtggtgaattttgtggttctttggcgtactatggtgttgggacgaacctggtaagttacctcactccccttctcggagcattcttggcagattcatattggggaagacaccgcacaatcgttgtttccctcacaatctttaccattgtaactctcgatcggcactccactcttttctttgtcaaatctgcatctgcatgttgagttcagatttgttccaacaaatgaaatgcacaattactagtgcttatgcctcaagatt

SEQ ID NO: 693 - DNA, 975 bp, Sorghum bicolor
  Clone ID: SORBI-28MAY03-CLUS122444_1
ccgaatcaaatataaaaaggtgcagtatggtgagcattcacagccagagccggaatacccgggggaacattgggacttggactcgcctgaatgggatagctttgatgaagatgcttggggggagctctatgatgcatgggcagcgacccgtcctattttacttccagaacctggggagttcaaaccccacgaaggctgggaaagaggccgggttgacctccggagacatttcccaggccaaaggctgcaagtaattgtcaagatggcaaatatcgagcttactcccgacagccctgagtacgaggggggtagctggcacatcgagggacagctgaatgaacgaatcgcagcgtcggctatttactactacgacaacgagaacatcacaccaagcaatctatccttccgtcagcgtggaggcagcgacttctacgaacctagttacgagcaatcgcgacatgaattccttgaggttgtctacggtttcgatgagccgtcaaaatggggcgaaaggaatatcacccaggagcttggaggcgtcaagtgtgaagaaggccgattgatcacgttccccaatactctccagcataaagtctctcctttctcgctggctgatcgttcaaagccaggtcatcgcaagatccttgcactgttcctcgtggaccctcatcggcgagttatatcatctgccaacgtccccccgcagcgtgaagattggcttcccgaggggcgcagggaagagcttaaaggcaagttgatgacgttggaagaggcaaaggattcgaggttggagctcatggcagagcgaagtctccggtccgtggagcggaaccgcaactatgaagtcggggatttcaacctctgtgagcattgactgtattgaagcctgttgaggtcgttgcaaatgttgatcttgccacctgttatgtgtacctaattaaatcgaaaatagcaggtaaaaggccgcaaaatatc

SEQ ID NO: 694 - DNA, 1107 bp, Sorghum bicolor
  unsure (1)..(1107): unsure at all n locations
  Clone ID: SORBI-28MAY03-CLUS122455_1
gcacgaggctgctccctcccacggtcctacacactccgcctgtactccgctccggctcgaaaccctagacctgtgcggccgtcccttttctctccagcggagagatgtactcggaccagatctccaccgggcgcaagcgctccatccacgaccgccttgacggcgacctccccgccggcacgggggccggcggtcgtgtccgtcacacggtgtccaagaggcaacggcagatagatgaaaaatggaagcatgatctgtatcgggaagacgacgaaccagcttcaaaatcaatagatccgaaggatttgcgattgaagcttcagaggcgaagttctcaacaaggctttaccagcacaaggagttctggtgtgcgtgatctacgtgagaagctatctggtacaatgcacccacagccatcaaatgctgatcctccaaagcgaaagccagtatcagaggttgttaacatttcaaggcgtgaaactgctgatgaaatgcctgcacgccaaagtaagaaagcaccaaaacagacttcatcgaagaagacatctcagccaaaggcggcaagtccactcgacagtttcctgagttcccttgggcttgagaagtactcgattaccttccaggcagaggaggttgacatggcagccctaaggcatatgacggacagtgatctgaaagctttgggcattccaatgggtcctcggaagaagattatccttgccttggaatcgagagcataagggaatggcaagcgagtacagtgtaggaaggtggggggatttgctaggcatgctcatgttcaagtttgacaactttgtatccacctcttggaaagggtacaatgacaatgatttgcgggcttcttgtaacacatatcctgtcctgttgagcatgctcaacgaagtttaggatgttagaaggcaagccacaacgtctattgatgtaatttctatttctgtgttaattaaatggtgtgctatacatgttgaggctgttgggttggtcttagaatgctatatcctataactacatttttcttatcgtcagaggatatatttgaagctaggtggtttggggcntatatacatctgcaatggttgctctggg

SEQ ID NO: 695 - DNA, 800 bp, Sorghum bicolor
  Clone ID: SORBI-28MAY03-CLUS122469_1
gcacgagggtcaatcccagtcatcatcattcatcggccaccatggcccggcggtgtctccgggtgactctcgccctcgtcgtcgccgtcatcacggcgacggcgacgacactgtcctcggcccagcagacggcggcggtggcgttaccgaccttgcccagctgcccgccggcgccactcagcctgtccccgtgcatcggctacgtcttcggcgtcggctcggcgacgctcgcctcctgctgctcccagctccggggcttcctccatgcccaggcgccgtgcctctgcgccgcctccaagctcgcgcccagccccatcgggctcttcctcggccaggcgcaggccatgatccccaacgtctgcgacctgcccaacccatgcgatgaagccgccgccggcgagggctccacgccgccggtggcaggcacatcgcctccatctgcaacgacgactccggcagccaccacaccggcaactgaaccgtcgtcgggcacgccggctgctgctgatccaggcacgtcaggagcaccgccggcacccatagaagatgcttctgccactgcaatggcgccggcaggcactggatcgaagctcccggaactgctgcatgcagcgggcgcgacgcgctccacagacatggctgcaggcactgtattcgtcgctgtgcttcttgcttcggttgcagccatgtatgtgtaactgtagtctgctaagctgtcattagaacaccaaatgcgctgattgtaacattatatataagctgaaactgcaccctactgttgtgcagctacaataaaaaac

SEQ ID NO: 696 - DNA, 680 bp, Sorghum bicolor
  Clone ID: SORBI-28MAY03-CLUS122518_1
aacaaggttatcatgccaatgctgagcatgatcactggcatgaagagaggcttgactgaactacaacgcatcggtgtcggtctggttttcgctatgctttctttggtttcagctgcgctggttgagatggcgcgccttaaaatcgtggacgaaagaggcctagtgcatcgtagcactgcagtccccatgaatatcctgtggcaggcaccacagtacttcttcgttggtgtagcgaaagtgttcaccgttgttggtttcattgagtttgcatatgagcagtcacctgatgccatgagaagtttgtgtcaggcttgctctctcatcatgatcacccttggaagctaccttgtctctgtgatgttaaagttcatggattcagcaacagtgggaagagggcgacaaggatggatccctgataatctcaatgaaggtcgtctcgatcgtttattctggttgatggcagggttgcagcttctgaaccttctcacgtttgcatattgtgccacgaggtacaagcgcaaactagctaatacttgagtttgttctagttcgtgccaaggagtgcttatatatcgatgtttgctgtatagttacacctatgttacatgctgcgtgtcctcaaaatttcaacttacattgtaagtttttatggaaggaccgaaaggttttggatactagta

SEQ ID NO: 697 - DNA, 720 bp, Sorghum bicolor
  Clone ID: SORBI-28MAY03-CLUS122550_1
gcacgaggctcgatccgatcgggaacggttcgaggggcaggggaatgtcgtcgtcgtcagggtcgtcttcggcggcggcgcaccaccagcagcattaccggcaccagacaggagggagtggtctcgtgccgctcgccgcgctcatcaaggaggaggcccgcacggggcgccactccgtagccagcgggcgaaagcaggatctccgcgcgcgacgaggacgcggcgggagtaggaaactcaggcgtaggaggggaggtggcggcggagacgcggctggagcgcccgctgctgcgctatgggtgcgccgcgcagtgcaaaaagggcgaggacttcttcttgctcagaacggactgcccgcgtcccgccatctccgtctccttcccagactccccgcaccctaccttcgccgtcttcgccgtacttgatggccataatggtaacgctgccgcaatatacacaagagacaatttgctcaaccatgtccttagtgctatgccaagggggctgtccagggatgagtggttgcacatgttgcccatagcactggtcgcagggtttgttaagactgacaaggagttccagagcaaagggcaaacttctggcacaaccgctacatttgtgataattgatggatggactatcactggtgcatctgttggtgattctcgctgtattttaaatgcccagggtggggctgtttctttgcttactgtggatcac

SEQ ID NO: 698 - DNA, 687 bp, Sorghum bicolor
  Clone ID: SORBI-28MAY03-CLUS122567_1
gcacgaggacgacctcagccgcgtcctccttccccgctccgcgcgccgcatacagccgccctgcgccccccgccgctccgcagcccgccgctccctggccccgcgccgccccaccctccctccccgcgcccgccctcccggccgcccgcccccggccggcccgccgcgggctccccccgcggtcgcccacagcccggccgcgctccccacccctctcctcgcccgccgcccggcctcctcccccgcccccctccccgcccgcctcctggccccgcggcgtcgatggcagcgccggcggcagcgctcgcgcgggagctcctggacgcggcgcgcgcgccggggttcgcggagtggcagcgcggcgtgcggcgccggatccaccagcacccggagctggcgttccaggagcaccgcaccagcgcgctcgtgcgcgccgagctcgacgcgctcggcgtcccgtacgcctggcccgtcgcgcggacgggcgtcgtggccaccgtcgccggccccgccgcggcccggggggccgtgttcgcgctccgcgccgacatggacgcgctccccctccaggaaatggtagaatgggagttcaagagcaaggaagacggaaagatgcatgcatgtggccatgacgcccatgtggcgatgcttctcggagcagctaagctgcttcagtctcggaggcgc

SEQ ID NO: 699 - DNA, 626 bp, Sorghum bicolor
  Clone ID: SORBI-28MAY03-CLUS122574_1
gcacgaggagagagaactagcagcaccccgagacggctccggttcaggcctgccatagccgcggcagacgcgacagccaggagcagaggcagcagcagggtcgccagccggaggatcggcagcggcggcgctgcagcgagagacgcgggcgccgaggtcgtcgtgctgcggcggcggcaggacgacggtaaggagacgaaaaagcaggagccggggctgttcaacaacgtgatcgaggagacggcgagccggctcgtcgcggaggcgaggaagagcaaggtgaaggcgctcgtcggcgcctttgagaccgtcatctcgctgcaggaaaccagcaaggccgctgctgctccggctatggcagcaggtgtcgtcgtgccatgagcgattcttgatctgcagtgtgcgtgatcatcattcttggaatttcgtacttgttttttggttccacaaaagagagttcgtagtactttaaaaaaaaaaggaagttcgtacaggttttgtgtttgtgcaaggcttggcattgtactacagataaggccttgtttagttcgcaaattttttgtttttggctattgtggcatttcgtttttatttgacaaacattgttcaataaaaagtaataggta

SEQ ID NO: 700 - DNA, 884 bp, Sorghum bicolor
  Clone ID: SORBI-28MAY03-CLUS122599_1
gcacgaggcatatgaacgatgagaatattttgaatgctgtcagtattgaaaaggatgttgatggctttcatccactgaacattggacgactcgcaatgcaaggtcgagatccattctttgtaccttgcaccccaaaaggatgcatggagttgctacaccgatatggagttgaaattaaagggaagagagctgttgtaatcggaagaagcaatattgttggaatgcctgctgcattgttattgcaaaaagcaaatgcaactgtcagcattgtacattcacaaactaagaaccctgaggaaataacacgacaggcagatatagtcatcgcagcagttggagttgccaacttggtcagagggaattggataaaacctggagcagctattattgatgttggtatcaacccagttgatgacccagaaagccctcggggttataggctcgtcggagatgtttgttatgaggaagcctccaaggttgccggagcaatcacaccagttccaggaggtgttgggccgatgacaattgcaatgcttttgtcaaacacacttgagtcagctaaaagaatccacaaattcaaataactgcacaatccaacagaaataaggtgggggttgcgtgcctaaccttttgatgtagactacaagcaaaggttttgctcaactgttttctgtgccttgccttctgttggaccagaaaagtgcaggagtcctaaaaaataaattttgacacagatgagatgggttcataggggtatttttattttgataatatgacatggatgttggaatcctgtttctggcaccagttgaattgaggtgaatctgagatgtcagtaagttgaggtgtcagtaagctgtgatgaattttgttttgctacagca

SEQ ID NO: 701 - DNA, 674 bp, Sorghum bicolor
  Clone ID: SORBI-28MAY03-CLUS122087_1
gcacgaggctcgccctcaccgctaccttcttcccggcgtattccaggcctcgctcggcctcctcaggttggggttcatcgtggacttcctgtcgcacgcgacgatcgtggggttcatggccggcgcggcgacggtggtgtgcctgcagcagctcaagggcatgctgggcctcgaccacttcaccacctccaccgacgtcgtctccgtcatggactccgtcttcacccagacacaccagtggcgatgggagagcgtcctgctcggctgcggcttcctcttcttcctcctcctcacccgcttcatcagcaagaggcggcccaagttattctggatctccgcggcggctccattgacatcagtcatactcgggagtgttctggtgtacctcactcacgctgaaaaccatggcattcaagtgatcggttacctgaagaagggtctgaacccaccatcagtgacaagcctgcaattctcaccaccctacatgatgcttgcgctcaagactgggatcatcaccggcgtcattgccctcgctgaaggcattgccgtagggaggagcttcgccatgttcaagaactacaacatcgacggcaacaaggagatgatcgcgatcgggacgatgaacatcctgggctccttcacgtgctgctacctcaccacgggccccttctcgc

SEQ ID NO: 702 - DNA, 522 bp, Sorghum bicolor
  Clone ID: SORBI-28MAY03-CLUS12260_1
ggtgacactgctgatgatcactatcatcgttacatggaagatattgaattgattcattccttgggtgtcaactcatatcgattttccattgcatgggcaaggattctaccaaaaggccgctttgggcatgttaatccagatggtgtagcattctacaatgctcttattgatgctcttctacaaagaggtatagaaccatttgtgacgatatctcattatgacattccatatgaactagagaagcgatatggtggatggttgagccccaaaattcggagggactttggttacctagcagatgtatgcttcaggatgtttggtgaccgagtaaaattttggataacatttaatgagccaaatatatttgcaaagctcagctatatctatggacggtaccctcctggtcactgctcaaggccatttgggaactgtaccttctgaaattcttcaactgagccatacatagtgggtcacaacatggtattgtctcatgcaaatgtggtcagcatttacaaggaaaaa

SEQ ID NO: 703 - DNA, 617 bp, Sorghum bicolor
  Clone ID: SORBI-28MAY03-CLUS122604_1
gcggcggcgggggcggggccgtacgaggagatgctgcaagtggtggagacgtgcgcagcccggatccggtggcgcctccgcccagcttccaagcgccgcctcctcaacgatatcctgtttctctgcaccggtttgcggcctgtggttctggttgactatggtggcacaatgcctcagctacaagaaaacctctgtagcctgttgcgtcatgcccggcaggtaacttcctgactgtgtcctctccgggtgttgatttctcgggatttgttctactcggtccctggtattgcacttgctgcacttgctccaccgcttgcacggtcgctgcaccggctcgcgttcgtgctcccagcggtaggctgtgccggtccgcctgcatcccgtggtcactgtggcactgtcccgcacctgggctctgtacatgtccttccccctggctcacctggcaaacccctgttcaaagacataagttttttggatcttgatagtgactagaagtttgtaatttgtatattgctctgccatccaacagttacatttacaacatatattaatgccattttgtttcttttgcttaaacagtcctcatatttaacttcttgttatgttgtgcttaa

SEQ ID NO: 704 - DNA, 1059 bp, Sorghum bicolor
  Clone ID: SORBI-28MAY03-CLUS122601_1
gcacgaggatccattgcatccgttaaccctccactcttctcatcgcccgattagacttggtcaccgctatctgtacactaggtaccttaccttaccttaccaaccacactccatcagatccatactactacgccaaacgtataagtagctgggcaccgccaacaccttgctaccaccacaacagacctcctctgtcatcttgtcacatacaactctgtcacaatgcctagaatcaccgctcccgtctcaaagcttactcggtctctggccgagtctcagcgccatgccggtatcgctctcatgcccaagtatgccgagctccttggagcttcttcagagcagtctcagcactctgagtcccgtggtctaaagactacccaccgccctactcctcagccatctctctctggtcgccgaaggccattgatgcagagcttccattcctcaacaccttctcgtgctcctgtcaaccatgtcgacagcacagtcttgcccaagatccacgctacgcccaacttcaacgagcctctccctcgtatgcctcttctccctgacaactatggcgcctaccacagctcaatgtccgatgccgccgacttgtatagcaagcggcccgtcatcttcgctgtcgaccctgatgtcgtcgttcctggtgctcccatggctaccatggatgccgtgaacatggacagcgtcgacgtcaagtttgttcatgagcagcctgctcaggagacaaagccagacgactctgacagaagtacctttctcaaagacgtcttcggcggaatgattcaggatattcttcctggacgcacgcttagcaaaaactaagaatcaagtgaaaatacgaaagggacgatagggcggagtctggttacaccagctactcaagagagctgatgatctattaagcgttttaatctgtttatgcgaagcaagatgcggttgcatcaattaatagcccgttacaagaggctccggtggctaagaaccatctttttttatacatcgatacacaatgataaagtgaaagctccaagtggcagactggaatcaatg

SEQ ID NO: 705 - DNA, 820 bp, Sorghum bicolor
  Clone ID: SORBI-28MAY03-CLUS122613_1
gcacgaggagcaagcgcgcccttcacagtttctagctagctagtagctagagcacacttctgctagctagtagtagccatggcttcctccgccgggtcgtccctcttcttcgccacggcgctcgtgatgatggcgctcatcgtgctcgatggcagcagcacgtgccacgccgcgcggcatctcgccgacacgacgactgccgccccggccgctgctccggccgccgtcccgggcattcctgcggtgccgaagccgccggtcatcgtacccaccgtcaccgtgcccgcggccacccttccaccgatgcccaccgtgccgacggcgggcgctgtgccaccgatcccagcgttgcccaagattcccgcggtgggcgccgtgccaccgatccccgcggtcaccgtgcccacagtgccgaacgccgccgcgctgccccctatgccggctatacccgccatgccaaaggtgacgctgccgccgatttccgccgtcgtccctaagggtggcgccttgccgccgatgccctccatcccggctggcgtgcccatgccgttcgtggcgtcgcctccttcggcataatcatcagcagtgtttaattgtgtcattgtctggagtgtaatatctagtcattcgctcatgcatgtctgatagattgtccatctgagtattcgagttgatcactcgtgatgcatgcatgtatgcatatgtgttcgttgggccgcatgcatgctgccttttcattagcggagtatttatttttccttttttatgtatgtttgtgattctatatacctatatattgtattaagttttgttggttcct

SEQ ID NO: 706 - DNA, 676 bp, Sorghum bicolor
  Clone ID: SORBI-28MAY03-CLUS1227_1
ccgtccgaatccaggtcgacagtgcgggcacccacgcccacaagcagagcaaggaaatggcgatcgcgatctcgcaggaggccttcgacgccatggtccgggagaacatggaggacctcggcatggaccccgatgaagccctcgctgacgccgttgaggcgctcaccctccagggcgccgatctctctgggatcattaagcgcgtgccgggagaggccgccgcggcggaggtgagcccggtggtgcgggttctggatgaactgaaggcctctcacagcgccagcagcgggtcggagcaggatctcgacggactcgtctctctgcttgatgaattgcgcggcctgtgcagctccggcgagggttctgagaatgcagcgatcgcggtgcggaatggcgtcgtggaggcgctcgttgccctgtgcgcgtccgcccgggttcagcaagagaggctgcttgcaacggccttgaagacgctgagctccgtgctccgtgatgtcgcaagcactgaaaagttcagacaaagtgagggacccaaaattgtcatggatctcttgaaaggaggctcagaaaattcagacttattggatgctggatttagtgttgtggctgcgggttctgctggcaatgaagttgtgaaagagtcctttatggacctgaaggttgatgaactcattct

SEQ ID NO: 707 - DNA, 709 bp, Sorghum bicolor
  Clone ID: SORBI-28MAY03-CLUS122652_1
tccggtacgacaacagcggcggcggcgcgtgcagcgagtccatcatggcggaccagatggccgggcagtggtacgcgcgggcgtgcgggatggagcccgtcgtggaggaaggcaaggcgcggagcgcgctggcgacggtgctggactacaacgtgatgcgccgtcgacgcgtcgtccgggcagtccaaggaggtgtggcctggcgtcacgtacgccgtcgcggcggccatggtgcacgagggcatgcacgaggccgcgttccggacggccaagggcgcacacgacgccggctggggaaaggatgggttcgggtacgcgttccagacgccggaggcgtggacggaggacggcggctaccggtcgctgcattacatgcggccgctcggcatctgggcgatgcagtgggcgctgtcgccgcctgagctccacaaggatctcagggcacccggcgcgcggtcggtagaagaggagtcgtcgccggcggacgccgcactcgggcaggcacagttcgagaaggtggcgaacatgctgaggctgccggaggagaagcagcctaagggatacctttgggccatctacaaggtgattaggcagatggtgctcccagaatgagagctgattagctgaacgaattcttactccatgcctgaagcagcagtaccgttgaatgcaaattgagcccactattatatgattatgtagagattta

SEQ ID NO: 708 - DNA, 567 bp, Sorghum bicolor
  unsure (1)..(567): unsure at all n locations
  Clone ID: SORBI-28MAY03-CLUS12270_1
cttcatcagatccaatccatgtaccctctcctggttctaaatcagctggaacatttggagccataaagcgtgaagttggagtagttggtgctaggcaaaggccatctaatagtgcagcaacaaccacatctgcttctaatggcttagtcaaagtggtttcagcaccaaaggttagcccacatttggagtggaagcccaaatcagtaagccccagctctatcagtcatgcagttactgctgcacctcctgctgctccatcacctgttgatgatggaagtaaaacagaagtgtctgctttgtctaagaagctttcacatgctaatgtatcacatgaacatgtcattataccggagcacatcaggataccagattccgaaagaactcatttcatcttcggttcttttgaatctgaaattgatccaaaggcttctttaacagcctcttgtgatattgtggctaaagaagaactgaatgatcactccccttcaagcctggcagctcaggattcgtcatcaacttcaggtcctaatggtagaatgtcatatgttgtttcctgcantccacttc

SEQ ID NO: 709 - DNA, 417 bp, Sorghum bicolor
  Clone ID: SORBI-28MAY03-CLUS122706_1
ctcaaggctcactcgaccgccatcaagggtctggctcacatcaccggcggtggtcttgtagagaacattccccgcatgctcccctcgactctgactgcggccgttgatgtcagctcgtggccccagccttccgtcttccagtggctgcagcgcgagggtaacgtctccccggcggagatggctcgcgcgttcaactgcggtgtgggcatggtcattgccgttgatcccgcttccgaggcggccgtccgtcagaactttgaggctgccggtgagaccgtttaccgggttggtgagctgcgtgctcgcgcggagggtgaggagggctgcgttctcagcggcctggagtcgtggagcgcatgatcacttttcccttcctttggttttttctcgaaaaatgtgaaaatggttgtgtttatt

SEQ ID NO: 710 - DNA, 518 bp, Sorghum bicolor
  Clone ID: SORBI-28MAY03-CLUS123043_1
ccgtggtggggctcgtgcgcgccgtcgcgggggagctcgcgcgctccggcgtgcgcgtcaacgccgtctcgccgaaatacatcgctacgccgctcgtcatgcggattctacaggagtggtacccggagaggaccgccgacgagcacaggctcatcgtggagaagagcatcaacgagatggaaggcgtcgtgctccacccggaggacgtggccagggcggcgctgtatctggcgtccgacgagtccaagtacgtcaacggacacaacctcgtcgtcgacggcgggttcacggtggggaaggtgcccaacatgcccccatttgcgcagggagctgtagcgaataattaatggatcggagggctgcaatggcttcattcgcgtcttctttttcgtgaaccaaaaaacttttgaataagctgtctcttgcatgcgtatgttttgttttgtgacaagcgaacaaaaatccagcagcaatattcgccgttctctcgatcggttcttcagcatttgaattgaaac

SEQ ID NO: 711 - DNA, 434 bp, Sorghum bicolor
  Clone ID: SORBI-28MAY03-CLUS123212_1
cggcttcggcacctttgtgcgctacaacttcaccgagcacatccgcgagctgccctgcaccgaggccaacggcttccccgagagcgactcgggctgcaagggccagttcatccgccacctatggaccggcaagaacgaccagatcaagattgacgtcggcgagcagctccccggcccctacctgcaaatgttccacgagcgcttcaccgccgagcgcagctattactacatcaacgagcccgacctcatggccaaggggcccaaagcctcggtccagaagccgcccaaggacgagggaaaggggggctcgtggtgaggaagaaccgtcggtcgaccgacgtgacatgatttatcgcaacaccatatacgcacatattatacgtacacacgattaatcggttggcttgggtaccggaaccacggggaatagacgc

SEQ ID NO: 712 - DNA, 583 bp, Sorghum bicolor
  Clone ID: SORBI-28MAY03-CLUS123155_1
gcacgagggtcttcatcctcgccttcatcggcctcatctttaaccacctcgactcgtggcacctgcccgcaacaaccaagacgggcgagcaaaagcaccacgacttccccgacacgtcgtcaccacccgccaacaaccccgacacgccgctcaagcccgccacgtcgcacgcgcctccgccgccgaacccgccgccgtttagcgaatcgacggcctcggaacacgccgccgagctgcgcaagttctacctcaagcagctgcgcaagccctccgtcaagcccgacgaacccaagtacaagccctggggcgccttcgactggaccctgcccgccaacccgcgctggaagcagcgcatgggcgagagcctctgcatcatcgacctcgacaaccgccccttcaacgagtcgggcgagctctttgggcccgagcccatgtcctgggccgacccgcccaagggtcacggcatctcgctgggtatcctcaaccactggctctacgccaagatccatgggtacaaatactactacatcaacatcggcgagtaccccgaccgccgcgcctcatggaagaaaccgcccgtcat

SEQ ID NO: 713 - DNA, 672 bp, Sorghum bicolor
  Clone ID: SORBI-28MAY03-CLUS122430_1
gcacgaggagatggatacgatttcatggaaaagatgaagctctaagattgatgaattggaataacagtgatcctcatttcagtctaagggtgaacacatcaaaaggctatactagggctgaccttgtaaaacgattggaaagtttacaggttcattatgaagaatcggttatggatggatttgtccgcattcaggaagggatgcaggcagtcctacaagctggattactgaaagatggcatttgtgctgtgcaagatgagagtgcaggccttgtagtgtctgtggtcgatccacaacctggggaaacaattgttgattgctgtgctgcacctggtggaaagactctttttatggcatcacggttgtcaggagaagggaagatacaggctctggacataaacaaaggtcgcttgagaatactcatggatgcagcaaagttacacggtctagatgatataatcaccgacatccatgctgatcttcgactatatgctaaggaaaccactgctaaatatgacaaagtattgttggatgctccatgctctgggctgggagtcctttccaagagggcggacttacgttggaatagacagtttgaagatttggaagagttgatatgtttacaagacgagcttcttgattcggcatcaatgttggtaaggcctggtggta

SEQ ID NO: 714 - DNA, 341 bp, Sorghum bicolor
  Clone ID: SORBI-28MAY03-CLUS123241_1
gacgacccacaagacggagagcctgatcagatactaccactaccacaactccatcaacgtcatgggagagccttgccgtgagttcgtgccaatgccagcgaacggcagcaagactatgttcgaaggggttccctacgtgtgcgccgataacatgaagcgattggctgacgagatcaaacggtttgagaaggtaacccttggatcagttcagacatagtagcagcttggcaactgaaggctagtacagatagatttgacattctttgggtgcttggctcatgtgggattggaagctcactcttctacagttctactgataggccagccattgcctctggctg

SEQ ID NO: 715 - DNA, 351 bp, Sorghum bicolor
  Clone ID: SORBI-28MAY03-CLUS123248_1
tcccagcagcagcccggcggccgtggctggtgggtccggggtcgtccccgccgacgtgccgcgcgcggtgcgggcggtgcacgccgtgccggcccacccgcgtggccatccagcccggcgtcggaccccagtgggagtactacccggaggtgtggcgctgcaagtgcggcaacaagctcttcatgccatgatcgatcgatcatcaacaaaagacgatgagagggcgtggagccgacgacgacgacgatgaacgactgcgaaaaaaaaaaaaggaccggccggtgtgccgtacgttgattaattttgccaagattaagggtgtacgtgcgtacaaaacgtacaaaaggggag

SEQ ID NO: 716 - DNA, 741 bp, Sorghum bicolor
  Clone ID: SORBI-28MAY03-CLUS123311_1
gcacgaggaagacatgtctctatgatcactataactctttcaaagatagagctggacacatcgtctatcggatatcaatctccattgcctgctgatgaactgaagcctttggttgaatatgataatgatgaagatgcacactcacctggtggccgacgaaggggtcgtggtggtcgagcccgtgggcggggcacgggtagagcaagaggtggacgtggaaatgggtacaacgactatgctgatgtcggttgggaagatgatcacgcccctgcatatatgggcaatggatatccccgtggaagaggtcgtggtttcaggggccgtggcaggagaggcggctacaatggccagcctgattaccaacaggatgcaggctattatgaggaggcacctgttcatgctccagcccgaggtcgaggccgtggtcgtgggagaggcccatccagaggtagaggacgtggtggcaatgcaaacggggtgatgcatgctgctgcaccaggtgcataagccgtttgttcccagtctggactggtttgttggatgcctgctccaaatatgaaaatgtatcatctgttgttgtcagttaacgttatacttggtataagattgacattctgtgtcggaatgcatccaggttttgatatttgactaggtctgtagggtagcgtctttacaatgcttcctccttcccagtagatgtcttaaactaattgtagcttcgtaaaggtttagagcagggca

SEQ ID NO: 717 - DNA, 615 bp, Sorghum bicolor
  Clone ID: SORBI-28MAY03-CLUS123319_1
gcacgaggccgcactgcttgcgagcgtgccaagcgtaccctctccagcggtgcccaggccaccattgagattgactctctcttcgagggtgaggatttcaccatgaccatcacccgtgctcgtttcgaggagctcaacgccaaggcctttgctggcactctcgagcctgttgcccaggtcctcaaggatgccgctatcgacaagagcgctgtcgaggagaaaggccacctccgccgagaccgccgacctcctcctgctcgatgttgttcccctgtccctgggtgtcgccatggagggtaacatcttcgctcctgtcgttcctcgtggacaaacggtgcccacattaaagaagcgaactttcaccactgttgccgacaaccagcagaccgttcagttccccgtcttccagggtgagcgtgtcaactgcgaggacaacacctctctgggagagttcactcttgctcctatccctcctatgcgcgctggcgaggctgtccttgaggtcgtcttcgaggttgacgccaacggtattctcaaggtcaccgccactgagaagtcctctggccgcagtgccaacatcaccatctccaactctgtcggcaagctgtctaccgg

SEQ ID NO: 718 - DNA, 788 bp, Sorghum bicolor
  Clone ID: SORBI-28MAY03-CLUS123323_1
gcacgaggggtaagttgtgcagccatcgactctcacttgtcgccctgttctttgtttggtggctaaaatggcagctgggcccggacccggtcggcgctcccaggtctgtaaatcgctggtggcactggagcagcacatggacgcggcggcgatcgtcaaggatctcctcacgtgcaagttcatggagaaggagcagcgcgatcagctgcacttcctctatgttggtacgcgccgcgcttgcgttcctttggccggctgccgggtcaccgctgcttgctaatgcgacgtctgtccacaggtgtggcgtttgaccacggcgactttgaggcagcgtatgagggcattcgtctcatctgtctgcgcaacccacagtccactcgcgcctggaatctgctcaacacaacgaccattagaatgggtcgcttcaactccaggtcgcaccacaagttcatcgtgcgccaactcctacgcagtcccaactcggtgccgcttatgatcctcgctggccacgactgcaacatctctggtatctccacacctgacgcacggattgccgcgcgcgagccttgtgtctgacctcgcatcacaggcacacacaagttcgcgctgggcgagttcttccgcgcgtaccacttctcgcccaagcatccgatgatctctctctgcatcgggctcacctacctcgctcaggtacgtaccctggctcttgcgttcagccgctcgtgcgcacaccccttatcggcgagttgcacttgcacgttgcacaggtgatgaacaggagaaggacc

SEQ ID NO: 719 - DNA, 612 bp, Sorghum bicolor
  Clone ID: SORBI-28MAY03-CLUS123330_1
gtcgattctaccagaatgtctactgagtcacctccgaggttcatctacaagattgtcccgtcgccgcctcgtgacccttttcccaaggaacatcccttatcgaaacttgatcagaatgatggctttgtacatctgagcacgtccactcaagtacctaagaccgcagacttgttctttactagatcatcctcactttgggtcataaagcttgaattcaagcagtttgctgattccatcagatgggagggcgggtttccccacctgtatggcaatttcggggctgacaatgtcgactcaattgtgaaatttgtccgtcaagagagccagacgtgggacgaagtgatggcaaagtcagaatggctggattgaatctattcctttatttggggagagtggatttctaaggactgcccctccgtaatcacatatctaaaggccgagatccttctcgaccatacccttacaaattggatggtaaaagtccttgttcttctcgaatgtttgcaatgccagctgtctatccaccttgttgagggcgcggaacaaagggcgcacaaacttcattcgatccaactcgtccaagcagagtggcggcgtcccggtagatagcag

SEQ ID NO: 720 - DNA, 730 bp, Sorghum bicolor
  Clone ID: SORBI-28MAY03-CLUS123349_1
gcacgaggctggatccttgtcattgaccttcgcagctcccggaggtcctcaagagctgattgcccttcatccgagtcggagggtgctgtccaaattggtgcagaaactagagaggacagcctgcttgcagtccacttgacgattccagatgcaattagcccagccatatgtgcttgcacctgtgttcgatctcagactcttaagaactttatgaccagatctgtgacgggtttctgtatccagtttcctgtttatgctaaacagcagcttctgtgtgtggccatggagataaggacgtttactttgtgcaggctacaagttgtacgcattctggctggattctcacatggggtgatttagtggcggagccaccctagcggcgacggcgacgtggggcagccgttccagctagacagtaccggccgatgatgttcagagcatcctcgtttttttcctgtcatctttctcatgtcatgtctcgcatcttacggagcaccgcgccagggggtcagacaaggcagaaaaaaaggtgctgcagcttggcttgttcaatggggccacaccacaacgacaaagacgactatgcagtattgtgccggtgccactaccagctagcagtaacagcattctgctgtttgggtttagattaatctcaacggcaaacacccaatgtactagtgctaaatgctgaagactaataacattttaacatttgagtttaggttactaa

SEQ ID NO: 721 - DNA, 522 bp, Sorghum bicolor
  Clone ID: SORBI-28MAY03-CLUS12335_1
gcacgagggcgctgtattttgaggccattggactgtcaggtaccaagaaaccaatgaggcttgaccttacaaatcagaattcaaaggttgaaaagacgaaagttgggccatttggatccaaattatttgactctgctgtctcagtttcttctggttcagcgtcagatgaatggacattggagtttgttgatttcagtggggagacgagacgagatgtgtggctcgccttcatcagtgaaattatttcagtttatagattcattcgtgaatatggtccgggtggtgatgacccagcaattcacaatgtgtatggtgcctacaaagggaagaaaagagctgttagcagtgctgcaaacagtattgcaaggcttcagtccctgcagttcatacggagattatatgaagatccagcaaagctagtgcagttctcatacctgtccaatgcaccatttggtgatgttgttcttcagaccctagcagtgaatttttggggtgggcctttgactacaaaagccagatctg

SEQ ID NO: 722 - DNA, 512 bp, Sorghum bicolor
  Clone ID: SORBI-28MAY03-CLUS123412_1
tccaacgatgaggctttcagcaagcgtttcgaggctaagcagcagctcgagtcctacattggccgtgttgaggagattgtctctgaccctaccctgtccctcaagctcaagcgtggccagaaggagaagattgagtccaccatcagcgacgccatggccgctctcgagcttggcgacagcaccgttgaggacctcaagaagcaggagctcgccctcaagcgccttgtcaccaaggccatgtcctcccgataaatgcatcaatcggcgagtgatgatgggataaaaaagcgggatgaagtgggattccgggagttgggtgtggaaaacaaaaaatttgggcgactggtagcataagaatcgctcactggtccttagcgccttgggaagagcgctatcatgggaggaatatcaacctcctatttccttgtttcatatttttctccaaatctgtgtccattcaattgagaagataccgaggcatctgaagagttttttttttgcattttcactct

SEQ ID NO: 723 - DNA, 551 bp, Sorghum bicolor
  Clone ID: SORBI-28MAY03-CLUS123371_1
ccccacaccacaccacaccacaccacaccaccacaagccccccctccgtcctcgatccccaagcagtcagtctcccctcccctcctcccgttgggcgttgggtgttcgcgagccgccgcccgccgtcccctccattcctccccggatttggttggtgcgcgcggcggcggcccggggagtttcttgattcggcggggagcaccgccgtcgccgtgggagggcgccgccgcttctggctgtcgtgacctgacccctcgccgctgcagcctttgtaggtagctattattccagaggtgatttctccggattgacttagggcaaatctggttcgtgatctctagtgccagagggagccacggttttgcctttcgatgtattagagccaagtgctcaagattttgcagttccgatggagtctaagtgtgtgaatgaccacgatgcctcgatcgacctggaaagtggcaatgccactgcagtaagcaaccacagcaatggtgtggatgccagttttacagtggcgcaagcaagaacagcacctaacggatgtccgg

SEQ ID NO: 724 - DNA, 799 bp, Sorghum bicolor
  Clone ID: SORBI-28MAY03-CLUS27660_1
gatcatacacagggatgtcaaagcagccaacatccttctagatgactactgcgaggctattgttggtgactttgggcttgctaaactcctcgatcaccgggattcgcatgtcaccactgcagtgcgaggcactgttggtcacattgcgcctgagtacctctccactggtcaatcgtccgagaagaccgacgtcttcggatttggcatcctgctactggagctgatcaccggtcagactgcactagagtttggaaaggcagcaaaccagaagggagccatgcttgattgggtgaagaagatgcaccaggagaagaagctggacgtgctggtggataagggcctgaggggcggctatgacaggatcgaactagaggagatggtgcaggtggcattgttgtgcacgcagtacctccctggccaccggccgaagatgtcggaggtggtccggatgctggaaggtgatgggctcgcagagcggtgggaggcttcacagcgtgcggactcgcacaagttcaaggtgcctgacttcactttcagccgctgctactccgaccttaccgacgactcgtcactgctggtgcaggccgtcgagctgtcgggcccaagatgacaccaccaccaccaccaccactagtttgcacttgtacagcataaagaccgagaatcctgtgtagattgccagattgaggaataaaatgagccatactagaataactatagatgtgtattaaatgaactgtacaaaagaagagtgtaaggtttgtactgatttagatatttacagaaataatagtgcgag

SEQ ID NO: 725 - DNA, 836 bp, Sorghum bicolor
  unsure (1)..(836): unsure at all n locations
  Clone ID: SORBI-28MAY03-CLUS123455_1
gcacgaggctcctctcgtcgtggttcacggccaggcgcggccgccgcccgtccatgatcatcggcggggcggcgttccttgccggcgccgcggtcagcggcggcgccgttaatgtgtacatggccatcctgggcagagcgctcctcggagtgggccttgggttcgcgaatcaggcagtacttttgtacctctctgaaatggcccctgcacgataccgaggagcattcagcaacgggttccagctcagcctatgcctcggctccctcgccgcgaacatcatcaactacggcgccgagaagatcaccggcggctggggctggaggctgtcgctgggcctggccggcgtccccgccgcgctcttcacgctgggcgccgtcttcctgccagagacacccaacagcctggtgcagcagggcgaggaccgtggcagggtgcgcgcgctgttcgtcctcatcggcgtgtacgtggccgggtacagctggtcgtgggggcccatgacgtggctggtgcccagcgaggtgttcccgctggagatccggtcggcggggcagagcatcacggtggcgtccgggttcgtgttcacgatcttcatcgcgcaggggttcctcgccatgctgtgccggatgagggcctggctcttcttcttctttgcggggtggatcgtggtgatgacggccttcgtgtacatgttcttgccggagacgaaggggatgcccattgagcagattgggaaggtgtggagggagcactggttttggggaagggttgtggggtcgtcagaagaattgcaggcgactcacaaagtcagtgacaatttgtnaaaagaactgagataa

SEQ ID NO: 726 - DNA, 633 bp, Sorghum bicolor
  Clone ID: SORBI-28MAY03-CLUS12349_1
ccgtcacttcgactcttccactcctctgtcgcttcgctgccgtccgccacctgagtcttgtcgccgccgccgggatggccggagtcaccgccaccggggtggccggagttccctccaccttctcctctgccacctctcagatcgggggcttcctctcgaagaagccttacgcgccgccgtcgtgggccacgcacctatcccccatgccttcccataccttctcgcttggccagttcccaacgccgattcacaagtggaatctgcccaatttgccggaaggcacggaagtatggatcaagcgagacgatttatcaggaatgcagttgagtggaaacaaggtccggaagctggagttcttgttggcagatgctgtagcacaaggggcagactgcgttattactgttggtggtatacagagcaaccactgccgtgccacagctgtggctgctaagtatctcaatcttgattgttacctgatactacgtacctccaagcttcttgtggataaggaccctggtttggttggcaatctccttgtcgagagactagttggggcacacattgatcttgtgtcgaaagaagagtatggaaaaattggcagtgtggctttagctgatctgctgaaaaaaggct

SEQ ID NO: 727 - DNA, 717 bp, Sorghum bicolor
  Clone ID: SORBI-28MAY03-CLUS123509_1
gcacgagggtcaacgctgccgatacgtaccgcccgtggcctcatccgtacgacgagccgcgcggggccccgtcgtcgtcggcgtcgctccctggcacgccggaccgcggcggcgcgcatgccgccgcgcagtcgtcgtcgccgttgtgggccgggccgagcgccaaggacaaggagtacgcgagcgagacggaggcgcggtggccgcccgacgccgacgggcgcggcgggaggcggcatcgtcagcaccggcgggcgcgggtggcgcgggaggtgtggctggagcgcgcgtggcggatgcggaagcagcggcggcagctgcaggaggaggtgcccgtggtcgtcctcggcggcggcgaatccccggcgagccgcggcggcgtggcgatggacatggaggaggtccgcgcgtgccgggacctgggcctggctctcccctgcgactggaccgtggagatcccctgctacgcgctctccggcgtcgacaccgccagcagcggcggcaactcgccggcctccggcagctggcgcatctccagccccggggacgatcccaaggacgtgaaggcgcggctcaaggtgtgggcgcaggcggtggcgctcgcgtccgcctctcgtctcggttcttgaccggcaccaagaagcaaccagcggccggccggcgatcaagacggatgcaaaagctcaccatgcgtacacattcacaggacagattatt

SEQ ID NO: 728 - DNA, 1214 bp, Sorghum bicolor
  Clone ID: SORBI-28MAY03-CLUS123520_1
gcacgaggaggtcatcgacaagggtccgcgtaacattgatttggacatacttttgtacggcgacgaaaaggttgaccacgagcggctcaaggttccccatatcggcatattagagcgagagtttgttctcagacccctggccgaactcattccggcaaaatcattggatccgacgaaaccgtggaagcttattcaggataatctcaatgagctgcctcttggcgagccattgtcttccatgacaccgctttcttcgacggcaggttctttgacgcctcttgctgcaaagcgcaagacccatgtcatgggcattctcaacttgacgccggattcgttttcagacggtggtttccatgatcgagataacctcgcccagactattatggatatggtcaacaacgggacttcgattattgatgttggcgggcagtcaactgcccctggccgaccagaagtatcagccgaggaagaagcatctcgatttgtgcctgctgttcagctgattcgatcgattcctgaagctcgtgatgtggctatcagcattgacacgtatcgtgcatccgttgctgaggaagctattgccaatggagcagatataatcaacgatgtttcggctggtctgctggacccagatatgctttctaccgtcggccgtcttgagaaaacgatatgtctgatgcatatgcgcgggacaccgcagaccatgacaaagttgacctcgtatccagacggacttattcccacaatagcatctgagcttctcgggcgcgtagcagcggccgaggcagcgggtatccggcggtggcgcatgattctggacccgggtatcggcttcgccaagacgggagagcaaaacctcgagattctccggcggctggaggagctgcgatactggccggggcttcagggcctgccgtggcttgttggctcgagccggaagacttttgtcggcaagatcacgggcgtcacggagccgaagcaacggacttggggcacggcggcgacggtggcagcggcggttcagggcggtgcggacatagtgagggtacatgacacgcaggagatgggcatggtggccaagatggctgatgctatctggagggtatgagactatgagtacgaagaaagagtgcagctggttggatgtctacggtgtgtgttgaatatgcatgaatatagacggaagagacagaatggaaatgcgtagcagaagg

SEQ ID NO: 729 - DNA, 576 bp, Sorghum bicolor
  Clone ID: SORBI-28MAY03-CLUS123608_1
gcacgaggctccacgcgtccctcctcctcccggacctgcccctgcacccgcactcgcacgcgcccatccgcgtgtacctccacccctccggcgcgctcctcgccgccgcgcacggcgccgtccccgcccaccgcgcgcgcgccgccgcgaaggccctcgtctcgaggctccagcctgaggaggtgctggtcctggacgcggtccggagcgggtcgtaccggggccgcctcgccgcggacgagcccgtggaggggaagctggagacccgcgcggcgcgcgcgcgcggaggcgtgggcgcggccagggccgtcgcggcgctggccccgcctggcagcgtggtggacgggctcggcgccgccgtgctcgcggagtgcgagatccggggtaaggcggccagcatggtggtgacgtggcccgcgggcgccaggcctgcggagttcgtggtcacgcggcgcgtggcagaggagatcggcgtcgacaccggcaaggctgcggcgagggtctccggccggccagagctggatgcgttgtacacttgagatttctctgttactgcttctgatttcgttgcctggt

SEQ ID NO: 730 - DNA, 798 bp, Sorghum bicolor
  Clone ID: SORBI-28MAY03-CLUS123649_1
cggacgcgaggatcgcgccgctgtcgctgcagctggacgagcggctgctgctgcgcgccacggacgccgcgaggctcacgggcttcaacggcttccgggggctcctgtacgcgctgcacaacgcgagctcgctcctcctgctcatcctcgccagcggtgccgtctcctgcgcggccgcggcggccggcggaccgtgcgccgcggacgacaccgccggcggcggcgtggacgccggtgccggcttcatggcgtccatcgcaatgctgcagcagaggatggcggaggaggccgagtccgacggcgcggcggggatcaggatgtgcgagttccggtgcgcgcgcgccgccgtggaggcggcgcgggaggaggtggaacgcgtcgccgcgacgggccgcaagtgcgagggcgccaccggcggcgtcgtcaaggacaaggtggaggagctcaaggcgtgggtggacgtgctccggaccggcaccgatagcctggtgtgccagctggacgacttcctggacgacattgtcgagggcaggaaggagctctccgacctgtgcagccattgatggatcgatcacacacacacacacacacacctcctcgtgccccccgatcgagccagcctcggagctccaccagtcccagcataaagatcgtcatcaccaccatcatcacaaattcatcacatgaacgaatgaatgatgctcgttgcttgcgttgcgttgcttgcatggtagtacaagcaaagtcaaatacgtacgtactagcagtgtccctagctagcaatagcctgttgttgtc

SEQ ID NO: 731 - DNA, 1133 bp, Sorghum bicolor
  Clone ID: SORBI-28MAY03-CLUS123666_1
gcacgaggtcctcatctctcactccgcccgccgcaatcgactccgtctcggcgtctccgatccggctctccgccgccgctagtcgacccaggcatccagcactgcagcagggagcagccgccgccccgtccatcgatcggcaactcggcccctgccggaagcctacaaggggctatccgcagccccgcggtcggccgtcggaggcgccgggcgcgctgcccgcttggcggctgtccgccttgggcctggccacagcggcacagcccgcaggtgcacgcccagactggacgtttggacgcctggccgaccaggcgccgagcgcggagcagcgagccgggcagccggcgaccgtgtatctccgtcgcagcgtacgctgtccagcctccagcttgggcagggcgccaccgcagtactctgcacacataatacatctcggttggcactagacaccatagtatcaatcaaccaacctcaatctctgctggttagatagatggaggtgccaatgaactctacgcaatctggtgctcactttcctgtgcagcatcggtccttctcgttagacatcaagggaaacaaaacagatattgtcatcagtaaatatgaagatacctttctggtgattgtgacacaaatcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgaccgtgccaagaaagatgaaagtgttttctcggacccaacctacaacgtttctgttctttttgggaagagagatgagccactcctagtagcttgtgcacgtcaacttattgagcacataagtggcagtggctcagcccggtcattggtgatttctctgggcctgaaagatcattctcagggaacactgaaggatatcattgtagctgtgattgagaatcgcctttggtgatgattgaatagctgagctgggcatgagattggcttattcagcccatggataaagatactgtttatcattgtgcgaggagccatggtttaccatatactgaatactggtagttttgtagttag

SEQ ID NO: 732 - DNA, 579 bp, Sorghum bicolor
  Clone ID: SORBI-28MAY03-CLUS123681_1
cgctccttgtcgctacagatgttgctgcacgaggtcttgacatccccgcggtgaaggttgtcatcaatgtcacgttcccattggcagctgagggctatgttcacaggatcggtaggacgggtcgtgccgcaaaggagggtttggcgatcacgcttttctcggaacatgacaaagcactatccggatcgttgatcaacgtcctcaaggcagcaaaccagcccgtaccagaagagttgatgaagttcggtacgactgtcaagaagaaggaacatggtgcatacggtgccttctacaaagacacttcagacgtcaaggccgctactaagattacttttgactaagttgtatgggtctgggcatgtgttgttagaagcggactccggcatctcgtaatgaagctggtcgccgaagtagatgccgcaggctgcagctgcagcgaagatcgaattttagacgcaggagcattcctctagcggaggcgtttcggatcatgcaaagcaaaagttccggtagtgtacattgtacagatcgcgatgtgttttcccgagctttagtctggctagtttgcaagcttcttgt

SEQ ID NO: 733 - DNA, 873 bp, Sorghum bicolor
  Clone ID: SORBI-28MAY03-CLUS123887_1
caaaaactgtgcgcttcgcacctcgctccgctgagttggcctctcgccctcttaccccacaggaagcttggtcactatatcacttcgagaaccatgcccgtggatgccgttcctgcgatagccgtagactctgcgatgtcggctacaacctatcgcaggacgttcgaattcttgtctgccagcacggtggcgagctgtgcagcacaaggcccgacgaggagggcaagtgggttcgcgttgaagtccctcacgcatacgacagagttaaagtcctcctcggcgccgaacgcagcagagagaggaagaagcacgccccggttgtcagctatgatgcccccgaaccgaagccctcacgaaagagggaaccaacacatgtggtcgtcgagccttctcgaacccacagagataaggagagacggtcaaggcaaaagccgcagcgttatgatgttgttgaagtaatccctacctctgaccatgaccggaaacacgagaggggcgagcctgtcaagctgcctgatagagcgaagaggggcagcctttacgagagcgatatgcgacgaccgaggagggagtaccgcctggaagatcgagcgcctgagcagagggagaggagggaccggagtcgcgagagggaatggagagagcgcgatagggcagagaggcacgagaggcggaggcgggagcgagatcatccagatgggggccactgagcgcatgtggtatcgatcttgtttgatcgagaggttttgacgactgagctggctggtcttgctctttcttcttgatttttggaaaacggtaatttggaatgatacccaagaggctacaacggatgccagaaccggtagcaataacctatcttcgacgagttaa

SEQ ID NO: 734 - DNA, 309 bp, Sorghum bicolor
  Clone ID: SORBI-28MAY03-CLUS12375_1
cgaaaggcggcgcagccgaggaactgaggaaggaagagaagcccgcaggctccgctagggcgagagaggtcggcgcgattcggggatgggcaagggcggcgaactctgggacgattcggcgctggtcgacgccttcgaccgcgccatgtgcaccttcaaggtatgcttgcttgtctcctccggcttctatgacttccgggacagctgcccctcgcccgccgccgcagctgctagggtttagggtttttgggcgttgagaggtggctgtcggttgcgtcggtgggtaggcgcggtgggtgcctggggttc

SEQ ID NO: 735 - DNA, 659 bp, Sorghum bicolor
  unsure (1)..(659): unsure at all n locations
  Clone ID: SORBI-28MAY03-CLUS123986_1
cgaggctctgtttgaaaagtattacacttcaaagaacttgccatacattccaacagctttcgatggccgatcagactacgatggattcatctcgcgaggaattcctgcaggtggtctcttcactggcgctgaaggcgtcatgactgaggccgaggcgaaaatgttcggaggacaagcgaatgttgcctacgatatcaattaccatgctgctggggacaactgcaccaatctcaatcacgaggcattcctgatcaactcgaaggccaccgcttttgccgtggcaacctacgccaacagcctcgcttccatccctcctcacaatgcgagtgttacccgcccagatgtgaagaatcgagcaccgaagtcgcgtgctcacaataagaagacggggtgcttccattctctggtcgaaatttaaggggctcgttagcgtgtggacggagttcaaatcatttgcgctttgcttctggggcattgcttgctgactcgtaagttgaaggtgccttgaggtgtttcgatgagtgttgggttatgaggtatggatgtcaatgtcacatatcttttctatgtggttcctgaaaatgcggtcatatggatctgtcgttattagttggcaggttcagtagcactagggcgatcgtactaaatattnctgaggt

SEQ ID NO: 736 - DNA, 799 bp, Sorghum bicolor
  Clone ID: SORBI-28MAY03-CLUS12402_1
ccagagcttgcatgtggccattgatgtcagtgaacctggtaaggtgaggccactaatggagatacagatacgcaccaaggagatgcataggggtgctgttggtggagaggcatctcactctctctacaaaggtggtcttactgatcccgaagaggctaaaaggctcaagactattatgttggctgcagcggagttagcagctcttcgcctacgagacctaccaggtagtgatcgaggagctgggaactgcaagaacccagctttctgtcagcttgacaagaatggggatgggagaatcagcattgaggagctcactgaagtgatggaggatctaggtgctggaggcgaagacgcaacagagctcatgcatcttcttgacgcaaacagcgatggctccttgagctctgacgaattcgagtcattccagagacagattgaaatgatgagaaacttggaggacgatgatgatcactacagggagatcttgaaggagaagctgcacacaatcgacagtgcaggtctcatccatgtctatcgcaaggagctcagtgacaaactgcttgtgggctgaccaggtactaaacacaacccaccaaaccgaacagccatcttactgtagttttgcatgtataccacactgagaagtgaccccagcactgatttgtaaatagtcgccgaatgtacatggtatcatatatgattgagaaaaaagagggccttcaatactggctgaatgtggatggtgttgtatatgattcaaaaaaaggcgggctgtaatactcgctgaattatatgattc

SEQ ID NO: 737 - DNA, 649 bp, Sorghum bicolor
  Clone ID: SORBI-28MAY03-CLUS124162_1
gcacgaggcgggaggctcccggcggctttgcgctcgggcagcgctgtcacagggctgccgttccccgggcctccagagttggtggggcgcggccttttcctgcggggtgctaccgcggttgtgcaccttctgctgaagccggcgcctgggtccttggtcggacgtcccctacctggcctctggaggtcggcgctaacggcgggctcctcggtctcgcccttcgtcgtgggtcaggcctgtgctcccgttcggcacccaagcaggcagctctcgtgccctcgcgtgtcagcaccggtccgggcgcgggcgcatggccgtgtcgtggcggcccgaaccatgggggcgtgattcatgtggccgctattggcgtcgggatcagtggcgctgtagctctgctggccgtctgcgctagcgatggctccctcccccagttccgctgccgcggccgtctgctgcgggtccgtggcctgtggtgctatagcaggatctcatcaatgatttgctacttcttctacaagaacatcacgtttggtgtgaccttgttcctgtacgatgcgtacacgtcgttctcaggccagcctttctacaacgattgggcaatggcgtgcttcaacgtcttcttcacgtcgctgcctgtgatcgccatggg

SEQ ID NO: 738 - DNA, 887 bp, Sorghum bicolor
  Clone ID: SORBI-28MAY03-CLUS124198_1
gcacgaggcactcgagctccaagcaaagcccagagagttcagcgatcgagtcgaatcacccggccgctagctagcactagcagcagcgcgatggcttccctgaccgtgtccacggcgaccgcggcggcggccggcggcaacaagagcaaggagcagcagcgcgagggcgcggagatcatcacgggcgcggaggcctgcttcgcgcactccaaggagatgctcaagtcgctggggttccccggcggcgtcatgccgctgcgcgggctggaggagtgcgggtgggtgcgcgagaccggcttcgtgtggatgcggcagaaggcgccctacgagcactacttccggggcacgggcacgcgggtgcgctacgacgccgaggtcaccgcgtacgtggaggaagggcggatgaagcgcatgaccggggtgcgcagcaagcaggtcatgctctgggtgcccatcgtcgagatgagcctcgacggcgacaagcgcgacaagatctacttcaagtccaacgtcggcatcggccgctccttcccggcctccgccttccccgacgaggacgaggaagcggcggagccgaagaagaagaaggaagaggagaagaaggaggaggaggagaacgccggcgacgacgacaagtcagccgccgacgatgccgccgccaacaagtgagacgcgcgagcgcgcgcgtgtcgtcgtcgtcctgcgagttctgtgcgcggttgcacgcacgattgcgcgacgcatctcgcgcgtgaccaagcgtgaagatgcatatgtatcatctttctttgcggagtttgtattattgcttttccctttttatttgttttattatattgtttttctctctctttcaaaacgtatcattgcttgtatctgttgttgcc

SEQ ID NO: 739 - DNA, 995 bp, Sorghum bicolor
  Clone ID: SORBI-28MAY03-CLUS124217_1
gcacgaggtcggtaccctgaggacacgtactacaacggcaacccgtggttcctgtgcaccttggctgctgcagagcagttgtacgatgctctataccagtgggacaagcaggggtcgttggaggtcacggatgtgtcgctggacttcttcaaggcactgtacagcgatgctgctactggcacctactcttcgtccagctcgacttatagtagcattgtagatgccgtgaagactttcgccgatggcttcgtctctattgtggaaactcacgccgcaagcaacggctccatgtccgagcaatacgataagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggccacatctgccactggtacctacagcagtgtgactgtcacctcgtggcccagtatcgtggctactggcggcaccactacgacggctacccccactggatccggcagcgtgacctcgaccagcaagaccaccgcgactgctagcaagaccagcaccagtacgtcatcagcctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgacacgcgacggtgactgacacctggcggtagacaatcaatccatttcgctatagttaaaggatggggatgagggcaa

SEQ ID NO: 740 - DNA, 801 bp, Sorghum bicolor
  Clone ID: SORBI-28MAY03-CLUS124225_1
gcacgaggccccgtcctgcactgctgggcgatctaggcgcggtggcgcacccagcggcgtagtcgacgcggaggtcgacgtctccgagcgggcgcatcgagacgaccgtagtcgtagggctcgtagttgcctcatcgtcatgtctatggtccccaacccccaggtaaccttgtatatgtctcaacgtctttaggagatgctcacaaattatctgaatccaccatccacaatcacatccattggtcgggtctaggcgcataccattcattgaaatcagaaccagaaactcaagcatggtctatccacggtggaacagagaggcatatagtgaaggtgaataacaactgacttgcttgataccagagattgtagtataacaccttggctaaagttatgtgcttctctggtgggacgatgttatagttagtctctacaaaaagaagcaacaatggtagcaactacctaattggtagctacagaagaaagaagctcgagggtaagcaaggcatcgtggtggaccaagttgtgcagccatcaccattctttgctcacgaaaccagggacttatctggttataatgttctacttgccatgcatgcttggaatggtaaaaggatagaaacatccatttgcaataatgataattatgaagtgaggaagcatatattgctacacctactcacatataccggaaacaaaaatatagccaacataccgaaaggtgttcgagatttgaacgctatattagtctcacaagcaaaaaacaatgaactgtttcttattttttctctatcaaagtgt

SEQ ID NO: 741 - DNA, 560 bp, Sorghum bicolor
  Clone ID: SORBI-28MAY03-CLUS12428_1
gcacgaggggaactcctagtctctgtcagaaaagctttttctatgctttctgacatggactattgccatggaaaggactctaatatcattctgagccctaaacttccttctgcaagcatttctagctgtgatatcaaggagcaaggtggtgacaagccatcttctttggttaaggactcatcactaatcaatgtctgtgatactgcactttgtcatccaaaagatatcttaagccgtttaacccttcctcatcgacaagatctggactctcttttagcacctggaagtgagagcacagctggagttaagccttatatgccttccatgacagttcatggagctagtttgccaccatttccttggtcacactcacaggctgggggctgtcggcaaagtgttgactgtggtaaacatgggtcaagtaggagtaactcccagtggcagtggggtacgggttggatccaacctcactctagattttgaagatacgtctgtccatagaattgatgatcctccttcaagagatggatgcagcgaaattatttataacaagatcatgt

SEQ ID NO: 742 - DNA, 557 bp, Sorghum bicolor
  Clone ID: SORBI-28MAY03-CLUS12430_1
acccagaatagcgggggaacatgaaatctgttgccccagatgcagctacaaaagtgaatgcatattagcagggatctgtcgtatcgtatttttgaatcaagttggttgcctgaactcatcgtatttgttttctgaaatgcattgacaacctgtcatcgctaaaagtggaagcactgctcaaaccaccttgaaaaaaagcaaggaacctgaagatggtcaaaccaccctggaaaaaaaaagctcaagggaaccagaagatagattccaggttcattctcttcggaacactttgatttagcctttattcttcctgcgtccacgcaagagacactcagaccaaattgtatatatcgaggtctattttagatgcatagtacaacaccatatctttagtactacctcaaagttttgtgaactttggagcactatacacagcaccttcgctctgtgttgctatctgttgtatacagcctgtacatatgcaccagttgtgcatcttaaactctatgtaaataccatgccacctatgtatggtttaagaagctccacatcagtgt

SEQ ID NO: 743 - DNA, 442 bp, Sorghum bicolor
  Clone ID: SORBI-28MAY03-CLUS124386_1
ggagatcaacgcctacaaatacgtcgagtgctcggccttgacgcaaaagaacctgtcgctggtcttcgaggaggcctgcaaggccgtcttcgtggaccacacccagaagacgggcaaggacaagaaggacaagaagggcggcggcggcggcgacaaagagaagaaggagtgcatcatgcagtaatcggaaccgatgatattgtaagatatcaggaggaggaggaggaagaaggaaggaaggaggaaagacgtcgaggatctacatggaaggacggaggaacgcgcgaacgatcgaaccggccaacagcgaggaaggaggagtgtcgatggaagaagaagaagatgacggagatgtggaggaagacacgcgcgaacgaacggaggaggaagcttcgttcctttcggtggtgggaggctcccattgtacaaataggcgcgccaa

SEQ ID NO: 744 - DNA, 561 bp, Sorghum bicolor
  Clone ID: SORBI-28MAY03-CLUS124346_1
gcacgaggcagcacccatggtctctcgccgccgctgagactggggcccaacgctctccaccgcgtccgcgcccgtctcctcctcctcctccttcctcctcgccgtcgttgcgttgcttcgcgaaaaggcgaagatgctgctgctgcgggcgtcgacgccgttcgggtacgccaaggtggacaaggtggacgcggaggaggcgcggcacctcagggcgcagtacctcatccacaaggtgctggaggagaagagccccaggccgtcggcgctggtgacgaggaccaggcccaggatcggcgtccggctcaagaagctcagggtcgccgtccgtggcctcagggcgcgcgcgtgccgggccctgcagaggcacctcaggaacctgaggcggctcgtcggcaacggacctcaggggtcgccgtcgccttattgatgacccgtgtctctggcgcttctgggagaagaggaggaggacgaatcctcgtgcctccatttttttttttggggtttggttattgggtgttgttgcgtggcaatggatcaaatagaagcaatggttcgtaa

SEQ ID NO: 745 - DNA, 490 bp, Sorghum bicolor
  Clone ID: SORBI-28MAY03-CLUS12441_1
gcacgaggctcaaaggaagtggctggacatggagctattgcacctcactactataaattccatggaattcgaaatggaattgatcctgacatttgggatccatatactgacaaatatattccggtccattatacatcagagaatgtcatcgagggcaagagtgctgcaaaaaaggcattgcagcagatgcttggattacagcaaactgatacccctgttgttggaatcatcactcgtctaacagtccagaaggggaatccaccttatcaaacatgcaatttatcgagctcttgaacgcaatggacaggtggttttgctcggttctgcaccagatcctcgcatacaaggtgactttacaaatttagccagtaggctacataatgaatatcatggccgggtgaagctatgtttaacctacgacgagccactgtcgcatttgatatatgccggcgcggacttcattcttgttccttccatcttcgaaccttgt

SEQ ID NO: 746 - DNA, 779 bp, Sorghum bicolor
  Clone ID: SORBI-28MAY03-CLUS124492_1
gcacgagggaagcactgaagctgtgtgagagagcgccgcgcgccgggaaggagccatggaaccagagaaggccgaggaggcagcgaagcaaccggtggaagcggaggccggagactccgtggatccccgcgaactagtgtccagcgacgacgaaatcgactactctgtcgagcccgagttctacgaccccgacctggatgacgtcgatgagcggtgggtggacaggcagaggaaaggccgcacatctgacgccgtgctcagctgccccgcctgtttcactaccctgtgcttggattgtcagaggcatgagaagtatgtaaaccagtaccgtgcaatgtttgttcgcaactgcaaggtcaagactgatcagatactgcgagagggcaagagcaaaaggaagaaccgcaaaggaagggctgctaatccaactacggcatcagaaggtgaaagcaaggggcaagcctaccaccctgtttgctgcgatgtctgctcaaccgaggttggggtgtttgacgaggatgaagtctaccacttcttcaatgtgatccccagcaactcttgaatcttgtgatgttatgtggaatagtttgtagacccatgtacgcttctgtagtaagctgtcgtatttactgttccgtatcgttgatcagcctgcggtacaagtaaaatcaggttgtgtggatagcatgcatctgtacggtacattgatgtgtgttttttttggtttatgtagcatacggttttgaagacgaggatctcagcttagctgtgaggctctt

SEQ ID NO: 747 - DNA, 575 bp, Sorghum bicolor
  Clone ID: SORBI-28MAY03-CLUS124526_1
agcacgagggtcaagctgactggcaagatgtctggctggactgctcctaaggacattatcctcaaggtcgctggtatcctcaccgccaagggtggaactggtgctattgtcgaataccacggccccggtaccgaaagcttgtcctgcactggtatggccaccatctgcaacatgggtgctgagatcggtgccaccacctccgtcttccccttcaacgaccgcatgtacgactacctcgctgctaccaagcgtagccagattggtgattttgctcgcgagtacgctcaggagctccgcgaacatgagggtgccgagtacgacgagctcatcgagatcaacctcgacgagcttgagccccacatcaacggtcccttcacacccgatctagccacacccatcagcaagttcaaggaggctgtcaaggccaacaagtggcctgaagagctcaaggtcggtctcattggttcttgcacaaactcctcttacgaggacatgacccgtgctgcctccatcgctgaggatgccatggcccacggcctcaaggccaagtctctcttcactgtcacccccggttc

SEQ ID NO: 748 - DNA, 394 bp, Sorghum bicolor
  Clone ID: SORBI-28MAY03-CLUS124594_1
gccgactacgagaagattggccccaacgacaaggtcgaccttgcctgccctgagcttgcccctggcaagccccttaccatgaccgtccaccccgccgacggcagcaagcccttcgacatcaagctctctcacaccttcaacgagggccagattgagtggttcaagatcggtagcgctcttaacgccatggccaaggctgttaagcagtaaatgctctaaatgagatttggacgaacataagaccaccactggggatgtaaattcagcaggacggaataccccgcgaaagcctaaaggttggggagagaaaagcccacctccgcgtatattgagtggatgatggcgagaggactggacgcttccgagaggtaacattggaagctttcgttatatg

SEQ ID NO: 749 - DNA, 840 bp, Sorghum bicolor
  Clone ID: SORBI-28MAY03-CLUS12459_1
gcgatatactctgatagtgacctttccttgcatatgtattccataaatggaaagcatattgcttcttcggaatccaatagccggctcaggtgcatggagctaagttgctgtggacagtttatggtatgtgctggtgatcatggacaaattgttctgcgctctatgcattctcttgatgttgtttggaggtatgagggagctgggaaaacaataacttccttagttgtaactcctgaggagtgcttcttggcgggaacaaaggatggtagcttgattgttttttcaatagaaaaccctttgcttcgtaaaaacgccatgcaacggcacaaggcaaaaccttccattggtggttagtggtatatagatgaaaacagtaccagaactgcttgctgcatgtttcaaatagaggttatctatcggcaataattgtaaaagagaagattctataactcatgtataaatgtacatatggcatcagattgagtttagcattctgaagaaggcatgtgccgatcacaatcaagaggataaatcttctaactgcaaaacacatatactatggaaattaaagtagatttatgtttcatgttcaagacggagcaaggggataggaccttcatatgatactcgagatttgtagggtggtagctagttggtaacgggggcgcatttgggtgtaatataacctttttttgtgggggcattcttgctagataagagcgaggcacagttttcccagatagaatttttaggtacataggttgtcgctgacgtgtaactaataatctgaacattgtaaatggaactgatggggtttataataggaggcgtgcagcttgg

SEQ ID NO: 750 - DNA, 936 bp, Sorghum bicolor
  Clone ID: SORBI-28MAY03-CLUS124621_1
gcacgaggattccaagaacgtacgtgcgccagagatagtttcctcagcaccctgcacctgtcgtcagccgtcaccggccagccagctagccgctagccatggccgccggttccgaagctcttcttgacgccaccgcgctctccctctccctcgcgctgccgacgacgacgccggcgcccggcctggtggcggggctcaagatcaacaaggaggactacctcgccatctgcctcgccgcgctcgccggtacccgaggaaccggcctcagcaacaaggcggtcgtcgctgggttcggcctcccgcagcaccagggacagggacacggcaataataataataagcagcagcagtggtgcccaccgccggcggcgctggcgcacgaggagcagctccggttccggtgcgcggtgtgcgggaaggccttcgcgtcgtaccaggcgctcggcggccacaagtccagccaccgcaagccgcccacgccggagcagtacgccgccgccgcggcggcgcagcagcaggaggcgttttccgcgcccgactccgaggagacgacgacgacgacgacgtcgtcgtcgggagggacgacttctaccggtgggccgcaccggtgcaccatctgccggaaggggttcgccacgggccaggcgctcggcggccacaagcgctgccactactgggacggcacgtcgtcggtgtccgtctccatgtcggcgtcggcgtccgctacggggtcgtcgtcggccgtcaccgtcaggaactttgacctcaacctgatgcctgtgccggagaacgccggcatgaagagatgggtcgaggaggaggaggtgcagagtccactgcccatcaagaagcgcaggatcttggattagtttaactctcactgcctacttttgagatcgtgtgtccataaatctcggattctcagttcatgtaaaa

SEQ ID NO: 751 - DNA, 1210 bp, Sorghum bicolor
  Clone ID: SORBI-28MAY03-CLUS124632_1
gcacgaggctgccctttcgtttgcccctggagagctgggtcaggtctacacgggcgcaacctcgactgcttcaaatccgcttccctcaaacaccccttcgaccaacactacacctttgccgactccaacaactatctcatcgccaattaaagcgactcatacatctgcaattagtggaggctttgccacggccaacaacggtcaggtacccccagccagccctgcacgttccaactcggcgggctcagtcggcacccactcgtctacgcagcaagccgcagctgtgattaacaatccaacgccgactctaggctctgtgccttctgtaacagcaacacactcctcgcagccctcgggcctccccctcacaacccccccgcagactcctttgccaaacactgcttcctcaactactagcactgttctaggcaagcgtgatgctcccgctaccagtgaatctgaaaaagaggattgcaaaggctccgaatcgatgacagtgacacaacagccgaagaagcgccgggttgccccaacccttatttctgcaggcactgattcaacctcgtcaaaggaccagtctcaaaatccgaatgttgggagctgaacatgggttgtggccttgcacgtcgcaccttctatccttaatcatcaagattggctcgttcttgattctcattaggccgtctcgcaaagatccggccaagcagaaaagaggagactcatggtcgccagtccaagaatcctcatgatttatgcttttccaggttatgattttgttgtcgtatcggatttcggtacactctggtgcaaattggttttcagtgctccagacaagggcttcttacctacctgaagccgtgtcgactgcttctgtctaggttcatcttgttcgtttcaatccccttgtgaccttattccctcatcccaatcttgaggatctttgtttctctgttctatgggatcggatgtggcgcttcggctatgctcaccgaaagatcgaatgtttctcatcgctggagttggtctttgtcgctattgtcttttcatttccctcaaatcccgtgtattcgttaatatccatcattctaccgtggcttatccaccttggacttgtggtctcgtccatatgacgatccgtgcgcttgctacttcagctttgatgttcgaacagaacttcattgagcgggacagtgaaagtaactaacaaaaa

SEQ ID NO: 752 - DNA, 937 bp, Sorghum bicolor
  Clone ID: SORBI-28MAY03-CLUS124633_1
gcacgaggcttccctctattaacaactagattgcctcaacatatcacttgcatatgaattgatacgcaatacaccctcgccttacataaatacaaaaccctctacagatcttcacaatggcttcccaagccctcgtcctggcaaccaacaccgcactccaaccctaccaacccaccgcataccaagagcactcttccacattccaccaacaaccctcatcatcccaacctcaacctacaacatcccaggaaaaccccttagcctcatcaaaatgcaaaaagcgatacagcagccccggcggcggactaaaaaaaggcctcgatacactgacaaaatgcatcgagcgcaaaatcgaccaacagattcttcaagctcagtcaagagcttatgacacgtcatcgcaaccagttgcaacggccaatggaatcaacaagaaggtacactgggaagagcatagccacgaagcgcaagggaaggcctagatggtgtaggacagggatccagtggcctgggacgactaggctaaaagaatgcgacgtggtggtataggtgtctggagtttcatcacaaggattgtatgaatttgggtgtgatctgttctgtgtacatcgaaaagcagcggggcatgggcgttgaagtgacgattggctgtgaatggctcgaagtgtcgtggctgggtaggctttcggtgctttatccggggtaccgcggagtatgatcggcgctcgtcagacgtgaagagatgataggaaccatgaagtcggggaatgattgtcggcaaacgatctttgggcggatagagcgatgaggaacggtgcacttacttcttcccagtcttgacgacagcacgagaaactgtgttctatggatgatggatgcaaaatatttgtttagaatagggtcctccattgtatttcttgatcattatagagagaag

SEQ ID NO: 753 - DNA, 390 bp, Sorghum bicolor
  Clone ID: SORBI-28MAY03-CLUS12469_1
gcgcgcgttgcccactgcattgcagacagacggacaggaccacaacagctgctgcccacagcaccgaagccaggaatccaccgccagcaggatccatccatggggaggcgcgagatgaacgggcggctatcggccgagtaccagggcctggaggtgaaggtgcccaacctcttccggtgccccatctcgctggacgtcatgcgctcccccgtgagcctctgcacgggcgtcacctacgagcgcgcctccatccagcgctggctcgactccggcaacaccacgtgcccggccaccatgctcccgctcccttccaccgaccttgtccccaacctcaccctgcgccgcctcatcgcgctctgggcggccacggccgcgccctcctctccctgc

SEQ ID NO: 754 - DNA, 979 bp, Sorghum bicolor
  Clone ID: SORBI-28MAY03-CLUS124645_1
gcacgaggccaacccgccgccgcctctcccgtctccggcgcccacagcgccattgtgaccgcggggctcgcggagtccccccaccaggctggtctaggccccctccactcggaacgcccgcgagaggcagagcgtgcggctgcggggacgccagcgttcgtagatcgattgcccgccgagcttgttcgcgaggagtcgtcaacgctttgcggcggccatgtctgtggaactcgtcctgtggctcttctccttcgcctccgtcatggtcctcatcggcctcaccgcgtaccagcttatctgtctgtcagatttggagtatgattatatcaacccatatgattcatcatctcgcatcaatgctgtggtcctgatagaatactcactccaaggggccctatgtgcttctttcctcttgacattgcattggttcccgtttctagtcatggcaccagtgacatactaccatgtgaaactgtacttggctcggaaacatcttgtagatgtcactgaaatttttagacaattaagtgacgagaagaagtacaggatgatcaagcttgccttctacttctgcctatttattataactatttacaggcttgtgatgacagctgtgatgctgtttattgatgaggacataaatttggtagaaactaggactatttagactttgccaccaacttgtcatgggggagcagacttgtagtcttgaaacaccaggctcaaaagaacactcatggttggaacccgtgagaccacaactgaatgccatgcccctgagttgtgagaaagaagatcaacctgtgcccaatagctggaggagctaacctggtatctcagatcctcagtgtttcatttcacccataggttgtgatgtacaatgaattctcatagtttggtctgtcgagaccatgtttgtaaatgggcagaggcaattaattttttgtgcattctatgtacttgcgtccaagtactgtat

SEQ ID NO: 755 - DNA, 765 bp, Sorghum bicolor
  Clone ID: SORBI-28MAY03-CLUS124726_1
atggcagcagcatcagtcacactcctgctagtccggaggcaaccacgcttgccagatggatctgccagagttacagatttcattttggggctgagcttatcaaatccggagatggtagcggctgtgaaggagtgctaaaaaccctttggcatcatgccagtgctatactctgctgctctttgaaggccttgccggtgttcacgttcgcgaaccagtctggcctggacatgctggagacaaccctggtggcgctccaggacatcaccctggagaaagtgttcgatgaccaagggaggaagaacctgtgcgcggagctccccggcatcatggagcaggggttcacgtgcatccccagcgggctgtgcgtctccggcctgggccggccggtgtcgtacgagaaggcgctggcgtggaaggtgctcgacgacgacagcggcgcgcactgcatctgcttcatgttcgtcaactggtcgtttgtgtaatgcatctgccaggtccgtcgcgctcatgggaaatcggctgatcggtggcatgttttaggttcgaatcgccctttaattattgggatgtagtaaaatggtttcggttttgaagaaaaatgtgaaatggtagaaggacctgaatagcagtattgtacacggatggatcatgtgaggccaaacaagaatgaccttttgtttgataatgaagttaacatggcccctcctttatggttttgattaacatgtgtgttaaatatgtgttagaacaaatatatattgttag

SEQ ID NO: 756 - DNA, 566 bp, Sorghum bicolor
  Clone ID: SORBI-28MAY03-CLUS124768_1
tttttttttttttatccaaagtatttttgacatatagaacttatatataattcggtgtatgtacccatacgatgcatactaagaaaaaatgtgtcttatctacaaataaagctgtaaaaaacattcaggtgtatgagagatgtcaccgatcgatccccttctcttgttcatcctacccttccattatttcctccagcagagctggagcatcacgtaggatggacgtcaatccgggggtcgccaaagaagcaatataatatgatacaacagcaacaagtgcatttagctctgcgtcagaatcaagagaatgcactcgccactcgactaaacctcaagaaatggggcaaataaggaggacatccatcgagcttcctcggcgtcgtcggcagtagggtcttattagtagtagaaattctgggttgtggagtaggtctgtccgaactgccaccacccaggcaccacgttccagaactgaatgtactgcccgccggtagtggtaacggcgaagctgagcccctggccgacgagcccggcgagcgcctgccagttggcgccccagttcctgg

SEQ ID NO: 757 - DNA, 471 bp, Sorghum bicolor
  Clone ID: SORBI-28MAY03-CLUS124777_1
gcacgaggctgtgtagtagaactcttgctgtagttcagggtcccagaatgtgtttcctaccacgccgtgtgcttcggggtacatgcccgtggccattgtgtagtggtttgggaatgtgacgctggggaagctgggcatcatgtactttggcgagatgccttcttggacgaattggttcagcgtgggtgtcagatttctgaacagaaagtcggcgcggaagccgtcgagggaaatgagaatcgtggtcggagcgaagagcgaggtgccgtttgatatcagggttactgcgcccttgacgtcttttggggtggagagattgtacgtagctgcaaggaggacgacgaagagaacgatgatggatacgtagatggccatgcgtcggtataggcttttcctgcgtgtctgtagcaagtattagctttttcatctgcgcattcgcagactttacaaaaaaaaaaaaaaaaaaaaaaa

SEQ ID NO: 758 - DNA, 572 bp, Sorghum bicolor
  Clone ID: SORBI-28MAY03-CLUS124802_1
ccgggacctcctccgctcccgcctgcccgtcggcctgctcctaggctcctccgtggctgctgcaagcgccatgtctaccgccgacgtgctctacaccttactacactccctcgagagccggaacagagccgacgtggtgtgcgagccggaaggggaggtagcacatcgccggaaggggagagcgccaacagtagtcatggagcggacctttgctgggggtgcggacctggtggaaagcgagcgcctggagcggaccttgctgggggcgcgttcatcttgcgcgggattgtgtccagaccccaagagcaggttctgtcgtaccttgtactagtgcgtacaggggaacggacgtaaggtgttcgcggaaatgccactgccagcaagagtcttttcttggacgcctctcagcttgccatcccgtacgtaccttctctcacatttgcaaaaacagttatataaacacctatcgaagctgtttattgcttgcgtgaaaactcagttactttattgttttgctaatcactgtattactttacgttagcctgtaaagcttatttaaatatgcttcgcgt

SEQ ID NO: 759 - DNA, 905 bp, Sorghum bicolor
  Clone ID: SORBI-28MAY03-CLUS124822_1
gtctcaagcacgccttgactggcgccgacattgtcgtcatccccgctggcattccccgcaagcccggcatgacccgtgacgacctcttcaagatcaatgccggcattgtccgcgacctggtcaagggcatcgccgagttctgccccaaggccttcactctggtcatctccaaccccgtcaactctaccgtccccatcgccgccgaggtcctcaaggccgccggcgtcttcaacccccagcgcctgttcggtgtcaccaccctagatgtcgttcgcgccgagactttcacccaggagttctccggtctgtccgacccctccaaggctaccattcccgtgatcggtggtcactctggcgagaccatcgtccctctgttcagcaaggtctccccggacttcaagatccccgatgaccgctacgatgctcttgtcaaccgcgttcagttcggtggtgacgaggtcgtcaaggccaaggacggtgccgggtccgccactctgtccatggcctatgctggtttccgcttcgccgaggctgtgctcaaggccgccaagggcgagaagggcatcgtcgagcctacctacgtctacctgcccggtgttcccggtggtgaggagatcgtcaaggcgaccggtgttgagttcttctccacccccgttgagcttggccccaacggcgccgagaaggccaccaacatcctcggcggcgttaccgagaaggagaagaccctcctcgaggcttgcatcaagggcctcaagggcaacatcgagaagggtgttgagtttgtcaagaaccccccaccaaagctgtaagcgcgaggaaatgagtttatgaaatatccaatggaacgaggggagaatttctcagtcgagcggccgggtaatccacatatagtgaagtcccagcgc

SEQ ID NO: 760 - DNA, 820 bp, Sorghum bicolor
  Clone ID: SORBI-28MAY03-CLUS124827_1
gacaatccctcttcaacctggcgttcaccaaagtcgcgttgctctctcttctttcgctggtcgcggccagggacgcgctccaaagccccaccgaaagccctgttctcggccaagtcaccccacagggctgcttcagtgccctccccagtgaagccgatggacgatccgacaccttcaacagcgtcggctcatgtgccgaatactgtgaggaacagaagaagacggtcgcgatactgaagggtgtagagtgcatttgcgctgatatctaccctgccaaatctgccaaggtagacgacgacaagtgcgacacgccttgccctggatacgcgaaagatgcctgtgggggaaaagatgcctacagtgttttcaacctgggtgtgaatttgttgcctggcaatgagggtgacaagagatcgtcgggctcaactgctgaattgaggggctcggccaaaactactgttgcgacgactgcgactgaagtctctaccaccaacgctgagacgacttctgcgcctacgactgaggccgaagagacagcatccgttaccaagcctgaaaaggcttccgcggccgaaacgacaacgagcgacagcactgcggtgtctacgcccagtgcatctgcatcatctgtccctgacaacgcgtcgcgcagacttaataaccccattggcaacttggttggacttttgcgacgcctgctataatgttagactggcgatgggggattgaggggttggtctgtggtgtatggtatcaattgagggacagattgccccaggtcataggagatcatagagtattatgccaattcacacatgat

SEQ ID NO: 761 - DNA, 1027 bp, Sorghum bicolor
  Clone ID: SORBI-28MAY03-CLUS125_1
attcccggtcgacccagcgttcgaccgatctcgttacaaatgtaaatgcgatgtctgggactacagatcaatccagcaacaaaagcccacctttgtcagcaactgagcaaatcaggacctttctatgggaacggctgtaaatttgccaagcccatctaaacacacctccaataacagcatgcaaaagcagcagaacgtgcgggggggtgatagcaaatgtcaccctgcacagaacccagagactcctctttggctggtaaatcctgataaatctgagggtgtgccacatgagagggaaaaggcgaagaacaacagtgcacaagaaattgcacctctggtccagactccattgccttccccagctgggtacttaataaagccctcttcaagcaaactggcagctcgcggcaatacaatttctgaatccactaacttcaccacacctggaaatcagaacaagcctctggtgaaaaacgtgggcgcgccaaaggcatggaagagaagcatcacccatgtgtacgtgagccatgtgatccagatgcacgtgaacaaggagaaggccgccgcgtcgtcgtcacaaatccaagcgaagcttgaggagaggcccctcgcccgctcctcgaggcctccgagcggtggcttcaccacctcgcacaaggccgccgccgccgccgtgcgggacgagaagttctacaaggtgcacttcgacgtgcgcgtccctgctcaccagcagccgtccgctggcggcatctgcgacgtgggtgccggccggcagaagattgtgagcgcgacagacactactccactagagcgtggcagctaccgcggcggcactgctgctgcttgaaacgctagctgctaccagtaactgagctcatttgaactcttgtctgaccgaagccgttgctgtgccgctgcgcgtttcaggtcagcggtggttcctggcagaacctgcccgccacggcggcgtcagcactaccggcgacggcacaagcacaggatgtccagtacctgcagcaccatcaga

SEQ ID NO: 762 - DNA, 691 bp, Sorghum bicolor
  unsure (1)..(691): unsure at all n locations
  Clone ID: SORBI-28MAY03-CLUS125086_1
gcacgaggaattaagaaagcttcctctcgcgatgagtggtatgcaaatcttcgtcaaaaccctcacgggtaagaccatcactctcgacgtcgagtccagcgacaccattgagacggtgaagcagaagatccaggacaaggagggtatcccgccggatcagcagcgcctgatcttcgccggcaaacagctcgaggatggccgcacgctggcggactacaacatccagaaggagtccaccctccacctggtgctgcgcctgcgtggtggtgtgatcgagcccatgctccaggagttggcgcgcaaatacaactgcgacaagaaagtgtgccgcaagtgctacgcgcgcctgcacccgcgcgccgtgaactgccgcaagaagaagtgcggccgttcgtcgcagctgcgtattaagaagaagctgaaataagcgcgtccgcacgtgtgcgcacgtgtgcggtcgcgtgtcgccgccgcacggagtgccaccgccgtcgtcgcaccgccgccgccgccgctgctgtcatcgcaacggcgccgccgcggctgcaccggtggtctgcattgtggtcgcacgattcgcgcatattccgccgtccgatcgccgccgccgcgtggttggagccgactgcctccctccgcgcgcgtgctgccgtgtggtgtttnccgttnccgcgtcggttggtgttgttgc

SEQ ID NO: 763 - DNA, 887 bp, Sorghum bicolor
  Clone ID: SORBI-28MAY03-CLUS125072_1
ccacatcatgctcaccgacttcgacctgtcgctggagtccacggcgtcgccatctctcgaggacgccaggaacgtcggcgacaacagggaggaggacgtgccggagccggcagcaccgacctgcctcccaatcccggagctgcagctgctccggctgcggcggtggaagcgccgcgccgcgccgcggcctcggttcgtggcggagccggtggacgcgcggtccagctcgttcgtcggcacgcacgagtacgtggcgcccgaggtcgcccgcggcggcggacacggcgcggccgtggactggtgggcctacggcgtgttcctctacgagctcatctacgggcgcaccccgttcgtcggggagaacaacgaggcgacgctccgcaacatcgtgcgccgcccgctggagttcccggccgccgcgacgaccacgcacgcgcacggggtcggggactccgccgcggcgcgcgacctgatcgcgcggctcctggacaaggacccgcgcacccggctcgggtcgaagcgcggcgccgccgacgtgaaggcgcacggcttcttcaagggcctaaacttcgcgctgctgcggtcggcgccgccgcccgtggtgccgccccccgccgccctgcaccggtgcgacaaggccgccgacgtgcagcagctgttcgatcacttctgatcgagtcccgagtcccgactacgtccgttcgttcaaatgaagcaagcattttttttttttttgtcgtcgatcgatcagtagccaaaagagttgagtgccggactaaccagctggggtacccagatcgaggcatgcccgtgttgagtgttgactccattagcactgctgtacaacgctgttaattacgcacgtactactaatcaaacaattaata

SEQ ID NO: 764 - DNA, 574 bp, Sorghum bicolor
  Clone ID: 9299739
gcacgagggatatctaagacctgctttcatagaggaagaatcttacttgaggagcttgtttcatggtgaatgcagcagtgatcgttattcatctgactggaaagtaaatgaaacagatgaatacagcagagaaactcggccagtttctggaaccaatcgcctcattgatggtgataaatcaaaatttgacttcaatgatgctgaaactaaaactgattcaatgatctacaagctggagataatgacaattgaactgttttccatgtatggcaagcagtttatgattgatccacaagattttcaagattcagaaccagatattcttgcaaattctgcttcagcgattatagaacggatcaaagaaaacagtgaccaatgtgcaatggctctcaggtcgctctgtcgcaggaaaaagggtcttactgtcgaggaggcaagcttgattggtgtcgacagccttggtattgatgtaagggccttttctggcttggaagctaggaccgttcgaatttcattcaatgcacaggcgctctctgaacgttcagctgaaaagaagatcaggcgaatgcttttc

SEQ ID NO: 765 - DNA, 350 bp, Sorghum bicolor
  Clone ID: LIB3478-043-P1-K1-G11
aaataactgatattctcatagagtgggggatgcctgcaacaatgcgtgcaatacatccgatttactttgccaaatgtttgaaaaaggccattcataataataatgggaaagaagatggatagtccatcaaatggtctctctattgtaggatatctaagacctgctttcatagaggaagaatcttacttgaggagcttgtttcatggtgaatgcagcagtgatcgttattcatctgactggaaaggtactcctgtagaaaaattggataagaataagcttctttccttctctcaaatcttatttgacaatccagtgccattttggatgtagtaaatgaaacagatgaatac

SEQ ID NO: 766 - DNA, 1009 bp, Sorghum bicolor
  Clone ID: SORBI-28MAY03-CLUS125229_1
tggacccttcgtaaccgacaataacaagaaatcaacaacttctggacggccatagcaaaacgacacagcaatccgctacaatggctgtcgacccctttgactcagctctcgacctcctgcgccgtctcaatcccaagcagacaaccgaccacctcaacgccatcatctccatcgctcctgacctgaccgaagatctcctctcgtccgtcgaccagccccttaccgtgcgccgctgcaagcagactggccgagactacctcctttgcgactacaatcgcgatggagacagctaccgctctccatggtccaaccagtttgacccgcccctggatgaggctggctctggcggtgtaggcgctggtggaaacgagggcgcaggcgagggtgcgatcccgagtgagcgtgttcgcaagatggaagtcaaggcgaacgaggccttcgatgtctatcgcgacctgtattacgaaggcggcgtgagcagtgtttatttctggaatctcgatgatggatttgcaggcgttgtccttcttaagaaagcttctccccaaggtggcaattccgagggtgtctgggactccattcatgttttcgaggctatcgagcgaggacgaagcactcactacaagctcacatctaccgtgatcctgacgctgtcgactgacggcggtaatctgggcgagatggacctcagcggcaacatgacacgccaggtcgagcaggatctccctgtcgagaacgacgacagccacattgccaacgtcggacgattggttgaggatatggagctcaagatgcgcaatctcctacaagaggtttactttggcaaggccaaggacgttgtgggtgacttgaggagtattggaagcttgagcgagggggcacgggatcgcgaagcgcagcgagagcttattggaagcatgaggagatgatcggtgtacgaaacctcctgctcgtcttatgtggcgttttctaagagcaatacgttcgatagactgtttacaactttggg

SEQ ID NO: 767 - DNA, 617 bp, Sorghum bicolor
  Clone ID: SORBI-28MAY03-CLUS125260_1
acgccgacgccgctctgctccaccacctagcgccgccactcctctgcttccgggcagcgccgcagccgccgagccgcacccgcgaccccgacgtcgagctcgtgccccatcgcccccgcgcacccgtcaccatcgagccgaccatggagagccaccggccgtgccgagccccatccccaacctcgccccgcgaccagcacctgaacgtgccctgctccaagccaccgacgccgcgcgccaaccccccctgcaccgcgagctcctcgtctacgacaccgtgctgcccacgacgacacccgcgggcagcagcaggccgcccccgcgtcttggacctcgccgtggccgcgtcgcggccagcagaacgagttctccgtcgagccgcgacgttgcgtcctcaccgtgtgctgctccgagccctccaccacaacatcgttgtctgcaacgcaggtcgtggtgaccgcgaccccggccccgtctgccacgacgtcgcgcacggaccctatcgtggccgcgccgagccccgtcactaagcaccactgagcagggagccgtccatgccgcgaccaccaccgatttccactgtcgcagggaagctggagccttgctgtgcacacgtc

SEQ ID NO: 768 - DNA, 688 bp, Sorghum bicolor
  Clone ID: SORBI-28MAY03-CLUS125344_1
gcacgagggtccggcgcaagatggatggccaggccgcctccgcggtctcggaggccgacgccgtagccagcgccaccgcggcgctggtgcaggccggcggccgctgcgtggcggacacctggaagatccaggcagcggcgctgccagcagtcgcgcggggcggcggcggcggccatgagcagcagcagcagcaccaggacctgctgtcgagcgaggcgttctcgctgctgcacgacatcctgtccgtggacgctgctgggacggggagcggcagtgccaacgcgcacatgtcgaactcgtcttcgctggctcccagcgtgagcaactcccgggagcagagcccggaccggggcagcggcggcctcgccatgttcttcgccaagcccgcggccgcggtgcccaggctggcctgcccgctgccgctgggatcctgggtctcgccgtcggccgtgtcctccgccaggcccggcgtgtccatcgcgcacctgccgatgttcgccgcgtggaccgacgcatgaagaaaacatccatggctttagaagggtacggtggaggtggataggcaaaaactgtggttcttttggtttgcttagcgcatgcttattagccgggtaacgtttagttgcgtagtggagcggtagtctaatctaatcaagcatatgtcaggaactagaattagccatgcgtg

SEQ ID NO: 769 - DNA, 859 bp, Sorghum bicolor
  Clone ID: SORBI-28MAY03-CLUS125361_1
gcacgagggccggacgccgtgcagcggatgtactcggaggtgcagctgctgagctcgctccggcacgacggcatcatcggcttccacgcgtcgtgggtggacgtcgccggccgcagcttcaacttcatcaccgagctcttctcctccggcacgctccgctcctaccgcctccgctaccctcgcgtcagcctccgcgccgtccggtcgtgggcgcggcagctgctcgccggcctcgcctacctccacgcgcgccacccgccggtgatccaccgcgacctcaagtgcgacaacatcttcgtcaacggccaccagggccaggtcaagatcggcgacctcggcctcgccgccgtgctcggccgccgcggcggcgccgcccacagcgtcatcggcacgcctgagttcatggcgcccgagatgtacgacgaggagtacgacgagagggtggacgtgtacgccttcgggatgtgcatgctggagatgctcaccgtcgagtacccttacagcgagtgctccaacccggcgcagatctacaagaaggtcaccgccggcaggctccccgacgcgttctaccggatcgacgacgacgacgcgcgcaggttcattggacgctgcctcgtccccgccgccaaccgcccctccgccgccgagctgctgctcgaccctttcctcctcgaccgccaccatgttgttgctgctgctgctggcacggtgccatcatcagtgccgccgccaccgtcgttgccagctgctgttgccgccgccggcgctccgccgccctcgacgtgtagcagctccgccgacgatgtcgtctcggcgtcgtcgtcgtcgttggacgatgacgagggcgagcatcatcacg

SEQ ID NO: 770 - DNA, 1006 bp, Sorghum bicolor
  Clone ID: SORBI-28MAY03-CLUS125362_1
gcacgaggcttacttcttagctcgccgagagggatggcgcacggcctcgccggcggcgtcggccccctccggtgctgtccctccgtgtcctcctcctccaccaccgttcatcacaccctggacgctccccctcgtcgaagcttagcgatgtgcgcctcgaccttctctcctccagccgcttccgccatcgagggccgcgacgtcgggctctcggtgaccacgcggcggggcagggtgttgccggtgcttaagggatgctccctccttgtcccacccgggcagctctggatgctcctcgggcccaacggctgcggcaagtccaccctgctgaaggttttagcaggttttctgaatccttcggctggtacagtgtatgtaaacagaccatgcagctatgtcttccaaaatcctgatcaccaggttgtgatgcctacagtggaatctgatgtagcatttggtcttggtaagctcaaacttccattagatgaggtcaggttaagggtatcaaaatctttggatgctgttgggatgttgagctactctcagaggccaatccaaactctgagtggtgggcagaaacagagagttgcaattgctggggcgttagctgaagcatccaaagtattattgctggatgaactgaccacattcttagatgaacatgaccagataggcgtgataaaggcagtgaggaactctgtggctgctgatggggaggtcgccgcgttatgggtgactcatcggttggaggagctgaaatatgcagatggcgccatttatatggaagatggccagataatcattcaaggcgacgtttctaccatatcaagatttataaagagaaaacaagcacgctactttggtcattttgaactctaaatcccgggagctttttggcaaagcttctcttgtgtaaatggactaattgcaaagcaacttattttgttattgtcaactgtagttttgctggagcatcgattttaggcattttcaaagcaaatcatgt

SEQ ID NO: 771 - DNA, 608 bp, Sorghum bicolor
  unsure (1)..(608): unsure at all n locations
  Clone ID: SORBI-28MAY03-CLUS125376_1
cttcagtggccatgctgtttttccgatgatatacaccggcatgagaaacaggaaaacgttccccacagtgttgctcatctgcttcattatatgcactcttagctacggtctgactggtgtcgttggatacttgatgtttggggaatcactaagttcccagaggctatcgaggataagcttcatgtgggcaagaacaggaccgtcagtattgtcatccggactgccctggtcgtcagcacaaccattgtggcccttgccgtgcccttctttgcctatgtcgtcgctcttacgggctcgtttctcagcagcacggtcacaatgttgataccttgtgtttgctacctgaagatcagctcaagaacctccaggaatctgaggctggagctggtagtttgcttggttattatcatgattggggcgggggtaattgtggtcggcacgtatagctcactgaaacagattgttaatagcttttgatttctgaatgatgtgcacgtcgagtgggtgtaaggatgaattgtatgtggtagctatcctangaagatactgtagcaaatgaatcatagacaagacgatcttgtaatctggaattagcttcgtatagtttg

SEQ ID NO: 772 - DNA, 661 bp, Sorghum bicolor
  Clone ID: SORBI-28MAY03-CLUS12540_1
ggtgagccatggtggattaccactgacaacacagccagcaggcacacttggctaccttgctccagagtatgtgcattcaggtgttgcaacagagcggtctgatgtgtacagttttggtgtgcttgctctggaggtggccactggccgcaggccaacagagaggggaatctctgttgttgactgggtgtgggttctatggggtcgtcggaggcgagttgatgctgcagaccagcggcttcagggccgattttttgcagaggagatgcgacggattctgcttgtgggtctctcttgtgtgcatccagactgtaggaagcgacctggtatgcgaagggtagtcaagatgcttgatggaactgcacccttgacaatggtgccagataagaagccacctgttatactccagacacaagtaaatcaaggttcatcaatgaactcagtggatactgtcaatacagcgttctacagttgtcgctgaacttatatgttaataggttggctaataaccacatcctgattcatacgtggtggtgttgatgctccaaatttcatttctgaaacatgagttgaagctaatgttggggttgttccacattgttggaagatatcctacttgtgcacagaacgctgcataatgtattggtttctggtacaaaatgcc

SEQ ID NO: 773 - DNA, 604 bp, Sorghum bicolor
  Clone ID: SORBI-28MAY03-CLUS125406_1
cttcgctgcccatacttatccccgcgctccctcgtgttttttctctattagacttcctttgtctctttgtctctttcccaaatttctcttttgcctgagggttcgaccttagtctcggcctactccaaccgtatttcatatctcttccgaactgcttggcatttggtctcatattcccctccttccgctgcccagaccagttgcgctattcgcgcacatgtactgttgcttgccacgcaaggaccctcaatggtggctttcgaagaggatccaatgagttttaagcttggaatgcattcggtggaggaaacaatgtcaaccatctcaagtccagaaggcccagcaactacgtcacagctgccggagaacggcgttggaccgcagtcgggggattttaggtgcggtatttgcaacaagacttacagtcgacgcgacctgcgcgaccgacaccgacgacggtgtatcaagactgccggacaagaacgcctatcgaaacgcaaatcctgcgaaatatgcgcgcagaagaagctgcggtgctcgatgactcgacccgcgtgcgctcgttgtgtccaaatggggacagcatgccactatcccccgacat

SEQ ID NO: 774 - DNA, 535 bp, Sorghum bicolor
  Clone ID: SORBI-28MAY03-CLUS125479_1
gcacgaggcccagcatggaggcggcggcggcggcggcggcgccatctgtttccgttgccggcggtagagggagggacgagaagacgcagcctaggccggcggcggcggcggcggcggcgtgcgacgtggaggcgctgcggaggtgccttgaggagaacaagggcgaccgcgtcaagtgccaggcgcacatcgacgccttccgctcctcctgctctgccggccctagcaccagctccaagctgcagtcctcctcctagagaagtagagaggagaggacggtgtcagatcgccgcaaggatcggggcttcttcgggatcgaaacaatttttcttttttctccccatatacaatgtcttgttagttgtggcctttggtaatattttctttgaataaagtaggatgtatgcttcggatcatcgaaggggaatcggaatccatatagagcaaaacatgatctgctttcctgccattcgtgataaattttctcctgcttcatctgtaataatgccagaatgatttgagtcgttctccggac

SEQ ID NO: 775 - DNA, 370 bp, Sorghum bicolor
  Clone ID: SORBI-28MAY03-CLUS1255_1
atcccggtcgaccacgcgtccgcggacgcgtggggacgccatccccatttctcgccggcggagcgcgcctgcgccccgggtgagagggagccaggatggccaagcccgctgccgccgagccattctccatacggggttacgccatgaggatgcgggccgtcgacgcggccgagtgctacccgtttcgcggcgggcggctgcagcgaaggggagggggagccgccgccgtcgcgcggttcccgccgatggacccgaagccgctgtcacggtggtggaagcacgagctcgcggtggggcaggcccggcttttggctggcgccaagggcggagaggctgcggcaagccgggtccggggcagtgcgctgcggaa

SEQ ID NO: 776 - DNA, 678 bp, Sorghum bicolor
  Clone ID: SORBI-28MAY03-CLUS125515_1
caaaaactgacggaggaggaagacgatcgacaaagcttgcactgcgcgatggatccatcaatggcggtgacaaagatctacgtcgtgtactactcgacgtacggccacgtggcgaggctggcggaggagatcaagaagggcgccgactccgtggccggcgtcgaggcgaccatctggcaggtggcggagacgctgccggaggaggcgctggcgaagatgcacgcgccggcgaagcgcgaggagcacccggtgatggtctcgggcaggcagctggcggacgccgacggcgtcctgttcggcttcccggcgcggttcggcatgatggcggcgcagatgaaggcgctcttcgactccacgggcggcctgtggcaggcgcaggcgctggcggggaagcccgcggggttcttcttcgcgctcggcacccagggcggcggccaggaggagacggcgctcaccgccgtgtcgcagctcgcgcaccacggcatggtgttcgtccccgtcgggtacacgttcggcgaagggatgttcgacatggacgaggtcaggtgctgcagcccctacgggtccggcaccttcgccggcaaagacgggaagagcaggctgcccagcgacgccgagctccagatggccgcgcaccagggcagctacttcgccgccttcgccaagaagctcaaggcc

SEQ ID NO: 777 - DNA, 804 bp, Sorghum bicolor
  Clone ID: SORBI-28MAY03-CLUS125523_1
gcacgaggcgtagaggaagctgcgtgccagaatcccgccataaaagccctcgtatcctacggcggcaggaagttcacttctctcagcgcaaccaaccaaccgccccagctggttcatacttcagggcctccaactgcccatcgtcgccagtcgtctaccgagtctgttggcatttccccacccagcgtcaagacctatcgctatgaggatgcggagaaagaatctggctggatactccccagcgacccaaactaccacaaacgcaatgccggcatcgctcacacccgcagcctaaccttccttaagccattgcttggaggaccgtactttgacctcgaggctgtctgggaagagcacacaaagtatgagtttggtgagcgagacgtagaaaagacaatggcgaccatggtcgatcagccctacgttaaccacattcccaccatgaccggcggagtcggcaaagaccgcctcacggccttctacacacaccacttcattttcagcaatccccctgacacatctctttccctcgtctcccgcaccatcggtgtcgaccgcgtaattgacgaattcgtcttctccctcacacacaccagccatgtaccctggcttctacccggtgttccgcccacgggctaagcggctcgctatcccattcacctctgttgttgccctgcgcggcgaccgcttgtgtcacgagcatatcagctgggaccaggcgtcggcgctgaaacagtgcggcttgttgccggaatttgtaccgtttccgtatgaggttgagaaagggatttgcccagaggggaa

SEQ ID NO: 778 - DNA, 458 bp, Sorghum bicolor
  unsure (1)..(458): unsure at all n locations
  Clone ID: SORBI-28MAY03-CLUS12553_1
nacgcatttctcaaggagatgtacccagaagcacaccccacacccaattggatactgcagactacaattgcctcattgcattttatggtgccaatataacatagtgcaaaagaataaagctggagttacttagtttatggcttggtctttttatttgtagtgcagattattctcctattttgtgagcaaattatagaggacaaacacagntccacatatatttggttatctgttatgaatagaatggtgttctcaagaataattttactctattgcccccaacgtgcagcttcctgggcgtgcgaaggtgcgtccattctactaaacacgtcacggtaatgaaactacttctgaactcagaggtacatgccccatcataaattgagcacacatttaccattatcaatacaccaacacttatcctgtgtatatgtttctacagaatcatcaaaccacat

SEQ ID NO: 779 - DNA, 642 bp, Sorghum bicolor
  Clone ID: SORBI-28MAY03-CLUS12559_1
ggaagattgtctgagcttctaggacttagtgaccatttaattcttctcaatgtgattgttgggaaaattgctacaaatctgaagtgctatgctgagagtgaggatgttattgatcatactctgtccctgttccttgatctggcaactggctatatgactggaaagctgctgcttaagctggagagtgtgaagttcatcattgcaaatcattctccggagaatttcccatttctagcagaatacaaatgttcacgtagtagaactacgttctattacatccttggctccttagtcttcatggaagatagccctgtgaaattcaggactttcatggaaccacttcagcaggttgcatttaacctggaggcaactcctgatgctgcttttcaaactgatgttgctaagcatgcatttattggtttgatgagagatctacgtggcatagcgattgccaccaacagccgcaagacatatggcctcctatttgactggttgtatccatctcgcatgccccttctgttgagagccatctcactctgcacggatgaaccagcggtcactacacccttgctcaagttcatgtatgaatttgttttgaaccaagctcaaagactgacgtttgattcatcatcaccaaatggg

SEQ ID NO: 780 - DNA, 759 bp, Sorghum bicolor
  unsure (1)..(759): unsure at all n locations
  Clone ID: SORBI-28MAY03-CLUS12561_1
cccacgcgttcggctttatattgcttctattggcattnatcttcagatttgaattgcagtaccttgaagtcagggagaatgaatatgatgagaaggtttacctggacttgtatactgtaagatgatacagagggctggatctatttcccttttgataatgttccgcatgtaactataggagtattaagttgtaataactttcaggattcatcgcccaaagtaccagctgtcgaaaatgtgatggtgtaagtggtcctgtaattttaaataagcatttcaacatgccaaaatttcactgacagaactgaataagtacatggataacagatacttcgccaccgctaataaggagagcaatgaaaactaccttggtcctgcacctctggatgaaatggccaggcaaatttgccttgctcaaggcccatctggacctaacagagagtatgtgttcaaacttgaggatgctttaaacaaattaggtaaggttacattctgtttcatctcttttatagaaattttattgacaatagcacaacatggcatggactacaaagttcaaatatttcttgtcaggagttgtagaccaacatgtccaagaactggcgaatgctgtgcgtgagtattctgacaccgagttatctaagtgaaaaatcacatttaccccttgtttggagggtaaagatttatgaataaagttagaatccattcatgcccaaacattgatatattcttgtaagctgctttttgagtggctacatt

SEQ ID NO: 781 - DNA, 846 bp, Sorghum bicolor
  Clone ID: SORBI-28MAY03-CLUS125629_1
cgcgggggttcaacgtggcggcctccatgctgcaggcttccggtgtggcgagtgagtttgaggccgacgagcacggtgctggaatcaccgtcttcgtccccaccgacgacgcctttgccggcctccctgccaccgaccgcctccagtccctacccgctgagcgcaaggccgtcgtgctccgcttccatgtgctgcactcttactacccgctgggttcccttgagtccatcgtgaaccctgtccagcccactctcgcgacagagcacactgaggctggccacttcaccctaaacataacccgtgtcaatggctccattgccattgacacaggcatcgtgcaggcatccatcacccgcacagtgttcgaccaaaatcctgtggcagtctttgccgtctccaaggttctactgcccaaggaaatgttcagtcggggggattccggcagcactgccattgtgccaccttcggttgcgatggcgcccggcgacaccagcagcgagcagacaccacagacgaggctctcatccccgcctgacctccacggcgaagatagcgagtcgtcggctgctttggcgacagcaaagggggcttcttggtggcgtataggactcatgtatctacagctgcatctattatttctatctctggtatgagattctggtcgtgcttgttgcttgcttctttgtgctcagtttttgtacttcttactgtctagaatgtctacaccgggaaagtaatggattggggagagaattccgtagatgcaaagtagcaaaaaaaattagttgcttcacctgattattctattttgttttcattttgtcatgtggcaaagggaaataaata

SEQ ID NO: 782 - DNA, 546 bp, Sorghum bicolor
  Clone ID: SORBI-28MAY03-CLUS125652_1
gcacgaggtcaacacctgccggctgcaggcaagtaaaagcatccctcttagcttctcccttctactgcagtcctctgcccccggcctgcagatcatggaggaagcatggtggcaggaatgtctgcatggttcttgagagttgcataagcagcaaagcagttcatggatggttggatgacaatggccagttgagcacttgagctgctggtcctcatcaatcatcagtttgtatttgtccatgcctcttgtggccgtcttccctggctggcttccagttccggaaggcccggtgaggcgtggacagagaccggcaagtcagagatcggcaatggtgagctcctgcaggagcctactccttatttaccagtttaaggtttccctctacctgttgttgctcgtcttccttcgctccttcttatctgtcccctctgtaccggtgagagcagaagatttcagtagaagtcttgctttctggagacagtttcagtgttggttttggaatatgctactgtgatttgctcgtgtttaccctcgctaaagatagct

SEQ ID NO: 783 - DNA, 395 bp, Sorghum bicolor
  Clone ID: SORBI-28MAY03-CLUS12586_1
cgccgccgccgcctccatgacctctcctcgtcgtgccgcctccatgccagcatgatggacgagcagacctccttcacgcgtgcagaggaccaaaggagggttcccacacggtagcgccggcctccctcgtcccctgttgaagacaacgtccatcgtggagatcccacactgtggcgcggccgtgcaacagcccctttgagtgccaccaacgtgaagcagatctggcaagtacaggacaacctgaggtagcggaggactagccaaatcttccatgagcagactccgttgcggatggtttgggtgggtggtggtgtgcggctccaccgcctgcgccagcgcctgagggtgatcctccagctaccgtcctgccggcgggtgagggggcctgagatggc

SEQ ID NO: 784 - DNA, 839 bp, Sorghum bicolor
  Clone ID: SORBI-28MAY03-CLUS125866_1
tcgcagctcgcgctccgccgcctcctgtcgccgccgtccgccaccgcggccgctcgccgggccgcgccggtggctgcggagcctgtttccggcgggggcggcgtcctcctacctcggggtggtgtcgccggggtagcggggaacggatggagtggcagcgcctcggggctccggttggctcgaaggctctgcacctacgacgagagagatgacagggcactcgaggaagaagctgagaagaagtttggatggatattgaagatattcttcctaggaactgctggtctagttggttaccaattctttccgtacatgggggataacctacttgagcaatctatctcgcttttgcgtgttaaggatcccttgttcaaacggatgggagcttcccgtttagctcgttttgcagtggatgaccaaagaagaatgaaggtggtagatatggggggagctcaggaacttcttaatgtattggaaggcgccaaagatgataaaacacgaaaagaaactctaaaagctcttgctgcactttcaaaatccgaagaagctgctggatttttggacaaggcaggtgcctatgcaatagtcagttccactcctaactctggagaatatgctgagatccaaacttacaagactagtcttctgacggcatttgatcaactgaagtcatgacgtgcaaatggcaattggtacattcagcaacatgttaattctaaacttcgcagtggtgggcaatgccctagtttttgagtcggcgtgtcgagcacatcatggtggccctttgttggtcaagtatcagtttgatgctgaaaatgcatgaacggttcatttgttta

SEQ ID NO: 785 - DNA, 687 bp, Sorghum bicolor
  Clone ID: SORBI-28MAY03-CLUS125872_1
tggacatcttttctttctctcacggtgttccatatgtatgcaaattacaaggcagtgcagtcactttcactcactacgctaaactatgagagagcctccatcttgctacagtacttcaaggaatgtggtgacgttcttgcaccgcaaaaggtttctcagcaggaacatattcttcctttttggtcaacctggaggaaattaaacaaaattaaactgccacatgagcgtgtgcacttaggtgctaaagcctcgatgcttacacacagtgacatgttggtgattgcaaaaacaagatcccactatgaaaatacaaactaccttttgctgaataaacaaggcagtgtttacattttcatccacaagctggcaacaccagctgatgttttaaggtccttcgtacatgggctcgtgttagcaagttcgacatcccagcacttagaggcccgtcgatggatggacgagatgtataccaattttatctcgaagttgcagagtgaaggttactcaacagaacgccttctgtcgcattcgattctttggagggcacactggcttcacggccagcatgatgagaagctcaagtaggaagaacacagcaagattgcatttgcttattcaagggcaaagtagacaggagtatcgcccaagtcacgattaactagggtgagaacgtgttaaacgttgatt

SEQ ID NO: 786 - DNA, 945 bp, Sorghum bicolor
  Clone ID: SORBI-28MAY03-CLUS125867_1
cttcgctcttgcccctcttgcggttgcgaagcctcttgcactccctcgtggtgcgcttcgtcccgccctcgatccaaccccacgttgatcgtcccacgaatcacatcgcgatcgcaatcgaagcttcccactttttgaggcttcgccattaccgcgtctcataccgggagtgaaggcgccatgtgtctcgtcaaagtcaagcaggaagaggaccatgtagtcccgtaccgcgtcgtccagcggaaccgctctccgccccgtcgccgcgcctcacgtcaatcgcgcgacattgagcgccgttattcgcgcaccgaaatagtgcacgactcttctcctaggccttcagcatcctacgttgcggtgccctcacccaagcctctccagatccccgcaccacagcctgtgcctatgtttgtgcagcctccaccacccccggcgcccatgccggctccacctgcaccgcctagccacatctcgtctcaccatacccaggcccattctcaccacggcggcgcacactatgtcgaagtttctccacgatccagcatgagctctcgctcctctagccctggccgcagcgagtatgtgtacactgagcgtgaggttaggcgcgaacgcgagcgcaactacagtccggagaaccctcgctacgagcactacagatatgtggagcctgcatcgagcgagagcgatcactacgagagataccaaaggcgggacaggagcagacaacgcagtcgcagccgtggcggctacgaagagactaataccagggttgcgtacagcaggcggtgaccgtctgcatacgagtagagaaatgtgtcatgtttgcagggactgttattctgatagcgtacggttcgtctcgtgtcctcactttaatctcgaaggatttttagcatccgtcaatagctgtggtgggtcgcctatagtttttcatttcca

SEQ ID NO: 787 - DNA, 618 bp, Sorghum bicolor
  Clone ID: SORBI-28MAY03-CLUS125932_1
caacgtcctcacaaggctactagacaactttccagatgttggcactgagaaaatcattgaggccatgatgtattcatcaacctcaaggagctcatcgtcagatcatgaaatgatggatgccaggaaggagatattgactagggtcttccttaaaagcctccagaccgatgacaccatcttcaagaaggtctctcagtctgtgtactgtgcattccgtgcaatcactctgggcggcagtggggagaagggccggaagctcgccgatgcatccctgaggcgcatcggggcaacaaaactcactgcacggctagtgaaggcagctgaagtgcttctcaaagcagcaatggtgtcagagcaggtccatggcccatggtacacgcagctgctgtgaatggttctgctaccgcggatatatatagcgtttctcatgccccattaggttctggacagcgcgtgtctatgtgtgaaaatggtatgtgttcaccgtgttacaactgaatggtttgtgggagtgccgtgatgttgggattcaaataagcatccagcataggcgagctgaatgcatatgtatataatatgtgtatatatatatatatatatgtataaacatgaaacttg

SEQ ID NO: 788 - DNA, 781 bp, Sorghum bicolor
  Clone ID: SORBI-28MAY03-CLUS12598_1
gacatcaagcgctacctctgcctcgagctggttaagcaggttccgctgttccatggcatggacgacctgatcctggacaacatctgcgaccggctgcggcctctggtgttctccagcggggagaaggtgatccgggagggcgaccccgtgcagcgcatggtgttcatcctgcagggcaagctccggagcacgcagccgctgaccaagggcgtggtggcgacgtgcatgctgggcgcgggcaacttcctgggcgacgagctgctgtcgtggtgcctccgccgccccttcgtggaccggctcccggcgtcgtcggccacgttcgagtgcgtggaggcggcgcaggcgttctgcctcgacgcgccggaccttcggttcatcaccgagcacttccggtacaagttcgccaacgagaagctcaagcgcacggcgcgctactactcgtccaactggcggacgtgggccgccgtaaacatccagctcgcgtggcgcaggtacagggcccggacgtcggcgacggacctggcggcgatggctgccccgccgttggcgggcgggcccgacgacggggaccggcggctcagacactacgcggccatgttcatgtcgctccggccgcatgaccacctagagtgagcattagggagggaccatcctagctgtccgctggtcgcgtcatggtgactgtacattgtagtacactgtaatatatggttgtcatcttctttgtaagtgaattagtggctccgaattgtcatcattaaagaagatcaataataaggag

SEQ ID NO: 789 - DNA, 527 bp, Sorghum bicolor
  Clone ID: SORBI-28MAY03-CLUS126034_1
gcacgaggctgcagtcacttctccagcagcctgatctggagcggcaggtcactgagctccggcatcaattcaatcggaagactgtcttgctcggtgtggatgatatggacatttttaaggggattgatctgaagattcttgcgtttgaacagatgctgaagacgcatccaaaatggcagggccgagcagtgttggtgcagattgcaaacccaaaaggcggcagcgggaaagaccttgaggggctacagactgagattgaagacagttgcaggaggatcaatgagcagtttggacggaactggatatagccctgttgtacttgtcaataggacactgtcaagtgttgagaggatggcttattacaccattgcagagtgtgtcgttgtcactgcagtcagggatgggatgaatcttacaccatatgaatacattgtgtgtaggcagggaattccaggtttggctggttctgtggatgataaaccaagggggaaaagtatgctagttgtatcaaaaaaaaaaaaaaaaaa

SEQ ID NO: 790 - DNA, 581 bp, Sorghum bicolor
  Clone ID: SORBI-28MAY03-CLUS126144_1
ggattttgatgaagaggaaatgtatgaaaagattccagctgatctcataataagttctgagaaggccaagtcaattgttcaggcttttgcaaaggttaggttggagaactcccttgttcaggctattgccttgcttcgtcagaagaagagagatgatgtggtttcatcactgaatgacatgcttgcatgtgacgctgcggtccctgcatcaaaacccttgtcatggcccacaccaggagagctagatgatctatatgccatctacctaaagagcattccaaggcctgagaagctatcaaggttgcagtacctgctgggcataagcaacgagaaggccaacaagatccgggacgccgcctcagagggatcgctgccaattgcagctgaagagaaagaggagttggccttctaggaaggggcacagttttgttagggtagccaccagagttgaggtcccttgccaatgaacgaacgaacttggtgctgtggccaacagctgctattgtagctaggcgcatacatgtttttggaataggaaagcagacgtgtgatcctgacatattgcatagctatctgtatag

SEQ ID NO: 791 - DNA, 875 bp, Sorghum bicolor
  Clone ID: SORBI-28MAY03-CLUS126039_1
gcacgaggagagccaagaaatgcgttaggggcttccaagggaaggagtgccgatggccgatggccagccggcgccgccacggccggtggtggtggtggcgatgaaaggccacccggggtccggcaagtccacggcggcgcgcgccatcgcggccgcgcttggttggccgctgctggacaaagacgatgtcagggactgcacgctgcccctcgagggcttggctgctgcagggatcctcaacgacctctcctacgccgtgctgtggcggatggctgagcgccaggtacggctcggtctgtctgtcgtcatcgactccccgctgtcgcgccgcgctcaccttgatgctctgacacgcctggctggtgcgcttgtcgtcgtcgtggagtgccgccctggtgataacgaggagtggcgccggaggctggagagccgtggggcggctgtcccaaatggtggtggcagtgatggatggcataagccgaagacgtgggccgagctggagaggcttctggaagggtaccaaggctgcacggactatgagattggggatgtgccgaggattgtggtggatacaactgatccggcggttgatgcgcaggcgatagctgagaaggttgtgggtttcattaggtcccttctttcttgtagccaatcatcttgtgagagacaggattcacctgtctgctattggaaaccaaaatgtacattaacttaagtattaggtagagtttcattgcaaaaggtcaatctgttgtactgtgatgctcaaagttcttgtttttgtttatgggtgtagcctagaggttctgttattgttgggacttgaaaaggatgttgttgtgtgttctagaggtttagtaaaaagatgtaaaaag

SEQ ID NO: 792 - DNA, 348 bp, Sorghum bicolor
  Clone ID: SORBI-28MAY03-CLUS126158_1
gcacgagggcagcgtccaccggagcaagcgtgcacgcaacagacgacgcgccagccgccaaacggcagcagggccggacgtccggtcaccttccgcgctctgcgctcgcaccctgacccaccaaccacccatggcgtccgcgccttccgcccccgcctccgccgccgtcaaggccgcggtcgtccccatcccaccggtccacccgccatcctccgtggcagtactggcgcggcgcgcgccggccccggtgccggccgccctgcgcgccctgggcctgggcggcaacgcgcggcatggcgcggcgctggtggcgtccgccgcgctggatgacctgcgcccgggcatcga

SEQ ID NO: 793 - DNA, 499 bp, Sorghum bicolor
  Clone ID: SORBI-28MAY03-CLUS126200_1
gcaaagctcggggacgtgatgtcgcgccccgtgcaggtggccacgccggggcagcgcctcgcggaggtcgatgccatcttcgccgcggagcagttctcgggcctgcctgtggtcgacgaggacggcaggtgcgttggggtgatctccaagaaggacaaggccaaggcgcccaatgggatgcagatggagtcaactgtagttgaagtcatgtcatctcctgcgataaccctgacgcccgagaagacagtcttggaggctgcagcactaatgcttaaggagaaggttcacaggataccggttgtgaatgaacagcaacaagtgatcggaattgtgactcgctcggacgtattccaggcacttgaggccaacaacaacaaagcatgagagtgaggtcccctcccctgttaggcttgttctcgccagatgttgcccgttgtaaatatcagttgaaatagtcggtaccccgtgttgccctaggtgcaagcgagaataacggtgg

SEQ ID NO: 794 - DNA, 863 bp, Sorghum bicolor
  Clone ID: SORBI-28MAY03-CLUS12624_1
atgaaagagaaggcaaggaaggactccaaaggcgtggaaaagaaagagaagggctccaaagacatggaaacaaaagagaaggcagggaaggactccaaagacgtggaaacgaaagagaaggcagggaaggattccaaagacgtggaaatgaaagagaaggtagggaaggagtccaaagatgtaaaaatgaaagagaaggcagggaaagaatccaaagatacagaagtgcaagagaagccagtaaaggactcgaaagatgtaaaaatgaaagagaaggcagggaaagagtccaaatacatggaagtgaaagagaaggcagggaaggactcaaaagatgtggaaacgaaagggaaggcaggaaaggagtccaaagatgtggaaatgaaagatgtggaaaagctggatgaccatactttgagcaacaaggtggaatcagacaatgaaactcttagcgtgtggaaaaaacgtacagcaaaagcaacataatcttgctttctcagctgaccattcatagtaggatgcagatttcacaggcaggcagtcgttcgggaatgtggatatctcattgattgaccccttgcaattgacagttgtaatgtaggaaatgtttgtttcgatagcaacacgttagtatagaacagtggaataggatttgtttgtaatgttattagaagcaggcacatgttgcccattaagctatggcatggcatccccgggttgttttgtatatcttagagagggtcagaggttatgtaacatacctattagctcttttgcaggacatagtactaagtcattaaactcctgtagaaatgttgtatgcaataaatcagtggcacttgtaaaactagctttgggcaccc

SEQ ID NO: 795 - DNA, 593 bp, Sorghum bicolor
  Clone ID: SORBI-28MAY03-CLUS126244_1
gcacgaggcgcactcgcccgccgcgccacgcaacacagccccgggtacaaggggaacccggaggcgaacgaggcggcgttccggttcgggtggttccacacgggggacatcggcgtggtggacgaggaggggtacgtccgccttgtggggcggatcaaggagctcatcaaccgcggcggggagaagatctccccgatcgaggtggacgccgtgctgctgggcgcccccggcgtggcgcaggccgtgtcgttcggggtgcccgacgacaagtacggggaggagatcaactgcgcggtgatcccgcgggacgggtcggcgctccgggaggaggaggtgctggcgcactgccggcggaacctggcgtcgttcaaggtgcccaagaaggtgttcatcaccgacgaccttcccaagacggccaccggcaagatacagcgccgcatcgtggcgcagcacttcgtgcagccggccagtgcctgaccgatcgaggatccttttcgtgttgctgcaccctgggggtgtcggattgggatttcgctagcggtttgccgttgttgtcgcattgttgcgaggtggacatggcctggactggaatg

SEQ ID NO: 796 - DNA, 338 bp, Sorghum bicolor
  Clone ID: SORBI-28MAY03-CLUS126539_1
gcacgagggcggcgtcgacgagtacgtccgctacgccatgctcagcatctccgactgacgccgcactgatcgatgacggacgacgcgacgacgatcgagtggacgacggccaggcgcgtccgtcctttgctagcttaattagcttaggagatatgatctcttcctccccttgtaatacacactgctcgctcgtttggtttcttcttgctcgtagctagcatgatttttgatagcatcgaaaagattgggatcagggagattgttgtaacatgcaaccgtcgttgttggcgcaaatacaagtgaattttttgttcgactaaaaaaaaaaaaaaaaaaaa

SEQ ID NO: 797 - DNA, 783 bp, Sorghum bicolor
  Clone ID: SORBI-28MAY03-CLUS126540_1
gcacgaggcctcgtgccgaattcggcacgagggttagatacaatacaagctgaacttctctgaacttgtagccaggaaagcaggagacggaaaccaaacatggtcagcgccaagagacttgctcaaatggcaaagaagtggcaaagaatggcggccatggcaaggaggcggatcgcatcggcgccgaccaaaggaaccaccgagggatcatcaccgtgcagcacttcgccggtggccggcaaaggccactgcgtggtgtactcggcagacggcaggcgattcgaggtcccgctggcgtacctcgacaccgccatctttggcgtgctcctcagcatgtcgcaggaggagttcgggtttgccagcgacgatggcaggatcatggtgccgtgtgatgccgccgtcatggagtacgtgatgtgtttgcttaggagagatgcatcggaagaggtggtgagggcgttcctcagctccatggtgaggccttgccactgtggaaatggcttggtgcaatccatgggagttagccagcaagctgtgttttagcttttgaggattagttagcactttgattgttttatcattcttgaatgatacatgtaaatagttacaatgtgagagaccagaaatggaacttagtaggacatcgaccaagaaggattcatgactatggtttgaagaaattggggcggcatgtatgcacagtccattgaaaaatgcacacatataccataaaacgttgtcacatgctatgacagaaataaagcagaccatttgcaggaactg

SEQ ID NO: 798 - DNA, 480 bp, Sorghum bicolor
  Clone ID: SORBI-28MAY03-CLUS126558_1
gcacgaggcctcgtgccgaattcggcacgaggctcgtctcgaagcagcggtgctacttcgtccacagttgggctgttctcatctttccttctcgaactgcagcatggcaaagatcaagccaaaggccttgcttgcgcaaagcaaaatgaagaaagcccctagccaaatcagtgtgattaccatcgttacctacacaatccttggcgtcctggtcgtatcctctgtttatgttgcctacaaatatttaacatgcataggaccagtggaggcagtgggcgtccaggggaattaatacctcaactttgtaactgattttgttgttgtatcattcatttggataattttggtcgttgctgtctagtaaatctattagtggaacatggatagaatgtgcattgctacagttatactgtaaccctttgtacatcatcatattatgtgtgttaaattttttctttaaaaaaaaaaaaaaaaaaaaaa

SEQ ID NO: 799 - DNA, 663 bp, Sorghum bicolor
  Clone ID: SORBI-28MAY03-CLUS126559_1
gcacgaggcaggaagatgcggcggcggtagattatccaagaccgaccgcttgctcttgggctggtgggtgttcaccgcgctggctcacatcgtcttcgagccacccttcctcttcacccctgatttcctcagcaaggagaacccaaatttcttcgacgagatgtttaaagagtacagcaaaggtgactccagatacgcctctcggaacactgtagtcctcgcacttgaagtgataactgttgggttcaaaggccctgcatcgcttcttgcagtctatgcgattgcatcccggaagtcgtacagccacatcctccagttcgccgtttctctgagccagctatacggatgcttggtttacttcatccccgcgtacttggatggcttcaacttctgggtcagtccgttctacttctgggcatatttcatcggttccaacagttcatgggtgatcataccgacgctcgtcgccacaaggagctggaagaagatttcggcagcatttcaagctgagaaggtcaagaccagataatcctgcattcctgtgtggttgtgtcctcccgtgcgtttgccacacgtcagaagttttatccttttcgcttgagcttttatgtatattcaacagtttttttcctcccaataaatcagtggatagtactttgagtt

SEQ ID NO: 800 - DNA, 310 bp, Sorghum bicolor
  Clone ID: SORBI-28MAY03-CLUS126600_1
gcacgaggctagtacacaccttatggcacggacgatcgatctaagaaggtcaaggtgatgttgaaccgtgcattttgtgacgtgtaagaagaaaaagtttaccgagatttcacttctactgcatggagttctgggctgctgcatagcgccgccatgcatggtgccatggacaggatgcgcagcgtgtgtgtattactgtgtgtgtgtgtgtgtgtgtgtatatatatatataactttgctttctggtaaaccagagctgtaatgatgatttgtagcaacaattttggattttaaaaaaaaaaaaaaaaaa

SEQ ID NO: 801 - DNA, 526 bp, Sorghum bicolor
  Clone ID: SORBI-28MAY03-CLUS126680_1
gcacgagggagacctgcgtcaccgtctgcggcgtctctgaactcgacgcctgcgccgacgcctgcgcgcgcaccgtctgcgtcaaccagcaccaggtgcccaactggaacgacgtctgcctcaagaggtgccagagcgagtgcctcaaactctcctcaaccctcatgcacgggccatctcgctaccgtgcggcactccttaggtaccaccagtcaggttcttatctgcttctatccatatcatggttgacgaacttcagtcttcagacattgttaaccgtcattatctcaaggaattggagcgagtgaatgtttctggccatggctgttatgtctttcattccattagctcttgcacatttctaccacagaatttgtttccttaactgattgtgtgtactaggtgcaatatcctgatttcttgagtcacaacagagcctgggactcctccaggattgaatgttggcttcgacattcacttttaataggttgcttatgtcttctaataattaaattatttttgtgaa

SEQ ID NO: 802 - DNA, 470 bp, Sorghum bicolor
  Clone ID: SORBI-28MAY03-CLUS126687_1
gcacgaggcggacgagaggaggaggaaggccaaggagtacggagaaaaagctcatgtggccatggagaaaggagggtcctcgtatgagaacctgacgcagctgattgagagcttcaggcaaagtggaggcaaaaaaaggttaggttagaacagtgcacgcatatgaactaccattgcaatggcagtaggaatgcaggacgaatagcagaagctttgcaaattgcaattttcatcagcagtatggctacgtttttcattttttgctgaaaccggtatatatatgtgtagtaaatatgaaaccaagccagtgattgtgttccatgcatgcttttctttttccactcaaatcttttcctgcttcaacagtagatttgtaattaccatgtagtgtgcaacatgtacagtgaacagcgctcatcatcttcttgcaatgtcaagtgtgttcagacttgagagcattattcccatgt

SEQ ID NO: 803 - DNA, 822 bp, Sorghum bicolor
  Clone ID: SORBI-28MAY03-CLUS126694_1
gcacgaggggaatggaagaagatattcagagagaaaaaataaaggcaggagttcacttgtggctctctcaatgcttactattttcagctcaacataaaaccatgccatcaatcaacattgaacacatagttgccatatcagtggaattctagggtttaaggggatcatctgcaattgtctgaatggttgaaattgtcccattatgagtttgagagtgaggagaaagtttcagttatatggtgggtatgttagttcattagaggaaattgaagttacatgaagaaaaaatgtcatatggggaataatttgatatgaatgtaagaatgttacatgagatatgagcatatggcatttctttttgttttgaagcttatgccttctgcagttctatgttcacctacctactaggaagcgattcttgtcaaaagcagaagtattgcactttgtcaataagggcatggtttctacatgtgatatggatgtgctttgcgacactagcactgatgataatatacttgctcaggtggagttcagtcctgatggtttaccagatggatgggtgaaagaaacaatatttagaaagtgcaatgatggaatcagaaaagacccggtacattagcgcagtgcatctaaccgtttataccttgtttgtttggaaaagttgcttattcctttattattcatcaacagcactagtttgataacatttctaacttaatttatacagtattatacagatcctgttagtcgccgtgtatttcgcacgcttaagtctgtattgagctaccttggaactggagaaatatctaagcattcctattt

SEQ ID NO: 804 - DNA, 752 bp, Sorghum bicolor
  Clone ID: SORBI-28MAY03-CLUS123901_1
gaaagagaggcgatttcggatcccgcatcgatttcgccggctcctcctcgtgtccggcggccgctccggcgctggaggtggagaggagtcgcggaatcgatggctggtgcgcggtctccctcctaatagcttatgtttaggtagattagggttagttgattctgcatcggtgacctcatcgatggggatttctacctcgttcccttcttgtgcggcagctacgtcggtttcagctcggtctctaatgacctccggcgcggtttctcgtacggacaagatgaggtacgtggcatggtgttggtctgggtacctttctatagccagccagttcttgtatccctccaggagttttccggcttcttttccctcctcgagaaatcgggttggtttccttcccctagggttgctctgtcgctgggtgttttggggtcgtcagcggtgattgtggcttctgatcccgttctcttggcgaggatatggccgctggccatcatttactcgggcgttgaacgtttaaggtgcacatcttgttacttgttatgtgccggttgatgtagcttcaaaactgtattttgctttttggaagcttcttcgttgaagtggaattcggcttcaagctgcaagctcgtatcgatgtcgagtggtggctcgacggagacaaccgggccatctttgcaaggaccagaatgtaatttttttcaggggtgtttttgtaaggatgtatgtgtaatatctatatgaatatgaatcaa

SEQ ID NO: 805 - DNA, 177 bp, Sorghum bicolor
  Clone ID: SORBI-28MAY03-CLUS126719_1
gcacgagggtcatctatctcatcattcatctgtaattttttgtccatacatatggtgtattaacttcagcaaaaaccttgttgggcccaaccacagcaccgggagattagttttttttaacagctataccatcaatatacttcaaacgagaataaaaaaaaaaaaaaaaaaaaaaaa

SEQ ID NO: 806 - DNA, 288 bp, Sorghum bicolor
  Clone ID: SORBI-28MAY03-CLUS126739_1
gcacgaggggcaaacctgaatgaggagccggagccggcgagagatttagatctcaatcaacggcctccgccggagctggatctcaatcaaagccctccgccagagctggatgaagccggagacgacggagcggaataagggatatgtatgaatttgctttctaatacagcgttggtagcttcatttcttgtgcggaaagaagcgaggccgctgcctccctaggctgcgggaaagaagagtgggaacgagggcttctttcccttaaaaaaaaaaaaaaaaaaaaaaata

SEQ ID NO: 807 - DNA, 353 bp, Sorghum bicolor
  Clone ID: SORBI-28MAY03-CLUS126822_1
gcacgaggcctcgtgccgaattcggcacgaggaaaaggtgttggatatattggaagatgcttgcgagtcactgctcgatagtatcgttgcaagcatttctgggtgaccttgatgtaattctctacattcagacatcttttttcagacgcaccgaaggctgtagcatccatgcataacttaagtcatttggtttggttgcaacattgatcgagtattcatgtacctagttcttggtttggtttgtatataccaccatccttatacctggtcatgtgataagtgacacacaaaaacattgctcatcatcattgttttccagcaagataatcagaaacaaaaaaaaaaaaaaaaaa

SEQ ID NO: 808 - DNA, 675 bp, Sorghum bicolor
  unsure (1)..(675): unsure at all n locations
  Clone ID: SORBI-28MAY03-CLUS12681_1
tatatattatccatcacaatctagtgatgtgccaagcaattcccgtgttacatttgcattggaccataactaccgatcacatatcgagtatcgttggggaggagaaggtttaaggaagtacttagttaagtgggcttcttcagtagtagaaagaagggggagaacagaaaagcaaatcatctttgaagattcagaacactcttcaacatattgtcttgcatttagagtggttaatccaaatcatttgcctcctttgaaggagctgcaaaagttgatgagaatccagtcactgcgttgtcatgctctgtataaccatggcgccaccaggctatctgtaattccaattcatgcatcgcgatctcaggctctaaggtatttgtctattcgctggggcatagagttgccagatgctgtggtcattgttggtgaaactggtgattctgattacgaggaactgtttggaggtcttcacaagacagtcatccttaagggtggattcaacactcctgcgaataggatccatacagtcagaaggtaccctttacaggatgttgttgctcttgatagctcaaatatcattggaattgagggattcagcactggtgacatcaggtctgctatgcaacagcttggtatacccacacaatgacaccaagtgcaatntgttttgttatt

SEQ ID NO: 809 - DNA, 648 bp, Sorghum bicolor
  Clone ID: SORBI-28MAY03-CLUS126972_1
gcacgaggtagtacatttgctgccttatcaccttcgttctaacctatttttgtattttgtttatagtgtaaacatgaatctgacattatcatttgtaggatgatgttaggctgttgtgaatattggtaagtcagagtgattatttagtatatccttcaacacttttttggttatgaacttgatcatgcatagggaaggtgtttctaacctctcagttatgtagaactggaaagcaagagctgatacacgagaaaaactgcagcttgcctccagttttgcgtgctgattctgattaatatttgcaagatgaaccttatccgaaagaaatccaagctacttatctgttcaatttggagtggggtggatttaccaatgagcagaggaagggcagaagcgcacccgccaagaattttaggaatgacatagtttggggcctctgggcatgtattgcttggagcatttcttctttcatttccatctgccttttctgttctttgtatattttgtttcttttgtgctatgtatagtaaaattaattttatttgatttgttaataagaatgtatgaaaagtttggaaggaataatgtgatatacaatgtggttgtaaatctattttatatgagtgcctatttgtatataaaaaatgg

SEQ ID NO: 810 - DNA, 630 bp, Sorghum bicolor
  Clone ID: SORBI-28MAY03-CLUS126973_1
gcacgaggctgttgggccgccgccgccctaggccacgtgctgaggctttccttggtctcttcgccggcgacgagcacccacaagatctgttgctacttctctggtgatgcctggaattcggatcaaaactggagggatgggaggaacatatatcagtttgagtgtaaatagagatgactccaaaatggagcgcatgcccttcagatagctacagagaactatcttcacatgaaaatggagagtgcaaatcaaccttaacaccagtcccttcacctacaagctgttttggtttacacactgcgaacacaatgtgctccctatcctcacaaaagaaggatggcaatgtttataaaagaaggaagatggataaggattcaaattctactatagcatatgaagaggctaaagaaatgacaacccaaagttgcacaatttctgatgatcactcgtcatcactgctacccattgtctcctcagaggcattgcatttaaattcaacagcaggcatggcaggtcctatcctagattgtgaggagcctgctgatgtttcattggagccaaattctggtacaaatgatagatgcttcgtttcaagtatgtctccatctttcatgattctaggcaaaaaga

SEQ ID NO: 811 - DNA, 515 bp, Sorghum bicolor
  Clone ID: SORBI-28MAY03-CLUS126993_1
gcacgagggtctgaataagggcttgttcggttacagtatttagaggccaggaatcaatccggcagtgaaagtttatataaaatagaataccaatccggccaagaattctttccggagctcgttcccggtgaaacgaacgtggcctaatagaagagaaaacttggaattgagcaaaagcctccaccgaaaggggcaagtgaaagagtaattggagttgtgttgttagccttgcactttgatctgagatattgggattcttggaaaaggagaacaattcagggaaggactgttggagaagatgtccatgccagaggtccaatcttaagaagcaggatgaaccagcaggagcttaagaatatccctccactagaaggaacctcttctttcttggataggtagaagacccttagagtaatgcctctcccaaatcagatgcaccaaaggtatatcaagcttattaaaaaatttgtgaagattcttgagtgataagctgtcactcaagattctgagtcttc

SEQ ID NO: 812 - DNA, 959 bp, Sorghum bicolor
  Clone ID: SORBI-28MAY03-CLUS127042_1
gcacgagggcgggacaatggccgggaacgagatgacgccgagctcgaaggcggcggcgccgccggcgacgatacgcctcgtgaacttcatctccgaggaccagctcgatgaggtgaagcggacgcgaggggagcgggtggaggatggcaccgcgcagcgcgacaaacccctcttccagatcctacaggagaacaaggagaagaaggacgccgagttcaacgagcggttcaagcacagacctccaaaggcattggatgaggatgagacagagtttcttgataaattggcttcgtcaagaaaggaatatgaacagcaggtggccaatgaagaagcggaacagctccgcagtttccatgaggctgtagctgcacggtccagtattgttcatgaactcgagactcctacagtatctagacctgaggagagcagacctaagccacctacgaagaggagccagcatgcactcctgaagaacgtaataatttccgtgaagccgcaagccaagaaaccaaaggttgaggcggaagctaagcctgctcctgctccagaggagcggccttcaaatgggcatgacgcagatcagaagcaaccagatgacacaaaggcaacactcggctctttggtggcttacgacgacgacgaaagtggtgaggacgatgactgacagtggcgatcaagagttgaggtgtggataccgcaaaatgactgacagtggcgatcaagagttcaggtttggataccgcaacagcttactggaagagatgccagtggagcgcagccagtggggtttcctggaggagaggcaaaattggcttttcttacattcgaaagcctttgcggcaattttcttgtatgtattgtacaattcgaacatgatttggggaacagtactaatgattggtacattggtagcaccttgttttacgaaggaaacctgtagcaagcagtagtttcaattt

SEQ ID NO: 813 - DNA, 515 bp, Sorghum bicolor
  Clone ID: SORBI-28MAY03-CLUS12702_1
gtaaaagtttcatgttctttgcccggtcaaaataatgttccataaaaagtatagtgtcattcggatattgcaaaatagagagcctccatcaattaggtacggtaatgatatacttaagacgtccgtccgttcggacgttgctgtccactcatttcgctcctcctcgatgccttcttatccactcattcttttccactctactcttttctctcgtctcgctgccgcccgccgctcccaccatgcggtcgcacttcctgccgcgccaatggtgagtcgctcctccctccctcctcgctgcgacccacgcgccctcgaagccaccggagtagagcgtgacggtggtagcatccagtgagcggcgcagctctctttctccctgccctttctccctcgctctcataacatccatgcatctggagatggagagaacggcgcggcttcgacgaggtatgtggggagggaattggatcttaagccctccttttcctttatccttccttcctttttggggatct

SEQ ID NO: 814 - DNA, 754 bp, Sorghum bicolor
  Clone ID: SORBI-28MAY03-CLUS12707_1
acctgagagaagaggcctattgagtgcgtgtgccgagctggggaggtggttttcgtgcctaatggatggtggcatttggtgatcaatcttgaagagtcaattgccattacccagaattatgtgagcaggaggaatttgttgaatgttcttgatttcctcaagaagcccaacgcaagtgagcttgtctccgggactacggacagagtgaatctgcacgacaagttccgtggtgccatcgaggctgcccaccctggcatgatcaagcagcttgagcttgaggctcagcagaaggccgctgctcgtaagaagaaagcgtcattctgggattcggctgccgatgccaagagtggaggattcaagttctccttctgagtttcacaacggcaaggtctctgatcttcatgtttgagtggatctggttttcttggtaacagttaagcaattttgtatgcccattttttcttgagcagtcagcagtaccttcctggtggacaacgatcatgagccctcccattggcatggtgctcaccgggaatctagctaactgattatctgatttaatttgtaccatgagctgctacattagtgtcatccaaattttttacacaattcaccgcaagaacgattgcattgctgtgccgtgcaacttgtattctggtacaattgagaataccatgccaagaacaattgcagtgtttggcataccatgtaacttgcaaagttgcaattggataactggtttcctcaaggaaag

SEQ ID NO: 815 - DNA, 589 bp, Sorghum bicolor
  Clone ID: SORBI-28MAY03-CLUS127092_1
gcacgaggctcactgtaaaaaaaaaaaaaagattaaaaaaatggtttcacgtaacatcagcaataaaagagccctacagatataatataaataggcacgagcatgaataagcatgttaggagatgcctgatcagttagatacaaattttcagttaaatgtcgctttcctcaagggttaggaaacacagggtcaaaagggccgcggttgtgtttctacatacaccgcctctgctcgccgacctgcttcttgtttagttttaattaattagtatctgcacactttctttcatttcattcattattatctgggacggtgaaaataataacaaatttaccgtggttaattaattaatcaattaataataaggtccagtagttaataataagaacgggcttattaatattgattactttttatatatataccgagaagagttacatcattaactaattatattggtgtatacgtacacgtgcaggtgttgaggccatcggggtgtgctacggcatgagcgccaacaacctgccgccggcgagcacggtggtgagcatgtacaagtcgaacggcatcacggcgatgcagctgtac

SEQ ID NO: 816 - DNA, 374 bp, Sorghum bicolor
  Clone ID: SORBI-28MAY03-CLUS127144_1
gcacgagggttgtgtctcgtctcgtcttcctcgtgcctcgcgcactcgccgcgcctgccttttctgctctcggcggcatccataatactccccctcccggctcccgcacgcagccccggaggtccccaatctcgcctcgcgatggattcgtagcctcgcgtcgcgagggtactgtcgttcttttcagggataggtagatagattccgactgctcgccattggggggctgccgcttgcctccgccaggtgtcgtccgtcggttcggcgagctgcgggcggggcgctcctcgtcgtccgtcacgatggggggctggaaccggaagcggtatgtgaccggccaccgtgaccgctccgccggcgcttctcgtcctcct

SEQ ID NO: 817 - DNA, 672 bp, Sorghum bicolor
  unsure (1)..(672): unsure at all n locations
  Clone ID: SORBI-28MAY03-CLUS127213_1
gcacgaggccagactgaccagctgccgagcgcagctacctgagtacccgacccgacccttcaccttcagcagttcagccttcagctagcgaccgtcagagaagatggagtcgccgtcgccgtcgtcgctgagcgcgctgcggcacaggctgagggccaccgtgtgctgctgcttcggccagcagggcgccggcggcggcggcctgagcgagcggatgcggtggcgccgccgcgcgggcgtcggggagttccgctacgacccgctcagctacgcgctcaacttcgacgagggcgacctcgacgtcaacagcgacgacgaagaggacgaggacgaggatctgggagcccgcgcccgccgcggcgacggcctgctctaccacagcttctcgtcgcggctgtccacgcccgcggcggtcgtcgaggtcgcgtagacgtgtagcgcccggccctgctgggaccggaaggtccgatgaggaggccatggatacgtgtgtttgtttgctgcgattacgagttctctctgcgcgtgcagtccggatgctttgcgttcatcgatcagtttttggctcttgcagaattcacactagtagcatatgcgtcagatcagatcgatgaagaatcagtatagttgtgttagtagtctgatacatgtaaaaactttagcatacgtgnt

SEQ ID NO: 818 - DNA, 569 bp, Sorghum bicolor
  unsure (1)..(569): unsure at all n locations
  Clone ID: SORBI-28MAY03-CLUS127217_1
gcacgagggccaggagccgaggcttggagcaacgagcgggcgagggtggatgcaaatcgcacgctgccctctgacctagctggtctgcgccgcgctcgtcctgctcctccctctcccctctccgtctctctggcctttctggggcgccgccgcccttcgccaggtcttcgccggcgacggttacacaccaggctgagcaaatattcttccgccaatggcgagggaaccaagtcctgaaatagatgacgaacttttcaatgaagtttatgggaaagcatacagtggcccagttgcatcagctgcaaatagtgcgactcctaaagtaaatgctgagaagaggcccctgactcgtgataagtccgatgatgaagacgaggccccagatcctaatgctgttcctacggacttcactagccgagaggctaaggtctgggaggctaaagctaaggctactgaaaggaactggaagaagaggaaggaggaagaaatgatttgtgaaatatgtggagactcaagccattttactcanggttgtccctccacacttggggcaaataggagaaatgcat

SEQ ID NO: 819 - DNA, 491 bp, Sorghum bicolor
  Clone ID: SORBI-28MAY03-CLUS127232_1
gcacgaggatttattcctgaaaaaactctgtttttcattgccatggacgccaccagcggcagcagcatgcacttcgtgatgatgccatggctagccgtcggccacatcctccccttcacggagctcgcgaggcgcatagctctgcaaggccaccgggtcactctgctctcgacgccgaggaacacccgtcggctcattgacatccctccggatctcgatggccttgtccacgtcgtggacgtgcccctgcctcgcgttgagcgcttgccggaggacgccgaggcgaccatggacctccgctccgacgatctgcggccgtgcctgcgccgagcctacgacgccgcattctctgccaagctttcaaagatcctgcagggtccggagccgtccagcaggcctgactgggtgctcattgaccacgcggcgtactgggcgcccgcggccgccgcgaggcacggcgtgccgtgcgcgttcctgagcgtcatgggcgc

SEQ ID NO: 820 - DNA, 512 bp, Sorghum bicolor
  Clone ID: SORBI-28MAY03-CLUS127329_1
acagcgaggaggcgatccagtcgagggtgagcacgcactcggggcggatcacgttccaggcgaaccagcagacgacgacggcggaggaggagaagcagctgatcgaccgggaggtggagcgaggggtggtgtacctgatgggagaggccaacgtgtcggcggggcccaggtcgtccatcttgaagaagattgtggtcaactacatctacaccttcttgaggaagaacctgacggaggggcacaaggcgctggccattcccaaagatcagctgctcaaggttggcatcacatatgaaatctaggcctattgtgctacccatccaagatctgaggcgtgcctaattaaccaacaaaaagcatttcttggcgagtgttcacctcattcacagggcacagtgcccgcggtggtttgataataataagtctgtgtgagtggcgtggtttttcttttctttttttgggctgcaaggtttctttttattctctgtacagtgtggttcttatcagaattt

SEQ ID NO: 821 - DNA, 589 bp, Sorghum bicolor
  Clone ID: SORBI-28MAY03-CLUS12733_1
cccacgcgtccgggagaaccggtcatggatacgccaaattacggggggagggggggtcaccgttccagccataatggagtacttaagattgtgggacatcctgtccacaataaccttaggagaaggcgaagacaaactcatttggcgttggacagctgatggggcttactcttccaagtcagcctaccgtgcgctttttatggctgctacaccggtctacggctgccacctggtctgggaaacctgggcaccgctgcgggtcaaaatattcctatggctcgccatcaggaaacgccactggacggcggatagaagacgctgacacgggcttgaggcagcagaccgctgctacctttgtgaccaggagccagaaaccattgaccatatcatcgcctcctgttcgctctcgagacaaatctggtggaacgtcttgactatacttggtgccaacgtgtcacagatcggagatgatagcctcctggattagtgggagcgctggaggcacaggtggcacggagaaaagcgtaaaggagccgacacgctgttcgccctggtggcattggagttatggaagagcgcaatgcacgct

SEQ ID NO: 822 - DNA, 594 bp, Sorghum bicolor
  Clone ID: SORBI-28MAY03-CLUS12740_1
caggatctcgtccgacacctccgcgttaccctacacgcaccgccgcggccaccggtccgccatccgcatctcccgcatcgtctccgagacgttccgcctgggcctccccggcgtgcgctggttcgtaatgggcgacgacgacaccgtcttcttcccggacaacctcctcaccgtgctcaacaagttcgaccaccgccagccctactacatcggctccctctccgagagccacctgcagaacatctacttctcctacgggatggcgtacggcggcggcggcttcgccatcagccggcccctggccgaggcgctggcgcggatgcaagacggctgcctgcgccggtacccagcgctgtacggcagcgacgaccggatccaggcgtgcatggcggagctgggcgtgccgctcaccaaacacccggggttccaccagtacgacgtgtacggcgacctcctgagcctgctcgcgtcccacccggtggcgccgatcgtgacgctgcaccaccctgacgtcatgaagccgatggtcccggacgcgaggtcgagcccggcggcagtgcagcagctgttcaaccgcacggtgaagctggacac

SEQ ID NO: 823 - DNA, 831 bp, Sorghum bicolor
  Clone ID: SORBI-28MAY03-CLUS126697_1
gcacgaggcctcgtgccgaattcggcacgaggcaagaaacgcctgtgccggcgtgtcgccgccgccggcgccctagcccctaggccagtgcccaggtccccatcttctggcccttcgccggcgacgacccccaatagcacccttctgggttgaagattcctacttgaggtgtaagcaggaggcaccacagctcctctgaacacattagcactgggctattggctgtattgcctccttgattaacatctgtccaggatattagatgttcagtaactgcatctatttggtctgtagtgattaaagtcaactcacaaagagtttcagcatcagtaaatgacattattattattattgttatttaactgatgcatttgctctccttgttacttctgaataggtctgaaggatgaggaagggactgcatcctcagatgcaatggatttcatatgtgacgcagagtggtaggctgatcaatatcatgatgaccaaggtgaaccatactggcaaagtgtaccacatgagggccaagcgacaaatggctcaaagcctcggtcagattgcaaagttcaaacgtcgatatgagcaggaaacagaggaaagcaaagacaagtaggatggtgttgagaaggaggagctgtagcctctgtaaccttagtcagttctgctgactgcaaagttctcagttaaggaactttgatcacatgattttattttagatcacaacatcatcttttgttccacttcagaattgagctgtacccccatcttgagcaagctatggcacttgttgcaccttaaagccccaagaaaatagtctatcgatgctttttc

SEQ ID NO: 824 - DNA, 237 bp, Sorghum bicolor
  Clone ID: SORBI-28MAY03-CLUS127553_1
ctctcgtgctctccacccgcttccccgcaaaaccctagctccgcgacatgaaccgtggcggcgatcgctcgggtggcccctccagcggcggagaccgctctggtgcccggttccagcggggtccctcccgctggtccggcagcggcggcggcggattatggggtagcccgccctatcgctactcctcccgcggcgcggcagatggaggtggtggagggggcggtggcggaggcggtg

SEQ ID NO: 825 - DNA, 271 bp, Sorghum bicolor
  Clone ID: SORBI-28MAY03-CLUS127561_1
gcacgaggcgggactttgctcccgcagcacgcgcactctgccagcgctcccgactcgccggcgagggcaacgccgccgctcgcactgtgcaaaaagtacaccgcggcggccgacgatggcatcggttcctggcggtttggatggagggagacggtggcaactccacgttctgaggtgaaaacatggattacaaccttggtgacacctcccccgatccctacggtggtggtggtggaagcatccacctaacgtgtgagcattgcggcaccag

SEQ ID NO: 826 - DNA, 653 bp, Sorghum bicolor
  unsure (1)..(653): unsure at all n locations
  Clone ID: SORBI-28MAY03-CLUS12757_1
gctcgcgccacgggagtccccgcacgcggacgccgggcacattcgcgaccgccatcgcatcggccatccccgcggctgcctcctcctcgatcgatccgggagagatttctcttgcctgctcgtctctctcgcacccgccggccggccggtgctcttcccggcccacttcgtttcgatcgaccatggcggcttccgtccccaacggtagtcccactgtcagctctctcgcgacgactgttcccgtccaggcggttctgttcgacatcgacgggacgctgtgcgactcggatcccctccaccatctcgctttccaagagctgcttctcgagattgggtacaacaacggtgtgccgatagacgacgagttcttcatcaagaacatcgctgggaggagtgacgtcgaagctgcccagaacctgttcccggactggccccttgagaaggggctcaaattcctggatgacaaggaagcgaaatacagaagtttggcaaaagagcgcttggtacctgtaaagggcctcgagaaagtggttcagtgggtcaaagaccacgggtacaagcgcgcagcagtaaccaatgccccagggatcaacgcggagctcatgatctcccttctgggnctgtcagacttcttccaggccgntatcattgga

SEQ ID NO: 827 - DNA, 854 bp, Sorghum bicolor
  unsure (1)..(854): unsure at all n locations
  Clone ID: SORBI-28MAY03-CLUS12762_1
cccacgcgttcggccatgtggaacttcacaaatctgtaaaatgggcttcactaagcccacgctggtgtgggaaccccacctcatggaaatagtgtcagtaacgtcgtttgtgacagcccagtcaaattcgtttcaagtgtcgtttgcagcagagctcagacttctccatcacatgatgatataaacttagaacaagcacaattaactacttcaccatatggatctgaggatacctcagcatcaggcacaagctttgcagcagtgggagcagttgttttggctgatgaatccagcaagctcggtaacttgacatcagatcttgaacttaatacaattcagagaatgccactgcacacatcttcagaatgcgtggctcagaaggatgaaacaaagtttgaggaaatcagaagcttggcaagcagcaattgtgcagagtttgtagagagctcagttcttgccattgccgagaaggtacacttagacataggtggngatgaagtgaattgaaacgtcgttgcagttgaggttttgcttnctatactttctncctgtcaaattaagattctagtttgatatgatctgaactctntgcctgtcttgctatttgtcattgatttactgtcctgatccacaaagtggatgaatcatgtgattcaaagtggtctcaaaaggtgatgcaggtgtgaagttgcatagcacttgagaggccagaaatcggagtcgaggcatgtctggtatcagaatccttcattcattccttaagcataaaaaaaaatgctctattatggttatgttgtgttttttgggccttatttctttttggcaggtcttaaatatattccatcaactgcttg

SEQ ID NO: 828 - DNA, 532 bp, Sorghum bicolor
  unsure (1)..(532): unsure at all n locations
  Clone ID: SORBI-28MAY03-CLUS127688_1
gcacgaggcaagtccccatccatccgcacccacgcccaggccaccaccatgtcgggcctcctccggtggcgtcgcctcgccggcgccgccacgcgcgccgcctccaccctcaccgccgccgagtgctccccggcggcgggggaggtggcgctggcgaggaaggtgcggggaaggagggctggggtggttccaatctcggcagggatttgcccacgcctaaggagatttgcaaggggctcgacaagtatgtcattgggcaggacagagccaagaaggtgctatctgttgcagtttacaaccactataaacggatataccatcaatctttacaaaaggggtctggagcagatttgggtggttttgatggggaagctgatgatgacgacaatgtggaactagagaaaagcaatgtgctgttaatgggacctactggctctggtaaaactttacttgcaaagacattagctcgttttgtgaatgtaccatttgtaattgctgatgcaacgacattgacccaggcagggtatgtang

SEQ ID NO: 829 - DNA, 627 bp, Sorghum bicolor
  Clone ID: SORBI-28MAY03-CLUS127781_1
tcttcagccgagaccagacacaggccgtcaccaaccgcgttgtcggaacctatgggtacatggcaccagaatacatgatgcgcgggaactactctgtcaagtctgatgcgttcagcttcggcgtcatggtgctggagatcgtcacggggaggaagaacaacagtaacaacgacggcacccagcagtctggagaccttttgaccactgtatgggagcactgggagaccggcacggtggtggagttggtagacccgaacatgggcggcggcagcatcccggagcacgatgtgctgaggtgcatccacatagggctgctgtgcgtccagggagaccccgcggctcggccggtgatgtcgtccgtcgtggtgatgcttggcagcaatacggtcaccctccaagcgccgtccaagccggcattctgcgccaggaacaactctaacacggccgtgtcgtcgacggcaccgctgcagggctagccgtgtggcccgaagcgcccaccactgtatccgtctagctgcaacttgtttttttcagatgaaaaagaattatattaacttatagctgaatacattatgatattacaagtactctgcaattggcctcagtttcattagtggccgcggctcg

SEQ ID NO: 830 - DNA, 583 bp, Sorghum bicolor
  Clone ID: SORBI-28MAY03-CLUS127794_1
tctacacgatcagaacatggtcgatgacggtgctggagaacgtacactccctggtggggcagtccgcctcgccggagtacctccagaagctgacttacctgtgctggaaccaccacaaggccgtgcggcacatcgacacggtgcgcgcctacacgtttggttcccactacttcgtggaggtggacatcgtgctgccgtcaaacatgccgctgcgggaggctcgcgacatcggcgaggccctgcaggagaagctggagcgcctgccagagatcgagcgtgcgtttgtccacctcgactacgagttcaccctccggcccgaacacgccttgtcccacgagaaatagcatgcaagtaccgagctgatgcagcaggtggaaggacacgggttcgtagctgaaactatttttgtgtagccgcagaagagacctgatgctcgtctagtctcgtcagccgtcgcagcaaaccaagtagggtacatgcgatgggactgagcgcaaagtagtgctctctgcgatggtgtccttgtagattacagcatcatgaactacataatctgattataccagtgatggtgatgaggacc

SEQ ID NO: 831 - DNA, 725 bp, Sorghum bicolor
  Clone ID: SORBI-28MAY03-CLUS127828_1
aatatattgtttgctagtggtgctgtattctgccttgatattttgtgaactatgcagtaatggaaaaccacaagccgaagcatggttaaaaaaagtataactaagcaacagtaattaagcaaaactgttcagcactaactaaaaactcacaaacattttctctctttttagtcagttgacctctgctgctcatacattttgttgtaatgtgcatgatatatttttttcagtccatgtgacaattttgccctttcatgtctgttgataaacagtttgtccattagtggcacgcaagattttaatatttcatgccaaaatttgtgctgctaatgttttgccagtggaactggcaatttgtttcttgatgcgtgcgcactataatactatatttggttcaaattagatggtagcttttttttttcatgttctacaacttctgagcaattcttgctcatttctctgatatatttgcatgaattcatctcccatgaagggattaaatgaggttgatatgtaaattttgtcggccttagtgtagtgcattggtgaggctattgaatttgctcttgtatttgtcgattggctgtaaggttggtttagcagaaagcgtgttccattcagtgtatgcattgtatttgtatattggaacaaaaatgtaatggtatagtctatcgtgtgtttagggtgaatacattttatgcttgtaacgcaagtgagatttgttt

SEQ ID NO: 832 - DNA, 710 bp, Sorghum bicolor
  unsure (1)..(710): unsure at all n locations
  Clone ID: SORBI-28MAY03-CLUS127905_1
tgtgttgttatgccattttcccatttctgtatcagtgtactctacaattagcttctaagggctttcagatctatgcttttggtttattcagttcacttgctaaatgtaaatggtctcatgaagaaaaaaaagtaagcaagtcatccaaggttcatgttgtgcaatccatttgtcttctgcagttgtctgattagcgtcgtgggctttcccttccccctcctgaccgcgccccctgctcctctcctccctcaattntgcgtcgtgccacgccgtttaatattatgttctcaataaggtacacaacaggtaatttgctgcaggtcatcactaaggtccacaatggagaaaagtggactataaccattaacatggtagcacattcatacactgaagaatgtcttctatgtctggattaatgtacttataacagtacctgcacatatatataagggtgctcctcttgctggataatatctctggagtacctgcagaagggccatgcccatcagtttggttgaactggaggctggagcacttgtctcaggagttgaagcaaaatttgttgatgcaaagacaatgaagcatctgcctctgaaccagcttggagaaatctgtgttcgagtaccaaacataatggaagatgatatttgattattttcagcccttattaattatgtttatttacaaatataactgtgtatatatgccaa

SEQ ID NO: 833 - DNA, 887 bp, Sorghum bicolor
  Clone ID: SORBI-28MAY03-CLUS127043_1
gcacgaggcgcggatgccgttgcggccggtgacagcgcccggggtgtggactccgcggcggcgagcgccgactgctttggcatggcggtcgaggagatcgtgcagcacccgctgccgggctacggggcgccttcggtgctcagcttcagccccgacgaccgccgggttgcctacctgtacagccccgacggcacgctccaccggaaggtgttcaccttcgacaccgcgcagcgctgccaggagctgctcttcggcccccccgacggtggcgggctcgaggaggggaatctctccgccgaggagcgcctgcggcgtgagcgagcacgggagcgcggcctcggggtcactcgctacgagtggcgcgctcgccattccggtgagcccgccgctcgcgctggcattgtcgtgccactcccatccggggtttacttccaggatttatctggctccgaaccagtgctgaaactacaaagttctcccacatctccgataattgacccatatctatctccaaatgggagcatgattgcatacgttagggatgacgagctgcataccttgggggtttccagtggagaaactaggcaattaacttttggtgcaagagaaagtaggaaggtccacgggctcgctgagtatattgcacagagatggaaaggaagatgggattttggtggtctcctgacagcaagcaccttgcatttactgaagtggactcaactgagattccattgtatagaattatgcatcagggcaaaagttctgttggtccagatgctcaagaagaccatgcgtaccctttcgcaggagcagctaatgttaaagtgcgacttggtgttgttccttcccatggaggggaagtaacttggatggatctcctttgtgga

SEQ ID NO: 834 - DNA, 555 bp, Sorghum bicolor
  Clone ID: SORBI-28MAY03-CLUS128127_1
gcacgagggctaaacctaccactaagggatgcagtaagcagcgtggccgtgattcttctaatgcaagagggaacaggaataaaagaacagaagaggaaaatgtgcctggattgattaccgtggctcctgagtcagaagatgagaccccatttgtagatggaaaccaagcagagggtggtgcattgtgggatattttccgacgggaagatgtgagcaaactacatgattatctaatgaaacatgcagacgagtttaggcattgcaactttgagacagtgaagcaggttactcatcctatacatgatcagtgtttttatctaacaaatgagcacaagagaaagcttaaggaagaatatggaattgagccttggacatttgaacagaagctaggtgaggcagtatttattccagcaggatgtccccaccaggttagaaatttgaagtcttgcataaaggttgcacttgactttgtttctccggagaatgtgagagagtgcatcaggttaacagaacaattccgtctgcttccgaagtggcatagggtgaatgaagata

SEQ ID NO: 835 - DNA, 534 bp, Sorghum bicolor
  Clone ID: SORBI-28MAY03-CLUS128150_1
gagataaaagttgaggcaattgcatttaagtcgtgatttgaatactcactaaattcagcgttcatattatattgcattacttcattgcagaagcagtatcttgtcattccttactctataaatagtagagaacttctcttagattgtatgctagccaatggacatatttcccttcttatccaaaagatatatgacaaatgtcactgattttcatttacagtggaaagggattcaattggcagaagttccaaatgccatctgtcaaaagcaagaatggatggctattagctggagggcttcatgcagataatgtttgtgaagccttttctgctctgaatcccaatggtgttgatgttagcagcggcatatgtgctcctgatggtatccaaaaagatgcagacaggattaattccttcataagtaatgtaaaatccatgaatttcttatcataaggtcatttgattgtcaagagtttagttttatttcaccgtgcggagtccattgaattaatgcaacatgaagagctgtcaaaat

SEQ ID NO: 836 - DNA, 473 bp, Sorghum bicolor
  Clone ID: SORBI-28MAY03-CLUS128176_1
gacggctgggctggccggaaggccgcccgcggcggcagtccgggcacgcccggcggcgccgagagcgcgtccaccggatcctcggacgcgtcggaggtgtcgtacggtggcggcgccgccgtcacgctggcggcagctggcgggccggttttcgagttcgagacgaagccgaccgtgccgccggcccagcagatgccgctgtcggcgatcgagtcgtggctgttcgacgacgacagccacttccaccatgtccagagcgccggcgtgctcgatgcggcccccatggattacccgttctaggcttctagctagtgtgtccaagtgatccagatcaagctaatcccccgtcaagcaaggagtgtggtgtgattacagcgcgcgctgtactcctaaagaaaactacatagatcctgcagtacgtcagtgactaatcaatagtcggctagctagctgttgtaaatcggtcacctgat

SEQ ID NO: 837 - DNA, 840 bp, Sorghum bicolor
  Clone ID: SORBI-28MAY03-CLUS12818_1
ggaggcgattaggattagctgtgccggatatccgaccagaagaacattctacgagttcatagaccgttttggtattcttgcgcctgatgttttgagtggaagttctgatgaggtcagtgctgtaaggaggttgttagacaaggtagatcttcaaggttatcagattggcaagacaaaagtattccttcgtgctggtcagatggctgaacttgatgctcgtagaaatgaagtgttagggcgttcagctagcatgattcagaggaaagtacgttcattcttggcacagaagagtttcattgcattgcgacgagcagctttacaaatccagacagtttgtcgcggtgagcttgcaagaagagtttatcacaacctccgcagagaagctgcttcactcaagatccagactttgtaccgtatgtatactgccagaaaagcatacaacgagctttctgcttcagcagttaccattcaatcaggattgcgcggtatgtgcgcgcgtaaagagctccacttcagaagacaaacaagagctgcaatcatcatccagagtcgctgccgtcaattcttggcaagattgcattattcaagaacaaagaaagctgcaattactacacagtgtgcctggagagggaaggttgctagaaaggagctccgtaagctcaaattggctgcccgggaaactggtgcattgcaagctgccaaaaataaacttgaaaagcaagttgaggagcttacatggcggctacagttggagaagcgcatgcgagctgatctcgaggaagctaaatcacaagaaaatgcaaagttgcaagctgcattgcaggaggtgcaacaacagtc

SEQ ID NO: 838 - DNA, 422 bp, Sorghum bicolor
  Clone ID: SORBI-28MAY03-CLUS128247_1
gcacgaggaggaaacttcctctcttcctaccaaaaataattatatagttatccttgggcgatcttgattcttaattagtacactcaggttctctgtggaaaatcgatactctggaatactcccgggtgaaagctacatcggtatccgtgcgcttgcggatttttctgtttgcgtttaaaatacccaataacctttctggcgccgttgccggggaacggtagctgtgctagtttcgaaccaagtcgtccgtgtatccttttcttttccttttttttaccacactcaccttaccattttcaccataccacatggatttcactccacacattaatgagcatggaatttatttcatagccacttcatttactctatgctcatatgtaatatcttcacaatccattggtctctccaacatcaccaca

SEQ ID NO: 839 - DNA, 480 bp, Sorghum bicolor
  Clone ID: SORBI-28MAY03-CLUS128293_1
gacaaagagcgacgtgtacagtttcggcgtcgtgctggtggagctcatctcctccaagcccgccgtggacatgagccgcgcccgcggcggcgacgtcaacctggccaccatggccgtgcacatgatccagtgctacgagatcgaccgcctcgtggacccgcggatcgggtaccggacggacggcgggaccaagcgcgccgtggacctcgtcgctgagatggcgttccggtgcctgcagccggagcaggacgtcaggccgcccatcagcgaggtgctggacgcgctgagagaggcgcagaggatgcagcaggatgggtgcgccgccgtcaaggccaaggatgacatggggttgctcaagaagagcagggacggctcgccggactccgtcatgcatcagtggaccagcccatgcaccaaccacccataacagcagttgagggttgtcagaaaacgaaaacatgtgagtaacctgtgtgcagt

SEQ ID NO: 840 - DNA, 441 bp, Sorghum bicolor
  Clone ID: SORBI-28MAY03-CLUS128465_1
gcacgagggtttgttggtgttggtgctcggagagtgaggtcattgtttcaagctgcaaagaagaaggcgccatgcattgtcttcattgatgaaatagatgctgtgggttcaactagaaaacagtgggaagggcacacaaagaagacattgcatcaacttcttgttgagatggacgggtttgaacaaaatgagggaataattgtgatggctgcaacaaacttgccggacattcttgatcctgcactcacaagacctggtagatttgataggcatattgttgtcccaagtccagatgtgcggggtcgccaagagattctggagctctatttgcaagataagccagtggcaaatgatgtagatatcaatgcaattgcccgtagtacacctggctttaatggggctgacctagccaaccttgtaaacattgcagcgataaaggct

SEQ ID NO: 841 - DNA, 765 bp, Sorghum bicolor
  Clone ID: SORBI-28MAY03-CLUS128679_1
ccacaaactcatactacagtgcatcagacaacgccttaccagaatcatactgttccacaggtgtatcctacttggccccaaacagctgaaccgtaccacaatcataatcagcaggtttatgctactgggttgcaaacagggccataccaaagccataaccaggtctatgctccaagattccaaacaggaccataccagagtcgtcatcatcaggtttatagagcagggttgcaacctggaggaacatatcagatccacaatcaacatccccaggtgtataatgcagggttccaaaccgacggtccacaccaaaatcagcagcggcggaagggatacacaccgacccatcagactaacaggtatactgccatggcagcgaggtatgagcctgttcgtggacagttcaacaatggatcaacaagggactcaaaatcccaagcagcagacactgcagcttcacaaagatagccgtcagcatccccttatcactcaggaggatagtaacaggcaaatcttctgatttccgcacggcagtactcgttaggtctatggcattttcaccttttgctcgacagtgtatagcttttgccagagaactctggtctaagcctagtgttttgtggatggaagtatctcgagctttgtactgctggacaactcttcaagctttgtactgctggacaactcttccctatgtaaaaatttgctaacgctttgtactgctggacaatcttccttgtgtaaaaatgctggtagcagtcgttt

SEQ ID NO: 842 - DNA, 691 bp, Sorghum bicolor
  Clone ID: SORBI-28MAY03-CLUS128663_1
cagacacctagtttgctgctccctgactatgaagatgagggttccagacaatacttggaggaaaaaggacagattgagtatagagatatgaacagtaacggagagcacacccccactcagcctaatgagtactctgatgttgagcatcaccagcaaaaggggcagacagagaccagccaagaggttgaaatggaggaggattatcctatgcagcaggagaacccttcatttctgcaactctgcgctagcctcttccccagcaacgggagcagtactttcagggtgcgacattccctgttccgtccgcgccgccgagctccactgaaggcgagccctctgcatgtagccatggcagcgataatgaagcgttaggattttttcagcttggtttcgtgtgaagagaagctccagaccagcggcgttctgactttggcaaaagttgtaccctgaatacatggaagcaggttggaatgtcgaggctgattagtctatacatacatgtgggtgcgagattagttgaggcatgcccatctccgtaggctgcatatgagattcagaattctgtttgatttttactattgtggcataattgtaatagccacatgttggtccattgcttgccgccccggaatagggctggcctgatgaaacacctctccttatataatttgatgatctaaagggtttgttt

SEQ ID NO: 843 - DNA, 674 bp, Sorghum bicolor
  Clone ID: SORBI-28MAY03-CLUS12742_1
tgtttatttagcttacactctatttcccggataatatttgcatgtctaaattggtattgatcactttgttcatgtatgttatctgtgattcattggtccgtgttaatggactctgtaaaatcatagttttgttgtatgatcagacatttaatttcttaggctgcagtgtccactcatgatttacattgatttgttggtttttcaacccagctcggtagtggccagtttggtctggttactcaaaatccttctttctcgattatagatgccacatatgtgttttttagttcctttttaattgcaacagccgacataccttgcttacaggtacttctatatgtcagctttggagctgtgtcctggtccttggaattgccatcgaccagatcggagagggggagcaacaacgacagaggtattagcaaatactggatggagctttggctacttaagatcttgatttgatgggccccaggatattcgtaaaccgctgctagcaagaccacaactgccacacaactccgggagaaagggagggcggccatagcatatggcttctggaggagggcgacatctgtagtttgagaagccaagctccctatgtttgtgattgcaagatgaaagcaaaaacttgggtggaagcatggcaagcaacatgcatgctacagatttgc

SEQ ID NO: 844 - DNA, 444 bp, Sorghum bicolor
  Clone ID: SORBI-28MAY03-CLUS12871_1
gcactcgcgaggtctcgatcccatcgccacgccacgcgccgggcaccgcccgcctcctcgaatctctcgagcccgcgcgccatccgatcccctgaaatcgatcggcccgaccctagccccgcccgccgccggtcaacgcccgcccacctcggctcgatcaggcggcccccgggggggagcgagcgaggcctccatcgcggcggaccccgatgccccgcctcccggtcactccggcggcggcggaggcatgagccggcggggactcgccggagctgtcagccatggacgccaccgcgcgcccggtcatcgtcatcgacaacggcacagggtatagcaaacttggattttctgggaactcggagccgtctttcaccctccctactgtcgtagctgcgaacgaatcttttctagaccagacagagctgttgagtagtgcgaactgga

SEQ ID NO: 845 - DNA, 876 bp, Sorghum bicolor
  Clone ID: SORBI-28MAY03-CLUS128757_1
gcacgaggccttggtcctctattgaatccagcaagggtgcctcatgctgttattggtgtttaccatgaaaacatagttaccaagatggctaaggctgctcagaaatttggaatgaagagagcactggtcgtccattcaaagggtttggatgaaataagcccacttggtcctggatatatccttgatgttactccagggaagattgaaaaaatgctcttcgatccattggattttggaattcctcgatgcacattggaagatctgaaaggaggtgatccagcatttaatgcaaaagttcttcaggatgttcttgctggtcaaagggggtccattgcagatgcccttgttctaaatgctgctgcatccctacttgtcagtggtaaagtgaagaatttacatgatggtgttgcactagcacaggaaacacagaggtccgggaaagccattaatacacttgagtcttggataaaggtttcaaatagttccagagactgagtaacattgagtagcaatagatggatttcttgcaataagacatgaggaatggtggcaaataagggctttgctaagtccatctgtaatccgtggatgattgagtaacattgtgttttgctttatttattaacggtgctgttgtgtagattttaagcttttttgttaaaaagggcggcgtgtgcttcattttgcttgacggggtaaatgaacataggttaaatgttgtgaacttgtgatgctgcattacgtttgcaatggattgtacattttgcaatggcatgggaagaaatacccatttgtaatgaggaaaataagggcttaaacatttttgcaatggcatgggaagtgttatccccattggtaacgcatgttcctgaaatt

SEQ ID NO: 846 - DNA, 649 bp, Sorghum bicolor
  Clone ID: SORBI-28MAY03-CLUS128820_1
gcacgaggcctcgtgccgaattcggcacgaggacgtgtacagcttcgcggtggtcgtgctggagctcctcaccgggaggaaggcgttcgtcccggtggaggacgaggacggggaagaggaaggcggcctcgcgttctgcttcatcacggcggcgcaggcgggacggcaccgggagatcatggaccagcaggtcatggaggaggtgggagcggaggtgctggacgaggccacggagctgctggtgcggtgcctcagcatggtcgccgatgagaggccaaccatgaaggaggtcgccgacaaactccataggatcagcagcggtacgcaaaattaacagtgacccggagtattggcgctatcagattaatgagaaagtcaaatttggcctcaaagacatgtccttgtgatattgagttattaactattgaatatacatcgtgaatcgtgatatgaacacatcgtgaggcagattcatcactggattttctacctaacataggatgggagcaattccaaaaaaaaaaatgtaggatggagcatatattttacctagcacttctatgtttcgaggtgtctgtgttgtttgccaaagattgttttctgaaaattcagacaccagaaatatagcaacttctttctttaccaagtt

SEQ ID NO: 847 - DNA, 733 bp, Sorghum bicolor
  Clone ID: SORBI-28MAY03-CLUS12885_1
gcgccaccgcgtcgagaccctcaacgccgccttcggctacgccgtccgctccaccggctacggctccaggtaccagggcgtgtacccggtcaagtgcaaccaggacaggtacgtcgtcgaggacattgtcgagttcggcgcgccctttgggttcggcctcgaggctggctccaagcccgagttgctgctcgccatgagctgcctcgccgcgcgcggcaacccggacgctctgctcatctgcaacggctacaaggacgacggctacgtctcgctcgcgctcatggcacgctccatgggcctcaacaccgtcatcgtgctcgagcaggaggaggagctcgacattgtcgtcgaagccagccgccgcctcggcgtgcgccccgtcgtcggcatgcgcgccaagctgcgcaccaagcacgccggccacttcggctccacgtccggggagaagggcaagttcggcctcaacgccgcgcagatactgtccgtggtcaccaagctcaaggccattgctatgctcgactgcctccagctgctgcacttccacattggctcccagatcccgaccaccgccctgctctccgacggcgtcggcgaggccgcgcagatctactgcgagctcgccaggctcggcgccgacatgcgcgtcatcgacgtcggcggcggcctcggcattgactacgacggaacccactcggcgcagaccgacatgtcggtggcgtacagcctggaggag

SEQ ID NO: 848 - DNA, 487 bp, Sorghum bicolor
  Clone ID: SORBI-28MAY03-CLUS12903_1
gcacgagggtcgcccatataccatacgtggacatcgaggtggtcggccatggcggagctccagcagctgcagcaggtggcgagcgacgacgcggcggagtggaagcaggtggcggagctgagggccgtcacccaagcccaggatccttcctgcaaggaggaggacgactacactctgcgtcggttcctccgcgcgcgggaccacaacatcggcaaggcgtcggcgatgcttctcaagtacctcaagtggaagccgacggcgaagccccacggcggcgagatcccggcgtcggaggtggcgcgggaggtggcgcaggcgaagctttgcctgcaggggttcgacagggaagggcggcccctgatctacggcttttgcgcgcggcaccacccggtgcggcgggacatggaggagttcaagcgctacgtcgtgcacgtcctggacgccaccgtcgcgcgcctgccgccgccggggcccgggcggcaggaga

SEQ ID NO: 849 - DNA, 632 bp, Sorghum bicolor
  unsure (1)..(632): unsure at all n locations
  Clone ID: SORBI-28MAY03-CLUS12908_1
gtnttnnttnttnccccacaataatgtagtctgtatttgtagattcattactgacaggcctgttttcacttgtgaatgtgttaactgatagtttctcgaatgaatttgataacacactttgttgattgcttgtctgattagttgtaggtccatcagtatcagaaggaccaacattgcttgaagtggatcttcggtcacgtaactctaactcaaaacaaccatatcctgagcttgttataccactaagagaagatcccaatagattggtactatcatcttggccaaagtgatgattatcagagacgaaatttctgtctagttctgtggataaaacagtaacatctgaaggaataagtgtaccgggatcagctacaagatcaacaataaactcccttccgtctttaaatttcacaatgttcaaagctccatcatctgatccagtgtattgccttcctttcagcagacggcaaggtacatcaaggtcatcagccaaaaccttaaacagcagtgcacgatgacgagctagaccaatttttagctggccaagtcgcacaattacacttccagtaccacttcttaagttgctaagcatattctggtatttcactaacatgctctcaggatcaaacact

SEQ ID NO: 850 - DNA, 852 bp, Sorghum bicolor
  Clone ID: SORBI-28MAY03-CLUS129107_1
gcacgaggcagagctagctagtagaaatttcgaaaatcgacacaggagaggtcgacgacgacgtcgtatttttttttttaaaaaaaaggcttggagtatttttcggatttgtatatatacaaccgacatcgaagaggaagagaggctgctgcggcggcatccatggcggcgctggcggtaacgacgacggcgacgacgagcagcaggcaggtggaggaggcgccggcggggcggatgtcgtccatagagtgggagcccaagacgctgaccctcgaccagatcaagttcgcaagggaggcggcgctgtacgtggtgagcaccaagacggaggaggaggcgatccgcatcttcaccgagggcctcaagcccgtgcagatgacgacggcgaccgtccgcaagtccagctccatcgactcctcgtccgacgacgacgtcgagctcggctgctgctgctgctgctcctccgccggctccaacaaaggctgttgcggcggcgggagcaaaggcggccgccgtggtcgacggcggcgctccatggacgacgacagggacgtcgctacggcgccattctagtagctacctagttgttcttttttttccacttcttattatagacgtaagtaaagctattagctgcgtgcgtactaggaatagtctagagtctacctgtgtgtgtgtgtgtttttttttacctcgcctgtttttacttggttatcctttggctggcctctggttcgtttgaaggagcagccggccagccggcgagtttggcccagcttttagcgcggcgaatttttgtggcacagggctatctataattagtactcgtagcttaggtacaagagaatatgt

SEQ ID NO: 851 - DNA, 747 bp, Sorghum bicolor
  Clone ID: SORBI-28MAY03-CLUS12921_1
cagtgagcagcataaggacagtggcatcattttcagctgaagaaaaggtgatggatttgtacaagaaaaaatgtgaaggacctttaagagcagggatcaggacaggaataacaaacggtattggctttggggtttccttcttcttgctgtttggagtttatgctgccagcttctatgctggtgcacggcttgtagagaatgataaaacaacttttcccaaagttttcagggtatttcttgctctcagtatggcagcaatcggggtgtcacatacaagtaccctcacatcagattcttccaaagcaaaatcagccgtatcttctatatttgccatcatggatcgaaaatcaaggatagatccaagcgatgatgctggggtaaccctggagccactaagtggcaacattgaatttcggcatgtgagattcagatatccaacacggcccgatgttcagattttccaagacctatgcctgacaattcaatctggaaagactgttgcacttgttggagagagtggtagtggcaaatcaacagcgatagcgttgctgcagagattctacgatcctaacgcaggccatatactcctcgatggagtggacatacagaagttccagctgaggtggctaaggcaacagatggggctggtgagtcaagaaccatccctgttcaacgacacgatacgcgcaaacattgcctacggaaaggacgggcaagcaacagaattagatatcgtggctgccgcac

SEQ ID NO: 852 - DNA, 438 bp, Sorghum bicolor
  unsure (1)..(438): unsure at all n locations
  Clone ID: SORBI-28MAY03-CLUS129253_1
gcacgagggtgagcccccggcagccggcacttttccggaccccgactccggcgattccccaccgccatggccgccgccggcgaggcctcaagcaagctcctccgcttcatgtacttcgtcggcgcaggagtcatctgcaccaaggccatcaacacctatcgcgactacgagcacaagaaggaggcctccgcggccgtcgccgccgccgaatcggcgttggctgctgccgcggcggccgagcccgctcctgcaaccgccgccgccgcgaagccctgattgcggaggagggcctgtattcgccggttagggttctcgggatgttgctctacagaggggaaatagatattatcttttgttttctgatgtttttgtccaccatgtatcgtgttgtcttgacatgaatcatcaataataatacttcatttcctgtctnanaaa

SEQ ID NO: 853 - DNA, 957 bp, Sorghum bicolor
  Clone ID: SORBI-28MAY03-CLUS129260_1
cgccaagagagttcagagttgcttgagcacgcagcaggtggacacacacaacacaagagaaactcggcggcgccagcgccgcggcggcaaaccgagagaagaagaaaagttccatctcaccggctcgcgcgcgcggaaacggagcaattaatggcgtacgcgaagaaggccaccgccgtgctcagcgtcgcggtgatcgcgtcgttccttgtcgccgccgctgagagtgagagccgccacattgcccggaaagacctgggcgtcggcctcggcggcggcggtggaggcagcctcggtgtcggcacgggtggcggcgtcggggttggtagtggtacaggcggcggactaggggttggcacgggtggtggcctgggggctggcacgggcggcgggctgggtgtcggttcagggatcatcggcgtcggcggtggcggctctggttcaggttctgagtccggctccggcgccgggtcgggatcagggtccgggtcatggtctgggtcaagctcgggctcggacgcgaggtctggcgccgcaggctcatcggccggctcctacgctgagtcagggtccggcacgaacgccgggcccggcggcgcaggatcctacgcgggctcgagagctggctcggacgccggaggagcaggctcgtacgcgggctctgacgccggctcgtatgcagggtccggcggcggcgccggctccggtgcagggtcccatgccggctcctacgctggcagtggacatggcaagtgagctcgagcttacttgcggttgcagcgcagcaagacagagacagtcctgcactatatatggtgttgacaagttagctttgctactgtatgtcatgtgtgtcatcgtgtaatgagtcgtagatgtgtatgagaattgaataaggtgccagagcaaccatgcccatatacttctgtgtaacatatatttatgtaaatgaataac

SEQ ID NO: 854 - DNA, 652 bp, Sorghum bicolor
  Clone ID: SORBI-28MAY03-CLUS129300_1
tggttcaagaaaagtaatgattgttaaggaaggggcaggctgggttcttccgctgcttggggtcatccggctgctggcggctctttctggtccgacctcttctggcaggggtgagcatgcccgtttcgtcgtagtctctgcatcgggctctgcggctgtccggctagctcttggtgccactcctgtcccgggtgtccgctgtgatgcctgccgcctcccctctaggggattcaccacgcgagggatcgcttgtctctgatcttgagagggttttccctcctttctgccacgggttcgtggaacttgctcctcctctcgctctggtccactgggccgtgcgcccttctccttgcagatttggcaaggtgctggaaggtgaaatcgcaatgtgccgccaggtagctcaacagaccggtatcctgctagatccaatgtacaccttggctgcctgggagcaagctgttgatctatgctgtggagacagtgcagccaaagtcttgatgatccatacgggtggcacccttggcctttttgagattggcaacaaagagtattcaaccacagttcaccacaggcgaacaatcataagcaggaccaaacccaacgttgatgtgcaaatgttacggtttgtgggtatggaatgtgatttttg

SEQ ID NO: 855 - DNA, 535 bp, Sorghum bicolor
  Clone ID: SORBI-28MAY03-CLUS127998_1
tctcaggataatggcacagatgatgatgacgacgacgatgatgatagtgacgaggactgggccgagtaatgcccttgtagttgtatcggatcttgtgcatgggtacagaacgatgggttggccaagcatgcataattgatgtataattggtgtgcgggtgaacagaacgatggattgtgaggatggcacagaagctgctgttttcatcgtctgattggttggacatgtatgacgactgtggaaaccctgatctatcgtcaagctgagtttatgaagcgttgattcctctagttagtcacaagtggagtgtatttttctttatctggcttgtttgtagtaggacacacacacacacacacacggtcaattcgaggtggcgatggggttgcacacatgaactagtcattctcattcatctgtctgtgtcttgtcctttgtgtggatgatggattcagtggcaagaacacctcagtttctgatggtcattcctccaggggcaagaacactatgtgtttcactgatcctttaaatcctt

SEQ ID NO: 856 - DNA, 581 bp, Sorghum bicolor
  Clone ID: SORBI-28MAY03-CLUS129314_1
gcacgaggagcagatgcttcgcaccgtcgtgctttcgctcggcggcttccggcgcctgcacgagatgtacatccggccggtccagcagcgtgctgctggagcgccgccgcctgggcagcagcagaggcggcagttgccggtgaggatgggccgggatcaggtccaagtctcactgtctctgctctcgacctcgttctttctgaatatgcctaatgctcctccaccacctcctcctaaggacaaggataaagatagagataagaatggaggtggccaatgtgggtgatcactgatcaagtttatgaaaaataggagactacctcccatgcagcatcaccactagctgcttatgtaatgtcaggcaattagattgtggttcttcactgcatttgtgggagtaaaataagtcacttggattggtgggcagagaagagtatgcagataggtgcggatgtactaatagggaggcaaatttaagctaatgagattggatggaatggaatgcaatggtgtattggatgactaccaagtctgtgtgttgtacctaaattacacatgatcggctacatgtgtaaagtttc

SEQ ID NO: 857 - DNA, 720 bp, Sorghum bicolor
  unsure (1)..(720): unsure at all n locations
  Clone ID: SORBI-28MAY03-CLUS1294_1
ctcgttcattggagactcacgcactgtcatgatatcatgcatttctcctagttctggctcttgcgagcatactctgaacacattgagatatgctgataggtgattacttacctccattgtttctgttgctataactgctcatattatcataatatgcacaacacattctcatttttcagagtgaagagtttgtcaaagggaagcaatgccaagaaagatgtatctttggcagtgcctatgagagagtcgagtccttccccactgacttcagttgtaccttcattctctgcatcgtccgtgatgaatgatatcaccgagagaagtaattttggttggcccaagcagcagtatgttaaagaacagcctgctccaacattcgctgaacgaatgcccaaggtgaaggattcggtggagttcacatcatcatatggtgcttattcgaagcaacaaagaagcaagggctttgtggcaccaaacatggctgaagtaccagatataatgtaccagcagggaaggcaaccaacaaggaaggctagagataccacttttgggaaggatatgagaaattccgttacttacccaactagaagggttgagccagatgaagatgagcatctaaataatcttctccaggtagtgctatctttatgagattntcttgtcacaacatgactgaggtgaacattgacttggaataattgctgcaggaagaggaagact

SEQ ID NO: 858 - DNA, 653 bp, Sorghum bicolor
  Clone ID: SORBI-28MAY03-CLUS12941_1
attaatgatatattcaaaaaattatgggttgagcacggtgatgagctgagcctggagtacgctggttcttatgctttgaaaggggatctagtgagatatggacggcagacattacctggactaattaaagatggaatgagtgctctttcaagatattatttgaataattttcatggtggagtgcggcaagatgctcttgaccttattagcggttattatacagtcagtcaaggcagctcctctccttttcataatggtggatttgaatcttcttcgtatctgcctgtggcacgcgcaagcatagttggtgggattactgcaacaactttcactcttagtcaagttggacggaatgcacaacacttgatctcctccattatctgtgcgggcttaacagtcggagtagtagccttggtgaaagccaatggaaaacagttttgctctaggccccgtctgtgtggtctaatctaattcttggtcttttttttttctccttccctttcatattgccctttgttagaaattaaaggtgaaaggattaaaatgttgttttactcattgcaagagtaggttaaataaggaggcaggatggcctgccggtcctgtaatctgaagctgctaatttgtaagcctagtttggactacagtctatt

SEQ ID NO: 859 - DNA, 469 bp, Sorghum bicolor
  unsure (1)..(469): unsure at all n locations
  Clone ID: SORBI-28MAY03-CLUS129423_1
gcacgaggcgcggttctacgtccgagtcgtcgcatcgccctgttccctcgattcgccggcggcgccacctaccaaggtgatgcctcctccctcctcccttctcttccccgatcaattccgtgtttccgagcttagaatttggaggacctgatgatgagctcctccatctcttgattgatctgtgggcggtcggattctgcggtcgtaatctcgccccaaatcgagcagatctcggggctgtttcgaggaatataatcgagcaggtctcggggctgtttcggggaatatgtgcgttggattgttaaggtggagaatgtttgctccgatcgggttttggtggtgtcggggagggtggcgatgggttggcgccttggcggatcgattttggggaacctccctcaaatcaagcaccaccacctgggtttgtnttcgatacagtttcatgatttggttaccgtgttttggtatn

SEQ ID NO: 860 - DNA, 236 bp, Sorghum bicolor
  Clone ID: SORBI-28MAY03-CLUS129434_1
gcacgaggacactccagcatgttgccttgcggaattaacttgctgagtttgagcagcaacccctgtatatgatagaaggatgtgggttgcggtggcatttgtgcatgttcaatgctgtatgtaatgttgatgtaattacagttttgtgtctaatgatcaatagaagttctctgccatggatcatggatggcagagcagctgtatctttgtttcctgtcaaaaaaaaaaaaaaaaaa

SEQ ID NO: 861 - DNA, 487 bp, Sorghum bicolor
  Clone ID: SORBI-28MAY03-CLUS12944_1
cctcgacctcctcggcgccaaggagatcgccgtccgcgcatgggaccagtcgctcaacacgcagcccgagaagctcatatggaacctcatggggatgatgaacaactgctggttcaaggtgaaggtgaacgtgtgccgtccacacagaggcgagatcgggctggtgttcgagcacccgacgcagccgggcaaccagtccggcgggtggatggcgcggcagaagcacctggagacggcggaggccgcggcgccggggctgaagcgcagcacgtccacgcccttcatgagcaccatcagcgacggcaagcagttcaccatgtcggaggtgcgcaggcacgcgtcgcaggagtcggcgtggatcgtcgtgcacggccacgtctacgactgcaccaagttcctcaaggaccacccgggcggcgccgacagcatcctcatcaacgccggcaccgactgcaccgaggagttcgacgccatccactccgacaag

SEQ ID NO: 862 - DNA, 319 bp, Sorghum bicolor
  Clone ID: SORBI-28MAY03-CLUS129559_1
atgctagttatgtgcatgggaggaagagcaaggacatgaagctaagaagcagctgaatgtttgcgtgcctctgggattgacgcagtaggaaaggcgcaccctgatccctttcttctaaatgttggcgagcatggtggtattggcatcttgatctgtttccatagctaaaggtgaagaagattgtgtaagatacaagggacaagctgcaaaggccaaagccaaagctgagtgaatttcaggctccttattgggtggcggtatgcgcgttgtgggacactgtgtttgttgagtaggtgttagctggggctggagtgagatg

SEQ ID NO: 863 - DNA, 706 bp, Sorghum bicolor
  Clone ID: SORBI-28MAY03-CLUS12971_1
attccatgcagcatttctgaagctattgatgggattcctagttcaagtcggaaggcagcatggataccgtttaccttagagggactggcagttttagacaaaacaactgctctttctaccacagggatcccatctgtgcctagaaattctggtgaagctaagtttgagacaattgataataagcctgccactgatgaactggatagcctgatcaggttaaagcaggctgaagcgtatatgtaccaggaacgtgcaaatgatgctcggaatgaggttgacaatctgagacatattgttgtggtaaaaaatgcacgaattgaggaagattatgccacccaaattgttgatcttgacataaatgagttacaagagcggcgcaagcaaaagattgaagaactccaagtcattgaaagaccaccccatgaatttcgcagcatgaaaactaggatggtggctagcattggggagttattgtcaaaaatggaggcactgaaacaaaatcaaagcacatgaactgaggttaccattgcagaaattgaagttgctcaacttgtttaaggaagcctgcacaaaatgttgtaagttttttctttcatgattatttatgcttgctctaggactagctttctgtaagattttctatttctgtactgctgtgatagagattccttcacttttggatcattccaatcacataggcaaaatg

SEQ ID NO: 864 - DNA, 688 bp, Sorghum bicolor
  Clone ID: SORBI-28MAY03-CLUS129972_1
ccaaacaacaccagcaggggcggcgatatagctagggagttcacttccccctccctctctcccctcctacgccagctcctccccgtcgtcgcgtcgcccctcctaccgtgctacgtctccctcatctccccgcttccgcttcctcccccgctgagcggcggaagcgcgcaagcaaccgctgccttcttttcttggcgtgcgcagctcctgatcggcagccccccccgcgggatctccgcttgctggcctgggtctggccgcgcgacattgaggcggggcgcctggagctcggagccatcgcagttggtgttcgtgccttggagtcggtcgggtgtctggtccctgatgtgatctgcagttgcctgcagcggcggcggctgccgacatggcggcttcgggagggctcgagcagtggcagaaggacgggttcttccaggcggccgaggaggtgcaggagtcggcggacttgtgagtgccttcgtcatcttggcttcgattcgttgcgcccggggctacaaaagtttgaactttatgtgcaatctctaccgcttggcgattgttttggccattaattttgattgtccttttttggaaggttggattgctgtggattataggtgtactgtgtttaagatggggattccgagctgacccgtgcttatttgcggtccttgctgactcgtgaact

SEQ ID NO: 865 - DNA, 576 bp, Sorghum bicolor
  Clone ID: SORBI-28MAY03-CLUS129992_1
gcacgagggtgctgctctcctggttccccaacatcccctgggaccgccagcccttctcggcgttgcgcgacctctgcgaccccttcctcgccctctgccgcgaggtcatgccccctgtgtttggccgcaagctcgacctcagcccgcttgttgcgttcatggctattgacatcatcatcatgatcctgcgcccacagccacgcatgtgatgactctctgcagcattgggttggagaatgtttggttggtatgtaaggctctgactgcaagaacaagcatctaaggctgtattcggtcatgagatggcaaagaaaggtgctgtgctgctcacctctatcagtacagaagtggtggttggatggattagttttgcgatcttagcatagcggttatgaaggttgtcatgcaatataaatgattttgaggtggcttcattggcagaacttcttccttctttttacagtgtttggtggttgctgtagtaatatatatgttggctacgtatacgtattggtaatcacagtttaggtctgtgctctcacattgaatcactctgttaatctcttatattgtatg

SEQ ID NO: 866 - DNA, 469 bp, Sorghum bicolor
  Clone ID: SORBI-28MAY03-CLUS130008_1
caccatgcttctcctacctagctccgccgagctccggcctcgtcaggtcgtcgtctacacgccgccggcctctctgcgcgctaccatatgctagcttgcccgccgccgctgcccagccgctgctcatgctcggcagccaccacatgcatccttttgcagatgcaggctggaggggcctttgttttattttaatataaaatggagggggcgccttcgttgatgtacgtgtgccaatctgcttcattgtgtcaccatgcatgtcttgttcatgtctccttgctcatcacctcgacagtggaacgcggtcaagtcttggtaccacgtcccccatgctgtcgtgtttgcgattagctgcacaatgcacgaacgcttcagcagttaaattcatagaatgcatgattaaacaaaaggtgtgtttcagactgtaataataattccaggatatgttggactgttaaaaaaaaaaaca

SEQ ID NO: 867 - DNA, 852 bp, Sorghum bicolor
  Clone ID: SORBI-28MAY03-CLUS130029_1
gcacgagggccacgacgacgagagattcggataagccacagcccacaggcgcgcgcgacaacaatggccggcagcgacaccgccgcggcctcggcgcaggcggactccgccgccgccatctgcgctcagatcgcctccgtcttctccgcgccctcgtcgccgcacccgcccgcgcgctccgtcctggtctcggagctcgaggccgcgtcctcccggggcggccgcgtgttcgtgcacggcgtcgggcgggagggcctcatgatgcgcgcgctctgcatgcgcctggcgcacctgggcctccccgcgcactgcgtcggcgacgtcacagcgccgcccgcgggcgccggagacctcctcgtggcctcggcggggcccggcgcgttctccaccgtggacgccatctgcggcgtggcgcgcggcgccggcgcgcgcgtcctgctgctcacggcgcgccccgacggggacttcccgcggcgccaggccgacgttgtggcgcacctccccgcgcagaccatggcggacgacgaggtggggccgggggagacggagacggagaggtcgccgccggcgcgggcgaagctgccgatgggcagcctgtacgagggagctatgttcgtgctgttcgagatggtggtgctggagctcgcgcgcgtcttgggccagagctcggcccagatgagggcccgccacacaaacttggagtagtgttgagcaactacagagcgtcactgccaaatgatggtagatagcctttcagcggtttataagacgttataagtacgttgtaaaattgatactcctacataatgtttgcgttatttatgtaatggatatcgacatttaactggattt

SEQ ID NO: 868 - DNA, 682 bp, Sorghum bicolor
  Clone ID: SORBI-28MAY03-CLUS130033_1
gcacgaggcccaccccccgccgccgccctctgttcttcgccttcccccctccccgtctctcctggccccaaccgcaatggccaagcggaggtttcttctcgctctcctcctggtcacggccctcctcgcgctctccctttcgcaagggctggtggaagcgcggaaggtgcaggtgctgcgtgcgctgcggcacaacgacgagcggcgcgcggcgcccctcggcggccgcctgctgccggaggagatggcgtacacgaccatggactacgggccccccacggccaacaccaacacccacggcggcatggtcccgacgcctgcagacccctcctcgccgccgacgcactgatcggatcatcggccccaccggcgacgactgtcttgttgcgcgtatatatactactgttatttgggattggaagagaaaagggcgaagccagaaggggaggggatcggatcggatcggaagaagctgttcttctcccttgacgcgcgtgttgcgttgtgttgtattcttgtggtgtttgctgtagctgtagctgttgttgcttttgcttggttgattgaagttggaactgttagtgggtccatagtattatgtttggtgagatgtcagctctgatcagagtgaactgaactcctcgttgaattttgtttgttttgtacggtgaattgtacgtac

SEQ ID NO: 869 - DNA, 653 bp, Sorghum bicolor
  Clone ID: SORBI-28MAY03-CLUS130051_1
gcacgaggggcgagcgccgccgccctccgccaggtcttcgccggagacgagcacccatcagagggggatcgttcttggcacaatggaaggaggaggactaccagggccatcgcaatccatccaggtttccggagacgcgtactgcaacagctccgctgcgcccctggacgctgccggcagcagcagctcaccggccgtcgcgaagctccggaagctgctgttccggcggatgctcatcggcgtcaacgacggccgctacttccacggcctgttccactgcatcgacaagcagggcaacatcatcctccaggacgccgtggagtaccgcagcgccgcccgtcattgctcgcctcccacggagcagcgctgcctggggctcatcctcatcccggccgcctgccggtcgtcttgccaggttgattgctccgttgaagagaagatgtcgctcctcggtttggaatgaattgtgcttctgaagatgctatgcataagctactgagcatagaaaagatgtcgctcctgagtttggattgaattgtgcttctgaagatgcttggcagttactgagcaactgagcatagattgcagccaattctgttatctgataagggcccctgcagtattttttttgttgtactagctaactctttgaa

SEQ ID NO: 870 - DNA, 515 bp, Sorghum bicolor
  unsure (1)..(515): unsure at all n locations
  Clone ID: SORBI-28MAY03-CLUS130053_1
gcacgaggatccagtcggccggccgtcttaccggcggccaccgtggcccgcggctgctccgctgtcctcttccaccggcgggggatcgatctgtctgcagcaacgcgcacgggcggggaatcaagacggacaccaggatcacggaacatgagcagcatctcgacaggttttcagatcctcaggttgcccgtgagcaccaacagttcgttcagttcctcgacaggatgctggacgcgataagaaatcctcaaagtctcgcacagatgcagcgccggaggcttgccagtgggctgaaagctctggatgatgacatatgagtcaaattctctctgcggaaatacaagagttgaagaaagtaatgagcagtttgtggtgtataaagtaaccctgctatgtcttgtaaataacaatgtgcaacttcagtgtgtgagactgctactgtgcaggttcatttagaagtagtttcatttnccctgtagtggatttgcgtaccaaagctgatcataacacagtac

SEQ ID NO: 871 - DNA, 810 bp, Sorghum bicolor
  unsure (1)..(810): unsure at all n locations
  Clone ID: SORBI-28MAY03-CLUS130082_1
gcacgagggcaagtttgtgcgcnatgcaggcagacaaggcagagcctgcagctgctgcggcggcccccgccgccgccgccgccggcggcaagtcgccgagcatctgcgacaggctccagagggccttccaaacccgtcctccagcgttccgtcccctccgccgcctcaccgtccgccaccaggacggcggaggaggaggagctgacaagcctgccggtgccggtgatggagccaccagcgctgcgcctggcgggcctgcccctaaggctaagcacagcggcccgccactgccagccgcgccgcggccactaacgccgtcgccggctccggttggcgttggcggcgctacctcggccccggccatagcaccgcaggctgagcagcagcggccggttcccgtgcgcttaccagccgtcaccagtaaagtggcggcgggcagcgcgctaacggggccgccggtgcctgtgccaccgccggacgtgatggcgggaatggcgacaccggcggatgccaaggccggggacataggccagcagaccaaagggaagtccagggttcgtcagttgctgtcgtccaagtaatagagagatgaacagggtgggatttcggaagaaggttgatcctaatggtgtatgcagcagctagtacgtgttccttccataacgttggtatcgtagcaaagtccgtggaatacgaatgaacaagaagcccgtcatatgatgattaattaggcccgaaaccgttgttgccatccacacggagaagaccacatttgttacaaaattaattatgagtancaaagaagaagtt

SEQ ID NO: 872 - DNA, 511 bp, Sorghum bicolor
  Clone ID: SORBI-28MAY03-CLUS130122_1
gcacgaggtacactcacaaaaagacccctcatccagagaagacatgatactcgtgtcgatcatggcggagctgctggaggcctacacggcggcggtggcgcgcgccgtggagcgcctgctctctgccgcggcgccgcggcgcgtcctgccgcgccgggtccgcttcctcgtcctccggagcctccccttcgcgccgccggcgccgccccacgccgtcgacgtcgccgtcgttacccgctgatctgctgtgtgtagcttcctgatgactgctgcctgctgtaattctgctgctgtacttctcaggtgttttggttgctcgccgtgcgtggatcagtttccattcgctatataatctcgcgagccagccagccgtgtggatagataggagcgattgcgacagctatgtataacgctggctggacccttagcttattgactgctgtgtatttttggttatgtaaaaatatgtttgcaggttgggaattcctaggaaaaaaaaaaaaaaaaaaaa

SEQ ID NO: 873 - DNA, 594 bp, Sorghum bicolor
  Clone ID: SORBI-28MAY03-CLUS13027_1
gcacgaggccgaggctaattaagacgcaacgcaagaggcggtaagcagcctgccatcagcagcagcaatggcggccgccggcgccgaagtgggagaagacaagtaccggtccttcatccacggcgagagcgagaggaacaccgtgtggaggtacggcggcccgcccaactacgacacggtgaacaagctcttcgaggaggagaggactcacgtgtgggccgagggctcgctggaggagaaggtgcagcggctgctcaagagctgggagatggagctggtgcacaaggcgcggcccgaggaccagaagaccgtcagctcggagcgatacaccaccagcaccaacgggatgagcgccctgacccgggcggaggtgatggccatcggcggctacaacaacttcctgcgcaccaagctgccgccggagcaccgcatctacgacccggacagcgagtccccggagtccgccatggacaccttcaagacggccttcccgagggggttcgccatcgaggtgctcgacgtctacagcggcccgcccaagatcgccttcaagttccgccactgggggtacatggaggggcccttcaagggaca

SEQ ID NO: 874 - DNA, 526 bp, Sorghum bicolor
  Clone ID: SORBI-28MAY03-CLUS130287_1
gcacgaggcctcgtcggtcgtctcgcgccttcaacttccaccgaggtccatctacatcgttccaccacctacccctgtaatctcccggccggcgacgtcatcctcatcatcatcatcatccatggagggcaaggacggcaagcacgacgtacccgccaccacggccgcgccaccaccggccggcgcgccgcagcccgcggcgcctgcgcctcccgcggagtcggcgcggtggggcacgcggcagatgggcccgccagcggcccccggggcgcacccggagaaccaggaggcggcgcggtggacggcggcgcgcggggaccaggagctgccgccgtacgtcgtcatgggggagcccgtggcggtgcagaggggcaagggggatagccccatggaacacatcctcgacttcttcaacacctggagccgcaaggccgaggagctggcatccaacatctggttcaatctgaagactgcgccatccatgtctgacgcggcgatggggaagctaagcctgggcgccaaggcc

SEQ ID NO: 875 - DNA, 614 bp, Sorghum bicolor
  unsure (1)..(614): unsure at all n locations
  Clone ID: SORBI-28MAY03-CLUS130348_1
tcgtccgcgcgtccgagacccacaagctgcccgcgggcttcgccgaggccgaggacgacggcgccgcgtgcggccggcagcgcgggctggtggtgtcgtggtgcccgcagctggaggtgctggcgcaccgcgccgtggggtgcttcctgacgcactgcggctggaactccaccgcggaggcgctggtgacgggcgtgcccatggtggccgtgccgcagtggacggaccagcccatgaacgccgagtacgtggaggccgtgtggcgggtgggcgtgcgggcgcgcgcggccgcgcccgacggcctcgtgcggaggggcgaggtggccaggggcatcgaggaagtgatggacggcgacaggagtgccgagtacaggagcaacgccgatgtgtggatggagaaggccagggcggcgagcagggaaggcggcagctccgacaggaacatcgccgagttcgtggccaagtacgcctcagacgccatgtgatcatttagagaaacgaacacgttttgggttgcatgtatatgtatatgtatatgtagcaattaagtctgtctacaggtacgtgcgagtatttgataagaatgtcgtcatgcatgcatgaatgaatncacg

SEQ ID NO: 876 - DNA, 584 bp, Sorghum bicolor
  Clone ID: SORBI-28MAY03-CLUS130473_1
ccgccacgttcgacacgagctaccagccctgcgccgctggccgctcgctccagctctccgcccatcgtccggccggcggccagcagcaagtcctccggaccgccgccgtgtccgggtccgggtccatgtccgcggccgcggccgccgccgtgcagccgcggcgcgccacatgcaagagcagcaagaagcacgcggcggcggcggcgtcgcgccgctcctcgaccaccgtggtcgcgaccgacgtgaacaacttccgggccatggtgcaggagctcactggcttcccgcccgccgccatcttccggccgctgccgcggagggtgcacgcggcgagccccttcgtcgccgtctccgccgcctcggggcaaggatgtgccggccgggaacagcatgggcacgcaagttgggaggcgacaaacagtagtagtactactgccggcggcggcagcagcagccccgacgacgctccggccgtgccgcctgtgatgctggcggcgcagcagccgcagttcgcgccactgggtgtgtttgacggcctttccgacctcggctcgccggagttcgactcgtggggagatttgtcc

SEQ ID NO: 877 - DNA, 604 bp, Sorghum bicolor
  Clone ID: SORBI-28MAY03-CLUS130531_1
gcacgaggctctctctctctcccgtccgcacgcgccgccccgccggcggcctcgcggcctccctcctccgcacgcgcccccgcaccagcaccagcaccgtcgccacggccggccctcctccaccgcaccagcaccttgaacaagttgatcgaggagcggaacgccggccgggagcacctcgagttaaacttccgttggacgcgccgcagcctcgctgtcgtcggcttcttcggcctcgccgtccccatccttgtctacaagggcatcgtccgcgaattcgaatacccaagtgccatcgtaggttcaggaggaggatgtatgggaggcatgcatcgcagctgctgaaggagatcgactcctctgaggctggccagcttgcgccattcaacgtaattcctgcttctctgtactcacctgcagctactagtttggaatcagagtgattactgcttttatctcgtttgtgtctgtgggaggctgcaattctgtatgatctagtgtgttctgtgtttgatgggttaatttgcgtgtggaaaaccttttgtatcctcagtcgaaagtattgctttggtagcaccttaaaatcccatgaattgtcagatcc

SEQ ID NO: 878 - DNA, 546 bp, Sorghum bicolor
  Clone ID: SORBI-28MAY03-CLUS1306_1
gccgtcgccgaggcggagcgctccgtcggccctccctccgcggcgcggcgcggctgctgcgccgcggcgggcggcgcacgatgcgggaaccctcggtgctggtgcgggaggcagccgcagagcacctcgaggagcggcaggctgactgggcctactcccgccccgtcgtggcgctcgacctgctctggaacctcgccttcatcacggtcgccgcggtcgtgctcgtgctcagccgcgacgaggactcgcccatgccgctccggacctgggtcgccggctacgccctgcagtgcgtcgtacacatggtctgcgtcgcaatcgagtaccggatgcgccacggccagggcggcggcgccggcgccgcgcccactgacgaggaaaggggcagcgacggatcgtcctcgtccagcgacgacgatgacagggagttcgatcgccatggtcgccgcaccgattacgccagtattgcaaagcacttggagtctgctaatacaatgttctccttcatatggtggataattggattttattggatatctgctgggg

SEQ ID NO: 879 - DNA, 771 bp, Sorghum bicolor
  unsure (1)..(771): unsure at all n locations
  Clone ID: SORBI-28MAY03-CLUS13071_1
gccggccgggttccgcattgtcaatatctgatatacctgttagcagggcatagagaagctggtggattttctggtcctggtcagccatctatgatgccaaacttgactgcagaggtcttagttccaagattaattatccctgctctctgtagtgaggatggaggttgtttggataggattcgtgagttttctgaagctaagataactgttgctgaacctatagccgatgcaatggacattcctgttttgatatctggcacaccagaccagatgcatgcagcccgaagtcttgttcaagcatttgtcatgagcgaatcatttgccccataatatgtccagagatttctggtaattgtgtaggcagtatgtggcttcatgtttgtgaatgtgtccctgtttgaagagtggcatatgctccaagaggctaattaggctgaatatagagactagagtcccagtctgttgggagaatatttataggttgttgcaaaatcttccaaactcatcacctgatttgagatatggagcaacattttgagtagcagcagaaatgtgttgcttatgcaagcagtactgttggacccgaaaagggcttctatctaacatttttgtactgatgttgtgagatatcaccattatctgtatttccagccgngcttattatatctgtatttcagcaacacagcagtgcataatagtggcaacggaggttttgtgctggtgccgcgtctatggtattcatacactaaaaaaaaaaaaaaaaggccccta

SEQ ID NO: 880 - DNA, 536 bp, Sorghum bicolor
  Clone ID: SORBI-28MAY03-CLUS130904_1
gcacgagggccagaagcaccgagtgggaaaaccagccatgccgtcgtcggcgccggagccgcacgtggtggaggactgccgcggcgtgctgcagctgatgagcgacggcacggtgcggcgcagcgcggtgccagcgctcccggtggacgtccccgacgacgaagactgcggcgtggagtggaaggacgtgacgtgggaccggcagcacgacctgaacgcgcgcctgtaccggccggggcacctgggcgcggccaacgacgcgcggatccccgtggtggcctacttccacggcggcggcttctgcatcgggtccgggcggtggcccaactaccacgcctggtgcctccgcctgtgctccgagctccccgccgtggtgctctccttcgactaccgcctggcgcccgagcaccgcctgcccgccgcgcaggaggacggcgccagggccatggcctggctgacgcgctccgccgccaccgacccctggctcgccgacgcggccgacttcgcgcgcgccttcgtcgcgggcgactcggcgg

SEQ ID NO: 881 - DNA, 599 bp, Sorghum bicolor
  Clone ID: SORBI-28MAY03-CLUS1310_1
ggcaggtcgacccggcgtcccgtcgccggatacgaaaatggctgcgctcgcgacgctcctccgccacggccgccgcacccacgcccacggccgccgcctctccagtgcgctctccaccaccaccgccccgaacaccaccggcggcaccgaccccggcgccacgccgttctcggacgccaagcggcaactccgccgcgagcgcgatccggaccgcgtggtctccatcctcgacgccatcgacacggcgtccatctccgctgcctccacccggcacgcgctctccctggcggcgcgccgcctttccctctcccgccgcttcgctgaagcggaggccctcctctcctcccatctcaccgcgacaaacaccgagacccacctcgccgccgtcctgtgctgctacgcctccgccaacctccccgagaaggccatcgacgcctttcgctccgctgcgccgtccctcccggcccccatctccccgctccccttcaacgccctcctctccacctttgtccgttgccgccgctaccgccgcgtccctgtcctcttcgctgagctctccaaggagttctcgatcaccccagacgccacatcctatgcca

SEQ ID NO: 882 - DNA, 586 bp, Sorghum bicolor
  Clone ID: SORBI-28MAY03-CLUS131108_1
gcacgagggtcttgaagtagtctgaacgattgatttctctaatggtataaatacgggccacagaatgtctatgatatttgggatctggttgttatgactacatagcaaacatctgcctgacatttctgacatgtgtggttaacctgcaaagttcggcttagggcttggagatttttggtcgttttttcatgttcttgttgtggtgattaggtaaatccaaagtacagtgtgtgtgagcgtgtgtgagttgtggggtgtgtgtgtgggtgttgggtctcttggacctgtgtacctgttttctaccttaatgaaatgacgcgcagttctcctgcgctgttcgagaaaaaaaaacctgcaaagttcggcatccaacccaacttgcctaattgccttcttttccatatttcattgtgggttttgcaacattatgttacaaaattgtgggcaagcacgaatctcaagtcactaccttctttattgtttattagcctctcaggctgtataaataacacattctgaagtgcttgtagcctagtacacttgcgggtctacaaatattctaccatcagttaattgggagcacaaa

SEQ ID NO: 883 - DNA, 623 bp, Sorghum bicolor
  Clone ID: SORBI-28MAY03-CLUS131133_1
gcacgaggatttggaagggaagagttaatccacttgtggataggactagggctgttaggccccgacgatcaaaacaagagacttgaagatattggactagattatttaagcgacttggttaatcatggcttcttccatgaagcaaaaaaagaggatggcagcacttattatgtgatacatgatctactccatgacttggcaagaaatgtttcagcacatgaatgtattagcatacaagggtctaatgtgtggtcaatacaaattcctgcatctatacatcacatgtcaatcatcataaataattcagatgtccaggacaaagcaacctttgaaaattgtaagaaagggcttgatatacttggtaaaagactgaaagctagaaacctacgtactttgatgttatttggagatcaccatggaagcttttgcaagatatttagtggtatgtttcgggatgcaaaaacccttcgtgtcattttcttatcaggtgcatcgtatgatgtggaggttctgctgcacagtttctcacaacttgtccatcttcgttacttaaggataaagggttatgtattaaatttaagaagtttatttggtagtatatcaagattttataacttgttggt

SEQ ID NO: 884 - DNA, 637 bp, Sorghum bicolor
  Clone ID: SORBI-28MAY03-CLUS131217_1
gcacgaggccactgcccgcccaccacgccccaccgcactcctccctgcgctccaccacgcccaccgtgcgatggacggcggcgggaggccctcggcgcggtggcccagcacggcgaccccaggcacggcaacgctggcacggacagaccctggtgcggcaactccggcgtggtggcggttcggatcctgtggcacggcggcccagacgagcgaggccgacgggaccgtggggaggtgggtgcggctgcgccgggcatcgtggggaggatggcgtggctgcgtggaggcgactggctgcgtcgatcggcacggctacgaggaggcggcatggcggcgagattgttgggttcgtgagcccgccgatgaggaggtcctccactgcatctccaccatcagtaccagcaccgtgcctcctatcaatcaccaccacctcccttcgcataaactgctaagtttgcacttgatttgcagatacatttcatttccagtggcctctttgaattttagagatacatcatatggtttttcctacagattaaatccacaaataatttaaactatcttatttctgccactaaaatgttatgcgaatctaagcatttaatctggtttcatagaacattacctataaaatgcc

SEQ ID NO: 885 - DNA, 650 bp, Sorghum bicolor
  unsure (1)..(650): unsure at all n locations
  Clone ID: SORBI-28MAY03-CLUS131389_1
gcacgaggcgccaaggtttagcttctcgtggacatgatgaaagtcaaagttcacttaacaagggaaatttcttagagttgatagatatgctagctgaaaactttgaagaggttgcaaaggtggttttgaagaatgccccaaagaattgtcagttgactgctcctcaaattcaaaaagagatagctaattgttgtgccaaagaaacaactaagcttctcatggaagaccttggtagtgatttttttttcaattcttgctgatgaatctagtgatgtttaccaaaatgaaccacgagctctttgtttgcggtatgttgacaaaaagggaagcatagttgagaggttcctaggtgttgtccatgtggaaaacactacttctttgacacttaaaactgcaattgagaaactattgatggaacattcattgatcttgtctatggtccgtgggcaaggctatgatggggctagtaacatgaatggtcatgctaatggtctaaagaaacttattatggatgattgttcgtctgcttactatgtcaattgctttgcacatcaacttcagttaactcttgtggaagttgctagggaaaacccagactgtgtttggttcttcgatcaagttagatttttattgaaccttattgngaattc

SEQ ID NO: 886 - DNA, 807 bp, Sorghum bicolor
  Clone ID: SORBI-28MAY03-CLUS13126_1
gtcgccacccgctggaaggaagtatcgaggtccaggaatcccggcgagcgcggtccgcggagcgcggagaggcgagcggctcgagtccaactccgatcccgaccgaccggcagccggacatggtgagccgcggcggcggcgcgcgcgggctgctgggcgcgtacgagctggggcggacgcttggggaagggaacttcgggaaggtgaagcaggcgcggcaccgcggcagcggcgcgcagttcgccgtcaagatcctggaccgcgcccgcgtcgtgtcgcagcgcgtcgacgaccagatacgccgcgagatcgccacgctcaagctgctcgcccaccccaacgtcgtccgcctccacgagatcgctgctagcaagaccaagatttacatggtgcttgagctggtcaatgggggcgaactgttcgacaggattgccagtaagggaaaactcccggagcaagaagcaaggaggctctttcagcagctgattgatggtgtcagttattgccacgaaaagggtgtctatcatagagacctcaagccggagaacattcttgttgaccgaaaaggaaacatcaagatctctgattttggtctcagtgctttaccagaacatctcgggaatgatggattgctgcatacaacatgtggtagccccaattacattcgtccgtccgtccgtccgtcaccccctgctctcccacccactcccctgcctgctccgatcctcagctcgtcgattcggtcggggtttcttcttccatctctagatgcatgattcggttcagttccgacttccgaaccgagcg

SEQ ID NO: 887 - DNA, 497 bp, Sorghum bicolor
  Clone ID: SORBI-28MAY03-CLUS131419_1
gcacgaggcaaaaactccaagctgctccaagcccgcccgccattcccctcccacaaccccaccccaacgccgccaccgctcaggggtccgaaccttcttgaaccttgcgggaaccccaggggcgcggggcagatgtcggcgaggctaagggtggaggagctccgcgcggcgctgctgagccgcggcctcgatgtctccggcaccaagaacgctctcgtgcggaggctggacgccgcaatctgcaaggacgagaagatcgcggttgctgctgcggcaaccgaggtggcagatgggtatggcgtagccgtagatggtgtgctcgtggatggcaaagggaacggcaggaacaacaagaggaaaaggtccggggatggggatgaagaggggaacggcgatacgtctatagacctggcaaaactagagggcatgagctatcgcgagctgcagggattggctaaggcacggggactcgcagcaaatgggggcaagaaggatgt

SEQ ID NO: 888 - DNA, 726 bp, Sorghum bicolor
  unsure (1)..(726): unsure at all n locations
  Clone ID: SORBI-28MAY03-CLUS131458_1
ttctggagatgcaaaatcagttcattcatgtgagctgttcttctccaaagatgtgactaccgcagtaccatggccaggagtgcaccaagatgggcacacgaaaccttcctgcttgactgagaaaccctccagcgcgcccattttgcgccaccacgaggagtgccagtcccctgggccgtggtcgttcatggactgcagcaagggaacggcaacatggcctgaagagaacttgccttctacagcaaagtctgaaagcagcccgaaggtgggtgactgcctctccctggtatccgctgcgtggagcacggtcatagtgaccgccagccgcgatggcgtgatccgatcttttcccaactacggcttgcccgttagattgtgagcttcaagactggtttgagcttgtcagcagagcgcagccgtggttggtggttgataacctgctaatgttatgaagtttttcctctctttttttctggtcagagttactagaaattctttttgttacatttgttagatcatgcacttctcctgaagagatgatctgtagtcagtccaagtccaaacacttgtgttgcctataggctttttgctggatggttgttacaaggtaaaaaacacaaccattcagttataattagttgaaggaggcctgcgccagtagcacgggtgatcagtttatttttttcacntaacaccaggatgtattagttgaaaatatttttaaat

SEQ ID NO: 889 - DNA, 684 bp, Sorghum bicolor
  Clone ID: SORBI-28MAY03-CLUS131489_1
gcacgaggcaccactgcatatagccttggttcttttagccttaagctctccgttgcatgtatcaagtactgaaccagggcatggtattctttttcagctctactttcttcataacgttttgtctttactgttgaaattgttttaccttgcaataggtcgaagaatgctgcagggaatgaaagtaacctcgacctcatatgcaacaacccaggctatccatgttgacgaggcagaattcatgcatgctggaagtatgggatttgtgctcaatgactaccctgcgtctggcgcaaacaaccgccattcaccatacccgggtggcaccagatgaaaggaggatgtacgacagctgttccactcagccatggtgtaccttacatccttaattttcataagaatgccctggcattcactagcatacaagaacctgaaatgtcatcagatgtgtgccaatgttgtaactgcgtgcgcttcacaaaaactgcccgccattttccttagctggggatataccagtttgagggaacaaatgatgacagagaataacacgcttcttttaggtttgatgcaatggtcacattattaaggacatccttgccaattagatgctttcagccttgtattgtggcatgcgatgttgtaagtagttcttgcttcaaatcctgtttcgaatatttactggag

SEQ ID NO: 890 - DNA, 520 bp, Sorghum bicolor
  Clone ID: SORBI-28MAY03-CLUS1315_1
gtgggttcctctcgtgtagtgcacgactgccagccaggccgccgccgccgcagctgtctcgtgcggtcgtgcctccgcatcgcggctcgtcttggagcttcacctgatccctgaggtgcggcaccggcgggtgaggcatatcggcgaggcggcaccagcggcggagttcggtcccagaagagatggcgaggggccctaatgtcgcgggcttgatcgaggacgatgcggtctccgtcatcacggagggcttagtggtgtgtgagatatgtggcagtggcagtgcccctcatcttattgcaaactgcgctaggtgcagtgcgcgtgagcattggtactgtatgcaggtgttgacgtttctgattccacgcatatggttttgtaatagttgccaacgaaaggccaacagggcacccagatcctagccaagcctgcaggttccggacatggtgttgggcaccaaatccccgactgaagttgcagggtagtagctgctagtgttgtactccgtattgggttgttt

SEQ ID NO: 891 - DNA, 538 bp, Sorghum bicolor
  Clone ID: SORBI-28MAY03-CLUS13149_1
tcaggttgatgttcctgtcattccttatattctggtttggtctcctcttcttaacaatgaagcgccagattgtgcatatgatcaaatacaaatatgtgcctttcagtttcgggaagcagaaatatgggggaagaagaatgtcgcgagcaccagttcctcaaaagactgattctgaacctacttacccccagtaggaagcttggcaggggaacagatacggggaggatgatatttgatgtgctaaatctcaagtgtaatacttattcatatctagaggtagacggatattcgctcctgtttctgactctgggctcactgtttaattcgatattgtgcttagattgcttctcaatgcatgtatagcgagtttcgcgtgcagataaattatttcgttttagttgctacatatatctgggccctaaaacaataagctctatgctctcaggctctcatcaagttgtttggttgggagttggacgagtgaggtaggcggttgttttttgtatcaaactggaacagaatgctaaactttaaacgc

SEQ ID NO: 892 - DNA, 662 bp, Sorghum bicolor
  Clone ID: SORBI-28MAY03-CLUS131551_1
tccgtctacaacacttgggcattcaggttctaatggctcggtcactgtggcaggtccaggcgccttcgtctctccccgtcttcctcactggggccttccggctccttgggcgcgggctcagtctttcggtcttgtgcttctggctctccagatgctaattggaaaaaggccaactgattcaatgtttgagggtgaaatgaacattgtcagctttgtggagaagaactttccaaaccagatgtcacatatcatagatgctcatctccaagaagagtgcatgtccaagcgctttttgctagcaagagtggaaaggggaaatgaggttcatcaatgcctgatgtctctcgttggaattgctctttcttgcacacgtctactcccaagccaacgaatgaacatgagacaggtagcagctaacttgaacacagcttcatatgctatacaacagttacccagtgcaactgtgcaagggcagatcattcttcgttagagcttgtataattaatttaggtcgtgcttcgatacaatataggcataaagctggaaaatggagcatgctgaaattgatgcacttgaaagggtaaatgatatgccaaaaattttccccaaattttacagtttctattcccaatttggattagatgaaagattttccatttcaa

SEQ ID NO: 893 - DNA, 364 bp, Sorghum bicolor
  Clone ID: SORBI-28MAY03-CLUS131575_1
gcaacttctggccatatggggaaacctcattgccttgtatgtcctcaacttttttatcagcagtatacccacttctggaatgtacaccgttatgttccgcctttgcagacaaccgtcatactggataacgctggtgttgatcagtggagttggaatgggtcctgtattagctctgaaatatttcagatatacatacagacctagcgcgatcaacattcttcagaaggccgagcgctcacgggggccaatgtacaccctgatgaatctggagtctcaactgagaccagataaagataatatgatgatagccagttccacagcgccagccaagaataagagctctgtttacgagcctttgctttct

SEQ ID NO: 894 - DNA, 1055 bp, Sorghum bicolor
  Clone ID: SORBI-28MAY03-CLUS13167_1
cccacgcgtccgggctggaggaggggaggccggcggggcggacgtggcgttgcagcggcagctgcagcagctgttccacctccacgactccgggctggaccaggccttcatcgacgcgctgccggtcttcgcctaccgcgagatcgtcgtgggcggcggcggcgacggggacaaggagccgttcgactgcgcggtgtgcctgtgcgagttcgacgccgaagaccggctccggctgctgccgctgtgcgggcacgccttccacctcaactgcatcgacacgtggctgctctccaactccacctgcccgctctgccgcggggtgctcttcgtcccggggctcatgggcgaggacaccccgatgttcgatttcgaggaaaggctggaggaagggcggttgtccgaggattgtgacgacggatttggattgcctgggttgaaggcttcagggttggcacagacaccggtggctgagaagaaggtattccctgtgaggttggggaagttcaagaatgtcggaacccagggtgcggtggaaggtggcaatgccaatgccgatgccaatgcccgtgtgttgagtagggatcaaggggagagtagcagcagcagctcggatggaaggagatgcttctccatgggcacctatcagtatgttcttggcgcttctgagctccgggtagctctccagcctggccggattaggaatggcgctggtggtgcaatgaggggaagacctcctggtttaagttcgatcaatgctgatattatggaggggaagaagatctgtgcacgcaacaaaggggagagtttctccgtgtcgaaaatttggcaatggtctaatcttaagggcaagctacctgctggttcggatgaatgttcggatgccgggagccttccatggatgaagagaggaggtgctgcggatacatcaaacttatgactctgtactagtgttatgtgatagtagcctttctttagttagtgttgctcacctaagttctacccgcctgtagtcatttttcttatctaattttcatgtgctgattttgatggagtcc

SEQ ID NO: 895 - DNA, 743 bp, Sorghum bicolor
  Clone ID: SORBI-28MAY03-CLUS13183_1
ctgaaattggaaaaggctgatgtatacaggttaccatatctatccagtggtgctcctggatttgctttgcttgaaactgccaggaagatcgatttccaagatgtacagagtagaatttcggccggattttcgtccaatggttgggaaaaaccaatactgcttgcatggggaatatctgacaagtacttaccgttgtcgatagctgaggaattcaagaaagctaatcccagcgttgtaaaactagaggcgatagaaggagctggtcatatgccacaagaggactggccagagaaggttgtgaaggcgctgatatacttcctgtaaacatggacaaagatcgttgtaccataatcctccagggaacatgcaaagatgcacgctgattgtcgtggcttcatgacgtcctactgtctaatttcattgtgccttggattgcttttggtggcgcgtgagcgtgatgttgggaagcccattaggtatatgtcgatgccctcgccgccgttccacctccacccacggtacaaaggtttcgtaaacccaaccgagagctgggcagcgatgaattgttgtattttttttttttgagaatgatgaattgttgtattcactatgatgtatattagtggcaggtcaagatgtatattagcgaggggaaaaacaaatgtctatatgatttgtgatctggacaatatcagtgacatgttagctcacattagagatggataacatgttttttttttgtc

SEQ ID NO: 896 - DNA, 949 bp, Sorghum bicolor
  Clone ID: SORBI-28MAY03-CLUS131842_1
gcacgaggctaccaagcaatatgggtgatcgcttctctaatctacaaaaactattgttgggcgagaattggctgaaaggtcgcataccagattccttaggtaatgctacaacgctaaaacaactagttctacaaactaacaacttcactggacaaatccctagttcctttgggaagctttcaagtttatctgaactagaccttgggtcgaatatgcttgaagcaaaagatagtgaaagctgggaattcttgcatgcactagaaaactgcagtgctctacgagtgctagcactatcaaacaatcagctgcagggggttataccaaattcagttggtaatttaacggctaatcttcaatacttatttttaggtggaaacaagctgtcaggtacagttccatcgagtataggaaaacttgctgggctaatttatctgcccgtggatggaaacagtctcattggtagcatcgacgggtggattagaaacctaaaaaacctgcaatatttataccttagtgaaaacaacctaagtggacccattccacccatcattggcaatcttacgcagttagcacggctccttctagacaacaatggatttgaaggtcccataccatcatcctttgggtagccctccaatgcttttaagttgaaccttaatcataataatctatagaagggagcattccactggagattagcaaccttaaacaacttatcaacctagagcttgcatcaaacaagcttattactggggaaattcctgatgatttgacactgtgccaatacttagtaacaatcgatatggagcataactttatcgtagggaacattccaaaatctgttggcagtctagaaagcttgaacaaactaagtcttgctcacaacaacttgtctggcaccattccagctgctctaggtagcctgaaattgctcaatatgctggatctt

SEQ ID NO: 897 - DNA, 515 bp, Sorghum bicolor
  Clone ID: SORBI-28MAY03-CLUS131872_1
gcacgaggctgataccatggttcattgtcatctcgataaaggtttctttggactttgttaaaagtctgtatgcaaagttcatagattgggacgaggatatgtatgaacctgcgaaaacgacatacctgcccatgcagcaaacacagcaattagtgaagacttggggcaggttgaatatattttgacagataaaactgggacattgactgagaacaagatgatcttcagaaggtgctgtattgggggcaccttttatgggaatgaatctggagatgcgctcagagatattgaattactgaacgctgtcgccaataattctcctcatgtcatcaagtttttgaaagtcatgacactctgcaatacagtaattcctataaaaagtcctagtggatcaattttgtataaagcccagtcccaggatgaggatgctctggttaatgcggctgcaaatttgcatatggttcttgtcagcaagaatggaaacaatgcagaaattcacttcaaccggcgagtga

SEQ ID NO: 898 - DNA, 515 bp, Sorghum bicolor
  Clone ID: SORBI-28MAY03-CLUS131876_1
gcacgaggctcatgtaaaaagcatgatcttgaagataacaatactgcagatgtatctaccaattctaatgacgaggaattaaatcccaaacaattaccatgtcatgaagttgcacaagattgccaggatgttggcggtgtcatttgcgacagcaatgaaaatcaggaccggcttttaactggagaagcaacccatcaggtttcatcgaatgattgttatgaaactggaattggtattgcgtctgagaccagtaacatcattcacaatgatttaccagtagaatcaaccgctgctgatttctcggaggtgatacctgaggaagttgctgtcagtgctggattggatatggaaggatccaaccaagttaatcactataacccttttattgcctatggatcactagacgggacatgggaatctaattactctctccctactattgtggatgccgcttctatagcacccatctgtcctgttgaaaagacagatagttgtagtgatcttgtcaacagagc

SEQ ID NO: 899 - DNA, 478 bp, Sorghum bicolor
  Clone ID: SORBI-28MAY03-CLUS131883_1
gcacgagggttaaactcgagtaccatcaccacgagcctcaacgggctgttgtttgctttgagaaattggttagctcgtgcgctttcagcgttgctggagttgctgcgcaggccaggcaatacagggccccgccgccggccggcgttccccaattcccagtcccagcgtccgccaacggtgctcaacaccctccccagattccgctctcgctactccacggaatccccacagccgccgagcacaactaagccatgacactgcagcccctgtccacggaatccggtagcagactagcagattgagcttcaagaggcggaagggcgtccacacctgcacgtcgcgtcgcatcgcatcttcctgttgccccagtacgtccttctggcccaaggaaactactgatgtccaaaagaagaacaaaagagattaaggccattttttccagaaagttattccatcgtgtttcagctgcttacctccc

SEQ ID NO: 900 - DNA, 549 bp, Sorghum bicolor
  unsure (1)..(549): unsure at all n locations
  Clone ID: SORBI-28MAY03-CLUS131893_1
gcacgaggggttgacatgngaagatattgctgggaaagcaccggcaaggaggaagaatgggaatttggagggtgttgtggctaatggagtgcagaacggtgtaaaggacatggtcacaccaatcattaggacgagcttggagaagcaaggttacaaaattatcggttctcatagtggagtgaagatttgtagatggactaaatcgcagctgcgaggccgtggagggtgttataaacactcattttatggcatagaaagtcacagatgcatggaagcaactccaagtttggcttgtgcaaataaatgtgtattttgttggagacatcacacaaatcctgttggaaagagttggaaatggaagatggatgaccctctcgacattgtgaatgctgcaattgaccagcatactaagatggttaagcaaatgaaaggcgtaccaggagtaaagccagaaaaacttgaagagggtctgtcacctagacattgtgcgttatctctggttggtgaaccaataatgtaccctgagataaatgctcttgtggatgagct

SEQ ID NO: 901 - DNA, 731 bp, Sorghum bicolor
  unsure (1)..(731): unsure at all n locations
  Clone ID: SORBI-28MAY03-CLUS131938_1
agcacgaggggaaaatcttatattccctgaggaggttctaccacgtggaaacgctctttaatggaactttcgttttagctggtcgtgaccaagaaaccaccggctttgcttggtgggctgggaatgccagacttatcaatttgtccggtaaactacttggagctcatgtagcccatgccggattaatcgtattctgggccggagcaatgaacctatttgaagtggcccatttcgtaccagaaaagcccatgtatgaacaagggttgattttacttccgcacttagctactctaggttggggagtagggccggggggagaagttctagagcccgtgccttactttgtatccggagtacttcacttaatttcctccgcagtcttaggcttcggtggcatttatcacgcgcttctgggacccgagactcttgaagaatcttttccattctttggttatgtatggaaagatagaaataaaatgactacaattttgggtattcacttaattttgttaggtctaggtgcttttcttctagtactcaaggctctttattttggcggcgtatatgatacctgggcccccgggggggggggatgtaagaaaaattaccaatttgacccttagccccggtgttatatttggttatttactaaaatccccttttgggggagaaggatggattgttagtgtggatgatttanaagatataattggggggcatgtatggcttgg

SEQ ID NO: 902 - DNA, 170 bp, Sorghum bicolor
  Clone ID: SORBI-28MAY03-CLUS132144_1
gcacgaggcccctccgtcgcccggtcgaggctggcagagtcgaataatccccgcgcactgccgcgccgggcgcgtccaattagccgctgccatcgatcgccaccagaggcaagagcgggggaggagtgtttctcctagggcgggcggatgagatgccggcgcgccggaag

SEQ ID NO: 903 - DNA, 467 bp, Sorghum bicolor
  Clone ID: SORBI-28MAY03-CLUS131342_1
gcacgaggactgggttcaggcgaagagctcatggagctagttggtgcccacaaggagtctctaacagcacttgatgtgatcgatggcatgaacgaagacaatgcatcctcctcctctcccactggcagagagaagcagaatctgtccacatcactgtcattagctgacaagaaacatgaagccaacgatgatgaagggaatgatgctcacagtgggcagctagtgcaggaggaagaaagggagaaaggcatggtggggttctgggtctactggaagtacctcacgctagcttacaagggtgctcttgtacccttggtgttgctagcacagatgctttttcaagtaattcatattgcgagcaattactggatggcttgggctgctccggtgtcaaaggatgttgagcctccggtgagcatgccgacgctgctcagtgtctatgtgatgctggctcttggaagctcgtt

SEQ ID NO: 904 - DNA, 434 bp, Sorghum bicolor
  Clone ID: SORBI-28MAY03-CLUS132158_1
gcacgagggcgcgagcgagcaccaaccgggccaagaagcctacccagccgccgagcacagctgccccggcccgtctcaggcgcgcgcgcgtccaatcgaagaagaaagggatcaggggagaccatatacatcgagcttggaaaagcagcggcatatgcagggcggcggcggcggcggtgatcaagcaggagggagcctaggcatggacatgggcgtggggtacgccgccggcagcggcggcgccgagtgctcgtcgtcgacttcggcggcggctgcagcagcggctgccgcggccgccgcagccgccgcggcggcggccgaggcggaggagcggcagctgctcaagggggagatcgcggtgcacccgctgtgcgagcagctggtggcggcgcacgtggggtgcctgcgcgtggcgacgcccatcgaccacctcc

SEQ ID NO: 905 - DNA, 546 bp, Sorghum bicolor
  Clone ID: SORBI-28MAY03-CLUS132178_1
gcacgaggcaaaggcgagctcatcttggtgtacgactacatggcgaacgggagccttgacaagtacctgtacgaccagcaagtgccggtgctgtcgtggcacgagaggtaccggatcgtcaagggcgtcgcggcgagcctcctgtacctgcacgaggactgggagcaggtcgtcatccaccgggacgtaaaggcgagcaacgtgctgctcgaccacgagatgaacggccggctaggcgactttggactggcaagactgtacgaccatggcaccgaccctcagacgactcgcgtggtcgggaccatggggtacctcgcgccggagctcgtgcgcacggggaaggcgacgccctccaccgacgtcttctccttcggcgtgttcctcctggaggtcgcctgcgggcggaggcccatcgaccgcgacgtcgaccgcgatggccgggtcgtgctggtggactgggtgatcgagcaccaccgcaacggatcggtcctggacgtggtggatccgcggctcgtggggaagtacgaggcggaggaggcgacgctt

SEQ ID NO: 906 - DNA, 672 bp, Sorghum bicolor
  Clone ID: SORBI-28MAY03-CLUS13222_1
accattcccaaggaaaccctccgctcctcgcacgtctgacgtctcccatggccgccgccgccgcgccgctccgccggctgctcctccgcgtccgcgacccgccgccgctgccctttaacacgctcctctccaacatcacgccgcacctgcagcagggccccaccccggcccctgctcctccactcccggcctcgacgccggcccagacgccacccgggactctccgcgacgccctcttctcgttccacccgggcctccagatacacccgtgcctagatccggctgggagtgcccccgcatgggaggaggtcggcggaggggccgcggaggtgtgggcggacagcgtgaagaagaagcgcaagcgtaagatgaacaagcacaagctccgcaagctccggaagcgacttcgccgccagacatgagagctctctcctctccggctacaaggttgttggacttgaaacctgggcctccgacgcacaacacagtggttaattgtttatgggctgatcacctgctgcgagtttttgtttggcaaaggagctacatgttcaattgcagccggcaattgttgcgactaacagtttagaaactatgacagaaattgaattgaaccaggaccgagctaggcttaagtcttgatttctgccgaataaagctccagatttgggg

SEQ ID NO: 907 - DNA, 775 bp, Sorghum bicolor
  Clone ID: SORBI-28MAY03-CLUS13223_1
gattgattcagattacagtgcaaaggactcttgttatctcaacaattggcttcagactgctgttacaccagggattgaagagctcacacttatactaatcccacatggcccaaagtacactttcccatgctcaattttgtcaaatgggagtggggacacaatccaacaccttcaccttggcaactgttcctttcgtccaacagttacatttggtggcttaagaagtctcacaagattgcatctttgtcatgtgtgcattacgggggacgagttagggttccttccttcccattctcctgctttggagcggttggaactcaagtgctgcaataagatagttcgtctgaaggtacctcacctactgcagcggctcagctacctggaggtgaccgggtgcaccaagctgaaatttatagacaatgaagcaccgaacgtttccagttttgcattcggaggagaaaacacagtacatctatcacttggagaaacttcacaaatcaagagcctaagtatgaaccgccctggttcagttttttatgctcgtgctgaacttccatccagcatgccaaatctcgaagctcttaccatatattcacaggaagagatggcccatgcaccaatgctgcgtagcaaattcatccacctcaggcacttgagcatggttcttactggagcactcctttacccgatctatgattatttgtccttggcttcctttttgatgctgctccttctctggagactttcgacttggatttatggcagcgagacatgg

SEQ ID NO: 908 - DNA, 605 bp, Sorghum bicolor
  Clone ID: SORBI-28MAY03-CLUS1323_1
cggacgcgtgggaaaattatgacgacttgtgtgaatgccatggtttgcagataactgagctgaagctccttgttgatagcctggagaaggagagagatttctacttcaccaagctgcgggacattgagatgctgtcccagaaccctgaggttgagcacgtttcggtccaaactatccagaacatactctacgcatcagaggaggacgctcagcagctgcctccggccctgagccccatcatggaggcgtccgaggagaggccgaagcaagagatggcgaacaagaggaagagcatctcggacctggacgagtttggtatgtcatccagctcaaggcagaggctctccgacatctcggacgtgcagctgtgcggttcgccactgacgagtttcagctgaaggaacttaactgtcattgctacaaaatggggcttgtcgttgctgtcatgacttggtccttctgaacttgggtgtctcgtctagcttttggattggtttgtggtttagtctttcatgtgttgtgtggtgatgtgtaatgtcgtttgcgcttcgcaaggtatattgatccaagttacctgccacagaatttgtggccatttgctaccc

SEQ ID NO: 909 - DNA, 671 bp, Sorghum bicolor
  unsure (1)..(671): unsure at all n locations
  Clone ID: SORBI-28MAY03-CLUS13241_1
gcacgaggatgattattcaggacaagtacaggcagaaaaggcatttctcaaaatgtgggatcccattgcctgacttcatggaagtagatactttacacagtatagaggaagctggggaaaagtttggttatcccctaatggtaaaaagcaagagattagcatatgatggtcgaggcaatgctgtagccaagaccaaagaggagctatcttctgttgttgcttcactgggtgggtttgagcatggcttgtatgttgagaggtggactcctttcgtaaaggagctttctgtaattgtggcaaggagcagagacagctctactgtctgctatcctgttgttgaaacaattcacaaggaaaacatatgtcatgttgttgaagcacctgctgaggtatctgacaaaataaagaagttggctactagcgtggctgaaaaagctatcaagtcattagaaggagctggtgtttttgctgtagagttatttttaacagaagaagatcagattttagtgaatgaagtagcccctaggcctcacaacagtgggcatcacacaatagagtcatgctacacctcacaatatgagcagcatttacgtgctattcttggccttcctcttggtgacccctcaatgaaagcacctgcagcaataatgtacaacatcctgngtgaggat

SEQ ID NO: 910 - DNA, 566 bp, Sorghum bicolor
  Clone ID: SORBI-28MAY03-CLUS13231_1
gcacgaggcgcttctcctccccgccagaaccggaggccaaggaggagcccgtatccccacgcgtccgctccaagctctcaacgggcgactgttgcgctcgtccttctctactctcagctgctcctgctctccctctccatctcccggcgacggtggggaagacagcgcccgcagcctgttcgatgagctttcagttctttctccagtcgttccatgggaggttgatgatatatggagaatatatgctggttatttcttcatcttgcatatccccttgagctttggagggcttggtgtggttgccaaagtgctacagtgctcctcacttgactcaatgacaacagtaatttctacagtcatacttcagttagcagagcttgttttgaccttagtgctactccagtacactgcaaagccagggcaaactattcaacctttcttttctgggaagatttttacagaacggaattgggtcaaagagactgtattaggctttgtagttttgatggccctggtattgaccacatccatcttagctgataaattggtagggtctgaggatgcat

SEQ ID NO: 911 - DNA, 636 bp, Sorghum bicolor
  Clone ID: SORBI-28MAY03-CLUS132414_1
tggttcacaagaactgcaaatgtggaacctctagtcaaaacacacctctatgaacgtggatcttacctttgctttgacccagagatctgggattcagtccgtaaggacaactttgttctccactatgagctggtagagaaaaggccagccctgccttcaatagcacaaaacgttagatgaaaagaaaatctgggtacctccttagtcctgacccatatttttccctgttggatgggactaagaagctcgccatcattgcctaacttttaagctctaggagagaaactcagaaatatctaacgatctgcagggaggaggaagctgcacaacagaagtgtggaatgtccagttgacaccccttgtaattatactaaaacagtgggagcgaatttgcgtttttccttcgatcgtggggagtgtgcactcccccttaaaaactgcctaatgttcaggattagtttctctgcacagttatctcaccagcttcaaatgaaaagaggcatagctggttttaatgtcttatcctctgtcgaatcatctctgtcagtctacagcgaaaagttataccccgtcggggggtaaaactgtagcagctgaggggggtaaaacaaattagcagtgtgcacacagtcgact

SEQ ID NO: 912 - DNA, 403 bp, Sorghum bicolor
  Clone ID: SORBI-28MAY03-CLUS132446_1
gcacgaggctgactcacatcacaagatgacaagagaagagcacgtagttgttcctgccatttgagcagttgtcagtcgagctcgagctggaggagcctatagggcgcgtagcagagaattgagccagcttagcggcaccgaggagtgaggttttggcttctcttcttgggcagtagttctcgtgtgccctggcggctatgtggggcggcgtgctgtcgctggtgcggcaaggcctgatcaggcgccggccgaggcggcggacgaccgcgcgggtggtggacgagagcgcgctcggcgaagccgccgcggaggccggcgacgtggcggcgcgcggagctaccgcggcggcaccaggcgcgcagctggccagggcggtcctggcgatggcgcggggcgccgtcgt

SEQ ID NO: 913 - DNA, 607 bp, Sorghum bicolor
  Clone ID: SORBI-28MAY03-CLUS133344_1
gcacgaggctcatgatcgcgcccgtgtacacggccgaggtggcgcccacgtcggcgcgcggcctgctcacgtccttcccggaggtgttcctcgacgcgggggtgctcctcggctacgtctccaactacgccttccacggcctccccgtgcacctcagctggcgcgtcatgttcctcgtcggcgccgtcccgccgctcttcctcgccctgggtgtcctcgccatgccggagtcgccgcggtggctcgtcatgcagggccgcatcggcgacgcgcgtcgtgtgctggccaagacctccgattcccccgccgaggccgaggagcggctcgccgacatcaagaaggccatcggcatcccggacggcgtcggtgacagcgacgacgacgacgaagtggtggtcgtggaccgcaggaacaagaagggcagccatggcgaaggggtgtggagggacctcctcatccgcccgacgccgcccgtccgccgcatactgatcgcctgcctcggcctccagttcttccagcaggcctccggcatcgactccgtggtgctgtacaagccgcgggtgttcgagaaggccgggctcacgtcgaacagcaactccctgggcgc

SEQ ID NO: 914 - DNA, 915 bp, Sorghum bicolor
  Clone ID: SORBI-28MAY03-CLUS131619_1
gcacgaggggaagaggaggctgctcgcctcaggtttgcttgtgaggattggggattttttcagcttgtaaatcatggaatagcagacgagataatcacaaatataagaagtgacattcagagtttcttccaacttcccttggaggtgaagtgtgcctatgcacaggttccaggaagccttcaaggctatggccaatcgtttgttgtgtcggaaggtcaaaaacttgactggtgtgacaggttttccatcatagcccaaccgcctcaggcccgtgatatgaaatattggcctactcaacctcgtactttcagcattaaatattgatctcaaactgatggacgacaaatatgtgtctcaagttttgaggatgaattactaccctccatgcatgaccatggctgaaaaggtattgggcttgtcaccacattcagatgcatcttttctaactatccttttagaaattaattcagttgaaggccttcaaattaaaaggcacaatgcatggatcacagtgaaaccaaatcctaaagcattgctggtgaatgtgggtgactttcttgagattatgtcaaatggaaagtacaagagtgttgaacacagggtgacaataaatgccaatcaagaacggttaaccatatcagcatttcattttccatcacttgatggagtagttgcacctatgacaaccattacagaagagaggatcctgtacaagacaatgggagtagaagagtatttaaaaatctttatgtcaaacaaactggaaggcaagagcgcattggatcatgcaaagttatcataaaagaatgaagagttctactaggtgggtcaaagcggttgcttgtaaggaattaaatctatacaaagatacgcaactcttctatgtgttacagaaaatataaatattggtttatt

SEQ ID NO: 915 - DNA, 529 bp, Sorghum bicolor
  Clone ID: SORBI-28MAY03-CLUS13254_1
cctactggaaaacccctcgccgccgtctcctagttggggtccgatattgctggaggtcgccgcgttccaaaatccgttaggcaatggcgccccctctcctctcgccgccggtgctcgccgacgcactagcgacgccgccacggtctttcccctgctccctccccacgcggcgactgcctaccgtcgggttcgccggagccgtacggagcgacctgcagcagagctggagtgcgcggaggagggatctcagggtctgtgccactgcgacggaagcggatcatgaaagggaggaggatgtcgccgacgattactactccgttctgggtgtgatgccagacgcaacccctgaggaaattaagaaggcatactacggttgcatgaaagagtgccaccccgaccttagtgggaacgaccctgacgtgactaatttctgcatgttcattaacgaggtttactcggtgttgagtgatcctgcacaacgtgcagtgtatgatgagatccatgggtacacagcaacagcaatcaaccc

SEQ ID NO: 916 - DNA, 733 bp, Sorghum bicolor
  Clone ID: SORBI-28MAY03-CLUS132526_1
tcagactaccagtatgtattaattacacatttgcagtcactttttttcaacccataaatcctactgtacattgttttctattttgcaaatgaaatttgactgtattaggtgtatacttttgttaatgggacaaagtatataaaaacttgaccatttggatattcacagaggaaatactcctacatacaaactaatgcaatcctgcatatgtgcttggtattttatcttctctataaatagcatatgtcaggatgactttgatgtagacctttgttttctgagaatcttcagagctggctaagcagttccagagttccagaagggcatcctctggtcctacaaaagatggcatattctatcgaactagacctatcaaaagatggctaagcaattcgttggagtggcttcagttttagttctaaaagagatggtatgatgaatgggagaaaaaaattggcattcctaccctatctaagctgtaaaccttggcctaattttttggttaaatttctctcagcttatgtagcaaacaatggcaattatcaaaagtccaagtatgtacagtcttgccctatctaggttctgacaggctatgtgctgttttgccttctcatggtgtgagtcatgggatgctgagacatgacccaaataactgttcttggtgggctgacctgggtacataatgattagtcttaggggtgaggattgatgtatataggtatgaaacccattg

SEQ ID NO: 917 - DNA, 503 bp, Sorghum bicolor
  Clone ID: LIB3478-055-Q6-K1-F4
gtcctcctcgtccgcgtcgatgaggaacccgacggctgttgcattcgcctcctctcctgcaagctggaggggtcaccgctcgtggaggcccaaaatgataaattctcagcttccatggcgaatagggttttctgcagcagcaggtcgcaagattcgaccattcaacagcttacatcagatactacaatagaggttgcaatcgatataccttttccatttcgagcaataccagttgaagccattgaatcaagtggcaggcaagtgcttgaacagttactcagagtcatgcttccaagatttctaaagcagcttgttaaagactaccaagcttgggcttctggtgatgcttcgaggaaaccacttggcactggggaaatctgaagctgcccagtggctccactagcactaggcatgataggttattcgttgaattcagttatcacctccttgtttgtatagcaatcctgcccaaacgttatccacttcactcatgacagttcttt

SEQ ID NO: 918 - DNA, 395 bp, Sorghum bicolor
  Clone ID: LIB3480-025-P1-K1-C9
gcgacggcttccaacacgcgcagacattttctttctggtgagccactgctgctcctggcatgacgaaggacggagatgtgtcccgcgaggaggaccgaggagctgttgagggcattgaggaggacgaccgaggcattgcaggcttccatggcgaatagggttttctgcagcagcaggtcgcaagattcgaccattcaacagcttacatcagatactacaatagaggttgcaatcgatataccttttccatttcgagcaataccagttgaagccattgaatcaagtggcaggcaagtgcttgaacagttactcagagtcatgcttccaagatttctaaagcagcttgttaaagactaccaagcttgggcttctggtgatgcttctaggaaaccact

SEQ ID NO: 919 - DNA, 623 bp, Sorghum bicolor
  Clone ID: SORBI-28MAY03-CLUS132580_1
tggctcagccaggttgagagcaacatcgtcacggggttcatggaacgctgcactctttgggagttgccggcatagctcgtctgatataggtccttctagggacgacaacattctgaaacgctcagagacaatcaaatcgtctggcgggagcaatggggatcattcttcttcccgcaggaggcaatccaaggagatctttcccgagccgtccggctctcgtgacactgaggattaaggatgaaggagaatctttcttgctgatcatttttccggtaaagagggaatccctatggaggacggctctgttagagctccgctggctgattctgatagaattctttcgtccaaaaagtcaggaatgtgaattctgtcttctagtcaatggcttcacaacagcacactggtgccatggtaatcatttttgcgggaagtagcaatggtggcatgtacgtcgtcggtgtaccttggttgacaacaattgcatgcagtcggcgcagtgaaaaattcttcacaattggaagtctgtgtctcttctgtccattttctcattttcccctcctatcggttaaagaaagaatggcgacctgattctttttctcactcccctactgtaattgattgtt

SEQ ID NO: 920 - DNA, 445 bp, Sorghum bicolor
  Clone ID: SORBI-28MAY03-CLUS1326_1
attgagatgctgcagcagtgtagccatccaaatgttgtccgctactttggaagctaccaaggagaggactacctatggatagttatggagtactgtggtggtggaagtgttgctgatttgataggcatcacagaggagcctcttgatgaatcccaaatagcttatatatgtagagaagcactaaagggccttgcttacctgcactccatttttaaagttcatagagatattaagggtggcaacattcttctaactgagcaaggcgaggtgaagttgggtgattttggtgtagctgcccagctgacaagaaccatgtcaaagcgcaacacgttcattggtactccacattggatggcaccagaggtcattcaagaaagtcgttatgatggaaaggtagatgtttgggcattacgtgtatctgcaattgagatggcagagggcatgc

SEQ ID NO: 921 - DNA, 1003 bp, Sorghum bicolor
  Clone ID: SORBI-28MAY03-CLUS132608_1
gcacgagggttagacgggagacggataccgcgacggccgacctctccgcctccgcgccctcctgcggtcctgcccttggcccgtcggccctcctctagtcctcttcctcctgtgcgattgtgccggctcccgcagaccgcagtcccgcgtccggcgtcccggccgccccggcccccttccctcacaccactgatcatggggctactcagcatcatccggaagatcaagcgcaaggagaaggagatgcgcatcctcatggtaggcctggacaactcggggaagacaaccatcgttctcaagatcaacggggaggacaccagcgtcattagcccaaccctcggattcaacatcaagaccatcaagtaccacaaatactctttgaacatatgggatgttggaggacagaagacgatcaggtcttactggagaaattactttgagcagactgatgggttagtttgggtcgttgatagttcagacataaggaggcttgatgattgccgtgctgaactccacaatctcttgaaagaagagagactagctggagcttcattgttggttttcgcaaataagcaagacatacagggagctctaaaaccagctgaaattgcgaaggtaagcaaatttcagtcattcatatgtattagagacatgtttcctatattcctatggttatttactgtgtgaaatcattgttaacttgtactgtgctttgtgaaatcattgttaacttgtactgtgctttcccggtcctcatgtttgacaagattttacttcagtgtgggagcaaaaggatatgccaaattgaatttagttttatcagttatgctcaattatggatcttctgaagcatccaatttcagtgtgtactgggatagttgcatacacttgtactttgtagatattctgcattttgttttcttataaattatatttggtttcccagtgtatagttctcttctggaacagctgattagatgctacttatttgtacaattttgca

SEQ ID NO: 922 - DNA, 618 bp, Sorghum bicolor
  Clone ID: SORBI-28MAY03-CLUS132724_1
gcacgagggggaagctcaagcacgcccaaaaaaaaaattccgaggtttccgcctctcggagtcggagcgcaccagcaccacccggagcgactcgccgccggcgcggagaaggagggcggaggctaggcgatggcggatgagaatcaggctggaaagaaagaggaggaggaatttagcacaggccctctgtcagtcctaatgatgagtgttaagaacaacacccaggtgctcatcaattgccgcaacaacaagaaactacttggccgggttcgcgcttttgatcgccactgtaacatggtgctcgagaacgtgcgggagatgtggacagaggtccccaagactggcaagggcaaaaagaaggctctgcctgtgaacaaggatagattcatcagcaagatgttcctcaggggcgactcggtcatcatcgttctgaggaacccaaactgattgcccaaccagccaccttgcagctatgccctttctctgggttcacggaagccaatgtctctgttgaaaactgtagcttatgtatgttttggaggattaactggttaccttgaactgacgttcatgtgaccttcatcagtttgttaaccggcagtatgtacctacctcctg

SEQ ID NO: 923 - DNA, 768 bp, Sorghum bicolor
  unsure (1)..(768): unsure at all n locations
  Clone ID: SORBI-28MAY03-CLUS132748_1
gcacgaggcaaaaacacgcacgtgtgtcgtcaacagtagagttcgtcgttcctcgtctcatcgatcagtcgacggcaagaatggcggtcaccgagctcaacaccatcaggtcgcgagcgccggccgtcgtcctcgtcggcctgctcctcgcgacgtgcctgttgctcttgctcgcggcgacggtcgcgaatgccagcaggccgttgaaggtgtcgtacgacgacggtgcgcagcatacggtggagtcgccgccggtggtgggttacatccagacggtggtggtcgggaccaccgcggaggcggagcaagacggcggtgctgcagcaggccacaggttgatgaacgtcgacatgctaggcgggatcaaggactccggcccgagccccggcgtcggccactagctagctaggcgccgacgcgcccgtacgccgccgggagcgacatgcatgccggctggaggatcactgtgtgcttcctggtttcagtcagagagagatcatagacttcaataaattatatatgtcgatcatcggttcttgcatgcatgctggacaggacttacgctggactagtaagcagggggtttgatatattattcaaagacaggtttattttgttctttatatatgcaaattattacaaattaaggtttgcgtagtgcttgtaatagctggtaaaagttgtaggagtatataagtagcaactagtagtgcatgaaactggtatcttgtatttgtatacgtgcctgtttncaggtgcatacaacag

SEQ ID NO: 924 - DNA, 436 bp, Sorghum bicolor
  Clone ID: SORBI-28MAY03-CLUS132794_1
gcacgagggagagagagagaggcagaaggagcgggagagggacaagcaaagattatgattccaagcatgagaggtatgaggatggcgggagcagaaagagtctctcgaagacgagtaggacagaagaagaggcctactcatataggagagatactgatgccaatggcagaaatttcagcaaaagagaagtacaataatcctgatatgcaagctgacaaacacagccgaagaaaagatgattctgaagatacagataagtggcccgctgacaatagacacagtgatgacacaaagaccctgtccagatatgaacatggtaaatctaggagttctaaggaacaaaggttcgatgatgacaagtataaggaaaagtacaaggatgattatgtaagggataaaaggcaacatgatgacaagttttctgatgagcgagtgg

SEQ ID NO: 925 - DNA, 689 bp, Sorghum bicolor
  Clone ID: SORBI-28MAY03-CLUS132205_1
gcacgaggatttccagccctaccacaaaggagaaccacaaagccgcaccgccgccgccgccgccgcgttaagccatccaccctaacaccgcagtcccgctgccccggccctcatcctcccatcctcgcccaacccctactgatgagccttttgctcccatgtcgacaagcttctccatagtttgccgccaatgccgcacgagctcccttgaccgtagcctctcctatgttggggctggttgggggtgaatcggtggaaagatactgtcgcttagcatcctgtgatcgttcatcgccaactcctgcagtcccatcgcgaactaccggagaaagaagcggcgactcggcaggcgatgcttttgctgttgtcatcccgctacagttgtatctgcacggtgggcagggatcgacatcgcaaagtccacgaacacgatctggctacaaaatgtcgattggggagacggactcgctgttgccgctgaatccaccgctggactcctatgcacaagaaccacatggagctgttccgtaataaggtattgttagtggaagcggcttctgcttcttgaccctcttcctgcctttgccaggtgaccagctgcaggcaagagttccaccaccggtgtgtccttgagtggaggaagcttgaggttaagtggagcacacgagtgatatgatggtcaacataga

SEQ ID NO: 926 - DNA, 596 bp, Sorghum bicolor
  Clone ID: SORBI-28MAY03-CLUS13297_1
tgctgcgccgcgccgcggcgtccggctccccgctcgacctccaggacgcgctcgagcggttcgcgttcgacaatatctgccgcgtcgccttcgaccacgacccgtgccagctcccggacgatggcgacgccggggcggacagcagcttcgccgatgcgttccgtgacgccgagaatctcagcgcgggccggttccggtacgcgctccccgggttctggaagatcaagaaagccctgaacgtgggttctgagaagcggctgcgggagtccatagcgatggtgcacgatttcgccgatcgcataatccagtcgcgccgggaggagatgctgactgccggttttgacaagcacgacctcctgtcgcggttcatggcgagccaggacgagacctactccgagtctgaggtgcctctccgcgacgtggtgatcagcttcctactcgcggggcgggagaccacgtcgtcggcgctcacctggttcttctggctgctgtcctcgcggccggacttgcagcgccgcatccgcgacgaggtcgctgctgtgcgcgcccggcggcgtgcacaaggcgacgtcgatagcatcgtcgggttcgacctg

SEQ ID NO: 927 - DNA, 590 bp, Sorghum bicolor
  Clone ID: SORBI-28MAY03-CLUS132972_1
gcacgaggagccacctggctagcactctgagacgacgatacacacagacgatcgatcagaaaatgtacgtgacgaggcctctgtcaaggtacctgtccgaccccaaggccatggcagagccgccgcctgaagctcctggctcagggttcctcgtcgtgctcgacgaagcgaccgagcaagagagtacgctctgctgtggcctgtgcaaagatcccagggtgcgcagcctcccattccctcagaaccggcagctctccgtggagaagggcaacgcctctgatccattggagggtatcggcaaatgtgtcgaagttgtctcggagcttctaagtatggcttcaggccaagactccggcggcggtgctccgggctccggcaggtacgtggcgcccaatagctacgccatgttcgtgcccgtcatcggccagccgctgtcgtccggccgctactatgtcgtcaaggtcgacggcaagcacaccgggaaggtgtcggcgtgctccaaggaggaggaccggacggagtgctgcttctgctccttccctgccgacgtgaagccgaggccgtttgatcgcagcgacgtctaccagcag

SEQ ID NO: 928 - DNA, 472 bp, Sorghum bicolor
  Clone ID: SORBI-28MAY03-CLUS132994_1
taacagcatcggaacacattgtgatgatgatgaagaagaggagggagctgataatgcagaaggtaacaataaattggaaaacccgaaggaagctgataccagtgttgaatcacgagaagcaaatggtaagtcagaagatctgaaagatgtaactgacaacttggatgaagtgaaagaggagactactagtagctctacagaagcaatcaaagccttagagggcttgatggaagccaatggtgacgttgaagaactaaaagattttaatgaaagctcataagaattggaagaagagaataatgaaaacttggacaagctggtagagctcttcttggataaggggttgttggatgaactgaagcccataaaagttgagtcccggcggcgggtacgggcagcgcttagcatcattgataaaatgatgagctctcgggtagtgaagggtggtaatggtgcaaatgatactcatgga

SEQ ID NO: 929 - DNA, 664 bp, Sorghum bicolor
  Clone ID: SORBI-28MAY03-CLUS13309_1
ctcttctccattcttatggccgatcaagagacagataaagctgaaggctgtttgagagaatgaagagcaaacctgtctatggatgccctggtttataatgagatgatgaccttgtatatttctgtcggggagcttgataaagtggagatcattgcagaagaactaaaaaggcaaaacgtctctccagatctcttcacttacaatctccgggtcagtgcagcggctgcgtccatggatctcgagggcttcaaaggaattctcgacgagatgtcgaaagatccaaactccaaagaagggtggacactgtaccgaaacctcgcctccgtatacgttgacgcgagccagcttgtgggctctggaaactcgctggtggaggcggaggcaaagatcagtcagagggagtggataacctatgacttcctcgtcatcttacacgccggcctcggcaaccaagagaggatcaaggacatttggaagtccatggtaatgacctcgcagcgcatgacgagccggaactacatctgcgtgatctcctcgtacctgatgtgcgggcagctgaaggatgccggggagatcgtcgaccagtggcagcgttctaaggcccccgaattcgacatctctgcctgcaacaggctgctggacgcccttatgagcgccggtctca

SEQ ID NO: 930 - DNA, 687 bp, Sorghum bicolor
  Clone ID: SORBI-28MAY03-CLUS133113_1
taaaaattgaaagtctctgcatgttttcagattacgggtttattatacaattaagcaaatctcttcagcggttcagaaacagatgatggccttgaagctagcatcgcccgagtagcacaatctctgcttttaccaaaagctcttcacctgggacgcaagcaaagcaatgcatctactcggcttttggccggtgccattgccaccctagtgactcaaagtcttcttttgcgtcgaggcaagcttacgcggcaaggtcaccgggccgcacagaggaggcccacgttgcttgcacatgaaggactacaggagtggtaacggccatggcctcgccgctcggctcttgtccgacagcgacgttaggggccgatagagcacagcagcaggaggaggacgcgtaggcctacgggaaagcaagcgcaatcgtagaatgggcggagcaagatgcaagccacggcggtgtgaaatagccatgcctcctcttttctgctttttacaagtgggaagccaaggcctacaacacaaaggatgatgttgataaacgcgggacagtggcctgtaccttaactaccagcacacgaaagagctgtgaaattttttgcaaagtgttactatagaacttttatttgtatttaatcatagattaactagatctaaaagattcgttttgtaatttataaacgaactatg

SEQ ID NO: 931 - DNA, 641 bp, Sorghum bicolor
  Clone ID: SORBI-28MAY03-CLUS133219_1
actctgattcagtttatgttttgcgaaccatgtgtgcagcaattgttgtggttttgcacaaaggagattgcagcaggttttgatgtggctgcctagcagaaactggtcaaaggtgagtgcttgattactgaactctgattcagatagtgtacttgtgcaaaggggcatatatctcatgaactctaacattattattgatggaactgggcaaatcacagttttgacgaggtcaaataaattattttcatgtttatttgcttgtaatgcagtggcattagtgttctagtatcagtacatcactacttgtcatgttgaccttaaatattttgtgatatgtcgtcttgtcaggctattttaaatctacaaaagaggcaatggagaagatcttggcatcagaagaaactattattggtgaaaagtctttagcaaaattgtacaagatatagatgcggagtggatatttgaagcaaatttaggccttccttacattgtagtttggaaatggataataatgtacactgtaggcattctagaacaagcagagatgtgttagttgtcaggattttccttgtgtatgttattgacatgattgcttgtcaaagcactgtctttgttttttcagttttatttataggataaat

SEQ ID NO: 932 - DNA, 588 bp, Sorghum bicolor
  Clone ID: SORBI-28MAY03-CLUS133231_1
gcacgaggggcttctggccaacagctgctgtttacctgcaaaagagcccctccttcggttggatattccaccaccctcttgtgacttcgctgatcactcggttcagaggaagacgggtcccggtgtgattcggtgggctgctggattaggatcacccccagggcatgcgaaatcgcctgtactgtgcagaagtaggccaattgacatatgcactttattcgtttctattcgtcgattctaccaggtctaaaagagatactaaaaggaggtcgttgttgctggtattggatcttcctatgatgctaccagtactctgtctgtcaacttcttaggaagtctgtctgtcaacatagcgtaactacattggtctttctttgcaagaaggcatctgtcagttgttacttgttgataagtaggtagatgtatcgatggtgataacagggtgactcttctctgaatgacaaagactaaggagctgtgaactggtctggaaaccagccgcctccccccatgtaaccctcttcccctggtatgcaacccggttgctcgcttcgatcaactatagtaagtagagcatcgctcccatga

SEQ ID NO: 933 - DNA, 835 bp, Sorghum bicolor
  Clone ID: SORBI-28MAY03-CLUS133268_1
gcacgaggaacacaagtacacaacgcaagaaaatcgatcgaatccaactccaaccttgggttttgcttgcacacgtcgacgacaccagctcctggtctccgagtccgagagcagaggcggcggcggctgtctggacctctggtcaacccagcttcgcttcatggccatggaggtccagggcaccaggcggccgccgcaggacgccggcgtgaaggtcaagttcatcgagacgcagttcatcagctccgacgccgccagcttcaaggccgtcgtgcagcgcctcaccggcaagtcccccgcccccgcctcgtcgcagacggcggctcatcaggcgccggcggcaccgcacccgcaaaggccgcgcccgtgccggccggccttcgttggcgccgggcagcagcagcagcaggctgccgggtggacgatggatcaacaggctactgccggctacctggcgatgatgccggcgccgaagcaagagccgctcgcggcggcgtcgaggctggaggacatgaacgagctctgcgacttcgcagacctgttctacaccaccaccgccgcgagcgcgcgccgcgacgtcggcggcagcgccttcccttactgaaacgacggagtgtggtgtgtgcgttgcgttcgccttgatgcatgtttgttttgagaatgagtcacaactcacaagcgcggatgcttgcagttgcagtttgccattgccaatttgccatgtcacagtcgcagtgagttttgggcacattaatgatccaggagtgcaaggagagatggattgtctgtcaaccgctgtactgttaagctaatatatgtcatgcagcttcccata

SEQ ID NO: 934 - DNA, 543 bp, Sorghum bicolor
  Clone ID: SORBI-28MAY03-CLUS133291_1
gcacgaggctgatagcgtcaactattcagggcccttgttctacagatcgaagctgtgttgtaagttcaatccctctgtacccaaacctctcctgtcatagaagttcactactgttcttaacaaaataaggtcttgcaatttgtagaaaatagttgccgggcagtgtatcaaagacttttgcaaccagtttacatgccaaacgacaaatgcctagttgtgtgggttcacttctatagtttttgactaaattctatgacaacgtaagttgtttttcttactaacaatttactgtacatcgaattttgaaatgtgcctacaggcagaataaaaataatccaaattatattggctcaccaaaaatttatcttgacctattatgtgtatgggtctgcattaaacattttgacttattgggatgcctaatcaggtgaataaagtaggttcacttctagctttcgtgattctgtgtgagttagtactctttatttttactcgagttcacttcttggtaacctaaaccaacagtgtgtagttttatcgaag

SEQ ID NO: 935 - DNA, 374 bp, Sorghum bicolor
  Clone ID: SORBI-28MAY03-CLUS132473_1
gcacgaggcaggcgcggcctcccctcggttggaagggtttgctgcatcatgcattttctgtggataatcttcatttgcccttgagtcttcgattcttttggtgtcttcaaaatgtcgggcttgctgaattcaaaccttaatagttcagcatcaaatcttccagactcagctggaaggccatttacagcatccttttcgggtcaatctggatcaattccaggtttccatcattctggcttgcataacactcatggaagttacaaccttccaaatatgcctggatcacttgcacaaaggaatgctgccatgagtggctttccgtcctctggggttcaacaacctggaggtagcattcctgggagattcccttcaaa

SEQ ID NO: 936 - DNA, 759 bp, Sorghum bicolor
  unsure (1)..(759): unsure at all n locations
  Clone ID: SORBI-28MAY03-CLUS133435_1
gcacgagggacgagcaagctgatcaggtcggtaagcggcctggaccttcccgtgcagccggtgcacacgctcatctgctactggaaggtgaagccggggcacgagcaggagctgaccccggaggccggcttcccgacgttcgccagctacggcgacccctacatctacggcaccccgtcgatggagttcccggggctgatcaagatcgccatgcacggcgggccgccctgcgacccggacggcagggactggtccacgggcggcctggtggagcccgtggcgcggtggatcgacgccgtcatgccggaccacgtcgacaccgccggcgggccggtcatccggcagtgctgcatgtactccgtcacccccgacgacgactacgtggtcgacttcctcggcggggagttcggcaaggacgtcgtcgtcggcgccgggttctctggccatggcttcaagatgggcccggccgtcgggaggatcctggccgagatggccttggacggggtggccaggacggcggccgacgccggagtagacctccgccccttaaggatcggccggtttgcggaaaatcccaaaggaaacctgtaggactcgttcaaggctgatggcaaccgcgggtggcttgctggatcggcgacggggctccatttcatgtttttatgtcagaaaaagtgtgttcttgccatctcgttcccttgtttattgtccttttggatttttggattttncaaagattgaagtgggcgcttctctcag

SEQ ID NO: 937 - DNA, 558 bp, Sorghum bicolor
  Clone ID: SORBI-28MAY03-CLUS133445_1
gcacgaggattcgatcaagatcgatccatcgatctgcacaacaatggcattgcctgctgagtacagcagcgaggagctattcaaggctcagcttcagctctggcaccaggccctctgcttcttcaagcctgtggcgctctcggttgtgttagacctccgcatcccggatgccatccatcgccttggtggtgccgccacccttccccagataatggcagaggctgggatcaacctctgtaagctccgcgacctgcgccgcatcatgcgcgtgctcattctctctggcatcttcagcgtcaagcaggtagcaacaacggtggcgtcagacggagaaggtccgatctacaaattaacgacggcgtccagcctcctcgtcagcgacgagagcttgaccagccagcagcagctgctgcgtccttttctgtacccgcagctcatgctcacaccttgccgagaatgccccgtgagcaggggcctacacgcgtggttccggcaggatcagccgcagccggcgggtctgtccccgttcgccctggcgtacagcggcctgacgatctg

SEQ ID NO: 938 - DNA, 648 bp, Sorghum bicolor
  Clone ID: SORBI-28MAY03-CLUS133534_1
aggtgaacctggcgcagctcgccgtggacaggatcggcaggggctgcgtcgacgacatcgtcgacccgtacctggacccgcacagggacgcctggacgctctcgtccatccacaaggtggccgagctggcgttccggtgcctggcgttccacagcgagatgaggccgtccatgaccgaggtcgccgacgagctggagcagatacagctcagcgggtgggcgccgtcggctgacgacgccgcgttcatgtcgacgtcgtcgtcgatctcctcgtccgtagcgtcgacgcgcggcacggacaggtcgtcgtggggtgccggcagaagccggacggagagggccgcggtgaaggcgtcgttggtcgtgcaagagacggcggcgaagggtgcagtggagtcccctgtgtccgtgcaggacaggtggttcagcgagaggagctccccttcctccaaacagcttgctgggcaataattgttccctgcactgaactgaaacatccgactgctcatcttctatgctccaagtttaagctagctagcttaggggcctctttgggttggggtgactaactttagtcacttttagtccataaaatgtcaaaaggatgactaaaaggtaactaaacttagtcaggaaccaaacagggtaa

SEQ ID NO: 939 - DNA, 788 bp, Sorghum bicolor
  Clone ID: SORBI-28MAY03-CLUS133562_1
tggatgatgtatggaaccgtgatgtaaataagtggggaaagctgaaatccagcgtacaacatggaggcagcggtagtgcagtcctgacaacaactcgtgatcgagtagttgctaaattaatggcggacacaactcatgaaccctatgatatcacaggattacatccagacttcatcaaggaaattattgaggcaagggcattcagttcaaaaaaggacagggatgctaagctagttgagatggttggtgatattgcaaagagatgtgctggatctcctttagctgctacagcagttggctccctgcttcagacaaagaccagtgtggatgaatggaatgctgtattaagcaaaagcgccatatgcgatgacgagactgaaattttaccaatactcaagctcagctataatgggttgccaccacatataaggcaatgctttgctttctgtgctattttccccaaggattatgagatagatgtggaaaagctaatccaattatggatggccaatggttttatcccagagcaacatggggtgtgtcctgagatcactggtaaaaaaatcttcatggacctggtgtcaagatcattttttcaagatgtgaacaaagtcccatttgaagtctatgacatagaagatcctagagttacttgcaagattcatgatcttatgcatgatcttgcacagtcttctatgggaacagaatgtgctacgatagtagcagagcctagtcaggccttgtttagttcaccccgaaatccaaaaagttttcaagattccctgtca

SEQ ID NO: 940 - DNA, 824 bp, Sorghum bicolor
  Clone ID: SORBI-28MAY03-CLUS133552_1
gcacgaggctggaaatcttccagagaatcccgttccacggttcccttcgtctttggtgttccatggcggcggcggcgcagctgcacggatcggctgcggccacggcggcatgtcgccggactcgagcctactcagttcgatcctcgtgccggtggccgcagagccttctagctggttccccgaagctttcaatttctacaagtggagtttgtacgaagccatttggctttgctgctaaattttcaaccaaatgtgccaatgagaatgctcgagttgaagagttagatttacaatcagacacaatgaaggaattacatgtggaggagcatgttattcctcagaagaggagtgctaaaatccatgacttttgccttgggattccttttggtggtcttttattctctatggggcttctaggatacatcttctccagaagcaccataagtcttgtcttgggtattgcaccagggcttgccactctgctacttggtattctcagtctaaagttttggaggagcggcagatccagcttcctgcttatcttggcccaagcagcaatttctgctttcctggcatggaagtactctcatgcttacttcttgacaaatagactccttccttggggcttctacgcttcactgagcactgcaatgggttgtttctatgcctatgtgctacttgccggaggaaatcccccacctaagaagttggcagccattccaccacagtagagagagggattcagtttaggatcagcgtgggttgacctttggctcctcatgctgtgtcagatagtatagtaaaattttgattgttttaatgat

SEQ ID NO: 941 - DNA, 980 bp, Sorghum bicolor
  Clone ID: SORBI-28MAY03-CLUS133672_1
gcacgaggtcaggaaaggaaacaccacccctccaaatctttcaactactcaacgttcatccgccagacaattagcagccgcccaaaatggctgttggaaagaacaagagattgtccaagggcaagaagggcctcaagaagaagaccgtggaccccttcacccgtaaggactggtaccagatcaaggcccctgcccccttcaacgttcgcgatgtcggcaagactctggtcaacagaaccaccggtctgaagaacgccaacgatgccttgaagggccgcatcctggaggtctctctggcggatctccagaaggacgaggaccacgctttccgcaaggttaagcttcgcgttgacgaggtccagggcaagaactgcctgaccaacttccacggcctcgacttcacctctgacaagcttcgctcgctcgtccgcaagtggcagactcttattgaggccaatgtcaccgtcaagaccacggacgactacctcctccgcctcttcgccatcgctttcaccaagcgtcgccccaaccagattaagaagacgacatacgccgcctcttcgcaaatccgtgccatccgccgcaagatgactgagatcatccagcgcgaggcttccacctgcactcttacccagctgacctccaagctcatccccgaggttatcggtcgtgagattgagaagtccacccagggcatttaccccctgcagaatgtccacatccgcaaggtcaagctcctcaagcagcccaagttcgatctcggcgccctgatgggcctccacggcgagtctggcaccgacgaccagggtcagaaggtcgagcgggaattcaaggagcgcgttctggaggaggtttaaggagtcaggcccttacatgatggatgcttcggcagaatgggactctggctctaccggccggaaaacaaaatcggcattgttttaggtcgttgcacatggcgtagcattaaggcggctgcgggt

SEQ ID NO: 942 - DNA, 542 bp, Sorghum bicolor
  Clone ID: SORBI-28MAY03-CLUS133725_1
cttcatcttcgacctggcggccatcagcgtggacgacgaggccgtgagggacgcgctggggctggccggcgtcttcctctgcgtgttcggcctgctctacggcggattctggaggatccagatgcgcaggaggttcggcctccccgagaaccgagcctgctgcggcaagccggacctcacagactgcatgcagtggctctgctgctactcgtgctccctggctcaggaagtccgcaccgccgatgcctacgaggtggtgttggaagacaagcagcagccgatgccgatgccgatgcatcacccccggcaccatccaactctgcaggaagagctatcgacgatgcaggagcccctcaggtttgcaggtgtcttcgcttcaccttcacctcatctaaacgacgacggcgtcaccattcccccgtcgtcactgtcagctacacgtacataagcagcagtagtaacttgggttttgggacttgtgagtagtttcatttttacccatgtacatgtatacagtacaaatgtggcagcagaatgagttg

SEQ ID NO: 943 - DNA, 689 bp, Sorghum bicolor
  Clone ID: SORBI-28MAY03-CLUS133798_1
gcacgagggctttacgagctgggaatgcgcaagttgttctttgtgggtacggggccacttgggtgctatccgttgctgcggcagggaagtgtcaccaaggaatgcaacgcggaggccaactctttgtcgatgcagtacaacaccggggttcagaaactcctgcgcgaaatgagcacgcggcaaccggactttcggtactccttcctggaccaatacgctgtgttgaagaagtacataaatgaaccacaagcaaatggctttgctgaagtggaagcggcgtgctgtgctctcggggacaaggatgccatgttgatatgcaccccggagagccaactctgctacagcaggacgaaccacatcttttgggacggcgcacatctcacggaggtcaccacgcagaagctcgtcgcggtcgccttcaacgggtctgcgccgctggttgctccagtaaatttgaggcagctcagcgctccataggtcaagactcaagagtgtaccccccagcgtgtcatattcggtgctgtgagaggctgaacagtaaccaacagtgggctcaacagtagttgaaaacaatgaatgcccccccttattgacagtaccacgccccttatatagggcctggaaaccgacctagtggcatttacataaatgccccgtgacggtgggggaatattccggcaattctctat

SEQ ID NO: 944 - DNA, 545 bp, Sorghum bicolor
  Clone ID: SORBI-28MAY03-CLUS133877_1
gcacgagggagagaacgcgcctcgcatttgtttgcttccattttgctcaaaacaagtcttgcaaagacccattcttctcttcaccctgcaaccgtgtttctctgcatcctgccagcgcgcgcgtgttgtgttgagagttgagagttgaggcgctccgatggctgagctgatggccaccatggttgtcggccctctcgtgtccatggtgaaggagaaggcctccagctacctcttggaccagtacaacgtcatggagggcatggaggagcagcatgagacgctcaaacgcaagctgccggccatcatggatgtcattgctgacgccgaggagcaggcggcagcccacagagaaggggccaaagcttggctccaggcgcttcggaaggtggcctaccaggcgaatgatgtcttcgatgagttcaagtatgaggcactccgtcggggagccaagaagaaagggcactacaagaagcttgggtttgatgtgataaagctctttcctactcacaaccgtgttgtgtttcgttacaggatgggcaacaagc

SEQ ID NO: 945 - DNA, 541 bp, Sorghum bicolor
  Clone ID: SORBI-28MAY03-CLUS132931_1
gcacgaggtgacgaatagtgtattaccttcagggttgtcggcccgtcggagagacacaccctgttttcttggctctccacaatctgcctctattgctgtggactgtgggagcagtagacctatatctggctctgacaattccatgtatcaacctgataatgctagtcttggagctgcatcctattatgttacaggagcaccaacttggggtgtgagcaatgtcggcaagttcatggatacatcaaatggaagtggaagttacataatcttcagctcgcaccaatttcagaacactctagattcagaactattccagacagcaaggatgtcgccatcatctttgagatactatggtattggactccagaatggaaactatacagtcactcttcaatttgcagagtttgactttgaagattcacagacttggaagagtgttgggagaagggttttcgatatctatctccagggcgagcgtaaagagaagaactttgacataaggaaggcagcaggggggaaatcttacactgctgtcgagaag

SEQ ID NO: 946 - DNA, 486 bp, Sorghum bicolor
  Clone ID: SORBI-28MAY03-CLUS133953_1
gcacgaggcggaacaccaaccgatcaaccatggcccccgccgacgccggagacttcctcctagacgcggacgacgacgatttctttggggactacaacccccacccctaccaaggcggctacgacctcgccgccaccttcggaactcctctcccgccgtcctccaacatatgctaccccgtctcctcctcctctgccgccaccgccgccgtccccgctatcccctcgccgccgccttcgtccacaccgaagccagaggaacctcatggcgatgagaaagcgcagcgggatccggcgcacgaaatcccggatgcgtttccggacggggcggcgaaggaagagaaggcgcggagggacaggcggcgcggccgcggcttctggaggaagtgcgtgcgggtgctggattacttgttctgctacaaggacccgtacaaggaacagcggattgtggtggacagttacgtggttcctgtttgtgtgatcagga

SEQ ID NO: 947 - DNA, 497 bp, Sorghum bicolor
  Clone ID: SORBI-28MAY03-CLUS133988_1
gcacgagggaacaaatcctttcagcttacccagaaaacttggttgttaaatcatgccttattaaatattgttagatgcacagtatgaatgtaattctgaaaacttgaaagattatcaagaagtacttcctaagatggctcaattatagatgcacaggagccttgttgtttacatgattctattctacttctagcattagaatctagatgtcttctagtaaatgatttttagttttggtttggttatcattggctacatcattagattatcatgtattgttttggcaacatttgtgagttcgaatgaaatggaagggggttgaattatttgattgtgagcctcacaagattgtgtcctctatctttttttcttccatttctcgtaataatgatacaggttgaaacaattttgtgcctaatagcttattagtttgaacctgtatctgttagcctgattaatgacacattttattgtgttttttttttcactgcacaatg

SEQ ID NO: 948 - DNA, 657 bp, Sorghum bicolor
  Clone ID: SORBI-28MAY03-CLUS13405_1
tttgcggacgcgtgggtttgaattattattcaagtcctctgtttattgtttacatgcttataggtgttgatgctctccatgctcaaggtacatgccctcccctttcggaccctttctttgattcagcatctttaatgtcgtagttgcttaattgtgcagctatagtaaggatctgaaatctgaaataataagttttgaaacagaaaatgtctggatgttaggttccatatatagatgtttgtggcccatatggtttggcacagatttctttgcctgtgcaagacttctttttccaatttgtttaggcaccaatggaaactggaagatccttaagctgtttagctattaaatggtacgtttttcaagttttgttcaatctatcttttatagaacaatgaatccacaattctcagtgttgtggatgattgacttgctccttaaagatcttcctggtgtaggttatcctctctttgttgctagaatgatcattttgatgttgctgctccttgcgttgcatttctgttggtgttatattatagtgtggatagttctgtttacaattctactagtgtatattgctttcttagtttcttttgctagtacagtcattgattgggtgcattgcgctatagtttcactgccatttcttaattttac

SEQ ID NO: 949 - DNA, 558 bp, Sorghum bicolor
  Clone ID: SORBI-28MAY03-CLUS134011_1
tccatgattggctagatacttccggaagattttgtcgatgaagtgggaacctccatcgcttataactatccggggtataccaaagcaaggaaagattacttcatggaacattctcttggcatgttttgaatcagctgatcgacaaggtagggcttctacccatttggacacgtagtccacagctactaagatatactcgcaattcccggacatagggaatggccccatgaaatcaatgccccatacatcgaaaagttccacttgaagattatttgtgagaggcatttcatttcgtgagtagatattcccatgtttttgacatcggtggcatctcctgacaaagtcctttgtatcttcatacatcgttggccagaaaaagccactttgccaaattttagcatgtgtccgaaatgctccatagtgtcctccaaatggcgaggcatggcatctttccgtaatttgagtagcctcaaccataggaacacaccttctcaagagtccatcagcacagactcgaaaaagatatggctcatcccaaaggtggaaacgactatcgtg

SEQ ID NO: 950 - DNA, 816 bp, Sorghum bicolor
  Clone ID: SORBI-28MAY03-CLUS134187_1
gcacgaggctctcacacagtcaattctatcgactgatccaacaatattctgatactccttacgaattttctctatccatcccaaagtcccaactacaatcaccatgtccttctccaatgcagacactggcaacaaggccgccgacccctacaaggccgccaacctcgacaatgacgtttccgtgaaagagaaggttgaggccttcgtcaagttcgccgagaagaccaagttcggcatgatgactaccagagatgctaaatccggcgctttggtctcgagagcaatggctcttgccgccactgaaaacggtggggtcgacctcctcttccacaccaacaccgagtcacacaagacggatgagattgacagcgaccctcacatcaacatcgcctttatcaacagctccggcgactgggcctctgtctcaggcgtttctagcgtcatcactgaccgttcgttggtcaagaagcactataaccctaccctcaaggcgtggctcggtgaccttggtgatggaacccacgacggctctgagaacgaccctcgcatcggcgttatccgtgtcaagaccaccagcattacgtacgccatcagtaacgcaactattgtcggcaaggtcgctcaattggctgagggtgttataacgggcagtccggcgcaggtcaacaagttgagagaggtttcgtcccaggaggttgagcagtaccgctctgctgcttcttcttgagtagaagggcgaataatagacatgtacgaatagcacagcagatgagcttcggggaacaacaccaacccgaattacgggacatgaatgaa

SEQ ID NO: 951 - DNA, 515 bp, Sorghum bicolor
  Clone ID: SORBI-28MAY03-CLUS13423_1
caagcatgtcagctactcagcttagccaagcgcatcagcactgaggaagttgcggtcttcatatagcacttctgatggacttcagctagggagctccaggagttcagctctagccatgagtacgcctttcatgattaaaggcgaatagtgtagccaggtctctcgacatataattttcagttcgacagacctcaggatggtgtgccctggcgtagcaccgatgagtgatgaaggcgcttgcacctttgtgcttctcgctagcttcatgccttcggctgaagattgtgtaagggtgcagccgtgtacagtaggcttctgaaaggtgagattggtctgcggcctgatgtgtatatgtaatttttgccaggaagcgtgtatacccttcctgtcctatcatatcccaaaagctcggtcatctaggctcatgaatgctgcttcagatcaaggctgtccttggaaatggaaagaggaaaggagattttgagtaatgccggttactccctttcccaaaaaaa

SEQ ID NO: 952 - DNA, 1066 bp, Sorghum bicolor
  Clone ID: SORBI-28MAY03-CLUS134283_1
gcacgagggtttgaatgccattgttgactaggggaccgtaggttacgaagcgcctttctcaactttcatggcgcgcgtccgtatttggaccgccagaactcaccatcgtttccaaacagttgttttccctttctgccttcctttttcgcatgccacttttgcttccggtccaactaatgaacatgaatgaactgtggttgtgttttactattgttgagcagaggtgctgagggagttcgcgtcgaagcggcaggtgaagctgagccgcgtcacggtcagggccaaggacgaagccgaggacgtgaagaagccggcgtccaagcatcgccgccgtcgcgccagggccagctccggcggcggagagcgcaaggaatcatccgagcggtcgctcgccaaggtacgccgcctggtccctccatggtcggtcttccgtttgcagtctccatctccaaccactgatcctgcctgtgctcgatcacgtcccgcgtcccgcgtttgacaagccgcctgccgcccccgcgtagttattatgcagcgatgcattcactccggttcccatcaatccaggtcatgcgccagacggaggaggagctggagccggaggcggaggcggaggcggaggcaggcccgtcctcggggcccagcggcaagcatgccgacacgccgtccgacgccgacgccgacctgacgccgacctggaggccctcctgcagccgcacggggcgttgctcggccgccgagccgcccggcaatggaggcccgcgctgcagagcatcgccgaaggctgaggagcggcatcagctcgagcgttcggtgtgtgtcgcggtcggtgagcagccgagctccgtctccgtgcaaagtcaattgcaacttgcgaggctgacagcgtattgtaaaataagcaagttcattgttagcgcctcgcccggtgtggatggatacgaccagctccagatgtgtagtactagtagtagttggctagcagcagtagaccagtagcagtatttatggatttgatggtgtgtttttaaaggtggcagacgattagtagtagtagtatacggta

SEQ ID NO: 953 - DNA, 867 bp, Sorghum bicolor
  Clone ID: SORBI-28MAY03-CLUS134266_1
gcacgagggccaaaccccgctactgccagtgcatattatacaagtagcagcacgtacaagggcaccagtaatcgcgcctgccgctgccactgaacccacagcagctggaatggcgacgacggccatggcaaaacggtcgtcgtggctgctggtcctcgcgctcgcagcgctactactagccgccgccgccgtgcgcgtcgacggcggcgccacggccgcggcgccggcgccggcgccggccgcggactgcggggacgcgcttctgggcctggcggggtgcctgagctacgtgtcggaagggagcacggtggcgacacccgacccgacctgctgctcggggctcaaggacgtggtgcacaaggaggtggcctgcctctgccaggtcttccagagcggtcagaaactcggcatctcgctcaacatgaccaaggccctgcagctgcccgccgcctgcaaggtcaagacgccgcccttcagcaagtgccacgtttctgttcctggtgtgcccaccgcgtctcctgtgcctgctccatctaccggggccccattcttcggccagtcgccgtcgccgtcgtcgtcaattccttcggggtcaccggcagcggcagcaaccgggagccagagccagaccagcaccccagcaccctccccagcgcgttctggcgctgccggcctctcggcaccaccgcggacgttcctcgcggcagctactgctgccgcgactctgttcgtgtgccgactcttgtgagctgggctacgtcacctgtcatgttccaagttcaagcgctccaccttaccttaccttaccccagtctgaccacagataaaaggagcatgtaacaaccctgtaccgagatgtattttgtg

SEQ ID NO: 954 - DNA, 658 bp, Sorghum bicolor
  Clone ID: SORBI-28MAY03-CLUS134290_1
aattcagatgctgctggcacgtgggtgccatggaaaactattgaactagataagctcctttcattagatcggttaacaaggatatggacggcaacgattctggggtttgatgaggatagcaatgctttctttatttgtacgagcgttggcatctacatgatccatcttgagtcaacacggttcacgaaacttttccaaggcgattcatttactgcctattatccctacacaagtttatatactgcaggcttgggcattgatgatggagacgatagagctgaaatgctgaacaatacatgagaattggcatgaatgtcccaatatatcttgtaaactgaggcatggaattggtggtagagactatataactgaaatgaaatgtaatgcaaacaaccatgagatccttacccccattaaatcggtgacgtgttggttgaacaattgatgcaaatttatcttctcccacgtgtatattgtgttgcttgtcagcgtttctgctgcattgttacctatgtatccatgatgcacttacgtgttccatggacagagtcatagaccttttacctgctggttctagcaattatcaaatttgctgaatccattaaatttacatttagggatgtataatccaacggaaactgctgctctatttggtaat

SEQ ID NO: 955 - DNA, 1020 bp, Sorghum bicolor
  Clone ID: SORBI-28MAY03-CLUS134425_1
gcacgagggttcctctcgctcccacctcctcctcatcctatcgagattgtggggagcaggggaggggacgccggtttcacctagctcgcccagctcgtcgcccccttcactgccggagcagagcttgccgccccctccacctcgagcccaccctctacgccgccgtgtcctctgaggatagccacggaccacggtcacgagcatcgatggcggcagctccgggcacctcgcgtggccgagttgcaagctcacagacggtcgagcgagcggaagcattggcgagctcgtggaggcaacgacattctcccatcgtgagatcgggacagccaccttgctctcaacgttaaggagtgcgggcggcacttgatcctcgacgcattgtggcctcgagcggcgaactcagtacgcggaacagatccggtcggcagcaggcctggcagcagggaggaggccgagccccattagacccccgtcggcagtaggcaggaggccaagccgccacgcccccttgcgagcttcgagcacgatgagcagcgagcagatcgataagacgacatcggctgctgcggcacggggcggggtcaccgtattgctcagtggcagcttcgcttcacacatgggcaccgcttttctgctgcacgcttggctccccgggcagggtacagcgagcccctggagtctgagttctcccctgactccatcacgagttatgcttttgcagaatccatataggtgtcttcaacctttagtgtcttacaattgttgtatgattaaattcaacatagcaaagggctactagtggaggttctgtgtgcaaattccaggtgttctccatcaaagcaccctccagcactccgatcgctcacaaaggacgaaagtcgactgagagaagccttgaattttgcttgtggagctctatactgacagatgtgctgcctactggaccacaaatgcttagcttggattaagtgttgtacttgaagtagtgtgcctacccaaactgctgattattgtaatgta

SEQ ID NO: 956 - DNA, 676 bp, Sorghum bicolor
  Clone ID: SORBI-28MAY03-CLUS13444_1
ttttcctatgatcagactgttcttgtttctttaaattccaggctgagaaggatgagcttcgtgatgagaagcagaagttgaaattagagaaggagagtttagagcaccagatgaagcttatgacctcaactccagcctacatgcctcatccgaccctgatgccagcgcctttccctcaggcgcccttagcaccattccatgcccaggggcaagctgcagggcagaagctgatgatgccctttgtcagctatccggggtacccaatgtggcagttcatgccgccatcagaagttgacacctcgaaggacagcgaagcgtgccctcctgttgcgtaattgcttcggtcgactggccacgcttgcaccatgtgaattaatcacaactgaagccccccctagtcgttgatccattgattgggtataactatttgttcttatgtggtagttcattggtaacgaagtaaagctgctgatataagcgtcctactatatagaggctactactgctgccccttcaatggctgtacaatttttgtggagaaaagaagaatgttcgttcttgttctccatagcaacaatgtgacgctatctatatgtcatatatatttcatatttaacggtgtcgtgacttgagagtcatgtttgtgatacatacaaaaaaaaaaaaaaaagggcgg

SEQ ID NO: 957 - DNA, 475 bp, Sorghum bicolor
  Clone ID: SORBI-28MAY03-CLUS134518_1
gcacgaggcgccagcctgaggccagccgccgcgacataacgcgaagccctcgctctgctctctgctctctcctctctcctctgccccccagtctcttcctccattgccgccgcagctctccgagccgcgcgccgccgccgccgcctaggaagtcagcacagcgcagcagcgtcaggaaggaaggaagaagaagaagaataccaggacgatggaggtggagacgatgctggaggacgacgtgttcttcgccgagctcagcaagcggatatcgctgctcatcaccgacgacgacgagggcggcgcggacttcgccgccgccgcgaaggtcatccccgcctccgccgccgcgacgcccctcccggggttcgcaacgtcgcgcggcgcccatgtgccatcgcagcagcagcagcagcaggattggggcgcgtcgttgctggcgccaccggcctacgcgttggaccaccacggcgccagc

SEQ ID NO: 958 - DNA, 508 bp, Sorghum bicolor
  Clone ID: SORBI-28MAY03-CLUS134572_1
gcacgaggaccgcccggccagctcaggcctcacggaacgccacagaacaagcgcagtcccgatgagtgagggtgccacctcgccggcgctggagccggaggcggcgcctttgccggacaacgacgacatccatcgggagatctttctccgcctcccgccgctcccctcgtcgctcccccgcgcctcgctcgtctgcaagcgctggcgccgcgtcctctccgaccccgccttcctccgccgcttccgcgcccaccaccgggcgcctcccctcctcggcttcttcgccgacgaagacggcgacatcgacttcgtgcccacgctgcgccggcccgaccgcatccccggcgcgcgcttctccctgccgcggcggcggcgcggcgacgactacttgagcttcctcggctgccgccacggcctcgccctcttcgttgaccgcgcgcggtctgaggccgtggtgtggaaccccgtcaccggcagccagtgccgcgtgcctttcccaccggatttc

SEQ ID NO: 959 - DNA, 589 bp, Sorghum bicolor
  Clone ID: SORBI-28MAY03-CLUS134574_1
gcacgagggttgattaaaattttttggctgttttttaatagaaaaaatggatcataatgttgggtcaagcaatgatgagaattctgatgttcgacccttaaagaaagcaaagatgagtgaagaaagatgaaaagataatggcatcgccaaccagagagacattgtcttcatattctgaattgatagataagcaagtgagagaagaaaaacttccattggatgatgaacataataataaaaagataaaatttcagcctcaaattactaaagaggcaaaatttcagccaaattttttgtcgggactagatcgggaaggtggattgggggagaggagccagatgggtgcagaggacgtgaggatgcgatgcgggtgcgtcgcgagcccgttgacaggtgtgtctgtgcgtgcgtggttttgcacggtgccagacatggtgccgttcctgaagatctttttccatccacaagcaaataagtttagcttttgatgacattaatattaatattaacttttggtatacatatatcgtggttataaaaattgctaatttctttctcccgttgcaacgcacgggcacttttcctagtt

SEQ ID NO: 960 - DNA, 545 bp, Sorghum bicolor
  Clone ID: SORBI-28MAY03-CLUS134610_1
gcacgaggagaaatttgaagagctctgcgaagatttatgggagcaagctctaactccagttaaagaagtgctgacacattctgggatgaagattgatgatatctatgctgtggaactaataggaggagctacccgggttccaaaattgcaggctaagctgcaggaatttctgggtcggcgcgagctccataaacatcttgatgctgatgaagcaactgttctgggagcctcacttcatgcggctaacctgagtgacgggattaagttgaaccgtaagttgggaatgattgatggctctacttatgctttggtacttgagatagatggtccgggttatgtcaaggatgaaagcattgatcaaactttggtaccaagaatgaagaaaatgccaataaagatgtttaggtccatcagacataccaaggactttgatatctctctcaactatgacaaagcttatgaactgcctccaggcattccatcacataagtttgcagagtattccatatcaggattgtcagatgccaatgaaaagtatgcacacc

SEQ ID NO: 961 - DNA, 924 bp, Sorghum bicolor
  unsure (1)..(924): unsure at all n locations
  Clone ID: SORBI-28MAY03-CLUS13463_1
cccgccaccaaaatccgccgactcgacgccgatgtgccgtctgtcgaatccgcggtgggcgtgccgcttgttgagcccgtgacgccgcagcctttcgtggtggggcacttgccgatgagcagcgacgtggcgccgccggccgcggccattggcgtggctgcgccggcggtgaacgaggagcgtgcgatcgtggtgtaccagcctgccgaggccgcacgcaacctcctgcacggcccactccgcccgggggcgtctctccgcgtcagccccgactggatccatgggctcaagagcaccatgccgcctccagctccacatcggcaggcgcggaaatgatggacgctgatcaggacggcgacggcgcatccatggaggtcgagcacggcgtggagagccagacctctacgcccccagctggcggtgcgatgcagggggaggcgttccaccaccattaccagcagccgcagcagcaccagtggccggcgcagcactgcgttgcgtcgccgcagctgcagctcccggccgcgagctaccagccaagccctgtcacgtggtcgtggtgactggtgacggcgcgaaccagagcacggtagaatagattaggatctcggatagtctagtcggatctcctttcagctcagtttggctctgctgggttttggttttggggctgtgaaaatggaaaagcgcgagcttttgagcagactttgggagagatgtcgatgccatctcacgatggatgccatccgttttttgcacgaggcagtgatgttgttgtcagatctgtgcttgctgcgatctgtgtagtggaacatttgttccttcgttggagtctgctgatgttccattttcaatttgggccttgtttagttcacccaaaaagcaaaaagtttttaaaaaaaaaaaaaaaagggggggncccgg

SEQ ID NO: 962 - DNA, 625 bp, Sorghum bicolor
  Clone ID: SORBI-28MAY03-CLUS134777_1
gcacgaggaccaggtgcaggcgagaaggatgaggtactgaggaaaaggcatgcaggtggtcaaccggagttgacaccagaagaggcagctgagcaggcagcagtaatgaggcaacagattcacctcttctggggtaatatgcttttcgagcgttctcaagtggagtttaagctcagtgtcggtgactggaagacaaatcttgatgcatctgttgaaaggtttaagctggctggagcttcagaatcagatatttcgacagtgttgaaaaatcacttttctaatgcagcctctgagtgtgaagagaagaaagtcatgacttcaggcacagaaatttcacaaacaaatgacaatgttgaagataagtgtgtggttgaaacctaagttttcatggttccaggttcatgacatcaatgtgtatcatattcatcaattgcttcataggctttatatgttcttggcaatatcatggtcctttgtcgtgacatctagacgagagcttcaaggttcaagcacactgagttttgtgtaatcttgataatttactagagaggtcttagatttctgaatatattattattcttcacccagttttagtggtatgtgatgtgggttagtttttttttcc

SEQ ID NO: 963 - DNA, 570 bp, Sorghum bicolor
  Clone ID: SORBI-28MAY03-CLUS134839_1
gcacgagggcagggccatgctccaggcctaccgccaggccatcgtcaatgcaaacaaaactggagctgcccaagaagctataaatggtattagacgagctagcaaggccatgactgagcaagaagcccggcaaattctcggtatcagtgagaaatcaacgtgggaagagattgtccagaagtatgacacaatgtttgagaggaatgccaagaatgggagcttctatctccagtcaaaggttcatagagcgaaagaatgcctggaacctttatatcaaaagcctgatgtactgaactgagattaggtgccctaccttccgtttgaagcagtatgcctaattgatcgatttgccagtgcgcccagagatcatctttcagcgttgagttatgtgttgggcgcatcaggttgattggttgtaatgccagaataatgtttaccaaatatacaaaattttggctgattctcattggcaacgcctcagttactgtggctgtaattcgtagtatgttagttggctgtgatgggataatttttgttttaaacaacaggtcccatttttgcctttgtgtt

SEQ ID NO: 964 - DNA, 600 bp, Sorghum bicolor
  Clone ID: SORBI-28MAY03-CLUS134928_1
gccgccggctgcgctgcatcatggaccagaggctcgccgggcactactccgtcaagggcgcgcgcgccgtcgcgcagctccccgtgcagtgcacgccgacgcagccgagggacaggcccaggatggtggccgtcgtcgaggcgctggagaagctgcaggggctcaaggacatggccgtcaccgtcgggctctggcccgccgccgcgcctgtcgctggcaggaacgccatctcggcgaagatccgcgccgaggtcaagggcgccggcggcgctgggtcgcggcggaggagcgcgtcctccaagctgccgtagtaattgatgcatcggatcgatcctcgattggttcggcagcggcaggacaccggcctgcgtgccacgtcgtataacgtgtctcgtcgtgtaccggggtgtaggaatcttatttcgatctttatggtataatgtaatgtgcccgcgtgtcgtgagtgtatatagtactgtaaaacgtaagatctgcagctgcggtatagtttaggcgcgtcgagattggtgaggcagagatgcatggtcatgcatgcatgcctctgaaatctgtatcctccatgactcactgtacgatcca

SEQ ID NO: 965 - DNA, 568 bp, Sorghum bicolor
  Clone ID: SORBI-28MAY03-CLUS133918_1
gcacgaggcgttcacgaccatgggcagggtcatcgccgccgcgctcttgaaatggagtgtcccggtcccggccgacgccaaggagctgcacgagctggacctcgaggagtacacgaggaagcgcaggttcaggatggactccaccaacgccatgaggttcctcaacaaggccgccgtgcccgtgaacgacgacaaggacggcggcggattggcggcgccgacgtggagcctgtgcacggtgacccaggtggaggagacgaagcagatcctgaagctgatgccactcctggtggcgatgttcgtgccgtgcacgctcatcgcgcagaccaacaccctgttcgtgaagcagggcacgacgatggaccggcacatgggcccgcacttcgagatcccgccggcgagcctgggcgtgttcgtgacgctgaccatgctcgtgtccgtcgtggtgtacgaccgggtgttcgtgaaggccgtccggcggtacaccgggaacccgcgcgggatcacgctcctgaaacggatgggcacgggcttggcgctgcaggtggtgaccatggcggtggcgtcg

SEQ ID NO: 966 - DNA, 662 bp, Sorghum bicolor
  Clone ID: SORBI-28MAY03-CLUS135_1
cgttcggtttactggtttcatattatggttttacatgtgtaatatatttatttagtcattttgcagatcagcttgatagatgtgcctgagtacaggaggaggaaagccatggccttatccccaaatattatgcgagatactagcgacaaagtattaactcatggtcagcctggtgaggaagtaagcttggagttgatcttaagggtagttgctgatgttggccttgtgggacctccaaagcctggaaaatcaacacttctatcagctataacacttgcaagaccagacattgctgattatccgttcactacattaatgcccaatcttggccggcttggtggagatcctgctttaggggccttacagttttcttcagaagcaacattggcagacttgccaggtctaattgagggcgctcatctaggaaagggtcttggccgcaatttcttaagacatttaaggagaactagagtaatcgtccatgttgtcgatgctgctgcagatgaccctgtcaatgattataagattgtcagagaagaattaaggatgtataacccccaatacctggagcgaccttatgttgtggtcctgaacaagattgatcttcctaaggctaatgataggctatcatcactggccttagagatatcttcaattggatg

SEQ ID NO: 967 - DNA, 512 bp, Sorghum bicolor
  Clone ID: SORBI-28MAY03-CLUS135114_1
gcacgagggccaagttgcatggccgtcagtaattgcagtacttcctctactgcttttgaacatctggtaccggaatcgttatattgcgacatctcgagagctttctcgtcttcaaggagtaacaagggcgccaattattgatcactttacagaaacctttttgggtgccccaactgtaaggtgcttcagaaaggaggatgagttctaccagacaaacctggacaggatcaattcgaatttacgaatgtcatttcataattgtgcagctaatgagtggcttggatttcgcctggagctaattggcacacttattttgtctataactgcttttctcatgatcagcttgcctagcaatttcatcaagaaagaatttgtcggcatgtccctttcctatggtctttctctcaattccttggtgtactacgcaatttccataagctgtatgatcgaaaatgatatggtagccttagagagggtgcatcagtacagtactctcccttctgaggcagcat

SEQ ID NO: 968 - DNA, 447 bp, Sorghum bicolor
  Clone ID: SORBI-28MAY03-CLUS135127_1
gcacgaggctcgcggcagctctcgtcgggggcggcgcggctgtggcgccagctgtcgctggacccgcacaccccgcgccgcggcgggccggggccgggggcgggggcgggggcacggcagacgcggttcgcgatcgcgaggcagtcgtcgctcgacccgacgccgcggggcgggcccgacgggtcgtcggcgcaccagcagctcgcggtgccggagaacctggacgccaccatgcgcctgctcttcgcggcgtgccagggggacgccgccggggtggaggagctgctcaggagcggggtggacgtcgacagcatcgacctcgacgggcgcacggcgctgcacatcgccgcctgcgagggacagggggaggtcgtgcgcctgctgctcgactggaaggccaacatcaacgcccgcgaccgatggggtagcacgccagcagcagacgcg

SEQ ID NO: 969 - DNA, 499 bp, Sorghum bicolor
  Clone ID: SORBI-28MAY03-CLUS135128_1
gcacgaggcaacaatctgccattgactcctcacgccgccaaaaccgaacttcgatcatgatgcgcaacagaacgaccgagacctacgtgagcgactccccaagtgggaggctaagccaaaaacgctcccgccaacaactgcaggacgaaaccaacgagcccgtgaacggcaccccctcgaaacggaggcgtcaagctgcaccggttgacccatacgaaataccctgctgataacgatgacgaagaggaagaggacaaacaccccgaaccggaccctgagaagccaactccatataaacgacggggccgcccacccaagtccgcgacctcattagccaacggcgccgtcacaccctcgaaacggcggcaggtggacgccctggtgacaccatcaaaggccatcacaccagggaggagacaggcgatagaccgttctgcacggcggaagagcgctcggtccctcattcagagcgtcatcgccgacgacagcgaagacgacg

SEQ ID NO: 970 - DNA, 616 bp, Sorghum bicolor
  Clone ID: SORBI-28MAY03-CLUS135269_1
gcacgaggattgcatattccatcctaatccatgggtactccaagctaggagaaattggaagagcacttcaagtctggaatctaatgtgctcttctcagagggtaactccaacttcagtaaaccatgtatctattcttctaggcctttgcaagaaaggattccttgatgaagcaaggtcatatttggaaactatagctagcaaatatcagccatccgatgtagtcctctacaatgtagttattgatggttatgcaaaagtgggtgatattggtaatgctgttcagctgtatgatgcgattattatggctggtatgtgcccaaccattgtaacatgcaattctcttctatatggttactgcaaatttggggatctgcatatggcagagagctattttacggctattcagttaagtgatctgctgccaacaacagttacatacaccaccttgatggatgcactctctgaagctgggaaagttcattccatgctaagtctttttaaagaaatgactggaaaaggtatcaaaccaaatgcagtaacttacagtgtagttattaaaggactttgtaagcaggtcatgttccatgatgccaagaatgttcttgatgatatgtg

SEQ ID NO: 971 - DNA, 661 bp, Sorghum bicolor
  Clone ID: SORBI-28MAY03-CLUS135414_1
gcacgaggtggacgtgaaggacccggcgacgatggcgagcgtgcccgccgacgggcgcaccatgggggaagtcatgttccgtggcaacacggtgatgagcgggtactacaaggacgcggcggcgacggcggaggccatggcgggcgggtggctacgttccggagacctcgcggtgcggcacgccggcgacgggtacgtgaagatcctggaccggtccaaggacatcatcatctcgggcggggagaacatcagcaccatcgaggtggaggcggcgctgttcgcgcacccggccgtggcggaggccgccgtggtcgggcggcccgacgagtactggggcgagacgccgtgcgcgttcgtgacgctcaaggagggcaaggacgtgggcgcggaggaggtcatggcgttctgccgcgcccggctgccccggtacatggcgccacggacggtggtgttcgtggccgagctgcctaagacggcgacggggaaggtgcagaagttcgcgctccgggaacaggccaaggccatgggcagcatctccgggtccagctccaagaagccgggagggtcaggggtagcagggacgaggagcaagctctgaactcgcgtgtcccatcactgtcgccattgatggagacatggagtcagtgcatcaacaactagt

SEQ ID NO: 972 - DNA, 863 bp, Sorghum bicolor
  Clone ID: SORBI-28MAY03-CLUS135531_1
gcacgaggccgataacgagctgggagacggctgccagaaataaattttttcttggaccatgagctgcagcgggcgagatgggaaacgctcgctccataatctctctctgacatggcctttttcctcccaaccggctaaaaaaacaagccgtttgaacaaggcttagatcaaacattgaaaatataaattaccaataaatttgcctttaaaagtatttttaacgtttagtcgctcatgtatatatgattcagtatatagcaaattaagaaaatcccacacctcaacgacaaatcaacaaattaatgatttatgtatccttggtttagtgtcaaaaggaagaagtaaataaatctattttgagagactcggtcacaaagcaagatccgtagaattcagaaagacatgactgcaagtcacggcacagcagctcaatctataatctatctcaattgaaaagcaagcaaagctttcagaaagcgtcctgactgctgtgcaccttggcgctctcgggagcaggtgctgctcctgatcagcggctcagtgcggcggccgccggcgctcgccaaatcctgcgtccggtactcaccatccgccttggggattcagggagttagtaggaaaagtatacccttaaacatgattgattagttttcctaattattaatggctgcaaaaaattttgaggagaggaaccggtggttcctcccaagtacagtaataaacctctttgcaggattatattctgaatataaatcttgacatatacatgtgacatatgccacctctacatgtaactgtgtgtaagagaagatttacatattacactgttagtgctggtcatgtggtccaatttttttaaaggc

SEQ ID NO: 973 - DNA, 628 bp, Sorghum bicolor
  Clone ID: SORBI-28MAY03-CLUS135557_1
gcacgaggctttttataaattgaaaggagttccagaaaacttatagtggaatctacacaccacgggatcccagaaagtaaaggaaaacacacacacacttcttagacgtggagagatggctcatgcactcatctttcttctcgtggatcatcttctcatcttcctactgtgcaatccaatagcattcttagctgcggactcgaccaataattcagagatcgaactgcaagcccttctcaacttcaagcaaggcatcacaaatgatccttctggcgcccttagcacatggaacattagcggctcattctgcacatggagtggggtcgtctgtggtaaggcccttcccccttcccgtgttgtttcactggacctgaactctttgcagctgtctgggcaattatccccttatcttgctaatcttacttctataacacggttagatcttggaagtaattcgttggagggacccatccctaaggagttgggtacacttcctaagcttcaagatctgatccttgcaaataatagcctgtctggaattatccctgctagtctgtttaaggactcatctcaacttgtcgttattgaccttcaaaggaatttcttaaatgggcctattccagatttc

SEQ ID NO: 974 - DNA, 891 bp, Sorghum bicolor
  Clone ID: SORBI-28MAY03-CLUS135622_1
gcacgaggtctatttcaaggatacttaaggatataaagctgacttcaaacatctctacgaatcagaaagagagcagtagtggaccttgcacagtaatttatgtagtttgcccatttccagaaccttgtgcaattctacagacgttagtagaatgttctgttgctcttgggtatgttatttcatctccggaaagggaaagaaagtcgctatattcgcaggttgccaaagccctaaacagcagtgcctctgcagatgaagcatcagcatcaaatgttgttatgctatccgggttcagtatacctaagccccgcgggcagattgttactattgaaactgtactgagaattgataagccaaacaaggagcttgctgttttgaaggacatagcattcacagtatacaacaaggcacgacgtatcccgcgggctgtctccacaagcgacatgtttcagtcaccaacttatttgggtagatctcagtccacaatgatgcatgttacatcacctgctcctactctttggaaagaatgtttagttcctcgaatgtctgggccaactctctctcgagaaacagattttgatgcatccatgaggtcggcaacatgggataactcatggcagcctgctcgttctggaggactgctggacccaagtaagatgccagatctatgtgctcaggatgataggaaatatgcctttgagccacttttcatacttgcagaccctgggtctgctgatcttaatgctttaatggaaccgtcaaaatctggagcagatgcacgtggcagcagggtttatggctccatgtcaggaagtaattctgatagtggagtgagccctctactcgatgtatctgagagtgacagtgcagcaagtcttcattgctgttatg

SEQ ID NO: 975 - DNA, 480 bp, Sorghum bicolor
  Clone ID: LIB5047-010-R1-XP1-D8
gccggccgggccgggggaggagccaagaaccagcagcggtctgccgagagtgctaattaaaaataataatcgtgcaattgtccggagcaaagatctccatcgatctgaggtgcagggaagaaaggccggcccccccatggagccgctggcgatcgtgacggtggccggcggcgtgctgaccccggtgttcgtgctgctatcgcgcctccagcccgtcgtcgacttcttccgccggctttgtgactgcctccggcaccctcagcgccgccccgctaggccggtcagggcggcatggaataagcctgcagccacggaggagtagagcatctggctgcctgcatcggatttgtctccagcctctggcgttcgttcaatatgtatgtactggagaggcatatagatgttgtatccactcttaatgagaattgcccggactcctgaaatcttctggctaaaaaaaaaaaaaaaaaaggcccctat

SEQ ID NO: 976 - DNA, 532 bp, Sorghum bicolor
  Clone ID: LIB3480-043-P1-K1-F7
caaagatctccatcgatctgaggtgcagggaagaaaggccggcccccccatggagccgctggcgatcgtgacggtggccggcggcgtgctgaccccggtgttcgtgctgctatcgcgcctccagcccgtcgtcgacttcctccgccggctttgtgactgcctccggcaccctcagcgccgccccgctaggccggtcagggcggcatggaataagcctgcagccacagaggagtagagcatctggctgcctgcatcggatttgtctacagcctctggcgttcgttcaatatgtatgtaatggagaggcatatagatgttgtattcactggcggagccaccgatcggccaccccgggcagccggtcgggctcctcgccaaaatgcaaaagaaatcttctgtatatttatatagaattatgtgattttatagctaaatatttttgcttaatgagaattgcctgggctctctgtaggagaagctactaacatctggaatggcacttacacaagacgcgcgctcccatctggatcaa

SEQ ID NO: 977 - DNA, 715 bp, Sorghum bicolor
  Clone ID: SORBI-28MAY03-CLUS15695_1
ggtggtaagctgttaaaactcgcagattttggccttgcaaggctgttcactagagatggaactttaacaaatcatgtcatcactttatggtaccgaccccctgagttgcttcttggtgccacaagttacgctgaacctgtggatatttggtctgttggttgcatatttgcggaatttttactcaagaaaccattatttcctggcagatccgagttattgaaaatatttgaactgtgtggatctccaaacgaggaaaactggccaggtgtttccaagctaccattgtacaagactatgactatccgacctgcgactcctaccaaacgaagcctgagagatatgctgcagaactttgactgtcatgctgttgaattgattgaacgaatgttgatccttaatccttcacagaggatttctgcacaagatgctcttgctgcggcatacttcaacaattaaactcatatggggggaaagaagtatagattcgctgttctctgcgactaagttttgtttaccatgtcagaatgggtctggggatctcattggtgtaagtactacctgaagactgaagtcttgtttctcctgctgacaatggattaggactagcaagcagtttaactttgtctgttctagctttaaatatgatatatatagatgtattgtactcatggaaaactgtatttgactatcagttaataataagtagtgattcttg

SEQ ID NO: 978 - DNA, 631 bp, Sorghum bicolor
  Clone ID: SORBI-28MAY03-CLUS15662_1
gctttgtggtgactgccattgcaaaactagcaacatgccacagtgagttgcttccgagagcacgtgtgtcacccacgagtccggtcgctcgttcccaaactttagacaggagagtctggcaacgggcctgtgactatttagggctcatgaatgaaccagccatctgtttatctgtactgggaccgtccactgcccaaggaaatggtcctggtattgtgaattggagtgaaggaggaacaaagatggtggctcacgttcctttttaccttttagctgagcaaaaaggtccaccgtttcatgatttttcatttaccgacctccttccaacagaatgaagaaaatatcttcacgagtgcatcagttcaggcatgatttctgtccatatatagcgaccttattttgtgatcatagcatgctgaagatccaaggtccttttcaagaaaaagagctggtctgaacatccaattttgtttctctagcagaatgcttgtaagagtcttgtacttcacatggttgcctgtttcagaggcactctcagatgcactcgagtttgtacatggaatgaatgatcggagtagtgtcttaaatgtacatctctgactttgtaagtgcgttctaaggagctgtttgc

SEQ ID NO: 979 - DNA, 444 bp, Sorghum bicolor
  unsure (1)..(444): unsure at all n locations
  Clone ID: SORBI-28MAY03-CLUS13589_1
agagattgacaaataccatcaaatgttccataccatggacaaggacaatgacggtaatttgtcacttgacgagctgaaagagggtttccggataaacggtcatcctgttccagaggaagagataaagatgctgttacaagcgggtgatatacatggaaatggcacgttagattgtgaggaatttgtaacagtcttacttcacattaaaaagatgagtaataacgactatctacctaaagctttcaagttcttcgacaaagacgggaatggttttattgaaatggctgagttgatggaggctctaggtgatggtgaactaaaatctaatgagcaagtggttaacgacattattcgtgaggttgacaaggacaaggatggacgtatcagctatccagagtttgaattgatgatgaanggtggatcggactggacgaatgcctctag

SEQ ID NO: 980 - DNA, 550 bp, Sorghum bicolor
  Clone ID: SORBI-28MAY03-CLUS13594_1
agccgcttatggtaattactggcgccacacagttcagctagaattattaccttaaagcgaatattcttctctattgttggcagagatggcctagttggcagtgctaccatacaccatgactttgaccactatagatggacctgacgaatcgtcatgctatgccaacaatttcacccacgcgtccgggcttctctgatgacttcctgctgtcgacaggttaccttccattggggtagtcacaatgatgttgacctccctttatatcgtggattactccaattcttgcagttctgaaatgatcagaaacaaccattgatatgcactgaaacattggaagggcaacacgctgcgagcacatatatatcaatccatgcatcagcaccgattgtgttgacttatttaaggatgtctagcttgaactcatgctatatgcctgtataatattcctccaccttcatgatttaccacacaaattatatatgtatcttataaatagtatcaatatatacctctccttatgaattattcaatttaaattaaactgaattgc

SEQ ID NO: 981 - DNA, 654 bp, Sorghum bicolor
  Clone ID: SORBI-28MAY03-CLUS13596_1
gtccaatacgctatttcccacgggcaactcttgcaaaaatctttcaagcttgtgtcatactccataacatggcagctgaggatgagaaagatatggcaagtgcttgctttgactcaggtgaagttatgggaacatcagctgttctaccgtcaaacatcaaaactgggcctgccaattgcttagccaatatacaacagaggaatgctactctttgtagtctaccaacacatggccaactaagaagggacttaatcgagcacatctggcagcagtttgggccatttggtgacaagtaaaataagttctcctagtctaaagtttataatgacatcctttgatgcacactagcatgtgctgctaccgttgatgcttggaactgagggtgagggagatatatatgcttggaactgtatttggcatccacatactgagtagcaataatcccccttcagtagccttttaccactatttttatgtgatgccatcctgaacgctcaaaattgtcaacaagcaagagatattagtctcacaatgttttttctcttttttttttactgggccatcatcgttactgttattgtttaatgcagtctactctaggctacgggcagtaccaaactaccagtccgtttaaaaagattttatcatgaattt

SEQ ID NO: 982 - DNA, 566 bp, Sorghum bicolor
  Clone ID: SORBI-28MAY03-CLUS135948_1
gcacgaggctatcctcccaccttggacttgcctttctatcgtcgtcgagtgtccaccccttcccatcacatcgcattgaatcgtacagacacatacgcgcgcgcacacatacactctccccagtcacaatgtccaagactttctcgaccagcgacgtcgcggcgcacaacaagcccgaggacttgtacattatcgttgatgaggacgtctacgacctcacaaagttccaggatgaccaccctggcggcaagaagatccttcagcgcgtcgccggcaaggacgcctccaagcagttctggaaataccacaatgagggtatcttgaagaagtacaaggccaagctccaggtcggctccctcgacagcaagccccagcccgtcgaggccgcccccgccgccgctactcccgtacccaagaaggctgcctccaagaaggccgtcgccagcagcaccgaggagtccgagcccatggacccctttggcgatctggttccctacgccgatcccaactggtaccaggcctaccacactccctactacaacgagactcacgctgccctgcgcgcc

SEQ ID NO: 983 - DNA, 549 bp, Sorghum bicolor
  Clone ID: SORBI-28MAY03-CLUS135998_1
ctcctccacctccactctcccacgccgcgcgcggaccgcccgccctctcctcctcctcctcccgctccaaacaggaaccgcgtcgatcccgcgtgccgtgtccaggagatcccgcgacccggcgggcggcgctgcgactgcgaggctgaagacagacgcggcggcggatttattaagggcgtcgccggctcggggcctctctccgcgcgatcgctgctggcctgggccgcgctctcgaggtacatattggtggttgcagcaagctggtttctcgagatccacattgatgtggtttgttctggaaatttctattcttcatggatgctcttaagagctatgcaaagaaggctgatcttggtggtgagactctaagaccaccactagttccatcagagaagcacaatgctttccgagtgagggaagttgcatccaggtgcaaaactgatctggctgatgccactaagacaaggcgatgtacatcaccaagtcttggccggacctcagcagctgaaggcacaccagcacccaaaagagctcaatcagcagaca

SEQ ID NO: 984 - DNA, 819 bp, Sorghum bicolor
  Clone ID: SORBI-28MAY03-CLUS13602_1
gccggccgggttccgaaacattttaatttcccgtttccttttaggcgtcatccaccggcctcgtcctcaccatccacggcgcacctcccgtcgaccagcggcagcgtcaaccttctcccctccggcgtcggcgagcctccccctcgttccacgccctccccccaacagcagcggcgcagccaggttcagcacgctcgatggccctcctctagcagatctagccacaagcggctcgcctcctgaggatgcggcccgtcggcggtgcagctgcactacaaggccacgacgtggtcgcccctccacctcccctagcggatccacctcaaggctcgacccctgcgtcacctatggtgttggggctccgtcccaccatggtggctccagcatcggccggtatgacggcctttgggccacgacgcggccatctgcggctaagggtagatctggtggcgccgaccctctcccacgatccatggcaggcttcctcctctgcaggctgttgcacggcggccctgtttccctaggcaatggtcgctacggcagcgacctttctcaagtaatcttgtcatggccagcaatttctttagatctgccaaggtctttttgatgcaggtgccttcctatgctatcgtaggggctgcaacaagtatgaatatacacctcatctacatatactcctgcatggtttgttcaaggatccttttagatacaatccgattcttataggcgttatgtgccttggatgtttttttcataaattatgctttcctaatcatatttggatcccacgaattcttataggttccgatggctatattt

SEQ ID NO: 985 - DNA, 445 bp, Sorghum bicolor
  Clone ID: SORBI-28MAY03-CLUS13611_1
cccacgcgtccgaaaaggatggcagtgttgtcgcaatggtcggagatggcatcaacgactcgcctgccctggccgccgctgatgttggtatggctatcggtgcaggcactgacattgctattgaggcggctgactatgtgctcgtccggaacaacctggaggatgtgatcacagctattgacctctcaaggaagacattcagcaggatccggtggaactacttctttgccatggcgtacaacgtgatcgccatccccgtggctgctggcgcgctgtttcccttcaccggggtccagatgccgccttggctggctggcgcgtgcatggcattctcgtccgtcagcgtggtgtgttcgtcgctgctgctgaggaggtataagaaaccgaggctcaccaccgtgcttcagataacagtggaatagttttttcttttcttcagttcatc

SEQ ID NO: 986 - DNA, 819 bp, Sorghum bicolor
  Clone ID: SORBI-28MAY03-CLUS136344_1
gcacgaggccacctcgacgtgtcgaggaacgccatcggaacggtgccggagggactgcggagcctgacgctggtccgcgtgcttaacctgtccgggaacaacatgaccggggtgttccccgacgacctgccgcctctcgccggcatccaggtcttggacatctcgcacaacaacttctccggcgcggttgacgccgccaccgtccttaagttcggcaactcctccttcttccaagccggcaacgcgttgcgagtgatcgacgacgtcgcaccggcttcttcgccggcgctggcgccgtcgtctaatggcggagacatgaacaggcgtgcggtcaccatagcgctaatctcagtcggcgcaacggtgaccctggcgtgcttggccgcgtgcgccttgacgcgtcgtcgccggaacaagaagaagaagaagaaggacaaggacgggaaaacagcggtgtgggaggacgaggaggtggtggtgggggcggtgaaggtggccgcggcggcgccggtggtggtgctggagcggccgctgatggagctgacgctggcggacctggccgcggccacgtccgggttcgggcgcgagtcgcagctcgcggacacgggcggccgcagcggggccgcgtaccgcgccgtgctccccggggacctgcacgtcgttgtccgcgtcgtcgagggcgccgtggctggagttgcggaggacgccgacgccgccgccatcgaggccgggttccgggagcttgcacggctcaggcatcccaacattctcccgctccttggttactgtattgcaggtcagcttaattacacattttat

SEQ ID NO: 987 - DNA, 451 bp, Sorghum bicolor
  Clone ID: SORBI-28MAY03-CLUS134947_1
gcacgagggccgatgtcgcgggtcgtgaagatgctcaccggagacgtcgaggtgaccgaggtggtggccaagccaagctacatcactgagtggcagcgcaggggtggcaacaccagctacgttaccagcgactactccggtgacacgaccggggagttcagcacgcagagggagacgatcgcgcctctcactccgtcgccggcgatgactggaatcatcgacgacggacggtgattacaggctgctgctgggtttgatatgatctgaacggcaaatctttgaacatagttgaaccatgtttctgtgatatatgtggaacacaagtcgatttgctagattagcacgttataagaaaaaaaaaacacacttaaccaggtattagtattttgtttgaatgaatgcagagctgtgccccccttttttttaaagaaaaaaaaaaaaaaaaaaaaaa

SEQ ID NO: 988 - DNA, 750 bp, Sorghum bicolor
  unsure (1)..(750): unsure at all n locations
  Clone ID: SORBI-28MAY03-CLUS134993_1
gcacgaggcacgagttgtgcttgtgcgtgcgcgatcgagctcagtgcctctgcgcatgcaagacatggccggctctgacggcatgcagacgatgcagctcccgccgctccgtgacctctcgcgacgggccgtctccttcctgcgcatggcgcggctggcgctcaccggcgccgccactccggcacaactgctcgccggagaggaggtcgtcgatggcatcagctgcaacccgtactacaagagggtcagcacggaggacgactgggaatctgagctctggccggaggaggacgaatcggaggagctgctcgtggacgacgacgaggacgggtcaacgacgagaggtgcgtctgatctggtcggaggcggtgtcgtcggtggtccgctgaacaagaaggctcagttcaggcatcagtctactgcaacacccggcgcacatgtaacggcggcggagccggaggagccatcggagccgttgatgacgcgccgagccacgaagcgggtgaacgatgccgccgtggcggttgatcacccgttcggatgcgatcgtcaaggcagggaatcatcgtcgctgttgcttgtttcttcctagctagtctcatcgatctgactgaagaaaaataaccacctagttgtgttacttttcttttttgaacttgcgtgatgggagaagcgaaacaatgcttcttactactagcctagtttattttcnacaaaaactcaaatgttgtgcatgtcactactattatt

SEQ ID NO: 989 - DNA, 623 bp, Sorghum bicolor
  Clone ID: SORBI-28MAY03-CLUS13638_1
aaaaaagagtatcagatgatactctcatctatctatagataaaagaaagaagtagcgtgattacactgatgcagatcctctcctggacgattgatgtactattctttgatcagattatagtaagaatattgttcctagtcatccgaaaggaaataatcaaagttcgtgctttatatatataagtatgtacacatacttcatattctaagtatgtacacatattatatattgtatgtacacatacttcatactctgagtatgtagccatactacatagcaaggttctagatcgcgatattccaatgctaattatccactttgttggctgccatcagttcagaaaacgtaggtttcgcaacctgcatgaattaactttattaaattgcatatgttgcttatttggaaatcttcagaacctagctttattagtataatatcatactttcctcctttggtagaagaacaaatatatgtcttccaatttagatagcaagaattgagattactacagtatgcaaatttggattagtatgtgaaaatttttctcagggaacaaattagtatccgtgataactaggtttaagacaagtatcaaagcgatacagaataatgtaaattgtatc

SEQ ID NO: 990 - DNA, 501 bp, Sorghum bicolor
  Clone ID: SORBI-28MAY03-CLUS13641_1
catgtacatatggccgctctctcctccacctgtatgcacctccaaacccaagaacacaaataagaagcagatcggtcgtcctctcctctccgcttcccggcgaggcgatggccatcgccgaggggaagaagaggaggcccgccctgatctgctgcggcgtgctggtggccgtgctcgtcctcctcgccgtcatcttcgtgacgctctacttcaccctgttccggccgcggtcgcccaaggtggtggcgacggcggtgggggcggagatctttcccaagaacaacggcggcggcgcccaggacctcaacctcaccgtgcacgtggacgtcaccgtgaacaaccccaactacgccgcgttccggtacggcgacgtggcgacggtggtgcggtaccacggggaggacgtgggcctgtcggtggtgcccgcgggggagatcggaccgcgcgagacgcatacgatcgccgtcgccgttgaagtggacaccggcaaggtggcgacca

SEQ ID NO: 991 - DNA, 749 bp, Sorghum bicolor
  Clone ID: SORBI-28MAY03-CLUS13644_1
gcacgagggttccttattctggctggagatcacctgtaccgtatggactaccaaaagttcattcaagcccatagagaaacagatgctgatataactgttgcagccctgccaatggatgaacaacgtgcaactgcatttggtcttatgaaaattgatgatgaagggagaatagttgagtttgcagaaaaaccaaaaggagagaagctgagatcaatgatggttgacaccactatattgggccttgatcctgagagggccaaggaactgccttatattgctagtatgggaatctatgtttttagcaaagatgtgatgcttcggcttctcagagaaaactttcctgcagcaaatgactttggaagtgaggttattcctggcgcaacagaaattggattaagggtgcaagcttacttatatgatggttactgggaagatattggtactattgaagcattttataatgcaaacttgggaataaccaagaaacctgtaccggattttagcttctatgaccgttctgctccaatttatacgcaacctagatacttgcctccttcaaaggttcttgatgccgatgtgacagacagtgttattggcgaaggttgtgttattaaacattgcacaatcaaccattctgtagttggactccgttcctgcatttctgaaggtgcagttatagaggattctttgctgatgggtgcagactattatgagactgaggatgataagaaagtcctttctgagaatgg

SEQ ID NO: 992 - DNA, 693 bp, Sorghum bicolor
  unsure (1)..(693): unsure at all n locations
  Clone ID: SORBI-28MAY03-CLUS13659_1
ccgaaaatttctccatccgctcctcgcctcgtccctcctccgaaccctacccttctctccgccgccgccgccgcagtgagcatgtggtcgtacccatgtccgggaggaagaggacgcaggagctcatggaggtgaccatgatcctcggcccggccgtccgcgagggcgagtaacgtcttcggcgtcgcgcacatcctcgcctcttcaacgacaccttcctcgcgactgcagcatgttgcgggtctatccggtgggagacgctcggtcgcatcacaggtaaaagcagaccacgatgagccatgcttgcagctcaggaagatgcactgagatgcaaggagcttggaatcaccgctgtgcacattgagcttaccggtggaatcaagacaaacactccaggccctggggcttagtctgtgcttagggctcttgcgtttggcatgaagattggacgcattgtttattctatctagatttgatgtcctgttggtaatgtagatttgttacacaattgggtcgagtgacacttctcgattttttgtattctgtttatactaatactatgatcgcacccgattggcaaatcagcactacaagtgttcacctntggagtttcgttttttatgttgngagattaaccgttttgttttcactgatatttgaaacacagtaaaaaaaaaaaaaaaaaaggcccta

SEQ ID NO: 993 - DNA, 661 bp, Sorghum bicolor
  Clone ID: SORBI-28MAY03-CLUS136663_1
gcacgaggggtgaacacatgtaagatgcatgacattgtgcgtgacctggctctttcaatagctagagatgaaaagtttggctctgcaagcgatcaggctgcagtgataaatatggaccgggaagtgcgccgactatcattgtgtggatggcacggcggtgatgcaccaagactgaaatttccacaccttcgcactctattttcacttgatggtgtcacatcgactcgcatgctagcctcaatcttttctgagtcaagctaccttactgttcttgagctacaagattctgagataactgaagtgccacaatctatagggaatctgtttaatctacgttacattggcttgcggcggacagaagtcaagtcactcccggagtgtattgagaagctatccaacctagagacactggacatcaagcaaacaaaaatagagaagctaccaagaggcatagtcaaggtcaagaagctgcggcatctgttagctgacagagtggtggatgagaagcagaaagatttccggtacttcacaggggtacagccacccaaggatctctctaacttggtggaacttcagactctggagactgtggaagcaacaaatgacttggcaggccaactggacaacctgaaaaaactaaaaagtgtgtgggtttgcaaag

SEQ ID NO: 994 - DNA, 478 bp, Sorghum bicolor
  Clone ID: SORBI-28MAY03-CLUS136636_1
ttcggcacgaggcccgcccgtctccaccaccgcccgcctcgtcgcccgccgcactggcccttccgacggcgtcgaccgcatcagcagcctctccgacacgctcctccgcgacatcgtctcccgcctccccttcaaggacgccgcgcgcaccgccgtgctcgccacgcgctggcgcgggctctggctcgccgcgccgctcgtcgtcgccgacgcgcacctcctgaaccactggcccccgacgcccgccgacgcggcgcccgtcaccgccgccgtgtcgcacgccctcgccacgcacccggggcccttccgctgcgtccacctcgtctccacccgcatggacgcgtaccagccccagctcaagcgctggctccgtctgctcgccgccaagggcgtccaggagctcgtcctcgtcaaccgcccgtgcccgcgggaggtgcccctccccgacacgctcttacggatcgccaccctcacccgc

SEQ ID NO: 995 - DNA, 852 bp, Sorghum bicolor
  Clone ID: SORBI-28MAY03-CLUS136719_1
gcacgaggctggagagcaaaaccctagcacagccgcatcccatggcgatgtccatctccgtcggctgcgtccgcggcgactccggcacggtcctcgcgccgtccgcgtcctcgctccgcccgccgctccgtcgtgccgctggccccaagggtcatttttgtacttttcctcatggagcatctagcaatcacaaccggctatgcattgaacatcaaaggtgttctcggagctccacccagacctatgctctttctaggaaggatttttctcctataactcaagatgtggaaggcttccttcacaatgttgttaacatgggatttcttgaccgtctgaaattagcgtggaagataatgttttctgcaccaaccataaaggatacctcgaatgcaaacatcgcaaaacagaggcttaagatgatcctgttctccgacaggtgtgaagtcagtgatgaagcaaagaaaaagattgtggagcacgtcattgaggcattgtctgagtttgttgagatagaatcaagggataatgtccaagtggatatctcaactgatgctggccttggcaccgtgtactctgtgacagttcccgtgcgccgtgtgaagccagaataccaggaatctgaagagcagtacagagggaaaattgtcggcgttgacttcaaggacactggagaatcatcagggaacgttgatgtcacctttgacttttttgtacccaatgagaactaattccttgtgcttctgtcagagtgtggtctgaaatgtttcatttgttcgttgcgtttgtgaaccccctaggtagaaggatagaatgttttgttctctagagtgatgtaaatatgtaggattcctg

SEQ ID NO: 996 - DNA, 320 bp, Sorghum bicolor
  Clone ID: SORBI-28MAY03-CLUS136808_1
gcacgaggaacagatctctacagaggcacccgaccttcgcccacagatttgaatccctcctcacccttttccttctttttcagatatcccccaaggaacaggaacgatgtcgtctttcgagccggtggtcgtcattgacggcaagggccatctccttggtcgtctcgcctccatcgtggccaagcagcttctcaacggccagaagatcgtcgttgtccgcactgaggccctcaacatctctggcgagttcttccgtgccaagctcaagggccacgcctacctgcgcaagatgacccgctgcaacccgactcgcggtggtc

SEQ ID NO: 997 - DNA, 1011 bp, Sorghum bicolor
  Clone ID: SORBI-28MAY03-CLUS135683_1
gcacgagggagagagagaactactgggatcagcctcaagttcgagagccccagccccagtggcggcgctgctggcacgatgtcgtctgcgagatcattcatgtcgtccttgagcatggatgggagcatggctagcttggatgggaagcggccattccatttggttggcaccccggtggcgagcgacccagctgatgcccaccgcgcacccaaacggcggtgcacgggtagaggggaggatggaagaggcaagtgtgccactaccggcaggtgccattgctcaaagagaaggaaactgcggattaagagatcaattaaagtgccagccattagcaacaaaatcgctgatatacctcctgatgagtactcgtggcgcaagtacgggcaaaagccaattaagggttccccccacccgaggggttactacaaatgcagcagcgtcaggggctgcccggcaaggaagcatgttgagcgatgcgtagatgacccagcgatgctaatcgtgacatacgaaggcgagcacaaccataaccagttgccagcacaggctgcccagacctagaggatcagtaaactgtcgctccattcaggaagcgcctgggccatgcctttgctgaaggatgacctagctggtcatgttaggatccgaggcctttgaatttcgaatgcagcagcgatgaacatggatccatttgagaatttgatgagctgcttggcccctcttcttgagctacacgctgttacagatgctattgtggggactgctgccaagttgttcatctttcttgtgagctgtggcatgtagtatgattgaaagatggtgcaggaaggaaaatgcggcgtctgatagcgaccggtgagctttgtcgctgagagtctgaagggttgaaagcaaagattgacaaaaggaagtgaacaaccgcgcattgttgtaaagggtggattaggatggcagggttggcttttagcgtgcacaagttcgcttgccatgacttgcctgtgtatgctgact

SEQ ID NO: 998 - DNA, 517 bp, Sorghum bicolor
  Clone ID: SORBI-28MAY03-CLUS13706_1
tggcaagatcaaatctgttacatatctaaaaaggaatggaggaaagaggtgcaacaatcatctatgccacacatatttttgatggtcttgatgattggccaacacacattgtttacattgctcatgggaagctgcaattagcactgcctttggaaaaggtgaaagaaatgagccagttatctctcatgagaactgtggagagctggttgaggaaagaaagagatgaggacaggaggaggagaaaggagcgaaaggagaaaggcctcccagaattcgacatggttgccgagggtagtcgggttataggtgatccagcaaagagcgcagccagagttgtaaacaacgggtgggcagcaggacggctcacctcgacgatcgcaggagaggagaattttgttttcagctcgaacagcgttcttaggcaatgatcttgtttgtagtttgcttttcatttattgaaaatggtaaataacaatcttgcagatccaatagatacaccattggagctttggcattt

SEQ ID NO: 999 - DNA, 811 bp, Sorghum bicolor
  Clone ID: SORBI-28MAY03-CLUS136856_1
gcacgaggagaacactggattgctgtaaaacgtatcctgaggtacttaaaaggcactatgggttacggctgcaagtatgagaagggagctgagctaaaacctatgctactgggttatagcgacagcgatttcgcaggagactcagaggacaggaagagcactactggagttgggtattttctgaatggcagcttggtaacttgggcatctcagaaacagaaaattgttgctctatcatcctgtgaagcggagtacgtggcagcggcagcagcagcgtgtcaaggaatttggttaagccgactgattgcagactttcagggaacaaaagagacgactgttaagttactcatggataatatgtccgcaattgctctcagcaaaaatccagtacatcatgatcgaagtaaacacattgatacaaagtttcacttccttcgtgagtgtgtggaagaagccaaggtggaggtggagcatgtcggaactggagaacaggttgctgacattttcactaaggcgctgggacgagtgaagttcatagaactgaggagtgcgttgggtgtcgtcgatgtgcatctagtttagggggtgttttgttagctaaatagatgcaagttatcatgagtctgtaatagttaaggtaggggtagagattgatcgtaggcgtgctcggtcaagactcaacccgaagagttggtctggttcacgccacggctcacgcagagcgcacgtaacgcatcatcgcagagaaacggtgttgcggactttgggaggcgtggcgtggggggtttgtaaagtatcaaacctgtaaaat

SEQ ID NO: 1000 - DNA, 522 bp, Sorghum bicolor
  Clone ID: SORBI-28MAY03-CLUS13712_1
tatagatcgcatcaggaagcatagcgccggccggtcgcgagaaacaaagctgacaacgacgatatgatgccgcagctgcgtagcctcgtcgcgctgctcctagtggccacggcagtcgccgccgtcgtggccgtcgccgcagccggtggtgggtttgtcgtcaccggccgcatctactgcgacaactgccgcgccgggttcgagaccaacatctcccacgccatccaaggcgcgacggtggagatggagtgccgtcacttcgagtcgcagcagattcacgacaaggcacaggcgacgacggacgccggcgggtggtacaagatggagatcgccggcgaccaccaggacgagatctgcgacgtgaggctgctcaagaccccaggcggactgcgccagacgagtcaccgcacgggccggtcactacgcacacgctaacaacgctcatccaccatgcttcgaggcctccaccgagtctcactcactaacagcttgatcagctcaatagtcttttttttatggtct

SEQ ID NO: 1001 - DNA, 381 bp, Sorghum bicolor
  Clone ID: SORBI-28MAY03-CLUS137129_1
tcgctggaatatcagccaaacagatgttttccattttgcagaatatgaatgatgcaagatgggctagtaaatttggactggctatcatgggaagcaatggtcccgaaggaggtagaccctggatgtttgaacgaggatcaaatttttctgatgatgacccttttgcaccagttaaatttcttgaacatggccctgcctctgcgccaagatagaacaagactgcttgtggtggcacacgctgcatctgagatcttcaacctatgaagcatgcatgtgttctggttctgtaatgagtaactactcttgaagattccctcccgttcttagttctgccagcacggttagcttgagtgttgcagttagcagtaccattttgatgca

SEQ ID NO: 1002 - DNA, 615 bp, Sorghum bicolor
  Clone ID: SORBI-28MAY03-CLUS13750_1
cccacgcgtccgatcaggtattgctgtcggtgatatcctgatcatggctgatgctgatgagatccctacccctgagactgtgcagctgctcaagtggtgtgatggaataccaccagtcatgcaccttgagatgaagaactacatgtactcctttgaatttcctgtggatgacaacagctggagagcaacagcacacgtgtacaatgagcgcacatcgtatcgccattcccgccagagcaacttaatcctggctgatgcgggctggcactgcagcttctgcttcagggagattaaggagtttgttttcaagatgaaggcatacagccatgcggaccgagtgaagcagaaaagcttcctaaacccagacagaatccagaagatcatatgcaatggggacgacctgtttgacatgctacctgaggagtatacattcactgacctcttcaagaagatggggccgatacccaagtcggcatctgccgtgcatctgccttcccatttgatcaagaacgcagacaagttcaagttcttgcttcctggtgggtgcttgagatcagagtagatcagagattagctctgttttgtagtcaacagtatttcttttagctgcaatac

SEQ ID NO: 1003 - DNA, 615 bp, Sorghum bicolor
  Clone ID: SORBI-28MAY03-CLUS13791_1
cggtaatgtgcaagaactacctcaaggaccccaccatcgccgtcttcaacgacatcatgacgccaggcaagttcgacaacatgtacttcgtcaacctggagcggggcctcggcctgctcagcaccgacgaggagctgtggacggacccgcgcaccaagcccctcgtgcagctctacgcctccaaccccgcagccttcttcaccgacttcggccgcgccatggagaagctcagcttgtacggcgtcaagacaggcgccgacggcgaggtcaggcggcgctgcgacgcctacaacagcggacccgccatccccggcgccctcggcggcggcggcgccatgcccatgcccatgcccaagatgtaacgctgcgcgtgctacgacgacggcgcgcgcacgcgcttgtctgccgatctcgatagacggcggccgagctgtgtggcacgacgacgacgcgttgctcgaggacctctctgctcctcctgcggcggtcacgatggtgttaacattttgtgcggaaatgtaatatgtttcctgctcgatcaagtaatttatccctaatctgggtgaagtgttgctaattgctagtataaattaattggttttttttggtcaaaaa

SEQ ID NO: 1004 - DNA, 444 bp, Sorghum bicolor
  Clone ID: SORBI-28MAY03-CLUS13794_1
catgaagtccgtagagggttccatttgaaggagaggctgctaaggcctgctactgtgaaggtctctactggctctggcaaacaaagcgcaagctcataggaggggagcaaagatgccgttttgtgaatctgatcaaacgaccatcaggaactgagagacaaggaacctctccttttgagcaacttttctgttcataacatggcaaatgtgtttgatatcaaatgagataggtcacctatgtatggtgttgccaggaagcatcatattgaagttttgctgttatttgcaatctgctagaattttgtccaccaaaagagagtgaaacattcaacatacatactccctccgtacccataaagaaagtcatctaggacaatgacgtggtttccaaagtttaactttgactccttgtttttataaaaatatttatcaaaaagtggtata

SEQ ID NO: 1005 - DNA, 629 bp, Sorghum bicolor
  Clone ID: SORBI-28MAY03-CLUS13821_1
ctcaaccctcgcctcactgactgcggccttgcatacttctatgaggatacgagtcagagcctgggaccagggtacgaccctccagagtgcacaagctcatcaggttacgttatgaagagcgatgtctactgctttggtgttgtcatgcttcagctattgaccggtcagaagccctatgacagctcgaagcctagagcggagcagtccttggtcaagtttgtcactcctcagcttcatgacatcaacgccttggaagctctggcagatccagctttgcgtggcctatatccaccgaaagcattgtcgcgtttcgccgatgtccttgctcgctgcgtccagtccgacccagaattccggccatccatgtcagaggtggcgcagtcgctcctgcaatgcgtccagcgcagcaccagcaacaggaggctgggcggccaccgcagcgtctcacagctaatcgacgatacagattgatgatgctcctcgctctgcttctgcgtccatcttgccgctgcccagttgccgaaactgaaacagaacccaacgtgtgcctcactagtgacgccatggtacaaaaggaaaggctatattagacaatctggctgctcaaacagtgtggcaacaaacaagtc

SEQ ID NO: 1006 - DNA, 541 bp, Sorghum bicolor
  unsure (1)..(541): unsure at all n locations
  Clone ID: SORBI-28MAY03-CLUS13833_1
ttatcgtcttcctgtgtcttgtttatcttctaaatgatcctgcagtgtctgaagcaagaaaaagaatgggattaggtaaccttgaaccaacatttgagacattggtcgagtcatttgtcttcttggacaagaacaaagatgggtatgtcagtaaaagtgagatgatacaagcaataaatgagaccattggaggagagcgctcttctgggcgcataggcgtgaaaagatttgaggaaatggattgggacaagaatggaacagtgaccttcaaggaattccttttcgcttttactcgctgggtggggatcgataatgaagacgatgacgaggacgatgaagaagcagcatgagtgtgtcaactgaagattattaggcgttctgaattggccaagtcagcccctcaggaggcctccagcagcttcctcctgccgcgatcagaagtagtagctcatgttctttgtgtgacaactgccaagccgatgatagatgtttatgttcgtataaatagaatgaacactagtcgtgtnaaagaaaatttgct

SEQ ID NO: 1007 - DNA, 512 bp, Sorghum bicolor
  Clone ID: SORBI-28MAY03-CLUS136194_1
gcacgagggagagaactagtctcgagttttttgtttgtggggatcgagagaggaagagagagttcatggaggatgacttatatgaacgagattaagataagagtgtgagagagaagtagctagctagctagcaaggccgcagggaagcttgttatcggccgggcaaggtcggtgcgtgctttccacagccttatggcagatggatacacaagatgcctctttcgctgtcgtcgctttcacaccacatcttgcaccaacaacatatcaaaaccgtactgttcatcctaagttagcatgctgatcacgatctagctagtggttcagagtcaaacaagctagccacctctcatacgacgttttatagccacacatcgatcccgacatgaataagtcgtcgtcaaaatcatcatgagttcatgactttgtatcttagccgccagtcaagacgatgacaaacaatctacatctcctaagagagacgtatggtggtcgtgtagttgtgctagcagaac

SEQ ID NO: 1008 - DNA, 516 bp, Sorghum bicolor
  Clone ID: SORBI-28MAY03-CLUS136355_1
gcacgagggaagcaaccatttcctcgttgcaagtcgagatttctgaatccaaggccaaatgtgtggcactgatttcccaggcaagcagcactgaggatcaaaaccacgccgaggacatcaggcagctaagtgaaaagctcgagagcatgcaatcgttggtgacacgattgagaactctgatcaattgatctgagttgtacatgggtttttgtgtacagtacacaaggtcgtcgttctgtccaaacctggaagtggcaaaatgctgcgtcctggtggctgattgagttattcttttgtgtacatttatatatgtttctttgggtgggggtgtataaaggtagaggggggtggaataatcagttgataggcagctggaaggaaattttgtaggcagatgaagtatgctgtgtagcactgcatcatgatcaaacaggtcattaagaagagtgcagtgccatttgtatcattccatgtataaaatgtgcacagaaggttgttttttagcgcacaattttt

SEQ ID NO: 1009 - DNA, 510 bp, Sorghum bicolor
  Clone ID: SORBI-28MAY03-CLUS13849_1
gatttgcaagctcaagctcatcttctcatgcacctcagaatcctatgcttaggccttgggacccttcttttgaatcaacagtttctcccacgcgtccgccgttcaacccatcagaatatcatggacacagcagttggccgtccttagaaggatcttccatagctggaactaatggattcaactcaatggctgttcatccagaatcagtacagcgtgggaactatacatttccatccaatcacattggccattcatggatgccccatgctactaatggtattgctgatggagttccccagtgggaatatgttaatgcaactactaatattcaaggtagatttttccattcaggagccaaagtttttgctgggacatctttacagtcatatcactactatccttctgctcaatctatattgacataacctatcgttgcccagcatgcgatgcatgtcatgtcatcgcatattcactttgatcctactcaaatgcaagttccttaccaacaat

SEQ ID NO: 1010 - DNA, 843 bp, Sorghum bicolor
  Clone ID: SORBI-28MAY03-CLUS13884_1
cccacgcgtccggcacaagtggaacaaggctggagtggatgacttagttcctcagaagattgtgtggcatcggcggcctcatgacccaccggtccttgtggacggcgggagggattattatggccatgcgcctgctgtcattgagctctgcatgcaagtgggtgcaatagtacccccaaaataccattgcatgatgaagacacacggcttagcaccacctgttcgatgagaccaatatgtaataaagttgactgcctggttagatacaggaactgtatagatcagacaccaaaataattttgtttgcgattgaaatttcttgggtgcaaaagactgttctggaagaagccatcaattaaccgtaatggctagctgaggagatacgccattttgaatatttttattgttatcagaatccagaaggtgggactggaaagaaaaggttttcaggtcagtagcagacacaactattattttgaaggccctcagacagtagggaaaattttgcattgtaaaatagtagagcagcttacttcattgcccttcatttgctcagactcgtttctctagaatggaggaagagctttaggagtagcctactatctgctcttcagtgactcagctgagctacagtaatagcaatgttgtcattgtcttacatgacttcattttgccaaatcctttgatagtagtgcacctctaatgttgtacaagtttttcccagcgcttgaatttacgggcaattttgttatgtgcaaaccatgtaaacatatcagagagattgacaatattatgtattgtatgtataccctgctatcaaaagagcacaagccattctttctt

SEQ ID NO: 1011 - DNA, 489 bp, Sorghum bicolor
  Clone ID: SORBI-28MAY03-CLUS13901_1
ccgcgaccgcatctcccggtccgtccggcaggagctggaccagccgctcaactacgcgcgcgtctacctcgccgacacgctcccgccggacgtgcgccgggtcacctacctcgactccgacgtgatcgtggtggacgacgtccggacgctggcgtccgtcgacctcgcggggcacgtggtggcggcgcccgagtactgccacgccaacttcagcaactacttcacggacgccttctggtcgcacccggcgctcaacggcaccttccacggccgccggccctgctacttcaacacgggcgtcatggtcatggacgtcgacaagtggcgcgccggcgggtacacgcgcagggtggaggagtggatggccgtgcagaagcgccgccggatctaccacctcggctcgctgccgccgttcctgctcgtcttcgcggggcacatcagggcgggggaccaccgtggaaccagcacgggctcggcggcgacaacgtc

SEQ ID NO: 1012 - DNA, 350 bp, Sorghum bicolor
  Clone ID: SORBI-28MAY03-CLUS13914_1
gggaaccgaagccgccgtcgtctcttctctggatcgcaagctgcgcgcaagggagggaagaggggagaagagaagagaagaggtggtggtggtgggtggaagaagtggggcgggatgagcgcggagaggcccgtgccgcgccgggagagcccgtggggtctgcccgagggcgacacgcggcagcccaaggcacaccgctgcaacgaccgcgccgaggacgtcgtccaggcttgctttgaagggaacccattcaagacagttacctgtccattcaagctcttctggcaatgcatgcgatctaaacctgaggaggtaccagccgagccctatacctacctgcagctagatcc

SEQ ID NO: 1013 - DNA, 653 bp, Sorghum bicolor
  unsure (1)..(653): unsure at all n locations
  Clone ID: 9303565
cactcagcaacagccggacgcagccgccgccaagcagncggcggcggcggccgggaactgctccggcgagtcggcggaggccaccgccgcggcgccgccgcctccgcttccttcgatccttgagctcctcccctcgtgccgcggcgaccccgcgcctgacgcggccgtcgagaccgcggcggcagtgggaacggagcacgaggtggttgagaaggcgggcgccaggctcttcggcgtctccatcgggcggaaacgaatgcgggacgagagcaacggcggcgtgttcgaggactaccccgcgagccgcgcggcggaggtgaaggcggagccggtggaggccgcgcatcccgaccagcggcagcaggagaacaacgcgacggagccggtgccgcagtcgtggcccatttaccggcccaggcccgtgtaccacccgctccgggcctgcaacggctcgggcagcgccgggagcgaccacgacgggtccaccaactcgaggttaaactagaatgagacctctaattagctggggatttactgaccgatcccatgtaaaactccagtgcttatttggtagtaactctttgctagtttatctcataatcactgcaagtatggagtatcctttagactttgtttggatgtaatcggattcg

SEQ ID NO: 1014 - DNA, 482 bp, Sorghum bicolor
  Clone ID: LIB3480-008-P1-K1-C6
cccacgcgtccggccgcggcgaccccgcgcctgacgcggccgtcgagaccgcggcggcagtgggaacggagcacgaggtggttgagaaggcgggcgccaggctcttcggcgtctccatcgggcggaaacgaatgcgggacgagagcaacggcggcgtgttcgaggactaccccgcgagccgcgcggcggaggtgaaggcggagccggtggaggccgcgcatcccgaccagcggcagcaggagaacaacgcgacggagccggtgccgcagtcgtggcccatttaccggcccaggcccgtgtaccacccgctccgggcctgcaacggctcgggcagcgccgggagcgaccacgacgggtccaccaactcgaggtgactcgagagcttgcaaagccaatcccgtccgtctcagtaaattattacacttactaatgctagtactttatgttactacaggttaaactagaatgagacctctaattag

SEQ ID NO: 1015 - DNA, 603 bp, Sorghum bicolor
  Clone ID: SORBI-28MAY03-CLUS13935_1
acgggctgttgatcgattggctgccaattatagcagattacctggagtcttcgacagtgagattgatgaggatatccctaggctgaagacagttgcggcttcagtgctaagtgagatgggtttgaacggagcatccttatccgaagacctgataaccgaaatgtgccggttcgggggtgcagaaatccatcctgtggctgcttttgtcggtggagtcgcttcgcaagaagtaattaagctggtcaccaagcagtttgtgcccttgcggggaacattcatatttaatggaatcgacctcaaatctcaagttttggtgctataacatggatattgagcgttgtattagtgactgaatttaagttggtcgagattttgtgccagggcaccatgccgcaacgaagtctgtttgctaaacgagtagccaaatatatattgttgcaatgatatttagatgtgtgccattgtcgccaagtagctttcgcgtcccttttgtgacacggaaaatgagcccgaaataagtggttcattgagaatgccacagtgtcgtaatttatcaatacttccgtcgtatgatttgtgcaagtgcctagcaaattcttagct

SEQ ID NO: 1016 - DNA, 666 bp, Sorghum bicolor
  Clone ID: SORBI-28MAY03-CLUS1394_1
cattccccatccatccatccatctgaaggcgagggttatctcgtaccacccccgcaggccgcatccgagcgcaaacaaaacccctctccgcgccggccctccaccggcgaccgcgcgcccatggctgccttactccgcacggccgcggccctcgcgcccccgccctcgtcgccgctgcccgcacgggagccgcgtgggcgttccctgcggctcgcctgctcccggcgcgcgcccgcccgaccgctcctggcgtggctgctgccgactccgcacgtcttctgtcgcgacggggcccggttccggcgcctagccgccaccgaggccgacgaggctgcgcagacggcgacgcaggaggattcagaaaccgaagttactggagatagtgctgcagatgatggtgctggaagcacagaggaaactccatctattattgtgacaacactgcagtcatacagagaagctctgattaatgatgatgaagcaaaagctgctgagatagagtcctttttactttctatcgaggatgagaagaactctcttctgaacaaaatcactgctctaaatgccgaactagcaactcaacgagagcgtatcttgaggatcagtgctgattttgacaatttcaggaaaaggacagaaaatgagaagcttaacatgatggaaaat

SEQ ID NO: 1017 - DNA, 689 bp, Sorghum bicolor
  Clone ID: SORBI-28MAY03-CLUS13973_1
ccaaactgagattgacatgctctccaagcttcggcacaagcacctcgcgtcgcttatcggctgctgcgaggatgacggcgagatgatccttgtgtacgactacatggcacatggcaccctacgggagcacctgtacaagagtggaaagccagcactatcatggcggcagcgccttgagatcaccatcggagccgcacgaggcctgcattacctccacactggcgccaagtacaccatcatccaccgtgacgtcaagacgaccaacattctggtcgatgagaactgggtggccaaggtttccgactttggtttatccaagactggcccgacggcgatgaaccaaacgcacgttagcaccatggtgaagggcagctttggatatctcgacccagagtacttccggcggcaacaactcacagagaagtctgacgtctactcgtacggtgtggtgctctttgaggtgctctgcgcacgccctgcactgaacccgagcctaccaagggagcaggttagccttgccgaccatgccttgagctgccagaggaagggaacactacaagatataattgatccggtattgaagggcaagatagcaccagactgcctgaagaagtatgcggagacggcagagaaatgcctggctgaccatggagtagaccgaccttcgatgggcgacgtgctatggaatc

SEQ ID NO: 1018 - DNA, 681 bp, Sorghum bicolor
  Clone ID: SORBI-28MAY03-CLUS13685_1
cgctgctcagagcgacgacacagactcggtccggccgtttgcccggccggaccttgggcgatgtccacaccaagaacctcctttgcttccgatggccacgatggagaagaaccaagactcccagttgatcatgggccggtacaggctgggccgcctcctcggctgcggcacctttgccaaggtgtacaaggcccataaggtggccaccggcgaggccgtggccgtcaaggtgctggacaaggatgccgtccaccgctccggcatggcggagaaagtgaagaccgaggtggacgtgatgcggcgcgtgcgccaccccaacgtcgtccgactccacgaggtgatggccacgcggtccaggatctacttcgtcatggagtacgccagcggcggcgagctcttcgcgcgcctatcccagagcgcgcggtttccagagcccgtggcgcgccggtacttccagcagctgatcacggccgtcgagttctgccacagccgcggcgtctaccaccgcgacctcaagcccgagaacctcctccttgacgcgcgcggcgacctcaaggtctccgactttgggctcagcgcgctgcagcaggacagcggcgcccgcttccgcggcgacggccttctgcacacggcgtgcggcacgccggcgtacgtcgcccccgaggtcctcttgaagagtgg

SEQ ID NO: 1019 - DNA, 512 bp, Sorghum bicolor
  Clone ID: SORBI-28MAY03-CLUS136853_1
gcacgaggctcaacgtacacgaaggccctattggcatcggtacccgcgtccaattcgccgaggttgccctggcaccaggcaacattctctcgatcgagcctggcttctatgaggatggatcatacggcattcggatcgagaatgtggccatggtgactgaagtcaagacaaagcattcctttggtgacaagccctacctaggattcgagcatgtcactatggtcccctactgccaaaacctaatcgaacccagcctattgacggctgaagagaaggcatggctcaacgcccacaacgcagatattttccagaagaccaaagaatactttcaggatgatcctctgaccctgacgtggctggcccgggaaacgcagcctttgtaggagaataagctcagaaccggacgaaggcggcaagagtgaaggtgacagcaaaagatagtcggaatacaccattgtggaatggtcttgtcagaaaggccttattcaaccgttccttgattcccaaaagac

SEQ ID NO: 1020 - DNA, 542 bp, Sorghum bicolor
  Clone ID: SORBI-28MAY03-CLUS14014_1
gatgattgtgtatctgcaaattctagtggtgtcacatgctgccggaccattgctttaattttgatgttccttttgcttgtacgccatgtaattgtcattgtgagggatgttagcatgctacaagatgcaacggtgctgttcagtgcaactcttcagtttgcgggattctttctaccttgttatgtaatagctcgttcttgctatgctttgcagcatcggagacgaagacaggtgtagggagactcacctgaaccttaaagaacacaaaggcgtaccaattgaagcgccgcctcggcgagaggatgcatggaagcttgcgaagtgagcttcccgttgttgcttggagtcaccgcaaagcatttggtttctttcctgaaaacgtaggcggtttaattaggtgattgatgagtagcgagaacaggcgttgtgaagctcaagtgtacatacgttgagagaacaaggccttttgtttttacagctggaaggaagcaaaatgtaccctcccacgtttttactgcaaataaaagaacgttctcccctcc

SEQ ID NO: 1021 - DNA, 417 bp, Sorghum bicolor
  Clone ID: SORBI-28MAY03-CLUS14017_1
ggcggtgtgagatttgtccagattttgatgtgtgcaatgcttgtttccaaaaaggagcggggactcatcctcacaatttaacaaaccatccatcagctgctgaccgtgatgctcaaaacgcagaagctcggcaaatgcgtgttcagcagctaagaaagatgcttgatcttctggtacatgcgtcgacatgccgctctggtagttgccagtatcctaactgccgaaaagtcaagggactattccgtcatgggatgcagtgcaaaacgcgtgcttcaggagggtgtgtcctttgcaagaaaatgtggtacatgcttcaactccatgcccgagcttgcaaagattcagattgcaatgtgccgcggagcagagatctgaaggagcatcttacaaggttgcaacagcagtctgattccagga

SEQ ID NO: 1022 - DNA, 608 bp, Sorghum bicolor
  Clone ID: SORBI-28MAY03-CLUS14021_1
ctagcgtccgtctcgatcgctcgttgtctcagtctcggcttcgacggcggacatcgatcgggacatagaaaggggaaggcggacgatacgcgagccgcgagcgttgtgcgctgccatggacgcgcccttcttccacgagctcaggcgccaggcctcctcctacctcaccggcaagatccgctccgcgcggctggcgctcaccgacgtcaccccgacgcagctcatgacggaggaggcgacgagcggggacgcgtcgccgccgaacgtcaagacgatgggcctcatagcccggcaggcgttcgaggtggacgagtacgtcaggatcacggacatcctgcacaggcgcttcgcgagcttcgaccgcaggcagtggcgggaggcgtacaaggcgctgctcctcctcgagcacctcctcacgcacgggccccgcagcgtcgcggtggagttccagaaggacagggaggccatcgagcagatggccaccttccagcacatcgacgagaaaggcttcaactggggccagacggtgaagggcaaatcggagcgcgtgctcaagctgctggaacgcggcccgttcctggaggaggagcgcaagcgggcgctcctga

SEQ ID NO: 1023 - DNA, 379 bp, Sorghum bicolor
  Clone ID: SORBI-28MAY03-CLUS14040_1
caggcaacaggtccaggatgttctagaggcagcgaaggtgcttgaatggctcaaggagaactgtccagtcgagtatatcaggcgatgagtctatgatgctgctgggtcaaggctctctgaacgtgagaaagatggctggtgtggcggtgggcaattttgtgagtgaccttggtccttgccaaccaacccatgcaatgaagaatcttgcgcatagcagaccagtgcagtgattaagattttgtttctatatagcataagaaagaagtatactatattttgtaagtacaatgcgagttcacaaaagttgttttttgacggtcgttcacaaaagttgtacccagtctttaagaggttgtaatccacattgccccagatcaaa

SEQ ID NO: 1024 - DNA, 599 bp, Sorghum bicolor
  unsure (1)..(599): unsure at all n locations
  Clone ID: SORBI-28MAY03-CLUS14060_1
ggcgcggcaggcgcggcgctggtccaacaccaggcgcaaggactgccagctgaagcgcggcggggacaaggggcagagcgtgttcaggagccacgacgactggaacgccaccgccacggacgccatccaagagtggagcaaggaggaggccgtctacgacaagcaaagggaaaaatgcctcggcggcaggacctacatggagtgcggccacttcgcgctcatggtcacaaagaggaccgccaaggtcggctgcgcacgcgcagagtgctaccagggcggcgtcttcatcacatgcaactacgccgccgcagccgacactggtaccaaggacaagaaaaagagcagcagcaaataataaatcatctattacttaattgtgcctgatcgatcgagcctcactcacaccacgtacatacccacctatcgcattgcattgcattgtattctacgtacgtgtttgtatacggtctnttacaccacccacccacccacctaatataagtacgtaccaactcgatcaaccccctccatcacctacatatatactctttccacatccaccaaccacccgngtatgtactattttatatataatatac

SEQ ID NO: 1025 - DNA, 472 bp, Sorghum bicolor
  Clone ID: SORBI-28MAY03-CLUS14064_1
cccacgcgtccgcaagtagataggcctgtctcttctcagaagaaggagcagcaggaggaccacggaagaaagcacaaaaggatccactactctggaccattgatgccgccaggtgggaacatcgaagacatgctcaaggagcatgagaggcacatccaagaagcagtgcgcaaagcacgcctcagtaagggaagcagatagctaggagaacatagagcaactgaaggtcctaggagaagatgaaccagggttcgatggtgcggctggccgttttagcactacgaatgccaacatagcactcatcagcaaagctgccatatcgagatgctgcaagagctgtcacatgtaacatggtcaggctataccattgaagattagtaagatggaagcatcataatataacagagcatgagtgaattacatcataaagatcaggaagttcataggtaggataaccctttaatattgatga

SEQ ID NO: 1026 - DNA, 657 bp, Sorghum bicolor
  Clone ID: SORBI-28MAY03-CLUS14074_1
atgcccggggtgacgatgtcatgctcccggaggttccatatgatcagttccgtgctgggtcgcagttctttgtgctcacgagaaggcatgccatcatggtcgtgagggatatgcggctttggaagaagttcaagttgccctgtctgattgagcgcagggattcatgctacccggaagagcattacttccccacactgctggatatgcaggatcctgagggttgtactaagtataccctaacaagggtaaactggacggattcagttgcaggacacccacacatgtatgggcctggagaagtatccgcgagcttgatcagggagctaaggaagtcgaacatgacacactcttacatgttcgcccgcaagttttctccagagtgccttgagcctttgatggagattgcagacaaagtcatcctacgtgactagtctgaagcaaccaccatttgacggtcggagtttgtacactgaaatgaatgagaactgcctctatgcacttgctgcatcctctctgtaagaattaatcttgctactttctgttgtgttgagagaaatgtctccaaatggagtgtacatagtacggaatgcgagagtattaggctgttcagtaatctgtatgcttaacctttccataataaagcggcatactacatta

SEQ ID NO: 1027 - DNA, 610 bp, Sorghum bicolor
  Clone ID: SORBI-28MAY03-CLUS14088_1
actcaggtcagagcagtcacttgtgcggtgggcaacaccccagctgcatgacatcgatgcattggacaggatggtcgatcctgcactcaagggtctatacccagccaaatctctatcccgatttgctgatgtccttgccctgtgtgtccagcctgaaccagaattcaggccaccaatgtcagaggtggtgcaagcattggttcgacttgtgcagagggccaacatgacgaagagaatgcttgatggagatacttctcggcgaccagatgaccaggaccaagatttcatatgacaagctgaactcgagcctttcagctacttctcagattgtatttatttcgtttgactagcacccagcagagagataatcacacaagtggaagaaacagaactttgtcagcttcgccagtaaataatcacaggtttttcttggtagaaaaggagttgtgctctatggactatggttgatggttgtattgtgtcaccgaaatagtaccttcatcttacactaatgatattctgtatagtgtcaactgtcaagtttgccgaatgttaaaataatcaagtagtacagtgctgctgatacaagttgcacgatgagtagcaaaaa

SEQ ID NO: 1028 - DNA, 549 bp, Sorghum bicolor
  Clone ID: SORBI-28MAY03-CLUS14094_1
aatgacgtgaacaggtggtgcggtggtatgtatgtttgttttctgcgccaccaccccaccgcgccacgacgcaccgctcctgaacgtgccgccgacgccctgtcgacgccgcgcacaccgcctgccgcacgccgccgtcaaccccgcgccgcgcgaccttgcctcaccgagcacccgcacgccgccaccacaccgccgtcgtgcacaccggagccaccctcgccgcccgccaagatccctgtagcatcatcgttggcgagccacttcgttccagggggtcgctttcgcgaccaataatctacgtgcggagtcggaggaggatcagactgacgaggaccgtgagtatctggaggagttaggcgacgactactccgaaggttcttatgattccaagggatatagcgactaggggattcgtgccttcgatcaagtagatggagtttctaccttccgcatctatcgagctgttccgcctgataatatagattttgtttctgccatctagcaatgcaataatgaaatattctctattcctaatgcttttgcatg

SEQ ID NO: 1029 - DNA, 466 bp, Sorghum bicolor
  Clone ID: SORBI-28MAY03-CLUS13834_1
gcacgaggctttctaatacttttgtgtgttgttagacgttctgcttttaaaatcacattgagatacctaaatttacttctcaaattgctggcagctctagctcatatgagatacactgatttagctgtacctcacgtttggcccatttgatcagcaaggtcacttcttgctggtaattgggttctgttcaacagcatgggcattttgataagttcttgctttatgaaatcctcacttggtaccctaatactaaagaatgcataggacaaatgtttgaatggttctgatgaataatgtggttctgaataacaaaaattaaatggcaatagcatatgcttcttaggctggttatatctatcatctgttctaaaaccatgtgttttgtttcagacaatattcttatgttttttcccaccatatatatactgagcaataatgtttggttttcctaattgccatatgctag

SEQ ID NO: 1030 - DNA, 508 bp, Sorghum bicolor
  Clone ID: LIB3480-057-P1-K1-F11
gaagaagagaggtgtcgatcgtcgatcggtcggccggcggcatgcattggcggaccaccatggcgcggcgagcggcggcggcgtcgacgacgacgaagcctctgctcctcctcctcctcctcgtgtccgcgctccttgcggcggcgccggccgccgccaacgcgcctggcggggctttcagcaactggatcgtgcagaaccagcagagctacgcgctgtacgcgcagaagtccgccggcgacgggggcaaggagcccatggacaagagcctgcaggaggcggaggcgaagaaggtgacgtacgtgatcgaccccagcggcaacggcgactaccccaacatcacggcggcgctggacgcgatcccggagagcaacactaagcgggtgatcctggacctgaagcccggcgcggtgttccgggagaagctgttcatcaacatcagcaagccgttcgtgacgttcaagtcggacccggcgaaccccgccaccgtggtctggaacgacacggg

SEQ ID NO: 1031 - DNA, 313 bp, Sorghum bicolor
  Clone ID: LIB3480-012-P1-K1-G3
ggcccccctcgcctcctaaacccttcacgcaccatctcgccgaggaccagggcggccaccacctaccccgcttcgccttcattcgccaccaccacctgcgtcgccggcaacggcgactaccccaacatcacggcggcgctggacgcgatcccggagagcaacactcggcgggtgatcctggacctgaagcccggcgcggtgttccgggagaagctgttcgtcaacatcagcaagccgttcgtgacgttcaagtcggacccggcgaacccggcgaccgtcgtctggaacgacacagaggaggcgcgctcgcgcg

SEQ ID NO: 1032 - DNA, 389 bp, Sorghum bicolor
  Clone ID: SORBI-28MAY03-CLUS14167_1
ccaaaagggaaagcacggaagcgattcggtggggtacgatgccaatggaaggttcgttcctgaaaaatttgaggagatcttcaagaagcatgcccacaccaggcctgatgccctgacgggcaaagagctgaaggagctgctcaaagcaaatagggagcctaatgacttcaaaggatggcttggtggtttcacggagtggaaggtgctctacttcctatgcaaagatgagaaaggttttcttcacaaggacactgtcagggctgtctatgatggcagcctgtttgaaaagttggaacacgagaggaagtctaagaaggagtctactaagaagaaatgataagagcatcgtcatgttactcgctagtgtcctgaagaatttggtaaatcgc

SEQ ID NO: 1033 - DNA, 726 bp, Sorghum bicolor
  Clone ID: SORBI-28MAY03-CLUS14186_1
gagagatttagagtagaaattgacagggtgttgggggagaacttgaacttctggttgaggtttagcacatcatatcatcaaatacgaaatttccaaatatcctttgacatgttgaaaactgagatgcacagattgactgatgaacaggaagatggggacacttaccgctttgctggtagttatcaggtagcaaagttggaatcagcagtactggaaaagaaattgagggatctaaatacagatcttcaagtttggattgaaaagaacgtgctattgaaaggagaggtagagaacagattttcatcactatgcagcatacaagaagatatatcaaagatcacaactctggataaatgtgatgaagttcacttcaatccttttcaagctgcgaaattccaaggagaggtgcttaatatgaaacaagagaataacaaagttgctaaggagctagaagctgggctggaccatgtaagaggccttcaagtggaggttggaagggtgctcttgaagctcagagagaatctcgaggtatctatagcaagaagccaccgagcccaacaaaacttccggagcctgtcaacaaaagccggggttccccttaaaacttttctgtttggctcaaaaggcaaaagaccatcactcttttcatgcatgagtcctggggtgcctaagcaacacaatggttcaagggctgggcgtaaatgagtacctgtaatttggtttttg

SEQ ID NO: 1034 - DNA, 621 bp, Sorghum bicolor
  unsure (1)..(621): unsure at all n locations
  Clone ID: SORBI-28MAY03-CLUS14218_1
gccggccggttcgggatgtggtttgttgcagcaccaaaatccatcgcgtgtgtgttccttgtgtacatacattgaaggtgatcttcatcgactctggattcagccgtctcctgccccctgcaggcgtgttagaaatggagatgacgagcaaagcaatggcttcaggtctcctcgttttgatgcttctcatgaacatcggctttgtgctacctgtccgggcggactgttggagcgagaccagcgacgtctgcacgaagacgcacaattgccggagcaactgccaggggcgtggccaggcggacgggaagtgcaagtgggagttccccgacctggtgcccttttgctattgcctgcgccccaactgcaatccctagtcggggtgcttcggattggttcgtcagcaatggggaaacgagtaacagcccggtagagagtggtagtggccagtatgttccatgcgctgttttatatanggaaaaataaacggncaacattcaggtatagtaaaacaaattttacatgtattttttcaaggttttgttacgatactccaaaataactatatatgaatcgatgatctaaacatcttttacgaaaaaaaaaaaaaaaaaagggccccta

SEQ ID NO: 1035 - DNA, 618 bp, Sorghum bicolor
  Clone ID: SORBI-28MAY03-CLUS14237_1
gcaggacgacctcaactacccgtccatcaccgccatcctcgaccagccgcccttcaccgcgacggccaaccgctccgtcacgaacgtcggcgccgccagctcgacgtacaccgtggaggtgaacgtgccggagtcggtgacagtggaggtgaacccgacgaagctgactttcaaggcgctggaagaggtcttgaactactcggtcacaatcaagtcagccaacggccgggcgcttaccggccctgtcgagggggagatcaagtgggtctccggcaagtacgtcgtgcgcagcccgatcctcgtcactaccggagccctcccgtccgcggcggcgacacgcaaaccctaacactcgatcgatagcagctggagcgtttgagatcgatgtgattgtgactttgtgagcttcattcacttttgattcggtagactaaattaggcatgcagatgcagagctgaatccctccctttgtggaagtgagagatacatgatacttatttttatatatttactattaaaaaataaaatagctgacgaatttacaagtttaacaatgtagatcttctatcttgtctcttgacgctgttaaacgtggtggttcaacccattaacaatgt

SEQ ID NO: 1036 - DNA, 718 bp, Sorghum bicolor
  unsure (1)..(718): unsure at all n locations
  Clone ID: 14328404
tacaggagctgtttgagggaataggccaggttggaaggatcaagcaaaaacgtggttacaaagatcagtggcctnggaacataaaaatatatactgatgactctggaaaagccaaaggagatgcttgccttgcttatgaagatccttctgctgctcactcagctggtggattttacaataattatgacatgagaggctacaaaatcagcgttgtgatggctgagaaatcagcacccagagcagcaccctcttatgggcatggcggtggccgtggtggtggctatggtggtggtggacgcagggatagttacagagatggtgggggccatggacccaatagaaaccagggtggtggttcgcgttcgcgaccatactgaaaacaatgaatattgttactgtgattgtcgtctgtgaaaccttgcacatttctattcctgttctacggatttgtactcatacaggcgcataagaggcagatggatataagctccaaatgctggtaggtttgtgatgttatttcagccggtggatcactcctgtaagctttggattttgctgcgaggaacaggtagggcggttttgttctgtgataggtttattagatttcgtgttttttagaggacatatcagccaacattagaatgctccacatccatttttgtttgaatggatggatgggttttaacttagactgtagcatgtacttagcttaggttgc

SEQ ID NO: 1037 - DNA, 344 bp, Sorghum bicolor
  Clone ID: LIB3480-014-P1-K1-A5
acaacatagatcaatcacttttggacaaacaaaagtccgaccaagacacagtatgacaatttaacataagtccaataaggaaagcagacaacctaccttatgcgcctgtatgagtacaaatccgtagaacaggaatagaaatgtgcaaggtttcacagacgacaatcacagtaacaatattcattgttttcagtatggtcgcgaacgcgaaccaccaccctggtttctattgggtccatggcccccaccatctctgtaactatccctgcgtccaccaccaccatagccaccaccacggccaccgccatgcccataagagggtgctgctctgggtgctgatttct

SEQ ID NO: 1038 - DNA, 665 bp, Sorghum bicolor
  Clone ID: SORBI-28MAY03-CLUS14241_1
tggtgggaaaaattgttgaggaacctgttcaagtgacagagaccctgaattttgattacaccagacctagcccaatggcgcttgtgccagtgccgcggttggtgcccccgaatcagcggatgcagcttgaggtatcgctgacgctgccagagtctgattacaaccggaggcttggtgttttccaggtaaaggcagagtttctctccgctgatggcaaagtgatgtcaacttcaagtcaaccatgcatgctcaagttcaagagtgtacacatgcacttcatagagacttttctccaaagtgtttctcttttgtcgggctactcatcagaatctcaggttattagactaaaaatgaggggtatcacccaaggtttggaaccaacaactgcggtaaggataatcctagagcaaagagcagagtttggtcgtggtgcaggcattccagagatatatgctgcatcactgaagcttgaggctgaacttcctcttttcaagagattactctggaactggagatggacccttttcgtttggagcagcatggggttctttgtttttgaattgttgtttgcacttgtgtgctgtagaccttgtatatttcccaggagtggacataatgttgctgctccttgagaccttggactaactcatgtaatgtaattacaa

SEQ ID NO: 1039 - DNA, 832 bp, Sorghum bicolor
  Clone ID: SORBI-28MAY03-CLUS14271_1
caaccatatccgaagatgaaattctgaacgacaatagtagtaaccataagaaatctagacatgaagttgatttggaagttgatgaagcaaatgatgcgggctctgctgtagctgaccttaatgggaaacatgaaactggagtagatggctctttagggggcgctgcagaatctgctatatgatggcagctgtatcattcagttggctgtttacagattgattgacgatggagaatgctgaactggtgtttattatctccctttctgatttaggagttttatttgcagggtatgaagatcttcggagaacttgagtgctgttcggagtgctcatctgatatattaaaatgtattcctcattaactcgagttttgctccttggagcaaacttctaaatgtaacgccggagcttgtaaggagatttcatacagtgaggtagaaaccaaccatatatttgtcgtttcaggctcatgattccatgaagagttgttggagcacatttctgggatgtcggttgaagatacaagggagtgcacacttactcaagtaaagtccatatacaaggctataaacaactcatcttctaggctgttgcatttgaattcaaatgctttggctagtaaaatggtccaaatatgcttgtctacatactgcaaacaccttctgatgcacttagtttgcctgaagttctgtttttgtatcttgtatcagcaatggttcaaaagtttgacttgaccatcttttgacagtcacatggaattgtgatgtaggttttatctatcatcttgtctgctgcttaattttgaccagtctatctaaagttgatacgagta

SEQ ID NO: 1040 - DNA, 637 bp, Sorghum bicolor
  Clone ID: SORBI-28MAY03-CLUS15806_1
ccgggaaaaaaaaaaaaaaaccaccccacctccatgccacaatcctggccagactccgcaggcgcacgccttcatcctcgctcgagccctcagcttcacgcgcgatcagccaccgacccaccgttgtccccatccaccgctcccccatctccgccctcaccccgtcacctgccagggtcttgcgccatcctcgacgtcgtgggcggtcccgttgtcacgcgtgccttggacgccgtcatccgcatccgccgcttccccgatgttgcctcacccgccagggtcttgtgccatcctcgttgttgcgggcgctgccgcctcaccaaccgatcgatggggagacaacgctcatggacatggcaagttcgtcgagatccatgaccatgacctcaacttctcagatcttggcaacagaagaagtgaggagatctatgatggcatctcggggaagggagaattgatggagtctgtgtaggagctacaccaggtgcccttacgaaggggagatcaattgtgtgcaacggcgaaggtgcaggcgcaggtcaatgtgcttctttttctcactctacggaaggtatgtaaccaaaatcgtccttttgtagctcaaataaatctcttgatggaggcgaatttggttttt

SEQ ID NO: 1041 - DNA, 888 bp, Sorghum bicolor
  Clone ID: SORBI-28MAY03-CLUS13961_1
ctggatgcaaacttccgccgccgcctcttgggtcccgacgacggcgagctttttggcttcaatgacctcctccggctcgtcgacgatgggcggatctggtggccaaagtcgccgggcggcgcaagacgcaaggccgcgcaggcgggcgtgaggcctctccccacacgcgatcctcttttccccttgcggccaccaccattcccatgggattgggggtacgtgggatggagtctaagcggaggaagcgcctccgggaggatgctcgtatgtggcctcgactccgcgacagtaggtagcgcagctctctgacaccctcaccgtcgtgcaaaagctgtcagtttgaatggcaagcaagacttctacacttgcgtaggagctcaagaacatcaagtcagaactgcacttcttgcagaggacaggcgcggattgctagaggagaactagagatcaaatagatgtgacgatggagttgccccctgaagaagatggcttggtagcaatgacgattgcttctgcattggaggaccagataaatttgacacactaattgctgcatttcgtatagtctggactctctacctctggatatgtggtctttcactcattgtctgcctaaagtcaagtttttggcaagcttccaaaatttgatcggtgtggtacaaccttttaataattttatatccacctcaacttatgtttgtcatatgcactgttacgtgtttctgcattcaagcactccattctgcgatccaattgttatggtgcctgacattttagacaatctttttggattatttctttgtgtttgcaaaaagattatggtttgtgtaaaatgattcgtttctgctatgatcctggagagtatgactgtaagccacaagagctatt

SEQ ID NO: 1042 - DNA, 711 bp, Sorghum bicolor
  Clone ID: SORBI-28MAY03-CLUS13979_1
tgcaagggacctcattggtatgcttcagaggattgatggtgacaactatccagagaccctgtgccggatgttcatcattaatgcaggccagggattccggcttctatggggcacagtgaagagctttcttgatccaaagaccactgcaaagattcatgttctgggtaacaagtatcagagcaagcttcttgaggtgattgatgctagtgagttgccagaaatttttggtggaacttgccagtgtgaaggtggttgcatgaaggctgataaaggcccttggaaggatcccgaaatcatgaagatggttcaaagtggtgctgggaggtgtggatcacacagtatgtcctcttttgaggttgaggagaaaatgatttgtgaagatgacatgtatcctaagaaacaagctttattcgatgcggaaacacaattagctggagatggtcagcgttctcagtcacagaaaatttcccgtagccgaattgaacatcctcagttgtcacctcttcacgaggaacttatgcccacttcacatcctatccctggatcaccctattcttgtgatgtcccaatggttgaaaaggccatagacgctatctgcaagagccagggaacaccagcagatgagaagcttgccatcaccaaagctattataaatgcctctaatgaatccaagcccccaatctatgctggcatcatagcacttgtgatgag

SEQ ID NO: 1043 - DNA, 438 bp, Sorghum bicolor
  Clone ID: SORBI-28MAY03-CLUS14300_1
gcacgaggccatgttctactacgagggcgaccaggacaagtccgtcgggaagaggctcaggaccgccctcatctgggtcttcgcgtccgcggtggtttgcggcctcgtcctcggtatcctatacggacttgttggtaaagtggacttcactgtcaggcacctatcttcaacggtccagacatttccaaactcattttctggattctcaagtggccagccttgctttagtcaattgcctcgtgtgtgtgcagcttctactgcaccggctaactcgcaaacaacttggacaatgcgtgctaccttccctgaatatgtggttgctcttactacaatcgttggatctgtgcttttcacgatatttggtggtgttggaattgcctgccttccattgggacttatattctcatttatccggcgtccaaaagctgtaattacacg

SEQ ID NO: 1044 - DNA, 711 bp, Sorghum bicolor
  Clone ID: SORBI-28MAY03-CLUS14317_1
gccggccgggccgggatcgcatcctattgctctcctctgctcggccggcgaagggaaggggatcgaatcgaaatcgaagcgaagcagaggggcggcgatgcagatccgcgtgcagtgcgggtgcggcgagtcgtcgtgcccggagtgggccgtcgtggagctgcagggcgtggtgcagccgcaggcctccttcgccggcgacatccgcggactccacatcggccgcctctgctccgccccctccccgtcctcatcttccaaggcagggtacaccttcacggttgggtaccacgagctcgccgggaccaaggtgacgctcaagaagcccctgctggtgctccggaagaagaaggtgtatgctggttgtggggaacaagagccaccggcggcggcggaggaggtggagctggaggtgattggcatcatccggcacaagatcctcttcaaggaccgtcccaaggccctcatctcaaagccgccaaccaaggagaagaagaccgtgcagccagcagcaaagtgacgccacgccagcaacttcatgccccttgagaatctgaagctcccttggtttggctgtgtgttccctgaatattgccactgttctagttatgactgggtttggtgatacgttgtccgttgtaccagtttaacgatgtttcctccaaaaaaagaggttaaggatgtccaaaaaaaaaaaaaaaaaagccccta

SEQ ID NO: 1045 - DNA, 727 bp, Sorghum bicolor
  Clone ID: SORBI-28MAY03-CLUS14343_1
gcccctccatcataccacaccatgtgatgcgaggagaggcctcctcttctgcctctcatccccctccccctacttccaagatgcaatcatgctgccccaagctcctcgggccctcggccgccatgattgcctcaccgcctcctcaagagagtcgcctccacctacttccaagaggaagaggccggagaagctatagtccatgaagaaattcagcggagggccggcagcgtacggggccggggccggccggggcagctatcggaggagagagagagagggagatggggaggtgacagaaagctagagagagagagagagagagagaggtgcatggtgcatgatgatggcgtggttgatctcttcgatctactctagtagtacatctatcgttcgatcgagtcaagaagccatcatcagatcggtgcagttctccctccctcctcctcctcctcctcctcctccttctccttcttccttccaccagctcctcttcagcttcgtctttgtaacactgcgtcgccatggctttggggaatcaagcgtcttggtccgaaatcatccgtgtcttctttcctagctaggatctacgtacttgtgaaagagtatgtcatgctatatgctatatatgttattcctacatgttcttattctcgatctgtctctatatatgggttgtgcagacagcaagattcgtttgtcttttgattgatttatttcagttcgagcg

SEQ ID NO: 1046 - DNA, 613 bp, Sorghum bicolor
  unsure (1)..(613): unsure at all n locations
  Clone ID: SORBI-28MAY03-CLUS14358_1
acagtatggaggaatgtatccgccagtgcaaggcaaccaaccagcaggtatttatccccagcaaatggctggagatgtctaccagcaacagatgtttagtggccagatgacaggctatggctatggtcagcagcctggaggctactacgttccgaacgccgcatatgcatatgccagtgcaaatgatctttctcagaggatgaatggtctctcgatgcaagacaacagtctgtatggcacacccgcgccgtcttccctccagcagcgtaacaggccaagtagacctgaagattcgctctttagtgatcttgttagcattgccaaaacaaagcctagtaaatctgcgtccaacaaggctggtaacttgtaaagatgagtcggtgcttacaagttccatatgggggtaccttctcatagtatataaattcttggatttttttttacttatttgaaagtggtaggcgagatttgtagattctgagattgatagcgattgttttttcaagaaaaagtttgtttaccatcattctgtagccttaatgtcttgtgtacatataaatggagggaaaaagaaaaaagagaggagtccagtatgctgtctctcctggtnnaa

SEQ ID NO: 1047 - DNA, 514 bp, Sorghum bicolor
  Clone ID: SORBI-28MAY03-CLUS14370_1
gcacgagggcgtctcgtgtctcacaacaggccagcgctggagaacgcgacgaccaccgcatcggccgtcctcggcgaccacgacaccgccgccggcggctgcggccacctgctgctgctgcccggcgtagtgcagcgccaggctgcggcagtggctggccacacggcgttcagcgacccacgcagcgagctcacctgcaacaacaacaacaagtacgacgccacttggtccgtcgtcgtgcccaggaagcgcgcgcggatcggcggcgcggtggacgccgccggcctggtcatggaggggcaccgccaccgcgcgctgctgcccgtgccgcaggcgttcgcgcccggcggaggcggagagggtgcgctgggcggcggcagcagcagcagcagcagggtgctctgctccggcgccgcgtccaccagcggacgcccaagcaccgtcgtgccggtgtcgcagtcgcagcacggtatactggcgcacctttactcgcacagcttctaggtcgacgcgc

SEQ ID NO: 1048 - DNA, 972 bp, Sorghum bicolor
  Clone ID: SORBI-28MAY03-CLUS14378_1
ctatatatagaacgaaccttccacctcttatgctagcaggataacagacaccagctatactattcctttatgtgatcagcaagctgaatggcttaggttatctttcacttcatatcctgcgcgaaactgttgcttctctgcagctgcgccaatggcacattgcacatgactatgatggccaggcgagggaacttaattgtaaatcaatatgccatagcccaatgtgccctccttattcagcgatgacagagtgtcagcctatcgctctttcagctgacaaaacgcatctggtgtttgagacacgcccacaagttcatgatgtctcatttggttccttcttcgaggtgcattgtaggtggtctgtgaaaactatcagttctagctcgtgcagtctcaacatcagtgctggtgcgcatttcaagaaatggtgcataatgcagctctaagataaagagtggtgctgtagatgagttgaagaaagaagtcaaggaaatgttagactttgcacaggggtatatgctcaaagttaggtctcctgaccaagagaacagtaatctcgctcaacaagacaacatggcgccggatgcgcctcctgatttagagtgacagccgccatcacatgacaatgaattatgatgttatacacagaaggccaggtggacctgtaacgagtccacatgaaccacatctaacatgttaagctgacttccaaaagaatgggtggaccgtgtagcgtgtaaacttcttctcctgtaatttctctatccattctggcagtttggctgctgtatatagttgtaaaaacacgtaatatatagtgctgactgcggacaggtcactgtgtggtgtttgaagataaacaaagaaagaaacaaaagagaaatatttgcccccagaaccatcagaacttgtgcagtgtacatttctgtagtcacagggcctatgttgtacaaataaaagttcacttttcct

SEQ ID NO: 1049 - DNA, 885 bp, Sorghum bicolor
  Clone ID: SORBI-28MAY03-CLUS14391_1
gcatttttggatgcttttctcatactctggattttcacatctctttcccgcactctagagaaactacaggcaaggaggagttctgtgaaattggatatatacagaaagtttacaaatgcattggctgtttctgtgatagcttcagttgcctggattggttatgaggtctatttcaaagcgacagaccccttcagtgagaggtggcagagtgcctggatcataactgccttctgggatgttcttgcgtttgtgttgcttcttgtgatttgttatctgtgggcaccatcccaaagctcgcaaagatatgcatattcaggtgaagctgctgacgatgacgatgaggaatcccaatctctgacaaaaggagatggtgaagtagggatggtaaagattgacaaggacagaagtgctggtgttagcggtgctttcagcttagatgatgaggctgaggaggacaagcgggaatagcattttcttgttcctgatgcccaggtcccagaaacaattgatattttggagcaataatgttccaagaatacttcttttcctgtctaatttttggcggtccagtctccaatgcccatctgttccaaagttacatatggtggttgtagaagtgctttggtggtctagtctccaattcctttctgttccaaagttacaggttgtagaagtctccaatgcccttctgttccaaagttacataaggttgttgtaggagtgcgcgattatctccattcctgtgaggtatatggttctggcttgatgtagacctcagataggccaaggtgttgcaaattatttataacaatgtacataactgttttgtttgccggttttacattttctgatgcataatcacatcatgcacgaaattgttgagcg

SEQ ID NO: 1050 - DNA, 1003 bp, Sorghum bicolor
  Clone ID: SORBI-28MAY03-CLUS14430_1
gccggccgggccgggtttttgagtagtgctgccccttcctcctcttctccattgtcgttgcttctctcacgcgcgcactgtcatccctgtgactgcgttgggagcgcaaccgtgtgcatagcagcccatggacgataaggagaaagagaaagagaaggagaaggagaaggagaagcacgccgacgggaccgacgttgaggaggaagaagaggatgaagaaggtaacaagcgcattgtcgtgcttggcccccaggtccccctcaaggaacagctcgagctcgacaaggatgatgagagcctgaggaggtggaaggagcaactccttggccaagtcgacacagagcagctgggagaaactgcggaaccagaagttaaggtgctgaacctgacaatcctgtcacctgacagaccagatctcgtccttccgatcccattccatgcggacgagaaaggctatgcatttgctctcaaggatggcagcccctacagcttccgtttctccttcatcgtctccaacaacattgtatcaggcctgaagtacaccaacactgtctggaagactggagtaaaagtggagacccagaagatgatgctggggacgttcagcccccagttagagccctacgtctacgagggtgaagaagagaccacccctgctggcatttttgcaagaggttcttattctgctaaactaaagtttgttgatgatgatggcaagtgctacttggagatgagttactactttgagattagaaaggagtggccagcaggaacccaatgatgtggaccaagggtactcgtcggagtatgttagagctcatagctaagccaagcagaaaatgtgctattgcttcaagaatgatccattcactatttcttcacctttaatcgcattttaatttaatttgagttgtcattggaatgtgtttatcgcaaaaaaaaactttttatttgcatataataatacctgtatggagatattaagagataattattgtagtgt

SEQ ID NO: 1051 - DNA, 544 bp, Sorghum bicolor
  Clone ID: SORBI-28MAY03-CLUS1412_1
gcacgaggctcagcctcgtgcatccagtgttgtaggaaattttggtcttttggcaaaggcaagccagccagagccagccatgaaaccccctcagctgcaggccggggagggctcctgggctcacgaggtcaagcaggccctccgtgagaaactccggcgctcctacagcgccgccagcacaccggcggccaggccggccggcgaaccgagccgtggtggcgctgactgccgcggctcggccgccgaggaccccataaggagagtcatgttcttggctccctggggtcacacataaaacacaaaccgagatctgggtttgcaacagcatggccgcttgtgtggccgtgtcttggtcagatctgcaaggaactgaaccataaaagaaccggagcttgtcttgtaaattaacatgaacatgaactaggtacatatggatatatgggtatgatgatgtgaaaaaacaaggtacgtagtccatgtctgatgttggagacgttgagttcttgggaagttcatgcatggcatgggtcatgggtgtgggttc

SEQ ID NO: 1052 - DNA, 630 bp, Sorghum bicolor
  Clone ID: SORBI-28MAY03-CLUS14163_1
gcgcagacgtcgaggtcgagagggtcgaggagtacggtagctcggagcttcgtcggagagcgacccgccaccgccacgcttgaccgcaagccgaggaggccggagacacagacgatcgatccatcgtcggcggtgcagattcggtaatggcggagacggcggacatggagcggatcttcaagcggttcgacaccaatggcgacggcaagatctcgctgtcggagctgacggacgcgctgcggcagctggggtccacctccgccgacgaggtgcagcgcatgatggccgagatcgacaccgacggcgacggctgcatcgacttcaacgagttcatcaccttctgcaacgccaacccggggctcatgaaggacgtcgccaaggtcttctgatgcatgcatcacatatcatcatcaattcgataccaaccatcgatgatcctgcttacatatatatctttataatatctacgtaccattctccagcttcatcaacatatcatttctgctggcctgcctagccggtctcttataagcactagctagtactaggattttttttattttaattcttcttgaattccaatccaatccaatatatggggacttcggtttatttcctttaattggtttt

SEQ ID NO: 1053 - DNA, 683 bp, Sorghum bicolor
  Clone ID: SORBI-28MAY03-CLUS14471_1
cccacgcgtccgcccacgcgtccgcgaaagttggaggggtgaaacggactttgtctgctctaatcccttcaaagtaaggcctttcctcctccgttgtgtagcgtatactgctgatctcgccgctccggttggtcttgaccccaacgaccctctcattgggtctaggtggaaggatcctcgtgccggttggcaccttgatggtggtcttcatcttggatgatgatccattgaggagtaggggtgcggtgagaactggttgagcatgataggattgggcggagctgcgttggcgtaatggcatggcttctagctgtcgctctgtgttagccgggacgagagcacgggcatcggggtcttccgcaagctccatgttggggttgaaggggacgacttcccaatcatcgtggaacctctcggccattggagcagcgaggaactaaacaagctctaattgaagaagaacagaaggcttggatagattggtgtttgaaaactgatgtcaggggtctgtttatataggggtcaaaaagtgcctctaggggttgttcgggttgctcccgtcgatgtgcgtgcgaaactttccatctgagggattattcggattaccataagtgcatttttcataacagagaaaatcgtgaccgagggggaacaggagctgggcgcacgccctcactctggcc

SEQ ID NO: 1054 - DNA, 773 bp, Sorghum bicolor
  Clone ID: SORBI-28MAY03-CLUS14492_1
ctcttttaggcatgaactgactgtactggagaaagtccgacaccctaatgtcgttcagttcgtcggagccgtcactgagagcatacctatgatgattgtttctgaacttcatgaagagaaagacttatcagtctgtatccagaagaaaggaaagttacatgctcacaaggtgctaagatatggccttgatattgccaggggcatgacctatctccatcagtgcaaaccggaccccatcatccactgcgacctaaagccaaaacatatcttcctggatagtggaggcaacctgaaaattgcgggattcggagtgataagggtgtcaaagatcgggcccgacaaagtgagactgatcaaccatggtgctctcgttgatagcttcagctaccacactgcacctgagctgtacagaaacgacgcgttcgactccagcgtcgatgcctactcattcggcttcatcctctatgagatggttgaaggatcagtgaggacgccagaggattcaggacacacgatccggttcgaggggatgcggccaccactcaagggcaagctcaagggctatcctccagacttcaaagcgctggtggaggaatgctggcacccgcaggccatggctcggccgacattctcggagatcatcatccggctggacaagatctacagccactgccaacagcaaagggaagctggaaggagtcgctcaagctttggaaatgatcgacatcgctggctcgccttcgtctatgtgtacatatcgctgcaaacgcgtc

SEQ ID NO: 1055 - DNA, 487 bp, Sorghum bicolor
  unsure (1)..(487): unsure at all n locations
  Clone ID: SORBI-28MAY03-CLUS14516_1
gcacgaggggaagctcctgtcggacacgctggacgagatcgccggcatgtcccacggcgcgaacggccggcgcctgcttagcaccctgtggtctcagataaccagcacccagggagaggacgtcctcgcccaccaacaaaagctgggcgtgtcgccagacgacgagaccgatcacgccgcccggcgcaaccttctgtcgaccgagctcgacagcatcgccagcacgtccgccgaggcaaaccgccagcttctcgcggcggaggagctccccgacgagctcgccggcaagcgccagctgctgtcccggacgctcatggggatcgacgaggcggccaccgaggccaagcgccagcttgatgaggcaacgacggagaacaccatgtcggagaccttcaacagggtactcgagggtgaccacgacacgctgttcgtgcacgcgcaancggcagttcttncgcaaactgcgaagtggctgggcaccgtggac

SEQ ID NO: 1056 - DNA, 433 bp, Sorghum bicolor
  Clone ID: SORBI-28MAY03-CLUS14541_1
ccaaacacccaggctatcatatatgttgttgattcaagtgatacagataggcttgtaacagcaaaagaagaatttcatgccatccttgaggaggatgagcttaaaggtgcagttgtccttgtatatgcaaataagcaggatcttccaggcgcactcgatgatgctgccattacagagtcattagaactgcacaagatcaagagccgccaatgggcgattttcaaaacatctgcaataaaaggagaggggctctttgaaggtttggactggctcagtaatacactgaaatctggaagcagctaattaggagcctctatctccatgtcatgaatcatttgctggatggtaaaaaatagagccgatgctgcccatttccttgcaagtcagcgcacaagtcccattctctctgtttaactccagaagttctacacca

SEQ ID NO: 1057 - DNA, 532 bp, Sorghum bicolor
  Clone ID: SORBI-28MAY03-CLUS14552_1
ttgagcggcggggcgctgtcctgtctctctacccgtggaacgtggcgaccacttccaacgggccactcgccgccgctgtgctcgcgtcaccgcgcgccgccgcccgccccgctcttcccccctcttttcccgggacaagcgatctctcctgtcctcctcttctccctccccgggggcgagtgattttttttccctctgttgcaatgaagagttctccatgggcgggggcccgccgtcctgccgtcgtgcagctcctcctcttcctcgcccacctcgtcggccgcggcggcgctgccgggggaggcagcaagggcagctcggtgtacccggcggccgtcgtctacccgcatcactcccgccagatctcctggaaacccagggtgttcctgtaccagcacttgctcagcgacgacgaggccaaccacctcatctccctcgcgagagcagagctcaagaggtcggcggtcgctgataatatgtccggcaagagcacacttagcgacgtccgcaccagctccggcacctttctcag

SEQ ID NO: 1058 - DNA, 898 bp, Sorghum bicolor
  Clone ID: SORBI-28MAY03-CLUS14545_1
gcagcaggtcctgtaccattggttgtgctcaccaaatcctgatttcaacgagataatgaactggtataagggatggaagggtcttttcccaccagagttacttgccaatgagcgcatacggatgctgctaactgctggtcttgacatgatgaaccaagctgctgaaggacttgaggtggtgcagccttgggctagggagaatgtgggttacttgagggcaactgagaagcggcagtttgatgcagcacagcaagcttaccatgctgcgccaggagctgccatggcagatttgagcttcaaggagtctatacaggcatatgcaatggagcaaggtttgttatttatgcctagagttggcaagttctacaatggcatgccagtgtatgagtttggctccgttagtatttgcatagactctgtgaagcgactactgtatgcacaacttcaagatggagttgagagatggagtgctgtaactcttacacaattgatggacatgaaccgaatgggaagaccacactagtagatcgcctaggcttggagttgcatcacatttttaggttcttccttgttttgtaaaactcttcagaggtgtcaatcaatagcttttttgaacaataactctgttgaagaagaaaggggttggattgatatctaaatgtgttggataatgctgtgctgccggtgtttactgtggtgctgtcaatatgatgtggcccctcagtaatttctatccataagctctgttgtaactgctgaaggacttctgcttatgcagttgctggaaaatcctaattactctgaacacttctggttgtgcactgaaatgtgtttgtaaattctttaatcgaagactcccaggtatgtttttgtggttataaattctttattgtgttgt

SEQ ID NO: 1059 - DNA, 645 bp, Sorghum bicolor
  Clone ID: SORBI-28MAY03-CLUS14561_1
cggacgcgtgggaacgaatttatgacattgctgaggaatcccctgtacctggctgttatatttgtcatcttccttgttgggaaggccatttgggtacagttagacattgccagtgaattccaaaatggctttctcccagccattctttcgctgtccacaaagtttgttcccactataatgaacattttgaagagattagcagacgaggggcaaagacctgcagcctcagacaggcaacgagagatggagctccaaccaacgaatcgttcatcgtacagcagtgtgacatctgcagggtcgtccagcataactgccacagagaatggatccgaatagtcaagcccagtggcaaaatgatttcttacatctgtgctttttgggtgaatgtcgatcgtagcagctgaggcagcagatggaatttgaacctgctagttcctagacccctgaataacatatagacgcgtctgttacatgtctatatgatgtatgatggttgttaggaagttagaggccaggacaaggaggtagggggcggggatactacgatatgtatacatgtatactaggtccatatagttgccagaaatgtgtagatgtgtcaaaactcaaaactatatcagcttgctttggagaatttgcggtttt

SEQ ID NO: 1060 - DNA, 566 bp, Sorghum bicolor
  Clone ID: SORBI-28MAY03-CLUS14574_1
cttccttcttcacttccatcacgcaagtgggttgtcgaccacatgctcagtcttggattttcaaagtctctttcagaatggattggcagtaacctgaagaaggacaacgatcatgtgacctgggcttttgatcttcaggctgccatagacatgtttagttcttatagggaaagggactattgggcacttttggaacacccacctaaggatttggagattgcaatagtgcaagcagagcacagtgatcgatgggtccctgatgatgttcaaaggctaaaagcattagccaggagagagtccaagactgacataggaaaagtgtcacttcacgttctccccaactctggccactgggttcatgtggacaatcccaaaggactactcgagatcatggttcctaactttctatcagctgttcaaaattgagtggtaccttcaattggaacattcatttagtgtgacatattaagtttgacaacccaggataacgtttcttctctcatattgttgcccaaccagaatcacccttctgttaataatagagagaagaagtatacataatcctg

SEQ ID NO: 1061 - DNA, 788 bp, Sorghum bicolor
  Clone ID: SORBI-28MAY03-CLUS17407_1
gccggccgggccggggtcccccggccggttcacccattgcaacttgcttgcgctggcgcacctctgcttcgccttgccttccccttccttgcacagactgccagacggaatcacgcaagacccgtgcctccattcctagccccaaccgaagcgaagcacgccaccggcctcaaaagtcaaagggatcatcttctctagttctctaccactcgtcctcgcggccctgttcctcctcttccataggggactgactgcggcggagtggagatccgtgccgacatagtccgacttcttcggtcgctgcctacgattgatggcctcaccttcaccaaccgagttcagtaaggaagcagctcgtcagtctctgatcgcaatctcccagtccattccggagacaccttcaccccagacggtgaagacaccaatctccagtgcagaaaacgggaagctgggcgatggggcggacaagttcagatcaaagctgatgtccatcacagacctgtcttctgatgcccaacctgcgcagtgccctcccaaggatgttgctgcttgatcgtgtgattccctgctcgacttgcggacataatgtatcagtgcttgctgatgctctggacatttagctgtcgtgcattgaactgaacgtccttgtgttactagtcgtttttcttcgttaaatattcagagaaacgggtggaaatatattgttcaagtttcctgactgctgataaggaacaagttaatctgaacatgctgtcatgcactcatgctcggaaaacctctttgttccc

SEQ ID NO: 1062 - DNA, 533 bp, Sorghum bicolor
  Clone ID: SORBI-28MAY03-CLUS14637_1
atgttatctaaatatcatgaagagggcatctctgttccagtcccagctgaggagcaaaatctggtcaacagacaccgtaaagctttcttggacaatatgtcggatgatcttaaaaccacagatgttctggatggtgaggatggcctcacggatctgctgaaggccattaacagcaatatgaatgatttgaagaagctgcaacaaaaactagagcaacagcagaagaagcagcagcagaaaaagcaacaacagaagcaacagcaaacacagaaacaacctgaagattacattcaaggtcttatcgctctggagacagaaattaaagataaactatcagtacttggtctgatgccaccttcatctttgtcagaggtactgaatccattgaaggacaaagcataaatgcaatccaactagactgtccaactatggttactacatgtttcaagatcggcctgaagagtcaggatctgtaactagtgatagtgtacctggaaaatttaataaaagctcagacccggctgaagagtcag

SEQ ID NO: 1063 - DNA, 668 bp, Sorghum bicolor
  Clone ID: SORBI-28MAY03-CLUS14656_1
tcttgacaatgttgtcctcaacaggctcaagcagttcagggccatgaaccagttcaagaaagcagcgctgaggatcatagctggctgcctgtctgaagaggagatcactgggctcaaggagatgttcaagaacatcgacaaagataacagcgggaccattacgcttgaagagctcaaaaacgggttggcaaagcatggacccaagctatcagacggtgaacttcagcagctgatggaagcagctgatgctgatggcaacgggttaattgactacgacgagttcgtcaccgcgacagtgcacatgaacaaattggatagagaggagcacctttacacagcgtttcagtattttgacaaggacaacagcgggtacattacgagagaagagcttgagcaagccttgaaggagcaaggattgtatgacgccgagaaaatcaaagaggtcatctcagatgccgactctgacaacgatggaaggatagattattcagagtttgtggcgatgatgaggaaagggaccgctggtgctgaggcaatgaacaagaagaggcgagacatagtcctagagtgaagcagcaagtgtgtagtgtgtatagcgctcaaacaacatgcaagttttcacaactgtacactaatgcaatggaattacttttgggatcagttgatgg

SEQ ID NO: 1064 - DNA, 708 bp, Sorghum bicolor
  unsure (1)..(708): unsure at all n locations
  Clone ID: SORBI-28MAY03-CLUS14658_1
aatggagtgatgccaacagggaagggctgatcaacgacgtggcaagaaagaactacctgcagggctacgtcacatgcctatccaaagcagtcaggaacggagcaaacgtgcggggctacttcgtgtggacgctcctggacaacttcgagtggacgttcggttacaccgtgaggttcggcctgtaccacgtcgactacgacacccaggagaggacgccccggatgtctgcgacgtggtaccagggcttcctcaccgcaggcaacaccagcctggtgacccacgaagacgaagcgcaggcacggagagcagacgcgtgatggtgatgcttccagttccagcgaacggatgcgttgctatttgctaaacagctagccgcaggcctcaggatgaactcaggagtcagcactactcgatcgtgctcgtctccttcccctcgccatattagaatgcgtggggtgtcctagctagtgtgtgtgtatatggatagatataatatatgggcatcattagaaaaggtggtactgctgcatatatagtggatcatgctgtactgctgctcgatggcttaacggtctgtactactagctagatgcttgcagttgcaggtagatgctctcagacgatctgaatgtgaaaaaaaaaaaaaaaaaaaaaaaaaaaaaaaaaaaaaaaaaaaaaaataaaataaaaaaaaaaaaaaaaaaanag

SEQ ID NO: 1065 - DNA, 418 bp, Sorghum bicolor
  Clone ID: SORBI-28MAY03-CLUS14676_1
accaggcatatgggggggataaaaatataattaaatttgatggtgatcataattccccaagacctcaatcatattatgattcagtttctatattcttctataaaactttgcgtcctcctatgctgcctacaacacgatcaaagcttcatgtgggcgcatttaaagttggtagcataaccaatgagagtttcttctttgaaatcatcaatggtctacggtcagcaaacactgcagcctgcagttcatcaagagatgcacctaacatcccacatgatagcacatctgtagttgaattgttgtctagcatgaatcaactgtccattaagaatgagaatgacttggactttcttttaaatgaaaactgcagcctgtcagagattgatggggatagcgttggatcacgtttgcaggataaaac

SEQ ID NO: 1066 - DNA, 625 bp, Sorghum bicolor
  unsure (1)..(625): unsure at all n locations
  Clone ID: SORBI-28MAY03-CLUS14682_1
gccactaaaagtcctggtgatggtgtctcctctgattcggctaccaagtagtgtgacactgaggctgttgtgatagcaacttcagtccacacttacctcaacaggtttacgtctctttgatgacatcattacccaaggtgggattacaaaaaaagaatggctgcagttgaagtgataaaggtggaactctcggacgcgtgggctgaacttcatccaggctagacttgaatagccatcgttgttctaccatccaggttagatccgaagtctagataatgagaaaaaagtgacaacaagtcaagtgtttctttctatttttcagagcataaatacgagattgtaaaatgtctaggggcacaaaaacacatttgttatatacacatcttcagagtgtatctgtgtaccatattgctcaccatattttgtctttgtgcccaatttttcttgtgcttgtgtatgtgcacgcgttggcgcgcctcttcactagtgagtgtctatatgggctgtggtgggctggtggcagtggcatctcaaatgaatactagatttgcagtatgcanaatgaatttcagttgctagctgctagccttagattgcacaggttgttgcaatcattttccaactt

SEQ ID NO: 1067 - DNA, 261 bp, Sorghum bicolor
  Clone ID: SORBI-28MAY03-CLUS14699_1
tcactggagggagatgtcgccgcagcagcagcagcgggtggcgatagtcggggaggagtactgcgagggcgaggacagggagctgacggtgcggaagacgacgctcttcaccccgggggacgggctggaggcgtacgaccaccggaacggcgcgctggcgttccgcgtcgagacgtacggccgcggcggggcgtgcgggggcggcgccgccaggggggacctcgcgctgctgggcgccaggggggagcccgtcctcacggt

SEQ ID NO: 1068 - DNA, 641 bp, Sorghum bicolor
  Clone ID: 30977557
tgtggggaagcacactcatgatagtttgttgtttaaccactacgagatatggtttgaattccgcaggccaaaagtttagatcgtgatggtatagaaagagagtggtttggcttctgtggtgcagttttggtggtttcaagcacagattaagccatgccttgtactgtttgtacactactggtactgggacttgacttcagattgagaattgagattgatgttctctcagtgcctaattcaagaatatgcgccaagagtcatgattgagcaatgctgtggtgcttcagtgagtcttcccagtttcattcggtgagtggtggatgaaggctttagtatttattagcaccaattattggatgttctgtaacttcagtaatgtttctggtagaaactatagctgatgtcaaagtagtgtgatacatgcctctatttcgaaagctacctctatggccaaaaatagaattttatgagcacccagggttttgtaagctgtgacaaggataactctggttatcttgtttttgcatttcatagaacatacacatttctatgctgctgtatcctggtgaatagttgcagccatatgattttgtcaacctaaagttacagtatatccctgttcattatataactagtttttc

SEQ ID NO: 1069 - DNA, 434 bp, Sorghum bicolor
  Clone ID: LIB3480-023-P1-K1-G9
cggacgcgtgggttcgaaagctacctctatggccaaaaatagaggcatgtatcacactactttgacatcagctatagtttctaccagaaacattactgaagttacagaacatccaataattggtgctaataaatactaaagccttcatccaccaattagcgattgaaactgagcagactcactgaagcaccacagcataggtcaatcatgactattggcgcatatgcctgcatcaggcactgggagaacatgaagatcaatgctgaaactgaagccaagtcctagcaccagcagagttcatacaggacaaggcatggcttaatgtgcgctggaaaccatcgaaagtgggccagacaagccaaaacactctctttctatagcatcacgagctaaacagcttagaccgcgcatgcgtagaaagcgcgcctatgggg

SEQ ID NO: 1070 - DNA, 837 bp, Sorghum bicolor
  Clone ID: SORBI-28MAY03-CLUS14715_1
aagccgtcgctggatgacatcaagaagttcgcggacacggtgaggatcaaccggaactcggttgcgcagatcaccggctacttcatgacgcacttcaccgacacggtcggcagcctacaggccgccaacctcaccgtgtttgttggcgtgctcaagaacgagttcatgaacctcggcttcgacttcttcgctgacccgacgatcgaggtcgctacctacgcttattcggtggtggccgatgggatcgtcacggactaccctgccactgcagcttcctacttcaggagtccatgcagtgacatgaagctgaacctgagctactcgatcctgcctgcacaacctggcgctctggtcaacctggcagcccccgggatgttggctccggcgggagcgccggcaccgttgctccaacccactgacgtagtggacccgccgctgcctccggttaaagctgtgatcaccgccgacgcgccggcaccaaaggcggctgacaacacctcatcggcgttcagctccaacacggcgaacggcctcttgtgggctggcgtcgttgccctcttgtccctgacctttctgcactgatccttccttggtggcttccattgtacccccacatgttctccttcttgctctctgtgtgaccctcttacatcctcaaatgggctgtaacataatgttccttaaatagatataaattgtcattaacctgcacataaatacagatcagaaaaaaaagttaccctgcctgcaccaattcatgattggatactactgacagtattttttttggttgaaatagtccaaatcagtacaacgtttagataactgcaaactaac

SEQ ID NO: 1071 - DNA, 540 bp, Sorghum bicolor
  Clone ID: SORBI-28MAY03-CLUS14443_1
cgcccagcagctctcggcggtgaactggttcttcttgggtggagctgttgcccccctcctagtatggcttgcacacaaggcattcccaacccagagctggatcttactcatcaacatgcccgtgatgatcggtgccaccggcatgatgccacctgctactgcagtcaactacaccacatggatacttgttgggtttttgtcaggttatgtggtttacagatatcggcgtgactggtgggagcgacacaattatctgctttccggtgcactagatgctggtttggcattcatggctgtcctgatttacttatgcctaggcttggagaacatcagtttgagctggtggggcaatgatttggacggatgtcctctcgcttcttgtccaactgccaatggtattgtcgtcgagggctgcccagtgtatacatgagaacccatggtgtgacctggggagaagagaacttgacatgtcaagtgtgtgaagagcaatgtaaataatcaaatttattttcaaacaatttagagatgagaaattgggtt

SEQ ID NO: 1072 - DNA, 681 bp, Sorghum bicolor
  Clone ID: SORBI-28MAY03-CLUS14428_1
agcacgcagcggcgactcggggcctgccgcgcttccccgtgggccgtggccgtgcgcaacatcctcgattccaccggagggaaaggaaacgccgggagaaggggggaggaggcgtggcggccatgtctccgatctgggtgttcgggtacggctcgctgatctggaaccccggcttcgcctacgacgcccgcgtcgtcggcttcgtcagggactaccgccgcgtcttctaccaggggagcacggaccacaggggcacgccgcagttccccgggaggaccgtcaccctcgagcaccagcccggagcgacctgctggggagttgcttatagtataaaggaggaagataaggagatagctatggagtatgtttattgaaagtcagggagaagcaatatgatgagtacctttgtatactgattcataccagctgtcgattgtgtgatgtttgatgattgggatattgctggtgctacgtacttgtcattatggaaatgtagagattggtcgatggaccaaaactcatatattctttcctaaagcctgattagatctagatactatgatgattaggtcatgaatggcttatgagatttctctatatatgaacttatatgtgtttatcgtgatggtatatgtagcagcaagtttctgcacaactgatattgtgttgcttacagcttta

SEQ ID NO: 1073 - DNA, 732 bp, Sorghum bicolor
  Clone ID: SORBI-28MAY03-CLUS14784_1
ggaggatgacatattctctgaagatgatattccatcagaacaatcatcttttgattctgtagatgatggagcagattcagaatatttatcagaagaaaattctgaagatagcaatgatgaagtgccatgtaaagagtcatttgctgagccaaccgagatggaagcaatgaaagtgttatcatcaaaagaatgttttggagcgatggaagcagtgaaagcatcaaaagaatgttttggagaacttcgtgtcccatatacaaatggacgcactttgccacaaccaacttccaattgtcatgtaaaaacttctgctgtgaccgggacaggattgcaagagttgttggcattgatagataggaaactgactgaacaacaaactgttgtgcaaagaagcgatggacctttcgacagaaaatggagacctagctctatggatggtgaaaatgctgcagagcagtagaatttttgcatcagaaagattgaagaaacacaggaagggactgtatgaattttgatcaatgtgagtcactttaacagaccttctgtacccatgcttcatgttgctagatagcatcaatcttgtattctgataagtgtgttgttggttgctgtaaatgtatttatgttgctccttctatatggccttatttgttaaatttatgcttgtcataatattggcaaatacgtctgaaatgaaagggaaaaaaatggaattgaggacactaaacatca

SEQ ID NO: 1074 - DNA, 728 bp, Sorghum bicolor
  Clone ID: SORBI-28MAY03-CLUS14738_1
gtcatgctgctgcagatcatcacggcgaagccgcccatggggctgtcgcaccacgtcggccgcgccatagagcgcggcgcgctgctggacatgctcgaccccgccgtgccggactggcccctcgaggaggcgcagtgcctcgccgagatggcgctccgctgctgcgagctgcgccgcaaggacaggccggacctcggcgccgtcgtgctcccggagcttaaccgcctgcgcgcgctcggcgaggacaacatgcagtactgcggcggcgccatgatcaggggcggtggcggtggctgcggcggcggcggcggcatgtacagctcgccgttccacagcaacatcgcacggtcgcacgcagccgagatgatggtggattctcagtacccaagatcagtgttcaactcaagagcgagcgattcgcccaagccgccgagaagatcgaacgcttgacgcccatgcatgaaccctgtttccagcatcggcacttacacatatggtgacgaaggggggtggcgttgtgttgtacgtgcaggttcataagctgcctagcatgagggggagctagagcaggtgttgtttctatctagcatgagtttggtgcagaattttcttgcacgaggcacgagctatgtactagtaatacagaaccgtatggctggctctgccattgccgtgtaccctgttcttgtaacttgtgacagcttcctcttctgtgtaatggatattct

SEQ ID NO: 1075 - DNA, 820 bp, Sorghum bicolor
  Clone ID: SORBI-28MAY03-CLUS14790_1
ctcctctctcccctcccagatccatctcccggtcccggcatcagacgcgcatcttgcagttgcagtaatggcggacgagaagcttgccaagctgcgcgaagccaccgccggcctcacgcagatcagcgataatgagaagtccggcttcctcagcctcgtcggccgctacctcagcggcgacgaggagctcatcgagtgggccaagatccacacgcccaccgacgaggtggtggtgccgtacgacaccctggaatcccctcctgaagacattgaggccaccaagaagctgctcgacaagctcgccgtgctcaagctcaacggcggcctggggacgaccatgggatgcaccggacccaaatcggtcatcgaggtgcgcaacggatttactttcctcgacctgattgtgatccagatcgagtcactcaacaagaagtatggcagcaatgtgccgctgcttctgatgaactccttcaacacccatgaagacaccttgaaaattgttgagaaatacgcgaattcaagcattgaaatccacacattcaaccagagccagtaccctcgtgtggtagctgacgagttcttgccatggccatccaagggaaagactgacaaggatggctggtaccctcctggccatggtgatatcttcccatcgctgatgaacagtggaaagctcgatttactactctcacagggaaaagagtatgtgttcattgcaaactcagataatttgggcgctattgttgacatgaagatactgaaccatttgattcacaagcagaatgaatattggcatgaggtacccctgaaactttggctg

SEQ ID NO: 1076 - DNA, 733 bp, Sorghum bicolor
  unsure (1)..(733): unsure at all n locations
  Clone ID: SORBI-28MAY03-CLUS14796_1
cccacgcgtccgctnnttttttttttntaatataagactttattgtttaccatttcatttcagaaaatatcaaaacataggttcacatacatgatataagaggcgtccacatatgacagccactgaaaatgcggtccaagcaaacaaactcgagttgagacgcgcacgcacacacacccatctccgatcaagataatattatgaccggaggtagtcattttctggactcctccaaaaattcgaggatccaagtacgcaaaaacaaagaaatcaataggtgaggtaaattcatcagtgccgcaacaaacaaaatctccaggcaacaactctgcaaacatgatcatgtccatggctgcaacttattaacctcagacagcacttcagatatgaccatatcaagttgttactgacgctgactcaacggatcagttggaaaatccgaccaccatcagaaggtgggcttctaggagatgcaggatgatatatgatgggttcaccttcttccatctcatccaccatgaaattttccctgcactccatgctgcaaaaggatttgtcaccctgatagatgtagatgtctttcccctctttgagcttctcactgcaaaagcaacagaagctcattgcaccctctttcacatgaagagacatactctgatcgcccttactctcaacaggcatcagctgctcagcttgaaactcaagaacaagatctccaaaaatgtgggtagtc

SEQ ID NO: 1077 - DNA, 395 bp, Sorghum bicolor
  Clone ID: SORBI-28MAY03-CLUS14815_1
gcgcccacgcgttcgccattgcgcaccgccctccccgtcgtcgtcccctcctcgcccgccgccaccgtcgagcccggcccggctgtggagacaaagcgaacccagcaaccatggcgaactcggcgtcggggatggccgtgagcgacgagtgcaagctcaagttccaggagctcaagtcgaagcggagcttccggttcatcacgttcaagatcaacgagcagacgcagcaggtggtggtggacaggctggggcagcccggcgacagctacgacgacttcaccggctccatgcccgacagcgagtgccgctacgccgtcttcgacttcgacttcaccaccgacgagaactgccagaagagcaagatcttcttcatcttctggtccccggacaccttg

SEQ ID NO: 1078 - DNA, 587 bp, Sorghum bicolor
  Clone ID: SORBI-28MAY03-CLUS14825_1
cggacgcgtggagcgaggcgctgctgatcgggattgtgtgcatggcactcatcctcatcttcagggacagcttctccatcatattcaccagcgacgccaccctgcagcgagccgtcgccaagatcgccggcctgctcggcctcaccatggtgctcaacagcgtgcagcctgtggtgtcaggggtcgcggttggaggtggatggcaaggcctggtcgcctacatcaacctcggctgctactacatcttcggcctgcccctgggctacttgctcggatacaagttcaactttggagttggggggatttggtcgggcatgctatgtggtgtcacacttcagacgatcatcttgctagttgtgatttggaggacagattggaaatcagaggcagcacaggcttcaacccgtgtgcaaaagtggggcggcaaaggcactgatgaagtcaaccctctcctgcaatagaattagtgtagtactcccattcaagtttatttttcttgccccacggtactttcccgctgcaggacataccaggttggtttaatttgaattgaataatcatgcatggggcacgggtaaagtgttata

SEQ ID NO: 1079 - DNA, 579 bp, Sorghum bicolor
  Clone ID: SORBI-28MAY03-CLUS14858_1
agagctgctgagagaaggaagcaaggagacggagagggagggagggaggaaaaaaaaaacacacacacacacacacacacacacagaggtgttgagcaagaaccgaggcggatcgccttttgttcctcctgccgaggactagcctgcctgtcggcgccgcgagagatcaagaggaggcgcggttcaggggagggagaagaggaggaacaccgggggcggagagagatgatgcgggagatgtatatggacgtgctgccgccggtggaccacatagccgcacggagcaactggttcccggccgcggcgcgtctctggacggcggaggagaacaagcggttcgagtctgcgctcgccgggctcgacctctgccacccggactgggagaaggtggcgcaggccatccccggccggacggtccgcgaggtcgtcagccacttcaagaacctccagctcgacgtccagcagatcgagagcggccaggtgcccttgccggtctacggcagcggggccagctcgttcactctgcagtgggacggcaatggcggctacgggcccggggacttcaagcacgggtaccgc

SEQ ID NO: 1080 - DNA, 420 bp, Sorghum bicolor
  Clone ID: SORBI-28MAY03-CLUS14884_1
cccacgcgtccgggagatcttccacagcgtcgccaaggtggcgctggagtcggtgaagacggcggtggagcagtccaagaacatcggcgaggccaaggccagcgacaagatgacagacagcgcgcgcgaggactgcaagaagctcctcgaggacgccgtggacgacctcaggggcatgctggatatggtcggcggcgacatcaaggtgctcttcagccggtccgacaacctctagacgtggctcacgggcgtgatgacgttcatggacacctgcatggacagcttcgtggacgagaagctcatggccgacatgcactccgtgctgcacaacgccaccgagctcagcagcaacgcgctcgccatcaccaacagcctctgcgggatcctgaagaagctggacctcgacatgttcaagaagga

SEQ ID NO: 1081 - DNA, 521 bp, Sorghum bicolor
  unsure (1)..(521): unsure at all n locations
  Clone ID: SORBI-28MAY03-CLUS14875_1
gcggggacacggatggggtcaaaatcaagctcattgcagaggatcacagcgtgcggggcactttgatgtgcccccctgaggagataatggaggaagtcntctttgccaggtttgcaacccngatggcatgtgcggcaacttcactggaggcacttggcacacgcccaatgcgaagcagatcgttgagaaggaatgccttggcaagccatcctgcatgctgccggtggatcacacagtgtacggcgcggacatcaactgccaatcaacaactggaacactgggggtgcaggtgagatgcatagggggcaagaagggtgcctgagaataacaagatggatgctgctaaatgctaattgaagtttcagcttgtttgtttgttcatcccttcggtttggcactcatgcttgtgacccattggtctgccattgcaattgaaatgtgattggaacatgcttgatcgggaactaacatgaaatgaatgaaggtttannaaaaaaatnataaattatttaaaaaaaata

SEQ ID NO: 1082 - DNA, 549 bp, Sorghum bicolor
  Clone ID: SORBI-28MAY03-CLUS14587_1
caagtccagccccttcatctccgcgctcgaggtcatcgacctcgccgactccatgtacaacaccaccgactttggcaggttcgtcatgagcaccgtggcgcgcaaccgattcggcagcaagcgccacatcgtcagatgacccgtacaaccggtactgggcgccgttcgcggacgccaaccccatggtggagagccactccgacatctcgcccgacgacttctggaaccagccgccggccaaggcgctcaaggccggggtcaccaccagcaggggcaagaagctcaccgtgcagtggccgacgacggagctcccggcggcgacctactacgtggcgctctacttccaggactcgcgctcggcgagccccttcagctggcgcgtcttcgacgtggccgtcaacggcaaggaattcttccgggggctcaacgcctccgcggccggcgtcatggtctactccagcatgatgcagctgtccgggaagacggagatcctgctcacgcccaacgagacgtcgcccgtcggcccgctcatcaacgccggagagatct

SEQ ID NO: 1083 - DNA, 818 bp, Sorghum bicolor
  Clone ID: SORBI-28MAY03-CLUS1459_1
tctggaaaaaccccaaactcaattcgaggcccgtgggccagcagcgccttatcccttcgccttccgcctccgtggcgcgcgcgctcgcacgaacggaagtcccatgtcgtccacagcagcgcgcgccgtcccgccggcagccgcggcgccgcctcccctcccacgccgcctgaggcccgcgaggtgcacggccggagccgccgcggcggagacgacggccaccgcggggccgactagggtgacgaccgtcagcaaccgcggggactccctggcgatatgccgggtgctcaacggcatgtggcagaccagcggagggtggggccgcatagaccgcgacgccgctgttgacgccatgctcgcgtacgccgacgccgcactgtcgccacgcgtccgggctgaccactatgggccagcagaggatttgtatggcatgttcatcaacagagttaggcgggagcgcccacctgagtttctcgaagaaatcaaggggcttacaaagtgggtaccaccaccggttaagatgacaagaagttatgtcgaggataacatcaacagatccaggaagaggatggatgttgctgcgttggacatgttgcagttccactggtgggaatactcaaatccaggatacttggatgcactaaagcacatcacagacctgaaggaggaaggcaagataaagactgtggccctgacaaacttcgatacagacagactgcaaataattctagaaaatggaatcccagttgtgagcaaccaggttcaacattctatcgttgatatgcgccctcagcaaagaatggcagagctttgccagc

SEQ ID NO: 1084 - DNA, 446 bp, Sorghum bicolor
  Clone ID: SORBI-28MAY03-CLUS14620_1
gcacgaggccaaacaccacctagctgccgccggctccccgcgtatgggtggatcgcggcgcaaattgaagcgctcccgcgccaaggtccgcgtggggctcccccgccggaaacccaacgagttcaagccggccttcgagctccccgaggcgctcgccgccgccgccaggggcggcgcgggctgggacgccgagggcagcgtggtgaagaactacgccgcgttcggggtggtggccaacccgaacctgctcggcgcgcacgcccgcggcacgccgcggctcgtccagagcgcgtcgctgcaagcgcccgacgtcgccgccgagcgagcgcccgtcccggagttcgagcccatcgacaccggcagcgacctcgagaacgacgacctgaaatctgctcttgggaagaggaggggggatggcaaatctgcaccgttgcaaccacttacta

SEQ ID NO: 1085 - DNA, 535 bp, Sorghum bicolor
  Clone ID: SORBI-28MAY03-CLUS14945_1
ttcgcacgagggttttgtcaccaaacatacataaattcagggactgttggccaacttgagtggagtgcaaattatcctaagcatgctgtttctggtaatcatcagccaataattgaggaaccactgagtccagaacctgaacctgaaaatgtagaggcaaaggagggtgcaatagaggatttcttttgtgaagaccctgatgaaattcctaccattaatcttaatatcgaggagtttacacaaaacttgaagaactatatgcaagcaaacaatgttgacattgaatatgctgacatgtcgaaggcattggttgccatcacccctgatgctgcttccattccaactccaaagctcaagaatattagtcgtctgaggacagaacaccaagtttatgaactgccggattcacaccctcttcttgatgggttcgaacagagagaaccggatgatccatgtccatatcttctttccatatggaccccaggtgaaactgcacaatcaaccgatgcacccaagacattctgtgattcagggg

SEQ ID NO: 1086 - DNA, 611 bp, Sorghum bicolor
  Clone ID: SORBI-28MAY03-CLUS14982_1
caactctcacttttggaaacgtcgcgtattaaaaaatattttagatcatgtcctggtgctgccttttatgctcgtactgagcttccatccagcatgccaaatcttgagtctcttagcttatcttcagcaactgagacgattaatacgccgctaatgcctagcaaattcctccacctcaagttcttgactattgctcttcgtggacagacctatgattgtttttctctgttatccttttttgatgcttctcctttcctggagactttcatattgaatgtattatcatcggtacatgtgaagcctgcctcagtttttgaagatccctcggatctgaggaagatgccagagaaccataatgacaagctcaagtgtgttcgaatcatcaatttctcatctgcaaagagcttgattgagttgacctgtcatattctcgagtctgcaatgtcactcgagtgcctcacattggacaccactcatggtgcgcctagatgctctgttaccaaacatggcagatgctggcgaatgacgagggatgaaattatggaagcgcatagagcactattggctgtccaaacatacgttaagtcaaaagttccttcaacagtcgagtt

SEQ ID NO: 1087 - DNA, 604 bp, Sorghum bicolor
  Clone ID: SORBI-28MAY03-CLUS1497_1
cgccgatcggcccgggccccggagccggggtcctcctcctcccgggctcttgcccacggagccgccttcaatcccttcgacgtcgataccgacccgccgccgcggcctgagctgtcgcccgacccgcgcgggctttgcagtgacgcgctcgcgcgcttcgaggacaaggggaaacgcccagatggcttgtccgacgagtacagaaaactctcgggtattagacatatgaaaacgatcagtgtagctcattatcctgttaatagaggaaagaaccgatatattgatgtcttaccatttgatgataccagagtacggctctcagcacgacctccaaacaatgattacatcaacgcaagctttataaaggctactgagaacaacagagttgcaccatttatttctacacaaggtccactagtgaagacatttggagatttctgggaaatggttcatgaatatcagtgccctgcaattgtcatgctcactcaatttgacagtattaagtgtgataaatatcttccacctgaaagtggacgacaaaaatatgggaattacgatatcaagattacgaagacaagaacagatagcccccacttacaggtgc

SEQ ID NO: 1088 - DNA, 636 bp, Sorghum bicolor
  Clone ID: SORBI-28MAY03-CLUS15066_1
aatcctctctcacacacaacacagactcccgccatccctgattccccgtccctgtcattcccgtcgcggcaagcggcattgcccaatttagcgcagcgcagaaacgagccgagcaagccgaccccctcgccgtccacccacgtcaagctcgcagcggcggcacgggctcgcacccgcacaccccgccagcagcggaattggatcgaagcgacaaaaacgcgagctaaaaaaaggggaagccgcgcgcgcaatccccggccggcaccgcgccgcgcccgcgcgcgtcgtcgtcgccctcgctacattgccgcccgggacctcgggcaccgcggggggaaggtttcggcgttgcgccaccgacccaccgttcccgcgtgttgcgttgattcccccgaatcgaaccaacgcgcggcgcggggtcccggccatggcgcagctgccgcccaagatccccaccatggcgccggcgtggccggagttcgggggcgggcaccaccaccaccaccaccaccagcagcagcgcagcccctccgtgggcacgttcctcgccgcgcccatgccgccgccgccgctccaccacccgccgccgcagcagcagcagccgtcgtgggtcgacgagttcctcgacttctccgc

SEQ ID NO: 1089 - DNA, 729 bp, Sorghum bicolor
  unsure (1)..(729): unsure at all n locations
  Clone ID: SORBI-28MAY03-CLUS15068_1
gcacgaggcacccagccgggcgccggcgagaaccctaaccctacccaatgtcctcttcctctctgccgccgccgccggcttcgccgcccacggccgcggaggacgaggcgcgggactgggcggagatgccgtcggacgcgctggcggccgtgttcgcgaagctggacgtggcggagatcctgctcggggccgggctggtctgccgcgcgtggcgccgcctcgcggcctccgacccaacgctgtggcgccgcgtcgacatgacctaccagggggaccagctgcagaccgaggaggtcgaggccatggcgcgcgccgccgtcgaccgcgctgcgggcaccatggaggcgttcggggccgagaccttcgtcaacgacgagctcctacgctacatctctcagagggccccctcattgaagagcctccatctctgcttgtgccatcatgtcactaatcaaggttttgcagaggcaattaatggtttccctcagctcgaggagctagatgttacattctgctcattgaatggtagcatgtgtgagactgctgggagagcctgcccacaacttanatgcttcaggttgaatgagcgctggtgtattcttcaaagtgaagttgcatcctacgagggcatggatgatgacacgggaagcattagggatcgctagcaccatgcctgggcctcaagaactttagttgattggtaaccagctgaccaattgttggactcat

SEQ ID NO: 1090 - DNA, 693 bp, Sorghum bicolor
  Clone ID: SORBI-28MAY03-CLUS15084_1
gcacgaggatctgacagtgcccttgtggctgcagctgttctttcagatcgttatatcagtggacgattcttgcctgacaaagcaattgatctggttgatgaatcagctgccaagttaaaaatggagataacatcaaaacctactgctctggatgagattgatcgtgctgtcctgaagcttgaaatggagcgtctctcacttacaaatgatacagataaagcatcaaaggacagattatcccgtcttgaagcagaattatcactcttgaaggataaacaacgtcaattgactgagcggtgggagcatgagaaatcagtgatgactaaaattcaatctatcaaagaagagattgacagggtaaatgtggagatacagcaggcagaacgtgagtacgatcttaatcgcgctgctgaactgaaatatggcagtctgaatgccttgcagcgccagcttcaaatgacagagaaggagcttgatgaatatcagagttctgggaaatccatgctaagggaagaggtgacccaagatgatattgcagaaatagtgagcaggtggacaggcattccagtttccaaactaaagcaatctgacagggagaagttgctgtttctggaaggaagagctgcacaagcgagttgtcggtcaggatcctgctgtgaaagcagttgcagaggccattcagagatccagagc

SEQ ID NO: 1091 - DNA, 594 bp, Sorghum bicolor
  Clone ID: SORBI-28MAY03-CLUS15087_1
gcacgagggttccagttgccgcaacaattagggccacaatgcctccagtaggatggagcattccaattttcaagaaaagaattgacgggtacattgaagaagtaccaaatccaatatgggactaccacaagtatattccatactcaaaaccagggaaggtccatgatcagattgaattatatggaaccccaaaagacctggaggatttttgtgaaaaggcacagctggtgaactatgttcagtacagagcacttttggaaggatggacttccttcatgtggacaaagtttacaggtgttctaatttggaagacgcagaatccttggactggattaaggggccagttctatgatcacctccaagatcaaaccgctgggttttatggttgccgttgtgcttctgaacctattcatgtccaactgaatttggtcactttctttgtagaggtggtaaacactacagctgatgaactcaaagacatggccgtcgaaatttcagtgtgggatctagatggtgcatgcccttattacaaagttactgagaaaatagttgtaccaccaaagaaagtgaagcaaactatcgagatgagatacc

SEQ ID NO: 1092 - DNA, 803 bp, Sorghum bicolor
  Clone ID: SORBI-28MAY03-CLUS14716_1
gcacgaggaaggaacgactcaaacaattaaatcaggaaatagatatgcttagacaactctcccacccgaacatagtgcagtatcatggaagtgagctgagtgatgaagcactttccatttatcttgagtatgtttcagggggttcaatccacaagttactaagagaatatggcccttttaaggaacctgtgattcgtaattacactgggcaaattcttgcaggtcttgcctacttgcatgggcgaaacactgtccacagagatatcaaaggagcaaacatacttgtgggtcctaatggtgaagtcaagcttgctgactttggcatggctaagcatatatcatcttttgctgaaatacgctctttcaaaggaagtccttactggatggctcctgaggttcttgacggatcgcacggctacagtttatcagtggacatttggagtctgggctgtaccattattgaaatggcaacggcaagacctccttggcaccaatatgagggggtagcagcaatatttaagattgcaaacagtaaagatatacctgaaatcccagacagtttctcagaggaagggaaaagtttcttgcagctttgcttgaaacgcaaccctgcatctcgtccctctgcagcccagctgatggatcatccttttgttcaggatcatcctgcagtgagagctgcaaaatccagtgtattgagaaacgcaatgtcttcttcagcagatggcagacacacaatgtccaacagggagttgccatctcggaagattattactcctctgaaagatattgcactgagcatg

SEQ ID NO: 1093 - DNA, 465 bp, Sorghum bicolor
  Clone ID: SORBI-28MAY03-CLUS14729_1
cgcaagcgacggcgacggtgccggaacgggctcttctgggcggtgcacccaggcggccgtgccatcttggacagctacgaggcaactctcggtctggaacccgggaagcttgctgccagccggcacgtgctaagtgagtacggcaacatgatgggcgcgacggtcatctttgttcttgacgagatacgccgccgccgccgccgccgctgcgaagacgacgctaaggaaaagaactgccagtggggggtcatgtcggggctcggccctggactcacaatcgagacaattgtgttgcatgccacagacaggcaggacgaaaattagtgatttattggtaagaagaagactctgtgatgagactattatagcaagaataataatacacctcagctgtctttatagccaagccatatatcagcaaatgtctagatggaagagagacagaaaggaggaacgagaagatgc

SEQ ID NO: 1094 - DNA, 738 bp, Sorghum bicolor
  Clone ID: SORBI-28MAY03-CLUS15153_1
atcaagtgcattctaggacagcgttcagtccaagcagggacggttccatgttgtctcaaaggcataatcggtatgaagaaatgcctgacacatggtacaagccatatgccgacaaattcaggacatgtcacagcaagcttcgctctggtgacaaagaaataccaaagagaacaccagagggaatgtctgactatcttaagatttgcagtttacataaaaggaagagggctgtgtttatggatgatcccagcatatctcctcccatgtcggaaaacggcccttccctgctttcaaaaaatgctggggaattcagcaattcaacagacgaattaattccagaaattagatttccatctgactgtgttccagaaagcgcaattcctaaaacaagtgggatatctaggacctacaaaatagaagttcatggggttcttgataatttaccagcaccagttaaccgcaacactgcaatgcttgaaaggtttggcatggtgcctgaatattacaaaacaggaaacaaatatagaggaaaagatggatctagagtagaagggaaatctttaagccaagagcaagcattgctcatgacaaaaaagttggttgctcgctacttagcaaatttacgttttgaaagtggaactgcagtctctattgatattctttcagaaataataattaagcacatatgtaaactgggacgcaacttgaagcttctaactgacagctacaggaagcaat

SEQ ID NO: 1095 - DNA, 500 bp, Sorghum bicolor
  Clone ID: SORBI-28MAY03-CLUS15176_1
ccaacgtcggcctcgtgggcgccataccggcgaacatggcgaagctgacggggctccggttcctggcgctggaccacaaccgcctgacgggcgccgtgccggccgagctcgcccagctgcccagcatcggcgcgctgtacctgaacggcaacaacctgacggggccgttggagttcttggcggggttctaccagcggatgggccagcggttcgcgtcgtgggacaaccccgggctgtgctacaacatcgcggccgtggacgtggcgcacgcgccgtcgggcgtggtcgtgtgcaaggacctgcaggagccccagcgtggcaccggacggggacggggaggtggaaggcgggaagaagcccgaggcgagctccagcctcgtggcctcgtcgtcgtcccgggggtcgtctgccaagggtcggtgggctctggtacctggtggtggtcaaggaatggtggctgccgttcttggattgttgtcccgactactatagcaacttaa

SEQ ID NO: 1096 - DNA, 566 bp, Sorghum bicolor
  Clone ID: SORBI-28MAY03-CLUS15182_1
cacgttcgtcgccgccgcggacggcgccagggagacgacgacgatgaggacgcacttcatccggacggcgaccaacgtgggcgggggcgggaaggcggtgtaccgcgcgtcggtccaggcccccgaggggtgcaacgtgacggtgcagccgcggcagctggcgttccggcgcgacgggcagcggctgagcttcacggtgcgggtggaggccgcggtggcggcggcgcccgggaagaggatggagcccgggagctcgcaggtgcggagcggcgcgctgacgtggagcgacggcaggcacgtcgtccgtagcccgatcgtggtgacggtgcaggcgccattgcagtgactagtactgatgaccgcggatggagccggagctgtggtgaggccatcgacgggaggtgggggagaacacagtctcagtgttctttgtgagtcctcaaggtttttagcttttctgtattaattaaggttgctgttagctgtagaatacggtcgtggaagagctgtatcggtagctactacgtaagctattatatactggaagtctggagctcgtcgatctc

SEQ ID NO: 1097 - DNA, 645 bp, Sorghum bicolor
  Clone ID: SORBI-28MAY03-CLUS15228_1
agacaccagtttgaaacttttgaggaagggtgttttaacacgtatatatgcgcccatggctatcatccgtgggctcaaggaatctggtgtctttaccaatgcagtaacatcagcgaaagcacagtcgaaaacaaagtcatcaaacacgggtttcggaaacgaggccatccaactaaacggaacagctggtcagtccacactagaaggtggtcacgaaaagttgcaggcaaccgtaagaaagatcctagagatggttgacgcccaggaagaagcaatgccgccaatgtcgcccccaggttttcttgagctgactgaaagcgccactgctttgtcatgatgcaatgcggggtcctggaggcgttgtcgagtacttactcagtcaggtttagccatgcatgctgtcttgagcatacggtcatacggataacataggcttgtttggtcttcgttgctgtgtcttgcaaccctcaatgtatgtgttgggctgatgtaaaatcgcttcaaaaaatcaagtaggctggtgagcaaggacagggcatcagaatagtatactgcgtctgcgatgcatacagaattgttgtctcatgttggaaaccaaaccatggattgttgtctaacatgtactaataagcatatatagtttat

SEQ ID NO: 1098 - DNA, 650 bp, Sorghum bicolor
  unsure (1)..(650): unsure at all n locations
  Clone ID: 30932702
ttctaaaggaaagaattgcacnggtaccaaatccntcgcccccgnnacgccctcgcactcgccctcgcccgacgtcgcaccntcttcctccatcgtcctggggtccntcatcgacgcccntcgcccccgacgcccgtaggccgacctgcgttgccaggtcaggaggctcgccctccgccaccaacgaccgacgccctcgcccgccctcgccaccgacgcccgtaggccgacctgcgttgccaggtcaggaggctcgccctccgccaccgacgaccgacgccctcgccctcgccaccgacgcccgacgctcgacgcccgtgttgcctcgaccccgacgcccgacgctcggacgcgcgacgccatcgacaccgtcgccctcgacctcgccctcgccctcgccccagacgctgcagcccaacgccctcgccgacctgcgcctcatcctcgcccgacgccctcgcacgacctgcgtcgggttgcctcgacgctcgacgcccgacgcgcgacgccctcgcccccgacgccgcagcccaaggccctcgccgacctgcgcctcatcatcgcccgacgccctcgcacgacccccgagcccaacctgcgttggcaacctcagccctgcgacgtccttgaagccgtcaatcctgcgtttt

SEQ ID NO: 1099 - DNA, 431 bp, Sorghum bicolor
  unsure (1)..(431): unsure at all n locations
  Clone ID: LIB3480-034-P1-K1-F4
caactctccagacctggcaacgcaggtcgggcgtcggggccttaggcgagggcgacggtgtcgggggcgggcgagggtgaagggcgagggcgtcggtcgtcggtggcggagggcgagtctcctgacctggcaacccaggtcggccgtcggacttcgggggcgagggcgtcgacgaggacccaggacgatggaggaagaggtgcgacgtcgggtgagggcgagtgcgagggcgtcgggggcgaggatttggtaccgtgccattctttcctttagaagagcatgcgattaattttgtttcctttacaggactgagattttatatcaggaatcctttctttttctttattttatttcgcccccttccacctctctgttatatattattgtgtgttggaaatttgcatcangaatcctaagttgttttttttttc

SEQ ID NO: 1100 - DNA, 560 bp, Sorghum bicolor
  Clone ID: SORBI-28MAY03-CLUS15233_1
gcacgaggctattacctaatgcttgatttgcaacttggcattaggtatacagtaggtaaaatcacccctgtgcctttgcgcgaagttcgttcaaatgattttggacctcgagcacggataagaatgtacttccctactgaaggctcgcagtatacgcctccacaccactctgtcaatttcttttggaaggattattgccctatggttttccggaatcttcgagaaatgttccacattgatgctgcagattacatgatgtccatatgtggtgatgacagtctgaaagagctttcttcacccgggaaaagtggcagtattttctatctttcacaggatgaacgttttgtcataaaaaccttgagaaaagctgagctgaagatactgttgaagatgcttccaaaatattacagtcatgtcagagcttatgataatacgctcattacaaaattctttggcgtgcacaggattactctgaaaggtggcagaaaggttcgctttgttgtgatgggaaatatgttctgcactgagctgcgaattcatcgtaagtatgacttggaggg

SEQ ID NO: 1101 - DNA, 544 bp, Sorghum bicolor
  Clone ID: SORBI-28MAY03-CLUS15239_1
ggatgccctaaatgatgccatgcaaggtcgaggtcgcatatgatcaggttccagtcagctcagctgaaccgtgcttgtcatcatttgccccattgtcggaaatctgccccagcattagcaatggtaatagtatggaagataaccaccaggttaatcctggcattggcatgcccatgcaaggtctacccaaaaggactggctttgatgttgtgccttgccctgatcgtgactcggtcatttcgcgctataaagcgaagaggaagacaagaagattcgacaggcaggtccggtatgagtcacgcaaagttcgtgctgatggcaggctcaggatcaaggggcgttttgcaaaggcaaaccagacatgaacctgaatttgcaatatgctaagcatcttccggcacgaaaaagaaaattgattaggggcgattgcgtgattataatgcataaatgtgccagaattttgtttgcgttcagttcaatagctgataaccatagcttcatatacagtggaatgatgtgtgtgtattgcagttatgtgactagt

SEQ ID NO: 1102 - DNA, 667 bp, Sorghum bicolor
  Clone ID: 30977122
gatcgcaattcgcacctgcccgcgcggcccgacgaccagtcctccccacccatggcgcggcgatccgcccctctcctgcgccgcctcgtctccgcgtcctcctccccgcccgcgccgcagcccctcggcggcgtcctcgcgcggcgcacggtgacctacatgccccggcccggggacggcgccccgcgcgccgtcacgctcatcccgggcgacggcatcgggcccctcgtcacgggcgccgtgcgccaggtcatggaggccatgcacgcgcccgtctacttcgagacctacgacgtccacggcgacatgcccaccgtcccgcccgccgtcatcgactccatccgccgcaacaaggtctgcatcaagggcggcctcgccacgcccgtcggcggcggggtctcctccctcaacatgcagctgcgcaaggagctcgacctctacgcatcgctcgtccactgctccaacctccccggcctgcccaccaggcaccagggtgtcgatatcgtcgtcatcagggagaacaccgagggcgagtactcggggctcgagcacgaggtcgtgcccggggtcgttgaaagcctcaaggtgatcacaaagttttgctctgagaggattgccaaatacgcgttcgagtatgcttaccttaacaaccgaaagaaagtcactg

SEQ ID NO: 1103 - DNA, 568 bp, Sorghum bicolor
  Clone ID: LIB3480-034-P1-K1-G2
ctctccctgtccctgccatcctcgctgccgcggccttcctcctcgctccccctccaccgatcgcatccaccccgaaaccctagcgggctagtcgccggccatggcgcggcggtcgacccctctcctacgccgcctcctcgccccgtcaccttccccctccccctccactcccctcgccggcgccgcgccccgccgcaccgtcacctacatgccccgcccgggggacggcgccccgcgcggcgtcactctcatcccgggcgacggcatcgggcccctcgtcacgggcgccgtgcggcaggtgatggaggcgatgcacgcgccggtctactttgagacgtacgaggtccacggcgacatgccaacggtcccagccgaggtcatcgagtccatccgccgcaacaaggtctgcctcaagggcggcctcgccacccccgtcggcggcggtgtctcctccctcaacgtgcagctccggaaggagctcgacctctacgccgcgctggtcaactgcttcaacctccctggcctgcctaccaggcacgacaacgtggacatcgtggtcattcgggag

SEQ ID NO: 1104 - DNA, 900 bp, Sorghum bicolor
  unsure (1)..(900): unsure at all n locations
  Clone ID: SORBI-28MAY03-CLUS14911_1
gcggcgctcgaggcggccgggatcaaaattggtgccggctggtgtcccatttcctactgcacgcctcggccgaccgccggtctgccgctctgcctcgatgattgaggctacaagagggctcaggggcccccgactcctcctgtccgtcgccgtcctcgtcctcgccattgctctcgtcttccgctccctcaccccccagtcccgcaaatggccgacgacctgcccacctccatctacgacatcaccgtcaaggatattagaggtgatgacatagatctaagcgagtatgctggaaaggttcttcttatcgtcaatgttgcttcaaaatgtggactaacaagttccaattacaaagagctaaatgtcttgtatgagaagtacagagagaaaggccttgagatacttgcattcccatgtaatcaatttgctggtcaagagcctggcaccaatgaagatatccaggagacagtttgtagcaggttcaaagcagagtttcctatttttgacaagattgatgtgaatggtaaggacgctgcaccattgtacaagtacttgaaatcacagaaaggtggcttccttggcgatggtattaaatggaacttcaccaagtttcttgttgacaaagatggcaaggttgttgagcgatatgctccgacgacttctcctttgaagattgagaatgacatccagaagcttctgggcacagcatcatgatttggttacatgaattatgttccctgaactctcttgccactgttgtaatttcattgaaaatatggagcttggacatctgtgccagntttccgttctcagttgaaaatacgatggtctagtgtaaagaaacattatcatgtatagatgctgtgtattttacttgcaaaaaaaaaaaaaaaggcccta

SEQ ID NO: 1105 - DNA, 547 bp, Sorghum bicolor
  Clone ID: SORBI-28MAY03-CLUS14923_1
gcacgaggcaacccacctccattcgtgggtgcccgtctcgactgccccgcccccactcccaactccggcgactgccgcgcgcccaccatggccgctcgccggagcaccagctccacccgacgcggcctcctccccgcgctccttctcatcctctgctcgtccctcccgcacttcgccgccgcataccgcccaggcgacatcgtcccgatgctccgctcgggacagtaccacgggtcgaggacggtgtggttcgacgtggtgggccgccactgcccagccttcgcggtcaaccgggaggtgctgatgccgatcccaaagccgacggggttcactggtgctgatccctacaagataacatttcaaattggacatgaaaagttccatgttccttggctttatgttataaatcgcaagacctctgaagttccactgattgatttccatttgaagtactctggaaatgatatacttggggtaacagctaaagttgtggacatgcctcaccactacgtggaagttcatcctgacataaagaagaatttctggg

SEQ ID NO: 1106 - DNA, 348 bp, Sorghum bicolor
  Clone ID: SORBI-28MAY03-CLUS15259_1
tcgggatgtgcgtgctggagatggtgacgcgggaggtgccctacgccgagtgcggcagcgtcgtgcagatcttccacaacgtcacccggggcgtcccgcccgcggcgctcaagcggctcaaggaccccgagctgcggggattcatcgagcgatgcatcggccagccccggaaccggccctcggccgccgagctcctgcaggacccgttcttcaacggcatccgcggcggggacgacgacgacgcgcttgctgatgcctgcagcgtcgtcgccggcgcgccggccgtgccacgcccgcggagctacgtcgacgacctcgccgggctccggctggactgaccgaccgtgt

SEQ ID NO: 1107 - DNA, 243 bp, Sorghum bicolor
  Clone ID: SORBI-28MAY03-CLUS15265_1
gcgctctctacagaagcatcttcgatcagtgcgtgtctgggccatcgtctggccagagttctggtatttcatcccctgcgcacaccaaggctatcactgctaggacaagaaggcagccaagcataatatcaagtgcattttgctcatccaagaagctcccacttacccttccacatattggagctcctcattggagccagattctaggtaacacccactttaggactgttatcctctcacaca

SEQ ID NO: 1108 - DNA, 796 bp, Sorghum bicolor
  unsure (1)..(796): unsure at all n locations
  Clone ID: SORBI-28MAY03-CLUS15268_1
gccggccgggcctgcaaaatagaggcactctcttttctacccctgcagttccatttaggctgatgcaactaccagatgtataccaggttctcctagaaagatatgtcaagatgcaatgccctgattgtggcttagtgcctgatgaaccggcattgtgtttgctttgtggcaaactatgttcgcctagttggaaaccatgctgcaggtctggtaaatgccagaatcatgcattgcaatgtggtgctggtattggcatatttcttctagtgaggaaaacaacaatcctgttgcagcgatctgctcgtctggccttttggccgtctctataccttgatgcttttggagaggaggatcatgaaatgcagagaggaaagcctttatatctaagtcaggaaagatacacagccctgacgtatttggtggcatctcatagccttgaccgaacttctgaagttcttcggcaaacgaccatcagcttttatgattgagtccattttccaaggaacaatgttcaaaggatcttgtggttgtgaatattgtgggaactgtagtgcaacttggtgttgatcctctccggtgattaacgaaagtattacctcaaccaaaggtggtgtagatcctgcaggcttgacgccattcgtcttctgtggtgcactggacctgctgcccccatgtgcctaatgtacaagtgtttcattcttttctttgtttactattgntattatggccggtgctccaaaatggctacagctgctgacctttgtacgtttaacgatcgactgcatgatctgtatgt

SEQ ID NO: 1109 - DNA, 612 bp, Sorghum bicolor
  Clone ID: SORBI-28MAY03-CLUS15406_1
tagggcccttttttttttttttttttcgaaatgcacaaagtcgcagcagcatgcaagcaattcgatcaagaatttacaccgtaccttttgtgtgtgtttgaggctttgttagaggttatcagaacagcatgtcaatcgagaggtacctatagctacatccagagcgatcagtcagtagcagccgtcgcagccgctgagaagcgacggcagcggcggcggcggcagaagcggcacggcgtcaatggcaggggctggcgcaggcatggaatcgaggctcgctcgctcgctcggcagaggcttcaaactccgatccggcgtgttcgtgaaccgatcgagaagacgaaggctgggagaaggggggcgtggaacgaagctcgctccccggcccggcccgcccaccgcgcacgccgccgccacctggccaagccgaccctagttttgatttttcctagttattggctagtcagcgtagctgcgttcttctccttccggcgcccttctaatctcttcttccccttccctccgcgcgcgcggctgggaggaaggaaaggagaagagggaagaagatcggaggagcagcagcgacaactgtctatcgcaagcccggccggc

SEQ ID NO: 1110 - DNA, 249 bp, Sorghum bicolor
  Clone ID: SORBI-28MAY03-CLUS15423_1
tctcagctaagctgcatgcatcatggcgatgtccacaagcaagtcgtgatcgatcgatcatggcgatggttatggagagccagcagccgctggcgccgccgatgccggtggtccgggcgccgcccctgcctcctactcttccccctccgccgttgccggcactctccgcaggcgtacaagcacctatgtagggtgtgcaagaaggggttcatgtgcgggcgcgcgctgagcagtcacatgcgggcgcac

SEQ ID NO: 1111 - DNA, 564 bp, Sorghum bicolor
  Clone ID: SORBI-28MAY03-CLUS15454_1
gccggccgggccgggggggttgtatgcaaagagcattgactgctcatggcgctcgtacactcgcttgcgctcactaggatcccggcttcgcttcggttcttatgtggtatgccatcatcatgcttggaggatcacggcgagagatcggcctacgaacgtgtatatcatccccgatgacaagcatcaggcgaggctggcgtcaagttccttgatcttttcagatcagggagcggcggcgagatggtctcttcggataagatcagggagcggcgagatgctgcagagatcagtgatcatggtgctctctgttctatacaagctggaatgtgcagattgatcccatcatctcgttctggagacggagtttgtctcatctgatggatcgcgtctgacttccttctggagacgggcgtttctctcatcttatggatcgatcgccacctgacttcaaatttgcttatttcgaactagggtctccattataactctttcccgtggaatatgtatgaactcgtactgcatgtgctccaatcatcatgtacgcatatcttattttattctaat

SEQ ID NO: 1112 - DNA, 707 bp, Sorghum bicolor
  unsure (1)..(707): unsure at all n locations
  Clone ID: SORBI-28MAY03-CLUS15473_1
gccggccgggtagcaaaaccgagcgctcccaaatccgtctcggaccctctccctcgtcgctctacgacatggctgacccgacgccgtcgcagtcgccggcgcagacaccgcccccgccgccggcgcagcaggctgccgcggcgggcggacgcgaggacatgctggcgtgcgtggcggcgcttgaggccgcgctgctgccgtgcctccccgcgcgcgagctccaggccgtcgaccgctccctccagtcctcccaccagattgatgttgagaggcatgcgagggatttcatggaggctgccaagaagctccagtcttatttcatcagcctgcagcgtgaggatcagccaactgcagaagagatgcttcggaaggagattactacaatggaggaagaactgaagaccaagtctgagcttattgccaagcacaagaagttgattgaagggtggcgaaaagaactgaaggagcagctgggcaagcacatcaccgagcttgaaagggtgtgaggagtgtgattctgcagtttccctcgtagtgaccatgaacctctaggtgaccaaatgttatgttatgccctataaactatgtacatgtttttagatctgacacgccatgattagcaatcggcttttgatggcttctaaaggtcggaagccacgaacaaagctcactttattgaaaaaaaaaaaaaaaaaaggccccctann

SEQ ID NO: 1113 - DNA, 574 bp, Sorghum bicolor
  Clone ID: 6676155
gtaaaagggcatgcatatatgcagctctgccctctctatcgatcccagtggctcaagctgtcacaatatcatgcctacatcatactattcaccttcgactgctagcaagctgcctcactgatgtggaaagccaagcttttgttttctgctgttcatcagtgagtcatctgaaccacaagttgcaggttgcatgaaaaatcttcatagcaggaagcaaggaaagcgaatgaagtaactcgagggaactatagaccacacaagttcaagtccactaaatcaagttttattttgaagaccagtaattggactgaatccactactcctggaaatcagatttttttatagaaaaaatatatgaactgttactgcttgtgccactgcattagttagacattactctttcaacttcagagttcagacctactgcttacctaaaccagaatagtacgtctgagcttctgcatggtaataactaacgcacatatatttggggtaaaaaatattgtaccagagcagcagcaagtccatattaccacaaaaacaagattatgttgactcgcaattcagagtcttg

SEQ ID NO: 1114 - DNA, 469 bp, Sorghum bicolor
  unsure (1)..(469): unsure at all n locations
  Clone ID: LIB3480-039-P1-K1-F3
cccacgcgtccgatttgaagggcctgcaacagatccgttgcaacatgatttgtagcttctgaacagtcaggtgttatattcattgtgaagtttctacaagatcatgttgttgatgtattcaaagcagatgtaaaagggcatgcatatatgcagatgtggaaagccaagcttttgttttctgctgttcatcagtgagtcatctgaaccacaagttgcaggttgcatgaaacatcttcatagcaggaagcaaggaaagcgaatgaagtaactcgagggaactatagaccacacaggtcaagtccactaaatcaagttttattttgaagaccagtaatttggactgaatccactactccctggaaataagattttnttaatagaaaaaatatatgaactggtactgcttgtgccactgcattagttagacattactctttcaaacttcagagttcagacctactgcttacct

SEQ ID NO: 1115 - DNA, 528 bp, Sorghum bicolor
  Clone ID: SORBI-28MAY03-CLUS1551_1
gcgaagcgagcgcgacgacatcataatggggcagagccagggcagaggaagaaccaaaccagagacgcggcacgcgacgcgggagggcgagcgtccggaggagcagcatcagcagcgcggcgacatcgcgaggccagacgcaacagccgaagagaaggggcagagtcgaccgccgggagtcccggccaccaccatggacaccttcttcctatcgcacggctcgcccacgctctccatcgacgacaagatcccggcgcggcacttcttcaagtcgtgggtgccggcgaaggtcgcgggcgaccaggcaccgcgcgccatcctcgtcgtgtcggggcactgggagacggccacgccggcggtcaacgtcatccgaggcagcaacgacaccatctacgacttctatggctttcccaagcccatgtaccagctcaagtacccggctcctggcgccccggacttggccctgcggaccaaggagctcctggagcaagccgggttcggccccgtgaaggaggaccacagccgcgg

SEQ ID NO: 1116 - DNA, 547 bp, Sorghum bicolor
  Clone ID: SORBI-28MAY03-CLUS15517_1
gcctggcccacctgtcagccagcgccagccctcctccttataaggaatgatcgaggacgacgcgacgcagcagggagagccgcaggttcgccggcgacgaggaggaaggaatcagaggcgcccaggagacccggccgcgatggctccgcgcagctcgtcggcgacgtgcctgtggctcgctctcgccgcggccatcctggcgcttgctcaggcacagggagggtcatcagcggcggacctggagaaggttacggccaagaccttcttcgatatcgagatcgacggcaagcctgcaggccggatcgtgctaggactttttggggacactgttcctaaaacaacagagaatttccgagcactttgcacaggggagaaaggaacggccaagtctggcaagcctctgtcgtacaaggggtcgacattccacaggatcatcccgggattcatgatccaaggaggcgatttcacaaacggcaacgggacgggggctgaatccatctatgacagcacgatcttccctgacgagaacttcaagctcaaccacact

SEQ ID NO: 1117 - DNA, 601 bp, Sorghum bicolor
  Clone ID: SORBI-28MAY03-CLUS15124_1
cattggactttgcaggaacttatggagttctggtactctttggagtttttcctgcggcaatgtcttggtcagagagatattcacatgagttggaagctccagtaccccctatagtcccaggagggaaatttactctctcggatgttacgggaggagcactgcttgtgattgtttcagagatattcatggatataatgcaactacaaggactacactgacaatcggtgcaagtgaaaggacatataacagttacaacttgcagtaagacggtgcgtgaggtttttgtcgcagtaatacggtccacgggcatgtatcaaaagcgtagtcagaacccaaaagcaatcaagtgcagtacgtgcttgcagtttcatcgagcatcgatgctggaattgaattgctatgatgagattagcaggagatactgtcaaacacgagttgtataatgtattcgttagtctctctatatatcattaactatagagtgaagaccatttaacatatttctttccttggtttacaaaggatttggtttgatcgatgtgtatgtaacaatgtaatttcttcatgattcttctcaccattccttggacctaccatcaag

SEQ ID NO: 1118 - DNA, 420 bp, Sorghum bicolor
  Clone ID: SORBI-28MAY03-CLUS15098_1
gcgcttcctgttatttcctgtccaagctggtagggaaaccactggtcttctcgttgtggccagacaagctcatgttcttccaaaagcaggttgcaaaaagaagagagaagctgctgaattacatgcttttcctgagagtcaccccaacactgcccaatactttcatcaatttttcttcacctatagtgggtgtgccgtaccatactttcttcttggcgacagccattggcctcatcccagcagcctatgtgactgtcaggctggaattgctttgagcgacctgagatcgttgaatgacctgtacgatccgcattctatagcagtgctgttcctgatcgggcttgtttcggtgattccgacattgctgggcaagattgagacgcctagcgggacaccagacattgtatcttgcaccatact

SEQ ID NO: 1119 - DNA, 589 bp, Sorghum bicolor
  unsure (1)..(589): unsure at all n locations
  Clone ID: SORBI-28MAY03-CLUS15147_1
cccacgcgtccgcgcagcgcccatcatcgatccgcccccggcccgtctgttcgccaccatttccttcacccccttcttcaatcccctccatcattcgctccaatactccgcccctcccccccgacccctttctccaccatcagggcgaaaattttatgcgcgctttgggaaagcgcgagttagttttgctttgaagctgcctgcctttttatccatccggggctgcgggcgtcgggagaagcacaggttcgagtccggctccgtgtactccggccgggcgtgggaaccgaggcggcagcggcggcaagagagagctagagagggggatctgatcgatgtcgtcggccgaggacggctactgcagctcggattcgccgcgggcggaatcccccgacgagccgctgctgcctgcggcggtggcggacgcggacgcggagtcccctcgcgccgccgggtccgggatgaacaagcgcgagcgcgacctcagcgacctccccgcctcgccgtcgtcgccgctgccgccagctaagcgcagccggagatcggtggagaagcgggtcgtgtcngtgccgctggccgagtgcgggga

SEQ ID NO: 1120 - DNA, 562 bp, Sorghum bicolor
  Clone ID: SORBI-28MAY03-CLUS15531_1
gtggctctgcaggttgctgtccaatcttgtttttgtgcttaaatagtatcatttgaatgttggctttgatgcttcattttgtttaataattttcaacttgttggaggataatattgaaagtaaagtagcctatctgtttttttatatatcctgccatttagcaataaattgaatcttttagatggtagtggaagcacctttctattatcatatatatatctttggtcatctattgaaactcctattccatgatattgctattcaacatatatatatgtatatattcgtctagctgtccaatcttcattagcccccatagttttgcacatgggcaacggtagatgggcatcgctagcttgacgatcttgatcggtgagttgctccttccatttttcttggtggttatggaatttatctgcaatatgtcttgtgcttttgtatgtctgctattgcactgctacttttttttttctgttctgtgctctatgcccttttgttgtatacatatacagatgtgcaaactatatttttgcagaatcgtgccaggaatccaatgtctggt

SEQ ID NO: 1121 - DNA, 589 bp, Sorghum bicolor
  Clone ID: SORBI-28MAY03-CLUS15563_1
gctccttcaaaggcatgctgcatgtgcgtgcccaccatccccgccgccgttctgaaaacctgaatatgatacttgcagttggtggggaagggaggccatttaggaccctgcactggccacaaaatgatcgtggtgttcttgtttttattggtcaatcccaagggcacctacattgcctgagtggatgtacgggaaatggttcccagatgactgaactgtccatttgggttcttgaggactacaatgcagaaaaatgggttctgagggacaatgtgagcttctccaagctgtttggaagaatgagcggcagtttccacttagactgggatgtggttgccattcatccagatcgtaatttggtcatctttgctgagtattggaattctaagctgatatcatatgacatggatgagaagaaagtgcatgctctctgcagtctacatggctatcctcggtatattattccatatgttccttatttcgcagagtcagcggcgttcgctaagaagcactgaaattgttgcttatgggatactccatgggatgtctaacaggaatttaatcttccaagaatggagcagctagcagc

SEQ ID NO: 1122 - DNA, 623 bp, Sorghum bicolor
  Clone ID: SORBI-28MAY03-CLUS1558_1
tcgaccacgcgtccgtcgacatccagtgatgaaagtctttcagcacccccttgtgttgtgacatttaatacaggagtgaaaatagtgtctgtagctgctggtggtcgtcatacattagcactatcagatttaggtcaggtgtggggttggggatatggaggagaagggcaactaggtctgggttctagaatccgaacagtttcttctccccatcctgtaccgtgcattgaatcagcactatacagcaaggatcggccatcagctatgaaaggtaacaaggctgctgaaggacatgtcagtaaagtcttgggaaattgcgtgagggccattgcttgtggaggtcgtcacagtgctgtagtaacagattcaggagctcttcttacatttggatgggggctgtatggacagtgtggacaagggaatacagatgatgttctaagtccgacgtgtgtatcatctatcctgggaatcaagatgcaagatgttgccgcaggtttgtggcacactgtatgtacatctgtagatggtgatgtgtattcgtttggaggaaaccagtttgggcagcttggcactggttctgatcaagctgagactgttccaaaattggtagatgctacaagcct

SEQ ID NO: 1123 - DNA, 828 bp, Sorghum bicolor
  unsure (1)..(828): unsure at all n locations
  Clone ID: SORBI-28MAY03-CLUS15564_1
gccggccgggttccggagcccagcgctggcatccgaacacggcaggcaacccgcaggggtagaaaaggggtgaagaagagcagtgggtggcttggcttggctggtcgcggcatatataccacctcggcactagagcggagcggttgctcttgctctgggctctcggctctcctctgtcttctgcatcgcagtcgtcgccgctccccggccgggctcgctcggtcgcgtgcgcggcccacccagaccaaagcagcggcgcagcagcatggggaactgccaggcggcggaggcggcgaacgtgctgctccagcacccgggcgggcgcgtggagcggctctactggtccaccagcgccgccgaggtcatgcgcgccaacccgggccactacgtcgcgctcgtcacgctccgcgtcgccgaggagcggcaggacgcccccggcggcgagcgccgcaccgtgcgcctcacgcgcgtcaagctgctcaagcccaaggagacgctgctcctcggccacgtctaccgcctcatcaccacccaggaggtgacgaaggcggtgcaggcgaggaaggaggagaagcagaggaaagcgcagcagcagctgctgggagtcgaggcagggcacgccgaggggcgcgcccgaggaggacgacgacgaggcagccttggacgccagccttgatcagttggcgcgtcaggacaacggcagccggagctccagtgcgcgacaccggccaatggcggccgtcgctgcnaagcatcgacgaggccacgagctgatatgtcagctcaatacactcatcataccacacacaaccgtagagccgtaatcat

SEQ ID NO: 1124 - DNA, 678 bp, Sorghum bicolor
  Clone ID: SORBI-28MAY03-CLUS15596_1
gccggccgggtccagatccaacgctctgacgcccgcactcggcgcacaccatggccgctgcttcagcttcgctgctccacctcgccaccccgacaaactccactcacctcgtagtccggctccccgcctcccagctgccccgccggcggccgccgggggcacgcatcgccaccacagccgccgcgggcgtacaaggtgacgatcgagcacgacggcgcgtcgcgggtggtggaggtggaggaggacgagacgatcctgtcccgcgcgctggacgagggcctggaggtgccgcacgactgcaagctcggcgtgtgcatgacgtgcccggcgcggctggtctccggggtggtggaccagagcgacggcatgctcagcgacgacgtcgtcgcgcaggggtacgcgctgctgtgcgcagcgtacccgcgctccgactgcaccatccgcgtcatccccgaggacgagctgctcaaggtccagctcgccaccgccgacgactgacgccccgccggtgacaagcggaccgaccaggcatcgacctccggcagtgtaataatggcccccgagacatcgttcaccactcttgttgattattagtagtaatagtgacagagctttttcttgagaatagatattgtgatgatatgcctcattgccaaaaaaaaaaaaaaaaagccccta

SEQ ID NO: 1125 - DNA, 603 bp, Sorghum bicolor
  Clone ID: SORBI-28MAY03-CLUS15597_1
tggccgattgatgaacctgagtgggaagcttgtgctggttggtggcattggcaagcaagataggcctgggatcatcaagggaattggcatttgggagctccataacaaagagtggtgtgaggttgctcggatgcctcacaagttttttcaaggatttggtgagttcgatgatgtttttgcaagctgtggggcagatgatcttatctatatccagagctatgggtcgccagctcttctcacctttgaaataaaccacaagtcatggaagtggtccgtgaagagccctgtttcgaagaggttcccgctgcagctgttcactggattctcttttgagccaaggatggacattgctctctaagtttgttatctcttccacctccaccagattttttgcattacattttgcctggttcaggagtggccaaagtcaggaggtgctgccattgaagccatttgaacacagagaatgttcgtttttatagctgtattcttttctttgttgggtctattgggtatattgattgaaatgatcaattaactttgccgatctcttttgttgacttggacattggagggagagatgatgccagcagcttgctttta

SEQ ID NO: 1126 - DNA, 719 bp, Sorghum bicolor
  Clone ID: SORBI-28MAY03-CLUS15647_1
gtttaaagaagaatccagcggagaggcctagtgccaaggagcttcttaagcatcgtttcataaaaaatgcccgaaagactccaaagcttttggagcgaataagagagcggccaagatttgcaggaaaaagcatggatgacacacaaaatgggcaaacacatgatgaagaagaggattttggtacaggcactatcaaggtcaataggacaaaagatacagctccgtctttgagtcaaggaacagttaggaaagctacagtcagggactttcctgatagatcagagggcacgggaactgtccgagttgtttcaaggcctcctcaaattgcctccaccaaggatggtagatctgatatgcctcaaagtccaaaagcaccaatacgtacaactgatcgagaaaatcagaggaagtcatcatggactggatctgaagattctctctctcagagagatacgcagagcgaacgtgggagagtagaaagttctactgatgatgtagaattttggcctttggcatgcaacttggttaaattgtgatgatttcactaactataattctttgccagaatgatcagtctgtaagcgggtcaggaactgttgtgttacgctcaccaagagcatctcagttgtactcaacagctagcaaccacagtaccaagcctcccagcagattttcctcatatgaagatatgtctaatagtgggacagttgttcggacca

SEQ ID NO: 1127 - DNA, 574 bp, Sorghum bicolor
  Clone ID: SORBI-28MAY03-CLUS15644_1
cggcgaggccctggactgggaggacctggcgaagatgaagtacacgtggcgcgtcgcgctggagacgcttcgcctggtgcctcccatgttcggcgacttccggcgagcgttacaggacgtcgagttcgacggctacctgatcccgaaaggatggcaggtgttctgggtggcgagcgtgacgcacatggacccgggcatcttcccggagccggccaggtttgagccgtctcggttcgagaaccaatcgccgccgtgctcgttcgtcgcgttcggcgggggtccgaggatctgcgtcggcatggagttcgccaggatcgagacgctggtgacgatgcattacctcgtcaggcgatttaggtggaaactctgctgcaagaaggacacgtatgccagggaccccatgccattgccgctgcacggactgcccatacaacttgagcacaaggtatcgccatgtgtcatgtgattattctctcgtacgtagcagatcagatccgcatatatataactactgtggtacgctatagcaatcaaatcagtgagttcaacagtgtacaaaaatagttttttcttt

SEQ ID NO: 1128 - DNA, 625 bp, Sorghum bicolor
  Clone ID: SORBI-28MAY03-CLUS15245_1
gaactgcttttgaatcgaacattgcctcaaggtcagaaaagcaagtgcacggacgcgtgggatcggtttggaaggcaagttcggccatatcatcggacagcagttttatggacagcatgcacacagccatcatgcactctggacaacctcctccagaactcaaacgagagcttcttgtacaccggtaagctggtgaagcatggtggcgtgccagatagcatactcgacggctgggacctggtagagcgtgaggtcctaccaccaccaccctcgcaggttgaagacgtcgcgcagtgggaaagagccatgtatgctggcaccaaaaagaaatgacctctatttacatgtcctcaaccattagaacactgcaagagctttagatatgtacctgatcatcaggttcaggttctggttctggttcatgtacagtagcagtacagagttaacctcaccctggctgggacctgtgagtcatctacactgcaagaatgcagagaggggaattgtagtgtagggttgatttgctgccatatgtacatcagtacatgtagtgcagcgctgtaaatttgtaaatataacttctgtaccgtttagaacggaatgtaaaatacccgtggaacacttt

SEQ ID NO: 1129 - DNA, 283 bp, Sorghum bicolor
  Clone ID: SORBI-28MAY03-CLUS15250_1
acggcgtccagcggtggccggagggggggagaccagagaacaacgaacgaaacttaaggtgaacttatgtggcggacgcgtgggcaagagagctttttctgagatctggtgtgtctgatcaagtgaatatgtacctacgtattgttgtgttcttaattctacattgtacagctttacactacacaaaggtacgggaatgctgaggtgtaacatccatatacaatatacttagttctgttcatccaaaaaaaaaaaaaaaaaaaaaaaaaaaaaaaactaaaaa

SEQ ID NO: 1130 - DNA, 502 bp, Sorghum bicolor
  Clone ID: SORBI-28MAY03-CLUS15709_1
cgcactcacctttctccatcctctctcgtctctcccctctgcttcctctctcacgccctctgttcttcatactacagctactcccgcagcccaaatccactaccatggattgagaatctcacctctaatcacccccatactactccctctactaccatggtgctatcccactcaattccccctctattccggcctcttcgtgccatctattttgggatcctagctctagggggagcaggcgatgctgcaccgaggtgccgagcctgacagccatggcgcccaggcagggccaaggagcctgtgcgtgctgcggtgtgcggatttggactccggcaacactttctccaatctaacacagagagtgctcttatttttacttcttcatgcttggttcatctagtctgtaactctgtaaaaagctatgagtgttctagatgtgtaggctcttgtattagagttttatccaaggctcaatgtgtgtacgtgtacgtgtacttgtgct

SEQ ID NO: 1131 - DNA, 650 bp, Sorghum bicolor
  Clone ID: SORBI-28MAY03-CLUS15711_1
cccacgcgtccgtcggcatcttcaagatggtgacattgtacttgtcaataggcagcctactcttcacaagcccagcatgatggctcattttgttcgtgtgttacctggagaaaggacgttacgaatgcactatgccaattgcagcacctacaatgctgattttgatggagatgagatgaatgtgcactttccacaagatgaaatatcccgtgctgaggccatgaatattgttgatgcaaacaagcaatacattggtcctaggagtggggatgctgtcagaggtctcatacaggaccacattattggtgctgtactactgacaaaacgagacacgtttctaactcgtgaagagtatagtcagcttgtctttgggtcttgtatgccatcctcaaatcgtggctctcgtcaccctggtaaaaaggtgtctgctattgaggattatggtacactcgaacttgtccgtcctgctatttggaagccaaaacccttatggacaggaaaacaggttataacaaccatcttgaatcatttaacaaaaggtcgtcctccatttactgtggagcagaagggaaaaataccaaaagaatatctaaaagaaggagatccttttgctcaagaagaaaaagattctcctgctcaacaacaagaag

SEQ ID NO: 1132 - DNA, 638 bp, Sorghum bicolor
  unsure (1)..(638): unsure at all n locations
  Clone ID: SORBI-28MAY03-CLUS15719_1
gccatcccgacggtgcaggtccctaacgaggcggggcagaagatcaaggcctacctcaccaaaacgcggggcgcgacggcgacgttcgtcttcaaaggagctgcgctcaacacccccaagtcgccgatggtcgcacccttctcatcgcggggccccaacaggaggagccgtgggatcctgaaacccgacctcatcgggcccggcgtgaatatcctcgccggcgtgccctcgatcgaggacgtggaccagctgcgcgacgcgccggtgcccaggttcgacatcaagtccggcacgtccatggccgcgccgcacctgagcgggatcgccgcgctgatcaagcacgcgcacccgacttggtcgcccgcggtcatcaagtcggcgctgatgacgacggcggagcctacggacaacctccggaagccgatcctggacgtcgacggcgagccggcgaccatgctcgccctcggcgccggccacgtgaacccgaagaaggccatggaccctggtctcgtgtacaacatgacggccaagggctacgtgccgtacctgtgcgggctcaactacacggacgacaaagtgagcacgatcatctacccggagccgncggtgtcgtgcgccaacctgtcaaagctcgagca

SEQ ID NO: 1133 - DNA, 684 bp, Sorghum bicolor
  unsure (1)..(684): unsure at all n locations
  Clone ID: SORBI-28MAY03-CLUS15737_1
tgttggaatagtggttgaaagtttcaaataatatttaaggctcccgttcaccccttctaatcgccgtccttcaactaattcttccggtgaaactgctttccttgaaaacaaagcgggagacaagctgtaccaaataattggcagctggcacgtctattcattcgatttcccactacccaaatcatccgattatgccgaggacaggtttgcactaactaacgtgctagttcaatcatagtctcctgaatgcctgcaaggccactcgcattagtagctccactactgcgtccccttcaaaaagcatccatcatcgatcgagctctatcgctcggcagaaatggcggggaatagaggtgagctgaagctgctgggcgtgtgggacagcccgtacgtcaacagggtccaaatcgtgctcaacctcaacggcctcagctacgagtacgtcgaggaagacctcctcaacaagagcgagctccttctcaagtccaacccggtgcacaagaaagtgcccgtgctcatccacgacggcaagccgatcgccgagtcgcaggtcatcgtccagtacctcgacgaggtcttcgccggcacgggcccgtcggtccttcccgccgacccctacgggcgcgccaccgnccgcttttgggccgccttcgtcgacgacaaggtcgggtcttcatggcacac

SEQ ID NO: 1134 - DNA, 648 bp, Sorghum bicolor
  unsure (1)..(648): unsure at all n locations
  Clone ID: SORBI-28MAY03-CLUS15762_1
cattttgctgggtttggaatctcgattccacaggaaagtcacaatgaggcctctcgcctacgtgactctcctggccatttttttctctttccacctccatctgtgtgcatcctcacgcctcctcgccgaacgtcctgcggcggctccaaatggccatcgccttctcgccggacgtcctgcggcggctccagatggccaacgccatctcgccgaacgtcctgcggcggctccaaatggccaggcagcagcaggtgcaccggcgccggttcctaccgcagggtcgccggagagcatgccggtagtgagcatgcccgccgccaaccagccggccaatgtcccacttccagcttacggcaacctcccaccggagttgctggcgaagctcccggccaacgtgccgccggacgtgctggccaacatcccgccggagacgctggccaacatcgaggcgtcgcaggggcagctgcagacgagcgagatcctggccaccatcccggcggtgcagggccagctgccggcgaacctgccgcccgaggtgctggccaagctcccggaggtgcagaaccatctgccggcgaacatcacgcccgagatggtggccagcctcgccgcggagcagcagnaagactggccggctcgccctggggc

SEQ ID NO: 1135 - DNA, 992 bp, Sorghum bicolor
  Clone ID: SORBI-28MAY03-CLUS15792_1
gccggccgggctgcaacgagagcgcaacgcaacagaggagtgacagagaaggaaacagcagcggccacgaggccaccaccagcgagtgagagagaacagaggaggcgccggcgcgccgcggcggagcgagcagcgagaaggagctagctagctagctaggcgggcaaaggtgccgagaaagaagacgatctcgacaacaatgggggaagctccgcctccgtgcgtcatcgtcgtgccgcggcgcgccaccgcgcactcgttccgcctgccccgccacggccgccggaagaaggtccacgtcgtccggctcggcggcggcggcggcggcgaagggcgccgctacgggcgcgggctcaggctccgtcggtggctgcggcgcgcggcgtggcgcctcgcggagctctgcgtggcggcgctgtcgggccagggcctcccgggggcgccgcccaggcccagcgcggcgcaccacccgccgtggaccggcgtggagccctacttcgccgcgcccttcgtccccgtcgcgcggatgaagcgcgccggagcgcatgcctagcctagctagctcgccgtgcgcgcgccacggtcacgcagttacatccatccaaccaatgccgaacacgtacaccggtgtggtagccacagtcatgtagggcaggcaggacaggggctgtcgctgtggtgtccgttccgttccatccatggtcaccttccattcttttgttccgtgaccatccctccattctgcggctcctgaaaaacacacagcaaggaagcatcaagcagggtagtgtttgtagtacgtactgcgtgctgcagctccaatcatgagcgccatagattgtttttgttttggacccattccattcatatgtaggttaataactagacaaatgtactagctcaccgtgctatggcatatactccagtgactgtacttaaatttgtactgctgctgtctgctactgataactaatgaatatgttactactgtc

SEQ ID NO: 1136 - DNA, 535 bp, Sorghum bicolor
  Clone ID: SORBI-28MAY03-CLUS15803_1
gctcggaggcccaacatggaacgtgcagctcggccggacggactcgcgcacggcgagccagagcgcggccaacgccaacctcccaggcccgggctccagcgcggcgtccctcgtcgccgcgttcgcggccaaggggctctcggcgcgcgacatgacggcgctctccggcgcgcacaccgtggggcgggcgcggtgcgtcttcttccgcgggcgcatctacggcgagcccaacatcaacgccaccttcgcggcggtgcggcagcagacgtgcccgcagaccggcggcgacggcaacctcgcgccgttcgacgaccagacgcccgacgcgttcgacaacgcctactacgcgaacctggtggcgcggcgcgggctgctgcactcggaccaggagctcttcaacggcgggacacaggacgcgctggtgaggaagtacagcggcaatggccgcatgttcgccaacgacttcgcgaaggcgatggtcaagatgggcggccttgcgcccgcggccggaacgcccacggaggtcagattgaac

SEQ ID NO: 1137 - DNA, 735 bp, Sorghum bicolor
  unsure (1)..(735): unsure at all n locations
  Clone ID: SORBI-28MAY03-CLUS15823_1
gccggccgggccgggaccttcccattccacgcacagacttttccccagctgcgcccgccccaactacctcgcgcgcgcggcaggtcgtgcgatggacgacgccacggtcgcatcgcggcagcgccagcagcagcagccggcctcgccggcgacgacgacgaaggattccagggacatgatggcggagctggacgcgccgctgcacgccctcgggttcgagatggaggagctctccccgtcgcggctcaccggccgcctccccgtcactcgcatctgctgccagccgttcaaggtgctgcacggcggcgtgtcggcgctggtggcggaggcgctggcgagcatgggcgcgcacatggcgtccgggtacagccgcgtcgccggcgtgcagctcagcatcaaccacttccgcagcgccgccctcggcgacaccgtcctcgcgcaggccgtccccgtccacgtcggacgctccacacaggtttgggaggtaaagctctggaagatggatgcatccacaggagagaaggggcctcagatcgccgaatccagagtcaccctgctgtctaacctgccgttgtcggagaagcacaagacggcaggagatgctctaaagaaatatgcatcaaaactgtagaaaagaaccttcaaactgatgaaaaccttgcatctcgcaggtttcacggatctgatggatgttgcaaaagcattgcctataatactatgtcttataccaccang

SEQ ID NO: 1138 - DNA, 660 bp, Sorghum bicolor
  unsure (1)..(660): unsure at all n locations
  Clone ID: SORBI-28MAY03-CLUS15837_1
tttttgcataaatgttaaaaataaatcttctctatttctcttgatttcctggtaggtatttaagtgtgtaaatctttggtgatgtgtattctgattaatattttttgctgcaaaacttcaacatctatacactgtataacaattctggtttttaattacagaagtatatgcagacccaactcactcatcatatgatgctcttgaattgcatttgggttgttctctaccttcacgccagcggctggcctcaagataatacaattgtacagggaaggatacaggcaggactgggaattgtcattcgaaaagaacactaggacaaaaggcggatggtatcaaggggggctgattgttgcaggtccgggtatcgataacatcttgtacatccacaaggacaaagaagccggagatgaccctgacatggaggatgtgttgagagcttgctgttcctgaaaattagtgcccccacgcccacacagtcactccatctcttgttgtaaaagtcaggttgtaagtagccctcatcaatcttcagcgatcctgttcagggtgtatgggcctttttttcttatatatatacggcgcgcggngaaagccaagctacatgtacatatgtatggttctatatagaaattaataaatttgtggatatctgcttgc

SEQ ID NO: 1139 - DNA, 575 bp, Sorghum bicolor
  unsure (1)..(575): unsure at all n locations
  Clone ID: SORBI-28MAY03-CLUS15864_1
aaaaaatggtccaaagatcaagcagacgttcttcaggtccataaagagcccttgcccacgctgaaggaagatgaagaggctgttgggatcataaccatggaggatgtcattgaggagcttctgcaggaggagatatacgatgagacagacgtacatgaggaacaatgacgcaggcctcgcgcccgctgtttatagttccctctatgtgttagaaaatgcggtgcggtatatgtaatgtacgtaaacgtatatgtatagatagacagatacattgagagatattttagccgtagcccgtagccgttcattgtagtactatatataggtggctggctgtctcgagtatatattggtaaagactgttcggagtgcgtcgtcctcgtccagaagaccggaacaggaacagcagcatggcttggctctggtcctgaaagggaaagaaacggaagcgttgacgcgtctgtgtagctgctgggttcagaagaaaccccaataagatactacgtatntgtttggttatatgtgatggcggcaggctgatacataccgtatgtgtatgtgaataccgagatgtg

SEQ ID NO: 1140 - DNA, 495 bp, Sorghum bicolor
  Clone ID: 9848084
gcacgaggcggaagtggttccaagaaaagcctctaagcttcagtctaacgagaccgtaccgcaaaccgacacaggtgggcgagatgagtattctaaggcgcttgagagaactcgggagaaggaactcggcaaattggtaccgtaacttcgggataaggtacgcccaagtagtttgactggcctgcgccagaaggacaaaagggttgcaataaaatggtggctgcgactgtttaataaaaacacagcactctgcaaacacgaaagtggacgtatagggtgtgacgcctgcccggtgctggaagattaaatgatgggcaacatttgcatgagaagaaagatgataatcaagaatcaatttcacattcaaataagagacatggagtagaacttgaggaaattgaaaatgttaggatgcaaagtctgcaaaaaataaagaaagagacatcacaacacacatttctgggaaataccaaggacaagacacctgcacaaagt

SEQ ID NO: 1141 - DNA, 196 bp, Sorghum bicolor
  Clone ID: LIB3480-049-P1-K1-D10
caaaagtgctcctctgttgaaactagtccaagggttggtacagtagatgggcaacatttgcatgagaagaaagatgataatcaagaatcaatttcacattcaaataagagacatggagtagaacttgaggaaattgaaaatgttaggatgcaaagtctgcaaaaaaaaaaaaaaaaaaaaaaagaataaaaaataa

SEQ ID NO: 1142 - DNA, 727 bp, Sorghum bicolor
  unsure (1)..(727): unsure at all n locations
  Clone ID: SORBI-28MAY03-CLUS15889_1
gactgaaacctgcatctatcatggcgangggcatctatggtgagatcaatgggaagaaaatctacatcggggacgaaaggatcatggcaaggtcctcctgtcatcaacatgcagctgcccaccaagaaacagatggtctgatgaaaggtgtgtcgatgggtctcgtgatctgcgacggcgacctcgtgggcaagttctcgctctccgacacctgcagaaccggggcggccgaggcgatcctgcagctgaaatcaatggggatcaagtcggtgatgctcaccggggacagcgcggcggcggcgaagcacgcgcaggagcagctcggcggcgtcctggaggagctccacgcggggctcctcccggaggacaaggtccggctgatcagagagctgcagacgaggcacggggcgacgatgatggtgggcgacggcatgaacgacgcgccggcgctggccgcggcggacgtgggcatctccatgggcctgtcgggctccgcggcggccatcgagacgagccacgccacgctcatgtccggcgacattctgagggtgcccaaggccgtccggctcgggcggcgcacccggcgcaccatcgccctgaacgtggcctcctccgtcgccaccaaggccgccgtcatggcgctcgccgtcgcgtggcgcccagtgctgtgggtggccgtgctcgccgacgtcggcacctgcctgctcgtcgtgctccacagcatgct

SEQ ID NO: 1143 - DNA, 701 bp, Sorghum bicolor
  Clone ID: SORBI-28MAY03-CLUS15912_1
cagccacggaagcccatgcccaaccaggccaacatcatcacggcgcagggccgccgggacaagcgctccgtcggcggcaccgtgctgcacaactgcaccatcgagccgcacccggacttcaaggccgacgccggcggcaagatcgccacctacctcgccaggccatggaaggagtactcccggacgctctacatccagaacgacatcgggggcttcatcgaccccaagggatggctcgagtggaacggcgacttcggcctcgagacgctcttctacgccgaggtcgacaaccgaggcgccggcgccgacatgagcaagcgcgccaagtggggcggcatcaagaccgtcacctacgaggaggcgcagaaggagttcaccgtcgagaccttcatccagggacagcagttcatcccaaagtggggggtgccattcataccgggattgctgccgcaggagcaacaaggaaggacgcactgatcataccatgcatctatcatccatccatccaggaccaccaccctgtgcttttacatttctaatttctttgtgcttcagcgtcaccgactgaccccccggcccagcccacctactaatatgtccactgtactctagtagtatttcgtcatttcccagtcttttttgttttgttttgtcaattgtcaattattaactatataaatattcgttccacaacctttttt

SEQ ID NO: 1144 - DNA, 579 bp, Sorghum bicolor
  Clone ID: SORBI-28MAY03-CLUS15906_1
cccacgcgtccgatagagtcttgcctgttccactccatcaaaggcgtgctgataaatccattcgccttggtcctcaaggtgacttaggaagaggaatgtcactttgtgggaagcaaccagtttcaaatgacattttgccggaagttcctttgaatagtcatcatggtcagacatcagaaaactcaagagacagttcatttacaggagtgacaagtaatccaacaagcttcagaaccagcaatacatcctggggaatggcggatctttcttcaccagtaccgtcaactataggtcaaacgcatacatcctccacagtcagaaaggagatgtgtgctgaagcgcagacattccctgaagaggttcttcaagagaaatctatactaaccataaaggaattttacagtgctaaggatgagaaggaggtcgctctgtgcatgaaagaactgaatgctcccagcttctatccttcccttgtgtccctttggatcactgactcgtttgaaagaaaagacctggaaagggaactcttggccaagcttttggtgtacttgtgcacagctcaagagcatttgctgagcc

SEQ ID NO: 1145 - DNA, 656 bp, Sorghum bicolor
  Clone ID: SORBI-28MAY03-CLUS19967_1
tccaatgatatcaattagcaagaatggcaagattttctcagagaccccatttgctgtccatgaagataatgatattggcagtgctcacaatggggaacaaggtgacaagcaagacatctaccagattggcctaattctcctggaggtgatcacaggcaaaccaacagagtcccaaagccaactagagtcactgaaagctcagctgagcgaggccctgactgaagacccagataggctgaaagacatggcagacccagcgatccatggtacttttgcagtggactccttgagcacagtcgctgagatatccctcaactgcacggctgctaacccaagcgaccggccttccgccggcggcgtactctggaatctgcggtactccatgcaagtgcaggatgggtgggcgagcagcgatagcttaggcttgagcgtcagatcacaggcttaggtgcgcagtgaatcacaggcttagataaaggcgcagtgattttgttcctacttcctacaaatgataattatgaagctctatgcaccgtcactctgtctcttgttttctgtttttttgtttcagagaagataggtcgctggtgttctctactgtacatatatatatgtggacctttcctttttcaaaaaaaaaaaaaaaaaggccccta

SEQ ID NO: 1146 - DNA, 751 bp, Sorghum bicolor
  Clone ID: SORBI-28MAY03-CLUS20033_1
gccggccgggctcgcgatcaggcaaccagggtatccggctatcagccaactcttggaccatcacgacgtcagagggccagccgcccagtcgacctctctgctcgctggaaatggcggcggcggcggcggaaggtctggctgcctaccgggcggtgctgcgggcggcgcggcggacgttcgcgggcgaccagctgatgctgaaggagtctgcggtggagatccggcgccgcttcgaggaccaccgtggtctagccccgggctccgacgaggcagcgcgtgccctcgccgacgcccgcgaggcggcgcacttcatcacccatatgatagtccaggccacacgcgcgccttccggatctttcgttgtgaagcctgagagtgttcatgctggagctacactggaggttccttccgaggagatcctttcaaagttgaaataggggaattgaagcgctcggctgtttgttgaagtaggtcatcaatcaccatctccaggctagtaaaataagatcagtttgcagcggttgcttcttgtgttgtatactggtgcatttggtagctttcacacttttgcctttctattactcacagcattttgctgcgccaagatacggtgtgtgcgtttgatgcaaagtagtttttgaaaattgactggcccttgagattttgagaaatgactgtatgatgaggaattattatgcaaaaaaagaaaaataacaggtttgttgcaaaaaaaaaaaaaaaaaaggcccct

SEQ ID NO: 1147 - DNA, 941 bp, Sorghum bicolor
  Clone ID: SORBI-28MAY03-CLUS16080_1
gcacgaggggtatccttggatacaacaggcaggagttgtaaccatggtgattcatgtgcacaaaatgcaaccactgaacactcagtaggtcctcttagcaccaaagtatgcggtgctcttcctactgacatggttcccaaaggctctgactatccagcaccaactggtgtaccagaaacgtctagttctgctggtgccaaatgcctgggttctcaaggcatggagggtgaaggtagagattctcctatgcagaacatgtcactgggaaactctgtagctcaacctgcgagataccaagatcctaatgtaacaagaatgccacctataagtggataatgccatggcaaaccgggaggttattaaagcagatttcctggtgtgaaagtttgcaattctgctccaacaatcatagggcctcctgcttgtgcttctctagctccaactaatgcttcaaagacccatgagattttggttccaggttcaactcctagtcctaagggccgtgagtctattgtgccaatcttggtacttggaaattcagaaagtgcaggcatcaagcgtctcaattctacaccaaggatgacacctgaaggccaggagtttctttcgcggggcattgcatcgcagagccctgttcttcatccagtgaaaagacctggtgcttcatcatcggctgccaggcctccaatctacccaccaggacgtggaaaatcaccatatgtgagcacaggggtccgtgattctctatcgctgagcatcacaccaaaacggcgttatcctccagtgcctacagcagagccaaagcaacaaggatctcctgcagctgattcaacgccaacgagcaatcgcccacctcaagccatggatgcggccactaaggttcacaatgctcctacaccaataacagggagagaaaaggccagctgttgacagaatagctg

SEQ ID NO: 1148 - DNA, 676 bp, Sorghum bicolor
  unsure (1)..(676): unsure at all n locations
  Clone ID: SORBI-28MAY03-CLUS16082_1
gcacgaggatcagtcatcacaatggggtcaatggcagcatcctcctccctgggctctgccaaagccctagcgtgctcccacgcctccctcctcgcgccccaattccaaagaccagtggtcgcgccagctccgtcgcgccgcacttccgtcaggatgcgcgcttctgctactgctgccccggcggagccgaagaagaccgtctgggtgtggaccgagagccggcaggtgatgacggcggccgtggagaggggctggagcactttcctcttcggatccaaagatctcggcaaggactgcaactgctcgcatcaatcctctattcattgatggcccggagattttcaatggggaaaaccaaaaggttgctgtaatttcacaagtctcttcgcccagtgaacttgaccgtgtacaacctgaaaatgccgaagccgagaacattgtcatagactttcgaggtgattggcaggttataccggcagaaaatatagttgctgctttcacaggatgcaaaggaactgtattggctggttctaccaactcaactgaggcacaagtttttcttgaggcctnggagcaagggctngatggagttgtacttaaagcagatgacatggatgatatcattaagctcaaggattattttgacagaaggaacgaggcaaagagtcaattacca

SEQ ID NO: 1149 - DNA, 651 bp, Sorghum bicolor
  Clone ID: SORBI-28MAY03-CLUS16121_1
cagaggagaacattccctacctttgcatagatctagtctaccaatacacattacttgtcgatggttttggtgttgatccttatcaagacattaccttggtaaagaaagtaccttatggtgattcgtatgttgaagcagcatggccccttggtagtgccattgaggttgcatcttcatcatagaaacagcacggcagtaacttatttttcatttttttatatataatatatatatataaatcttccatcgttatagtttttggcttagtttactgatctgtagtagtgagtttagatcctgggtttgacgctagggttttgccttgattcaccatttgttatccatttccattctatttgtttaggttcctacacattaacaacgtatacatggaggagtatagattgtagttctgtgccagcattttcccctttacgtccccagttatttagaagcctttgtcattcatcgttagtatgctttgtgggttgttcaatgtgataccattctttttgttccctttcgccaattgggattgctcaatgtaataaacgcatggtttgcctttgttccctggatggttcattggttcatttgtagtcttgtagatttaaagcctcttgtcacaaatatttaggccctgtttggccc

SEQ ID NO: 1150 - DNA, 558 bp, Sorghum bicolor
  unsure (1)..(558): unsure at all n locations
  Clone ID: SORBI-28MAY03-CLUS16125_1
ggtagcttggatgacaatgatgctgcccccaaaggggctgcagatggagaccattctgaagaagacatgaacaagggtttggatgaggaggtgggcgatgatggggatgaagagctggaagaggaagaaatggatgcctccaacaagaggcagtgtgttagacttgaaaacggggaagttggggatcactcctctggcgccgtagcagaggccatacccataccagacggggacgccacgctccaggctgagcaagccaagaatcaaacaacgttggccgggactgatgaacagtgaacaatacgtttgccactattttcagaacagcattggttttggatttttgagcgttctctctggtattccatgtattttaaataatttctgttgtactcgtaactgattgttctaacggtggcggggactgatgaacaatgaaacccacgtttgccactgttttgcataacagcatcggttttgtattttttgggggggcgtttttttnctggtattcaatgtattttaaatagtttttttccttttttttggganaaaaat

SEQ ID NO: 1151 - DNA, 822 bp, Sorghum bicolor
  Clone ID: SORBI-28MAY03-CLUS16131_1
tttcccttttgccaatgtacacatcactgaatgcagaatgaagtgtcacaggtgcctttttaagaacagcacagctctacaaactggtcaagacgaattactttcataagtactctttagctctactaagttgtatatcttccaaaaaaaaatctactaagttgtaccagtaacttttcttcgaatagctttctataccaaagaaaaaaattttacctctgaaaggcattccattattcgtttgcagcattcaaactgaagaacagtgatggcgaactgatctgctagtagaagaagttgaaccaacactgatgtagtatccctagtatccaacttaagtttcccgtagtacataaactgaaggaggagaaagaatggttcaggaggaacatctccgaaaaagatatccgtggcactgctttccctcatcccgtttgtgaacatcttggcaagtggagcgctccacaggctaaggataagcttgtgacccttactgacaagaccatgtccattaacatagatatttatatcactatgttcaccatttgcaaggaactctccaactttctgcacattcagtggtgctttgagtggagaagagtcaaatctatgatcttggagtccgctttttggaaattttattaagatttttccagaatcagaaagtttcttatccacttctaaacagtcaatgatttctttgcagcacttcaccagtggttcgactttaaactgcgagctcaactccagcacagaagttagtagccattcaacaatctgcgtcgaacctgtatagatatactcaagaaaggagtggagaac

SEQ ID NO: 1152 - DNA, 644 bp, Sorghum bicolor
  Clone ID: SORBI-28MAY03-CLUS16188_1
cgccggcaaagcggctgcccggccgccggctcctcatcatcacggcggtgacacgacgaccggcggcagcggaagatcgccgaaggttgttgccgctcgtggcgactttgcgtcttccaacctgagcaagcctatcaagaagcagccgcagcagcagcatgcgcagcggctcttgctgcggcggtcggcgtcggaccttggcacccgtgtcgtccgcaacgaccacgacgcgccaccgccgccgtcgcccggcgtcgcgcgtggcaggccgagggtccggaggtacaagctcctagaagaggtgatcactagctagctatagccatataccccgtgtggtatatcgatgtcgatcgtggatgacacgatcgagtgcgtgtgcgtgtattaggtgtataatacgtgtgtgtgtgtgtatgtgtgtgtataggggtagacaactagacatggcatcttgcggtgctgccatgcatgcatggagatcgatcgagcagtgtatcgtacgtactacgtgctgatcgatctcaggtgtgctgatcgatctcaggtgttaatcagggtgctcgcttcgtgttgtggtacatgagaggaataatatacgcgcagctcgatcatgcggtgtgcagctatatatagcttgatcg

SEQ ID NO: 1153 - DNA, 571 bp, Sorghum bicolor
  Clone ID: SORBI-28MAY03-CLUS16162_1
agcaccggaatggcaggcccgacccaggcgtccggtgggttcatcctcaagagaccaggacatgcttaacaaccctgccaaaatgcaggagcttatggcccttcatcaggcccaggcccaggctcagatgtttaagcggcagtgtgagcagaaagagcaggggcaatcaagcagtagtgagcaaagaagtggcgatatgaggcctcctatgcctcctcaaggagtccctggacagcagttgccatcaatgggtatgatcaggcccatgcagccagtgcaaggccaggtgggcatgggcagcgccggtggcggcccgataacacctgcgcagtttcaagccatccaagcctgggcaaaagagcacaactttgacctgtccaatcctgcaaacatgagtgcaatttctcaactcctgccaatctggcaggccaacaggatggcagctatgcagaagcagaatgaggcaaacatggctgcacagcagcaagcaatgccctctcaggtgaacagtgacaccccagggcacggtaacgctccaagccagggtgccctactgaagccccggcaacaa

SEQ ID NO: 1154 - DNA, 514 bp, Sorghum bicolor
  Clone ID: SORBI-28MAY03-CLUS16194_1
tgggaattgctgtatagatcatgccgtcgtacacttgcctcagtcttatccactcgccccaggctgcccccttctatgaactcaccaaccaggttgatcgagcaagtcctgccatttgcccgtgaaacagtggatttggtccttgatggacttgcatcaatgccaatgattataccgcctagtgatcttgatgagttctcaaacttcctcaaagtgatgtgccagcaggcacgccattggatttcaggtgaggggccgatgcccagtaatctgtacagcagggagtctgagcatggtgacacatggatatggaggttccacaacatgtcgatggatatgttgaaaaggttggatgagtgcttgaagacattggagatggacctgtcattatcatcagagagtactggggtcatggatagtcaaaccacatgggctgctcgatcacacatcctggtcatattgactgaacttgatttcatctcggcgatttatgaagatgtggggcacaacctac

SEQ ID NO: 1155 - DNA, 212 bp, Sorghum bicolor
  Clone ID: SORBI-28MAY03-CLUS15812_1
gcacgaggctcctctacgacgccagcaacccgttcgtcgcgctgccgcccaccatgccgtcgccgtcgcccacgcactcgccgctgcagatcaaccagaactacccgctcctgaaccagatgcaggtgttccaccacatcggaggcagccaccaccagcagcagcagcagccgcagccggcgttccaccaggacaacggcagcgcgggcgcg

SEQ ID NO: 1156 - DNA, 920 bp, Sorghum bicolor
  Clone ID: SORBI-28MAY03-CLUS15813_1
gtggaagcagcaagggctacgcttgatcaggtcaaagtggaagacatagacactaatgtagctgtcctaaaggaactactatttcctttgattgaaataggcaaaaggctgctcgctttggccgggtgggaagagccctttaaatcttttgtcttcttgttatgtttcctctacatggcatacagtggttggatctggttcatgtttcctggatttttgcttggttctactctcttcatgctatggaacaaacattatgggaatgggcgctcggtagaagcatttgagatcataactcctcctcgaagaagaactgtggaacagctcctagctttgcaacaggccatctcgcagctggaagcacatgtgcaagcagggaacatttttctcctcaagctccggtccctcatgcttgcagcatttcctcagagcaccaacagagttgcagctgcacttgtcgttgtggccatgttattcacattcatgccattgagaaccattgttctactgattcttctagaagaatacacaagacagatgccattgaggaaaaagagcagcgaaaagttggtgagaaggttaagggagtggtggctccggattccggctgcgcctgtacaacttctaaagcctcgggacactaggagatggagatcgagattgagataagataagcaagtaaaaaaaatgttggtttgattgctttacgccatgctccatggacattcttttgagcggtagagatattggtatcatgccgtcaaaatgagtgttcagatgaaaaaaaaacccttagtttaagctaggcctgattttaacaagtggaaatagatgaagaaatggtgtcttgttcattgtagcaaacatatatggcttttcctgatatgacggaaaaagaatagatgaaagaattaaatctt

SEQ ID NO: 1157 - DNA, 571 bp, Sorghum bicolor
  Clone ID: SORBI-28MAY03-CLUS15819_1
cccggactcccccgtccacctctgcttcgccatgaacgcgcggcccatgctgcacgcctcgctcccgcgtggcggcgccgggttctacggcaactgctactacatcatgcgcgtgtcggcgcccgcggggaaagtggccgggtcctcggtcacggaggtggtgaagatcatcaaggacgggaagcggcggatgcccgcggagttcgcgcggtgggcggcgggggaggtgggcgccgccggcgtcgacccgtaccagatcacgtccgactaccggaccctgctggtgtccgactggacgcgcctcggcttcgcggaggtggactacgggtggggcccgccggcccacgtcgtgccactgacgaacctggactacatcgccacgtgtatcttggtgaagccgtgggcccacaagccaggggcgcggctcatcacgcagtgcgtcaccccggaccgcgtcgccgccttccacgagggcatgctcgacaccagctgttgaacaggtctgtcggtctgtgtgtgttggaatggatgagaagtacgtacagcccaaggcgttaatggattaaggtta

SEQ ID NO: 1158 - DNA, 598 bp, Sorghum bicolor
  Clone ID: SORBI-28MAY03-CLUS16287_1
gtcgccaccatggatgccctcctctgtcctcgcctccattgcgtaccagcacctcagcctccgcacagtgaatcccgcatgggcgcatctccctgcctcctctagggtttcttctctctttgttcctctcactaatccttgtagatcttggggaagaagatccgaggcaattcaggatccccggcgagacaacgacggcgagactagttctctctgcaaccacacgtccacagctctatgtctcagccggccgcggaacgtccgccccttgtacagccttactgggcctgtcagttggtaaaggaacgaaaattacaaggccccttcactcatggagtccctgttggcgattcaagcatggaattcagctttaacaaccatatggaagtgcatatgggtttgtcagattaatgctttttgtgcacatggaaatctcagtaatctgcattattcagtttcttgagctccaattacatagatattatggcaatctcatcctcccctgcgtctcctgccatgtgattcacctgcaccttcttgtgatgtgcgttgttcgcttgttctacagccacgaacatagacaggtgccctacaggct

SEQ ID NO: 1159 - DNA, 475 bp, Sorghum bicolor
  Clone ID: SORBI-28MAY03-CLUS16294_1
ggagctggcagttcaattttcagtctacattcagaatcgtgcagcggccattttcaagcgagatatgaaattatgccccatatttagcaacttaaagactttggtgctcaatgggtgggctgtggcctgtgaacttgatgcactaatttgtttccttcagcatgcgccaatcctagagaagatcactcttcaacttaatggacttaactatgatgtggaaatgagagaaagttgtagttcaaatgaaaaaattgctctgcctgagcaccttaaattagtcgaagtcagatgccaaaagattgctgaaaatgttcacagatttgtggatgtcttgaatgcctatggcataacttctgatataatcaatatcgtggagatggatgtctgatccaaatgcatcggtttgaagaggctaaagggtgatcttgctgttgatggatcaaccagtcgttaacctccagggaaaaaatgagat

SEQ ID NO: 1160 - DNA, 676 bp, Sorghum bicolor
  unsure (1)..(676): unsure at all n locations
  Clone ID: SORBI-28MAY03-CLUS163_1
cgttcggtggngcgcaccctggcgccnggggtttgatacggggccgggctgggcatgtcgcgggacgacgccgtcgccatggtgctgcggtgcccggcgctcttcaccttcagcatcgagcggaacttcaggcccaagttcgagtacctggtggacgccatgggcggcggcgtcgaggaggggggggggcggcccgcattacttcgccttcagcctcgagaagcggatcgcgccccgccaccgcgccgcggaggacgccggcgtcgcgctgccgctgccggacatgctcaaggccaccgacgaggagttcaaggagatgctcgacaaggagcgggagctgctgcaggagcagacagcgacgacggactgatcgagggccgcgccatgctttgtatgcttgtttgcgcctgatccgaagaatgcaagtattcaaccgccgtctacatggcgagtgtcctggccatgacggtagcaatgtagccatttgatttgagtaattattagcctgtacatatgcattaacaatattatttggttagtagccacgactcgtaagctcaggagagatgcctgttcttcctccaattgaataagcaccgtgcaggaagtcgtgcctctatgtacaaaaaaaatacatgtatgaattttgtatgaatgtaccaacagccttaaattt

SEQ ID NO: 1161 - DNA, 496 bp, Sorghum bicolor
  Clone ID: SORBI-28MAY03-CLUS16330_1
gaagcgggccttctccttctccatcgcgctgtccaagcaggagatcgccgaggacttcgcggcgattcgcgggacacggcccccgcgccggcccaagaagcgcccgcgcacggtgcagcggcagctcgacttgctgtacccgggattgtgcctagcagatgtggcgcctggttcctataagattgaagagaggtgattgttgctttggtggagcttcggatggacggggtttccattcttcttcttcttctgatagctaacacgtctgtttcataagtgttctgttttcggtggattagaggaagttgaggtgggatttcctgtgattatgtattggagtgtggttggggaggaggttagcttcttcagtttgattactggggcttgtaggattgtcaattgtgtaaagaattctgatccactaggtgggatgtcttgtcctggcgtcctgcactgtacatggtttaatatatgaagcagttttagtcgttggatt

SEQ ID NO: 1162 - DNA, 678 bp, Sorghum bicolor
  Clone ID: SORBI-28MAY03-CLUS16360_1
tatgctggcatcatagcacttgtgatgagcattgcagcgatggtccgtgtgacccgcaacatgcctgggaaggtacttggcctgccataggtggaggtaagcctgctaccctctcagaaagtaaatcaaaaatacaagagcggcagcaacccaagctatcagaagaggctgtgaaggaagctgaagatgccgtctccgcaaagcgcctcgtcgagcttgaggagaaggtcattgcactcctgacaaaacctgcatcaatgcctgttgacaaggaggacattctgcaggctgctgtcaaccgcgttagtgcactggaagaggagcttgcagctacaaagaagaccttgcaggagactcttgagcgtcaaatggagatagttgcatacattgagaagaaaaagaagaaaagcaagcgtttgtttcgttggtagaagcaaacaacactgaaagtgttcacgtccatgagaaaaggtcttgcgtgtgaatggaagtgagctggtgtttgcatatgccagcaaattacgattctgggtgtaacatataacattcttttattcttctttttattcccttgttgcatcaaactgtgcctttaccacgttgatgtgctgccaaattgtcaatcccatccctgatatggtcaattcatggatggacggactgctgagtatttgcaat

SEQ ID NO: 1163 - DNA, 574 bp, Sorghum bicolor
  Clone ID: SORBI-28MAY03-CLUS16363_1
gcacgaggatgaacttcaacaaacttgtatatgcacattatgtggaacgctgcccaaaatcggaaccttttttcgatcctcttgcagttgacccacgcgcatgcacaaggaaacgagctcctaaaattgttgaggcggttctttcacttgagcagaaagttgtctctactgcagctctatctgatgctgaaaggttttctcagataccatacttcatggaagggtcatcgagtgcaaatgatggccatcatgctgttgctggtaataagcgaaaacatgaagccttagaagttgatgaagaggattccataattgcagaaagtgaatttctctggcggataaattttgagaggttcatattttgtttaaagaagaagttctgtgcagaacgaaagaaagcaaagatgaggcttggaacacttgctatatgggaagcattttttgaggccaatgtaacagacaacgacaacaagactgtgacatcaccaatagatggaattttggagagagtaggacaaaaggaatgaggcacgtcaatgactttggatcagataataagtgtattgaatgattt

SEQ ID NO: 1164 - DNA, 518 bp, Sorghum bicolor
  Clone ID: SORBI-28MAY03-CLUS16375_1
agacccccctccacaggccggcgtcgtcggtggtcggagagattgggaagcatagtacgctggtgtacagctttgtggcgcgaggaaccgttgtgctagcagaccacgctgaggtctccggcaactttgcctccgtcgccgcacagtgcctgcagaagctccctaccaacaacaatcgttttaactacaactgtgatgggcacacattcaactaccacattcatgatggattcacatattgcgttgttgctactgaatcagctggtcgacaacttccaattggatttattgagagagtgaaagaagattttttcaagaaatatggcggagggaaaggtaaaactgctaatgccaatggcctcaagcgagaatatgggcctaaacttaaagagcacatgaggtattgtgaccagcaccctgaggagattgacaaacttgcaaaagtgaaggctcacgtcacagaggtcaagggagtaatgatgcaaaacattgagaaggtactagatcgtggtgaaaaa

SEQ ID NO: 1165 - DNA, 897 bp, Sorghum bicolor
  unsure (1)..(897): unsure at all n locations
  Clone ID: SORBI-28MAY03-CLUS16409_1
cccacgcgtccggagatctcttcaggccacagccaacagaatgatcctgtcacaggaagagctggaggaggtggtgctaaagaggtgttggctggcccgctactggacattatgttctaaacttgggatacattctgatattgctgaagacaaaaaagaatactggtcctcatttgcaccgcgtgcacttgaagcagtcctatcaattgggcaaaaggcaagagatggaactttatcagataatgctgacatggagagcagaagcaaaatgtctgatgtaaatgacatatctagtgatggcaatgttgagaccatgctttcagttgagaaaggattacgtgaattggcttcactcaaggtagaggatgcaatcatgcttactttggccgaaaatcgacatatcaaacctctctcaggccaagcttctgagggtaggagcccttctgagtcattagagttaagtgcggatgagcgagaggatgtacgcttcaagcaggcatggttgacctatttctggaggagggccaaaaatcacaacatagaagaagatatagctgatgagcggctacagttttggatagaacaaatcaatcacccagttactacgagtgacgtaatagaagttgagagaggactccacgagctgaagaagctgggaatcgagtctcatctgtgggatgcgacgaggaaagctcaagctctggatgatgatttaagcaaccacgggagtccaactggatctgaagcttaggaaacaaatttagcaaatgcataaacatggagcgaggctctattgccgattttgtgccgtcagaggccctagagccctcctgatattcttttcngtgttgttaatgtcccttgctttgtaacatattgaactttgataaaatatat

SEQ ID NO: 1166 - DNA, 540 bp, Sorghum bicolor
  unsure (1)..(540): unsure at all n locations
  Clone ID: SORBI-28MAY03-CLUS15962_1
cggacgcgtgggggaccaccggagaaggctactgacaaggccatggagcagatcgnngacgcgcaagccacgccggcggtgaccgccgacaccgaccagaagtccaatgcagaagctgacacggccacagcctcggctacggaggtaaagaaagagaaatctgcatatcctaactagaaggtgtagagaaggcagaaaattgagaagcctgatgagtctggtaaatgagatattttacaaagctggctggcgtgatcatcagtgaaatagtggatatgagagaggatgggaggattgatgaaacgttggaatcatgagcgtgtaagctagaggaggtctcggtgaaataaggtggggcgctttgctatgtaactgaatacctcatgtactcaatgttaatcatatattgtaaataaaaggtgactaatagatacgaagaggattgattatgctgtccaaaacaaaaaacaacagcagaggaggaggatacacgcataaaaaacaaatacagtagccaacgccataaaaaaccaaaactta

SEQ ID NO: 1167 - DNA, 563 bp, Sorghum bicolor
  Clone ID: SORBI-28MAY03-CLUS16020_1
gcgcggcgcgcaccgccgctccgtcagcgactccgtggcttttctcgaggccggccccgacgacggcaatgccggcgtcggggcgcacgacttcgaccgcctcgacgacgaccagctcctgtccatgttctccgacgacctgcagccgccgccgccgccaacgacgacgaccgcgcaagccgcgccggtggcgagctcctcgtcgccgtccgaccacaacagcatcaacgacgagaagacggacaggggcgaggccgaggaggcgcagagcaagtgccacggcgacgccaccgccgacgccgcgccggcctccgccgccccggtcgatcctaagcgtgtcaagaggatcctggcgaaccggcagtccgcgcagcggtcgcgcgtgcgcaagctgcagtacatctcggagttggagcgcagcgtcacgtcgcagcaggtgaccgccattgccctgttcccgcgcgtggggttcctcgaccaccagcgctcgctgctgacgctggggaacagccacctcaagcagcgaatcgccgcgctcgcgcaggacaagatctttaaagatg

SEQ ID NO: 1168 - DNA, 686 bp, Sorghum bicolor
  Clone ID: SORBI-28MAY03-CLUS16064_1
cacaaaccatatgacatcatgtgctgtattggtaattcaaaatcattgataattatatataacaataatcatgtgctccactttatttgaagcataatttacctttgatttcttatgtgcagtttttctgactccttcttataacccttctcttgaaggttataagattgtctgcagcaactcaggatgttcctaggtctgtgatttgtaatgttcatggagttaaccccaaatttattgaaattggcaaattgaaacatcaggagctatgccaaagagaacaagcattcttcaagggtgcatattatattggaaagatggtttggagtaaaggttacacagagcttcttcatcttcttcataagcaccaaatggaattgtctgttcttaaaatggagttgtatggcagtggggaagatgctgatgaagtaaaagcatcagctgagcgactgagcttagatattagagtctatccaggccgtgatcatggagattcaatatttcacgagtgagtattcaatagatgcccaataccttttcatacattcttaacagctgctagagaagcttatgttctggggaagattatgatctgtgcttatgctctctcaaatgactttttcaaaagatttcctaattgtcacatgtacagtactgagaaagagtttgtgacactaacaatgaaa

SEQ ID NO: 1169 - DNA, 650 bp, Sorghum bicolor
  Clone ID: SORBI-28MAY03-CLUS16539_1
gccgcttcttccgcctctacttcctggagcgccaccgctcgctggtgctcgacacctacctgcctcgcgtccgccagctcggccgcgacgtcatggtcaagaaccgccagcggaagctcttcaccaacatctccaccagccagtggagcgacggcgggtacatgaggtcggcgtggagccatgtggtgttcgagcaccccaagacgttcgacacgctcgccatggaccccgtccagaagaagaggatcaaggctgacctcgacatgttcaagagcggcaaggactactacaagcgcgtcggcaaggcgtggaagcgcgggtacctcctgtacggaccccccgggacggggaagtcggccatgatcgccgccatggccaaccacctcgactacgacatctacgacatcgagctcacgtccgtgcacaccaacaccgacctccgcaagctcttcatcgagaccaccagcaagtccatcatcgtcatcgaggacatcgactgctccctcgacctcaccggcgcgcgcgagaagaagcggcggcggaggaggacgacaaggacaagaagggcggcggccccgtcaggcccggcgagaagaggacaccagcagcaaggtgacgctgtcgggcctgctcaacttcatcgacgggct

SEQ ID NO: 1170 - DNA, 877 bp, Sorghum bicolor
  Clone ID: SORBI-28MAY03-CLUS16559_1
caatggctggggggttgaggatcgctgtcccagcactaactatagcaatgcaactgaaggtacttcaatgttacttctctcttgcaaataagttactactgtgccttgcacactatatttatctgacgccttctacagtggaagatctagagagatgtaatgccatggtgggcacagaagaggacataaataactcaaaacatcatacagctgccaaacatggagagccaaccaagttttttccatttaaacagggataccttgctattgcaacactgcgtgtaggatcggagggtatccatatgacagttgatgggaaacatgtcacttcatttgcatatagggcggtaaacttcttccacatcaccaaatggatcattaaatagatctgatatgagaccaatcctaacgaactggtgtttctcttattagggtttggaaccatggtatgtaactgaagtaggaatttctggtgatttcaaacttgtaagtgcgattgtaagcggcttgcccacatcagaagacttggagaactctaatattgaagcgttgaagtcaccacctattccagacgacaaagatgtagaccttctgattggcatcttttcaacagcaaacaacttcaagcgtaggatggcaattcgaaggacatggatgcaatatgacgctgtgcgccaaggagcagtagcagtccgatttttcgttggcctgcatacaaacctaatggtaaatgaggaactctggaatgaggcacaaacgtatggtgacatccaggtgttgccttttgttgattactacagcctgataacatggaagacactagcaatatgcatttatgggatgagatccaatccacagtaaaacagcttaatgtcag

SEQ ID NO: 1171 - DNA, 745 bp, Sorghum bicolor
  Clone ID: SORBI-28MAY03-CLUS16565_1
ctagttctaagatgggaggaagagtaggttattcagcccgagactcgagatgatcgatcttgaaatgagaagagaaggacccacccaataaataaactattccaatgactttgttcgcttcccctgaaaggtaaaatggtttatttgcacctgtagtgggacacctctcccagctcccagccagggttcaagcaggaaactatgttaaggagctgatccgaatacagatacaaggcccccactcatcacaacgaacggtgagctttcccactagccttcacaggagcagcacaatcatggccaaaaacaaaaaaaaaagatatcgtagtacgagaaaaccaatggcatttatctattctaagtagtttcttcttttctttttagaggacctggccaactctaattccaatgctgcaatcctattggtttactgaatgagggtgggtagaccgaaagaagtgttgttatttacttccttcgataacatagattgtccactcttatgccccatgcataaaaatggcttgtgctttagcacgtttcgaataaaagaatagaaaaaaagtaggtggatcgggatcgctattacgagtattcgagttcttgttttcctttccttggaaagggaataaaaaatgattcatgcgaagtgcaccggtagaaatgtgactaaatatgatcttgatccatagctcgtccactttcttgataaacgacttgatgcattttctcttccttgccgctg

SEQ ID NO: 1172 - DNA, 696 bp, Sorghum bicolor
  Clone ID: SORBI-28MAY03-CLUS16587_1
gcgtgatcgcgggctgtgggactcgcagatctactgcatgaagttaactgaaaactcgtcagattctagctgtcatgaaagttaactgaaaactcgtccgttttcacaatttctaacacatgcttttggacaaaataactcaactttcgccatcaccaccaagaagaaactgtcgtttactaaaccctgattcaaacttatgcaggtaagactaaagggaggccaaacgcccaaatcactgaagcaatgcatggtatgacagtacgacactcatctgctcctcgtatcgccggcaccactgggtggaaggatggaatctgaagatgcacggcgcggcaggcttcagtgcagacagaaagccagggctcatccgcccggccggtgcccccaaatttttggttcgagaagttgtgcataccgatcgctacgtccgtctgctcccttactttgcatctgtctgtggttctgtggcaagtgaacgtagtatgaactgtaaatattatggaacatttgtgcttcggcctcctgcagccaatgcaatgcaggacgagccgtgtggcagatgcttttgttgccttgttgacccggaattgtggatacctgtcacgtgcgggcagaggtgacaatgggcatctttaaatttagtttttataatatccagctttcaaggggatttggaagcttttcatgttagct

SEQ ID NO: 1173 - DNA, 647 bp, Sorghum bicolor
  Clone ID: SORBI-28MAY03-CLUS16597_1
ggaaagataagacatttatgtccaaggatgtgccacggatcccgccattgtaccctatcctaagcacgctagtaacatgatgtcgtctaccttgccattccgggtgatgtggaagaagtggaaggttactggtttaggggagcgaagctcctgctttctgttaacacgcgcaaaaacagggtcatctctgccacccagcaaaaacacccaagagcattggtgagatggcgctacatcctcgccgccagtgtttcccactcccagttgggctcaaagtatcaccaaggagcctgcgaagcaattgggatgggggcaagcacctaaaaggatgaagtttgaatgacctccgcaactttatcatgtgaagttgaagccttttgatgatcagtctcccaattgatgtcatgcgtctagcatcattacatggtctttcttgcagcatggttgaatgtcctgtttttaataactaaatgacctggtcaatattatcactacctatatttcatattgattgctgcggtatgtaatatttaccgtttatagcacggcactttaagctcttgtgcttgtgaggattatctatgaatcatgtaccaacaccggtcaccctttcttatatcctcccgtatcgtgtttttattaatgct

SEQ ID NO: 1174 - DNA, 650 bp, Sorghum bicolor
  unsure (1)..(650): unsure at all n locations
  Clone ID: SORBI-28MAY03-CLUS16613_1
gggggactggcatttgctcatcactgcctgactggtanacgaatcctcaggttagcgacgggagcaattcctggtacacgtgactatgataaacagcagtgcatggatctgaacctcctgcctcctcaagttcaacaccctgtatatggctggtgatttgaaccatttcacattgaactatgtatagttgagggatatttctccataggtatgtacatattaagtgatccagttcccgtgtactgacaggagcatgaacttttgtagagtcttggtaattcctagggtccatgaggaacatgtcttgttgcactctttgactgtaattatattccttttcactctccaaataggttagttatgtagttgaatgatctttcatcagaggtatgtgtatacaaccattatgtagttcacatgattcccagtgcctgtactctgatggagtcttttagggcagtaaggaatctaaggattgtgacttgtttcagtttcctctgccatagtttgttcaaaaagcgtgtgactagctgaagcaacaatactcaaactgaagattcagtaatgagagcaattaagacattgattcaaaaatacttgccttnccttactaacctatgatgcaattgaaaattggaattgtctcgacc

SEQ ID NO: 1175 - DNA, 417 bp, Sorghum bicolor
  Clone ID: SORBI-28MAY03-CLUS16626_1
ctatcagcgtgtcagcagtgagtggtggcaactgcacattgcggtacgtcatgttatacttctaataatattcttttggtccttgcagccaaatttttgtactagctcagttaatgcatgcaactagctagaatactgctctccaaatcgggccttagctttttaccgagtctttgcttgtattgttgtttcagggatgtttccttttggaataatgaagtgctcagtgttgaactacaacagtataattttttttccagccggttgcttgatgctgcatgttcctgggacatcagaagtaattgatttcattggccccaaaataaaatcagatgtatctatctgtccaagtattacctatcaaccggtgaggcctgcgtgctatattacttgacaattgacaaatgtaatagttat

SEQ ID NO: 1176 - DNA, 515 bp, Sorghum bicolor
  Clone ID: SORBI-28MAY03-CLUS16213_1
ttgcagcatatgttgatgatcatcaacatcattccatttgcaacaaaccatatcaccaggtcatcaaccatcaaaggtagccgaatttttgagatggcacgatgcaatatggtgaactggcctgcgagaatccgggcatggctcttttactgagagtgtacatatttatcagagcaacgtccttgtaggagtgaacactgcggaggcttcaagtatcagcattgttccgttccaactgataagaatacgccctttcaattttgctcttttgcaggtcaaacctcgacctgagctgtttctgtagtgtgctagcagttaacctattcgaaacatttattgacctgtgacgcccatttcatccatgttggggttacacggtgtaaaatgagaacacttgtgggtccagattcattcctagtgccttaaaaggagggctgattttgcccgatagtggcttgtttcccaataagaggcaataatgaaacgtgtgttcattgtttattgacatggctacc

SEQ ID NO: 1177 - DNA, 604 bp, Sorghum bicolor
  Clone ID: SORBI-28MAY03-CLUS16276_1
aaattagctagggatttccataattatccagctttgggtggacttgtccagacccttatgggctatgttgttggcggtgacagttcaaattgggtgggagtgcttggtctgccccactacaacatggatgacatgcctggtgtgtcatttcatgttgcgcttcaccttgctcagataaagagggcaaagaagttccaaatgtatgactacggcagccctgcagcaaatattgaagcgtatggaactccggaaccattggacttgggagctcattatggtctcattgacattcctgtggacttagtcgctgggcagagggacagagttatctcaccatccatggtaaagaagcactacaagctgatgcggaagtctggcgtggaggtttcatataatgagtttgagtatgcccatttggatttcacgttctcacatagggaggagcttttgtcttatgttatgtcccgtctactgttagtaaccgatcctggtaaagggcgcatcaagcagcccaccatgcgcctcagcaggcagaagaaagctcagtcagagattgagaaggacatggagtgcagagccaaggaggaatcagatgaactagctg

SEQ ID NO: 1178 - DNA, 754 bp, Sorghum bicolor
  unsure (1)..(754): unsure at all n locations
  Clone ID: SORBI-28MAY03-CLUS16654_1
nnnnnnnnnnnnnnnnnnnnnnnnnnnnnnngggcaggaccgataaaaaaacaaaaaatactgaaccaccaaaaaaaggaataataggagctagaaaaaacactttaagatcagcagcagcagcagccaccacggctgacgatggttgctgacctgaataaggcatttatttatttttcccgaatgatgcatagccttcacctggtggacaatggtggagaactcatgctggtgcaccgaactattggccagggcaaatgcagggagtatgatgtttatagattggatttcgaagctgggatcttgatcccagtcaagcgcctcaatggacgcgccgtgttcatgggcatgcagcgcaccatttcggtatcagcagaggcatttccctatgtcagtgctgataccatctatttgggatatggatgtgatagaaacactgaggagtacaatattgcagatggaagcagatacagtcggtctaggatctatgatggatcggtatccccagataccattgtccaaagtctgatctgctactgcatcaaggacaaggacatactgggcactgaaaatgctgggcacttgtcactactgtcgaaactcaccggctagtttctgacacaattcactctactatttctcgttctgagacgggatttatagctatggtggttcattgtctaaacaaaattaacatgtcgatatacaagtatatgaattacaaagcataattaaaaaaaggacatatagattc

SEQ ID NO: 1179 - DNA, 656 bp, Sorghum bicolor
  Clone ID: SORBI-28MAY03-CLUS16720_1
cacagaactctgaaacatagtgaactttcagtagtcgcatggtaggtcatgatatttttctgctaattagttcctcactattctgtacttttgttcagatattggatcgtcgtgggaagattgaacttttggtgggtaagacagagaccttacagtcgcaggtcgagctacatctgtatgttactccacctggtgtaggccatcaaacactattcttctccgtctccacatccccttcctccagtccagaacaggtagactacagggattgtgggttatttcaatgggaaataggggctctcctgcaccattgggtgacaagactaactctattaatgaaggaagtgatgttgtacagcgtaggcgagaaagagataaggctcgatggcatgcaatgtctcaagagaaaaaggatgaaaaaaataaaaaacgtcgagaagcatataaaagaaaaaagaagcaacaactgtgtattgaaacaatcaatggttgtatagtagaaatattggtgaataaaatatagatattactattcatgtttctcaaaaaaaaaaaaaaaaaaaaaaaaaggcggccgcccgcgatctagaactagcatagattcagctttgccttttgcggggcgtttctactgtgccaccaacagaggtatcatg

SEQ ID NO: 1180 - DNA, 748 bp, Sorghum bicolor
  unsure (1)..(748): unsure at all n locations
  Clone ID: SORBI-28MAY03-CLUS1673_1
gagttacaggacagggtggtgagcgccgcggagatggggtcggcggaggagcttctgtgggtgcggaaggagatcgtccacttccacggcgagatggtcttgctcgagaactacagcgcgctcaactacaccggactggtcaagatcctcaagaagtacgacaagaggaccggcgcactgatccgcctgcccttcatccagaacgtaatgcaggagccgttctgcgctaccgacgtcctgtacaagctcgtcaaggagtgcgaggagatgctggaccagctcctgcccggaaaccagccgtctgtgccaagcgaagacgacgggaaagaagacagcgacagtgacgacaagccggcgaagcccagcgcctcgctggccaacggaaatggcactggggacatggagctggaggaaatcgaggacatggagagcatgtacatgaagagcacggtggccgcgctcagggcgctcagggagataaggagcgggagctccacagtgaacgcgttctccctgccgccactatggtgagggccgaactcgctgccgacgttgcagatgactgggttgattgacatgttgtggggctgtgcatacaactgcttctttgcactgcagctcattcctgcctcgtgggttgtgctcaaagaagcattgccactttggtgctgcgtcatgtacacaatagtngctttatacataagcaggggccctgcggtggaatgttgcacaaatatcaaaatatata

SEQ ID NO: 1181 - DNA, 430 bp, Sorghum bicolor
  Clone ID: SORBI-28MAY03-CLUS16736_1
tcaagttgagggccttgcactccgtatggggggcggagggcagcctgcagaatataaccacctgcacgataggttgagctctgttagccatggggtagctcctcatgcatggtctggatagttaagaatgacaaatgcagctttgtcacgcttactcatgagatgtttgtgtgatatatctcggtgtgtacttcactatcgtcggaaatcttcaggtatttcctctggcatctttttatcagccaggattacatattcaccagcttattttttccagctggaggatcgagatgaaataagactgtttagattagttaaaatgatgatgctggcatatgtcctaccttttaatggacatatgtgcttgtaacctgtggacttgcacacgcacgtttgcaatataaaaagatatgatagtttgttggttgtt

SEQ ID NO: 1182 - DNA, 933 bp, Sorghum bicolor
  Clone ID: SORBI-28MAY03-CLUS16753_1
tcccggtttcgcccagcgtccgccttcacagccaagtgcactacagggggcgagggggggttgtcttactgcattacacagtttgttggagaaagattgcaagcttgcggatactgttattaggggcctcataaaatattggccaatcaccaacagcacaaaggaggtactgttcttgggtgagttggaagagatactgttatgaacggagcctgctgagtttcaaaaatgtatggttcctctttctcaccaaattgctcgctgcttgaacagctctcacttccaggttgctgagagagtattgtttttctggaacaattcccactttgagaatttcgttaagcaaaacagtaaggtgatcctgcctatcatcttccctgcattggagaaaaatataaatgggcactggaatcaagtcgtgcaaagtctcagtctgaatgtccgaaagatattctccgatcgcgaccctcaattgtttactgaatgcttgaggaaatatgaggaggacaaagacagagagaaggaattcaaactgaagcaagagttggcatggaaacgtttagatgagattgcatcagcaaaaatcacaagtggtgaggctgtcctcgtgtctccaaccttgcctcgtcaaccttcagtcttgtaggaacctgcactacatgagtggtccttgcagagtcgttagacattgtacaggattgggttgtagataaaagggggtatatgaagccaccaaggctggtgtgcgaaactgaggaaagagagatgagaggccaattgtgcatcatttctgtaaatcccatgccatggcttcttttggcatcctggtggttcactttgctgctgtagtccgttgtttgggagattggatgtttttttcttcttataatagaaaatgtcgagatggcgtgcagtcagcttaaatgataaaag

SEQ ID NO: 1183 - DNA, 677 bp, Sorghum bicolor
  Clone ID: SORBI-28MAY03-CLUS16779_1
ctttttctctgagatggatgaccaacttcttgatgctatctgtgagcggctggtgtctttcctgtgtcctgagaatacatacatctctcgcgagggtgatcctgtgaatgagatgctttttattatacgcgggaaactagagagctcaacaacaaatggtggccgtagcaacttcttcaactctatcatcctgcgccctggtgatttcgctggtgaagagctgctcacttgggccctacttccaaagaccaatgtccacttcccgctttcaacaaggactgtacggagcctcacagaggtggaagccttcgctctgcgagctgaagacctgaagttcgtcgcaaaccagttccgaaggcttcacagcaagaagctccagcacacattccggttctactcccatcactggaggacctgggctgcctgcttcatccaagctgcatggcggcagcaccagagaaggaagctggctgagagcctcagccgatgggagtcatactcatggtggtcagaggatcacccatctggtgataaacccagacaggagggcacctcaagcggcggcacaaggacgattgctgaaggtgccattgcccatatgcataagcttgcctctgcttccagaaggttccgcaccgaggacattgctattcgcagattgcagaagcctgatgaac

SEQ ID NO: 1184 - DNA, 1150 bp, Sorghum bicolor
  unsure (1)..(1150): unsure at all n locations
  Clone ID: SORBI-28MAY03-CLUS16842_1
ccttgccaccaacacactggcaggatctctgtcttcagggctttctcaacagaagccaaagcgggccagcgatcttgatacctgatgcagcgattgatatgtctggtaatcttgttcaggatctttacagcaaatccgatatgcggctaaaacaagaactcgtgggtcagcaaaagtccaaagctagtttaacagatcatcaactagaagcatctgcctctggaacttcttacggtttagatggaggcgaaaacaacagacaacaaaatttcttggctccaacttttggccttgacggtgattccaggaacagcttgctcggtggagctaatgttgataatggctttgtgcctgacacgctactctcgaggggatatgactcccagaaagatcttcagaacatgctttcaaactatggaggagtgacaaatgacattggtacagagatgtctacttcagctgtaagaactcaatcttttggtgtccccaatgtgcccgccatttcgaacgatctagctgtcaacgatgctggagttcttggtggtggattgtggccagctcagactcagcgaatgcgaacttatacaaaggtgcaaaaacgaggctcagtggggagatcaatagacgtcaaccgttacagaggttacgatgagctgaggcatgatctagcgcgcatgtttgggatcgaaggacagctcgaagatcctcaaacatctgactggaaacttgtttatgtcgatcatgaaaatgacatcctcctcgtcggcgatgatccatgggaagaattcgtaaactgtgttcagagcattaagatcctttcatcagctgaggttcagcagatgagcttagacgggaactttgccggtgtaccagttactaatcaagcttgtagtggcggtgacagtggcaatgcttggagaggtcattatgatgataactcagccacttcgtttaaccggtgatggcagaagagttctctcacagacaaagattcttttttcttcgttttgtaatataacttctcgttgataacatgtctcaagtttccactgggcactgtagagcatttacctgtaaaatatcttccactaagtttacacggagattttatttgctgtgnnnaanannnnnnnnnnnnnnnnnnnnnnnn

SEQ ID NO: 1185 - DNA, 517 bp, Sorghum bicolor
  Clone ID: SORBI-28MAY03-CLUS16838_1
agggccaacatatggagtccagtccgcagatttaatgtcctcgacatcaagtgactggagcaacttaacatagtcggcagcagaacaccaggcgggaagataaaaggggttgcatatcttgtccaatatctctttctcccgaggctgcagcgcatcttcgtcttccctgagatctctatggcaccatgtgacaattattatcgtgccacccggagctgctactcttactagctcattgacaaacttgctcttgtcgggcatgtgttccccgctctccatggaccagaccaaatcaaactgtccatcgggaaatggctgtgccaaagcatcggcgacttgaaaggagaccttgtcagaaagaccttgagaccgtgcaagtgaattgcccctctcagcctggacaggactgagagtgatgccccgacactcggcgccatattttctagccaggtatctggagcttccccctatcccacacccgacatccactatcctctttggaatcttagacttggac

SEQ ID NO: 1186 - DNA, 590 bp, Sorghum bicolor
  Clone ID: SORBI-28MAY03-CLUS16423_1
ctcatccattctggattgtgtgagtaatatcatgaggcatgcacggcaggctaatattccaactgttgtggatggggatggcctgtttcttgtaaccaataaccttagtcttgttgaaggaaaccctcttgccattttaacaccaaatgtctatgagtacaagcgtcttgttcagaaggttcttaactgtgatgtagatgaggaaactgcttctgagcagctaatcacactttgccaaaaaattggtgatgtaacaataatgcagaaaggaaaagctgatgtcatcagtgatggtaaaacagttacgcaagtgagtacttttggttccccaagacgatgtggtggtcaaggtgacatcctttctggaagtgtggctgtatttgcatcgtgggcacgacactttgtcttgacaaatgaacaacctacagagaaaagagttaatcctatgacccttgggtgcatagctggctctcttctacacggtaaagctgcatcacatgcttttgagaagagcttgtgatcaacgtacacctctgatatcattgaattcttgggcaaaagcttggaagatatctgccctgccgagcact

SEQ ID NO: 1187 - DNA, 404 bp, Sorghum bicolor
  Clone ID: SORBI-28MAY03-CLUS1650_1
gcgcatgttgccatcttcgatcagactgtggcacgtcatgcgtgcctactcctaattttggttttcactactaatttttgtttctaaagatctaatgtggatgtcctgtctatttatttactaatgatgtcagttcctccttcctcctctctacaaattgttagctggccattttcaacatgcaacagaactggacctgctctaaagaagagaaagctgtgtggatgcatcggcagttagcatcttaactttgcatgatgctggttcttgccagttaaattgatagtataggttacattggctaacatgatattactacagtatgtaccatcaggctgtgttgcataaacgaccatattttgatgttgtattcgcattcgagaatgctggttcaacatcttctg

SEQ ID NO: 1188 - DNA, 701 bp, Sorghum bicolor
  Clone ID: SORBI-28MAY03-CLUS16489_1
gccggccgggccgggcagtaggaaggaaatccaagcaaggaacttcgctttaattcaggcctgttcttgcgaggagaaacaaagatgaggtctcaggtgatactcgtcgtcgtcactctggctcttctcggcgtcctcgcagctctgccgctcggcgaaggctcgtcatggccgtgctgcgacaactgcggtgtttgcaacaagaagttcccgccggagtgccagtgcaacgacatctcggcgcgcgggtgccacccggagtgcaagaagtgcgtcaagaacaagttcaccgttcctcccggcggcggccccggccccgtcgtcacctacacctgcgccgacgttcttacaaacttctgccagcgccgctgcacgccggcgccggcgccaccgcctaaggcgttcgtcggtggtgtcttctgatggcatcggccgggacgccgtcgatctgcgctgcaagaatgcaagccaatcaagtcgagtttgcttctctcgagcttcgcttcgtcagagaagaaataaaataaatgtcgccgctctctgctcgatcgatgcttgctcttgtatgtcgtcagtgtattattactgtttctggaataaagagcgacgcatgatgcatgccgtgctcaaagcattgttggttttcaattgtcatacctataagcaaaaatatccagaaaaaaaaaaaaaaaaaggcccct

SEQ ID NO: 1189 - DNA, 613 bp, Sorghum bicolor
  Clone ID: SORBI-28MAY03-CLUS16925_1
gcggcgctcgagccggccgggttcgggtaatgagctggtggactacggaacgagctcgggcaccgcagcgacggagagaccatcgagtggttgctccgccaggccgagccctccataatcgccgccaccggcaccggggtcaccaccgaggaggcgccctcggtccttgtccccgtctcctccgtcgcggccaccgcgtccatgacgccggtctcgtactcgtactacaccgcgctcctcatgcaacctcccaccgccaaggagtcccctcctgcctctgcatacgtctctggcactgctgcggaggagaataataataactaggctagtttggtggaagaggattatcaaatggcagttggctatgcttagggctctaaggttagttagtttgtagcttagggtttattatgtgtgctctgtggtcatggactacacctcaatcgttaacttatcaccttggggaaggattgcgggtgatttaggtagcaaaactgattgagatggtaacaacagaagaggggaaatgatatctttcttattggttgttgagttctactgagttgcaaacaaagtctaatctcttgtgaatcgtctagtgctgctgatttct

SEQ ID NO: 1190 - DNA, 733 bp, Sorghum bicolor
  unsure (1)..(733): unsure at all n locations
  Clone ID: SORBI-28MAY03-CLUS16931_1
gcggcgctcgagccggccgggccgggacacacgccggccggagcgccagaaacagtcggcggagcggatctcgggtgaggtcgagggatggcgaacggcggcggctacgtgtgggccctcgcggcgggcttcaacgccgggctcgccgccatctccgccaagttcttcgccactctgttgctgaaatatggcatggtgatagctttcaatgtgacaatgtgggggtgttatgtcaacagcctcaaagctttgtcatccctccaggcaacagtgacaaacttcgccgccaacttcatctcgtctgggcttgcagggtatttcctgtttgaagagcccctgccttctaagtggtttgcaggtgccagtcttatcattcttggcgtctttgtcctcagcaagtcaagcatcgaggagaaaccgaacacagattaagaggaaagttttgaccactagtgttagctgtaacataggctgagcctacttatacttcttttatttttcccatgggatgtttgtccatagccaaatcagaccatgacttagtcactcggctaatacaatgcaccagtatgttctccaagctgtcacttgagcttattgtttgttcagtaatccagctcctgggatatttcccatggtggtgctggtacgtcgaaacttatcgctgntaatgtatgaatatatggntggattggttttattctgaaaaaaaaaaaaaaaaaaaagggcccta

SEQ ID NO: 1191 - DNA, 619 bp, Sorghum bicolor
  Clone ID: 30974851
gagaggaggaacgaccttggaggtgatcgatgccatggcgatgtaatgtgcagggggtgttggggtcaggcgtcacgttctacctgcagtcgtggagcatctcggtgagaggcccgctctactccgccatgttcaacccgctctgcaccgtgatcaccaccgtcttcgccgccgccgtcctccgtgaagagctgcacgtcggcaggttcgtaatatgcatgtgaatgaccgagcaatgacatcgatattttgtggctgaccaagaggcgggggctgcaggaccaggagccagagcagcactcggacgacgacttggagaagacgtcggcgcggtcggattcgatggtcgacgtcggcaatggcatcgccgagcccctcctggccggcggcgatccaacggcgaagtagaggggattttttgctcctcagtgttctgtgcgtgcgccgtgtttcagggtcgtcgttatgctactggcgcagtgcgtgcagtcccattttttttggtcatgtacagtactctagcagtttcaaaatggccggttggtggagtttgacttgatctacgtgctgccgatgtgtattatccgcaagattttgctaatcaacgcggcaaaccccc

SEQ ID NO: 1192 - DNA, 369 bp, Sorghum bicolor
  Clone ID: LIB5047-008-R1-XP1-D7
gccggccgggccggggtacgtggtgctgtggggcaaagcgggcgacgccaagaggcgggggctgcaggaccaggagccagagcagcactcggacgacgacttggagaagacgtcggcgcggtcggattcgatggtcgacgtcggcaatggcatcgccgagcccctcctggccggcggcgatccaacggcgaagtagaggggattttttgctcctcagtgttctgtgcgtgcgccgtgtttcagggtcgtcgttatgctactggcgcagtgcgtgcagtcccattttttttggtcatgtacagtactctagcagtttcgaaatggccggttggtggagtttggtaaaaaaaaaaaaaaaaaaggccccta

SEQ ID NO: 1193 - DNA, 592 bp, Sorghum bicolor
  Clone ID: SORBI-28MAY03-CLUS16975_1
acgaccccgcgttctcagcggcatcgcagaaggccagcggctacagcgacgacggccacgagcaggtgccgtccctggaggcgggccgggtcgacgtggtggccggcggccggccggggaagcgcggcggcgtgtggtcgaccggcgccggagcgctgggcttcgacaaggcgacgccggcgtccgtcgtggccgtcccgacgcaggggttcgtgagggagatgagctggaactccgacagcgacagcgacgtgttcgcggtgccggagttcccgcacccgccgccggccaagaaggcgcagccggcgccggcgtcgactttctggtgcttctgagctgtctctactgtatcagtccggtccggcctgtgtgtacttgcccgggcgtgtgtgtgagcttcttgctgttgttactgcatatatacttaccagttaccactagtagctagaggcgcttaatccaagttaattaagtttactgcagtttatgtcatggcttgatcatgaggtaatatcgtcattaccgtattgtaaacttttgttgtgtcatgtatgttatgtatgccacctcgctcctgatcttgaggtacaaa

SEQ ID NO: 1194 - DNA, 886 bp, Sorghum bicolor
  Clone ID: SORBI-28MAY03-CLUS17017_1
gccggccgggccggggcccgcaagcacgcacgcctgtccggcccgtcctagcgttcctgtttcatttttttaagaatagccccctccacctaggcctggagccccgaagcctaggctccttctcattctcctctcccctttctctcactcaccaccgcgctggattcgggaagccgcagagctccatagcattgacggataccacagccaagcaggatcgagagaagctacgcgacattagttgttggagccgacggacatcccacatcggcatgtgcgcgtaatccaacgagtgcattatgcttctgcggcacgcctggaagggatgtttctttcaggatatacttcattatcttaaagaatgtaatgatcgatatattccaggagtgttgacaccagtttaagtatgtcacttgatgtgtgaacttccatcaaattcagacatgttcatgatacctataatcacctaaagaggaaggctacatccttttgcctctattggttgcccctagctatttatgtgtgtttgctcaccggctgatctacgtctgatgttcagcaccaaaggaacttagcactatgatgatcgactctctgtcttttgcaaacctcctggcggcaaactgtgtagttctccgttctaagttaccagctgaagtgttcggttcttatgaattcccggtcatatattgtaatgaacagttatgtaatgtatagttcaatagaaccattaatgtaatgaagggtgtgtaacgtataggtgaacagaactatgagagctacaatggacataaaaaacatatcgttgcctcatcggtcttagataccgactattgtgatgatggccaatactatttattaatgatgggacggacatcttttcttg

SEQ ID NO: 1195 - DNA, 607 bp, Sorghum bicolor
  Clone ID: SORBI-28MAY03-CLUS171_1
cccggggtcggtgatcatcatatttattgaacaaaaagtagaaaaaaaagacttcaagtcttatttagactctccacattgttcgaggtaataaataactttagactttatgatagtctgcattgtgagtgcccttaagaagcctgcttgtcctcatggctggtagagaaggtgcttgtcctcaagcatgagcacacgggaagtgttgcttttagggctttgagatcctctgaagtggccagtgatcaagggagcccggaccattggatgagcatacttgcagaaggattgagattccggaggtgaagacatgtcgctaaagaaccttcactagaaattgcagacagtccaaagcttagggaagcattgagatggtatgcaatgttggcgctgaggtcttgagcttgaacacgtgaaacacggggtggatgaaagaagtcgccaacaagtcgagcttgtacgcaaaaacaccgattttgtccagaacctaaaaagagttgaaaaacttgaatgcaagcttttggttagagcggggcacaaggaaagcctgtacattgggctgctacttcaagtagacctagtcaccgacataaaagtgatgttatga

SEQ ID NO: 1196 - DNA, 569 bp, Sorghum bicolor
  Clone ID: SORBI-28MAY03-CLUS17066_1
gccggccgggccgcgcttcctgcacgagtcgtgttgatttacacatcaaaatggccgagggtacagccactatccggacgaggaaattcatgaccaaccggcttcttgcccggaaacaaatggtcgtagatgtccttcaccccggtcaggcctcagttaagaaggctgacattagagaaaagcttgctaagatgttcaaagttacccccgatgttgttttctgcttcggcttcagaactaactttggtggtggcaagtcaactggctttgctttaatttatgatactttggacttcgctaagaagtttgaacctaagcacaggctagccaggcacggcctcttcgaaaagaagcagcagaccagaaaacagcgcaaggaacgcaagaacaggatgaagaaggtcaggggtaccaagaaatcaaaggttggacaggcgtctggaaagaagtaaacgatgctggtggacactcgactttaaacttgtaattttatcgtacgggaatatacctaattcgtttctaaacgaaaaaaaaaaaaaaaaaaaggcccctaaaaaaaaaggccccta

SEQ ID NO: 1197 - DNA, 559 bp, Sorghum bicolor
  unsure (1)..(559): unsure at all n locations
  Clone ID: LIB5047-010-R1-XP1-B9
gccggccgggccgggaaaaacactatctctaaaaaagaccgatttgcagttttctgtagtcaaaatgcccaaagccgcttctacccctaaatccgctgctggaaagcccctgcacaagttctacgtcgattactctgtccctgccggagacaacgttttcgaccctgcttcattcgagaagttcttgcatgaccgaatcaaggttgatggaaagcctggtcaacttggagaggccatctctttgagccgagagggaaacaagctcgtcctcacctcctccatccccttctccaagcgatacctcaaatacctcaccaagaagcacctcaagaagaacaactttgagaacttcctccgagtcgtcgctaccgccaaagacacctactctttgcgatacttcaaggtcgaccaggatgaggccgaggaggaggagtaagctattcttgattgattagtattatccgagggttagcggagcagtgtagtctttgtnggatggtttttgggccatgcataggtgcacttgaaaaaagaaaaaaaaaaaaaaaaaaggccccta

SEQ ID NO: 1198 - DNA, 569 bp, Sorghum bicolor
  unsure (1)..(569): unsure at all n locations
  Clone ID: LIB5051-006-A1-XP1-F3
gccggccgggctttcaacttcttcaccccccaaaagcaccgttttgcagaaatctgtagacaacatgcccaaagccgccgcctccaagaccgcccccaaggctgtgcgcaagttctacgtggactactcggtcccggccaacgacaacgtctttgacccggcctcgttcgagaagttcctgcacgaccgaatcaaggtcgacggcaagcccggacagctcggcgatgccatcaccttgaacaaggagggcaaccgactcgtcctgacctctaacatccccttctccaagcgatacctcaagtacctcacgaagaagcacctcaagaagaacaactttgagaacttcctccgagtcgtcgctacctccaaggacacctactcgctccgatacttcaaggtcgaccaggacgccgaggaggacgaggagtagattcagtctttcattagtctggatcgaactgtcccgcgcagaaatgcggnggactaggggtgtgacgggtggatgagcgattatattggttcatgcatcaggtgcacctcgaaaaaaaaaaaaaaaaaagggcccctan

SEQ ID NO: 1199 - DNA, 376 bp, Sorghum bicolor
  Clone ID: SORBI-28MAY03-CLUS17212_1
gccggccgggccccgaagattgcatctccatcctgatcgatcgtttgattattggcgagcttcattccattccatcagttcctttggcggaggatgtcgtgctgcggaggcactgcgggtgcggctccggctgcaagtgcggcacgggctgcggagggtgcaagatgtacccggacatgcctgagcagcaggtgaccaccaccgccaagactcccgtcatgggtgtcgcaccatcgtccaagggcacgcccagggcgggttccaggcggcggccggcgccggagctgagaacgacgggtgcaagtgcggccccaactgcagctgcaacccctgcacctggcaagtgagctgtataataaccccctgcactgcactg

SEQ ID NO: 1200 - DNA, 636 bp, Sorghum bicolor
  unsure (1)..(636): unsure at all n locations
  Clone ID: SORBI-28MAY03-CLUS16638_1
gctgggcccgtcggngtacggccccgtggtgacctccctccgcacaaccccaggcgtggctggagttcatgatgaagttcgagctcgggctggagaagcccgagccccggcgcgcgctggtgagcgccgccaccatcgcgctgtcctacgtcgccggcggcctggtgccgctgctcccctacatgatcgtgccggaggccgggcgcgccatggccgtgtccgtcgccgtcacgctcgccgcgctgctcttcttcggcttcgtcaagggccgcttcacgggcgacaggcccttcttcagcgccgtccagaccaccgtcgtcggcgcgctcgcctccgccgccgcctacgccatggccagggccgtgcagtccatatgatgattaagcagcttgcaggccgtatcatcagctcatcaccggtcgatcggccggcagcctagctaggttggccggccgttggcgacgaaaaataagtgcagctatgcatacgtggcttctgtcactggtcagctgctggtgactgtacacatggcaacgtgtagtgtacttgtactagtgtactatactactactagtgtgtatgtactctgtttgatggctgcgtgtagtcagtctaagatgacgtgctgtattttca

SEQ ID NO: 1201 - DNA, 724 bp, Sorghum bicolor
  unsure (1)..(724): unsure at all n locations
  Clone ID: SORBI-28MAY03-CLUS16640_1
ctggtgcaccagcccagcggcgacgtcttcgagctcttccatggcctctgcttgctcgccgccggcaggacggtcttctttgggaccatctctgatgccaccgagttctttactctgaacggatttccatgtccacacctgagaagcccgtcagatcacttcctgagaacaatcaacaaagactttgatgaggaaaccgtagagagctctaaaactcaaaggaaaacagcagctgaagcaatagaaattctggcgactgcatacagatcctccgattatatcgaaaaaacgacaaaccaaattgttgaaatgaaaaacatggatggagcttcatttaggaggagagaacaagcaagcttcgccacaaagctccttgtgctcacaaggaggtcattcctgaatatgcacagggacataggatattactggatgcgtttgggcatctatatgggcattggcgtatgtctaggcactatcttctaccaagttggctatagctacagttctatccagagccgatgttcagtaataatgtatacagttgcacttttaactttcatgtctattggaggatttccatcttttgtggaagacgtaaaggtcttcagaaaggagaggcttagtggccactatggtgtgtcagaatttgtgatctcaaacaccctctcagctactccttacctatctgggattgctgtattacccggcgcaatgctntactatc

SEQ ID NO: 1202 - DNA, 241 bp, Sorghum bicolor
  Clone ID: SORBI-28MAY03-CLUS1665_1
tcgcgatctagaactagtgtcgccaggcaccgccccacggcggcggtcccagccggcgctgctgcatcggcggcgagaggcggatggcgaggaagatggtggcccgtccaccaccagccgcagcttctttcagaagctgccactctgctctcggcgatcgtcctgacgctggtcgtccagacatcgtgggcgccgccggcgctggcgcacttccacccgacggccaatgcggcgggcacga

SEQ ID NO: 1203 - DNA, 735 bp, Sorghum bicolor
  Clone ID: SORBI-28MAY03-CLUS17290_1
gccggccgggccgggctggagcgcaagtgtctcgccgtccgcctcgcctcgcctcgccgtcagcagcagcagctccacctctccattccacggcgcccgtcgtgcgcttcgtctgcaccgggacaaaggcaacggcgacggagacggcaacgcgagggggaggagatgaagctgaagcagctggagggcctcttgggtggcctgacccagttccccaacccgaaggtggagctggagcagtatccgacgggccctcacatcgcgtcgcggatgctctacacggcggagaatagttttgatgacataactggcaaagtggtagctgactttggctgtggttgtggcactctggctgtggggagtgctctactggaagctgaacatgttcttggtattgatattgacccacagtcacttgaacttgctcaagaaaatgctgctgatctggagctggatatcgacttagtttggtctgacataaagaacttaaatttgaaaggcgtccatgttgacactgttgtcatgaatcctccctttggtagtcgaaggaatggagcagacatggagttcctctctatgggcttgaaggttgcttctcaagctgtctattctctactcaagacttctattagagaacatatcaagatgctcgccttgcgttgctgcaacgcccgcagtgcggaggttctatgcgagctgcgttacggtctaccgcagacgtacaagtttcacaag

SEQ ID NO: 1204 - DNA, 697 bp, Sorghum bicolor
  Clone ID: SORBI-28MAY03-CLUS17285_1
agcaatgcaatcacaaacccaattaaaatcgaagacttcatctctattacttccaaagctcgaatatgaacttgaaacggaataaactcggactggaggacaagtctgttaggatttccaatccagcgccctaatcaaaacgaggattctgtgacgacggatcccttcttccctgctcttactaaagagcagcccggcgtcgtggtccacgccggagtcctccgaggagatcctatcccgcccagggtgcgaggtcaccggctcaccgccggcgaccacacatggcccaaccacccgtctcatccaaagatgcccccgatctccccgccgctagggaacagagagtcgtggtagcgaacaagcacggcgagaatcttatggggatactgcaccacgcggggtccaacaaggttgtagtcctgtgccatggctttgcggcttgcaaggatgatagcatcatgattgatcttgcagctgcattgacaaagaaagggatgaatgcgtttcgctttgatttcagtggaaatggagaaagcgaaggtgaattccaatatggcaactacaggaaggaggcagatgacttgcattctgttgtctcacatctttaccagaagtatgatgtaacagcaattgttggccacagcaaaggtggaagtgtggttgttctatatgcctctatctatggcgatggtcccat

SEQ ID NO: 1205 - DNA, 729 bp, Sorghum bicolor
  unsure (1)..(729): unsure at all n locations
  Clone ID: SORBI-28MAY03-CLUS17327_1
gccgggccggngacaccacaccgcccaaaaaaccccaaacccatcgatcccctttcgtcctgcctccccatcattgagctccctccggcggtcggcttgcctgccatggcctcgccgttgccggcgccatcgagcgccacccaccggcgccgctcccgaccgccctcatcaccgccggcatcctcggtgggatcctcggccgcattcccacccccaaaaaagcgccggtccgagcctccgcctcccttgctcgggttggcctgctacgacggcttctaccccgccatggagccccacccttccgccaagcacgccatcgccctcgctcgcaaggccgatttcgagtactatttcgtgccgccggtgccgaaggaggaagcctggggctggttcccgctggacgcccgcgacggccgtgtcctcgtccagtccaagtacttccccgacgacttccaccgccctcgcttcatgaactacgccgtgtgcgatcccctgttcaagcgatatgtgctgctcccacctatacctgacgacctcaccgtcaatgaggggagccttctcaattttgggctctgccttgctccctcccaggaggatgaggtggatacatcattcagggtgatatgcgtggcggggtacgaaaccaagctggtcgtgttcgtgttctattctgtgactaggaaatggggaatcgctacatcttcaaactggagctttttgggcacagaa

SEQ ID NO: 1206 - DNA, 708 bp, Sorghum bicolor
  Clone ID: SORBI-28MAY03-CLUS17332_1
agcccctcctctctctctctcgttgctctacctgttcggctgtgccggccgggccggggagaacgaggcattcactcgggaatcgcctccgctagggtttagaggccaaccggcgcccggcgcctccaacctccggccagtattcgccgcggctaggaggacaccaaatcgagtcagcaacgcctctctgatctgatgcttgtcggcggcgggctctcctagtcgcccgcaccaccgcctctggtctcctcaagttccgacctcctcggctccaaccccgcacctcgcccactcctagcctctctgtgcataacgaggcgccccatcaagttgcttccgatggatggtgccacagctgcaggaggaagtagggaaccggcagccaacgggtccaaacccgaggagcagcagtttgatcccagccgaatgatagggatagttaaaaggaaggccttgattaaagatctggccatggcgtaccaagctgaatgtatagcatcctgtaaagaactccttcagcttcagagaaagtgggaggaggaacagcacatcgaagccaaaatgcctgaagaaccaagatcgttgatgatcaagacctcgaagcataggaagaagtagatttaggagactaatttcttactttctttcgaaagaacacttttcggctctgtccatgctgtgattggtagcttgacagtaaacaaaacg

SEQ ID NO: 1207 - DNA, 429 bp, Sorghum bicolor
  Clone ID: SORBI-28MAY03-CLUS1737_1
acccacgcgtccgggcggtgacgaggatgagggagtagagtatgaaccttcggtagcggtggctgatccgctgcagctggacgcgtatccggcggtgctgcctcagcacggcggcgacgtcggcgcactggccgaagtcccgcgcgaacccggtcatgcgaaggatctgcaggtagcagatggtgcggaacagcacgcacgccatgaagaacatggcggtgcggtacatccacgacgccatctccagcgcgcacgccgcggccgaccaccagggcgggaagggtgcgttggcgcagtaccagaacaccttgtacccggcgtcggcgaggaagcaggggagcacgaagcaagcgaggaggcggaacgagcccgcgagctggacgatgtacccggcgcggacgttctgcgagtcgtggcggaagcggtcga

SEQ ID NO: 1208 - DNA, 772 bp, Sorghum bicolor
  unsure (1)..(772): unsure at all n locations
  Clone ID: SORBI-28MAY03-CLUS17384_1
gccggccgggccgggacttgtcccctcacctcgctgcgtcgttcgtccccagctgcggcgcgtcactaggacacggaggagatccggcggcgattccggcgatggagtacgtgaaccccctcaccggcttccgcgtcgacggccgccgccccaacgagatgcggcaactcaagggcgaggtcggcatcgttgcacgcgcagacgggtcggcgctgttcgagatgggcaacaccagagtcatcgctgctgtctacggcccccgagaggttcagaacaaaggtcagcaagtaaacagcaacgaggctttggttcgttgtgagtataggatggcagaatttagtacaggagatcggaggagaaaaccaaagggtgacaggcgatcaacagaaatttctcttgttattcgacagacaatggaggcaagcatattaacacatttaatgccacactcacagattgatatatatgtccaagttcttcaagctgatggtggaacaaggtcagcttgcatcaatgcggcaacactagctcttgcagatgctgggattccaatgcgagacattgtcacatcttgtagtgctggctatctgtgttctactcctttgctcgatctgaattacctcgaagacagtgctgggggttccgatgtcaccgttggcattcttgcaaagatggacaaagtgactttgcttcagatggacgcanaattaccgatggatacatttgaaaatgaatgggacttgcatagaaggatgcaaagcaattgcatctt

SEQ ID NO: 1209 - DNA, 683 bp, Sorghum bicolor
  Clone ID: SORBI-28MAY03-CLUS17388_1
gccggccgggccggggagccgttcgcttcatttctcctcttgtctgctctgctgcctgtctgccacgaaccacctccacgtctgagaggaaggagtcagccaggtcgagatcgaaaccaccaccgcctccgccaccgccttcgcctccgccgttggggctcatcagcagttcgcgggggaaagagagggcggccgcgatgtgggtggagatcctgtgcggcctcttggcctacaagatcatccaacgcgtcttcttcgccggcggcgacgacgcttcctacctcgccgacctcgactcctcccactccgacctatgcttcgccgtcgcctccaggctcgagaagctctacgccggccgatgcttcgttggtctccgcatccccgaccccgacgccggcgagcgccagcatattgacgttgtcctcgttaccaagagggaggtgatggtggtagcgatcaagaacttctctggttttgttgaggctgacaaggatggaaattggtcttgcccaactgacaagaagcgtaagcaagagatatttccgaaccctgtattagaagttaacagactagttgctagtcttcaatcatacttggagcaaaggggagcaaaattgcctgatgggcatatcgtcggggagagttgttctgcccaaccccaattgcaggccttcgtatactat

SEQ ID NO: 1210 - DNA, 710 bp, Sorghum bicolor
  Clone ID: SORBI-28MAY03-CLUS17396_1
gccggccgggccggggccttgcaaattgcaccgcgggcgctctccctgtctccctctcgcgtgcggcagccagtcaaaccgccggcgcccccaggccttcgtcggtccttcgggaggtcatcggtgcgtccttcgtcggggaatagcacccgcacccaccagatggccgcgcaaaacgatcctgctgcttctccgatggtgtaccctgtctaccttaccggggcattcccccagcaagccggggatgatcaggctcaaggtccagggatatatgccatacaacagaaccaattagcggcggcgatgggaatggggtgctttgctccaaccacactcattcctctcacttacaagatcccaacggaaagtgtcggtggtcctgctggtgaagagaatgtacaggatgctaggcagcaaaatggacctcaaagacaagttgttgtgaggagctttcactttgcttttcagcttgacttggccctgatcatcaaactagccgcagtggtgtttctctttagtcaggaaggctcgaaacaaaggctgtttcttctcatactgtttgcctcattgatttacttatatcaaactggagctattacaccttttgtaagatggcttcagcgggcgggaggtgcagctgctcgtccaccacaggctcctgctcgggccgagaaccgtgctcctctgcctgcccagaatgatggaaatga

SEQ ID NO: 1211 - DNA, 789 bp, Sorghum bicolor
  Clone ID: SORBI-28MAY03-CLUS16852_1
gccggccgggccgggagacgactggtcggccgccgccaccgccgccgccgccctaagctaggcgctgaggctttcgttggtctcttcgccggcgaagagcacccaccaggacaggcatcaggctattggaatatggaccaacaaggcatggatgaccatgaaggggtccacgttgttggatttgaagtcccaccttcacctgattctagctacaacaaccctattcctggaaatgaagatgaaggccgggagcccccactggtgccacctcatcttcagcatacgctgctgagcttcccaccaagccaagacgaatcgagcccgctgcctcaacctcagaccgtggttctgaaccacctttacatcgagaaagagaacacaagatccgtggttgctctggggatcacgcaccggttcaaggccaagtttgtgacagtcgtgctttacaagccagtgctgaggcggtagggtgtggctatatgtcctgtgaggtcctgctttcttgtgtaggatctgtaatggtaatgataattaaacacccttgggggttgctacccaccgatgaacaaatagagtcccacccctctcctgttgttgcgcagattctgcagaaacagaagaatttaagccccctgttgtagtagtgcagcagaaaacaggcgaggagcctaggccgtcattttcgaatgattattagtcttgtacctaatttggttgttggtggtggcagtgatggttcggttgaatgagtagttgtgtttagaaaaaaaaaaaaaaaaaaggccccta

SEQ ID NO: 1212 - DNA, 535 bp, Sorghum bicolor
  unsure (1)..(535): unsure at all n locations
  Clone ID: SORBI-28MAY03-CLUS1686_1
gcgcccacgcgttcgcataattacaagatactagtcaaagtgctcagaatactctacacaaattacagaagcacaagtatagcatcaaagcatcaccataaaaatttcagagcaattgcacataccaaattaaagatatgcatttaaaatgtaacaaggtgtctatttcataaattggggatcatgacttatattgtatcaaacagcagatttcagattatttccatgttatgaataccataaacaagttactaccaaagtagagcactagcataagcaccaattattttatatgatttactcaagggaacaagctaaatctcaaacataaattacataataaagctgcagtactccaaaaatcatgaaatatntatcatagcattctattatcacacagagactaccataaaatttgtagagcaaactaagcagtataaccagagatatgaatttattcatgaatagcaagaataaattcttaataaatatttttccagaaaacatggttcattntatatttttattaaacact

SEQ ID NO: 1213 - DNA, 647 bp, Sorghum bicolor
  Clone ID: SORBI-28MAY03-CLUS17418_1
cagcccgcctccgcaccaccagtcccaccaccggaatactcccacctccccccggccgggccggaaacccaccggaaggacccaggcgccgccgtcggcaccatgccccggctcctcgtcgtcctcctcctcctcgccctctcgctcgtcgcgtgcgtgagcgccgtgcccgctgtcatccgcatggtcccggccgaccccaccgcggcctcctctggcgcggtagacgacgcggacgcgctcttctgcgacagctggaggctgtctgtggagacggccaacgcggggccctggctcgccgtgcccgcgcgctgcggggattccgtgcgggactacatggaggggcctcgctacgcgtctgactccgccgtcgccgccgccgacgccctagccttcgcctctgatgccctggccgccgccgccgagtggggcggctcggcgagcgcgaggccggcgtgggtgttcgacgtcgacgagacgctgctctccaacgcgccctactacgcggtcaacggatggggattacaggaattcaatgagacctcatttgatgaatgggtagatgctgcaaaggcaccagcattaccatcaagcttgaatttgtacaatcaacttcagggacttggattccatgttatccttttgac

SEQ ID NO: 1214 - DNA, 648 bp, Sorghum bicolor
  Clone ID: SORBI-28MAY03-CLUS17442_1
gccggccgggccgggtcacatttgctaccataatgacaactagacagctggtgagtatattgctttcctgcatctggtttgtacatcctctgagctggatgcagtgggttggcgcagctattgtattcggagccctatacacaaagagcttcttgaggagtaaaccacagaagccagcggtggcaagcccgccacgtggctctagcccgaatcctgttaacaatagttaacaattgatgacataatagcataggaaacaatggatctgttgcggtaccgggacgaagtctctgtgtgtgagatcaattgcaccatggcgcatggcgaggtaactggacagatatgtagctgtgtaactgtgttactgctcctgacctggaggtgatgaaggtggtctttcttttttcgtttggaagaagcaaggtggtcctagtgttagttcagtatctagagaccaaatgttcaggcagcccagactttatcaattttgtagctcaggtcgttgtccgttaacctgtatcacaacagttccaccatagaacaaagtatttttagtccgtagaaagattttataccatcaacataagcatcgtgtaatttgtctgttttcatttttattattttatatattataatatacaatttgtc

SEQ ID NO: 1215 - DNA, 546 bp, Sorghum bicolor
  Clone ID: LIB5048-005-R1-XP2-A7
ctgggagaggccgcccctccctcctcaccagacgccgcccctctcctgaccttctctctaggcatgacacaggcgcggccaccacttggccgcacggtgtcctggccctcacacgcagcagcagccaactccttccgtcctaccggccgtgcgaggtgttgaagggggcacctgatctctggcgtcgaggacctgcggtgagccttcaccggacctgcggacgtgttcggaggagcggcgctagatctgcagcggagctgcgctggcatgtccaggatgatagtggtatggccgcgtgcagtagaccaacgcatccagcatctccaacatcggacctgtggcggagctggattttggtatgtatcagactcgatctcctcctgtgcagcagtgaacattgtactgttcgcagctccagtaaattagcctaaatgtcttgggagctgtgttccttgattcgattgactctgagacatacctagttgcatacattgaggttgtatctgtctattgcgaaactattgtggcaaggcttggttgtactgc

SEQ ID NO: 1216 - DNA, 630 bp, Sorghum bicolor
  Clone ID: LIB5049-003-R1-XP1-C6
gccggccgggccgggaaaccctagaggccgcccctccctcctcaccagacgccgcccctctcctgaccttctctctaggcatgacacaggcgcggccaccacttggccgcacggtgtcctggccctcacacgcagcagcagccaactccttccgtcctaccggccgtgcgaggtgttgaagggggcacctgatctctggcgtcgaggacctgcggtgagccttcaccggacctgcggacgtgttcggaggagcggcgctagatctgcagcggagctgcgctggcatgtccaggatgatagtggtatggccgcgtgcagtagaccaacgcatccagcatctccaacatcggacctgtggcggagctggattttgagagaaataaagatatacagaaacttctgtactgcttgctgctgatgtgaccaaagacgggcatacataaggcaaggaataagagatctaagtgtggcttgacctgaaattgtctggtagttatgaaagatggaccaaaaatagatggacaaaaaatgtagattgaaattttgcctctttattattaagtgtagatatagatttgcatcttatagcagcctggcctggtttggtgtttgttatttatgcaaatgtac

SEQ ID NO: 1217 - DNA, 264 bp, Sorghum bicolor
  Clone ID: SORBI-28MAY03-CLUS17445_1
cgctcgaggccggccgggccgggacccaccaaactgtgagcagcgcagcggcgaccagcgcccaactaattttccccctcacctccccctccctcgatctcgctctcgctctcgtcgtcgatcggcatggccaccgatgtgttgcgcgcgcacaacatcctgatgccggcgccaccgccgcagaggatccgggcggcggcggtggcgcaccggaggcctgctgcgggtagcgacaatcaccacccccggcgccaccaggaggag

SEQ ID NO: 1218 - DNA, 773 bp, Sorghum bicolor
  Clone ID: SORBI-28MAY03-CLUS17468_1
gccggccgggccgggccctgtccctctggggagacttccctttcgtctcttcctcgcttcggtcctcttcctcgattccggtgggaaggaacgggacgggaatcgaactgcgatggcctccgactcgttggagacggcgaggcagctgctggaggtgacctacacgactgaggcagaagcaacggcggaggcggagcagctgcccagcctaccctcggggttctacgacgccttcgtcctcaggggaatccgcgtcgtccaggccctccagcccggcacactcctctgccacttcaccgtcccttccagactactcaattcgggcggcttcctgcacggcggtgcaaccgcctccctagtcgatttggttgcctccgccgccttcgccactgccggcctccgcaccaggggctcgcccctggagatgaacatctcctacctcgatgctgcttttgctgatgaagagattgatattgaagcgaaggttctgcgcgctggcaaggcagtaggggtggccgttgtggaactgaagaagaaatctggcaaaatcatcgctcaagcccgctactccaagtatctcggtgtagcatctagtaaactctgatctgactgaatcaacaaggtggccttgcgacatggcagcatgttgtaatctgctgggttttattttcccccctactggtgcctatactctcatgatgctagccccctgagcatatggtagtagggtgtggtgtgcttggacaagtgttactactgtctatatgtgacag

SEQ ID NO: 1219 - DNA, 818 bp, Sorghum bicolor
  unsure (1)..(818): unsure at all n locations
  Clone ID: SORBI-28MAY03-CLUS17527_1
gccggccgggccggggtcagacgccaagttgccaagcaatcgcaccggagggaggagctctcgccgtcggccgtcggcagtcacaaggcgactccggacgcaccgcttgccgtgcgatcagcccatccgcccgccgtgcggactcgcgagttgcgaccctaatagctgactggttctaggcgtcatttcaggcccaccaacgccgccgccgccatcatccagttcacccagcttccaaatggctagtgaggactcgaaagatatgctgaagaatgtggactggaagactgtgggcggtgcagtgactactgaatctagccaaccagttgtcaagaagcgccttccaaagaagatcagacaagtccctgagtgttattttctgcctcggcgatctttgccttctgcactagcaatctatggtgccgtgtgtgctgctggagtcggtgcaggaatgcttattgaggtgtggataaacaaaaagatcaaagaggatagtgctattatctgggagatggataaatgatgtgcagttgtgcaccacactacgatatggtggaaccattttcgacactatgatatttgctagctctgaagctaagaatttcatttataggattcctttgtccatttgttttattttgagtgaggtattgcaaggatggatttgagaatggtgttcagaacgatgcctgcctgcctgcttgtgagtcggttctgccacactttgatggtgaagcaaaanaaatctgagccccaactaatgatgtcatgtagcagttcctggctaaactatagaaatacttctcttttccatgcgc

SEQ ID NO: 1220 - DNA, 451 bp, Sorghum bicolor
  Clone ID: SORBI-28MAY03-CLUS17561_1
gccggccgggccgggagtactcccattcgcttgatccacaaaaacagaagaagaaaaaaatcgcaagctagacatggctagcagcaagaacaatatcattggggccactgcatcaccgattgtggtcgtagtggcactaacactgctgtccacacttttgatgatggaggcagatgcacagccatatgatgactcagcaatgccacatggcatggttggggatttgctgccacgggggagagtaccaccctcagggcctagccatccaccacccttgctggcgtcaccaccagacggggttggggatttgctgccacgaggaagagtaccaccctcagggcctagccatccaccacccttggtggcgtcaccaccagacggggtcggggatttgctaccacgaggaagagtaccaccctccgggcccagccatccacccgccttttgggcg

SEQ ID NO: 1221 - DNA, 595 bp, Sorghum bicolor
  Clone ID: SORBI-28MAY03-CLUS17588_1
aaggagcgtgtgaccccaaaagggccaacggccaggacaggtagaggccggccgggccgggaggccacatccatggcatcctctcctcctcctcctcctcctcctctccaggaagaggaacaggaacagggacgggaagaggagcaccgccatggcgccggcggcggtgacgatgaccagatcaccaccccgctcctcctggtggaagcgacgacatcgacgtcgcgcagctcgccggcgggcgacgagcactactccgacgacttgtcgtcgtcggagggagagaactcgccgatcgagcaggtggcgctgacggtgccggtgggggacgacccgacgacgccggtgctgacgttccggatgtgggtgctgggcacggcgtcgtgcgcgctgctgtcgttcctgaaccagttcttctggtaccgcaaggagccgctgaccatcacggccatctcggcgcagatcgcggtggtgccgctgggccgcctcatggcggcggcgctgccggagcgcgccttcctccggggcacgcgctgggagttctcactcaacccgggccccttcaacgtgaaagcagcagtgatcatccccattc

SEQ ID NO: 1222 - DNA, 645 bp, Sorghum bicolor
  Clone ID: SORBI-28MAY03-CLUS17214_1
gccggccggcggccgggccgctataagcaaatttaaagttgtcatctcgatcctccatcaccaccaagttcaacaacaacaacatccatatcgcctagaaaatgaagacattggcaaccacattcttcatattatcccttacactagtggtcataccactcatagcagaggcagaagagagtgatgatgcaaagaaggcagcagaagacttctgcatcactagctgtgcagacaagaaggagccgactatcaatagcaactgcaaggagtcatgcgccctcaaccagcgctccgacttagtgttctttgagagtgtcacgtgcttgggcaaatgcacccaatttgacaatgtccctgacatgaagtcttgcgaggaaggatgcaaaaaagagtacaatgctaaagcggcggaggtcaccgctagctgcaatgcggtgtgcagcaaggtggagaaggacccgcatcgtatcgaaacatgcaagatggaatgcaccccgcctagctcctaattgaaggacttctatgtatgtacatatgggtgacctagcattcttggtgaagcatcaaatcattattgtatcataagtgtaagtgacttaaagctatgataaagtcacatgtgttaaagtggttcaagttatagct

SEQ ID NO: 1223 - DNA, 725 bp, Sorghum bicolor
  unsure (1)..(725): unsure at all n locations
  Clone ID: SORBI-28MAY03-CLUS17241_1
gccnggcgccggccgggccggaaaagctaatattatactagctactagcttcaatcaattcgtcatagcaagcacaagcagcaagaggggatttacgtgcaggatcggatcggaagagcagccggtcgtcgagaagctgctgagctagtaggtagggtatgacgacgacaccagtaatgatacggaggtcgtcgacggcggcggccacgacgacgttgtgcctaggcctgctgatgcttctactactggcggcgtcgacagcgacggcgcatttcacggtcggcgaggtggacgagtacttgaccaagcgcacgcaggagtcccgccgcaggaaccacggcagagcggggatcaacgacctcatctccagtgcggcgcgtttccacgccaacgtagatgcacgcgcgtatggccgccgctccaacctggaggaggaggaggcagcaacagataccgcaggggcggggcgtgtaacgaaagcagaagcgcaagaggcttcagctgagggtggcgattagctatccaattcattcgttcattcatttacgaacgcatgtatgcgcatgcacatgctgccattattcttcttctatacgcgtaccccgatcccatccttgttggattaagcatcactgatcgattactatatctgtaagcaagcaaccagatattttatagtatataaattcaaattattattgaaaaaaaaaaaaaaaaaggcccct

SEQ ID NO: 1224 - DNA, 743 bp, Sorghum bicolor
  unsure (1)..(743): unsure at all n locations
  Clone ID: SORBI-28MAY03-CLUS17632_1
gccggccgggtcggggaaaaacaaggggaaaaaatagtaaagaaacggagcgaggcgaggcgaggcgaggctccgctcctcctccccggtctatcctgcctgatccaaatcctccctcgcttcatatatcctcctccgacgaaaatacgtccattcattccttccgcaccggcacccgcatctgggcaaggagggctcgtcgtcgtcccttgctcgtctccgtcctgcgccgccgccgccgccatggccaccgaggaagctgccaagccgtccccgatcccgccctaccctgagatgatcctggcggcgatcggaggtctgggagacaaaaacgggtcgaacaaatcggccatctccaagttcatcgaggacaagtacggcgaccttcccccggcgcacgcgtcgctgctgaccgcgcacctggcgcggatgaaggagtccggggagctcatcttcctgaaaaacaactacttccgcgccgacgcccccgacgcgccgcccaagcgcgggcgcgggcgcccgcccaaggcgcgggacccgaacgctcccccgccaccgcccaagtcgccggcttccgcggggacgggccgcggccgcggccgcccgccccaggccaagagcgcgctcgacgccgccgtcaagcaggccaccgcgnggatgcccaaggcccgcgggcgcccgcccaagaaggccaagacctccgaggacggcgcgtccccggatcccaggccgtgcccacccct

SEQ ID NO: 1225 - DNA, 717 bp, Sorghum bicolor
  unsure (1)..(717): unsure at all n locations
  Clone ID: SORBI-28MAY03-CLUS17670_1
gccggccgggccgggatctttgaacctggttcttctgtcgcccatcttgcggcaccccaccaccaccggaagagcggccgagcggcgcagagaagagagaaccagcaagtttagcggagcggccgcgcgtccggagggaggatggagaaggcgctcaccaagctcggcagcttcaccatctcccgcaaggccaagcaggagctctccgccatcggcggcgacatctcccgtttatcgagcacggtggaggagaaggcaaaatgggttttcgagaagctcaaaggacacaagaagtcgctctctgatctactccgtgagcacaacctccctccaggtctcttccctcgtaacatcatctgctatgagtacgacgaatcaacctcgaagctggtggtgcacctgtccaaaccctgcgaggtgagcttcaaggattcctccacaatacggtatgctcctcgtgtcaaagcgactctgtcccgaggcaagctctccggggttgaaggcatgaagaccaaggtggtggtatgggtgaaggtggcaagcgtgagcctcgagagctacaagtctgacaagatatgcttcatcgccggtgtgaagaagctgaggcagaaggatgcttatgaggtccctcgcgaagccgtctctggtgaggagttctgagnctcgatggtttgccttatccgnatnccgnagnnatcatcattcatagcatttttt

SEQ ID NO: 1226 - DNA, 723 bp, Sorghum bicolor
  Clone ID: SORBI-28MAY03-CLUS1771_1
acgcgtacgcgtcagtctgtaactgttggacacgtcgagtacgactggtcgcagttaaagttgaaagcttatctggattcaccaactctcttctaacgccccacatatttccacagattatcttgaatgatccagttgagaagtatatggttccatttcaagaatctcgaccattacctgcagacttaatcttgcggaaggctgtgatgcgattcttgaaagatcgtgcagttcctcttgtcgatgattggggaggttgtgttggcattgttcatcgtgatgattgtaccaagctggatgcacctcttctatcgatgtctagagggccacctttgtgcgtgcctacttcaaccaccgtggagcacgtcattgacctcctcctcagagagaagtccgagatggtgattgtggtgaagagtggtaacatgttcgaaggaagctacacatccagctcaagacccttgggcattttctccctcgccagaatatggagcttcactggcgattacgactggtcggaatcagatatccccgacgacgcaggcacatcctgggcaacaagacccaaacaagacacctgaggcctgcaaccgcggttggtcccgcagataagctagtttggtgtgtcttttactggtcagcttatagcaactccacgtggtgatgccgagcaaactagtcatgtaatgtcctcctccagtggacaaggagagcgaaaaggtt

SEQ ID NO: 1227 - DNA, 779 bp, Sorghum bicolor
  unsure (1)..(779): unsure at all n locations
  Clone ID: SORBI-28MAY03-CLUS17787_1
gccggccgggccgggtgatcaattcccaaagtggttccctattgagagagnacttacctagatcggctgtcactgaggtttgacaaggaaggccagccatctcaacttgctccaattgatttttttgtcagtacagttgatccgttaaaggaacctcctttggtcacagcaaatactgttctgtctatccttgcggtggattatcctgttgataaggtttcttgctatgtttctgatgatggtgccgcaatgctaacgtttgaagcattatctgaaacatctgaatttgcaaagaaatgggttcctttctgcaaaaggtacaatattgaacctcgtgctccagagtggtacttccaacagaagatagactacttgaaagacaaggtggcagcaagttttgttagggagaggagagcaatgaagagagagtatgaggaattcaaggtcagaatcaatgccttggttgctaaagcacagaaagttcctgaagaaggatggacaatgcaagatggaaccccctggcctggaaacaatgttcgtgatcatcctggaatgattcaggtcttccttggccaaagtggaggtcttgactgtgagggaaatgaactgccacgattggtttatgtttcaagagagaaacggccaggctatgaccatcataagaaagctggtgctatgaatgcattggtccgagtctctgctgtactaacaatgctccatatttgttaacttggattgtgatcactacatcaacacagcaaggctataaaggaagcaat

SEQ ID NO: 1228 - DNA, 794 bp, Sorghum bicolor
  Clone ID: SORBI-28MAY03-CLUS17801_1
ctgtgcggcgctcgaggcggccgggttcagacgccgcttctcagccttttgttttgccgcgcacccagcttgagcgcgcgctgtctctctcgtgcggcaactcggcgtccgccgacgccctgcccagcccttcgtcggtcgcttcccagcccttcgtcgcgtccttggccggcgacgagcacgcaccaccagtgtaccaccatgccctttactgggtccgtccctggtttcatagttaggctggttggggttcggccaagctgctgtcctccttcccgtgcatttgcggctgtcagagctcaaaagattcagcttcccaagaagtaaagtcgttgtggatggaagagttgtgaataaagctggaacacaagtatctgacaagtctgtcatcgaaatcaaggctgaaatcccaaaatatagcaggacataagcttgaggcagctatcaaaggatttgatattgattgtgagggaaagatagcccttgattcaggattatctacaggtggctttactgactgcttacttcagcatggagcatcacatgtttatggtgtagatgttggctatggacaggtggctgaaaaaattcgcacacatgaacgtgtttcagtgatcgaacgcacaaatttaagatatctatctcaactgccagaaccggttgatttggtgacactggacctatcatttatctccattctcttggtcatgcctgctgttatcaaagtaatgaagccggattctatattgataacacttatcaagcctcaatttgaagcacgtagatcacaggta

SEQ ID NO: 1229 - DNA, 698 bp, Sorghum bicolor
  Clone ID: SORBI-28MAY03-CLUS1784_1
gcacgaggaatagttaaccttgacccctcaataactaatgatgatctgcaccagatatttggtgtccttggtgaaatcaaggagattcaccctatttcagacaatgatcattacagatcgatagaattttttgatgtcagagcagctgaagctgcgcgatatgccttaaacaggagtgaaattgcaggaaataaaatcaaattggagcctggctgtctggatggtactaaacgtttgatgcagcagatgtctcgcgtgttggagcatgaacggtttggtggatgcaaactgggaagcccaaacagtccttcaccatgctttggttccatcaatatggcatccatcagatccactggcacagatagtggaactgttcaggttttacattctagagttcagacaccgacaaaccaattccaagagggaagaagttttctggatcttccctcaactaccataagaaatagatcctctcctgttggaattgcaactgcaggatcacaaagcagccaccatgttcttgatgagcacatccattcacttggaaagatgaatgtacagaacaaggggcgaatggattgtggctttcaagagagtattgctttccatcctcattctctccctgacttcaatgacagactaagaaatggtatcccctatagctgctcaatacctcccatcggtgttaaagagcaaat

SEQ ID NO: 1230 - DNA, 775 bp, Sorghum bicolor
  unsure (1)..(775): unsure at all n locations
  Clone ID: SORBI-28MAY03-CLUS17824_1
gccggccgggccgggactcctcacctgccgtgcagcccatttatccccatccccacgctgcttcagagagagagagagagagagaagggtgagagggattcaagtttcaaacacacaaacaaaaacacccacacacacagagtcagagagcgatcgatctagcgaggggggaaggccggaagggaagggaagggaaggtcatcgatcgatccgtagctcgtcgctcgtcctccggagcaagcagggaaagcatggctgactggggccccgtggtgatcgcgacggtgctgttcgtgctgctgacgccaggcctgctgttccagctccccgcgcacggccgcatcgtcggcttcggcaccatgcacaccagcggaatcgccatcctcgtccacgccgtcctctacttcgccctcatcaccatcttcctcatcgccatcggcgtccacatctacgccggctaggctagcttattaggcgcctgccctctcgccgggccacaggacaggacggtttcttttcttcagcccccttctttcctcatcatatactagtgctactcttgatgtctttgctcatcgcgtttattattgcctactcctacagtcctacttgcgtcgaaatggaatgaaccttagctacaacaagtactagttgtttgttggtggtgtatctttttttaaaaaaagaattgtttaaactgcggtgaacaatccgatcataccgcagtgtgttgcatctaggtgattgattatgggatttctctgttccttgncag

SEQ ID NO: 1231 - DNA, 827 bp, Sorghum bicolor
  unsure (1)..(827): unsure at all n locations
  Clone ID: SORBI-28MAY03-CLUS22408_1
ccgggatcaaagctcatctccttccctgttcccatctcctcctcctcctctcgggcatccatccattctccaagcttgtttgaggtgccatgagccggggcaacggcggcagcggcgtgaggagcactcggctggagctgcagctgaacctgtccccaccggtggggatggaggtggacggcggcggcgtgcaagacgacagcgactcgtcgtcgccgagctcgtgcgtgtcgtcggacgggcggagctcgagcggcggcggcagccccgggggcaagtcgccgatggtgatcggcgcctgcacgcggtgcctcatgtactgcatggtggccaagaaggattacccgacctgcatcaactgcaagcagccgtgcctggtggacctcctccacggcgaggccggtggccgtggcggtggcggtggtgccagcgaggccgccgccggcgacaagaagcagcagcagcagcgcggcaagcgcaagtgaagccacgcggcggtgtaccgtgcatgtgcccgcgcgcccagtggatgctcatacggagggtcagctgctctagctcgaactgaactgactgccgttggatcatccactggacagcagggtgtccccttccttccttccttccttcctcattaggaggaggctagtactacgtagtagtagcagcagcagcttagttaacttcgcttgatgctgctgcagttggagtaaggtagttgttttcattatgtgtggtggagacttgtggntttgtgttggtgtttcgggttgtaatcctctgaaagaacatttgcaagctaaggggatcaaactctttattatctc

SEQ ID NO: 1232 - DNA, 700 bp, Sorghum bicolor
  Clone ID: SORBI-28MAY03-CLUS22590_1
tcgggaaaagccaatctcccgatcccgccgccccaatcgaccaacgccgtcccttctcgttgagtctcgactctcggctctcgacctctccctaccggctaaccctagcagcggcacgcgggcgacggccgcgccaccggcgaagggattcagcggtctccccctcctccgactcaggcgaagcggcgccctgcagattcttattggttttgttgcaaaatggctacggaagcgactttgaacaattctggtggttctgagtccgcaacaccattactggaacagcttgctgaagtatttggaaagttgaaatcccacaccgaagcatctctgcaattgcaaaatggcatgcaatgggaagatatcaaagggcatttcctcagccttgataagtcgtacagaagcaagtgtgatgaactggtagagaagcagaaggcattagaagaaaagaaagctgaagctcgtaggttgattgcagagaaagagactaatgtttctacaaaagagcgtgcctccctgaatcagcttcaggagctaagagatgctgctgtgtcttctctagcagaggctcggcaaaaaatataaggtggagcttgctgagatactttgatgccggcggaaagcaagaccaaaaaggaaagtccctccataaattgaccatcaatgcattctccgtgcttcaaaggagaaaccccctgct

SEQ ID NO: 1233 - DNA, 729 bp, Sorghum bicolor
  unsure (1)..(729): unsure at all n locations
  Clone ID: SORBI-28MAY03-CLUS18017_1
tgtgcggcgctcaggcggcggctcccgaagcctggcccacttcgtctcgaagtcactgagctccaccaaagaatctactagtagctaggagcagcaggcgtacgccacccacatacagcaacatgtgctccggctcctcctggtcctggagcagcagcagcagcaagaagcacccgtctcttgttgtcgtcaacctcgagcggcagctgcggaagacgacgacgtctcatgtctcagttgccatcaggagaaagaggctgaggctgaggaggttgaggttgagagccggagcagaggccatggagatgctgaacctgaagctctacctggagaaccggtgcatcctcgccgagaacgagaggctccgggagagggccaccgcgctccgccgcgagaacctcgcgctgctgcagaacctgtccaagacggcggccgtgccagaggcaggagcaggagctgcgtgagattgcttcctcggctctgcctgcctgctgaagatgaagtagctagcttgcgtcccctctcgttggtgcatgtgctagttgtgtggacactggacaggacagtgaactcctagttatcatccatctgcttggctgctgcgccatgtctgtgctcataaatcgccaaaattcctggagctctcttggtcttgggtgctctgtgccatggtgtttgtacattataagtgcgcggattaactanaaaaaaaaaaaaaaaaggccccta

SEQ ID NO: 1234 - DNA, 804 bp, Sorghum bicolor
  unsure (1)..(804): unsure at all n locations
  Clone ID: SORBI-28MAY03-CLUS17918_1
gccggccggggcctcatctccactctcccacccaaaccagaaaatcagaaaatcccaccaccggcgccagccagccagccagccagccagcgattccgtcgaggaaggccagtcccggaagagaagaggcggcgaggatgagttccgtcggcggcaggggcaagcccaagggcaccaagtccgtgacgcggtcggccaaggccgggctgcagttccccgtcggccgcatcgcgcgctacctcaaggccggcaagtacgccgagcgcgtcggcggcggcgcccccgtctacctctccgccgtcctcgagtacctcgctgcggaggtgctggagctggcgggcaacgcggcgcgcgacaacaagaagaaccgcatcgtgccgcgccacatccagctcgccgtgcgcaacgacgaggagctcagcaagctgctcggcgccgtcaccatcgccgccggcggggtgctgcccaacatccaccagacgctgctgcccaagaaggccggcggcaagggcaaggccgacatcggatccgcgtcccaggagttctagggcgggcggccgcccgcaccgcggtggctgcaggcttcccctccctgcttcgaatcaagattgaacatgaaagggccagcccccgccgctcaagtttcgtcgattagtagcagtgttagcgtcttgtctatgtttcgttaggtttaggttctgtgatggatggtgtgtcaggtgaaaagggtgtggtgaatcagagctgcttgtatgtatcaatctatcaatcttgctggaatggaagaaatggtcggntgctgnc

SEQ ID NO: 1235 - DNA, 528 bp, Sorghum bicolor
  Clone ID: SORBI-28MAY03-CLUS18094_1
gccggccgggctcggcacgcactcatcctgccaagaaagaaatatggctaccaaagtaacatgcttgctcttcgccattctcttgctctccattaacatacactttagcgttgtcacatcccgcaaagatccttcattctcgggaaaagctgaagagaagataccgggcgggcacaagactgcacacgcagctggatccgaagaaaaggttttactgattggacccaatatcctgctccgtccgcggcccatgccaccgtgcaagagaaggtgttactgatttggccaaaatggcattctgaaattgagatttacgacatccggaatcagtaaaactatatgtgtgattggtatttcggttatcaacgaggcttgacttttggtgtttccttcaaataaagcttgcccctggttttaatattagttacttcaattatcatgtaatcagaaatcagacaatatggtgcaattgattgcaaaactgttcgtttggaattatctcaataaacgaaaaaaaaaaggccccta

SEQ ID NO: 1236 - DNA, 462 bp, Sorghum bicolor
  Clone ID: SORBI-28MAY03-CLUS18038_1
gccggccgggttggggaatggtgggaagccagagggggaaggaagcatgagcaacagtagtactgtgtctatggcggacagcatggctgcctcagccgcagcgctcgagctaatcagcgaggacatggacgaggaggacattgccaacagtgtggtgttctcgcagctcgttcacccaactggccggtaaggtgtatatgggacgtggatgctgaaatttatcgtgcatgcgtttgttgttcattgggatttgggattcatctcttcctgtcaatatgtactcagatcatattgtgcgtatgtgtgtatcattgttggttgattctttaatttggtcccttttgatgtactttcgtgggccatgaaaacggggaaccatggtaagaacttaggatttctgtaagatgcaagggagatgttgctttaaggatcactgaaaaaaaaaaaaaaaaaaggccccta

SEQ ID NO: 1237 - DNA, 823 bp, Sorghum bicolor
  unsure (1)..(823): unsure at all n locations
  Clone ID: SORBI-28MAY03-CLUS18099_1
gccggccgggctgggctccaaacgcagcaaagccccccgcgtctccggccctcctccacctcgccgcgcgcagcaacgagcctccagctccaccctagggtttccggcggcgatggcgggcaagggagggaagggtctgctggccgccaagacgacggcggccaagagcgccgacaaggacaaggacaggaagaaggcccccgtgtcccgttcctcccgcgccggcctccagttcccggtgggccgcatccaccgccagctcaagtcgcgtgcctccgcgcacggccgcgtcggcgccaccgccgccgtctactccgccgccatcctcgagtacctcaccgccgaggtcctcgagctggccggcaacgccagcaaggacctcaaggtgaagcgtatcgccccgcgccacctgcagctcgccatccgcggggacgaggagctcgacaccctcatcaagggcaccatcgctggcggtggcgtcatcccgcacatccacaagtcgctcatcaacaagaccgccaaggagtgaaggagggcaccccccgtgctgctgcttctgcctgactacagtccatctagctgtgtacttgtgctattgttaatttaagtgtctggtgtcacagtcggtgtaagctcatcgcgtttacctgtacttctatggtgttaaattaagttttcttctgctgaaaaaaaaaaaaaaaaaggccctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1238 - DNA, 617 bp, Sorghum bicolor
  Clone ID: SORBI-28MAY03-CLUS18128_1
gccggccgggcttgcgaatatggcaaaatcaatgttgttttatccagtggtatattgatttattctagtttttagtatcaggcgagatccggcgtcaagtttggcgagatggcctcttcggatgagatcatggagcggcaagatggtctctgtgtggataagatcagggagcgtctgaaatgtgcagattgatcccatcatctcgttctgaagaccgcatttctctcatctgatggatcgcgcgtgatcgacttaccttctggagacgacgtttctctcatctaatggatggatcgtgcctgactgcctagttgcctgcgaactaactcaccatggaaattaatccgatggaagtttaagcactaattctccctgctcgtctttgactttgaatggcaatctgagccgatctagtacatgcgttcgtgtttctttttcatctaaataatttgaatatgcatatatgactccaaaaaaaaaaaaaaaaaattttcctaatttcaagctgggttcacaatgatgacttttcccgtggacatgtatgaactcgtactgcatgtgctccaatcattatgtacacatattttattttattctaataaaatagttgaataaaa

SEQ ID NO: 1239 - DNA, 521 bp, Sorghum bicolor
  Clone ID: SORBI-28MAY03-CLUS18141_1
gtgcggcgctcgagccggccgggccgggacacacgtcctctttgaaaactagatcattcacgagctctgcaatcagaatgggtgtcgagattgagaacatttccgctggagacggcaagaacttcccaaagaagggagacactgtcaccatccactacgttggaactctccaagacggctccaagttcgattcctctcgagacagaggatcccccttcgtcacccaaatcggtgttggacgagtcatcaaaggatgggatgagggtgttcctcagctctcggtcggccaaaaggcaaacttgatctgtacccccgattacgcttacggatcgagaggtttccccccggtcatccctgctaactctacccttaaattcgaggtcgagcttctcaagatcaactagacttgtagtcgggtttaactgaagagagtcaaaagaattagaaaggagtatgaaaggaggtatgaaagagaaggaaaagggagtagtttggaaacatgcatctttgatgcgctgggc

SEQ ID NO: 1240 - DNA, 472 bp, Sorghum bicolor
  Clone ID: SORBI-28MAY03-CLUS1815_1
gcacgaggcacatgcatgccagtgtgcacaacagctaccacccgactgcgagctagcgcccgcagcactgcagcagctagctagccagctcgctgtgggagagaagctagctagagagagatcgatcaatggcgtcccgtggcagcagcatggcctgtagtctccagctcgccgtcctcatgttcgccgccgtcgcgctcgggttcggcgtccgggccggcgcggcggagctgtgcagcgagtactacgaccagacgtgccccgacgtgcaccgggtggtgcggcgggtgctgaagaaggcgcacgaggccgacgtccgcatctacgccagcctcacccgcctccacttccacgactgcttcgtgcagggctgcgacgggtccatcctgctggacaacagctcgagcatcgtgtcggagaagttcgcgacgcccaacaacaactcggcgcgcgggtaccccgtggtcgacgc

SEQ ID NO: 1241 - DNA, 568 bp, Sorghum bicolor
  Clone ID: SORBI-28MAY03-CLUS17592_1
tcgaggccggccgggccgggcttcagtgccctgtgcagccgtgtgctagctcctcagtcctcactagtcctttctccatcacaaacgctagtctttctctaaaggtcggagactcgaagcaatggcgtccaagatgctgctcgccgcgctgtgcgtggtggcgctgctcgcggtgcggtcggagtcccacggccttggggacttcacgaacagcgaggcgacgccgcagatgcagaacttcttcaagcccgaggccgcggcgctcccggagtccctggacccctcctccatgcccgccgccaccatggccgccaagccggaggccacggtgatcccgaccaccacaaccacggccaccacggcggacacctccgccgcgactgcaggcacggtgcccaagtcgtcagccacgccgcgcaggtccgtgtccgtggccgccggcgtggcctgcggcgtggctgccgtggccgtggtcggcatcgcggccgccgtggcgtacgcgctgcgcgcccggcgcggcggcgcgccccccgccaccccccccccgctcggctcctccccgtgagct

SEQ ID NO: 1242 - DNA, 820 bp, Sorghum bicolor
  Clone ID: SORBI-28MAY03-CLUS17607_1
gccggccgggccgggatctccatgctggtccggccgggcccccagtccccactgtccactgacgaaagctttggacgattgaagcgaagatgccgccagctctgcggcgaataatcatgctggccgcggcggtgctgctgctgtggtcggccgcctgcgtcgcgggcgacgacgactcgacattcttgccgccgtcgccgccggggaccgcgtcgccgttcccgttctgcccagcgcggccggctggggtctccacggggccgttcccctggtcgccgccgcagccgccgccgcagtcgccgccgtcgctgtcgtcgccggtggcggtgttcccgcaggatccggggttcttgccgtcgggggccggcgcggtggcatggctgccgctgctcgctgtgttccctgctttcttggtgcttttttagtgactcgctcacagttgcttgctggttgctgctgctggagtctggatgtatccgtagttgtttagttcagaacaggccttcatctatttcatacatgtagctctggaaaatctagcaaagaggggcctttctcttcttttccttttcgtttgcctttgcagcagctgtgtttgtttcttttcttaaatcttttcgagaaagtagctagctctgcttggttcttcccagagaaagaatatcttcgtgaataaccgcaagcttctttcatgtaattcaggcttccggcaaataaagcttgaattgaataaaaagaatccgcattggcggttacaaaaaaaaaaaaaaaaaaaagccccctagggcccggggccgcttctcaaaaattattggaatcc

SEQ ID NO: 1243 - DNA, 616 bp, Sorghum bicolor
  Clone ID: LIB5051-010-A1-XP1-E5
gccggccgggctgcgctcgctagttccacgctgcgcccgccgccgcgacggcctccccacgctgcgccgtctccgcgacggcatcacccatggcgtgctgctgccggcaacggcctccgcgctgtgacgcccagaagcccgcgtccctgtgcccacgggcggacaggactcctcgctaccagcgccgccgccaccctcatgggcttcccgatggccgtgccgtcttaggctgcgactccggcagccgcacaaccaccaccgtgaggggcctctccggcatctgcatcactggcacccctttggtcccctcccatgtccaatccgcacaaggttgctgtgtcttcaatgatgccaactccaagcattgggcttcgctttttgcatattggacatggttactatgaacttagtatagttagctggacttgctttgtagttgacttcagtactgctctgaatcaacaatatattagctgtatattagttgtattcctagtgtcacaaacaattaatattagttgtcatacttttgtattcctagtgtcgcaaacaattaatatgtattgatatgttggtgtttggatttttggaaaaaaaaaaaaaaaaaaggccccta

SEQ ID NO: 1244 - DNA, 673 bp, Sorghum bicolor
  Clone ID: LIB5049-005-R1-XP1-D5
cgctcgaggccggccgggccgggctcgctagttcccacgctgcgcccgccgccgcgacggcctccccacgctgcgccgtctccgcgacggcatcacccatggcgtgctgctgccggcaacggcctccgcgctgtgacgcccagaagcccgcgtccctgtgcccacgggcggacaggactcctcgctaccagcgccgccgccaccctcatgggcttcccgatggccgtgccgtcttaggctgcgactccggcagccgcacaaccaccaccgtgaggggcctctccggcatctgcatcactggcacccctttggtcccttcccatgtccaatccgcacaaggtgcttccctctccccccagatctgctctctctttcgttgctagcagggatgtatctatattaacagctgtgtaaaatatgtctcccaagtcccaacctccctctcagatctgttcttttgttcttttgcctgcaaggggatcgatgtttacacttgcattaaacagatgagatgtaagaactaatagatctggatgttttcccccgatttgcctatgtacattgtatgaaatttcctcagttgtctttagcagtagagcattcaaaggctattagaaatttaagttgaaattgatatctaaactactaaattgcatacagtagtggcttcttc

SEQ ID NO: 1245 - DNA, 698 bp, Sorghum bicolor
  unsure (1)..(698): unsure at all n locations
  Clone ID: SORBI-28MAY03-CLUS18235_1
gccnggcccgggctggngaggattcaccaccatcgatccccaatcacccgtgtggcgcctggaagagcatgacaaccttcctggtatagtaggattccaacaatccggcatcgctacagcatctccctcctttctcatccaacgtccatacaaacctcgccacagatccatccaaagttttcaacatcgcttcgtgcagctcggtgatggctgcacgaacgatggggatcgcctcggtgacgaccagtctggcggtggtgctgccggtgctggtggcgctggctttctccagggctgcggcgcagggcaatggctgctccagcgtgatgatgaccctctccccgtgcatggacttcatctccagcaaggcgccggaaccagggatctcctgctgctcggtgctcgccggagtggtccagaccgacccccgctgcctctgcatggtcctggatggcaccgcgacgtcctttggcatctccatcaaccagacgagggcgatggagctccctggagtctgcaaggtcaaagcaccaccgatcagccactgcacaggcgtccaaggagcacctgcaccagcaccttccaatgaggcagcaacagcagagggggaagaagttgaggcaacagcagattccccaaaaggatatggagcctcaatgacggaaagctccacaaactcaaagaatgcagcaagttta

SEQ ID NO: 1246 - DNA, 876 bp, Sorghum bicolor
  Clone ID: SORBI-28MAY03-CLUS18322_1
gccggccgggcctgggactttgacatcaaccagggtagccagtatataactcttatccagtccctaagaaataacagtaacaagccacgccttttgaggataactggtgttgatgatccagagtcagtgcacagagctgttggagggctgaaggttgttgggcagcgactagagaagcttgcagaggactgtgaggtaccatttgagtccagggcagtggctgctaacactgaggatgtgacacctggaatgctagattgccgtcctggagaggccctcattgttaactttgcattcctgctgcaccaccttcctgatgaaagcgtctcaattgtgaaccaaagggatcagcttctccgtatggtgaagggtcttcaaccaaaactagtgacgttggtggagcaggatgcaaatactaacaccaccccattccttgccaggttccgggaggtctatgactactattcggcactttttgattcactggatgcaacccttccgagggaaagcccggatagaatgaatgtggagcgccagtgcctcgcacgagaaatcgtcaacatcttagcttgtgaaggtcctgaccgtgtggaaaggtatgaagtggctgggaaatggagagctaggatggcaatggctggctttgcgccgtgcccatttagcagcaacgtgatcaatggcataagatctctactgaaatcgtcgtactgcgataagtacaggttcgagaaggtccacgatggcctccattttggctggggcgacaagacgctcgtcttctcgtcggcgtggcaatagaagcttgcgttgcatatcttagcactgccagcgttttaggagcatctggtgcaagggctgtaaagagatttatgtcac

SEQ ID NO: 1247 - DNA, 631 bp, Sorghum bicolor
  unsure (1)..(631): unsure at all n locations
  Clone ID: SORBI-28MAY03-CLUS18305_1
gccggccgggcctggggcttcccatcgagagcgagggtgccctcccgactccgagatggcggcgccggcggcggacgagacatggtgccgggagacggtgccacgggtgatggaactggtgagtccacgccttccgcagcgggacgcttgcgctctgctcgcggtcagcccttggtgctaccgtgccctcgtcgccaaccccaggctctgggaggtacttgatccacgtgagatgaagaatgctggagaccgacttatttcagcactttcactggcaaggtatcgtcatctcaaagtactaaacctcgaatttgctcaagatattgaggaccgacattttgttcatctaaaagaaatgagtggcatctcactggaaaatttggaattcctgaacttaaatgcatgtcagaagatctctgataaaggaattgaagctgttaccagtctttgtcctaatcttcagcgccttgctatctattggattgtaggactgacagacttaagcattgngcacattacaaagaactgtaagcagatagtggacctcaacttgagtggttgtaagaatatctncagataaggaatgcagttgattgctaataattaccagaactaaagaattgaacataac

SEQ ID NO: 1248 - DNA, 732 bp, Sorghum bicolor
  Clone ID: SORBI-28MAY03-CLUS18328_1
cgtggaacatcgcgctcatgttcatcaccgggatgctggtgaacgggccctacgcgctgatcacgacggccgtgtcggcggacctcggcacgcacagctccctcaacggcaactcccgcgcgctggccaccgtgacggcgatcatcgacggcacggggtcgatcggcgccgccgtcggcccgctgctgacggggtacatctccgccaggagctggagcgccgtgttcacgatgctgatggcgtcggcgctcgtcgcggggctgctgctgtcgaggctggtggtggcggaggtggccgcccggccggagtcccggaggacgcccgcccacgccgctagcgacctgcccgtgtccaccatggacgaaccgtagaccacgagaccacctgtgattttaggcctcagggtgaggggagcaggtgcgcttctgtcccagaactgtgggatcttgctcctggtgtgccgtgcttcttgttcgtcatggtatatatgtatatggaaatggaatgcaatgtggttgcagcgcgccagcccgggcgtttctatctctgctctgttagggagctgcacatactgcaattccactagccatagttagacgaccttgtattattagcgaaagcaaatccaagaatgagagtacaacaaggttgcacaactaaacatgagttttagctgcgaaatgttctgcggtggtgtttgtcgatgaaaaaaaaaaaaaaaaaaggccccta

SEQ ID NO: 1249 - DNA, 591 bp, Sorghum bicolor
  Clone ID: SORBI-28MAY03-CLUS18338_1
gccgggctgggaacagaatccggcaactctctgctcagccagaatagagaataccgaagaaaagaggcctcgctactgccgtccgtcgctccacctgaacacaccggcgaacgggcgaagacaaggcgaagaagcgatgggcgtcaccaaggaggacgtcgaggcggccatcacctccgctctcagcccttccaatctcgtggtcacggacacatccggagggtgtggtgcgagctacgagatcgaggtggtctcggagaagttcgaggggaagcggctgctggagaggcaccggatggtgaacaccgcgctggcgcctcacatggcggagatccacgccgtctccatcaagaaggcgctcaccccgacgcaggcccagccccagccggagcccgccgccgataagccccagggctaagtgcttaattaaaaccccccaaaacggtttgatcacatatgctgatgcggcattagtccctgagtcaagctatgcataacgcatctgtgtaatatgtggtatgtgctacattgactgtctgcttgaataatgtggcagatgaaatttctaaattgcaggatgttatccttgac

SEQ ID NO: 1250 - DNA, 530 bp, Sorghum bicolor
  unsure (1)..(530): unsure at all n locations
  Clone ID: SORBI-28MAY03-CLUS1835_1
gccggccatggaaggagtacgcgaggacggtggtgatggagagcaccatcggcgacctcatcaggccggaagggtgggcggagtggatgggcgacctcggcctcaagacgctctantacgccgagtacgccaacaccggcccgggcgccggcaccagcaagagggtcaactggccgggctaccgcgtcatcggacaggccgaggccacgcacttcaccgccggcgtcttcatcgacggcatgacgtggctccagagcaccggcacgccaaacgtcatgggcttcaccaaatgaacgaattttttttttttttgcagtgatttttttttcattgttttttgcagtagtatgttgcatgcatgcagcatgcttttgggtttgtcagggaacggctagcttttttgttattatagctggagggcggctgctgtgcacgcatgcacggtgaatataggtgatctaaggaataaagtatcagtcagatgagagcgtgactgtgagagaaagacagcttaacaaagaactaataag

SEQ ID NO: 1251 - DNA, 663 bp, Sorghum bicolor
  unsure (1)..(663): unsure at all n locations
  Clone ID: SORBI-28MAY03-CLUS18371_1
gccggccgggttgcgcagtagatagatataaacaagacaaggcgggcgtcgagcttggacctccccgccccgtcctgtcccctcgacgcaatcgaccgccaagaacatcccgagagcagcgccgccgtctcgtctcgtcgccatgggtctgcaggaggagtttgaggagcacgccgagaaggccaagaccttgcctgacacgacgacgaacgagaacaagctcatcctctacgggctctacaagcaggccaccgtcagcgatgtcaacaccgggcgtcctggcattttcagtctgaaagagagagccaaatgggatgcttggaaggccgttgaagggaaatccaaggatgaagcaatgaccgactacatcaccaaagtgaaacagctgctggaggaggccgcagcatccacttcctaggctatgaaaacaccatgatccatagttgcctatatagttatgctatatgtgtcgtcaataaaccttgggtccctgttatgttttggatggcttctgtttccatacatgtaactgttctgtctccaaggatactcaacgtcgcttataaaggcctgtaaactcttgtgaaaacagattcaaattaccatctccgcaaaattgagcacataatccctgctaaaaaaaaaaaaaaaggcccctanggg

SEQ ID NO: 1252 - DNA, 763 bp, Sorghum bicolor
  unsure (1)..(763): unsure at all n locations
  Clone ID: SORBI-28MAY03-CLUS18398_1
ggccggtcggtaatccaccttctcacttctgatcctgacctcaaccccggcaccgccgccgtctctctctctctctctctctctctctctctaacccgcttctccacctccctctcctcggctgctctccgcgcgtccaccgggtctacgccgcatcggattggttagtcggcactggtgaggtcgcgcggggtaccgtcggtcgatggcggagcttgtggggccgcgcgtatacagttgctgcacttgccggaaccacgtctgcctccacgacgacatcatctccaaggcctttcaggggaggaatggccgtgcatttctgttctctcatgccatgaatgtagttgtgggggcgaaggaggataggcagcttacgacagggctacacacagtcgctgatatctactgtaatgattgccgtgaggtgttgggctggaagtatgagagagcatatgaagagacacagaaatacaaggaaggaaaattcatattcgagaagtcaaagattgtcaaagaaaactggtagtatccaagttgtcactcaccaaatattctggtgaagatgaattggtcattgttacatggcagtatgcttttggatgtttgtgtccctgtaaatagcctttcctcgatggattgcagtgctaaggcgcctcatgttctcgccttagattgtaaacacacttattcctgttcatttgggtgaataagatactgcatgtgggttttttgggatggaaaaaaaaaaaaaanaaggccccta

SEQ ID NO: 1253 - DNA, 753 bp, Sorghum bicolor
  Clone ID: SORBI-28MAY03-CLUS17848_1
gccggccgggccgggactattgcaaaatacagcaacagcatgaagaatcttgctcaaaaactgctgtgcatcatctcagaaagtctgagcctaccaccatcttatatacaagaggcggttggagaagtttaccagaatattactattagctactattctccttgtccacaacctgatcttgttcttgggttacaatctcattctgatatgggtgcaatgacacttctgatacaagatgatgttggtgggctcgaggtattgaaggatggaatgtggatagctgtgcctgctttgcgtgatggcatccttgtgattctggctgatcagacagagatcatcaccaatggaagatacaagagttcagttcatcgagctgttgtcaatgctgagcgtgcccgcttatcagtagcaacattttatgatccatcaaaatcaaggaaaatatgcactgccccacagcttgtgagcaaggatgagccacaaaagtatcgggatgtaatttatggtgactatgtctcatcttggtatagcaaaggtccagagggcaagcgaaacattgacgccctcctgattcagaagtagagccataggtgccttaaaacaggattgggccactcatcagtgttctaatgcatgtccaacatatcagtttccaaccataatctatgaagataagtaaacgaacttgtatactggatgcagtgcaataaagaaaattttcattgccaaaaaaaaaaaaaaaaaaggccccta

SEQ ID NO: 1254 - DNA, 835 bp, Sorghum bicolor
  Clone ID: SORBI-28MAY03-CLUS17854_1
acttccggccgggccggggcagagcgcatttgctcgctcgctctccgccgcagacagcctccgccgagctcatctgcgggcggcttctagggtttaaaaatttcccccaaatcccagttcgatattcatcctcgtcaccgacctgcgccggcgccgtcgatcacggccatctccggtgtctggttgctctcgtagggaggtatggagggctgctccaagactagcgccggcgcggcgtccggcctcccagacgaccccctggtggagatcctctcccgcctccctgcgaagtccatctgccggttcaagtgcgtgtcaaaggcctggcgcgacctcatcgcggaccccgaccaccgtaagaagctccgccaagccatgcagggactgttcgtgcagacgcccgaggtctccgaggctgacaatactatattggaccgtacaaatttcagtttcgtcgacctgacagtgggatccatgcctctggacatcgacccttgcttctccttcctgccggaaatgactgggatcgagatatacttcttggattcctgcaaagggcttctccttttcgcgcagcatcaggagccgtctcacggatcgggtggctatatcgtgtgcaacccgaccacaaggcaatggtcacccgtgctcgcttgcgacactcgcctagcgttaaatcacacctatttggcttttgatccggccgtatcctctcactttcattggttgagtccagatgcactattgggaagaggtgtagtatcgttgcatgtttactcatccaaaactgggacctggagtcaaaaccaaattgatgaccaaagagagcagggac

SEQ ID NO: 1255 - DNA, 860 bp, Sorghum bicolor
  Clone ID: SORBI-28MAY03-CLUS17904_1
gccggcctggccgggaaaaaaaaaatggagcaatgcaccaaaacaaaccatagaccaatgcaggagtagcatatctaataattggatttcggatccatttccatccagtaggaaatgtaaatatatggtatatatcggcaacatcagtatctccatatccgttaaggatacaaaccttctagtcagcgcaggccaccgtccttctataactacccagcacatacaccctccttgagcagatacaaagcactcctcttcatttgatcatgtcgttcagcaagcaggttgcggtggccgccttcgccttggccttcctcctcctcacttcaaatcttgcagttgcagttgcagcagctggagccgaagaagaaacaatagcaccgttaaacacatgcgaaaccccaacctgcattccctgctggggccaaaacgcgatttgcattcccgcttgcgttgcaatgcacttcactggcggtttctgcaatggtaagaactgcgtatgcaccaagccgtgccttgcgcagtcagagacagaggcaggtgggccaacaccgcagccgcccgtgtgcatcaactgatggacgtactatgtagcttgttgaccgccagcttgcagaggaatgtaaaaataaactttcagtgttaaaccagaaatatataaacaatccagggcagagctgggttactttgccatgtaccagattcatgctagttatttgaaggtttgtcatctgaatctttgacatatatatgtgttgagcaagagaaatttatcgcaattctaaatgtattcggtcattgtttacagattgtccaatgaatgcgatggattgagaaaaaaaaaaaaaaaaaaggcccct

SEQ ID NO: 1256 - DNA, 794 bp, Sorghum bicolor
  Clone ID: SORBI-28MAY03-CLUS18459_1
gccggccgggtcgggatgtagcctagaaagggaacagaaacagcagctctgaaactcacggcggccatggccatcctgggcgccctgaagctcgccccgtgtccacccgccctcgccggcgccgcgccaccggcgacgtcttcgcccgcgcgctcctcggtgcacttccacctcgccaatgccggcctgccgcgctcgtcgccgcctcgctccccgtcgccgaccccgccgtggcattcattggaggaggtccgtacgggaagcaggtgacgcgggggcaggacctcaccggcaaggacttcagcggcctcacgctcatcaagcagggcttcaagacgtctatactgaggcaggcgaacctcaaaggcgcgaacctgctcggcgcaagtttcttcgacgcagacctcacaagcgctgatctctctgatgctgatcttcgaggcgccgatttctcgctagcgaatttaacaaagacaaacttatcaaatgccaacttggaaggggcacttgtcacaggaaacacttctttcaaaggtgccaacataactggggcagattttaccgatgtcccacttcgagacgatcaacgggaatacctctgcaaaatcgctgacggagtgaattcaaccactgggaaccccacaaaggagactctgttctgcagctgatcgatggaagacctgaccctgtgacttgtgagacttataacttatatattcgacgtcttgcaaaaaaaaaaaaaaactgtatcttctgctgtaagcacgcaagatatgtaaattgagttatagaga

SEQ ID NO: 1257 - DNA, 534 bp, Sorghum bicolor
  Clone ID: SORBI-28MAY03-CLUS1856_1
gcacgaggcaacttccgaaaaaacttcagaggtcgtggaaatggcggcggcggagaagcccgcggcggtgcggcaagcggaggagctggtggagagggagatgggcgggcgcgacgcctcccacgacgcctcgcacgcgctccgcgtccgggacctcgcgctctcgctcgcagccgaagagggcctctccgcccccagccgcctcctcaccgtggaactggcctctctcctgcacgacgttggagattacaagtataccaagaacaatgtggaggacatgagcgtcgtggagacgttttttcaagaggtaggattggatgaagcccagaaggatgaaatagtggcgattattaaggggatggggttcaaaaatgaagtttcgaataaatctattgttgatcccacccttgagtttgcaattgtacaagacgcagatcgcctggatgcaattggagcaattggtattgcaaggtgctttacatatggtgggagcaagaacagcgcattgcatgatcctcgaattctgccacgtga

SEQ ID NO: 1258 - DNA, 815 bp, Sorghum bicolor
  Clone ID: SORBI-28MAY03-CLUS18602_1
ccggggccagtcgccacctcaagctcctgctgcgtctccccgtgccgccgcgagcgctcccaatcaggcaaccaggcaacaaaaaccagcaccgccgcagcacgggcgccgcccggtcccggcgccgccccctacctcatcgcgccccgctccatggccgcaaagtgggcccagaagaccgtcgttatccccgcgcatcggcggggctgccacctcatcacccccaagattctgagggagatcgagggcgacctggccgggttcaagtgcggtctcgcgcatttcttcctgcagcacacaagcgcatcgctgaccatcaacgagaactatgactcagatgtgcaggctgacactgaaacttttcttaacagaattgttccagagggccacaatgctccttggagacacactatggaaggacctgatgacatgccagcacatattaaatcttctatgtttggttgtgccttaacgattcctataactgatggacgtctcaatatgggcacttggcagggcatatggctgtgcgaacatcgtgaccatgccagtcctcgcaaaattgtgattactctcaatggtgtctaacttgaagatcttaaatgctgccaggaaatagggcaaatgcaatttggacctgagtgtaaaactagatctctgtttcaagtgtgtgttgagttgtaatatatggatgtactctataaattccaataagttcaccgcgttactatttcgtgtgtgattattggcttaggtgaccaatactatgctgttgaacttttttttaaatcactatgctttgcagcattttgtag

SEQ ID NO: 1259 - DNA, 564 bp, Sorghum bicolor
  Clone ID: SORBI-28MAY03-CLUS18647_1
tgtgcggcgctcgaggctggagggctccggggcatttcaacagtttgaggctcccacgcgcgacctcaccgtcaccgccgtcgtcctccccgctgtccagtctccaccactcccagtcccagcccaggccaaggcaggcgccaaccgtccggcggtcgctccccgggccgcgcggcgcgatggggtgggcggcgcggttcctgacggcggtgtcgttcctggccgcgggggtcctcttcgcgcccgacgcgctgcccctcggcggctcctgatccggcgccgcggccgccgcgaggctggtccacgtcctcgccttcgccaccgcctggggcgccgggctctgggtcaccttcatcggcggcatcgtcatgttcaagtacttgccgagacaccagtttgggagtctgcaggggaaaatgttcccggcatacttcatgttgatatcatcatgttcagcgatatccgtggcagcattcgcgtacctgcacccctggaaaacagcgtcaaccatcgagcgctaccagcttggctttctgatttcagcccttggctgtaacctgtcca

SEQ ID NO: 1260 - DNA, 512 bp, Sorghum bicolor
  Clone ID: SORBI-28MAY03-CLUS18695_1
gccggccgggtcgggaatcattccaatctataatcacgacaatctcacactaccaaccaaaccacatcaacgaccaaacagaaaccacaatgcccatcgacaccggatccaacaaaggcggcgccgagggtgctgtcaaggctggcacttccaccgtcggaaacgccctaggcggtatcaccaagaccgccggcggcctcgtcggcacagctggccgcggcgtcggcgagaccatcaacaacaccaccggcaccaaggctatcggcgacggtctccaaggtattactggaggcatcgaggacggcgccaactctgctggcaagggcgtcgagaacgccggtcagggaaagaagagttggtgaagcacttgggcgagtgagcgagcgatcggagggtctgatgtgcttcgagaaacttgtttgcagatgagcaattttctgtttttaacgatgctacgagatattgagtcattatttttgctactacaaaaaaaaaaaaaaaaaaggccccta

SEQ ID NO: 1261 - DNA, 489 bp, Sorghum bicolor
  Clone ID: SORBI-28MAY03-CLUS1865_1
taccgtccgaattcccgagttcaaaagaatggaacaggtgaacatttgcccccgcctaggccaaaacgaaaggctgcccatccatatccacacaaagcctcaaaaaaagcccttcaagttgtcttaccacaacaagcttcacatataatggagcaaggctgtggtacacctatggatactgctactgttgctacagactcgagtgcaaatgatgcttttcctgttcaacatttcagtccgaggcatacacaaggtgcaacatataataactctagtagcataggtagccaatctggaacttggccaacttctgaaggcacagaacaagacatcaggcatccagcactgagtgccatgccagactttgctcgtgtatacaacttcctgggaagcatatttgatccagagacaaatggtcatttgcaacagttgaaggaaatggatcctattgatgctgaaacggtactgttgctgatgaaaacctgtcaa

SEQ ID NO: 1262 - DNA, 423 bp, Sorghum bicolor
  Clone ID: LIB3480-033-P1-K1-F2
caaaaaaaaaaaatctcaacaattttcaaacttcagtttttggtaaaggttaatagataccaaacaaaggattctagtgtttaatacatcctatattatttggctagtgccagcctttgggatagaatcctctaccaaataaatagcaaatttatttggatggaaggagtgtatctctaattaaatacatacgacaagcatttatatggagcaaacgtcagaaggttatcaacggtaagcttgactgaccttgagttgaacaaaaacttccgtggagatgtatctttggcaatgaattggacaggtaaaatctacctagacagatgacgttcatggacacttcagctaaataaatgagtagagatagcatatctttctcaagagataggggactaagggagtcactagtaatgattatgcaaa

SEQ ID NO: 1263 - DNA, 453 bp, Sorghum bicolor
  Clone ID: LIB3480-033-P1-K1-F7
tcgaccacgcgtccaggccgcgtcaccatgtccgccgagtggatgcccggccagccccgccctgctccacctcgacggatcctagcccggagactacggcttcgacactctcttgtgtctggcagaccgtgccggagaacttctagcggttcaaggagtcagatgtataccaatggcaggagtctatgcttaatgaaccacataccataaggctttatacggaacagacatgcaaaggttatcaacggcaagcttgactgaccttgacttgaacaaaaacttccgtggagatgtatctttggcaatgaattggacaggtgatatctacctagacagatgacgttcatggacactccagctaaataaatgagtagagatagcatatctttttcaagagataggggactaggggagtcactagtatcgtatatgccaaactcgaattccttttct

SEQ ID NO: 1264 - DNA, 647 bp, Sorghum bicolor
  Clone ID: SORBI-28MAY03-CLUS18766_1
gccggccgggccgggagccgagacgaggtgcctttgcccacctttgctccctccctccctcgctttccatcctgttgcgcggccgcggcgcaggtgcggttggccatcacaggccagcccagcagacaagcagacggaccctcctcctctggccctgctgcctcctcttcttccttttccctccctttgacccaccaccgccccccctcttcggctcttcccttcttcccccactgtcgccgctcctcgtcttctcctccctccctccactttgcttcttgttcttgtcctcgatgctcgtgggcgggctcctatgatccgccctccgccgcgggtttcttgatccgtgcccggcccaaggaagcggaccccggccaacgacgctcctgacagattcgccctgccgccgctcccttcgattccgtcctccccgtccgcggtgtttaggacctctgcagcgtagcatctggtccgtccctggagatgtccggcgcccaggagcagttcgagatcaagttccggctgccggacggcaccgacatcgggcccaggcgcttcccgccggcgtccaccgtcgccacgctcaaggagaccatcatcgcccagtggcccaaagataaagaaaaaagtcctaggactgtgaacga

SEQ ID NO: 1265 - DNA, 893 bp, Sorghum bicolor
  unsure (1)..(893): unsure at all n locations
  Clone ID: SORBI-28MAY03-CLUS18165_1
gtgccggcctcgaggcggccaagcctcaccagatttgatacacatgcagaccctgctgcctgttgcttctcagcagggccaaaagctgttgtgcctttggcctagcatcagtagctaccactaccaggagatcttcttccccctcctgtgagaggtgcccaacagcttcatcgtcagaagaatcagcacttcaggcagtagaagctcctgaggcagagacaagacccactgtccagcccagcgagctgatacttgtgtgtggagcgggcagagataagatggagaaggaacacatcaagatggccatgctgaagcaagaacaaacattcagacagcaggttcacgagctgcaccgtgtgtaccatgttcagaagcagttgatgatgcagatgcagataaccaagacaaacaactacggaaacaaagttcccgaaacgcaaaccgaaccgacagtaaaactcgagcgccaacaattgtgtggtagctcaggcaagacggaggccaagctggctgaagacttcaacctggagctgacactggcaactggggctggaaggatgaagcaggagaaggcatccaactcagactccgaagcaacaatgtcgtcatcgacatctgcagaatcagagtcagggcagagattcatgccaaactccaatgtaacaaacctaaggttccagaatgagagcaataggcatgatgatcaggtcatgcagtctccttggcgctatcaatgtttgagtctcaagatggcgtgaaggattagatagggttggcatgagagtgccccaggactcaaaagctcaacaagagcaagtgcattgctgcctgtatattacgatttcatttgcactgtangagcgagctcaaaagagaaatggagcattatggnc

SEQ ID NO: 1266 - DNA, 794 bp, Sorghum bicolor
  unsure (1)..(794): unsure at all n locations
  Clone ID: SORBI-28MAY03-CLUS18194_1
gccggccgggccggggccttcgccagattcgccgccgagcgctgcggctcagggagtcgtcaggctgcagcgccgctcctcccttcccctgtctggtggagtggagatccgtccgggcgtggaggattggctttcttcttcttgcctattggaatttttctggtaatcagcatggcattgtcatcagtgtttaggagaaaaatgtgaaagatttgacctccaaggtttcagtctataccagtgctacagagttatctggtggactaaacatgatatttaggcgctgggccacaaaaaagactgctgggtcaacaaaaaatggccgtgattccaatccaagtatttgngtgtaaagaagtttggtggagagaaagtgctaccaggaaacatcatcgtccgccaaagagggacccgcttccaggccgggaactatgcgggcgggacaaagtaacactcacttttctgcctgaaagaaggccatgtccgctttgagcgcaacaagctctcaggcaggaaatgggttcatgttgatccagttgctggtcatgatcttcaccccatttatgcagatagttttgctactacagccgacactgagcctttgcaataatatgtttgggggtttggggtgtcattttgtcccaactcattcagctgccattttacagtttcatgtgtaaactttagcaggctcgagtgtagctggaccttttctttgtaatcataactactcactttgaataatgtaagttatactttgtgatctgcaaaaaaaaaaaaaaaaaaggccccta

SEQ ID NO: 1267 - DNA, 823 bp, Sorghum bicolor
  Clone ID: SORBI-28MAY03-CLUS18962_1
tgtgcggcgctcgagccggccgggccgggaccgaaacaacgacactaaggtttccggcggcatccacccacggccacgggaggtgcgtggaggctgccgcctgccagtgacacggcgccgatagcaagagtgcaagagaggagcggcgttgctggtggtagcggtgcccgtgaggcgcggcgagatgtctgtgcggataaaggcggtggtggacaagttcgtgatggagctcaaggaggcactggacgcggacatccaggaccgcatcatgaaggagcgggagatgcagagctacatcgcggagcgcgagcgcgaggtcgccgagcgggaggccgcgtggaaggccgagctctcccgccgagaggctgagatcgcgagacaagaggcgaggctgaaggtcgagagggagaacctggagaaagagaagagcgtcctcatgggcacggcttcgaatcaggataaccaggacggagccctggagatcaccgtcagcggccgagaagtacaggtgcctccggttctccaaggcgaagaagtgagaggtgacctaggatgacaggacgacactgaatgaattaaccacgggtagtactacactgaaatcttcagtttgaaggctgcggttgtacgagttggtttgttagtttggtactcactgcatcgtgcatcctcattgatatgggcattgaaccagcgcacgacctgagcatatgattcagctgtcatggggtcactgctcgtagcatgaacttcagaattgatggcctctgttttgttcatctgataagaaggtaaaatcctgctgtctctacagtgttttccc

SEQ ID NO: 1268 - DNA, 700 bp, Sorghum bicolor
  Clone ID: LIB5052-006-A1-XP1-E7
gccggccgggcctgcatccagctttcagaccaacagacacacctcttcgctgttcttctcccgtttcaccaggagtcttgcgctggattcggccgactgagcacggccttgccgccgccgccgccctactccaagcggcgcaggtcttcgtcggaccctttgccggcaacgagcatccaccagtcacacaccaggttttgttgcaatggggttattcaagggcagcttcacttttggtgggaatgggatgtggtatctatgtagctcagaactacaacgttccgaacgtcaagaagttattcaacacatatgtttttctggctaagcacattgaggaaacctaccgaaagccgaagaaagacgatgattgattctttgggaaagcaagtacagctaacattatacggaaaggtgcttttttgaaatggtgaaggcaattttggttatgaacaagtattgaactctggtgggtaatgttggttagttgtggaattcagttgctgtaatagtttttggtcgtgttagaccatgagcttctatagcatcccttctgctcgtgttcctctgcctgggaaatgcactgaactttgtaattgaagtgcggtgatggataatgtagcatcatatcagtgtgtttgtcaacataggatgggatgatatgtttagttgactccaaaaaaaaaaaaaaaaaaggccccta

SEQ ID NO: 1269 - DNA, 722 bp, Sorghum bicolor
  Clone ID: LIB5049-011-R1-XP1-F3
gccggccgggccgggaggagtcttgcgctggattcggccgactgagcacggccttgccgccgccgccgccctactccaagcggcgcaggtcttcgtcggaccctttgccggcaacgagcatccaccagtcacacaccaggcctttaagagagatttcttgctgtattgaccttattacctacaactcacttcaccttggtcatttgttgattggattacttactcattagtcaggttttgttgcaatggggttattcaagggcagcttcacacttttggtgggaatgggatgtggtatctatgtagctcagaactacaacgttccgaacgtcaagaagttattcaacacatatgtttttctggctaagcacattgaggaaacctaccgaaagccgaagaaagacgatgattgattctttgggaaagcaagtacagctaacattatacggaaaggtgcttttttgaaatggtgaaggcaattttggttatgaacaagtattgaactctggtgggtaatgttggttagttgtggaattcagttgctgtaatagtttttggtcgtgttagaccatgagcttctatagcatcccttctgctcgtgttcctctgcctgggaaatgcactgaaactttgtaattgaagtgcggggatggataatggagcatcatatcagtgggtttgtcaacctaggaagcgaagatatgtttaggtgactcctaaat

SEQ ID NO: 1270 - DNA, 520 bp, Sorghum bicolor
  Clone ID: SORBI-28MAY03-CLUS1899_1
gccggcctggcctccgatccagcacaacagacctggtcgatatagcgataatggcttccacgtcgaccaccaccatgtcctctcttgccttggtcctcgcgttgctgctctcgagcggtgctatcggcagcgcggcgcggcagctgcaggagctgccgccgttgcccaagcctgagataccaccgaggccggacctgccgccgctccccaaacctgaggagcagccaccgttgcccaagccggagctgccggtgccaccgcagcccctcccgaagccggagctgccggtgccaccgcagccactccccgtaccgccgcagcccctgcccaaacccgagctgccggtgccaccggagcccctcccaaagccggagctccccgtcccgccgcagcccctgcccaagccggaggtgccggtgacaccggagcccctgcccaagcccgagctccccgtcccgccgcagcccctggccatgccccaatccccctgcccccccgccgcccccacccaccccccaac

SEQ ID NO: 1271 - DNA, 769 bp, Sorghum bicolor
  unsure (1)..(769): unsure at all n locations
  Clone ID: SORBI-28MAY03-CLUS19039_1
nctgcgatcaacttcagatttccgccctacgaacactccagcccacactcacacacaatgggtcacgcagccggtctccgcgcgggtacgcgctatgctttctcgagagacttcaagaagaagggtatgatccctctctcgacctacctcaagcagtacaaggtcggtgatatcgtcgatgtcgtagccaacggtgcggtccagaagggtatgccctacaaggtctaccacggcaagaccggtatcgtctacaacgtcaccaagtccgctgtcggtgtcatcctccagaagcaggtcggcaaccgatacatggagaagcgcatcaacgtccgcatcgagcacgtccgccactcccgctcacgagaggacttcctcaagcgcgtcaagctcaacttcgccaagcaacaaaaggccaaggagactggcgagccccagcagatgaagcgccagcccgcccagccccgcaccgagcacattgtcagcctcaaggagcaaaagccggagaacatcacacccatcccttacgagacctacatttagacgtggacagttggctcgggtgtattggctggcaaaatgggatacggatggtcaacggcgtggtttctcggacttctcgattattctctctttctgcactttcttacgcatggaaagcggcgataccatggtgcagatatagtggtgtgccaacatgggttttgagtgaccccctccgcccataaacatcatcttcccatcctaaaaaaaaaaaaaaattgcctctagg

SEQ ID NO: 1272 - DNA, 601 bp, Sorghum bicolor
  Clone ID: SORBI-28MAY03-CLUS19043_1
gccggcgcctttcaaaacgagcccatctccacccacattaccatctgatcggccgtccatatgcatggcttccctgggcatgcttaccatcaggaccactccacatgtttcgcaaggctgccggcgacgatgtagcagcgccgtgtctaggccgagatcctacttcctctgccaaagtcgcctcccgtccgggccgccgccagcaagcggcggcggtggaggaggaggaggaggtggtgagaagaagaccccatggtgggctgccacggccgagaggctgcgcggcgacgtggtgaaggcggggatggcggcgcgggagagcctgagccccaagcagaagggggactggaaggacgtcacgctcatgagcttctccttcgccgtgtacgtgtacatctctcagaagctcgtgtgcacgtactgtgcttggctctctatgattaatcactaaattggtgctgtaatcatcgataccgttgctgatcattgttattagaacaggtcattgttattaggtgcatatggatgctctatctgtaatatatttcgctccaaatccaataaagccccagttgaaaaaaaaaaaaaaaaaaggccccta

SEQ ID NO: 1273 - DNA, 883 bp, Sorghum bicolor
  unsure (1)..(883): unsure at all n locations
  Clone ID: SORBI-28MAY03-CLUS1908_1
gccggcctgggtgcgnaaaatgaaaacttagctaagtattactaattattgtatctaaagatggccgtagtctaacgaataaatagtcctagtgctctgtatgcctatccacacacccatagctagccagggattgcattgcgttatttcgtatataatctccgctgcgttattgtcacgcaagtagttgcctcggtcgagccacaacacaaacacagacaccacactagtctccgtctctcatcgaccatggcattccccgggtctccggcgaggaagctcctaccaggcggcttcaccgccgtcgccggcgggtctctcagcttcgacctcgacggcgccggcgacttcttctcgggcctgtggcagctcgtcaaggcgaaggccgccgaggtcgtggcctacctcgccaccctgttcgcggcgctggcggagaaggcggacgaggtgttcccgccggagacccggtcggagacgctccggcagtgggtgcacgtggccgtcaccgtggtggtcccggccgtgctgggcgccctcgtgctccgctgcgtcgcccgctgctgctggcgctgctgctgcgccggcggcggcagggccgcgcgcggtggccgctttatggctgcgccgggccgcggcggcgcgcgcatgccgcgnggcgtgttcgagacaacccccgggattacttccgtgacctccgcgccgggaaagccctcgtgtactagcgtacgtgcattcgtggatacgcctgtgtgtacgtattgtacggctgtacgagtacgtacgagatcgagtgtgtgatggtattatgcatggagcatggntcnttttttatctctatataaataaaatctctctaggcaaaaaaaaaaaaaaaaggccctag

SEQ ID NO: 1274 - DNA, 731 bp, Sorghum bicolor
  unsure (1)..(731): unsure at all n locations
  Clone ID: SORBI-28MAY03-CLUS19195_1
aacagaaccacttgtttccctcaaaaaaaaaaaaaaaaaaaagcgcgacttcaacaccaccagcaccctccacccgacgactccgattctcgacaaataccgccaacatgcccggtgtctctgttcgtgatgtccaggcggacaagttcatcaacgcctacgctgctttcttgaagcgtcagggaaagctccccattcccggttggagcgacaccgtcaagaccggtcaccttaaggagcttcctcctcagagcatcgactggtactacatccgtgccgccgctgtcgcccgccacatctacatgcgcaagactgtcggtatcggccgtctccgcaaggtccacggtggcaccaagaaccgtggctcccgcccctctcaccacgttgacgcctccggctccgtcgaccgcaagatctgccagtctcttgccaagatcggtgtcctcgagaacgacgacgacaagggtggccgccgcatcacccagtccggccagcgtgacttggaccgtattgcccagaccaccgtcgaggccgaggaggaggaggatgaggacgacgagtaaatgtcctctctgacttcgggttcttaattgctgcaaaggcgcctggcgcaggaggattgcgggtctgaatggacgggtcgagggaactcgaacttcataggtgtctcaagcgctgagcactggaaacaggctgctatcttgatcaatcaaaagntttcctgcgcccgt

SEQ ID NO: 1275 - DNA, 693 bp, Sorghum bicolor
  Clone ID: SORBI-28MAY03-CLUS19227_1
gccggccgggtccggacccataggtagtagtttgatagtttctttcctgtagctattctcttctctatggcgatgtcgatcccgtcaatggttgttgtaatagcaatgctgcttatggtagcatctacaacacactacggctgccacgcacatgcctatgctcctgccccacgtcaccatgcagccactctgagccctcatcatgccccggcacctgcgcagccattgggttctcatggtcatggccacgatggtgctgatcatgcacctgcgccaggtcatcatggtcaccatgcacctgcatcagcgccatatcatcatggtcaccacagtcatcacgcaccggcagcgacgccaagtcatcatgattatagtgccccagcaccggtacacacccaccaccaatcggctcacgctccaaaattgcatcatcctcatcatcacgctccagtgcccgctcctgttcatggtagccaggccggtcaaagctcctactaatctctagatgcaaatggttgtaacatgtgtggcaacaataaaaggcaatatttacataatggctaaatttctatgttcttgctatgcctccgtgttattcatggtaatcttagccaatcagcttgaattgagctacaaatttgctgtttatagttgcacctcatgtgcttactctctccatctcagaaaaaagag

SEQ ID NO: 1276 - DNA, 837 bp, Sorghum bicolor
  unsure (1)..(837): unsure at all n locations
  Clone ID: SORBI-28MAY03-CLUS18405_1
tttatcccacacaccttaacgtgacgtgctgcaggggggcgcagggcaggattaggcagggccggccggaccgcccgtccaggagccagggactttcgttcggccatgggggacggtggtgctgacgacgcctcctcgccgccgccgcccgggggcttctcctacctcgccgtcttccacaactaccccctcgtcgccgccctgctcgggttcgccatcgcgcagtccatcaagctcttcgtcacatggtaatggtacaaggagaacagatgggatcccaagcagcttatcggctctggcggcatgccatcatcacattctgccacggttacagcactagcagtagcgattgggttccaagatggctttaattgctccctctttgcaacagcaactatatttgcaagtgtggtaatgtatgatgcttctggtatcagattgcatgctggaaagcaagcagcggtattgaatcaaatagtttgtgaacttccttctgaacatcccttgtccgaaacaagaccactgcgagaactttaggccatacaccaacccaggtgattgctggcgcattgcttgggtgtacgatagccacagcaggacaattattcgtttgaactcctaaggtgcagcagaatgttgtagcatttgtttcgtggagacttgagaagaagtttctctagtgttctgctactttagatattggtaagatttgcaacttggggctgtagtgttgttgaatgttgtaagttctgatgggaggtgattatatgtncaggtgatgtgcacaggattggtgtacagaacatttggtcgataatgtcatggggtatgatgatg

SEQ ID NO: 1277 - DNA, 583 bp, Sorghum bicolor
  Clone ID: SORBI-28MAY03-CLUS18454_1
ccgggggacgagagcactgacttgtcttcctctctctctcctctcgtctccagcgacggtggtgggcgagctaggcgaaggcgaagcggaggagtgggagcagaagcggcagccatggccgcgatgcaggcgctcaagagcttcgtcgtgaaggagcctgtcgtcgcggcctcctgtctcatcgccggattcggtctctttcttccagcagttgtccggccaatcctggattcatgggagaccgcagagaaagttcctccaccacctctaaatgatgtggttgcaggtgtcaccggcaagaaaaagtagtgaacttgcattgttttcttatgtcaatgttgtgccacatttcttccccatgttttctggcgaccagattggaaggatctcccagtcatggtcttcaactctagatggcgaccagattggaaggatctcccagtcatggtcttcaactctagatggtgtccgcggaataatcattgtacctgaatcatgtactgcagtgtgacagttttggaaaatttttctcctacaaaggttgatagaatgtcatcaaaaaaaaaaaaaaaaaagggcccta

SEQ ID NO: 1278 - DNA, 632 bp, Sorghum bicolor
  Clone ID: LIB5052-005-A1-XP1-D7
gccggccgggcttcgcgcacatcttctcccccgctcctcgttcctctcctctccgacccgacccgctcgcgccgcgccgcgccgcgcctcgcctcgcgcagtcgaaaacaccgcctccgcccccgtctccggcgagatcacctccggcggcacgcggatatgactacttcaaggcgtcttgctgacaggaagagcgccaagttccagaagaacatcacaaagaggggttctgtgcctgagactacggtgaaaaagggaaatgactaccctgttggaccgatagtgcttggattcttcatttttgtggtcattggatcatcattgtttcagataatcaggacggcgaccagcggtgggttggcctgaattcactgagctgagatcagaaaattatccgttcaggagctgggaggcagtatctattttctgtagcaaacttgttcctggatgatatcagtatcatgtagtgcgagtatcactgttgttttgtttggagtatcaaaagagttttaaactgatgttggaaccatgcacatgctgaaagtttcaaagagtatgagaggaaccttaatctgaagaatagtagcggctctgcaattcccgaacaaaaaaaaaaaaaaaaaaggccccta

SEQ ID NO: 1279 - DNA, 596 bp, Sorghum bicolor
  Clone ID: LIB5047-005-R1-XP1-A11
gccggccgggctgcgacatctcctcccctgctcctcgttcctctccgacccgacccgacccgcttgcgccgcgccgcgcctcgcctcgcctcgcgcagtcgaacaccgcctccgtccccgtctccggcgagatcacctccggcggcacgcggatatgactacttcaaggcgtcttgctgacaggaagagcgccaagttccagaagaacatcacaaagaggggttctgtgcctgagactacggtgaaaaagggaaatgactaccctgttggaccgatagtgcttggattcttcatttttgtggtcattggatcatcattgtttcagataatcaggacggcgaccagcggtgggttggcctgaattcactgagctgagatcagaaaattatccgttcaggagctgggaggcagtatctattttctgtagcaaacttgttcctggatgatatcagtatcatgtagtgcgagtatcactgttgttttgtttggagtatcaaaagagttttaaactgatgttggaaccatgcacatgctgaaagtttcaaagagtatgagaggaaccttaatctagaaaaaaaaaaaaaaaaaagccccta

SEQ ID NO: 1280 - DNA, 834 bp, Sorghum bicolor
  unsure (1)..(834): unsure at all n locations
  Clone ID: SORBI-28MAY03-CLUS19356_1
gccggccgggatcggaggtgacccgggtacgcctcaatctggccgggaagaacagctccaaggaagaaaagcaggcggtagagtgctagaccggccgtcctcctctgcagccaccaaatcctcctctgcaacgaacatggcagcaggcccggtgtacagcatcacaagaacggagatcgacgagttctggaggaggaaggaggtggaagcagaggagcggcgactcgctgccgagaaggaggctgcaagaatcaaggccaagacactcaagatagaagattacgtgctcttcgagcaaatgatcagggagattctcaaagaggggagcaaagaagacggagcaaccatggcgccagctaccaccggtggcactgaggcacggatcattggcatcaaacactggtggacaagaagtgcttatgcttatctgaattcacctacctcgtccatggatgggaatggcagaagcaagcatgttggcccatatgttccgcaggagagatgtaccatgttcttctcatcaactccatgccaggcaaatgtcaatgctcgtgcagtcttttaggtgttcccgccaaaccaaggataagctgggacctggggaaatcaggaaatgtggatgtgatattcatgtgtttgttataatttgggttgaataagctgaaacttatttcccatatggaatttaactgtatatctatcttctagtactgcttgagagatcaagtaataagtatggataaccatgttgcttcacgtatgaagcaagatactaatgagaaattgtcattacaacattgcttgcgacganaaaaaaaaaaaaaaaggccccta

SEQ ID NO: 1281 - DNA, 497 bp, Sorghum bicolor
  Clone ID: SORBI-28MAY03-CLUS19417_1
gccggccgggccgggaccttcgtgcccagaagaagccgctgccatcgcaaaatccccaaatcctcggcggagagggagagccggagagaggggcgcagccagagaggtcggagaaggggaagaagatggtgcgggtggcgacctacttcgcgatgaccttcggggcgttcctcttctggcagtccatggacagggtccacgtctggatcgcccttcaccaggacgaaaagaaagagaggatggaaagggagctggggataaagagaatgcaggcagagttaatggcccaagctaaagagaatgaatcatgattatcatttggccaattgtttcaggcgattcctttgtcatatttcctctgctgtatttccaagtgatatcttgactgatgtatgctcgacacttctaataaagcgagagatgctataactttgtcgaattcaacgggtatgctcatcttgaattattggaaaaaaaaaaaaaaaaaaaggccccta

SEQ ID NO: 1282 - DNA, 726 bp, Sorghum bicolor
  Clone ID: SORBI-28MAY03-CLUS19476_1
gccggccggggccgggaacttctcgacccaaggtactaacctcacagcacaatcaagatggcacgcttccaggaataccagattatcggccgccatctgccttcagaggccaaccccgcgcctaagatctaccgcatgcgcatctttgcgcccaacgaggttgtcgccaagtcacggttctggtacttccttggcaagctccgcaagatcaagaaggccaacggtgagatcgtctccgtaaaccagatccacgagaagaagccccagaaggtcaagaacttcggtatctggctcaagtacgactcgcgctccggcacccacaacatgtacaaggagtaccgcgagatgtcccgcgtcgccgccgtcgatgccctctaccaggacatggccgcccgtcaccgatcgcgtttcaggcaggttcagattctcaaggtcgttgaggtcgagaaggccgacgacatccgccgaccatacattaagcagctcctcaccaagaacctcaagttcccgctgccccaccgcatcaacaagaaggctggcaagaaggtcttctccgctacccgaccttccactttcttctaagcgtgttttccattacggagtgcggtctggatgggttgggatgatatgggtttccctcggttatgcatgcttcacgaaaagaagtacactaggaacgaatgaaatccctgatacctccaaaaaaaaaaaaaaaaaaggccccta

SEQ ID NO: 1283 - DNA, 745 bp, Sorghum bicolor
  Clone ID: SORBI-28MAY03-CLUS19521_1
tgtgcggccgctcaggcggccctgtgcggcgctctttttgtgatcgcggcccgaactttgtctactaacccgacaacccgccaattccacagcaaaaatgaccaaggtccagtcaatggtcgcgagctctcgccgcaaatcgcgaaaggcacacttcagtgcgccgagtagtgtgcgtcgggtcatcatgagcgcgcctttgagtaaggagctccgcgagaagcacggagtgcgcagcattcccatccgcaaggacgacgagatcaccgttgtccgcggctccaacaagggacgtgagggcaaggtctcctccgtctaccgcctcaagtactgcctccacgtcaacggcatcgtccgcgagaagagcaacggccagtccgttcccatccccatcgctccctccaaggtcgtcatcaccaagctcaagctcgacaaggaccgtgagcaaatcctggagcgcaagagcgccggccgcgaggagaagaagaagcagagggaggcataagcgtatcaacgctttccttggttgacgacacacaccacgacgatgagggacatcgacacgagcatccccgtccgtagtggatgaaatgcatatcatgggttcacggtctgggcatgcgatacgcgcatggaaaagcagggcgttataccggcttctagctcgaacaatggacttgccgtcatgcggccccgtcgaaagacaaaaaacaaaaaagaaaaaaaaaaaaaaaaaagctcccta

SEQ ID NO: 1284 - DNA, 725 bp, Sorghum bicolor
  Clone ID: SORBI-28MAY03-CLUS19555_1
gcacgaggccacaatcgcaagccggccgcctgttctttccgccatcacccttccaactcagccgagatatatcactacaacaccgacgccaacatgcaccgaacatacagcatgcgccaatctcgcgcgcccacggcgtcgcagattcagagccccccgccaccttcgtcctcgaccaagagcgggcgcttctttggcaaggctaacattggccacaccttccgccacaagtctgccggtgccttcggacctgaccttgcgaagaagttgtcacaacttgtaaagatggagaagaacgtcatgcgcagcatggagctggtttctagggagcgtatggaggtcgcacaacaactctccatttggggcgaggcttgcgacgacgacgtctctgacgtcactgacaagctcggagttctcatctacgaaatcggtgagctcgaggaccagtatgttgaccgctacgaccaataccgtgtcactatcaagagcatccgcaacattgaagcttccgttcagcccagccgtgaccgcaaacagaagatcaccgaccagattgcccagttgaagtacaaggagcccaactcccccaagattgttgtccttgagcaagagctcgtacgcgccgagggcgagtctctggtcgccgaagcccagctttccaacatcactcgtgagaaagctcaggcagctttcacttaccaattcgacggcatgcgcgagcactg

SEQ ID NO: 1285 - DNA, 767 bp, Sorghum bicolor
  Clone ID: SORBI-28MAY03-CLUS19564_1
gccggccgggctcacacaaggaaaggaaaaaggaaagagtgcagcgacgcgcacacacacaaaggtaaaaaagaaatatctctcgtcaccgcgagctccccgccgagctctctccctctccgtcggtgatggcaactcagagctccaaggccgcggacaccgccgcgcctgctcctgcgccggaggccgcagccgccggagaggcggctccgagcgctgcttcctcaacaccggcacaaaaccctaccgctgctgcaaccgcggcggccggggctatagatctggagaagaagatgcgccgcgcggagcggtttgggacgccagtggtcatgtcagaggaagaaaagcgcagcaatcgcgccgagagatttgggactggatcttcaagtgtaaaggaggaagagaagaagaagtccagggctgagaaaattggccttgcctcatcctcttcttcagatgaggaagctaagaaaaagtaacgtctggaacgatttggtcagggcacaaatggtgacaaggctaaaaaaaaaaaaaaaaaattgacctgcaacactgtaggcttttatggtagtactaaagtacttagatgaggtctagctccaacactttaggcttaggcttttagggtactataaagtacatagacaaggtctagctccatacatttcagttctctgtctgtgttcttctgaggttgcagttattcacgatgttgcaaggcacgcggggggtgatgttgcagcaattctgtgcgctgtattattcga

SEQ ID NO: 1286 - DNA, 653 bp, Sorghum bicolor
  Clone ID: SORBI-28MAY03-CLUS19632_1
tatcgcttatcatcctcggtttgtgcatctcctccgcctccgcttgacctcctaggccggatacttttgtcatactcggaggagcaccacttctaatccaagggcgacgctggtgcgtccaagacttacccgcataaggctggcaccgctcgaaagatacgggttcctcgccatctgggggcgtccctgatagggtgtgtaggtatctacctcctagactgggaagcacggacacgcctcatgcctatattgatgccatatacatattcctcgctgaacagcttgaaaatattgctccttcgtcacacaactgtgacattccgcatgagaaccctactgagtatcccctgattgacctattggaggatgaatttgtgagccttcttactttacacgtccacactaatgatgatcctagactcccaactgatgatactcttgtggaccatatgatagaatgctctgaaagtgttaaggatcttgctgcgactgtccagcctgatatcgaggacgagcagatctgctacctgaaggatattgaccccgagaaacttccctgccttggaacacggaactactgtatctcactacttaaatgcaagaacaccgtatcaccaagggattgctactgaaatcatcccatgccgaaacat

SEQ ID NO: 1287 - DNA, 883 bp, Sorghum bicolor
  unsure (1)..(883): unsure at all n locations
  Clone ID: SORBI-28MAY03-CLUS19621_1
gccggcgccggccggatcttcatatcacatcacacttcaactcaattcccattttatataccccaaacttctttactcttcacaaacccacctaatcgccacaatgcccatcaccgttccccaagctaccgagctcaaggacctcttcagccttaagggcaaggtcgtcatcgtcaccggtgcctccggtcccaccggtattggcacagaggctgcccgaggatgcgctgagtacggtgccgacctcgccatcacctacaactctcgcgccgagggtgccgagaagaacgcaaaggagatgagcgagaagtacggcgtcaagatcaaggcctacaagtgccaggtcaacgagtacgctcagtgcgagaagctcgtccaggacgtcatcaaggacttcggcaaggtcgatgtcttcatcgccaacgccggaaagactgccgacaacggtatcctcgacgctaccgttgagcagtggaatgaggtcatccagaccgacttgaccggtaccttcaactgcgcccgtgccgtcggtctccacttccgcgagcgcaagactggctctctcgtcatcacctcctccatgtccggccacattgccaacttcccccaggagcaggcctcctacaacgttgctaaggctggctgcattcacctcgccaagtcactcgccaacgagtggagggactttgcccgtgtcaactccatctcccctggatacatcgatactggtctctccgacttcgttccacaggacatccagaagctgtggcactccatgatccccatgggtcgtgacgccaaggctactgagctcangggtgcctacgtctacttcgcatcggatgcctcatcctactgcactggntccgatctcctcatcgac

SEQ ID NO: 1288 - DNA, 830 bp, Sorghum bicolor
  unsure (1)..(830): unsure at all n locations
  Clone ID: SORBI-28MAY03-CLUS18848_1
ccgggatggacaccaatattatttcatgaatgtcactctactgatgctgatactaatttcgttgtgagagaaaaacattatatatgatttaaaaatagtgctaataaattcgagcgaaccgagacatattgttgccgcttccctttccacaacccgccactaagtacaatctagcaaagccatggtcagctgcgtggtgctgctccacgagacctccccatggagcgtgctcggtggtgcggcggcaatgttggccctgtggtgggcaatgcaggcgctggagtgggcctggtggactcctcggcgaatagagcgaaccctcagggcgcagggcctaaggggcacccggtaccgctccctgtggggcgacctcaaggaggagagccggctaacagcgacagccctggcgaagcccgtgcacacggaccggccccatgacatcttcccacgtgtttcccctctccttcatcgtgccgtcgaggagcatggcaaactctcgttcacgtggttcgggacgaccccaagaattgcaatcgccgaccctcagctggcccgggaagttatgtcgaacaaagatggctacttcgtgaaaacaaagataaccactcgtgtcacgaagcttctatttgctggggttgcgattcttgacgccgagaaatgggccaagcataggaagatctgaatccggccctttcatgctgaaaagctcaaggggatgttgccggcgttctctgcagcttgcagcgatctaatttgtaaatggggcaacttagntgctgattctgtcggacaaaagagctggatgtatggcctgaattccaaatttatca

SEQ ID NO: 1289 - DNA, 679 bp, Sorghum bicolor
  unsure (1)..(679): unsure at all n locations
  Clone ID: LIB5049-010-R1-XP1-F11
gccggccgggccgggatcacccagtcattgtggaaccaacaaatctccaagctcaaccaagaaccgagagatcttttgatttcaccacgatgaggaccctcatttccatgctcgtcgtcgccgccgccgcggtggtcggcctgtgctctgtggctcccgctgcatcagcgcgcggggagccgccggtgccgcaggccgtcggcgggtggaggccgattaatgtgaacgacccccacatccaagagctcggccgctgggcggtttcggagcacggcaagcaggccagcgaccggctggtcttcggcaaggtggtgagcggcgaggagcagatcgtcgccgggacgaaatacaagctggtcattcaggcgaccagggccggcgccggcgggaacagcgcgacgtacggggcggtggtgtacgagaaggtcgacaagacacggcagctactgtcgtttagtccggcgaactgatcgatataaaggcgtcgctgggacgatggttgttctagcctcgacgtttaggatttcagattagagttctgcaagtaccgcggtgtaatgtaacgaacaaaatcatgtactattgctcttgtcatatcgcgggataatggtaataaataagcttcaataaaacttggtgccttgcaccatgataanaaaaaaaaaaaaaaaggccccta

SEQ ID NO: 1290 - DNA, 628 bp, Sorghum bicolor
  unsure (1)..(628): unsure at all n locations
  Clone ID: LIB5052-006-A1-XP1-B8
gccggccgggcctccgacccaagtncattgtggaaccaacaaatctccaaactctcccaagaaccgagagatcttttgatttgaccatgatgagggccctcatttccatgctcatcgtcgccgccgcagttgtggggctgtgctctgtcgctcccgctgcatcagcgcgcgaggcgcccctgccggagaacgtcggcaggtggacgccgatcacggacgtgaacgaccccgaaatccaagagatcggccgatgggcggtttcggagcacgacgcggcggccagcgatagtctggtcttcagcaaggtggtgcgcggcgaggagcaggtcgtcgccgggacgaactacaagctggtcattgaagcgaccaagggcgccggcgggaagatcgcgacgtacggggcggtggtgtacgagaaggttgacaatacgcggcagctactatcgtttgcgccggagaactgatctgtaggacgtcgccggacgacggttctaggattcagatttcagattggattagagttctgcaattacggtggtgtatgtaataagaaacgacatgctggattgctcttgtcataccatcggattataataagtaagcttccatcaaagtgtcttgatcgaaa

SEQ ID NO: 1291 - DNA, 520 bp, Sorghum bicolor
  Clone ID: SORBI-28MAY03-CLUS19751_1
gccggccgggctgggatctttatcgacacatcatgaccaagaagagaagaggaaacggccgaaacaagaagggacgaggacacgtcaagagcgtccgatgctccaactgctcgcgatgcgtgcctaaggacaaggccatcaagcgatactcggtcaagaacatggtcgaggccgctgccgtccgtgacctgtccgaggcttccgtttacgccgagtacgccctccccaagctctacatccgagtggcctactgcatctcgtgcgctatccacgccaagatcgtccgagtccgatccgccaagcccggagcgatcaactcccgaaagaaccgactgccgcccccccgtgctatcttccgggacggaaagcgaatcaaccctgccgtcgccgccgccatggctgcgaagaccgccgagggccagaaggcttaaggagggtcttgatgggttgtagtggtttgcagcagacatgcacgtatgacgactatgacgtaaaaaaaaaaaaaaaaaagggccctaag

SEQ ID NO: 1292 - DNA, 681 bp, Sorghum bicolor
  Clone ID: SORBI-28MAY03-CLUS1975_1
cgtccggtctgccgcaccaccgtcgtcgacgcggtcaccctcgccgtcgcctccgtgatccagccccccgccgccgtcgaggtccccaccgaggcgcgcgtcgcggtcgccggcgacgagctcttcctcgtcgtcaagtccaagtggatgtacctcttcggcgacgacgtcgacttctccaaggccttccacgtcaaccaccgcggcgtcaatcctgtctggcaggagctcacaggcatcggcgaccgtgcgctgttcgtggataaactccacgggtttgcagtgccgacgccggggttcggaaatcttgagggcaacacaatctattcagtgagcagcaaggatgtgaacaacaataggcgtcacactcccaccacggtgaactacagcgtgtcggcatttagccttgagagccgtatctccaagaaacttgtgtgcctgctcaacggccgggagatggcgaagcgtggtgagacggcatcgtggatcgtaccgagcttggatgaaggctgactctgcagagcttggacatcatcattattgtggaatcagtgttgatatatggctctaggtaatttattcggtatcccttgagttgctatagttcttttgagttcgaaccagcaataatccccttcaatatataagttcactcctgtaaattcttaattctgtcgatta

SEQ ID NO: 1293 - DNA, 960 bp, Sorghum bicolor
  Clone ID: SORBI-28MAY03-CLUS1976_1
cgtccggttgttggcaaggaattgatttgctaccaagattcccggtttgaggtttggggaacaaaaggttatggtgtccaaccaacaggcacatcaagaaagcttccagagtaccagatgcatgaaagttctagttctcccaatgtaacaatacaaactactgacagtagacaagataaagttgaaaggcttcaaagaaatctttcgacaccaaacgttgctaaatttgatgataaaagagattattttggatttattggtcatgaggaggttgacataggaatgtcaatggcaagccaatggatggtaccttgcttcgctgccactgcttgccttatgttgtatcttagttgtagaatgcaacaaaaacgccgccggcgaaggaaaggttcggtggctagtgctagtcggctaacaagtatggtataatgcggcattggtggggtgctgaataggggttttagcagatctaagtttcaggcctccagccatgatggataaccaggaagcgctccatctgagcagcatgacagaattctgcccagcatgacagaattttagtagccggaagttcctggtggtcaccaagacacattttaacccagcaactagaggcggaggaacttaagagaaagctgactcgtcacttctgtggacacatggaaagctgcttatctgcccagaatgagcagtttgtagcatctactgttgttgcttgtagtcgctcaattttgttcttcaccacagatagttgtagccacaaaaatagctaagagctaatatctaggggagaagctagagctaattatttgccatctcctttatgtgaaggggatctgagcttctctgtagatccatgagcccttaggggcagacactcagcatgagcttggcaggtacaaaggaggcttaggcttatgtaaagaaaattttgcattgtaaaaaagaagcaaacctgtg

SEQ ID NO: 1294 - DNA, 564 bp, Sorghum bicolor
  Clone ID: SORBI-28MAY03-CLUS19801_1
atcctttgaagcatcacactccaagcgtgatttaactagctccattgcagagaaacttggtgtccaagctcctcctgttagaatggatagccaagcaaaatatggtgccctagcacgtggtgatggtgacatttttctgcgcattccgcacaaaagttacatagaaacagtttgggatcatgcagctggatcaattgttgtcacagaagctggtggcatggtaaaagatgcctcaggaaacgatttggatttttccaaaggtagatatcttgatcgtgacagaggaattattgcaacaaataaacatttaatgccacttgttctaaaggcggttcaagaggctatgaaggaggaacaggcgggtggggccggcatagagcagtcacgaaatttgttatgaaaatttcctttttgaatcaatatatttgttatgcacaatctcgacgtgaagaaaagataacaatcctgttgtacttgtaccatatgctattgtatcgtgtgagtcatatgccagtcacatactcacatgtcattttcgaaaaaaaaaaaaaaaaaaggccccta

SEQ ID NO: 1295 - DNA, 378 bp, Sorghum bicolor
  Clone ID: SORBI-28MAY03-CLUS19826_1
gccggccgggctgcgacctgtttgacattcctccggggccgagctcagttgcgtgggcttgtaacccaagtgggggcatcaaggtggtgtggatgtttggtgcggaatctgggcctgggctcttgatgtgccttggctggcctgcccgttccaagttggttgtggccagcggagacttgggcggaagctcttggcctccctggacctaaagtggcaggaacggcgtgaggctggtttcacagagcagcgatcactgtccgcttccaacggtggaaggataacaggccgctgcatcatgggtcccgcttcaggcccagactcctactataacagaccaccatctttttacatgaaaaaaaaaaaaaaaaaaggccccta

SEQ ID NO: 1296 - DNA, 445 bp, Sorghum bicolor
  unsure (1)..(445): unsure at all n locations
  Clone ID: SORBI-28MAY03-CLUS1986_1
acgcgtccgcagtcgtttcctaaagctttagcttgcatgcacttccctactgctgctagcaaagacctttattactagtgttacaagttattacaaacaacaagaagaaaaagaaatcgaggccaagataaaagagggcttcgatttctctgctagtgtgatcttgtgtagtaatccagtgaggaagaagaaatcaagaagcagagagctgctctgtttttttttcttgcaagaaagggcggttcttgtcggacggagcacaggaagaagagaatggcttcctccagcgggagcgggagctcgggctctctgtcggcggcgacggcggcgctggccgcggcggcgggcacggaggaggagctgcgcgcgctcatggagcagcggcgcgccaagcggatgctgnccaaccgcgagtccgcgccggnggcgcgggtgcccaagcagc

SEQ ID NO: 1297 - DNA, 811 bp, Sorghum bicolor
  Clone ID: SORBI-28MAY03-CLUS19840_1
aatcttatctcccccgcaccacagctccttatcctctggttctccaacgtatggacacgatgatttcaggcggcggcgcatccacatagtctcactgcttccgccggccggatcctcattcttgcatcttcattcttcggcctagttgagcgacgatggcagacggcggtcctctacttctggcgagaagcggcagggcaggtgccggggacgtgccccgcaaggaggcgagagctgttggggcctgctgctggcctgggacgatgaccgatggctactgcatccagctgctagggccggccaagggaggttggaaagggccgccgtggagcgcgcagcagctctgtcacagcgcccgagcgccgacatgcagtccattagtgcgaccaaaggtatgcagtggctggtcaactaacccaagaaagatatgtaaatagctttggagtagttttttggagcttttgataggtagaatgcctgcggaccataatgcctagaggctagcagagcctggtaacttggttatgttcacttgataatttagtgccagagggtctatgttaaacctgtatggtttacacaactcttaaatgggcagattgtagatggcaaagatagccacctgcagcagaacgtccatgtgcacaacaagcaacagatggataatgagggaggcatggaagaaggtagtccagtcacagtgccaattcccacttagcctctgaaaacatataaacttctctgaaccagttggcatataaatttcatcaaccaatttgccaagaaaaaaaaaaaaaaaaaaggcccccta

SEQ ID NO: 1298 - DNA, 724 bp, Sorghum bicolor
  Clone ID: SORBI-28MAY03-CLUS19894_1
gccggccgggctgggattcttctatacctcccgtgctctcgtccctcccattgtacctgcagtgcagcccatcatactttagatcatcatggccaacgccttgctgctcctcgtggcgctgctcgtcgccgggtgcgcggctctggcttcggccacgtcgtacaccgtcggcgacgggcagggctggacgaccaacgtcgactacagcacctgggccagcggcaagagcttcgccgtcggagacaaactagtgttcaactacatgagcaaggcgcactcggtgacggaggtgagcaagagcggctacgacacctgctccggcgccaacccgctgagcgacgacgagagcggctccaccgtcgtcccgctccagaccccgggaacgcactacttcatctgcaacgtccccggccactgcgcggaaggcatgaagctggccgtcgccgtctccgccacgccgtcttccgcggggggcgccctgctgcaggtcccggcgatggcctccgtcgtcgccgcggcggccgcaggcgctgcgatcaagctcgcgctcttctgacggagcacggcggcgcggctatcgatcgtcagagtcgtctcagggtagagacagtgcatgcagttggctatgttcttggacgttgatggttcgtgtaatcggtgattactgtccacacttaatttctgctacgttttctggctaaaaaaaaaaaaaaaaaggccccta

SEQ ID NO: 1299 - DNA, 737 bp, Sorghum bicolor
  Clone ID: SORBI-28MAY03-CLUS1926_1
cgtccgtgagaaacaagagagccagagccaggccagcgcttgctgcaaagctcaagcgccgcagcaatgtctctggccccgtccatcccttccatcaaggtgaaggtgggggccgtctcggtcgcgccgccgcaccgcgcatgccggtccttcgcggtgatcaggagctccaaggcggagggacccatccggagacctgcggcgcctccgctgtcgccgccgccaccgaagccacccaagacgccggctctgtccactcctcccaccctgtcgcagcctccgacgcccgtgaagcccgctgttccacccacgtcgtcgctgccgacgccaccttctcctgagctgaagccggttgaggcccaggccccggcggcagcgctgcagaggccggtggctggggctgtgacgctggagtaccagaggaaggtggccaaggacctgcaggagtacttcaagaagaagaagctggaggaggctgaccagggtccgttctttgggttcttgcccaagaatgagatttccaacggaaggtgggccatgtttgggtttgcagtagggatgctaacagagtacgcaacaggctcggattttgttcagcaaatgaagatccttctctccaattttggaattgtggacttggattaatggcggacttttggtgttttcattatgtataagtcttttaaatgtaatgtaattacttgatatgtcatatagaaaattttatcttgcgcgtt

SEQ ID NO: 1300 - DNA, 587 bp, Sorghum bicolor
  Clone ID: LIB5051-004-A1-XP1-A11
tctcaagctacgttttaataccgacgcacccaactctggatgccgctgggggctgtggccaccgttccgagcattgtgtttgcggcgagcagcgcaggcagacatggcacgggcagagaaagaagccccacgaggacctgaacatctggaggggcatcatcgtcatagagatcgtcaaagagttgatcggggggggcaccgacaactatgccgtcgatggtggtgacggggcgcatcgtccccgattttttcaacaagaggggcagtggagattctgccggcatcaacgtcgacgcttctggctgaccgaatgatggcaccagcttggtgccgttgctttagtgagctggcctctttatcctgtatttctgctaggatgccggcaggtatccctgaagcctttcgatccgcatgtaatgctgtgtaggatgtgcatgggatggtggtggcaatatggagcggctgatcggtgatcgaggggttcgtgagcctggctgtgtaacttcgagtgagttgcgcaataattcttgatcgggtgacagggacgcactcgggtggatctatgaatgcatgctcactttgtgttc

SEQ ID NO: 1301 - DNA, 507 bp, Sorghum bicolor
  Clone ID: LIB5048-005-R1-XP2-C2
ttcgggggatagcacctcgaccgtcagcccgtgtagtccacctgctcagtgctcactctcgagctagtctcgaacacggccgcacccaagtcagggtgccgctggggcctgtcgccagcgttccaagcagctgtgtttgcgcgagagcgcggcgccatggacggccagagaaagaagccccacggcaacccgaacatccggaggggcagcatcatcaaagagatcgtcaaagacttgatcggagggggcaccaagaaccctggtggtgatggtggtgacggcggcaacgtcggcgacagcaacggcaagaggggcagtggagattctgccggcgccgccgccgacgcttctggctgaccgcatgatggtacgtgcttgttgccgttgctttagtgagctggcctctttagtctttatttctgctaggctgccggcaggtttccctgaagcctttcgatccgtatgtaatgttgtgtaggatgtgcatgggatggtggtggtaatatg

SEQ ID NO: 1302 - DNA, 709 bp, Sorghum bicolor
  Clone ID: SORBI-28MAY03-CLUS19327_1
gcacgaggccgcgtcgcccgcggccgccctccggtcgcaggctcagccgcacccggcggtggagactcctcccccgcagccgtacggcttccacaacctcgaccgccgcaccatgctcctcgccgacggcaccgtccgcacctacttcgccctgccccctgactaccccttcgagccggcgcccctgccacccctcccacgccacctcctcccccgcgccgccccagacctttggccgccacatcaggcgccggcggcgccgccgcagatgcccatgcccatgcctgtgcagatgccgccgcacgaggctaggcggaaacaccccgccgaccaggacgagggcttccctaggcaccacaagcagccgcggctcgacgggccgcatcaaccgccgccacatgccgcggtggaccggcacgcactcaggagggcgttcctcaagtacgccaagatgctcaacgagagctccgcgcagaggcggagctatctcgagggcggccgtgtcccgtgcctcgcctgtggcaggtttggcgatcccacactgtttgctgccttcttcctggcaagctttctagtatcatttgtagtcaagttcctgtgttggtttcttgctattgttgagctggcacttactttggcttgatacgacttgtttttcagctatgatctacagttaatctgacaaaaaaaaaaaaaaaaaaggccccta

SEQ ID NO: 1303 - DNA, 853 bp, Sorghum bicolor
  Clone ID: SORBI-28MAY03-CLUS20070_1
gccggccgggttccgacccgttcctttccttctctcccagtcccagtcgccgcttctccgtcctcagtcttcacacgccgcccgcccgccacaaagtctgcgtagacgccgccgaggcaccggagttgccagctactgcgcacctaccaatctgccgccgatgctgcgcacccatctgccgcctgaggcttggcggcggccgctgccccaggaggcaggaggagcccgagatcaaagtccgcgcatttccttccaccgagccgcgacgagatccaggatcccaggtgggaaacttcgatgcggcggccttgaaccgcgatggctgtcctcgtcgcggagttcgtcctcagattcaaagccgtggactagaatgtgcacgaaggcagactataccactcctgttgattctgttgccacctcggagcaaacaggtggtgaaactgaagccacctcggagcaaacaggtggcaaaactgaagagccagccattgtagcacctgctaatgaatatacagtgcaggaggctgctcctcaacagaagtgtgcaaagatacacgacttttgcctagggataccttttggtggatttttattctccatgggccttattggatatctattttgggggagccctgcaagtcttacttttggtgttgcacctggccttgctatattggctctggctgtacttagccttaacgtctggaggagtggaaagtccagtttaccgttcatactggcgcaagcaggcattgccgctgcggtagcctggaagcacagccaggcatacaccactactaggaagctgcttccgtggggcttctatgttgcgctgaatgctgccatgatatgc

SEQ ID NO: 1304 - DNA, 608 bp, Sorghum bicolor
  unsure (1)..(608): unsure at all n locations
  Clone ID: SORBI-28MAY03-CLUS201_1
gggcgggccgtgggggggcgtgggacgtgtctcgacggcgaagcgtgncgccgacgacgacngaggacgaacgtgggggncgcccccgcccgtcccgctcccgccggagccgtcgtgcgacctcgggctgtggctcagccccggatcacccccggcgcctggggagcggcgggggccagccacgccgtccttgacctccgaggagtccgtgacgacgacgacgacgagcggcggcgcgcgcggagggagggagccggagctgctgaacctttttgtctgagagagagagagagagagagagattagctatagaccgacggcttggctaaaagccagcggtcgatcatgcagcatatcatgtgcccctcggcgcgcggtgcgctgtgctgttgcttgatcccggcgaaaacatttgtctagctagcctctcgccggcgaggtaccagtagtcttcttcttcctttttgggcgtgtagaaaccatgggccaccgcccaccaccggtgccggcagcagcagcccctctgcgtgccgccgtccgttaactgtttattttgtttcttcccaactttgttggcaagcacaaagcagcagcagcacccaccgctc

SEQ ID NO: 1305 - DNA, 755 bp, Sorghum bicolor
  unsure (1)..(755): unsure at all n locations
  Clone ID: SORBI-28MAY03-CLUS20109_1
gccggccgggcttgcgttcaaaaaaaaaaacaagacacaaacccccccacatattctccctgctccagccagttctcacgccgcccccgccgcgccgccgcgtgctcgccggaaccctaggatcctgcgaccgtggcgggaagcgctgccgcggccatgacagggacaacttggataattgacagccaaagatttgccacaaaaaaaaaaaaaaaaaaggcccctacagatccgtctgaccaggaattaatctggcacttactggcaaaacatggaaaatctgatataaaacctcatccgttcattgatgaatttattccaacggttgaggaagatgaaggcatctgctacactcatccgcagaaactgccaggtgtcaagcaaaatggaagtgtatcacatttcttccacagaacatttaaggcctacaacactgggactaggaagcgtcgaaagataaacactgttgatgctgatgtccgttggcacaagacaggcaagacaaagccagtattacttgatggaaaacagcttggcagtaagaaaataatggtgctttatatgagcccggcaaagggtgggaaggctgagaagactaattgggtgatgcaccagtaccacctangcattggagaggatgagagagatggtgaatatgncgnnctctaattattttttcagcaacagtttaaacctggggacaagaatgctcaagagctaaccacatcggatgatctggaatcaatagctgctga

SEQ ID NO: 1306 - DNA, 526 bp, Sorghum bicolor
  Clone ID: SORBI-28MAY03-CLUS20069_1
ctgtgcggcgctcaggcggcggctgggatcaacaaaaaaaaaaaaaaaaatacacattccaaacaaaaaactaaatgcccaaatccaccggtcccctccaagaacaactcggcctcggcactgccaaccaatccacaccaaacaacatgaccgacaacaccaccgcagcggctgacaagctcggcgcaaacaaggacaccaatgccatccctagccagaaccctagtgtgattagctcagcgggtgctattggaaagcagttcaaccccgacggcgcaattggccagattggcgagaaggtcggagggccattcagcaaggacggtgtcattggaagccagttcgatgcgagcaagaatggtatcgctggacacgtcgagagggctgtcgatggaccaagcaaccctgctggaagctcaaagtaaagtcctactttagtaaagaagtaggaacctgtattatagccaagaggcactcaatataagaagcataatcatgccaaaaaaaaaaaaaaaaaaggccccta

SEQ ID NO: 1307 - DNA, 709 bp, Sorghum bicolor
  unsure (1)..(709): unsure at all n locations
  Clone ID: SORBI-28MAY03-CLUS20143_1
gccggccgggctgcggggaactacactgggcctagcttgcctatgggttttgcaaaaaaaaaaacaaaaacaaaaaaaaaaaacgtttctctgcccccgactcgttctgtgcagacctcttgcggcctccggtctcccagactcctcggctcctcgccgctggtgaacctgcaggcggcggcttccaaactccaaagagcgccgccacccgctgcctattcgacgaaatggctgaggggccagcgcccaagaaaccgaccagtacggccggcgccgccgcgagtgacgccttcgccgccctccctgacgagatattgcagcacgtcctgtccttcctcccggcgcagccggccgtgcggacgtgtgtcctggctcggcgctggcgccgactctgggaaggcgccgcgggcctgcgcatcaccgccgccaacgcacctgagccagtgtgcaaaccggatgacctggtgtcctcggcggagcttcgggagttcgtggaccacctgctcctcctccgtggtggcgcgccgcttgatagttgcgagttcatgttcgatgtgcgcgacgacgcggacgtgccccatgtcaacctctggatccggcatgtcatccggtgtcaagtccggcggctcgagcttagtatcacccgggaggaggatcccacgggccttcatttttacgtcgacnacctgcctcttgtctccaggcacct

SEQ ID NO: 1308 - DNA, 694 bp, Sorghum bicolor
  Clone ID: SORBI-28MAY03-CLUS20152_1
gccggccgggcttcgggagctgcttttcttctccgcgagctttccccacctccacctccccctccccgtcctcccgagctgcggcggccgcatcgattgctagggcgaaaacccgctcgactctcccggcgatttccggctctcagggggagacaggtggatccgcgggaaggattcggctgcatcctcctcgtgtcgtgttgagatggctgggcgcaaggagaccgctctcgacttggcgaagttcgtcgacaagggcgtccaggtgaagctcaccggcggccgccaagttacaggaactctaaagggatatgaccagcttctcaacttagtgctagatgaagcagttgagtctgaaagagagcaagatgatccattgaagctatcagggaaaaccagacagcttggcctcattgtgtgcagaggcacggcagtcatgctggtctcaccgaccgatggaactgatgagatcgccaaccctttccttgcggacggagcataagcttgcacttggtcaattatttagaaccgtgttctcaaagcaccctcggaacaatatgtcccagtgagggaaaaaaagaactccattctcgtgtattagttgtaccggttggtgatgaacgctgtaattttcactgttgcgacttaaaacatcgaccctatggttgataaaaaaaaaaaaaaaggcccctag

SEQ ID NO: 1309 - DNA, 624 bp, Sorghum bicolor
  Clone ID: SORBI-28MAY03-CLUS2017_1
gcacgagggtgaagttacctgtgctcgacacaaaactccaaaacgagatgaattctccatgcctacttccagagtgctgttcaaagaggttgacactccttcaacatctccagctttgtggaatcgtccgcaagtagccattttggatgaaaaagccacagggtgtccttcatcgtggccgccctagaagcttcagaattgctgtccgaggaaaactcgcagagatggtacacagaagatccactgcttgatgtatctgtgttggctgaagtaggaaattcatactgcctgacagatgatgcagtgcttttgtttgactgtgtggaagaagttcttctcaagataagggacaagttctttggtaccgacccttgggttaattttctgaaacacaatgtacgaccagctccagtaggaagacagctcgttgaagaggtgactaagggaatcgattctcttgtcggtaaagaatttccaaacactttagaacaggtgatgatgaaagacttggacagtgggtcgtggctggatcttcgaggcgatactgaaagtgttggagttgagttgtgggctggtttgtttggtgacttactggaggaaggtgtttttgatttgtgggtttga

SEQ ID NO: 1310 - DNA, 668 bp, Sorghum bicolor
  unsure (1)..(668): unsure at all n locations
  Clone ID: SORBI-28MAY03-CLUS20175_1
tgcgccgctcgagcgccgcctgannagngagagtcacaaaccgatctccttcgtcgccgtcgtcttcggcggcgccgccgccgcccaattcttcggccacctccgctgcaataggcgatcgtcggcgccgccgccgcaaaaaaatgccggcctcgaagacggtgtcgacgagcgccgcggagacggatctaggcacgcacgtgtttaacgtcgtcggatacagccaccaaaaggccatctgcgctcacaaggatacttagctcctttccggccgtttctccgtcggcggccatgaatgggccttggttcttgtggctgatatctacaacgacgaccaccctgattgcgtcgcaatttcgctcctcttggacccttttgccgcgccgggggtactggcgtccttcgagctgaggttggtcaaccagagcactgggttgcccttcacggtgcacaaggaggcaccgatggtgttcgatgacaataatgacatggcagctacttgctggataaaaaggagcctgttagaatcgccaacatacctccagaatgatcgcctcacagttgaatgtattgtcactgttatcaaagaacgactggtctctaaaaccaaatcacttcccagaatcgaagtgccaccacctaacatggctgagaattttggtagtctg

SEQ ID NO: 1311 - DNA, 754 bp, Sorghum bicolor
  Clone ID: SORBI-28MAY03-CLUS19665_1
ctgtgcggcgctcgagccggccgggtgggacctcactccactcctcacacactcactcagccaaagctgtcagcagcctgcaagcaccggcagagctcttctcggtggccatggccaagcccccgattcagaccgctgcgatcctcctcctcgtcgtcgcggccgcgtcgtggctccagaccgccgacgccgcctcagggttctgctcgggcaagtgcagcgttcggtgcggcagcgtgcgggcgcggggcgcgtgcatgaggtcctgcggcctgtgctgcgaggagtgcaactgcgtgcccacggccacggcgcccgcgcgcggcggcaacgagtgcccctgctaccgagacatgctcaccgccgggcccaggaagaggcccaagtgcccctgaacactgaagatgtgtactacgggactgcgactgcctgcaactgcaatcatccactgatgaagatgaatgaagagacggatcggatcggatcgggcgtatgtatttgtacagtatgtacgtacctgctgagccaggccaggctacctgttacgtcgtccctactctactacgtatttttgtatgtatgcatatagcgtccggccgtgtgatctatatgtaatgtaatctgctaccaggtcacgtgagatcgatgtactgttgttagtctgttattagtagtgacaagcttagtgagttaatgtactgatgaatcctcagtagtagttggcagaatgcaaaaaaaaaaaaaaaaaggccct

SEQ ID NO: 1312 - DNA, 616 bp, Sorghum bicolor
  Clone ID: SORBI-28MAY03-CLUS19692_1
gctatgccctccagtgttgcactgccgagaacatggtgcttcgccagagtttgctgaaggataggcatgccggtgctcccacagccatgcaggagtctgccgaactctcggaaaccctgccgctggtttccctgctttggctagtgagcatcttgtgcctattcctggtggacgacatgcccaacagaagcctgccggctccaagaagcctcgaaagagatcttgtaaagctagccaggacatcaataaacggtgtaaagatgaccagaatgacaaacaacagtgacaatcctggggctttgggactcatccgccttggaagacgctgcagaggcacaagggcgaggatcaagtcaccttgggttccttggcatgcagtagctgcttgctaagccgccagtcatcatgcgaaaccttctgaggtgttgttaaacataacatattggcacatgggacgactgtatgcatcgttgctgtgaaagtgtgaatctttgttccgctcttttcctgataccctgttgacgtggtttaagaaaagttgtcacagtagatatttgtcaaaaaaaaaaaaaaaaaaggcccctagcagatactactatcgaaacagggattagct

SEQ ID NO: 1313 - DNA, 922 bp, Sorghum bicolor
  unsure (1)..(922): unsure at all n locations
  Clone ID: SORBI-28MAY03-CLUS2262_1
gccggccgggcctgggaaggtcccttcccctccatgtccgatgcccctcatcgccagacaaagagcttcccggtacgacgccaccgcgccacggaactaacgcgagcaccttatcggcatcatcaaagaaactgcaagcccgcccgtcgccagccaccgccatgttcggcatcgtcttcccggaccacaccttccccctcgacgccaccgctttcgcgcaggtggcgcccaattcctggctcctcgatctctccagtctcgcgctcgccaccgcgccgcgctccgcagtcgttttcctgctccccgccgccgtggcagcgctgccgcccggcaaggccgtcgccgtctacttccaggccgccaccaaccgccccttcgcattcttaggcgcgcttgggcccacgcgcccctcggctagcttcccgcttccggaggccggcgacgagccggagcctgccgtaggccccgctaagctaggcgtcgccgtgggaggacgcggncgcgttgccgccgcgtcctgacgagcagcgcgccgagcgtgtcgcgctccgtgttggcgagaacttgttcaacttcatgcaatcgttctgcggtgccgacggcggcaagctggtagtgcccacggacatcctggaccggtggttccgcaagttccaggagcgagccaagaaagatccagcatacctcaagagcttcgagttttgagaaaaagggtgatcgcaggttgttttgcagataccatgtgggaagaatgtgttggatagcagtgtttgtgccacagctaggccctcctatgctgcacacagtgtcacgccgtgtcctaggggctgactaaaccaaggtgcatatgcagcttctcctattatagacaaggacaacgacaccaaaagcaaccagatagcttagatggtgggggtttaag

SEQ ID NO: 1314 - DNA, 725 bp, Sorghum bicolor
  unsure (1)..(725): unsure at all n locations
  Clone ID: SORBI-28MAY03-CLUS20208_1
ngccggccgggttgggtcncaccgctcctaacacccaaaacccatccccattcccgtcgccgttgcggcaacggcagcgagccgtggcgccagctctccagttgccccccaacgcaacgcagccgccgcccacagcctacaggctccagctatgtgattatgtctccactgacgagtttaagagagattagtgagtagtgacagatgcactcaccatgggcaaggccggtcgcgttgagcaggcctccttccccaactctgcgccggcaaccaggtcctgccgctgccggtgtggcgcagtcgttgaaaaggtagtcaacgggaagtgcgtctctttggtgttcctggcagtcagcggattcctctcggccttcttcctcctgcttcatctccgggcatcaggagacatccctgatgatcctggcatactcgccgaaatcgaggcaggcttcattttgtcagtaccacactcacaggtagcttcacaagttggaatgctcgaaaatgagatatatacccaaataggtgtccccaatagtacggtttcagtttctatgcaaccatacatatatacagataccacttatgtgaagtttggtgttcttccagccccaagaaatacctccatgagcacacaatccatcaatgcactgagagcatctttgataaaacttacactacaccagctgaatttatctttgacaccatctgtttttggagacaca

SEQ ID NO: 1315 - DNA, 693 bp, Sorghum bicolor
  Clone ID: SORBI-28MAY03-CLUS20257_1
gccggccggtcgccggcgatcccccgccgctcgccccgcaatcaccgcaagcaatcagcacaatctacatgagtctgccttctcccctgcactcctcaggcggtggatttggccttccttcccgattcctcagcccgttaccaccatcacgaagttcttgcgactgctgccaccatcctgcttcttcgcaaaagatgtcgcgcgccacccaccatcggctccaccaacaccgccctcgccctcaccctgcagtccgtggagtagatcgacgatcatcaccatctctactggtggtggcaccgccagaaccctgcaagggatcagacgaaggcgattctatccaagaaggcgtcgagatcgccaccaaggccgagcagcatgagtgcttcatctttaaggttgtaatgaaaagttgggcctgctaggctgaagagttttcgatataagtctgcgcctttgcgatgggttcaggcaatgtgatcatgaagaaggtaataaagcacaactcttttgatcttgacattcaacttgctaagagctggatggtaaaacacgctcttttgtctctatgtgataatagtgtgtttaatgaaggtagttttgtatgtcactttaatcctgatcattcatgctgcgaagaattggatgaaaaagcacgctcttttgtctctatccgataatagtttgtttaat

SEQ ID NO: 1316 - DNA, 853 bp, Sorghum bicolor
  Clone ID: SORBI-28MAY03-CLUS2030_1
cgtccgaaaacagttcgggatgtagccttgcgctgccgatggatgaataaaaaggagagtgccaaaagaaagaaagaggatcacagctcgtctaagaaaagcaaggacaaaaaggagaaggtttcagattcttcatcaaaaccacctgtccatatggctggtaggcctagtgttcctccataccctcttccagttcttccaatggacgatgatgaaatctcatccaaagccattggaggtccaacaggcgaaatccttgaaactaatgcccaggttttgagtcaaatttcgtcaaaccttagcaacatgcagatacaggacaacatctctctgctgtgccaaactcgagataatatactcagggtcttgaaagagataaacgatgctccagagatcatgaagcagatgcccccgctacctgtgaagataaacgaggacctcgtcaactcgttgctccccagaccaactgtacctatgcagtagtgatagcaaaatgactgtatcctctgtagtcccgagagatctttagataggcagctgaaataaaaaaaagggggcagccctgggtacttgttcgttcgttctgtagctccacatctcacctcttctaccttatgtttcgtccggatgcttatgttccaacctttcccaagtcaggcggttgaaacgtgtaccgagttaccaagggctgcttctacatcagcatcaggtcctgactctgttttgtaatctatagctgtttgggtaatgtcatggtatcgtaatcagagtagtcttgtttggatgtatatatatcgacattaatccacatgtatcgggttggattaaagggaaaataattaagttttatttt

SEQ ID NO: 1317 - DNA, 854 bp, Sorghum bicolor
  unsure (1)..(854): unsure at all n locations
  Clone ID: SORBI-28MAY03-CLUS20375_1
gccggccgggccggctcaaggaggccctcctcctcgcgctctcggacggccaccagggctccacccgcctaacctctccgatcgacgtcgtcctcaagctcggtgcatacaagtctttctccgacctctcgcctgtgctccagttcgccaatttcacggccactcaggcgcttctcgacgagatcgcctcaaccacttcatcgtgtatccgcatcattgatttcgaccttggtgttggcggccagtgggcttcctttctgcaggagcttgcacaccgccgtggaactgggaatgtcaccctgccaatgttgaagctcacggccttcgtctcaagtgcttcccaccacccgcttgagctgcatcttactcgggagaacctctcacaatttgctgcggaccttggcattccatttgagttcactgccatcaatctcgatgcatttgatccagcggaactcattcctcctactgccgatgaggttgtcgctgtttgcctccctgttggttgctctgcacgcatgccaccgcttccaatgttgcttcagttagtgaaacaacttgctcctaagattgctgtggctattgaccatggcagtgaccggggtgacctcccattttcacagcacttcatgaattgcttccagtcttgtatgttccttctcgactcacttgatgctgctggcactaatgcggatgctgccagtaagatcgagaggtttctgatccaatcgagagtagaggatgcagtacttggccgccgtaaagctgaaaaggcaatggcttggcgggcagtggttacatcagcccgggnttgctccagtgccgctcagcaaccttgcagaagcaccagctga

SEQ ID NO: 1318 - DNA, 408 bp, Sorghum bicolor
  Clone ID: SORBI-28MAY03-CLUS20446_1
gccggccgggcctggcgcacctttctcagctctggcacagttgaacagcacctactgaagttgttactgctctggaaaggaagagcacaacgcagacctgcaggagagatgaaaagcagcaaagtgtagcgctatacttacacctgctgtgttgttgctcttttgcaaaactactgtctagactccgcctggtaattagtgtactgatagcgaggtataaaaattagattatttgttagcgacgcaaatcctttctccttttcttctcctcctctctctattcttatcccttttctcttcatccttgagagaacaggtggttgtaaattgtccggaacatgttttccctaatagtccatcatatcccgcttttttcgtgttgaaaaaaaaaaaaaaaaaaggccccta

SEQ ID NO: 1319 - DNA, 972 bp, Sorghum bicolor
  Clone ID: SORBI-28MAY03-CLUS20457_1
gccggccgggcctgcaggttctcgccgactccccttcttctccgaccttcgccgctcgcccgcggcggcgcctcctcccctcccactcctcgtcgtcgatctcgtctcgggtaccatggcgagattactctccaccgccctcgcgaagggacttatgagatcgtcccgcgcatggacaccagctgctgtgtcacgaccagctatccagcagtttatgaactactcatcaggtcttggcggtgctcctaatacaaatggggactcaatggcaacacgagtagctgctgatcacgatacacatcaagattttcagccaacaagtaaaagttcagacatgtctttcagtgacattgttgctcaggatgtcaaggagcaccctgtcgtcatctatatgaagggttatcctgatgctcctaggtgtggattcagtgcattagcagtgaaggtcctccagcaatatggtgtccccatcagtgctagagatattctttcagatctcaagctcaaagaaagtgttaaagcatacagtaactggcctacgtttccacaaatatttatcaaaggagagtttgttgggggctctgatatcatactcaccatgcaccagaagggtgaactgaaggaactgcttggtgatattgcacaaaaaggcgaacaaagtggttcgtcatgaaagtggtatttatggtgcaaacttctcggactggatgttctttctcagaaggtttttggtgatcttgcgttgtcatcctgtggcctcggatttgaatatgttccgtgttttcttctgttcttgccagttgtgatggaagatccactgaaggctcaactgcaggacagcaggagtaaccaaagttcttgttcttgataaataataaatgctaatgctcgacgctgttctttttatgcattaagttgtttttaaactgaatcggtgctgttgaaacatgtaattagtacgtgacatgctca

SEQ ID NO: 1320 - DNA, 370 bp, Sorghum bicolor
  Clone ID: SORBI-28MAY03-CLUS205_1
gcaaatgcgtcaggtcttactcagtcttatgtaaagaggtaggaaaatcttgtggaacatagacctgctgaaacagttgaaatactgttaaggctctgtacagatgttggagatcgtacgacgagaagaggttcgaacagtatgcacttgcttatgataccatccccaatggactttgtgaatatatttggggcacagcccacaatatctgatggaatttctggaaaattatatcaaaacagtgacggattcacctgcgcaaacagaaattcataatacccttctggagctctatatttcaaacgatttgagcttcccgtctatctctcaagaaaatgaacatgagaatcactatatcaaagaaacaaaa

SEQ ID NO: 1321 - DNA, 707 bp, Sorghum bicolor
  Clone ID: SORBI-28MAY03-CLUS20518_1
gccggccgggcttcgtccactctcgcccaccatttccgctttcccccctcccccgcctccggtcgaaaccgctccgctcggcggctccaacaagaaacacgcaaggcagggtgctccgtcgtccattcgccgacagatcgaccatcgtccatggcgaagagggcgacggtcatggtgctcgcggcggcgctcgcggtcctcctgctggcggccgtctcatcttctcatgaccagaagcagggatcggcggcggaaggcgggtgcgagggcgccaacgacgaggacgagtgcatgatgaggcgcacgctgaacgcgcacaccgactacatctacacccagcagcaccacaactgatccatcatcatccctctcctatctatatcctaggctatatatatacgacatgcgttgctccgtgctcgtcgtgttctttctctgttcccgtccgtggcgtgtgaacactgtgcatggcgcgttacctgcgtgtcaataataacagtttcgatttttctttttttgtcccatgtcacagtagtgatccatcgatcgatctatccatcctagctcgaggatttcttgcttgttgtttcatctcgaggatttcttgtttgttgtttcattctatgcatgtatgtacgcattcagaaaagttcaagtattatccaccaaacttcagaacgcaaaaaaaaaaaaaaaaaaggccccta

SEQ ID NO: 1322 - DNA, 631 bp, Sorghum bicolor
  Clone ID: SORBI-28MAY03-CLUS25277_1
tgagtgctgtaggggttactggtgcacgctcaaacgtaaacttgcgtgtagaacatcttcttagggagatcaagaaggttacagataaacctgtagctgttggttttggtgtatcgactccagagcatgtgaaacagtaaacagatcgcaggctggggagcagatggtgtgattattggcagcgcaattgtcagacagttgtttgaagctgctattcctgaagagggtctgaaaaggcttgaggagtacaccaggagtataaaggctgctatgccatgagatgatcactcgctgcacaggtcttccgcttgaacccaccagttggtgtccatggatgaggcagcgtgatggctgattggctgcactgaaaacgacatttccttgagccaattcgtcttgctctcttctggaggactttcaaggtccatcagaacgatcccaatggacccagatgttggtgttttggataacggaaagtcaattctgtcctctatttatgtcgggtccttttatagcctacccatatttatggacttatggtcaaatcagtcccggaagttaacacttctctaatccctatctatggaaacttttccgatactcatcatatcatgcatattattattggtaa

SEQ ID NO: 1323 - DNA, 637 bp, Sorghum bicolor
  Clone ID: SORBI-28MAY03-CLUS25282_1
attatggtttctgctgtcatatagatgaagaatgcgcaaaagagttagctgatgttcctggagtgttatctgttcaacctgatatgaactttggatcagacaacaaagagtacaaagtttcaggtgatgatggcttgaaatcatctgaagggactgtagcagccgatatcaaaactaaaaggctctttgttacagggctttcattttatacatctgagaaaactttgcgggcagcatttgagcctttcggtgagctcgtcgaagtgaagataattatggacaggatatcaaaaagatcaaaaggttatgccttcatagaatacactactgaggaagctggaggtgctgctctaaaagcaatgaatggacagataataaacggctggatgatagttgttgatgttgctaaaactagatcgagagaccgtctatctggtggatctaatcaagcatttcgaccacactatcaggctagatgactgtttaatgtataaaacttacagctgtagagtagagataagcacgggagcgaggaattgcttgggggatgtcgttgtctgattgtagttcagtgcccttgtctgctaattgctagagaatactcccagcacaatatgtaaatgcagctaaagtgacg

SEQ ID NO: 1324 - DNA, 834 bp, Sorghum bicolor
  Clone ID: SORBI-28MAY03-CLUS20644_1
gccggccgggccgggattcactagctactactgtagctagcaggtggctctgaaatccccttcctgctcccgcgatgccgtcggctgggctgtcgccgccgccgtggagcagtatggaggggcaggtggtgctggtgacgggcgcctcctccggcatcggccgcgacttctgcctcgacctggcgcgcgccggctgccgcgtcgtcgccgccgcccgccgcgccgaccggctccgctcgctctgcgacgagatcaacgcctccgaggctgccgcccaaggcccccgcgcggtggccgtggagctcgacgtcgccgccggtggctcggtcctggaggcagcggtgcagagggcctgggacgcctttggccgcatcgacgccttgatcaacaacgctggcatccgaggtggagtgcactctccattagattggcctgaggatgagtgggacagaatcatcaagacgaacctaaccggatcatggctcgtggccaaacatgtctgtcggcgcatgcgtgacgccaagctatatggttcagtggttaacatcacctctattgctggccttaaccgagggcatctgcctggctccactggatatgcatcctcaaaggctgctgtgcattatgccaccaagattatggctttggaattgggcgcgtatggaatcagagtgaactcaattgcgcctggacttttcaagtcagagataactgctcctctgcttcagaagaggtggttgagcaccgttacttcaaagatagtgccgctcaaggagcatggcacgactgatcctgcattgacgtccctggtccgtttcctgatccatgaagcat

SEQ ID NO: 1325 - DNA, 639 bp, Sorghum bicolor
  Clone ID: LIB5052-008-A1-XP1-A9
atactcagctctcttcctcttcttcatgatgatcaatcggtctgcagccatggctctgcttctccctctattgctcgtgctattcttggccaccagtggtcaagccaacgccgatgaaccgtcaacatcacatagcaagagctatgaaacctcgatggggccatcggcagcaaccggcggtcaccgtcaccgggagatcaagattggtccatgcttccccagcagagacagcaatgctctctccgacaaaggcaatgctccctcctgcatcaagcgatgcacgagcaaaggctacgctggtgggcgctgtgacactgagtctggcggcctccccggcgactgcttctgcgtcacgcttgatggccgtgcataggccacccagtggtatcgctgtctcggttctgcaaggtcgttggagctagcaatcatggcagaaagaataactagggtttattttggtagtttcatcactagggcagacagatccgtcttcatagaagattgtagtagtcattgtgttagcctcactagtgtgaaactgtgaatcaagttccaacgtttacctattaaatacttactagaaacccatgcgtgaatcatggtgatgcactgcaaaaaaaaaaaaaaaaaaggccccta

SEQ ID NO: 1326 - DNA, 606 bp, Sorghum bicolor
  Clone ID: LIB5052-010-A1-XP1-B5
ctgtgcggccgctcaggcggcgggttcgaaatactcagctctcttcctcttcttcctgatgatcaatcggtctgcagccatggctctgcttctccctctcttgctcgtgctattcttggccaccagtggtcaagccaacgccgatgaaccgtcaacatcacatagcaagagctatgaaacctcgatggggccatcggcagcaactggcggtcaccgtcaccgggagatcaagattggtccatgcttcccaagcagagacagcaatgctctctccgacaaaggcaatgctccctcctgcatcaagcgatgcacgagcaaaggctatgctggtgggcgctgtgacactgtgtctggcggcctccccggcgactgcttctgcgtcacgcttgatggccgtgcataggccacccagtggtatcactgtctcggttctgcaagaggttggagctagcaatcatggcaggaagaataactagggtttattttggtagtttcatcactagggggcagatagatccgtctccatagaaaaatgtagtagtcattaaggatgaaaacagaacggaaatatcccgaaccgaaccgaaccgctttctatattggatc

SEQ ID NO: 1327 - DNA, 517 bp, Sorghum bicolor
  Clone ID: SORBI-28MAY03-CLUS20664_1
gccggccgggccgggaaaaactcaccaatcaacttttgagaaaactagcacattcttcatcatcagcgaggatggcgacatttgtgaagcgcagcagcagccaaggactcctgctgcttgcattggttctcctggcattatctgtcattcctgcacccatcagaggtcagaaaactgaagaaagctggaggggcaggaaggacgacattttcaatgggtgtcactacaaccacaatgtccatgacacggatatcttctgctgtagcaaggacaaccagtgctggtcacaactgacggagtgcgtcaaaaactgcccctgcttggttggctgcagccgttgagctctgccatcactccatgcatggtcgttggttccatcgtcaaccgtgttgttggagaaacttgatggaaggatacatacaaagatgtaatcttgttaccagcaactgagaagtgaaaaactgaaaatgtaataaagaataggttttcacaaaaaaaaaaaaaaaaaaggccccta

SEQ ID NO: 1328 - DNA, 834 bp, Sorghum bicolor
  unsure (1)..(834): unsure at all n locations
  Clone ID: SORBI-28MAY03-CLUS20704_1
gccggccgggtttcggaggcaactccgccatccccacccactccccccaaaaccccactcctccgggccccggcgagcaatctccgaccagcggcgagatgcagatcttcgtgaagacactgacggggaagacggcgactttcgaggtcgagagcagcgacaccgtcgccaacatcaaggccaagatccaggacaaggaaggcatcgcgccggacaagcagcggctcatcttcgccgggaagcagctggaggacgagcgcaccctggcggactacaacatccgcaaggagtgcacgctgcacctggtgctccgcctcaacggcggcggcaagggtggctgctaccccccgaaggtcgaccccaacctcctgcagctcgcgctcaaatactgcgagtacaagatgatctgccgcgagtgctacgcgcgcaattccatcagggccaacaactgccgcaagaagaagtgcggtcactgcaacgagatgaggccaaagaagaagctggctttcaaacaggcctgaaaacactgtgggaaagcgatcaatccaagtagttcatcagttgaatcaacagtctttattaactccttattaccagtcttagcgtactttataatctatataaatcttgtttaagttcacgctggaatacttatctgaagcagcagagcagtaccattcctaagaaactactagtcaaaaatccctgcctgttgttgaaacttcattgttaattntcgatgcaagtgagcatgcgagcattaatgttatttggggtctagaattgatggtcttctaaaggaaaaaacaaataaaaaacgcccctagggccggg

SEQ ID NO: 1329 - DNA, 732 bp, Sorghum bicolor
  Clone ID: SORBI-28MAY03-CLUS20734_1
gtgccccgctcgacgtggccgatccgccacgacccaatggcctcccccaagcacgacccggctcagcagcaccacgcctcgacgccgccactcctcctcgccgtacgccacctgccgtcccccggcgtccaccggacacgcacgctccccggccccgacgtcctcacccctctcgcccgccgcctcgaggagctcgcgtccgcggcggccgcccacccgctcctgaagccgctcttcgccgcccactcccacctctcagcacgatatgtgacccgtacctgaacatcttccggggcatcatcccgccgctcgggggaacgctggacctgtcgcctatcctggctttcctcgtcctcaacgccttcaccagcacggccgccgcgcttcctgcagagctccccagctcggcagctgcacagcatcaccagaggaccgctgctccgtccagcccggcgccgctcgaggcgacgtccaaccagaggaaatggatgcggagaatgcggtcacagaagtcacagggagaaggtggtgatcactaggcttgtgagctgtggctgtgttcgtcaaatcgtcagtgccttgcccttaccagctggggctcatgcttcgcatcagacgctcgagatctgcacaacagtgtgttggacatggatgctctttgctctctagctatcgaacgcgaattcatcacgttgcctcaaatggtctttttgcagagtaatgcggaacttt

SEQ ID NO: 1330 - DNA, 740 bp, Sorghum bicolor
  Clone ID: SORBI-28MAY03-CLUS20743_1
gggccgccgccggccgattccgcaggcagctcgtcctgctccgctccctcctcccttccctgcctgccccctcctccgtcgccggctttcccccatcctgcccctcgtgctccagcttcctccgggtccggaccaaccacgcgatggcggcgtccgccgggacggtgtacgaggcggacgcggaggccgtcgtgcgccggatcacgccgccactcgaccgcgccaggcacaagggccaggcaggtcggtaccgccgcccgcccatcttggtctgctcacgcgctctgctttgtgtccgagtgtgtttcttgcggtcgggctgctgatgcgcgcagcgtgtttgatggaattccctggtgctcagtggagcgctctgggatgctgggttcagtcgacaggctattggtggttgtttcggggacggtggttcattgttctcccatgttgtaaacaacactaggggtgacactcatccgagctcgctgtacaattttaggtttggattctgttcaattcgagttctgtaggcccaagtgtcagaacccttctctggagctaaggagttcattctctctgccactgaaacaaattcaggggcattggttagtgttgaaatagaagtccttgttcggtatgtgggaatgtgacagaagttcatgatggatattaagtgtctgtttggtagagctctatctgattctgattctttatggaaactgattctctaagagaagtaatct

SEQ ID NO: 1331 - DNA, 958 bp, Sorghum bicolor
  unsure (1)..(958): unsure at all n locations
  Clone ID: SORBI-28MAY03-CLUS20747_1
ggccgggccgggatttcctccatactataccccaattcgtctttattaccaacctttcccccaaacaaccccacacaacaccgcaatcatgcctcgtcaattcttcgtcggcggtaacttcaagatgaacggcacaattgagtcgatcaaggacatcgtccacaagctcaacgacgccaaggtcgaccccaacaccgaggtcgtcatctcccctcccgccctctacctcctcctcacccgcgagcacgcccgcgagggcatcgaggtcgccgcccagaacgtcttcgacaagcccaacggcgccttcaccggcgagatctccgtctcccagctcaaggactccaacatcacctggtccctgctcggccacagcgagcgccgcgtcatcctccaggagagcgacgctttcatcgccagcaagaccaagactgccctcgacggcggcatcaacgtcatcctctgcatcggcgagaccctcgagcagcgcgaggccaacaagaccatggaggtcgtcatcaaccagctcgaggccgtcaagaagactgtctccgactggagcaagatcgtcattgcctacgagcccgtctgggccattggcaccggcaaggtcgccaccaccgagcaggcgcaggaggttcacaagggcatccgcgagtggctcggcaaggagctcggccagaaggtcgctgacgagacccgcatcatctacggtggctctgtctctgagaagaactgccgcgagctcgccaaggaggccgacattgacggtttcctcgttggcggtgctagcttgaagcctgctttcgttgacatcatcaacgctaagcagtaagttgaacgatttacatgacatgagttcttacgcttcttgttacgatgatctgagaaaattanaaagcgtggtgggattgctgggtatatagagtaacattgacggcttttccttccatacaccacg

SEQ ID NO: 1332 - DNA, 729 bp, Sorghum bicolor
  Clone ID: SORBI-28MAY03-CLUS20184_1
gccggccgggcttggggaacgacccgacgaggagattgcttggtgggaggagttggtgaggagaggtcgcggccatggagaaccttgctctgctttgggggatcatcggcccgggcgtgtccggcgccatcttcggggcgggatggtggttctgggtggacgcggtcgtttgcagcgccgtccaggtctccttcctccactaccttccagggatcttcgcttcgctggcggcgctcatgttcaattgcgtgaacaaggatgagatcggatacgactattactcgccctacggtgacgattccgagtggagagtgaagctctggcttttcgtggcatatgtcgtttcttttgtctgcctagctggatctgtgggtttactggtgcaagacgcactgaccaacaagggcccttctgtctggactggtgttgctggcgttctgcaatgtgttctcgtgttgataagcggactggtgtattggacatgccattcagaagattaaagggcttaatgtcatgcgcaggcttgcaaagttggtcacaatcgcgtgaagaaaattatttctggtagcatatgattttgtgtgatggaaatggcgtgcactgttcactgctgaatgggatgactagacgttccatctgtgtatatctgacttttggaaaatgattaaatgatgcttcttaacaccaaagaaagttttaaaaaataaaaaaaaaaaaaaaagggcccta

SEQ ID NO: 1333 - DNA, 888 bp, Sorghum bicolor
  unsure (1)..(888): unsure at all n locations
  Clone ID: SORBI-28MAY03-CLUS20187_1
ggccctcaagaagattgcttctgtggcatgtaagtgtgtcagaatgcgggggaaagaccggccttccatggataaggtgacaactgctctagagcatgcccttgcactgctgatgggcagtccctgcattgagcagcccattctgccgactgaggttgttcttggaagcagccgaatgcacaaggtatcacagatgtcctctaaccactcttgctcagagaacgagcttgctgacggtgaggaccagcggattgagtacaggccggcctcctggataacttttcctagcgtgacctcatcacagaggaggaaatcatctgcatctgaagctgacattgttggccgaaggaccacagatggtaggaacgtcgggagcagcataggtgatggcctgcggtcactggaggaagaaatcgctccggcttcgccacaagagaacctgtacttgcagcacaacttctgaagaaatttctggagatgcagaaaccagagcagtgactttctgccaatgctgagcagcattttaagttcggacttcatgccctgttgctaaatccaaatgcattacagtgtttatacgtcctatatagtagcaggccgtctaaaaacagagagctaattagtactggaagaatttttttagcatccagaagcattcctttgtagattcatatggtccctttcttttcctgtcatgatctatcttctgatggttgcagttgatggattatcttgtatccttagcttgcaaaactgtgtagtttccttgatccttcagatcatccctttggttcgcgatgctgcttctgcatgttaaatggcagtagctttgggaactannnnannnnnnnnnnnnnnnnngaanannaanaaaaaaaaaggccccta

SEQ ID NO: 1334 - DNA, 643 bp, Sorghum bicolor
  unsure (1)..(643): unsure at all n locations
  Clone ID: SORBI-28MAY03-CLUS20190_1
tcgacggagcacccctacacgtactacgaggacgccgggcggcccaggttctgcctgtgcccgctggggtgggcgccgtggagccccaggctggtggaggcggtggtgttcgggtgcatccccgtcatcatcgccgacgacatcgtgctgccgttcgccgacgccatcccctgggaggacatcagcgtgttcgtggcggagcgggacgtgccgaggctcgactccatcctcacctccatcccgctcgccgacatcctgcggaggcagcgcctgctggccagggaatccgtcaagcaggcgctgctgttccaccagccggcaaggccaggggacgccttccaccaggtgctcaatgggctggcgcgcaagctgccgcacggcgacggcgtgttcctgcagcccggggagaaggtgctcgactgggacgccggactcgacagcgacctcaagccctggtagtactagtactagtgtaccacttgttgtgcaatctgttcatcatgtccgtttcttctctttgatttgacatcggtggatggatgggtgtnnaaaaaaaaaaaaaaaaaaaaaaaaaaaaaaaaatttaaaaaaaaaaaaaaaaagggccctaagggcccgggcggtccaaaacttatggaacccc

SEQ ID NO: 1335 - DNA, 583 bp, Sorghum bicolor
  Clone ID: SORBI-28MAY03-CLUS20846_1
tccccaaactggcatttgagctgcaggaagcagaagccagtgaaggcgtggaggcttcttctccagctgagtgctccatatgcctggagaggtgcgctgactcaggcgacgggctcatccaattacgctgcaggcacattttccactcggcctgcctggaccggtggctgcggtcccacgccgactgcccctactgccgggccgccggccgagtttgctcctgacagcatgaggatgagactgaatgacagaatgagaatgacaaaggtgtccaaggctgcaaactacggtttactgaacctcctcctgtctgaggcttgagcttaacccctgtcgccgctctcaccccttgttgtaactactagtatatatggttttcccttaccttacccgttgaggtagtagcagtactgaactctgcggcttccgcaatttagtatggtatggtatatgtgtgcatctaatctatgctcactggctgctgtaatgtaagtggatattttgcaactgtggataccatcagagaaaagcaataagctgggctaatgttacgctgtaaaaaaaaaaaaaaaaaaggccccta

SEQ ID NO: 1336 - DNA, 603 bp, Sorghum bicolor
  unsure (1)..(603): unsure at all n locations
  Clone ID: SORBI-28MAY03-CLUS20878_1
cggagcctcacaaccaactctgacggagcgccgggggttgtttccggcgagatggatcccacaggagcgtggcagccggcgagcgttcacacaggatgcctcgaagtcgcttgctagctaggccaaggccggccgagcatctcgctcggtgatgatggaaaaggccatccactgcctccccacaaccttcaaggccatcgatcgaatccatgtgcaagaagacatcagtggccttccatggtgaggcagcatggcgcaccaccagcaagagccggcacaactgcgagcttttttttatttggtccgattttggcctggtggcatcgattttaggtctcgatctattgtttgattctatttggtattcatcttgcctttctcgtttaggtctcaaacaatatatcgatttgttctatgtgacttctgcttcactccacatcgccgagactcctgatctatctccacaccatcgaatagtgtttattttgggggcttcgatttgatttcgaaaaaaaaaaaaaaaaaaggcccctaacctaaggcanggattggcgacggagaggcttggtgcgcancggaacggtgaaatgtgtgtgtgtgtgn

SEQ ID NO: 1337 - DNA, 758 bp, Sorghum bicolor
  Clone ID: SORBI-28MAY03-CLUS20931_1
gccggccgggtcggggttgggttttccgggtgtgtagccaaccaaatcaacacttggtcaaccagctccgctaaaatgtcgaccgaggcgcagaccaagaagttccagaagggcgagagggttatcccctctgcgaccgacaaggccctgaagtactacccggccgaggatgagcaggtcatgaagaaggcccgcaagacccagcacccctacaagccccgtgcttccctccggcccggtgccgtcctcatccttctcgctggccgcttccgtggcaagcgcgtcgttctcctcaagaccctcgaccagggtgtcctcctggtcaccggtcccttcaaggtcaacggtgtccctctccgtcgcgtcaacgcccgctacgtgatcgccacccgcaccaccgtccccatcaacggcctcgacagcaagaccctcgagaaggtctccgacgccaactacttcgcccgcgacaagaaggccgacaagaagggctctgaggaggctttcttccagcagggcgagaagccccagaagaaggaggttgccgccagccgcgccgaggaccagaaggccgtcgacaaggccatccttgagtccatcaagaaggagcactacctccagagctaccttgcctccaacttctccctgaggaagggtgacaggccccacgagatggtcttctaggttatgagcatggaaagcgagtgagtcaagagcgggaccggctgccagggcgttatcattgcgtattagaactctat

SEQ ID NO: 1338 - DNA, 677 bp, Sorghum bicolor
  Clone ID: SORBI-28MAY03-CLUS20970_1
tattcgaactatagaaggccggccgtgccgggacatccccatttccccgctctgcacctgcactcccagcaagtagccgctcatcacacactgctccttccattccgtcctctccatctccggccaccagaaacgtcgacgacgatgagtggcttccacaggcggcgcacagccgcagccgctgcgctcctcgtcctcttcgtcatggccgccgccacctgcttggtggcggccgctcgccccatcgacaacgacgacgacgggtcctcgcgaagcatgcagcagcgggcgccggcgacgaggctgttcgactacctgccacggccccgggtgatcccgcgttccggcccgtcggaggggcacaactccatcggccaggatgagcaggaggaggccggagagaaagcggatggtcgtcgtccatgagcctgcacgggcacggcacccttgatgagagtgagacatacctgcagctggtcgtcgtcaagatcgagcgagtacgccatatatatgatttgctagctatactactggcaccacgtatagtggtctgcatgtcagtactcagtaccaggcacatatatataaactaaatgattctctgcgaaaaaaaaaaaaaaaaactcctcccttcgtttcttaattatacactatatatatatatccctgatgatctg

SEQ ID NO: 1339 - DNA, 743 bp, Sorghum bicolor
  Clone ID: SORBI-28MAY03-CLUS20972_1
gcacgaggaatagagagccggccattcccagaactccttccattccatctctcaaagtctccacaccacaccatcttcctccccatcgcgtagcatcaagaaccggagggaggagatcggaggtacgtacgccgccatcgccagcgttcatcagttcctatgggtcctcagcaagaccgatcgtcgtccatggcgaacggcacggcggcggcgaggagcaaggaggcgaaggtggtgcactaccgggagtgccagcgcaaccacgcggcgtccatcggcgggcacgccgtggacgggtgccgggagttcatggcgtcgggcgcggagggcacggcggcggcgatggcgtgcgcggcctgcgggtgccaccgcagcttccacaggcgcgaggtggaggccggcggcgacgacgaccgcgactgctcctccacctccacctccaccacctccggttgatgagccgtcggcagcagctagcagatgggcattgaaatatggtttggtaggtgcattatattcagccgtatatatatggacaaatatttctttttaatttcttcctttttcctttcagatccccctctcgttcttgtataatattcagtgaaagttatgtgtgatgtaacatatgtgttgatcgatggtatatgatgcttgtaactgatgtgcctgtacatggtttcccctgttatttacttatatagaaacagacatcttaaaaaaaaaaaaaaaaaaggccccta

SEQ ID NO: 1340 - DNA, 721 bp, Sorghum bicolor
  Clone ID: SORBI-28MAY03-CLUS21105_1
cattgcgaaatttgctgaaagctttgaaatggttccaagaaccctggcagaaaatgctggacttagtgcaatggagataatatcctctctttatgccgagcatgctagtggcaatgtgaaagttggcattgacctggaggaaggtgcctgcaaggacatctcgaccttaaaaatatgggacctctatgtcacaaagttttttgccctaaaatactctgccgatgctgcgtgcaccgtgctaagggttgaccagatcatcatggccaagccggcaggaggtccaagaagagatgcccagcctggtggcgggatgggtgcggagctcgattgggcctgattgttttctttgtatcacgtatgcgaggtttcagagcagagaacatcatatcttatctaggctttggttctgtagaagattttgggtgcctggtgttcacgtttggaagggttgcacagtcgtgctgatatatcccatgggtgttgcatgtttttttcctggaatattgcagtgccaatgtatcaaatgatccattccagggttcgttcctttagttaatcacaccggctgagctcatgtaagagtgctactttagttttagcttaaagggcgaaagttgtcttgatggataaaaaaaaaaaaaaaaaaaaaaaaaaaaaaaaaaaaaaaaaaaaaaaaaaaaaaaaaaaaaaaaaagaaaaaaaaaaaaaaaaaaggccccta

SEQ ID NO: 1341 - DNA, 747 bp, Sorghum bicolor
  Clone ID: SORBI-28MAY03-CLUS21139_1
gccggccgggttccgggagtcccggcagcacgtcgcctcgcctcgccacaccacctccacgtctctgtccctcccgcgtccgtcttcccaaccaacccacccgatctttttccagccaaaccaacgcacgcacaccctcccaagtcccaacggcagcagagcggcggcggcggcggcaaatggccatcgaggcggacgcggcggcggtgacagcggcgagggcggtttcggagacggcgcccatgtccccggccgccgagacggcggcatcagcggcggcggcgcgcccgcgcgggtggctgaggaagctcatcccgagagactaccacctgccccggagcagccggcgctggaggctggccgccccgtccgccgccggcgcgtccaggctcgcctcgtcgctgtctcgctccctcaggtggaagggcctcccggggctctcctccctctccctccgcagcggctccgcggccgccgtcgtcgacgccgtcgcgttccgcgtcatgtacgtcgtcgaggccgtcgtgctcggcctcgcgctctcctgcttcttcctctgctgcggctgccacctctaattaagctgccgcttttcttccccccttcacttcaccaccactgctcggctgttggcgtgtaacaaatgaaatgaccatcgttttggttcttccttcgatcgtcttcctgtaaatttcctaccttttgctattggtaaaaaagaaaaagaatatgaaaatttgcgatgcc

SEQ ID NO: 1342 - DNA, 230 bp, Sorghum bicolor
  Clone ID: SORBI-28MAY03-CLUS20605_1
tcacctatgtatactgtggccggccggtatgcttcatattgtaacattaaggaaagcacctccaggcctgagtgttactgctaacgcgtttggttttctaattgtccttgtagtatgcatacacattcggaactagacacatgcttcatgcagccattttgtgaggttatgtgtgctcgaaccggtgatcactgtcccgttcacaaaaaaaaaaaaaaaaaaggccccta

SEQ ID NO: 1343 - DNA, 813 bp, Sorghum bicolor
  Clone ID: SORBI-28MAY03-CLUS20637_1
gccggccgggctgcggaccaccagtccaccgccgcccgaataccccagccaaccggcggcggcggagatgtcgctgtcctcggtgaagatcggcgaggaggtgtggctcacatgcctctcccacgccctcaccaccgagaccgaggaggtcatgggcctcctcctcggcgacatcgagctttccagcaagggcgccacggccctgatatggggggcgtcgccgcagatgaggtgcgagcggaagaaggaccgcgtcgaggtcaaccccgagcttctcgccgccgcatccgcgcaagccgagaaaatgacggccaccatcaagaggactacgagggtgatcgggtggtaccactcgcacccacatatcaccgttctgccgtcccatgtagatgttcgtacccaagcaatgtttcagttgctggatacaggctttgtgggcctgatattttcttgttttagtgaagatgctcaaaaggttggaaaaatccaagtgactgcctttcagtcagagggtggacaacagcatgcccttcctcttgccatcgctccagtcattgaccttgattcatcctgtagctcatcagataatgcgtttgcttcacattctgcatcggttgaaggcatggaacaggacacaggggattccagggcctcaaagaataacaaggcctggagaagatctatggatttctactctcatcctgacaccagtcattccacaagttatcaacccagagaaaatgctctcattctgtacaatcctgataacacacaagaagcgtctgttgatccatatgattcagatatgactcc

SEQ ID NO: 1344 - DNA, 854 bp, Sorghum bicolor
  Clone ID: LIB5052-007-A1-XP1-D1
gccggccgggtcgggaaaacctctgcacacacttcctcttctccttcccccatacgcctcacatcaaccgacatcatgggtttcaccgatttcgtttccgagactggcctccacgtccttaactcttgggtctctacccgctcttacatccttggcaatgccccctcccaggccgatgtgaaggccttccagcagatcaaggagacccctgctgttgagaagtaccccttcgcctaccgctggtacaagcacatcgcctccttcgagtctgagttctccaagctccccggcgacgcctccaaggagttcaccgcctacggccccggctctgaggagctcaccctcaaccccgccaaggctcccgagaaggaggaggaggatgacgatgaggtcgacctcttcggctccgacgacgaggaggacgaggagaacgagaagctcaaggctgctcgtgtcgaggagtacaagaagaagaaggagggcaaggccaagcctgccgccaagtccattgtcacccttgacgttaagccctgggatgacgagacccccatgaaggagctcgaggaggctgtccgtggcatcgagcaggacggtctcgtttggggtggctccaagctcgttgccgtcggtttcggcatcaagaagctccagatcaacctggtcattgaggacgacaaggtctccctcgacgagctccaggagaagatcgagggcttcgaggactacgtccagagctccgacgtcgctgccatgcagaagctttaagcgtgtcaagccccacagccagggttggcgcgtgaaatgaagaagatgcgagagcattcttttgttgtgacgactatatacacaccttt

SEQ ID NO: 1345 - DNA, 800 bp, Sorghum bicolor
  unsure (1)..(800): unsure at all n locations
  Clone ID: LIB5050-005-R1-XP1-F1
ccgggacttcntcccacacacctctcatatacnccgggacaacacacattcacaatgggcttcaccgacttcgtttccgagactggcctgcacgtccttaacagttgggtctctacccgctcatacatcatcggcaatggcccctcccaggccgatgtgaaggccttccagcagatcaaggagtgccctcctgttgagaagtaccccttcgcctaccgctggtacaagcacatcgcctcctacgagtccgagttcggcaagctccccggcgacccctccaaggaggccaccgcctacggccccggctctgaggagctcgccgtcaaccccgccaaggcccccgagaaggctgaggaggaggatgacgatgaggtcgacctcttcggctctgacgacgaggaggacgaggagaacgagaagctcaaggctgcccgtgttgaggagtacaagaagaagaaggagggcaaggtgaagcccgccgccaagtccatcgtcacccttgacgtcaagccctgggacgatgagacccccatgaaggagctcgaggaggccgtccgcggcatcgagcaggacggtctcgtctggggtggctccaagctcgtcgccgtcggcttcggcatcaagaagctccagatcaacttggtcatcgaggacgacaaggtctccctcgacgagctccaggagaagatcgagggcttcgaggactacgtccagagctccgacgtcgctgccatgcagaagctttaagcgcgtcgtatacacaatacccaacagcctgggccatacgagcgtaacgcatt

SEQ ID NO: 1346 - DNA, 630 bp, Sorghum bicolor
  Clone ID: SORBI-28MAY03-CLUS21373_1
tcccaatacagagaattacaaagccgggatgctgtacctcaacgcgcccctcggcgtcggccaccttgaggtgccactcgccggcgccggacccgaacgcctcgccgttgccgctccactcctcccacttggccacgtcgtcctcgtcgacgccgtggtactccatcccgagcacgcggcggcggaagcggacgcagtccatgacgccgaagcggcgcgcgtaggcgtccaggtaggccatgacctggcggtggccggggaacacgtcggtgacggtgtccggccaggggaagtcggagtactggtacatcggccgcggcgtctgcagcgccgtgctgtccggcacgcgcgcccacacgccgcccacgacggcgccggactcgaagacgaccggcaccgggctgttgaagccgcgctccagcaggtgcttgcacgccgccaggccgctcacgccggcgcccacgatggccacccgcttcgaattcgtctccatgatgatgatgacgacgcctcctctcacaatcacaagcgatgtctggagtgtagctagctagtgtactgtgtactgtgtaccatgatgcaatcatgcaatgcgatgcatgcgcgttcaggttgcgtttgacactatct

SEQ ID NO: 1347 - DNA, 844 bp, Sorghum bicolor
  Clone ID: SORBI-28MAY03-CLUS21378_1
ccgggacccatatcattgagagcaattagaaacttgccaagtgaaacgcactagcaacatcttagaaacaatggctgccaagatatttgccctccttgcactccttgctctcacggtgagtgctacaagtgcattcatcattccgcaatgctcaccagttactgctgctgggtatgaacacccagttgtgcaggcctatcggctacaacaggtgctcgcggcgagcatcttacaacaaccaattgtccaattacaacagcaaccttcggctcacctactagtacagaccattgtagcgcaactacaacaacaacagttcctaccagcgcttagtcaactagctattccaaaccctgccgcctacttgcagctgcaacagctacttcctacaaacccactggctgcggtgaatgccattgcatacctacaacaacaacaacagttacaacagtccgtggtgaaccctatcgcctacttccaacagcaacagctacttccattcaaccaactagctgtgtcgaacgccgctgcatacctgcaacagccacagtcacttccatttgctcagtcggctgttgcaaccgctgccacctaccaccagcaacaacagctgctacaggttaacccattggcactggctaacccattggcggctgccttcctacagcaacaacaattgctgccattcaaccagatgtctttcatgaacccttccttgttgtggcagcaacccatcattggaggtgccatcttctagaatacagaagagttgtacttgataataatgttcttgtatcaacgtgtgcaacttcccaaaaataatcaatacattgattgaggtctg

SEQ ID NO: 1348 - DNA, 434 bp, Sorghum bicolor
  Clone ID: SORBI-28MAY03-CLUS2138_1
cgtccggtgaagatgactacatatttgagacttctccttcagagcagaatttaagatggaactatgcaccagaattgctgggtgaacctagtctttctgactcaaatgagacacctaagcgactgcctatagtcatcagtgcaaaacgaaccggcaacatagctcgctttataaaccacagttgctcacctaatgtgttttggcaaccagttttgtatgatcatggtgatgagggatatccacatattgcattctttgcaattaagcatattcctccaatgacagagcttacctatgattatggtcagaaccatcatcctaatattcaaatgggaacacattctagttttgggaaggctaaaagttgcttattgtgggcccccaagtgtagagggtcctttggcttataaccaggcctattagggaggtattgg

SEQ ID NO: 1349 - DNA, 470 bp, Sorghum bicolor
  Clone ID: SORBI-28MAY03-CLUS21389_1
ccggggacgtcaatccacaactcaaaagtcgcaaggcgagcaatttgcaaggcgatgagcttgaggtacatgagccgtgtgggcgcgcgggcggcgcaggcggtgcgggagagcacggggaggtcggtcaaggacaaggcgcagtcgtcggcgtcggcgtcgatggcgaggagcggcggcggcagcaggccggcgccggccgccgggtcgtcggtggagtcgggaagggcgagcgccgcggcggtggccaggaggaaggcggaggaggagaagcggcgccgcgccgagcaggcgctgcgcaccgtcatgttcctctccatctgggggcccaacacctagtactagtaggagcatcttgtgtagcgtgtgttgtgttgtgcgcgtttgttttgtttgaggttggaaacaagatgtaaatttgttacaatgatctaatagatgaagacatccatacgctgattcttggaagt

SEQ ID NO: 1350 - DNA, 633 bp, Sorghum bicolor
  unsure (1)..(633): unsure at all n locations
  Clone ID: SORBI-28MAY03-CLUS21450_1
nnnnnnnnnnnnnnnnnnnnnnnnnnnnccattgcggcgctcgaggcggccgggggcgtcatatcgaccggccggaaacaccagcgccaaccaaaccaagcagcagcagcagcagctcatcatcatcagctccggcgcctagctcgaccggtgggcacgggggcgtacgtgcgtggcaagaacccgatcgagcaggccagcgaggagcgagatgggcagctgcttctcttcttcttcttcttcggggtcggcgggcgacgacgctgccggaggctacggcgacgagaggagggtgaggagggtgtggcccagcgacgacgacggcggcgagtgggacgtcgacaacagggccgccatctacatcgccaagttccaccgccaccagtccggcgtcgtctgctccgactgcgccgccgaccagcagcagcagacgccggcggccgccactgccgctcagtgacgagacgacttggctgcttatgcatgcatggaatataatcaatccgagatgaagagttcagtagtgatgtcttgtttttggtggatccaaatccgatctaatcggttatatgccctgtgcctgccatcgcttccacacttcttaaatttctgtctactactaaatttcttcct

SEQ ID NO: 1351 - DNA, 586 bp, Sorghum bicolor
  Clone ID: SORBI-28MAY03-CLUS21484_1
atcgtaagctaaggaaggatcatgtacagaagttcattgattgccaggtcaaggatgtggcagagtttgaagctgagcgggatgaactgatcaaagtccacgaggagaagaagatgaagctcaagaaagagtacatggagaaggagctggagctggagaaggagctcgacgcagccctgacggtcctgatggagaagcacaagccagatagctttgaggcctaaaacattgtgtccctgtggtggcagcttgcgtgatacggagacgtgaccagcatcgcgttatattgtcgctgtagtagtatctttcagtcgtagtgtgtgtggttcgagcatctgaagttctgaacacagtgtttgcctgtgatggcatatggatcaaactacaactggagtgttatgtcatcctctatgggcgtgcgactgtcgaagtgcctaattcagctattaggattgacctgcatgcgtaaatggttgtttctatgtttttttgcgcatcgagggtttttttttttgctgctttatatgcattcctatttttttgcgcaccactaacctccatcccgaacatacaaatatacaacggt

SEQ ID NO: 1352 - DNA, 529 bp, Sorghum bicolor
  unsure (1)..(529): unsure at all n locations
  Clone ID: SORBI-28MAY03-CLUS215_1
cccgtccggcctgcagnaataacccggccaagcggctcacggccgcgcagctgctgcagcaccccttcgtcgccggcccgcagccgcagccactcgcaactcctcccccgtcatgaccaccgtttcggattggatctcgtcgcagttcggctttggctgcaggcagtgtggactccaatccggcattcccatgtctgtcaggtgtatccttggatggacggaacacctagctgatgtgtgaaggggatttggctggccaatttcggcttctgtccatcgtcatcgtgctcatccatccatggttgttgctgctgctgctgcagttaaggtcccccttgatgttcttgaaaccaattttgagtgttgtgtccatcaccaattcatcaccacgatcgtcctcaaccagctcctcgctgcaattaaggttctttctccttcctgttgtttgatgttctttacttccagctgtgatagcataacgagagagaaaaaaaaagtgtgtacaaatgattttgtaaaagatcatatc

SEQ ID NO: 1353 - DNA, 764 bp, Sorghum bicolor
  Clone ID: SORBI-28MAY03-CLUS20766_1
gccggccgggctgggaatttccattcaatcgaccagatctctcccagagccaatcaacacactctcaatcgtaccactcgagtcaatatgtccggaagcatccccacgtccacgtcggtcagcgagtcagctgtcatcgacgcgtctttcagcgatgtctggcacctgatcaagctccaggacttcagcaagttctggtccaagctcgacaagagcgaattcgtcaagggaacctcagacgagacggacatcgtcaagtggaccttcaaggacggcgccgagctcgaggtcaagcaagaggagcactcttcaatcgaccacttcatcacatactcggtcattacctccaagcctgagctctcttactcttccgtcgtcaactatccgcgtataccccgtcacttccggcacccacgagaacaagacgttcatcacatggtctggcaacttcagcagtgatgccgatgctagcgtgatccaggatgccaagttcaagcgccgcgaagcccttgccgatcttgccaaagttgtctccaagaaataggtttcgggcaatggaggcctgactttttcagaggttgagaaattcatgcagtaaaagacatgttatggtggctcgcattgtgcgattggttcgcaatgacgatgatgatgatgatgatctgagaatcatgcaggcaatggacccgagttctgtagtttagcatagcaataccgatcaagatacaacgttcccaaaaaaaaaataaaaaaagcccctaggg

SEQ ID NO: 1354 - DNA, 819 bp, Sorghum bicolor
  Clone ID: SORBI-28MAY03-CLUS20794_1
gccggccgggtcggggagaaagaatcggtgcgtcggaaggaagagaatcccgcggtggcggagcgagtacccagtccctacggcgagggatgtggtgggagtgggaaggcggcggtggggaagcgccgcgggaggagacccccgtcgacttcgacttcatctccctcctttccaagcccaaggattactacaagatactggaagtagactacaatgcgtcagaggagacgatcaggtccagctatatccgccttgcactgaaatggcaccctgataagaagcagggcgaagaaagttcaacctccaaatttcaggaaattaacgaggcataccaagttctgagtaatcctgcaaaaaggcaagagtatgacaagaaaggcattctatatgttcaagatcagaatgtagtggactacctgaaccggcacaaggggctaatacttacctgcaatggtcttggcataaggtactcagtatggtgaacatgctcaggggtccacagtttgcacccatctgcagtcttggagaatctaattgtaaaatagcattgatctgaaaatgatatagtgcagcagtgccacgtttgaaagccaaagatttggcaatgatatagtgcagcagtgccacgtttgaaagccgaaaaaaaaaaaaaaaaaagtcaccttacaacagagttgatttttatttgtcgatcagctgttgttgaatgaaagaagcagatatgttccggctgctccttgtatgtaacgtacttttcctaacctatgccatgtaagcgtctgtttctgtcttggcgctttatgttgacgttaaaaagaa

SEQ ID NO: 1355 - DNA, 550 bp, Sorghum bicolor
  Clone ID: SORBI-28MAY03-CLUS2082_1
cgtccgcacgtacttacctcatcctctgtgcgtccgtatctctctccttcgcatccgcctgtaaagacgaggcagtcaagcaagggagtttgaccaagagccaagatcgtgtccgtcggctgccatccatggcgggggaggccaagaagctcttcgccgcgtccgaggtcgcgctccacgcctccaggaaggactgctgggtcatcatcggcggcaaggtgtatgatgtgaccaagttcttggaggaccaccctgggggagaggatgtgctcctccatgcatcagcctctggggatgccacggaagcatttgaagaggtgggacacagcacttcagctgtcagcatgatggacagctatttgatcggaagcatcaagggctatgttcgtccggctgcatcaaaggctacagatccttggagcactgatgtgccaccaaattccaggacaatgcaagggaacaaaggccctcctaatccaaataccttcctggactttctactcccattgtttgtgcttggcctggcatttgcagcttggtattacctaac

SEQ ID NO: 1356 - DNA, 412 bp, Sorghum bicolor
  Clone ID: SORBI-28MAY03-CLUS21590_1
ccggggtctggggcttttccacgagcgccccccagcccttctagctttcctccctaggcaactagacgccgctctcccgcagccgctccgccggccaagtctcatctcccgccccagctgagacgatggggtcgtcgtcctcgccggcgccgccgccgcccatgatcgggcgggccgggaacctcaccgtcttcatcacgccgccgtctcccgctagcactccgcggggcgcctcgcgcacgcccccgcccgagtccccgcgctcggatgtctccacacccaccccacagagggcagccccatcgctctccgcttctgcctcgccgcgtaaccacgagagcccggtcgcggcgcctgcggtggtgttcaccccgcccccgccgccggctcctgtgaaggtcgcgccgccgcc

SEQ ID NO: 1357 - DNA, 455 bp, Sorghum bicolor
  unsure (1)..(455): unsure at all n locations
  Clone ID: SORBI-28MAY03-CLUS21640_1
ccgggaaatcaaatccaccgccccccaccttcattgattgattgattacagcccgtgaatccttctttctcccgtcgaatcggagcttaagcagcagcagcagcagcgtcagcagcaatgacggccgtgctgaggagagccgtggcgcagcgcttcgcgtcgtcgtcgtcgccggcgacgttcgggctccggcggttcctgcaggagcagccggcgttccgccccgccttgtcgcccgaccgcggcttcatgcccctggcggccgaccggatccgggacctcggggtcgtcggcgtcgcgttcccgcggatcaacctcgacggcctcgtcccgcccgcggctccggcgacggcgccggccaggcgggagccgacggacgcggccgcgctgcccgcggccgcgagcctcacggggnaggaggcgcgcaaggtgctgcgcgccacgcagatggaggc

SEQ ID NO: 1358 - DNA, 868 bp, Sorghum bicolor
  Clone ID: SORBI-28MAY03-CLUS21600_1
ccggggtcttctccacctcaccgctaaccggcgcccggcggtaagccactcccgcgaggccgcgagctcgcatctgcctcgttcccacttccatcccacccgctggtccgtaccacggtaccacacacaagccgccgcgccagccatggacgccgtgctaccttccctcctcatcggcggcggactctccgtgtccgtctccattcccaccgccaccaaagccggcagccaatccatttcagtcccccacctctcgacctccgccctccgttcaacccctcgccgtcggggccgacggcgtttgaccctcctcgcctcatcttcgcagttgcctcccacgccactttccgccgcttcgactgagagccagtcgcgttcctccaggtgggtggttgtgatggatacgccctctgccgccgcgggaggcagcagggtgtcccgcgcagacgccgtggattactacgcagccacactggcccaggtcgtgggaagtgagaaggaggcgcagatgcgcatatatgaggcttcgtgggatggggcctacgagttccgctgcgagatcgacgaagatgcatcgaaggagcttgcaagtatgacctccattctatctgttaagccctatatgaaaaactgatcagagtagggtaatcacattttgagtctttcgacatctaaccttgtaataattagtgatagtgcatctacatcttcaagtgggaaaaatgagttttggcttgtccgaatggagaagcccggagttgaagtcgtgacgaaggcccaaatggtggatcactatacccaaatccttatgaaagtgttggggaacgaacaggatgcccaagttagcatatatcacatttcatgggag

SEQ ID NO: 1359 - DNA, 650 bp, Sorghum bicolor
  unsure (1)..(650): unsure at all n locations
  Clone ID: SORBI-28MAY03-CLUS217_1
aaagctaaatatgatgccagtaaaatgattgacacacatggccttcaaccttttagtacaaattttcctgtgtgtggtcaaatttacacaattcctgngaacattccatgacttttaggattttttttacacacgtcttcctaaatcactattattttcatagagaagtgttttagaaaattagtttccatacgagtctacttgctgctctgtacacacaaccatttaacttgctgctccaaatgtgctatccaaacatagcaaccaatattttttacaattaattttgcctacaatgaaaaatagtatgtgctgctttcggtaagcgccgatcatagtactcagatgatgcctagccatatcaaaccaaatttggacattctctcctttcatgttagtttctaacatatacttgcttactggactttgcatgttttcctttgatgaataagcagctgctgctgatacatataacaatgatggtttctaatctttaaggtcagctttattcctaaccccctcccctttagatttatattgttacattgttttttgtgatttctagattaggtttcaggtttttacatgtatacctttatagtgctcgattgcattacgggtcttcggtaagagaacatataggggaacta

SEQ ID NO: 1360 - DNA, 636 bp, Sorghum bicolor
  Clone ID: SORBI-28MAY03-CLUS21726_1
ccgggaaagcaacagaacccaaaattcccggctcgaagagtctaggcatcggacgcgcccgcccgagaggctactcgaatcccccccaaaattccgcggtgagagccactgatccatcgcaaaacccatcaaatttcgcaattcaaatcacccaaccccacctcccgccaccaattccgaggagatctcagtcaaccgaagggtcaagtctcgcgaagctttgagttggaaatatggggaaaccgctgatctacgagattctggagaagccggcgagcagcagcgtcatcggcatctgctccctgatctggtggctcatccagaagcggggcatcgggtacgcggacgtcgggctgagctacgaggccgccgtggacggcgggcagtactggcggatcatcacctccgccttctcgcacatcagcgtggtccacctggtgttcaacatgagcgcgctgtggagcctcggcgtcgtcgagcagctggggcagatcgggctcggcgtcgagtactacctgcactacacgctcgttctcgtcgtgctgtccggattgctggtcctcggcttctaccacatgatgattcagaggttcaaggtggagtacttcaggagggtcactgcgggtggctactcat

SEQ ID NO: 1361 - DNA, 768 bp, Sorghum bicolor
  unsure (1)..(768): unsure at all n locations
  Clone ID: SORBI-28MAY03-CLUS2182_1
gcacgaggattactatatatatatctaagacataataataacgctgatatatagagtaactgataagttcatcataattggatagagattacaaggtatctatctataatgagttggaaaataaacaagtagaaagagtgtacaaagatcagtaattttgattagatgtacgtactttagtgcctattttgagcatggtttttaaaattcaataattagagtgtattgaataaggtatctagctagtggaagaacatgagtagatgggttatttttcctaatttaagcatggcttttaaaattcaataatttgtaaatgattttaatccttttagtagagttctattgcacatagaaaagtttagtttagtttgacgtccgtaatgaaaacattttaatttagtttgaaacacgtactttagtgcctattttggtggtcctaatatactttatttgtaaaactactatctacttcaaaaaaacatgctttaactttattttaaaagtcaaactatcaagtttgaccaagcttgtagagaagattattaacatttatgacgcggaataggtacatcatgaaactatatttcatgatgaatctaatcacacttatttagtattataaatatttgattcttttgtataaatttgatcaaacctaagatagtttgacatagagcaaaactagaatatcattgttttttagatggagtatttatatagctttcaagttttaaaattnaaatactacatatgggctttaattat

SEQ ID NO: 1362 - DNA, 745 bp, Sorghum bicolor
  Clone ID: SORBI-28MAY03-CLUS21826_1
ccggggagcctcctaatcatacgaacaagagaggagaggagaccacgtcgtcctccgctaattctccgcgcagtggttgcccgccaccaactccaacaagacagcagcgatcgagctcaccacaaagcagcagcgcagccatggcgcccaccatccctgtcccatgcccaggcgccacggttattacctaccctactagctagctaagccctccacgccccctctgcccgccccgccgttgtccgttgaaccggccggcgatcaagaacagctgttatatatacatataggtgcaccagcgttgttgcgcctgcacttcgtccggcgacgtacgtacgagtacgacgatcggcgatgatggtgatgggctacttccggtcgacgaacaagtccgcgacgtcggcagcgggcggcaagaacaagaagaaggcgaagaacagctgtgcgccggcggcgcgcgaggaggcggccggactgcgggaggcgctgctggaccagccggcggcggcggaggaggacggcggcgttcctaagggctacttcgcggtgtacgccggggaggagtcccgccggttcgtcgtgcccacggggtacctccgggagccggcgttccgggacctcatggagcgcgccgccgacgagttcggcttcgcgcaggccggcggcctgcgcgtgccctgcgccgaggaggacttcgaggacctcctgcgccgtctccagcgcaagaacggcggcgccgtcggga

SEQ ID NO: 1363 - DNA, 552 bp, Sorghum bicolor
  Clone ID: SORBI-28MAY03-CLUS21192_1
ccgggacactcgccctcttcctcttcctcggattactgcgtttaccactcgccgccccgctacatcgcctaagttgccttcgccgccgctccgatggaaaccgccgcgccggcgcgcgtccaagccctcgctgagaccggcgtgtcccgcctcccggcgcagtacatccagccgcctgaggaccgcccgaccccctcgccctcccccgttgccgccgcggtttcggtcccggtagttgacctctcgtcctccaccgccgccgacgccgtcagcgccgcgtgcgcggactggggtgccttccacgtggtcggccacggcgtgccgagggagctcctcgacgcggtgcgcgaggccgggctcgccttcttccgcgcgcccatgggggacaagctccggttcgcctgcgacccggccaggggcgccgccgcggaagggtacggcagccgcatgctcgccaacgacgactccgtgctcgactggcgcgattacttcgaccaccacacgctcccggagttccgccgtgatcccgcccactggcccgatttcgtccct

SEQ ID NO: 1364 - DNA, 533 bp, Sorghum bicolor
  Clone ID: SORBI-28MAY03-CLUS21334_1
ccccgggaatatagaactattctaagacgcgatgtcacctgggtaaattaacactcctcctgattgtgtttgcaatagctttatctgtacagccagttattgttaatggaatgtgtaccgataaggagaagaaagacatcctgcagcattgtgaagattacctcaagcatggagctcccatcccatccttacatggtccctgttgcgcagcagcgttagaggtgcccgtcctggacatgcaatgcatcgtcgatctacttacagcaaaagagaagagcgaatacaaggaagcaaatatcttgcagctcaaacatctctgctatcctttgtcttcagagcctcctactaatcaggtcatgcatggtctcaaaggaagcgcagccatgcgtcactgatggagacattggagagcatgagtttgaatgagatggatagatataacaaagctttaagcaagtgtgatgttgtggtatgtgtcgttgattaagagaaaaccggctcgataagcattttaagtgtcttatttgtttgat

SEQ ID NO: 1365 - DNA, 642 bp, Sorghum bicolor
  Clone ID: 7217293
cctgcgttgcaccgatcgccgatccagctcctcgccgaccggccatgagctaccaggctcctcctcccggcaccgccgcctacccgccgccgggcacggcctaccctccgccgggccagcaggcgtaccctccgccgggccagcaggcgtaccctccgccgggccagcaggcgtacccgccgcctgcctacggcgcgccgccacccatggccgccggcgggtacccgccgccgccgccaccgcagcagcagcagcaggactccaagggcggcagcaacgacggcttcttgaaaggatgcttggccgcgctctgctgctgctgcatgctcgacatgtgcttctgagactgagttgccgtcagggatgcatggggatggcgcgtccagattcatcctgcagtcaggcgaatgcgtggagctgtttttctgaatcatgattatgatgcatctttgtttccatctccatcttgtgtatgtttttcccgtgcaatgaatctataatcatgcatggacttcactagttaaaccagctgggattttctggtgttcatgtgcgtgtgcgcttgagctctgaaaacattttcgatcagatttgtatttgtactcggtttgttccttattatcgccgtactcttcaatcctc

SEQ ID NO: 1366 - DNA, 647 bp, Sorghum bicolor
  unsure (1)..(647): unsure at all n locations
  Clone ID: LIB5050-003-R1-XP1-E8
ttttttttttttttnttttttttcttttttctttcctctcccctttttttttnnntcaattttggggcgcttaaggcggcgggtccccaacgccatccttgcatccttgtcgatcatcgcctcctgctcggccggcttccccccaccccggccgcctgcgttgcaccgattgccgatccagctcctcgccgaccggccatgagctaccaggctcctcctcccggcaccgccgcctacccgccgccgggcacggcctaccctccgccgggccagcaggcgtaccctccgccgggccagcaggcgtacccgccgcctgcctacggcgcgccgccacccatggccgccggcgggtacccgccgccgccgccaccgcagcagcagcagcaggactccaagggcggcaacgacggcttcttgaaaggatgcttggccgcgctctgctgctgctgcatgctcgacatgtgcttctgagactgagttgccgtcagggatgcatggggatggcgcgtccagattcatcctgcagtcaggcgaatgcgtggagctgtttttctgaatcatgattatgatgcatctttgtttccatctccatcttgtgtatgttttttccccgtgcaatgaatctataatcatgcatggacctcacc

SEQ ID NO: 1367 - DNA, 673 bp, Sorghum bicolor
  unsure (1)..(673): unsure at all n locations
  Clone ID: 30967293
gaacgcctccatcctcctccttgctctccctctccttcgccgatcgatctctagccaccagcagcagcagcagtagctagctgtgtgcgtgtagtgtagccaagccaaccatgagcctgaggcaagtgatgagtcgcgtgggctggcnggtggcggggggccaaggccaccgcgtcctcgccgtcgccgccggcggactcgtcgcggcgggcggaggaggtgaggggaacggtggcggcggcggaggagcctgtccgggcgttgatgttcatctccttctgggggcccaacacctgagcagagctcaccatgctggctcaggctgttgctgatacgtacccaccctgaattccgtcgctttctccactccacgcaagtttttttttgactgaactctgggcccctgcagaattttattaagaatgacaagaaaaaaattacagagttacagagttacaagcagggcaacaggattaggagacaaagaaagaaaagaagaaaataagaaaacatctggcatcaattacagattttgaatccatataccatagggcgctgagagtctttgcttgacctgaaggatacaagctgtagctccttgaagaaaagttccttgcaatcatgaattgacnactgattattgttgaagatcatcttattcctggctttccag

SEQ ID NO: 1368 - DNA, 444 bp, Sorghum bicolor
  Clone ID: LIB5050-002-R1-XP1-G4
ccgggatcctcctccttgctctccctctccttcgccgatcgatctctagccaccagcagcagcagcagtagctagctgtgtgcgtgtagtgtagccaagccaaccatgagcctgaggcaagtgatgagtcgcgtgggctggcggtggcggggggccaaggccaccgcgtcctcgccgtcgccgccggcggactcgtcgcggcgggcggaggaggtgaggggaacggtggcggcggcggaggagcctgtccgggcgttgatgttcatctccttctgggggcccaacacctgagcagagctcaccatgctggctcaggctgttgctgttacgtacccaccctgaattccgtcgctttttcgcttcaaacggaggagtatttgtactgtacttttgtaaacaaaaaaaaaatcaaatgagtgcagaacaaatttctctgatccggat

SEQ ID NO: 1369 - DNA, 704 bp, Sorghum bicolor
  Clone ID: SORBI-28MAY03-CLUS21911_1
ctcggatcgcaacaaagttacaaacttacaatacaccagcaattagcagagcaaagtgcaggagaaaatggcctccatgaagccgctgctcacgctcacctgcatcttcctcctctccgggctcgtcgtgttgggtgagatcggcgggacgacgctggcggcgccggagccgtgcccggtggtgtgcatccagggcgggtacatcacctgcgacaactacccgtaccaggagctggacggctgcgactgcgagtgcgcgcccaaggacggcatcaactgcgtgctccaccaccttgccaccggcgataccttcgactgcccaccgcaggcataggctttgcacttcagctggagcggcgcatgcagggatgatacgagggctcgctgttgctgctcttgattagtctataccaagctgatgcactgtgatcatcgtctgaatagtatcgttgctgaatatcagtgaagtcctagtatatatgtttatagtacaataatgaaagcatgtgtcttagcactatagcgtctgtatgatgatgtgaaacgaacgatgacagggcaagcccagtctgcactgcagtcaactgaacaagcgtttcaaggtcatgaaaaatattcaaaatgcaaaaggccaccgttatttttccaatttgcttaacagtactttttcagcaaaaaaaaaaaaaaaaaagggcccctagggc

SEQ ID NO: 1370 - DNA, 676 bp, Sorghum bicolor
  Clone ID: SORBI-28MAY03-CLUS21940_1
ccgggaatcgtcgtagccctccctccggctccgatccattactcgccatggacgcggcgggcggcgagcagctgagcctggccgcggtgcgcgatgcgctggtccggctggaggactccgtggtgttcgcgctcatcgagcgcgcccggcatccgcggaacgcgccggcctacgcgcccgccgccggcggcggcggaggatattcgctcgtggagttcttcgtccgggaagcagaggccctcaacgcgaaggctggacattatcaaaagccagaagatgttccattcttccctcaagatcttccctcgcctctctttcctaccaagccttccccaaaggctttgcacccttttgctttgttggtcactgtgaatgatgcaatatggaaaatgtattttgatgaattgctcccattattcactgttgatggtgatgatggtaactatgcacaaacagttgcactggattttgcgtgtctgcaggttctatcacaaagaattcatattggtaatatgttgctgaggtcaagttcaaagatgctcctcaagattatagtcgattaataaaagcaaaggacagcaattctttgatggatctgctgacattcaaggctgtggaagagaaggttaagaagagagtagagaaaaaggccaggaccttcgggcagaacgtcacc

SEQ ID NO: 1371 - DNA, 882 bp, Sorghum bicolor
  Clone ID: SORBI-28MAY03-CLUS21945_1
ttcggtcttgatattcggtttggacctgctgacatagaggagctggttcgtaaagcattacaattaagttgtaatgcgaagcccattaaccaccccacgtatgatgatccaaacaatggtaaagcatatgccatattcaaagctaaagatgctgctgatgctgccatttcaaaaatcaattctggtttggttgttggtggaagacccctttactgcagcaaaggcttactcgaggttccaaagcctccaaagaatcttgttgggcacctctcctcacatatcaaaattggtcacaagcagcgtgatgagcagagcaaggctgtagcaacctcgcattgttcccagcccaacacgatcgagtacgacttggccttggactggatgcttcttcgggaaaagcaagaccaaagcttcagaatacttcacaagaagcacagagaagccaggaaagtgtttgcaagcctgggcaacaaaagtttgaaggcagagaaatagcaggccggttcttgtgccatatcagatggatgtcttaatcaccatgtgtcggagcttggtgttgtatgactggcaagtttcttctctgcggaagagggttgtgcacagcacagaggttttcttttttgcttagtcattggcttcattgggttaattcgtgttaccagtggctggtgatgttagttcgtgttaggaaaggaaagaaagtgcatgacagattttagaagtcagagcaggcctaggcatcatcaatagccgatgcagcaagttcggtggccataagttgttttaggctaacatatggttacctcggttagcaattcacagattgtaaacattttgagtttttcttttatgaaccctctgctctaccattggataattcgt

SEQ ID NO: 1372 - DNA, 756 bp, Sorghum bicolor
  Clone ID: SORBI-28MAY03-CLUS2198_1
cgtccgggctcctcccgttctggggcaaagccaggccggccctcgggcagagcttcctggtggcgcagtcgcagctcacggccaccgccgtgcagtaccgccgccgcgacgacgggacgaccgccgaggcggccatgctccgcccgctctacccggccgccaccatggtctacttccagtgcatgttcgccagcatcaccgtcatcatcctcgccggctcgctgctggcgcgcatgaacatcaaggcgtggatggccttcgtcccgctctggatcaccttctcctacaccgtctccgccttctcgctctggggcggcggcttcctcttccagtggggcgtcatcgactactccggcggatacgtcatccacctctcctccgggatcgccggcctcaccgccgcgtactgggtggggccgaggtcggcgtcggacagggagcggttccctcccaacaacatcctgctggtgctggcgggggccggactgctgtggcttggatggactggcttcaacggcggcgacccttacgcggccaacatcgactcgtccatggcggtgctcaacacgcatatctgtgcctccaccagcctcctcatgtggacgctccttgatgtcttcttcttcgggaagccgtcggtgatcggcgccgtgcagggcatgatcaccggccttgtatgcatcacccctggtgcaggtgagtaccgactaccgagtagagtagcttcctttcgcttgctacaatccatcctcgtgc

SEQ ID NO: 1373 - DNA, 696 bp, Sorghum bicolor
  Clone ID: SORBI-28MAY03-CLUS21986_1
gacaccaatcgcgtacctccccttcccctccccgggcccactctcggcgtccgtctctctctcctctccggcagctgcgcgacgggcttggcttggatcgcaccctcgtcggagctaccatggctgggaagcttattgcaaatctgattgtcatgggctctacaattataggaagagctatgcttcaggcatatcgtaaagcacttgataatgcaaataaaaccggtgtggcccatgaggcaataaacaatattcgtagagcaagcaaaacaatgaccgaacaagaagcgaggcagatactgggtgtctcagagaattcaacgtgggaagagattgtacagcgatacgataacttgtttgaaagaaatgccaaatctgggagcttttacctccaatcgaaggttcaccgggccaaggagtgcctagaaacagtgtaccaaaagaacaaacaagatgagcctcctaattgaaatcccaccccttaaccgcttctgatactctttttcccgtcataagagaagtgtacatacaaacaatggtcgctgctgttgtatcagtagtatgcaatgtagcaacaataagctttgtgtgcagcgactgcaaacctacctgtataagactgatctgtaaggtctcgctggaccacctcctttctctttttgtttcttttcttttcttttatttctttcttttttt

SEQ ID NO: 1374 - DNA, 886 bp, Sorghum bicolor
  Clone ID: SORBI-28MAY03-CLUS22_1
tcttcttgttaacccaagtagggtggagctatctagagtttcattgaaaacaaggaagtccgacaatgtcgacgatcacttcttgcacccttctgagcctcggatcggcagcgtggccggcagtctattccgccgggagaccatcaccggtggcggtggcttccctttcttcccagaggaggccccggcccctttctgtgtgttgtgcgacgagccagaaaggggatcacaacccaaagacggatttgcatccatttaacatccctgccttcgttctggtgcacccggtgccaccacgcgaggaacggtggcagctagaagaggacgccgagaaggtgaacctgtggttcgaggtgcctgggcagtcccaatatgacctcgccgtggagatcgacgaggacgtgctcgtcatcaagaagaaggtccatgtcgtcggtggggacgtgggccagaggagccctggcggcggcggcggcgtcaacgattatgctccccagagcagaaagggcggcgcggcgccagaagctagcaaggaggccgcacagcagggcggcgaggtgatctacgcccggatgctgctcccggcggggtacagcagggagggcgtggaggcggagctcaagtccggcgtgcttagggtcactgtcgccaagatcaaggagcgggcgcgcaggaagatcgacgtcggcattctagtcaagtaggagcatgcatgcatgaactgaaagagtgcttttgatttgtgcgatgtccggcaggctactgcggttcgaccgcgatctggtcacgtactcgatcgcgttgaccatatatatgttggtggctttgtgtacccaagtacacgatcaataaaaataagcatccgatcgatgttctttcttcacgc

SEQ ID NO: 1375 - DNA, 627 bp, Sorghum bicolor
  Clone ID: SORBI-28MAY03-CLUS22004_1
ccgggatcacatcctcacaaaggcctgctctgattcccttccattccttggaactgaaactcattgatggcgaaggaaagtgggagctttgttccatccaccaataaccaatgccatcagctgattttcatcgttagctacctgtcagttgtacaaagtactgttgtcaccaatttatgcttcatcagaggaggcaattacaagttgcaaagcacatgaagagactcgtccactcggggtgcagagtgtgtgacggagccttactttttgttgaagattttctctcttttttttctctccccctttgaatttttttgcgatacagaagggaggaaggaaatatacaccagtcagtgttaggaggaaaggttatagatgggaacattggggctgcaggcttcagcgggatagcatagtacatagtcctagcatgatatgtcagcctgattgatttttatacgagagagacacagaataagttggccgcagtgactgaaatcaaatggtggcgtgtggaaatatttatggtctgtatcaaaatggacaaggcacgaagggtgcctttgtaaatgacaactaatttataggaaattaatctttctctctctctctctctctctctctctc

SEQ ID NO: 1376 - DNA, 796 bp, Sorghum bicolor
  Clone ID: SORBI-28MAY03-CLUS22062_1
ttgcgaccgtggactcaagccgcctccctccccactgcgtctctccccctcacaccgcgagttgggttccaaccgccgagctcgattccaaccggtggcggcgagatgaagatcacggtgatgaccgtcgacgagcagatcctcaccctcgacgtcgaccccgacgaatccgtggaaaatctcaaggcgcttctcgaggtggagactcgagtaccgttgcagcagcagctgcttcacttcaatgggaaggaaatacagaatgtggagaagctcagcgccattggggtccgggatggcgaccttgtcatgatgcttcccaccagtgaaaggtcatctcaggatactttaaggataaatcctgctgatggaactgctgtgaaccctcaagcttttcaacaacatattcgaggtgattcacatcttatggcacagctccttcagaatgatcctcaactagcacaagctattcttggagatgacaccaatgagctacagaatatcctgcggtcccgccaccaacagaaaacggaactgaaacgtaaacaagaagaagagcttgctttattgtatgctgatccttttgatgtagaagctcagaagaaaattgaagctgcaatccggcagaaaggcatagatgaaaattgggaggctgcattagagcataatcctgaatcatttgcccgagtggtaatgctatatgtgggatatgggaggtcaatggtggtacttttgaaggcttttgttgacagccgggcacaatcaactatcatatcaaaaagttgcgcttgaacgttgc

SEQ ID NO: 1377 - DNA, 764 bp, Sorghum bicolor
  Clone ID: SORBI-28MAY03-CLUS21509_1
tcccggaaagtcgccaaaactccggacagtctcgtatttccccactctccagtctccagacgaaccttcgcgatggcgacgctgacctcccctccagcttcccccgcatccaccgccacctcccccgtctcgcgcctccggccaccgcccccctcccttctgcgcctccgcttctggccagcaccagtggcggccgccgccgccgtgccttccccgattgctctgggcccaggctgtcgttcctcgtccggcatacgctgtcgagccgccgccgggccctcgccgccctcctcagagccccctccgtctccgcacggttggcaagagaagctgtcaagtttgcaggatagagcacggatcttctttgccgttctgttctggatgtcattgtttttctggggaagtgcttgggatggaagtaacaactctggaggcaagaagcgccaacgatttcgaaagaagtcaaagtgaagatgctctaggatttacattttttccatagggatatagctttctatgttcaaggacttgtgaacatagtaaaggtgtaggcatagaaagttgccgtgttacatagttgtatttcagcagccggtaccctaaagtaaattgcccggtcctgctgtatatattgccaatcatggataggagacatgaatgacatcataatggactaaaggagacatgtatgtctgttccttgatattagtagtattattctggaaaaagaaatgcatgtaaaaaaaaaaaaaaaaagggcccct

SEQ ID NO: 1378 - DNA, 520 bp, Sorghum bicolor
  Clone ID: SORBI-28MAY03-CLUS2152_1
tttctgcttgcacatgaacttcctcaagaggtaggagattttggtatccttgtgcggtcaggcttcacggtatctaaggccctattcttcaatttcctctccgcgttggttgctcttgctggtccagcacgcgtccggtctttgggtaaagatcccggacattcctccctgattgagggtttcacggctggtggtttcatttacattgctgtcgcgggagtcctcccacagatgaacgaccagaaaacaaccctcagaagctcagtagctcagctgatctccctgtcaatggggatgctggtcgctctaggcatttctctggtagaataatctgaatctccatttcacccgttgcagctttaggtccaaccgcagttaccccaagtcgatataattcttcagcagctccagactagaagccggattctttgaccctctcgattatagtaccaaagagcgtttttacaatttatcaaaaaaagagcgtttttgtaaattttggtatctgattatagattgg

SEQ ID NO: 1379 - DNA, 875 bp, Sorghum bicolor
  unsure (1)..(875): unsure at all n locations
  Clone ID: SORBI-28MAY03-CLUS21534_1
gcacgaggggagcacttaaattctctcgactcgcccttccgtcttcacatttccttctactcctccgtccatagcatctgcaacctcacctttttctccaatctcccctctacacgtcttcaagatgtcgggaaagcagcaagacaagagcatcatggggatgcccggcttcgtggtcgacttcctgatgggtggtgtttccgccgccgtctcgaagaccgccgccgctcccatcgagcgtgttaagctcctcatccagaaccaggatgagatgcttaagtccggtcgtctcgaccgcaagtacgacggcattggcgagtgcttcagccgtaccgctaagaacgagggtgtcctctccctctggcgtggtaacaccgccaacgtcatccgttacttccccacccaggcgctcaacttcgctttccgcgacacctacaagtccatgttcgcctacaagaaggagcgtgacggttgcgccaagtggatggccggtaacttggcctccggtggtgctgccggtgccacttccctcctcttcgtctactccctcgactacgcccgtacccgtcttgccaacgacgccaagaccgccaagaagggtggtgagcgccagttcaacggtctcgtagacgtctacaagaagaccctcgcctccgacggtatcggtggtctttaccgtggtttcatgccctccgttgctggtatcgttgtctaccgtggtctatacttcggtatgtacgactcgatcaagcctgtcctcctcaccggttccctcgagggtaacttcttggcctctttcgctctttgttgggncgtcaccactggtggcggtatcgcctcttaccccctgacaccatccgtcgccgcatgatgat

SEQ ID NO: 1380 - DNA, 726 bp, Sorghum bicolor
  Clone ID: SORBI-28MAY03-CLUS22268_1
ttcgggataatataatcttacgattccactgctgatctatcaactccataaataacatgaaacttccagactataatcctgcttaaagactagataaccgcaacaaacactggcaaccacaaccctgcaaagataattcctgatcatgtgcaaggtacacaatacagaatgcgccgcaacagcacttggctggctactgaccaggcgcgggttctgtgccactcccacatcagaacgcacgagggcactgtggaattccctgcccgaaggatcccggcaccggtagatcaaatagccgccaggaatcaagattactatgaaaggggtgcagtactgtcaccagtggacgaaaatcttgaggccatgctgggagccaccatagagaatgtcgatgccccttctgtttcacagcctaatgagcttaggcaggacgtacttgatccttctggacttcaatatgacgtgccatcagtttcaagtcatgctgattcaaacacgaacgcttcacagcctagcacaatggaggatccacaaggaaacaaccaagcacatactttttcccatttgtcaaacttgatgcaagcaaatcctttgagcaccagcagcctattggggtcaaatcaaaatcatgcagctcttcatggcttagagtttgatttaccgccttatctggaagcaaaatataacacaggctcgactacacatcctagaccagccatatccatg

SEQ ID NO: 1381 - DNA, 720 bp, Sorghum bicolor
  Clone ID: SORBI-28MAY03-CLUS2227_1
actacagtgctgttgaggatgtccaactttgcaaatcctggattcatatcagcaatgatcctatcatagggaatgatcagtcaggaaaaacttactgggagaggattgctaatgatttccacatgaacagggactttgagtcgataggactcccaattcactcgagcatcggtttggaatcatactaaacgtccggcatgaaattccatggcttcttcgaggaggtccagcgtcgtcatcgaagtggtgtcccgtaccaagaacatttgggggaagcccatggaaggtatgtcagaaaagaaagcgcaaagaaatttcaatttgaacaatgttggctcacgttgaggaatactcaaaagttcgaatcaacacttgaagtcagcaagaggccgaccaagtccagagagctcaacctctccgtaggaactcaacaagacagtgagacaaccgcccaaggtcaagagagctcctccattccttctaccaagacaacccgacctccgggtagaaagcaatccaaagacaagctgaaaaaaaatgaaggagatgacggctataaggatatgatgcaaaattttttggtaatgaagaccgaggaacaaatgatgaagaaagcaaggtgggagaaggatatgctgcttgaggagcggaagcttaaggtggaggagcagcggctgcagtgggagcaggaacagaaaatcaatgttttgtgatgtgacc

SEQ ID NO: 1382 - DNA, 644 bp, Sorghum bicolor
  Clone ID: SORBI-28MAY03-CLUS22329_1
ccggggattcctcccccacaaatcctccaacccaacccacaaaattcacgcaaccttgcatcgcctcggctccaaattcgcccccttccatccacaaatcccctcccccgcctccgattccgcggcgaattcggttagcttactctccgagcttatcgccaaccgtgtgcgaccacgagctgccaatttgcggagctccgaacgcgagccgcagaaggcgaatcgaatgaatcaagctcgcgcgacgggaagttgatgccacccggcgatggatcgccgcatcctcaggagctcgtcgtgcaacggcagcggtaagaacccgcccccttcctctccggcggcggtctcacggtctgcgtcctccgggggcatcggctccaaggacgtcgacgctgcgggcgagcgcacggcgctgctgccgcagcagccgcctggcggcatagcgcgcaagggccgcaaggggcccaaacgccgggtgcagtggaaagataggcatggcagcatgctcaccgatgtcagggagttccagcctagtgactcaagcgactcagaagatgaatatctggatacatgcatatgctcaatcatgtaaatacatcttggcacagtgggattctatcatgtgtataaagagctgtatctca

SEQ ID NO: 1383 - DNA, 723 bp, Sorghum bicolor
  Clone ID: SORBI-28MAY03-CLUS2235_1
ccggaactccgaccgtcacagtacagatacagtgacgacccgaccgctcgatgatcgtcgttctgacgctgtaccgtacctagctcgcgtacctcgtatctcagccctccgccgactatccaccatggggatggtactgggcaagatcacggtagagacgcccaagcacgaggtcctccacaccggcgccggctacgagatccgcaagtacccgccctgcatcgccgcggagttcacctacgatcccaaggagtggaaaggcaaccccgacggcgggttcaccgtcctcgccaactacatcggcgccctcggcaagccgcagaacaccaagcccgagaagatcgccatgacggctcccgtcatcaccaccggcgggggcgacgacggcgaatcggccgagaagatcgccatgacggcccccgtcatcaccaccggcgagcccgagcccgtggcgatgaccgcgccggtgatcacggacgaccagcaggcgcctggcaaggtgacaatgcagttcctgctgccgtccaagtacaccaaggtggaggaggcgccgcggccgacggacgagcgggtggtgatccgcgaggtgccggagaggaagttcggcgtggcgaggttcagcggggtggccacagagaaggcggtgagggcgaaggcggaggggctcaaggccgcgctggagaaggacgggtacgccatcaagggcccgttcgtgctggcgcg

SEQ ID NO: 1384 - DNA, 730 bp, Sorghum bicolor
  unsure (1)..(730): unsure at all n locations
  Clone ID: SORBI-28MAY03-CLUS22354_1
ccgggacttgttcatatctctctctctctctctctctctctcgttctcgttgccacgcctgcctgggcgaccgtcgccgctctacaccaggcgtccaggtcttcttcgccggcgccgagcagccaccagccctgctcaacaatcatctctgtcaagggcatgggcatggaccacatgatgaggcttggcgccggagtcgcccaccagatctccagggctgaaccaatgcctgaccgaaggtcaaggttttggcagacggatgtgccgcctgcgcctcggatagacatcatctgccctctgccttgtcgcccttcccgcccacagctcctcaataggcccagccccaagtctaatggggcactcccattgtatagagcagaccccacttgtgatatcgttgatctcatccttaacaagaatgaccctgatgtggatactgattcaagcagccaggtggcctttttctgtggctcaccccctgcacgcactaacaaccctgttatcaatgacccacagtttggaaagaaaacaccatccttttctcctctaggaagctctttcggaaaaatagcagctggaagagttgaagtaggttctccgacctgcggngccagtagcccgaaagtaagaattgaaggttttgcttgcgggaacaaagagccccctcactgtgcggttacatttgcctgatgatccccatgaccctacctaacccaccctgttttgctac

SEQ ID NO: 1385 - DNA, 798 bp, Sorghum bicolor
  unsure (1)..(798): unsure at all n locations
  Clone ID: LIB5048-002-R1-XP1-B5
ccgggcccctccccttccaattcttccccattcggttcggagttcctccctccctcttcctcgtccgctccgctcccctcccctcccctcctgggttgccgtggagcgctgggggttccattccattccacccctatccggaccgaaccccgcgccgccggcgcgtcggttgcttcgtctcccgggttcaagatgattagctcattcattaccggaattctaacgcttgttctcggatacgcgtacccagcctacgactgctacaagacagtggagctgaacaggcctgaggtcgagcagctgcggttctggtgtcagtactggattttacttgcgtttctcactgtactggagagagttggggaaaatttcgtatcatggttgccaatgtacagtgaagcaaagctggcatttatcgtgtacttgtggtatccaaagacacgggggactgcctatgtatacgagtcattcttcaagccatacattgcaaaacatgaaactgagattgatcgaaatctgcttgagttgaggacaagagccggtgacatggcagttctttacttccagagggttgcaaactatgctcagacaaggtcctatgaaattttgcagtatattgcctcacagtctcagactcaaagatctcgccctcaggcacagcaacagcagcagcgcccaccaccgccacggactcggcaagtgaaccctgcaccctccactgttcctgcaccatctgcgcctccgatgcncacacagcctgcccaaagctcagttcctcccactccatgccgcccccca

SEQ ID NO: 1386 - DNA, 702 bp, Sorghum bicolor
  Clone ID: LIB5121-005-A1-PF1-G1
gctcccctcccctcccctcctgggttgccgtggagcgctgggggttccattccacccctatccggaccgaaccccggcgtcggttccttcgtctcccgggttcaagatgattggctcattcattaccggaattctaacgcttgttctcggatacgcgtacccagcctacgactgctacaagacagtggagctgaacaggcctgaggtcgagcagttgcggttctggtgtcagtactggattttacttgcgtttctcactgtactggagagagttggggaaaatttcgtatcatggttgccaatgtacagtgaagcaaagctggcatttatcgtgtacttgtggtatccaaagacacgggggactgcctatgtatacgagtcattcttcaagccatacattgcaaaacatgaaactgagattgatcgaaatctgcttgagttgaggacaagagccggtgacatggcagttctttacttccagagggttgcaaactatgctcagacaaggtcctatgaaattttgcagtatattgcctcacagtctcagactcaaagatctcgccctcaggcacagcaacagcatcagcgcccaccaccgccacggactcggcaagtgaaccctgcacctccacctgttcctgccccatccgcgcctccgatgccaccacaggctgccccaacttcaagttcctccccctccaa

SEQ ID NO: 1387 - DNA, 586 bp, Sorghum bicolor
  Clone ID: SORBI-28MAY03-CLUS22370_1
ccggttctactccgccgtggcctccagcaccagcagcggcggctcacgcatcgctcggcgcctgccccgggcaccggagcgacgaccggcacagcgcagccccacaccgccgaggaaaggagaaaggcgccgagtccaggagcgcgtcgccgcgggggctcgggaacgcggtgtcgccatcgcggaaccctagcgagatcgccgggaaggtccggaggccagcacgttgtttctgtgtaacctttcttccctttctccctttgccggccggcccttcagcggcgacgagtgcccaccaaggcggtggtttaccgtgagctgaggaagatgtctggaactccagtcggcgtcgacaacacttctaggaggaaatttgacaaggaagagtacttggagagagctcgacagagggagcagcgggagaaggatgaagcgcggaaaggcaaggaaaggggtcctcctgtgcaaagacagcctttgaaacacagagactatgaagttgatcttgattctcgtcttggcaagacccaggtggtgaccccgattgcaccgttgaatcagcaggctgggtactactggtctgtat

SEQ ID NO: 1388 - DNA, 732 bp, Sorghum bicolor
  Clone ID: SORBI-28MAY03-CLUS21848_1
ccgggatccgcacccaggctgctgctaccacccacgtcggagaagagcagaagcaagagtaaacggggcttgtgatttgtgaaagagatgcctctgcagctgccgccgccggtgaatccgcagcggctttcgccggcagagtcccgagagcggacggtgggcttcttccaaggcctgggcgtggacgtgcccctcccggcctcggccgagcggcccgacgcctactcctcgctcgtccgcgccatcgtctcctccgccgtcgtcacctcctcgcgcgtctcctgcaccatcaccatctcccccgccgtcgcgaaccagtacaacacgctccacggcggcgcggtggctgccgtggctgaggccatcgggatggcgtgcgcgcgcgccgcggctggcgataaggagatgttcctcggcgagctcagcaccgcgtacctcgccgccgcgcgactcaactctgaagtggatgttgaagcgcagatactgaggaagggcagatcagtcgtggttaccacaatcgatttcagactaaaggataccaaaaggctctgctacacatctcgagccaccttttacatcatgcccatggcaagcctataagcccaagttttatatggacaatttcttctgtctacacgacagagtttgtattgtgtgtatttaacttggatagtggatagcatgtatctgcaatctgttgtattaataatgaagcaaaagtcatattgatcc

SEQ ID NO: 1389 - DNA, 752 bp, Sorghum bicolor
  Clone ID: SORBI-28MAY03-CLUS21875_1
ccggggacctcctccctccatcgaaccccaagcgcggcgctcccgttgtcccgcacccgctcttggccatgtcgcccgccgccgccaccaccacagccttcgccgcggtctccgtcgccatccccaaccctactgctccatcccgcggccgcgtgcgccttccgctacgcggggtccccgccgccgcacgccgcgccgtcgcctcgatggccgtgtccgcccccaggtccggcgccgccgcctcgttcctcgagcgccgcgagtccgagcgcgctctccacttcgtcaagtaccagggcctcggcaacgacttcatcatggtggacaacagggattcgtcggtgccgaaggtgacgccggaggaggccgcgaagctgtgcgaccgaaactttggcattggcgctgacggcgtcatcttcgtcatgccgggggtgaatggtgccgactacaccatgaggatcttcaactctgatggcagcgagccagagatgtgtggtaatggagtccgttgctttgctcggtttatagctgagattgaaaatctgcaggggacaaatagcttcactattcatactggtgctggaaagatcattcctgaaatacaaagtgatgggcaggtaaagggtgatatgggtgagcccatcctttccggaccagacatccccacaaaactgctacctacaagaacaaagctgttgtccaagctgaattggcagttgagggcttaacatggcatgccacatgtgttagca

SEQ ID NO: 1390 - DNA, 757 bp, Sorghum bicolor
  Clone ID: SORBI-28MAY03-CLUS21763_1
tcgaggggccggccgggcccgggatccacaactcacacacactctccacatcaaacaaactactttcaactcttatccacccaaccaaacccaccaaaccaccaccatcaagatgcgtttctccaccattgccaccgctgtcatcgccgccggcgttgccaacgcccaggtcgactccatcatctcccgtgtcacctctgccgtaggcggtgtcccctctgacatcggctccgtcgtcagttccatcacctccgacattggctccggtgttgcatccatcaccagcgacgccgcctctggtgcttcatctgtcgcctcttccatcgagagcgacgcctcctctgccctcagcagccttgcatctgaggcctccactgctactggctcgcgtgcctctgagatcgcatctgctaccagcgccatcaagagcggtgctagctctgctaagtctgccgccagctctgccgccgccagcgctactggtgctgccgactacaacaacgtccccgccatgggtgccgtcgctggtggtctccttgccatcgctggtctcttgtaagcagctcgacctgcaagggcttccttcgactccggacatgaaaagtctctttcgacagtttctttcatcggctagcgacatcagccacgagctgaacacgcttcgtctcttatgagacatttgcgggataggaatggttctcggcaatactggagaatatccagtcggtctataaacttataataagtcatttcaatg

SEQ ID NO: 1391 - DNA, 765 bp, Sorghum bicolor
  unsure (1)..(765): unsure at all n locations
  Clone ID: SORBI-28MAY03-CLUS22649_1
aatcgatatgaagtgaccgagatacgccactcccagaacttccccaccccgctcctaaacccggaaccacgaacgcgatccatggcggcggcgggttggctccgacgtgcggcggcggcgtcgatgccccgcctgccttccggacttcccctcataccgcctcctccccccgcccctctcaccgaggcgcagtcgctcgtggtccctggcctcggcgccgccgccggaccagccatggagctcatggccgttcctaagaagaaggtctccaagtacaagaagggtttgaggaatggacccaaagctttgaagcctgtgccggtgattgttcgttgcaggtgctgcggtcgagtgaagctacctcacttctactgctgcagcggagaaagaggaaacccaagcgagtcaagctcataaatgttttgtttgcctactttgcgctctatgctaggtctgaactctggacatcgtaataccactgaaataaattctcagatcgcatttggtattcacctattgttctccttccaagcatttaatcaatgtacacttactctagtttgaattcaaagttctctcagctcgtggcaagaacgtacacgttctgatatactcagtgtaatgaactattgacgtagtactagtttgaattcgaagtatcagcgtcaaagttctctgtgcttgttgcaggagcggacacgttctgatatagggtactatggncttgttcagtttgcaaaaacctttgaaaaacgacactgtagc

SEQ ID NO: 1392 - DNA, 689 bp, Sorghum bicolor
  Clone ID: SORBI-28MAY03-CLUS22918_1
ccggggacctatccgcacgtcttgtcgactattatccctcttcattcatacatttctccatcacaacgccatcaccaccaagaacaacaagatcacacaagtcagggaaacgtgctacagtactatacacggaccatggcaccatcatcaccaccaccgttcctcgttctttccgtcgcgctgtggctgctgctgctcgcctcctcgcacacgcgcggcgccgaggccgcgccgcccaacacggaggcgctgtcgctgctgtgcaacggcgcgtcctacggcgccggggaccccttcgcgacgagcctggcgtacgtgctgtcggagctggtgtccgccacgccggccagggccggcggccacgacttctacgacatctccccgtacccggccgccttcgcgtacgggcacgccgcgtgccgggcggcgctgtccgcgccggactgcgcgacctgcctccgctccgccgtcagccagatggacgcctcttgtggccacagcgtcggcgccagggccgtgctcgtcgactgcagcgtgcgttacgagcagtacgcgttcgtggattaattcgtcgcttgatttccagtagctcctttcgatttggccggctggatgtgttccaaagtaatccactttgtccaacatttatccttgttgtcttgttgattagtagcagttagcactccagg

SEQ ID NO: 1393 - DNA, 603 bp, Sorghum bicolor
  Clone ID: SORBI-28MAY03-CLUS22957_1
ccggggacaagagccgtcgccgtcaagcattccgaaacacatctgcagcctcctgcattccggctggcggtgctctccaggagtcggcatcttcgactcttcgttgccaattggcgacgcctccatccagccgcgacattgccagcagcagccatcgctagcagctcatggccctgctcccgctgttcctgaggccggtggttcggttcgcggcgcgcgtggcggccggcggcccggcggtcgcggcggcgacgatcctgcaccgcgccggcgcgctgccgaggaacaggggcctggagcgcctcgtccgggacgacgcgctcggcggccgcgacggcaggggcgatgactgcatcgccagcttcgtcgtcggcgtcatgcgctgcctctgctaatcctgtagtataggcggcgcagcaaatgctggccatggaaggcatgacatgcacgtcgccatgacatgaccaggtcgatgtagattcggttggctagctagagctagagtgtggaaatggactccattgttcggaggaaaaatcaccttgaaatttgtaacagggaacttgcattgtaatgctaatcttttatctttggcgtcaaaaa

SEQ ID NO: 1394 - DNA, 899 bp, Sorghum bicolor
  Clone ID: SORBI-28MAY03-CLUS23070_1
gcacgaggctaaacccttgcttctccccccaacgttccgggaagaccaagcaagatgctccgccgcgccgcccctacgacggccgcactctgccgtcgcgcgctctctgccacgccatcctcctcccgcaccgccgcggcaaccgcggcggcctcctcctctgccgtgaactccatcctcctccgctcgctcaaggagcactacctcgaggtctgcaagatgacgccaccgcccaaggtcagcccaccagagcccttcaccatcgtcaagggcgccctggaccagccgtcgggacccgtgctgcgccgcgaatatggtgacgacggcgaggagatctccatctccgtcgccaggctcgccaacatcctgcccgccggcgccgactttgactcggacggtgccggcgagggcggagggatgagcgcgtccatcagccagctcttcctccatgttgatatctccaagcccgggtcaggaaagtcgatgcagttcctttgcgggctgtacccggacgcccttgggatccattcggtctgcctccggtctaagaacgccgagtctttgaacggggatatgacttcgaagggcggcggagagtaccgagggcgtattttccaagagttggatgaaaaggttcgtgatgcactccatctttacattgaagcccgtggcataaatgagaagctcttccgttttctccaagcttggctttatgtaaaggatcaccgcaatcttatacgctggttcaagagtgttggttcagccatcagtgagccaaagccaagtaaggtgtcaggaaacccatgctggagaaatgagatcatctgaaaggcgggtgtggagcagttttctccaggatgggagatagatctaggataaagtgaattacgtgcaaagtt

SEQ ID NO: 1395 - DNA, 833 bp, Sorghum bicolor
  Clone ID: SORBI-28MAY03-CLUS23176_1
gcacgaggaccccgatgcgtcccgccaaagccgctggtgggaaggtaagtaacatagcagagtccagactcgagagaccgaccgacccggccggcatggcggcgaggccggcggggtgtggctcgctgttcggctgcttcggcagcagcagcagcagctcccacgagaacggaggcagcacgaagaagaagggcgggaagaagaagaagaagaagagcaagcagcagcagaaggtggcggcggggagcggcagcgcggccgcgcggtcgctgcctagccggatgtcgttcaacgagctgagcctgagcgggatggtgtcgcccgaggacctgtcgctatcgctcgtcggctccaacctccacgtcttcaccatcgccgacctgcgcgccgtcacccgggacttctccatgaccaacttcatcggcgaaggcgggttcggccccgtctacaaggggtacgtcgacgacaagacaaagccggggctcgccgcgcagaccgtcgccgtcaagctgctcgacctcgagggcggacaaggacacaccgaatggctgacggaagtgttcttcctgggacagctgaggcaccctcacctggtgaagctgatcggctactgctacgaggacgagcacaggctgctcgtctacgagttcatgaccaggggcagcctggagaagcatctcttcaaaaaatacgctgcgtcgttgccatggtcaacacggctgaagatcgccattggcgctgctaaagggttggccttcctccatgaagccgagaacccggtcatctaccgggacttcaagacctccaacatcctgctggacttggattacaac

SEQ ID NO: 1396 - DNA, 598 bp, Sorghum bicolor
  unsure (1)..(598): unsure at all n locations
  Clone ID: SORBI-28MAY03-CLUS23193_1
cgctcgaggccnggccggggccgggaactccaagtcaacaaaaccgccatcatgtcgttcgctccccccgaggctcaccagcagttccagcacatcctgcgtctccttaacacgaacgttaagggtggaggaaagatcatgttcgccttgaccgagatcaagggtatcggacgacgatactccaacttggtctgcaagaaggccgatgtcgaccttaacaagcgtgccggagagctcaactcggacgtgctcgagcgaatcgtcaccatcatgcaaaaccccgcccagttcaagatccccacctggttccttaacaggcaaaaggacttgaccgacggaaagaactcgcacaccctctccaacgccatcgaccagaagctccgagacgacctcgagcgactgaagaagatccgatcgcaccgaggtctgcgacaccaccggggattgaaggtccgaggtcagcacaccaagactaccggacgacgagtcggcaagtcgatcgctggaaagaagaagtaatcgtcgacatgtacgatacttgttgttacggcggttgggttgtggctgggtggttatggctatgcacgatctgatactc

SEQ ID NO: 1397 - DNA, 459 bp, Sorghum bicolor
  Clone ID: SORBI-28MAY03-CLUS23198_1
ggatccgccgcaactgaatcgggtcagatcgggccgtcggggaggtgagggagctcacgcggcgccatggacgaggaggagcacgaggtttacggtcaggagatcccggaggacggcgacatggacggcgccgacgttgatatggccgccgccggggatgacgcgacgaagctgcaggagctcgacgagatgaagcgcaggctgaaggagatggaggaggaagccgccgccctccgcgatatgcaggccaaggtcgccaaggagatgcaaggaggtgaccctagtgcatctacagctgaggcgaaggagcaggtggatgcccgctctgtctatgttggaaatgttgattatgcttgcaccccagaagaagtgcagcagcatttccaagcatgtggaactgtcaacagggtgacaatcttgactgacaagtttgggcagccaaaaggttttgcttatgct

SEQ ID NO: 1398 - DNA, 704 bp, Sorghum bicolor
  Clone ID: SORBI-28MAY03-CLUS22224_1
tccgggaccaaaagtctgaccgttgacgacacgcgagaccccatccacatcacccggtcctactaacacacagtcaaaatgtctactcccaaggtcaagaccgcccagctgtggaacaagtccaaggatgagctcgcgtcccagctcaccgacctcaagtcggagttgatccagctcaggaccgccaaggtcaccgtggctccaacaccaagctcacccgcattcatgacgtccgcaagggaatcgccaaggtccttactgtcatcaacgccaaccagagggctcagctcaggctcttctacaagggcaagaagtacactcctcttgacctccgccccaagcagacccgcgccatccgccgaagactcaccaagcacgaggcttcgctcgtcactgagaagcagaagaagaggaacacacacttcccccagcgaaagtacgccgtcaaggcataagcgtgctttcgtgaaggtgtttcctcttttcttcctttgtctctcatgaagcattgcattgccggggcttttccagctagcgactcaccagtgtacccttagtaccatactccaacggggccaggaaggtgggatagcagatgggaatggacggacagggcgatctttaacggaaatgggttggcgtccatgtcaagatctatgaataaaaagttcagacaagcacggaatgatacctcatgatttgtg

SEQ ID NO: 1399 - DNA, 676 bp, Sorghum bicolor
  Clone ID: SORBI-28MAY03-CLUS22262_1
aagtgcttcctaatgacattgcagaagatcaagtaaaaagaatgaaggctcctaccgtggctcctcaacctggccctcccattaatcagccctccgtagttatttctgacgcactagcaaagttcattggaacagatgggacatttcctcaagatgatgcccagaaatacctgtgggattacataaaagcaaaccaacttgaggatgtcatcaatgaatcaatattatgtgattcaaaacttcaagagctatttggctgtgagagcattcctatgtcaggactatcagaaatgcttggtcaccacttcatcaagaaaacatagcaaatccccattaactgatctaggattgcagtgtggcagataggcctaacattacaatatggtgttcttgacagaatggacagcatagcgtatgtatttcttcaatgttatggattatgaattgtatctggcaaagatcagattatttgtggtagcctgtactttgttatgcgtgccggctgctgctgctgtgtctggtgtaacctctttactgaattcgtagagttagttcttaaatgtcaaaatgtcattgctgactatgtaaagttaagctttctatttgagtgccagattgtatccttaaaaaaaggactaatcccccccctcaatcattgtcaccaaaaatgaagact

SEQ ID NO: 1400 - DNA, 659 bp, Sorghum bicolor
  Clone ID: 30970754
aacccccattccccgtcatccccaagaccccaacagcaacaggagcaccagcggaagtagcagcagcagcaggccgccgccgccatgtccatccgcaaggcgctgggcgcggtcaaggaccaggcgacgatcggcatcgcgcgggtgacgggcgcggtggcccccgacctcgacgtggccatcgtgcgcgccacctcccacgaggacgcgcccccggacgagcgccacgcgcgggaggtgctccgcctcgcctccgccacgggcgccgcccccgcctgcgtcgcctccatcgcccgccgcctctccaagacccgcgactacgtcgtcgccgccaagtgcctcgcgctcctgcaccgcctcgccacctccaccgcctccgaccacgccgaccccaccgagggtggcaccgagggcggcgtcggcacgccgtccttcctccacgagctgctccgccccaccctcaccggccgccgcgcgggagagcccgccctggcgctgctcctcgacttccgcgacgacgcgcacgcggcgtcgtgggaccactccaccttcgtccgcgcctactccacctacctcctcgaccgcgtccgcttcctcgtcctgctcctccccgcgccgcgcttcgccgccgccgacgactcccgcgtcgcgggaccagg

SEQ ID NO: 1401 - DNA, 311 bp, Sorghum bicolor
  unsure (1)..(311): unsure at all n locations
  Clone ID: LIB3481-005-Q6-K1-B9
cgtccgaccacgccgaccccaccgagggtggcaccgagggcggcgtcggcacgccgtccttcctccacgagctgctccgccccaccctcaccggccgccgcgcgggggagcccgtcctggcgctgctcctcgacttccgcgacgacgcgcacgcggcgtcgtgggaccactccaccttcgtccgcgcctactccacctacctcctcgccgccatgtccatccgcaaggcgctgggcgcggtcaaggaccaggcgacgatcggcatcgcgcgggtgacgggcgcggnggcccccgnacctcgacggggcctc

SEQ ID NO: 1402 - DNA, 432 bp, Sorghum bicolor
  unsure (1)..(432): unsure at all n locations
  Clone ID: SORBI-28MAY03-CLUS23390_1
ngactgcagagcactcctccaagcttcagcttcagcttcagctccgtgcttctctttactctcctactacacgtccggtgccgttcgagcgtggtggtaagcttagaccagccatcgagggcaaagggcatggcggcggctgtgtccttctcccgggtgcgagctctcccgacgtggtccagctccgtgtccggcgacgaccaccacgcctactcctccgtgctggcgatgtcggtgtcggcgcggccccggtccaccggcgcgcggccgctgcggtcgccggcgcggatgatgggcaacgtgaacgagggcaaggggctgttcgcgccgctcgtggtggtgacgcgcaacatcgtcggccgcaagcgcttcaaccagctcagggggaaggcaatcgcgctgcactcgcaggttatcaatgaattctgcaag

SEQ ID NO: 1403 - DNA, 592 bp, Sorghum bicolor
  Clone ID: SORBI-28MAY03-CLUS23426_1
tttgctgttttggtgttgctgtacttctactctcactatttctttgccagtggtgctgcacacatcggagcaatgttcgccgcgttcctgtcagtggcgagtgccctgggcaccccatcgctctttgctgccatggttctttcgttcctctcgaatctcatgggcggcactacccactatggcattggctctgctcctgtcttctatggcgccgggtatgtcccattggctcaatggtggggctatgggtttgttatctccatcgtaaacatcatcatctggcttggggcgggtggcttctggtggaagatgattgggctctggtgagcaccacattaactgcgacgacattcctttgttttctgttgttttggtcgagtggggaaggaaaactattcccgaatttgtggtgtcacagatgccgctgtccccaaagttttgttgtcgacatgattgcaacccattcttttagttggtatcgatacatttgtttcgaaccttccggcagcgaattgcaaggccagggtgcagtttttaacttgcaatgttaattatagagttgtgttcaatggatcttggggatcgttctctc

SEQ ID NO: 1404 - DNA, 828 bp, Sorghum bicolor
  unsure (1)..(828): unsure at all n locations
  Clone ID: SORBI-28MAY03-CLUS23455_1
naactgctccagcaatacgctacgactgcctcaccatcgcatagacaacatatatagcatctcatcgcatcaagcagcttcctctcttaccatctccgcctctcttaccatctcaccatgctcgcccgactcgctaccctctccctcgccctcttctccctcaccgctgccgctcccctcgagaagaagcagcatggcgtgcaggtcatcgagacttgctctgtgtccggtgacgtcgccttgactttcgatgacgggccgttcaactacgagaatgacatctccaactcgctcaacggcgcaaaggcgaccttcttcctgaacggaaacaactacgaatgtatctacaaccgcatcgaccaggtcagggctctgcatgctgccggccacactctgggctcgcacacctggtctcacgccgacctgaccaccctcgactgggacggcatcaacagcgagctggagaaggtggagcaggcgttcatccggatcctcggactcaagccgctttacttccgaccgccgtacggctcgtacaacgacctcgttctccaggtgctcggctcgcgaggctacaagaaggtcttcctgtggtcggacgacaccagcgactctgacggcggtacggtccagcaagccaagtcgaccgtcgacagcgtcgccaacaactcgcccaaccccgcgatcatcctcatgcactcccccgagcctgccaccgcctacgacacggtgccgtacgccgtcgggcgtctcgaaggcgcgggctaccagctggtcgccgtggacacctgtctcggcgngaacggcgagtggccttacgagtatgtc

SEQ ID NO: 1405 - DNA, 1128 bp, Sorghum bicolor
  Clone ID: SORBI-28MAY03-CLUS23477_1
ctctgccgttccgcccgcctcgctccaccaccggcggccgcacgcaccgctgcctgctggcgtaggagcacaggaagcccccgcggccccgcccccgtcgaccgaagcctctcctctcgtcgagtgggcgtctatctctccttcccctcaggttcttgttcttcagtgcgcgagatcaatccactgaggcggtgggtgcagttaatttcctcaaattacattgggggagttcagctgaaccgcgtcaatcgcgcctgtgcgggctaggcatcgtaagagccttggctcgcggtggagatggggaaggcgacaccaagagtccgctatgagcctggaccagcttttgaggaggtcaaagaagaagccatgcttgacatatcaccagcagactcgacagagttttggttaattcagtggcctaaagaccagatagattttttggattttcatggcaaagagctttctctcaagctccgtagtgatggaaacatgggcagcttggaaagttcctcaggaaaatcttatgagcttgtgagctttgcagctcagaagccagatgcaactgtcttcctgccttcagggtcagaaacaaagcctgtggggaagatttcacggcgagtctctttagttcattatcctaaacctgaggaattggctaaaccaagttttgggagtcttactcctagcattaagaaatctgcaggttctaagaagaccatgtctcggttcactagtgcatcaaagaaccgcagtagccaaggttcagcgctttcactgggccaaaggagcgcagagccgacatccaaacacaagggaaagagaaaggatgaaagcagcctgggccactcaaatgtatcaggcaagtcctcgcaaggatctcaggctggaggcgtggggagcaacatggcctccaagatgccacaatcgccatcagaaaaatcacagaagaagaggaagaaggttaagatcgtggagtagtactgtagtagtgtcaacttggcaagagatcaatttcccttgaactatcagtagctgaggagctgtgctggaagttcacgttcaagtttcttcatgcatttctggtttcaaattttatccattgagaatgttttgctggagtgtgaggtg

SEQ ID NO: 1406 - DNA, 771 bp, Sorghum bicolor
  Clone ID: SORBI-28MAY03-CLUS23482_1
cccgtctcgcacctgctcctcccgtgacagcgacggcggcagcagcgccgagtgtaaggcttggctgccagcgaggccgccgaatcccgcggcttgtttgctccatgtctccagctggtgatccgagctccgctgcccggaggaaccccacaaaataaaaaaaaaactgctttcgccgcggccccacccatcatcacccaaccacctcaccggctttatataccccccagcgccagctacccatgtcacacgacacggcatcgcaccaccccgtcgccgccgcaacaggccaagcagcagcagcagcaccagcaccggcacacgaccccggcggcggcagcgagtgccggttctgcgagatgacgcggcagcaccatccgcagtgttcgcggcggctgccgaagcgcatcatcctggtgcggcacggcgagagccaggggaacctggacatgtcggcctacaccaccacgcccgactaccgcatcccgctgacggcgctgggcgcggagcaggcgcgcgccgcgggcctccgcatccacgacgtggtgtcgtcgccgggcggcaactggaaggtctacttctacgtgtccccctacgcgcgcacccgcgccacgctccgcgagatcggccgcgccttccctcgggaccgcgtcatcggcgcccgcgaggagtgccgcgtccgcgagcaggacttcggcaacttccaggtcgaggagcgcatgcgcgccgtcaaggagactcgccagcgcttcggccgcttcttcttccgct

SEQ ID NO: 1407 - DNA, 503 bp, Sorghum bicolor
  Clone ID: SORBI-28MAY03-CLUS23600_1
taccatcaaaaagagcagcatattcactaaaatcagtggaagaccttccggttctggtggtagcgggctccgaggatgctcttgtttctgtgaagtcggcacaagccatggcttcgaaacttgtaaattctaggataataactatatctgggtgtggacatctgccgcatgaggagtgccccaaggcgttgctctctgctctttctcctttcatctctacattggtaccctcacaagatttgttgcaaagactgtacaatatactcgttccttttcgttcttcttaagattttttttcccagtgtttccgtcctccacattgagtagacccctctagttggtgagtttgtatgagccagtgtagcgcaaagtagtagtggagcctgacccaaaatctcaagggtttgtagagctcccctgatctttttttgtcacatgtaatggtttcccccgaacgatttcaattaagcaagttgaatctgtaccgaacaacaaaccaaaac

SEQ ID NO: 1408 - DNA, 624 bp, Sorghum bicolor
  Clone ID: SORBI-28MAY03-CLUS23688_1
gggccgggaatgtcctggtagatgttatttagatcctcctccattcctcctgcagtcctgcctgccatcgtcaccctgcaggctctttcttgattccaagatcatgaaattcagaaaactatgaagcagctcgatctggtcaagtagctttcaggtctgggaaaatcttggatctggggcccaaaacctgttcttatgaactcagactacaccaccaccagctggccgccgcaccgcaagaaccaagccttgtctcggcccaaggcgatgccggccaagtgggacgacgcgcagaaatggctggtgggcatgtcgaacggcggcggccgcgcggacggaggaacccacggcggcggcggcgccagggtgaagcccaggaactcgaacgccgacgatcggcgcctcctcggctcgtcctcgcagaacggccgtgtgtcctgcagcagcgtggacggcgccttggagtacaacagcatggtggtggccgcgcccgcgccctcgacgccgccgcggcagaccggcggcgagggcgacgacgacgacgtggaggagaccaagaagatcgactgcatggtgcagcagcagcatgggcatgggcatgggcatggctcgccgcacaaggcg

SEQ ID NO: 1409 - DNA, 557 bp, Sorghum bicolor
  Clone ID: SORBI-28MAY03-CLUS2372_1
gcacgaggccttattacagataatgaaccacccaagttgagatttaatagagtggatgcctccaaaagaatgcaggatgttgtaaagaaattgcgactcgtgcgtcaagatgtttctggcattattgcaacattaggttcaaattggagcgtccgcccaaatattgcacagagtcgtcctatcaccacctctgaaagtatagaacagaaactgtatgggagggaccatataatgaatagcatcatccatgttatcacaaagagtgaacattctgctgaggtcctcacggtcattccaattgttggtccaggtggcataggaaagacaactcttgcacaacacatatatcacagtggagaagtgcaacaacattttgatgtcaaggtctggacatgtgtatcactcaactttaatgtgaataagctgctaacagagattaaaaaatatatccccaagattgatggtgaaagtagtaatggtactaactactggtgagttaattgggcaaagattgaaaaataagaagcttttgcttggattagatgatatatgggact

SEQ ID NO: 1410 - DNA, 148 bp, Sorghum bicolor
  unsure (1)..(148): unsure at all n locations
  Clone ID: SORBI-28MAY03-CLUS26390_1
taagcataatattttgatgacatacgcaagcaggctggtggatttattttcgctcaagaccggttcggtattacacaccatggccattttcagtacagagcagtgtcagccacagccgacagcccacagctctncatttttggggatc

SEQ ID NO: 1411 - DNA, 175 bp, Sorghum bicolor
  Clone ID: SORBI-28MAY03-CLUS26391_1
aattccacaggtgatcatgcgcccaagaatgtggagcgtcagacaaaagggagtgtgcactggcaattcgcaaggcgccaacttgggcatttgggctaaagtgagtttggttttgtatatatcgaaacaaggtagcaacttagtcccccccgttctgacagacctgaataagctg

SEQ ID NO: 1412 - DNA, 535 bp, Sorghum bicolor
  Clone ID: SORBI-28MAY03-CLUS23853_1
aaatcaaataattaagcgatcgatcatcatcaggattcaggaggccaggcggatcgacgacgacgagatgtcggactggggccccgtggtgatcgggctggtgctgttcgtgctcctctcgccggggctgctgatccagctccccggccgccaccacttcgtcgagttcggcaacctgcagaccagcgccgtctccatcctcgtccactccatcatctacttcgcgcttatcaccatcttcgtcatcgtcatcggagtgcacatcaccaccggcaactagctatctacctacctataatatcatatctcgattcaatcaccaccttgattgcttgttgtagattcaatcatataaatcgtcgatcctattcttcattcgcttctttctttctttctttctttctttctttcaaattcatgcatctgtattactacatcatatatacatgtcttcctacccacttctgactcctctctgtccttcatcagcatactagagtatactgtcgtgtatgtactatgtatagtacggtac

SEQ ID NO: 1413 - DNA, 1007 bp, Sorghum bicolor
  Clone ID: SORBI-28MAY03-CLUS2396_1
gcacgaggggcgctaatcctgtgcgtcctgggcttcatgtgtttctggtccgtacaccggaggaacaagaagcctggcaacggcaacaagccctgctgcgataagatcccggtgtcccaaatcccggacgtctccaaagagattgcggtggacgaggtgcgggagcagcaccacgccgttgtccacaacctccgtgtgcagcaggaaagccatcacacgctggccgttcaggagaagccccaccacgagaaggattcggggaagatgctggggcacctggttaggagcaagtcgagcgacgctgataacctgagccagtgcagctccgcggcgtaccagtgcgaaagggctgggagctcatactctggcgacgaaggtagctcgggcaatgcgaggaggcagtatgctcagtatgcgaccgtctccgcgtcgccgctggttggtctcccggagttctcgcacctgggttggggccattggtttactttgagggatttggagcatgcgacgaatcggttttctaaggagaatgtcattgcgtccggtgggtatggagttgtttaccgtggtcgcctcataaatggtactgatgttgcagtaaagaagctccttaataacatgggtcaagctgaaaaggagttcagggttgaagttgaggcaattggacatgtcaggcataagaatcttgtccgccttcttggatattgcgtcgagggaatacacaggatgcttgtgtatgagtacgtgaataatggaaatttagaacagtggcttcatggtgcaatgcgtcaacatggtgttcttacttgggaagctcggatgaaaatcgttcttggaattgctaaggcgcttgcttatttacatgaagccatagaaccaaaagttgtgcaccgtgatatcaaatctagtaatatactaattgatgaagaattcaatggcaagctttctgattttggattggccaagctcttgggtgcaggaaagagccatatcacaactcgagttat

SEQ ID NO: 1414 - DNA, 640 bp, Sorghum bicolor
  Clone ID: SORBI-28MAY03-CLUS23884_1
aaactccgcagcccaaccatttccagcctcagttaccccaggcccggcccacttccttccccacgccatctctctctctccctctcatcgccgccgtctcacataccgccgccgtcgtgcgcgtgcgccggaacgcccgcgaggatccctcccaccccaccgcccccgcggcccgcgcaggcagcggccgcagcttgtccgcgcgaagatgctggggttctcgaccggccagctgctggtcatcctcggggcctgctccgtcatgatgaagcctagtgacatggtgaagattgcgaggacggccgggaggatgacggggagagcggtggggcggctcatagtggctcgccggcagctggacgagattctggggcagtctgcagccacccaggttcataaggagcttaaagatgctatgacacaattagactcgattcgttatgaagtccagaacttatctagattaactcctgggcagtttatgatgaagcaacataatactggcatggctgaagcagggaaatctgactctgatgatggtcctacaactaaccaagaaaaatttcgtcaggaaattcgcagtataattcgtgatgaaattacaaactttgtgagcacaactgaagctagaaaacttgat

SEQ ID NO: 1415 - DNA, 735 bp, Sorghum bicolor
  Clone ID: SORBI-28MAY03-CLUS2405_1
cgtccgctccaccacacatcacgcacttcgcgccgcagcagaccaccacacatccatcgaagggggagggaggatgtggccgtcgacgacgtcgtggctcccgttcctgtacccgccgccggggtcggcgtacgtggcggcgatgtctgcggtgtcgctggtgtccatggcgaacgcgggcctcgccgagctccgcggcgaacacatggcctactccaagttctggcacgtcgtggcgggcggcgggaacaacaacaagcggggcggcggcggcggcggcacgggcgcgctcttgatgagaagccgcgacgggatgctgctggcctacgccccggcgctcctcgccgccgccgcgtccttcgccgtgccgggcgccgtcgaaggcgcgcgcgcgcagctcctcagcgccgcgctcgccgcccacttcctcaagcgggttctcgaggtgctgttcgtgcaccggtacagcgggagcatgccgctgggcacggcggccaccatctcctgcagctacctgctcagcacggccaccatgatctacgcgcagcacctcagccacgacctcccggaccccgccgtcgacatgctctacccgggcgtgctcgtcttcgccgtcggcctcgccggcaacttctaccaccactacctcctctccaggctgagagctcgaaccggagacggcggcggcgacgacaaggggtacaagatccccaggggcggcctgttcgggctcgt

SEQ ID NO: 1416 - DNA, 397 bp, Sorghum bicolor
  Clone ID: SORBI-28MAY03-CLUS2406_1
gcaacttgtgccagtccacgaccaccagcgctcgaaccaaactgctgtgtactatatgcgaggccaaagtcatccagaacacagacaggcccaaatgttccaagctgctgctcaatctgtgcagacacacactcggaaaactcagccacagacagtagttgaggtaccccaggtaaccagtcaggcaccagagttttaccctcaaccgcagcatcaatggcaacatcaaactggtcagcaggttcagtcccaagcaaggcaaccacaaccacaggttgtacagcagcagcagtacagcaatatccagcaaggtccagcacagatgattcagctgcaaacgtcctctccacatgctcatagcacaccacaggtcacagtagtatatcctccatatggg

SEQ ID NO: 1417 - DNA, 398 bp, Sorghum bicolor
  Clone ID: SORBI-28MAY03-CLUS2415_1
acgcgtccggaacgttcaaaaatggttgtagcacaaactgttgagactggagctcaaactgctgctacattaacagcgcaaacagagcaaatgaagagaattggtaatgagctagatactgtccacttttcactgaagaaagctagcaaactagtgaaagagattggtcgccaggtagcgactgacaaatgtatcatggcattcctctttcttatcgttgtgggtgtgattgctatcattgttgttaagatcgtccatccgaataacaaaaacatccgagacattccaggactggctccgcctgctcaaaactaccagaacaggagattattgtgggcagaagctttcataggtccgtgatgactgtaaatgtaggcttcatgcaggcaggtgcactg

SEQ ID NO: 1418 - DNA, 481 bp, Sorghum bicolor
  Clone ID: SORBI-28MAY03-CLUS24220_1
gcacgaggcttcctgcaaccggcgaacccatccttccggcggcggcgaagatgatcatcccggtgcgctgcttcacatgcggcaaggtgatcggggacaagtgggatgcatacctcgaactcgtccaggcggactatgacgaggaggatgctctgactgccttgaatttaaaccgttactgctgtaggcgaatgctgatgacccatgtcgacctcattgagaagctcctcaactacaacacgctggagaagacgactgggactgacagttaataagcgaacctggcatgctcgactgctagtccatcgcccctagtacccttcatcggacttttatgctgggtgtttcctaattcctatatgtccggacaacccttattgctgttctgtgttccccgtattctactcatgttttgctatgtgactgtgactggtcctgaatgaacaacttaatacagcaaaaaaaaaaaaaaaaaaaaaaa

SEQ ID NO: 1419 - DNA, 597 bp, Sorghum bicolor
  Clone ID: SORBI-28MAY03-CLUS24235_1
gaacacaacacacggcacactagctacatactagtagcaagcaatggagaaccctccgagcatcatagtgactcccattgctccagctgtatcagcgcagttcacaagattcaccttcagcaaactgtatattcgtcggactagcccaggcagcaaggagctaactgtggatggaaggccatctgatcatctgggcacaagaaatgtcagtgattgccccatatttgatggccctgggtccaacgccatcctcgtggctcgcatacagggaaccataacccaaataagtaacgcacacgaattatacaccatcgtctttgaggagaggcttaagggctccacgatcgtcaccgaaggaataatgacggaagggtctgatgaatgggcaatctatggtggaactggagtgtttgctatggcaagaggtgtcataaaaagaaaaaatcttgctgataagagtggtgggaatactgatgaacttaccatggaagttttctgtccggtgtttggctcataaaagcagtcaatttagtttgaatagcttgctgcctggccagctactacctgcttgatcgattatccttttagttcggttgt

SEQ ID NO: 1420 - DNA, 669 bp, Sorghum bicolor
  Clone ID: SORBI-28MAY03-CLUS23242_1
atacccgcggacccgcctcgcgctcgcgcgtgaacccccccgaactccgccaaattcccccaaacccgggccgcaagtcctcgccaaatcgcccccaaatcaaccggagccgaggccgacacaaagccgcgcaagcgcaacccgcggcgatggagctggcgtcgacggacctcgcggcgctgggcgcggcggacctggtgcgcgtctcggcgtcgatcccgcgcgcggctccgcgcaccttcgcgctgctcaccgcctgcctcgtcttcccgctctccttcgccgtgctggcgcactccctcttcacccaccccatcctgcgccgcatccagggcgccacccacaacgagctcgcgcagtggctcaggctcttcgcctaccagttcctctacctcatcgccctcttcaccttctccctcctctccaccgccgccgccgtcttcaccgtcgcctcgctctacgccgccaagccggcctccatctccgcctcgctcaccgcgctgccccccatccctgccccgcctcctccgcactttcctctgggtctccctcctcatgcttgcctaccacctcgtcttcgcgctcaccgtcctcctgctcctcatcgtcttcatccccaacgcgtccgagtccgccgcgccgccctccctctccttcgtcctcttcctc

SEQ ID NO: 1421 - DNA, 686 bp, Sorghum bicolor
  Clone ID: SORBI-28MAY03-CLUS2328_1
cgtccgcggacgcgtgggcgaccggatcgatcgacccagcgcgcgcatgaacgaacgaataacaagcgtaagcgatcgaacaccgacttgaatcgcaagctcgatcgcagtcgcagtcgcagcggcagcggcatggtgtcctggaagagaaagtgcggcggcggcggggagtcgcccgcccggggcgccggcgaggagaaggccgtcccgagagggcacgtcccgatgctgctcgccggcggcgcgaacggggaggaagtccggcgcgtgctggtgccggtgaggctgctcagcgacccttccgtcgcggagctgctggacatggcggcgcagcggtacgggtacggccagccgggggtgctgcgggtgccctgcgacgccggccacttcctccaggtcctcgacggcgccatgcacagatgcgggatcacctcagctgcctgaaatgaaatggctggggtctgagatggccatggcgaccaacgcgccgtcgcgcgccccatgaggcgacctagctatagcttgtacacacatagataatcctagagatgatttgttcgttcttcaatacattgattcatccattcaattctcttgatcttgatcaggatcggagtgactccttaacgtactgtaaacgcaacacaataccacaagtcaatctattagtagagctcgaacaggcc

SEQ ID NO: 1422 - DNA, 565 bp, Sorghum bicolor
  Clone ID: SORBI-28MAY03-CLUS23311_1
cttttccccccattgccattatccgaacccaagccgccccaggggtccgaccacagaaccgagcccaaaaatggcggccgcctcctccatgctcaccgccgcgtcgctctccttctccccgctcccagctccgcgcctcccggccgccgcctccttcgctccgccgcgccgcgcggcagccgcactcgtcgtgcgcgcggcggccgcctcgtccaagtccccggccgcggcggagacggccccgaagaagaagagggcgaccggcatcacccagccgaagcccgtgtcgtcggcgctgcaggcaatcgtgggcgaaccggttatcccccgcaccgaggccctcaagcgcctctgggcctacatcaaggagcataacctccaggatccttctgacaaaaaggtggtcatctgtgatgagaagttgaaggtcctgtttgctgggcgggagcgagttggattccttgagatcgccaagcttctcaaccctcactttgtgaagcgagaaggcactcccaggagctgagttggcctatggatggccacttgtgatcttgacagtgcgagg

SEQ ID NO: 1423 - DNA, 301 bp, Sorghum bicolor
  Clone ID: SORBI-28MAY03-CLUS2429_1
cgtccggttagctggctgttttttttaaaccaaaattttgaatgtcagatcctttgattttgtattatttatgaacagagaacaaatatagtataatcagaatagattatagtgattcatatataaaggacataaatatattgtaatatatcgatatcatctgaggaaaatttttggctagtccctaactaaattattgattccaattattgtaattacttaacagcctattgtgctcctgatttgagtagcatcagaataccatgaccctaaattctgggagcttcctatcttcattatg

SEQ ID NO: 1424 - DNA, 572 bp, Sorghum bicolor
  Clone ID: SORBI-28MAY03-CLUS24355_1
gcacgagggcgatgcgtcctccatgccgcatgggcggcgcccacagggcttccagctgagacacttgttgaccggtacgtgacagtgggtgcctactgtctgctgcgctcttgcaccatcgagcccgagtgcatcattggccagcactctatcctcatggaaggttcgctggttgagaccaactcaatccttgaagctggctctgtattgcccccaggaaggcggattccgaccggtgaactctgggctggaagcccggctaggtttgttcggaagctgaccaatgaggagatcatggagattccaaagctcgcaactgccatcaacgatctgatgcaaagccatttctcagagttcctgccttactctaacgcttatttggaggtagagaagttgaagaagtcgttctcgatccccctgtaagagtatgttgccaccctcgtccagctgagtgaatgaggaaataaaggttccccaatactagatgtttttgtattgaatcaaacttctactctgggtttgatcttttatgccgcaatttttttttggggttcaaaaaaaaaaaaaaaaaa

SEQ ID NO: 1425 - DNA, 720 bp, Sorghum bicolor
  Clone ID: SORBI-28MAY03-CLUS2436_1
cgcgtccgcgactcgactggcggcgccgcctccgcgtcgtgctcggcgccgacaagggcgtcgcgtacctccacgagctcgccgacccgcccatcgtccaccgcgacatcaagtccagcaacgtcctcctcgacgagcgcctcaacgccaaggtctccgactttggcctctccaagcccctcggcgacgagggccggggacaggtcaccacgcaggtcaagggcaccatgggataccttgacccggagtactacatgacgcagcagctgacggagaagagcgacgtgtacagcttcggcgtgctcatgctggaggtggccacggcgaggaagccgctggagcgcggcaggtacatcgtcagggagatgaaggcggcgctggaccggaccaaggacctgtacggcctgcacgacctgctggacccggtgctgtgcgcggcgccgtcggcgccggaggggatggagcagtacgtggacctggcgctgcgctgcgtcgaggaggccggcgccgaccggccgtccatgggcgaggtggtcagcgagatcgagcgggtgctcaagatggccggaggagcggggcctgagtccgcgtccaactccatgagctacgccagccggacgccgcgccacccctacggcggcgacagccccttcgccgactacagcagcgccgggttgccgtccgccagggtggagcccaagtgaatctaatatacagcaa

SEQ ID NO: 1426 - DNA, 654 bp, Sorghum bicolor
  Clone ID: SORBI-28MAY03-CLUS24376_1
gcacgagggcgctgactagcgcacaggaaaattggcgcaacgagccgcacggtggtgtccgccggccatcgggcttcctccatggacgcacccaggaactgcactggacgcacgattttagggcagctgcaactggcgccgcgcttcacttcgttgttgcgaatctcgagcagcgactgtggcaggagctcgccgccgcgggcgacgtgtggcgagcctggcgggtgctcagggcttggtgtgttcgctcgcacggcgtcactgaccctccaatgccaagcatgacgtcgttgggggcacgcgcagcaatttcaggttgtggtgcaaagtgcaagcggatgtgaagattgaaaagttgacatagtctacttagagtacttacgaagaaaggaaacaaccgctgttgcaatgcctaggtagacaaagttcagaactgcctgtgaaaaaagcaaaggtaggtagaaacaaagtgagaattgagagatgcaataatgtctcgctaacaagttgaagtaaacttcaagctacatgtaattcatggagaacagtgataaaagtttgaccacctttttatgattttgttcatgattcggatagaaatctgtcagcaaaaatacactactgcaacgacaaacttgacagcttattcttgga

SEQ ID NO: 1427 - DNA, 1014 bp, Sorghum bicolor
  Clone ID: SORBI-28MAY03-CLUS24405_1
gcacgagggtgactggttggaaggaggtgttggtggcccgtgcagcggcggactggcggcagggagagcgatgagcgcggcggcggcgagctcggtcaccaagttcatcaagtgcgtcacggtcggcgatggggccgtcgggaagacctgcatgctcatctgctacacctgcaacaagttcccgacggattatatccccactgtatttgacaacttcagcgccaatgtctctgtggatgggagcattgtcaacttgggcctctgggacacggcaggtcaggaggattacagcagattgaggcctctcagctacaggggggctgatgtgttcatcctctccttctccctggtcagcagggcgagctatgagaatgtcttgaagaagtggatgccagagcttcgccgattttcacctagtgttccggtagttcttgttggaaccaaactagatctccgtgaagacagatcttaccttgctgaccattctgctgcttccatcatctctaccgaacagggagaagagctcagaaagcagataggtgctgtggcatacatagaatgcagctcaaagacacagaggaacataaaggctgtgttcgacactgcaattaaagtagtgctgcaaccaccaaggagaagagaagttaccaggaagaaaatgaagaaaagttcgaatcagtctgtgagaagatacctctgtggaagtgcatgtttcacatgataaagcacagactcttctgcaattgtagtactggatttgctagatggtgtcagctctatgaatgaatagttcccaaggcagccactgggaacttctggttctcttctaccttccaatagagagctcttttgcgttctccagctgtgaaaaatgaaggttctagtttctacattccctacgagttgtacctccattaatatgaatggtgggctatttagtagtttcagcaaagtgtgaagtgacccttctatgcatgttttgtttccaaaaactgctgttgctaaatgcccata

SEQ ID NO: 1428 - DNA, 975 bp, Sorghum bicolor
  unsure (1)..(975): unsure at all n locations
  Clone ID: SORBI-28MAY03-CLUS24485_1
cgcggccgcgtcctccacaaccccaccagaaacggacgccaccccttctccgcctcgcctcgccccttctcgccaccccagccgacgcccgcgatgcggtcgccgccgccgacgccgccgccgtggcggccgcggcgcctccattccgtggtccccgtgctcctgctcgtcgtcgcggcgctggcggcgcggggcgtgggggccgacgacctcgcgagcgacgcgcgggcgctcctggcgttccgtgacgccgtggggcggcgcctggcgtggaacgcctcggacgtcgcgggcgcgtgctcgtggacgggggtctcctgcgagaacggccgcgtggcggtgctgcggctccccggggccacgctctcggggtccgtccccgcggggacgctcgggaacctgacggcgctccacacgctcagcctccgcctcaacgggctatccggcgcgctcccggccgacctcgcctctgccgccgcgctgcggaacatcttcctcaacgggaacaggctgtctggcgggttcccgcaggcgattctcgcgctcccggggatcgtcaggctctcgctcggcgggaacgacctgtcggggcccatcccggcggagctcggcaacctcacgcacctcagggtcctgctccttgagaataatcacttttccggcgagatttcggatgtgaagctaccgccgctgcagcagttcaatgtctcgttcaaccagctgaacggatccatcccggcctctcttcggtcgcagccgcgctccgcgttcctggggacgggcttgtgcggcggacccttggggccttgccctggtgaggtttccccttcccctgctccagcggggcagacaccgtcgccgacgcctgttcccagtggcagtggcggtggtgngtggcggcggcgccagtggcgacggcaccaacggtggaagcgggggagaaaatggccataagagcaagaagctctccgttgg

SEQ ID NO: 1429 - DNA, 465 bp, Sorghum bicolor
  Clone ID: LIB3476-022-P1-K1-A8
agctacgattacagtccatcgccgccaagaggttacaggagaagaactcgcagcccaagtcctcgtggtcgttatggaggccgtggtagggacctcccaactagtcttttggtgaggaatcttcgtcgggattgtaggcctgatgaccttcgtagaccatttggaaaatttggccgcgttaaagacatatatctgccaaaggattactacactcgggaacctaaaggatttgggttcatccaatactttaatcctgaggatgcttctgatgcgaagtaccatatggatgggcagatgctgcttggaagggaaattactgttgtttttgcagaggaaaacaggaagaagccttctgacatgagggccagggaaagaatgagtggcagaagccgttcttatgatcggaggttgcgctcaaggtcacctggttacagtgattcttctaggggtagatcaaggtcgcac

SEQ ID NO: 1430 - DNA, 456 bp, Sorghum bicolor
  unsure (1)..(456): unsure at all n locations
  Clone ID: LIB3481-009-Q6-K1-C9
cgtccggccgcgttaaagaatatatctgccaaaggattacctacactcgacgcaagtcttaagagtacctattgaagaaaaggaagaaatagaggtttaaagagatatgcaagttatgaagagtttcaagtgtatctaaacactgatgagtgcaagggaacctaaaggatttgggttcatccaatactttgatcctgaggatgcttctgatgcgaagtaccatatggatgggcagatgctgcttggaagggaaattactgttgtttttgcagaggaaaacaggaagaagccttctgacatgagggccagggaaagaatgagtggcagaagccgttcttatgatcggaggttgcgctcaaggtcacctggttacagtgattctcctaggggtagatcaaggtcgcacagcccaagccactcgcccgcacctaancnaaagcactattcaaggtcccc

SEQ ID NO: 1431 - DNA, 561 bp, Sorghum bicolor
  Clone ID: SORBI-28MAY03-CLUS24511_1
acaatccctacttccctggtggtgccatagccatgcccaagatgcttaatgatggagctgtggagtatgaggatggtactcctgcaactgaagcccagatgggtaagtatgtcgtatcattcctttcttgggcagccgagcctgagatggaagagagaaagctgatgggagtgaaatggatcttcctactatcactagcgcttctccaagctgcctactaccgccgcatgaagtggtcagtcttgaagtcccgtaagctggtcctggatgttgtcaactgaggactaccattatctttttttatttgaaatatgttgagccgttaaggagcattcaaaataatgaatttgtgatgtacaattttgccactggggctaggttccatgcctagaagttattttgttttctttactctgctgagctgcaaaagcatttcaccaagggagtacatttcacgggtttttttttttgggtttgcaatgcctcaatgttatcagcaatattctaacttaacagctgttgggagttgataaatgcttatgctatgaaatactacctaat

SEQ ID NO: 1432 - DNA, 251 bp, Sorghum bicolor
  Clone ID: SORBI-28MAY03-CLUS23754_1
accattcaggagctccccacatcgcagcccgccttgccgctcgcgcctcccccaccgtggcgctgtcccctccctcccctcacaaagcatcggcctctccgagtccgagcggacgcgagccgcccacccacgcgagacgcgacctcagggtgcctctctctctgcctactgctcccgctgtacctttccttccccatggccaccgcctgccgcctcgccgcgccgctcggcctcgccccgttgccccgcgg

SEQ ID NO: 1433 - DNA, 634 bp, Sorghum bicolor
  Clone ID: SORBI-28MAY03-CLUS23829_1
acgatcgccgccgcaatcactgccgctgcccctgcccctgcccctgcccctgccgtgggagacaagcgggcgtcccccgagccgaccgcgagctccgactcttcttcaccttcatcgtcctcctcctctgggacaccaaagcggaggaagagaggcgaggccgctgccgccaccatggccatggcccttgtcccgcccccgccggcgcaggctcccgtccagctgaccctcccggcccatccgtggttcgccgccggcccggtccagcagctagtgagctaactgatgctgtatcagcggggacgtggttgatggattcagctcagtgcaagaacagagcaacaagatgcgcatcaaacacacacactgctccaagaaacgcgtgtggtgagctcgacgaaatcgtcatcaggatgttcctggttcgcatggaattcgttcctccatggtcgctagtgtggtgttctgagagaagcttgtaatgtgtggaaccagaatcgtgtttgtggcgtcactggattggattcagatgagttgaaatcggaagcttctctgcgagaggctggtggtggtcctggtgcaaatttgcatcagcatttctagaatggatattattttttgctctttggggttc

SEQ ID NO: 1434 - DNA, 675 bp, Sorghum bicolor
  Clone ID: SORBI-28MAY03-CLUS23855_1
cttcttatatagtttgtctatcgtagattttttttgaggaaaaaaaaaaaaaaaaaaaaaaaccacagactactactgcttcgagtcacgacccacggacagtcgatcggatcgatctcccctccaaatcattccaagctagcgagcctcttcgtccatcagcgcaccgggcgttctctgaaactccaaatcttggattaaatcatcagccatggccaagcaaaagatcgtgatcaaggtgccgatgtcgagcgacaagtcgcggtccaaggccatggcgctggtggcggcggcgggcggggtacactcggtggccatcgccggcgacggcaaggaccaggtcgtcgtcgtcggcgagggcgtcgactccatcaagctcaccaccgacctgcgcaagaagatgggcgacgcgcagctcgtcgaggtcggagaggacaagaagaaggaggagaagacgaagcccgaccccgtcgccgacgctgtggcagcctactacaacagccagtactactaccactacccgccgccgccgccggcggtcgccgtcgcctacgacccctactcgcggccgggcagcacctgctccataatgtagactactacagcctgtgcatatgtctctaatttaattaatgaaaagggaaggccatgtgttgtgtaaaaaaaaaaaaaaaa

SEQ ID NO: 1435 - DNA, 566 bp, Sorghum bicolor
  Clone ID: SORBI-28MAY03-CLUS24547_1
gcacgaggcaccatgctcgtgtccggtggcctggcgggcgtcgctagctgggtctgctgctacccgctggacgtggtcaagtcccggctgcaggcgcagggcatgggagcgacgcccaggtaccgcggcgtcgtcgactgcttccggaggagcgtccgggaggaaggtctccccgtgctgtggcgcggactcggcaccgccgtcgcccgcgcgttcgtcgtcaatggcgccatcttctccgcctacgagctggctctgcggttcttggccagcgggagtggccccaggctggtcatggaggagaactgagctcgcgtgctgtgccagattctgcaccgttcgttcgtgcaaccataccctaccccatttgtgagattggaccgtgttgtacataggctagtattcattgggatttgggagtggatgggggagtctcatgccatgggaatgagctgagattcgtagagtactgtagctgcaagcttcatacaaattgaagcttgcgtctttgatgatgatggcgatcagttaccccgatagttggggaaactacagtctgcagtaca

SEQ ID NO: 1436 - DNA, 708 bp, Sorghum bicolor
  Clone ID: SORBI-28MAY03-CLUS24565_1
cagccaccgccaatgccgccaacaccaactcacagtttcacagagacattacaccataatcaccactggtcaccaccactgccatcagtgctgtcatcaccaccacgctacttgttcgagatgtcgcaccatcaacaccacaagccacctccaccaccaccagtaatgtcactgccatcgagaagtttgtttgagacgtcgcactggcatcaccacaagtcaccaccaccaccgccagtgctattgtcaccaccacgccgtttgtttgagacgtcacaccatcatcatcaccacagttcgccaccaccactaccacctatgccattgtcaccatcacacaatttgtttgagacgtcgcaccatcatcaccactcgtctccagcaccaccacgaccaccagtgccatcatcatcaccacgtcgtttgtttgagacatcccaccatcatcatcacaagtcgccgccaccaccgctagtgatatcgtcaccaccacacagtgtgtgagacgttatcaccaaatcaaagccaaataaagctatagtctgggacatgctactgctacaacaacagattctgtttgactcatcattgcaagaacatgtgtgcgaggaaaacggcattgaactcaaataaacctacttgttgcatacatgaagttgcccacattaagcactgtgtagtgagcatttggttgatgcggactccaat

SEQ ID NO: 1437 - DNA, 651 bp, Sorghum bicolor
  Clone ID: SORBI-28MAY03-CLUS24579_1
tggcacactgccgccgtaccacaaatcagaaccagtgcctcaagagaagggacttgttgaaaaggttgttggtcgtacatttgattcttctgtgctggaaagtcatcaaaacgtcttccttgaggttcatacaccttggtgtgttgactgtgaagcgataagtaaaaatgttgagaagttggccaagcattttaatggtttggacaatcttaaatttgcacgcatagatgcttctgtgaatgaacatcccaaattgaaggtgaacaattacccagggctattcctttttcttgctgaagacaaaagcaagccgatcaagctttcaaagaaatcaagtgtcaaggacatggccaaactcatcaaggagaagctgcaaatatcagatgtggagacagtagcggctcctgacaatgtcaaggatgatgtggagacagtagcggctcctgacagtgtcaaggatgagctataacctgtagtagacttcgccggcggcctgtgtctgagtaatccaaggatccagtgacgggaaaattgcagcacgtttgcttgttttgcgccaacctgataacagaactcgctttgttcgtgtgctgtaacttgtgttaagttgacaacagacatggtatatataataggtacgcaaatcaaacg

SEQ ID NO: 1438 - DNA, 642 bp, Sorghum bicolor
  Clone ID: SORBI-28MAY03-CLUS24583_1
gcacgaggcagaaaattctagcaggaaagtcatatttgaaattgaggaacttaaagatgtaaagcctggcaatagggcagataacagcaaaaccttgggacaagtagctacggatgaacaaaaccaaatagaagacagacttaatcatgagcgcttgcagagtctccgcctgaagcaggaactagctgatgtggagaacagaaatgcagaacttactgaggaactccacttagttcgagataaactttctatcgagcaaactagggcttcccaactcgagaatgaagtttcagagattcaacaacgactacagaagatggatatcctagaaaaggagtttgaatcacttcgcagtgaactggacagtactgtatccgaagaagcagcttcaagtggcaaccagctgcaccgcagtcgcagtcggggcttctggaggtggaatgggtgaatgaacgcctcaaggctcaagtaggagtattgaagagaatacacttccaaagagttgccattcttttaaattgtctttcacaaaattttgaaggaacatgatatatgaattcaggatgatactagttcggaagcatatacaggatctaaacaaactgcacctccatcaactgtgaaaagcatcttatataaagt

SEQ ID NO: 1439 - DNA, 689 bp, Sorghum bicolor
  Clone ID: SORBI-28MAY03-CLUS24586_1
tgatcgagtcagaaagccttcagatcatcacaagctaaagtacaaatccaggtcacagtttagtacaaaggtgatcttgaaagatggccaaattagtttaatgggtgagggctctccaagcattgctggatcgttgactgggaagccatctgatggacgtctgataaatagttacaattgtgacttggaagacctcccaatgatgcttctgcagcaggttgccagtcaagtaatccactggctccatgatgaagcgatggttcttgggatgaatgtgactagagatttcctgtgcctgtactttgaccttgaccaaggcgaaacacttggcctagtggcacatgttgatccggatgacacatatggctgcatctcatggtacctcactgttgatcacccaatggaggaggggaagatgtcagcggatagtccagagttagagaagcgtaggtttttggggtacctttcactggaagtgctttactctaccctgatggacctgataaaattgtgcagcacaggtgtccagcactgagactcggagtgatcaaattcacgcctcttgatcgacatgagtggatgagatgatgtatattcgtactgtatttgagagccatgtaaattggggcattatgtgcacctgatgtatttgctatgtgaacgataatgcattgctagctttttttgtt

SEQ ID NO: 1440 - DNA, 748 bp, Sorghum bicolor
  Clone ID: SORBI-28MAY03-CLUS246_1
attacatatacatttcaaagttcaaacccaaaccattaattaaccataccactacttacttaggctacgtagtactttaaccaacattgacatttgacagcactggaagtaattaacctgtttcaggacccaccacgtccgtttttttttttttttttttccatatgactgtagtatatatgtatccatcacttggactagtacgcatgcaacatgcattgcatgcacctactcgtacgtttcagagtcgtcgttcaattcattcctgcagctagctaatatatatacttaatattaggagacctccaataatcgatcacacgccctcgatcggattcagatcagatgcatgtgccatgtcttcttcgatcgatcgtccagaggcatatatgcatgcaagtccttaatttatttaggagaccttgaatggcttgtagcccttgaggtccttgacgagcccctggacggagcccgcggcggcgagcagcgacacgaagaggcatgcgtagctgagcacgttcatccacgtccacgccggcgagaatcggcgcgtcttggcctgcgccatgtacatctggatggggaagtagacggtgagcggccagaaggagacggcgccgatgagccccaggaagtcgttgaagaaggggaagaccatggcgacgagcgcggtgaccacgacgtaggcggtgcgccacacgaggcggaacgggctgacggagaacagtccgccggcgacggtgtgctc

SEQ ID NO: 1441 - DNA, 544 bp, Sorghum bicolor
  Clone ID: SORBI-28MAY03-CLUS24630_1
gcacgagggtgatctgtcgtcttcgtctccggcggagcaaagcggcggcgaggcgggagatagagaggaggagagctgacaggtgagagcgggatggggtacctgtggagggtgcgtctgtcgtctttcgctgccggcgcagcgacggcttcggcggcggggttcttcctcatctacaaggaccacctgatcgcccgcgccgccatcacccgccaggtggaggacattaaagaaacttctgaaaagcattatgcatccctaaataagaggatatcggcactggaaagcagaaaagaatcaggaactatcaaagaggcatcagattaattctatgagttgggcttatgtcatggttacgtctgcccaggtgtttttgattgctgcatgtggtataaactgcagcgttttaagttgtactattttgttgttggaattctatgaactctgaatttgaattgtgttctgcatgtctatgtcttctttttgagatggacaaagatcaaataaaatacaacttttcttgattaaaaaaaaaaaaaaaaaa

SEQ ID NO: 1442 - DNA, 761 bp, Sorghum bicolor
  Clone ID: SORBI-28MAY03-CLUS24844_1
actaccggcgacggcacaagcacaggatgtccagtacctgcagcaccatcagatggcgccacggccgccgccgcgggacgcgacgccgtacccgttccctcacctccctgcttacagcagggggactctgggacacgccgcggcactccagcagatgccagtgccacagcagtacgtgtgcagcccggggtacggcccgcgcgccggcctcgccaccgccgcgacctcgtcggcgatgatgatgaagcagctgcagcaactcatgccgatgcagcagcagcagcagatgtggcagtaccatgtctctcagtaccagcagccgaggccggaggctacgccttccccggtgtcgtcagcggcggcagcagcagcctggcatggcatttcgtcgtcactgcggccgatgggcatgcttgctcccccgccgatgccgccgtcgccacggccgccgcagatggagcttttctgcgcgccgtaccaaggtggcaggcagcctcagcagctgaggttgatgtagctgggcacccttctgctgctgattagcttattggtgctacatattcagacgtactaatttatagagaagtatatactacttagcagtaaaaaaaatgggatgttgcaaaaaaaaaagagagatccataaaatgttaccagggtttttatatgcatggtaccagaggagaccgaagagggagggctcaactgtaattaacaggtttaatttctggtgcagttgcagaattaatgtagtagtagcc

SEQ ID NO: 1443 - DNA, 644 bp, Sorghum bicolor
  Clone ID: SORBI-28MAY03-CLUS24240_1
gcacgagggagagacctagtctcgacagggatgatgacggcgacaggcacaagaagaggaagaaggggaaacacagcgacagggacaaggacaaaggcaaagagagagattcgaaggataggcattctaaggagaaggagaagagcaagagaaaagacaaggatgctgtcttcaaagaaatatccaaggatgactactttgcaaagaacaatgagtttgctacctggttgaaggaagaaaaaggcaaatatttctcagatttgtcttcagagtctgctcgtgatctgttcctaaagtttgtgaaacaatggaaccaaggaaagctgccatcacaatactatgaggggattacgagtggcccacgttcagcacacaattggaacatcaaaacatgatacattttctgcttcatcgggtccttcagcttgagacattttgtgttctcctggcgagattttcttatagttgcatgtggcaatggcttttaatgttctaggttattgtatttaagctgatgtgcataatgtctaaggcaggacggtagatcgtgggtctctcatagtatcccgggtttaacattaatgctagtttttcaattattactactgttagatcctgacaatgagcaaacatactgtttctgg

SEQ ID NO: 1444 - DNA, 224 bp, Sorghum bicolor
  Clone ID: SORBI-28MAY03-CLUS24265_1
tttggattcaggcggcctaacacattggtctcacaagatattagtagatctgctccctcacttcgtttactcagctaccacatcaattctcagacatttatacagagtaaatatatgttgtaaatgcagtcacacagtctctcagaaacacatagagtcacattattaactcaataaatcaacatagtccagtgactaaacactccaaaaaaaaaaaaaaaaaa

SEQ ID NO: 1445 - DNA, 697 bp, Sorghum bicolor
  Clone ID: SORBI-28MAY03-CLUS24706_1
cgggggcaagcgcaagagcgccaaggtgatgcagctggacggcacctccttccgcgtcaagccccccgcggccgcggccgacgtgctgcgggaccacccgggcttccagctgctcgagtccgaggaggtcaagctcctgggcgcccgcgcgcgcccgctggcgcccgacgcgccgctccgccgcggccggctctacttcctcgtcgcgctcccgcgccgcgcgcccgcggggcccatgcgccgcgcctggtcgggcaacctcaacgtcggggcccgcgagcggctcgagtcgctcaagctcgcgcgccgatccacctccgacctctcctcgctccccgcccacgccgcctccgcgtccgcccccacctccccgctccccggccgcggcgccgcctccccgctgcccggcgccggcggcgctacgcccgtgcgcctcaagatgcggctccccagggcgcaggtggagaagctaatgggggagagcaaggaccccgccgaggccgccgccaagatcatggagctctgcggcgcgcacgccagcgcccgggtcaccccggagcgcccgcccgggatactgcggagccctaggttcgccaagacgcccgagtggggcgccgggttcatgctgccggcgccggcgccggccaagacgccgcagcggtggcccacgctgccacgcaccaacgagaaaaaggca

SEQ ID NO: 1446 - DNA, 959 bp, Sorghum bicolor
  Clone ID: SORBI-28MAY03-CLUS24711_1
gcacgaggatcatgtgcagcacactgttgctcctgttgaaaatcatgtgcagcaccaagatcctttggaatataaggctggcaatgtcatttatgatgaaacttatccagaagagcatattccctcattccccagttcaacagacgtcaaaagggattcacctcttgctcctccccaccctcctttgtcgcctacccttcaagaacctgtggaagaagcacccaagacatatgcttcagtgttgcgaagaaatgtgaaggcaacgatggcaactgcagagacacagcagactcaacagttggccccacaggcacagtctgccccagtgcaggaaaagtctaacttggacaaccaccgggctgttagcacccctgaggatgaagaagagtttctttcggtttatgttgggaatctttcgccatctacttcggtctttgatcttgagaaagtgttccaggcttttggaagaattaaacccgatggagttgctatccgaagccgcaaggaggctggagtcttctttggctttgttgagttcgaagacatgtctggtattcagaatgctttaagtgcatctccaatagagttaaatggccgtttggtacatgttgaagagaggaggcctaactgcggattccctcgtggaagaagaggccgtggaagagctgatttctcaagggaccaagctggtgggagatacgacggggagtatgctactcgattgaagggaactgggcaccagaaaaaatctggacgccagtatgacagttactactagtttcgtacctgctctgctggtaaatggccgtgtaccattggcgttcaccacctggtgctgttctggccatagttttgctgaaagtcacagtgatgtcgagactagtatttctgttcggtacattgggcggtgtcttttttggggatgggcttctgttaccatttgtgcgtccagtagtttt

SEQ ID NO: 1447 - DNA, 754 bp, Sorghum bicolor
  Clone ID: SORBI-28MAY03-CLUS24727_1
gcacgagggaaaagagaagaggtgctgcacattgatttaccaaggatgtctcgcataacagtgatgcaacagctctcgattttgcggcaatcaggaggtgaaattatgcagaacatgaatgcaagtgatacaccactcgatattgagcccttgactacagcggatatgggggaacatgttgtctgcacgccaagacaaattctgttgcatccagcatatcatggtggatggaaggttcttcgcagctgcagggaagatggcagggttgatttaacatacaagcataagacgcatggcagatttcgctcaaaaaaacaagttcttaattatctcgattgtctgttggaaaaacaaaaggagtcagctgatccagctaagcagtgttctggtgtttcccaggctccgtctttccagccataccagcagggatacccatctactacaagctcatactcctcaggtgggccttccctgaagccgagttcaacaatctaccctccatcatactactacaaggcacccccgccaccgcagtttcagcagcagcagctgccccagcagtctccacctcgcgagcagtaggtgttgccttctagccattgtcgttgtcccagcttatcagttgtggtcctgatcatctcatgagaaagagatacactttggttggtctttgcctcgtgggatgtacaggggctataatactttgttgtgatgcacttgatacttcagtctacttgtgggtcatccatacgag

SEQ ID NO: 1448 - DNA, 578 bp, Sorghum bicolor
  Clone ID: SORBI-28MAY03-CLUS24731_1
gcacgagggcctaatgccttggcctcttgcacctcctgcaagttgccggcaaccgagaagctaccactagtagctgctcaggcaggctccgctcagctcaaaaaggcgctcgggtttagtgcacgaaatgagcagcgcgctgcccgcggcagattgggcgtcgtcgacagggaggacgaggacgaggagcgagagggagagatgttgctgctactaggattagccacgggcctcgccgtcgccggggaagccgagaagcagcagcaggacggcggcggcggggcggcgtcctccgggggcggcggtggccatggttccaagattagccccgcggtgctgttcgtcgtggtgatagctgccgtggtgctgttcgtctcctgcctgctgcatctcgtggtcaggctattgcttaggcgcggccgtgcgcgggcccgagccgaggccgacggtggggtggacgcggcgggcggcggcggcggcggcggggaggagtcggcgttgcagaggcagctgcagcagctgttccacctgcacgacgccgggctggaccaggacgtcatcgacgcgctcccggtgtt

SEQ ID NO: 1449 - DNA, 538 bp, Sorghum bicolor
  Clone ID: SORBI-28MAY03-CLUS24736_1
ctgctgtcaaggtgataagaggctgcttgtgtatgaacatatgtgcaatggttctcttgattcccatctcttcgaaaggaatgatgttgcggctgtcctacactggagcaccagatatcagatagctattggggttgctagaggattgtcctacctgcatcacagttgtcaccagtgcatcatacactgtgacatcaagccagaaaacatacttctcgatgaatcctttgtgcctaaaattgcagactttgggttggcatcggtcataggcagggattttagccgggttctaactacgtttaaaggaactatggggtatcttgccccagagtggctcagcggagttcctatcacgtcaaaagtagatgtttacagctttggtatggtactgatggaaatcatatcaggaagaaggaatgcatctgtggtatgcagtaacaatagtaggggccatgttacttatttccctgtgcatgccatgagccagcttcatgagggggatgttgagagcttgatggatccaaatttacatggagac

SEQ ID NO: 1450 - DNA, 598 bp, Sorghum bicolor
  Clone ID: SORBI-28MAY03-CLUS24764_1
gcacgagggcagctcattttaaaaagtctaaggtggaaaggaaaaggtctagctaagagtgctttggattcaagcaagcctcaaacagattcattggatgggcaagtgacgaatggtctgaagaaagctggcagcctaagattttacaaaccaaaattcaaatatattttttgtgatatggatggcacactgctcaacagtaaaagtcaagttacagcaaggaatgcagaagctctaagggaagctaggtcaagaggagtaaacatagttattgccactggaaaggcacgttctgctgtgattgatgctcttagtatggtggacttatctggaagaactggcattgtttcagaatcatcacctggtgtattccttcagggtctgttggtttatggtttggaagggagacagatttataaaagaaatttggaccaagaagtatgtagagaggcactcttatattctttggagaacaagataccattagtagcatttagtcaggatcattgttattctgtgtttgaccaccctttggtcgattctctccattacatataccatgaacctaaggctaaaatagtgtcatctattgatcagc

SEQ ID NO: 1451 - DNA, 810 bp, Sorghum bicolor
  unsure (1)..(810): unsure at all n locations
  Clone ID: SORBI-28MAY03-CLUS24812_1
ggacaaagctaaggaganagagtgtgagaggaaggaaaatttgtaccctagcctggttgttgaattgtgcagtttcgaacatagaattgtcttccaggaatctggagcaaatttttatacaccggccccagtatcgttatccaacgagctggttactgtatgggatccagaacttggacgaaccaatccatctgagcacaagcagttaaagcttgctaggagcttaactcgtgggatagttgatagagatctaaaaccaagctcaaatgagcgaaagttactacaaacaattattaagtttcctcctacacgcactttgcacgtggatgagaagcagttggtgtggaagtttcgtttctctttgatgtctgagaagaaagctctaacgaaattcgttcgctcagtggattggagtgataaccaagaagctaagcaagctgttgagttgattggaaagtgggaaattattgatgtggctgatgcactagagcttctctcacctgattttgaaagtgacgaagttcgtggttatgctgtcagcgtacttgaaagggctgatgatgaagaattacagtgctatttactccagttagtgcaagctcttcggtttgaaagatctgacaagtcccgtctagcactctttcttgtaaaccgtgctttgtcaaacattgaaattgctagcttcctccggtggtatatattagttgagcttcacagtcctgcatatgcaagacgatattatggcacatatgacatgcttgaaaatagtatgatgaaattggttggtagggaggatggggatgaagatgg

SEQ ID NO: 1452 - DNA, 743 bp, Sorghum bicolor
  Clone ID: SORBI-28MAY03-CLUS24520_1
gcacgaggcccactcgtgtgcagcgcctgtgtttctctgtgcgtgtgacgcctgccagcagagggccgtccatgaaggaccgccgtggcagctccggcggcggcggcgaccgcttcgccgtcttccccttctccatgggctgcatgtcgcagtccgccgtgtccgtcgccgaccccagcgagaagaaggcgcagggggacccctcctcctcgtcgtcctctgctgccgccgccgtcacgaccgccaacacggcggctcagggttcatcagaagaaggcgccgtgaaggcggcggcggcgacgccggggctcgtggcgaccggggtgtcgaggctgatgaaggggatccggagcctgtcgcacatgttcgcggcgtacgacggcgacgaggaggaggaagaggagcgggagatggtgatcgggtaccccacggacgtgcagcacgtgggccacatcggctgggacggccacaacaacacggttggcggcgccggcgccgccatggcgagcatggtgaacgccttctcgctgccctcctccctctccctccaccacctcgacatggccatggaccgcgccgccgcgcacgcctccgcctgaacctgacttccgcgcagctccgtcgaaggctacctggtgccgccgccgccgccgccgccgccgtagctagtagaatttgccattgattgcgttggttttggttgacacgtacgcggagaaggaaggacaagttgatgaatcgac

SEQ ID NO: 1453 - DNA, 1005 bp, Sorghum bicolor
  Clone ID: SORBI-28MAY03-CLUS24526_1
caggagtgagatgttcaatccctgcaaagaagactctgcgtctggattccgaatagaaccaccccgaccaactcctgttactgagtcttctgaagacccacaacgcgcctacccaaccaggatcttccattctggtcctttagttaatcagagccagccatcaaaggctggaggtggtaaaaatggtgaacttcaggtccctggtgttgcgaatcaccctgtgcttgtgtcaacaagatcaggtctccgaacggacgatagcagcaggacaatggttgctcaagctgaagcatttgctcatgggcggaggctgtcggagtccatcaatgagcatttcagtaacagtgggaagtacgatcaagtgttcccgaagaaggatgagaggaacagcagggctgatggagctattggctatggatcgaaaggtaacaagatccaccattctgggcccctgacctgcccttcaggcaacgtcgacgagatgctgaaggagaacgaccgacaaatccaagaagtcttccggcgaacccgagtggagaagtcgagagcgaggagggaccatggacatcaccagggcggcataagacctggcgatttcggcgccatcccagtcttcccttccagccgctccagctatcaggccatccagcagtgaggcgctcgaacaagagttggaaccttgagttgcttggccccgtgctgttttcggggggatatagaagcgcacgctatcctctgctatgctatgctatgctatgctatgctatgtacagggatgaagaaagcaacaccccgtgtagtgggcatgtgtattggagagactctgaaggaaagaggggaggtgatttgtttattggcggcgattctggttgtctcggtgacggaagtcatgtattgtcaggtggtttcgaaatgtttgctgcaactgcaatgcgatggtaggtgtatctctcagctcgccaaatctgaaactgaaaacccaatgtatgtatgagtcgaaaattg

SEQ ID NO: 1454 - DNA, 517 bp, Sorghum bicolor
  unsure (1)..(517): unsure at all n locations
  Clone ID: SORBI-28MAY03-CLUS24545_1
gcacgaggcttcctcctcgccgcggcggagttcgcggcggcgacgcggtcgccgtcggctttcgtccagaacgccatctactccaaccgcatcaccatcttctccaagacctactgcccccactccatgcgtgctaagcgtatatttcgagatctcaaggaagacccatatgttgttgaactagatacccgagaggatgggcgtgacattcaaaatgttctcctggacctagttgggcgtcgtactgtgccacaggtgtttgtcaatggccagcatgttggtggcgcggacgatacagtaaatgcactttcaaatggacagctcgagaaacttcttgggaagagtcagtcacaatgatggatcactggacaagcttgcactgtcaagaacacgtgagtatatgtatgggagngggtgttcttttctgtttagggctgacagaatgtgtgagcatggtagtgttgcgacaaccatctgtactgctggatttgtgtgttctcttcattgcatataattn

SEQ ID NO: 1455 - DNA, 681 bp, Sorghum bicolor
  unsure (1)..(681): unsure at all n locations
  Clone ID: SORBI-28MAY03-CLUS24944_1
cagtgacggcagcgccacagttatgacagctgatggtgactccccagataaaatccaaggcaggagccaccaaagccctcgggtttcaggatttcagtattctcccagcccacagaggcaaaatggttcagcttcagagagggctatcaatgggtttgattcaacaatggatgcaaagcgtagggccagccctgtaccagcacatcataattccaagcagatgaacaacaaccataactctgctactactacgtcatctgctccagctaaagtgacaagggagcaaaggcagagtcttttggaccttgacaagcttgactctgctaggaagaggctccaggagaattatcaagaagcacaaaatgccaaaaagcagaggacaatccaagtgatggacatcaatgacataccgaagccaaaaaacagagacgccttcatccgcaagagcgccagcagtgggctcccggcgaggaaccgataacctagccttcatcggctggacatttgcgccacttgcaaacttgttccctagagccgcaacggggaaagagaaagaagcaaacggtctcttgttcttgttccccagtgtcttgattgcctaggctttacctccagcgtaatattgtcagaagtcaggtacataagcgtgaactcatatgaggttntcgaggagaaagaaag

SEQ ID NO: 1456 - DNA, 470 bp, Sorghum bicolor
  Clone ID: SORBI-28MAY03-CLUS2495_1
gcgtccccgcccagtgcatcaagcaggacgctggggagcagcgccatggctctctcctatgcggttttgagcacctcaccgcccttgaggcaacacaccagcagagatctgaagctggattcactgagtactacaacattgaggcaagaaatgagttccgttgtgccggagtgagcgtgaggcgcttggggggggagagcaagggcttagttttaccaatgtatgctaatgctcacaagcttgtctacatcgtccaaggtcggggagtgtttgggatggcactgcctggttgtccagagacgttccattcagttaggtctccctttgagcaagaggtggcaacagctggtgaggctcaatcatcaatccaaaaaatgagaaacgagccccagcaactttaccaattccaccaaggtgatgtaatcgcagtgccagctggagtagcccactggctatataacaatggtgat

SEQ ID NO: 1457 - DNA, 503 bp, Sorghum bicolor
  Clone ID: SORBI-28MAY03-CLUS25009_1
gcacgagggctatctcggcaccttgcttccctgcccatccaggccaagcacccggatcaactgcatcaggaccgccatcaagcggaacatggaggtccagaactacgcctacgccaagcaaatgctcgacctcctctactccaaggcgccccccacgaagcaggacgagctcaagagcctgatcgacatgtgcgcgcagaggggcctgacgaacaaatccatcgacccgttcgaggacccctcgcagttctgctccgtgacgctcagccggctatcgaccatcggccacgacgtgtgcgacctctgcggcgccaagttctcggcgctctctgcacccgggtgcgtcatctgtggcatggggagcatcaagagatccgacgccctcgccggtggacctgggcccgtgccgtcgcctttcggctgaaaagctcgagagttttccttcctccctcatcggtcctgtttttgtatatctataatatagtgtgcagttttgcatccct

SEQ ID NO: 1458 - DNA, 948 bp, Sorghum bicolor
  Clone ID: SORBI-28MAY03-CLUS25015_1
gcacgaggcagcaaactccagtccccacgcacttcgtctctttctacgtgcaacaacgtaggtacaggggtctcacaaaaaatcctcgattacataccttcacaccgctctgtgagggagcctcatcgatcagctaagcaaaatgaaggtacgcatacgtaccatagccggtgctgatctttttctcggctcaaacgctaacacatacacacgtcgtcgatccggacgcgcagcaaaagatcgtgatcagggtgtgcatgtgctgcgacaagtgccggtccaaggccatggcgctggcggcggcgacgtgcggcgtcgactccgtggagctcgacggcaaatacagggacgaggtggtcgtcgtgggcgagggcgtcgactccgtcaagctcaccagagcgctgcgcaagaaggtcgggcacgccgacctcctgcacgtcagcgaggtcggcatcaagaaaggacaacaagaagccgtcggacaccgcggcgccatccaacccgccgccgtcggccaaacccgccgccgccatccaacccgccgacgccgccgaccacggcgccacccaacccgccgacgccgccgcagcaggtcaccttcgtctgccaccactgccaccctgtctgctacggatactactcgtgctactgctactgccaccgccactagctagacgcggcaaggacgagtggagactggagaccataacgcagagacgacgcgtaccaacggataggatccgagtagtccatatttttagtttttctaccagtaatcaactctatatgcgttgccatgcatgtaatgtgcaacttgttacgtggttatataaaccagtacctagctcgtgtcaataataatgatgtaactatatttgttagatttagtttgctcggactttatttcaactaaattaataagcaaattcgaagtacccataataaata

SEQ ID NO: 1459 - DNA, 780 bp, Sorghum bicolor
  unsure (1)..(780): unsure at all n locations
  Clone ID: SORBI-28MAY03-CLUS25058_1
ctccaacggcccacgtctcggtcggtctcaagactcccagaaatgctttcccgtctcctcccgcgccgccatcaccgccgcctcctccaaaccgtgctccgggccggcgccgcccccgaagttgacctccaccagaggctgtgctcttcgtctgcagcgtcgagtccaagcctgtcgatatggcggcggaagaaggagatgggcaaggagggcctcatggcggtggcgcagctcaagcggctcgcggcgctgcccccggcgggggcccacccgcgcctggagcagttcatgcgttcgcacgtgtcgcggctcctccgcaccgacctcctcgccgtcctcgccgagctcctccgccaggaccatgtcatcctctcaatgaagatatatggtgttgtgcggaaagaaatctggtaccgccctgacatgtacttctatcgagacatgctatacatgctagcgaggaacaagaaaattgatgacacaaggcaggtctgggcggatctcaagtctgaagacgtgctatttgatcagcacacttatggtgacattgtgagggccttctgtgacgctggtctgattgatctagcgatggaaatctacgaggacatgaggagctcccccgacccccctctatcgttgccattccgtgttatcctgaaagggctggttccgtaccctgaactaagggagaagataaagcaggattttctggagcttttcccagatatgattgtatatgatcccccagatacctttnctgatgtagatgaggaattncaa

SEQ ID NO: 1460 - DNA, 479 bp, Sorghum bicolor
  unsure (1)..(479): unsure at all n locations
  Clone ID: SORBI-28MAY03-CLUS2506_1
gaacaaaatgttgtgttgatatctgttcctagtgttcttagtaaggacctggcaccaccaggaaaacacattcttcatgcatatactccagggacggaacctttcagtttgtgggagggattggacaggaaaagtgcagaatatcgaagattgaaggaagaacgttctgaggtgatgtggaaagctgtggagcttgctcttggcccaaaatttagccgtgaaagatgcgacgtgaaattggtcgggacaccactaacgcacaagagatttctcagaaggaataggggaacctatggtccagccataaaagctggagaagccactntccctgggcaagcaacaccaatcctccagctcttctgctgcggtgactcgactnttccagggattggagtgccggcggtcgcggccagcggtgcaatcgtcgcgaacacgctggttccggtgtcgcagcattcagaagcttcttgatgctgttg

SEQ ID NO: 1461 - DNA, 752 bp, Sorghum bicolor
  Clone ID: SORBI-28MAY03-CLUS25063_1
gcacgaggctcccacggtgccgctggacgacctgtcatccgggctgctggtggcacgccaggccggctcgctgctgctggacgaacgcggcgtccaggaggagcacgagcgcccggctgctcgtctcgtcgctcgcctgcgtgctgggggcccagcagcagcagtctcctgccggcagcggaaccaccgccgccgttaacgtggggcatgagcaggaccaggagccgccgccgccgcgggcccgcacgcgcgacgacgcgcctgcgcctgcgcctgcgcctgcgcctgcgggcgttgacgacgacgcgcccggtgagatgccgcgcagcatcattgacgtggacgtggcggggctggatgtcatggactactatgtgacggacgcgctgtgtttccgcgattcctacgacctacctagcgacggtttttcgttttgatgagagcgcagcacatgcatcttctcgcgaaaccgggtattacgtgtcaggcccgagatagtttaatcggacgagacggccgggtcactgaaccgtgatctataatgactgctacagatatatacatagagcgtatgcgtacgtaccgcgtcgtcatagaacactactgtaatagtactatatctatctataactatgtctatacttgcagtagcttacagccggggtttgcgtctctccagttaagttttggtcaggctggtgtgattaatttgcaagtgcctgatttgttaatcagacacgtatacttagtag

SEQ ID NO: 1462 - DNA, 1062 bp, Sorghum bicolor
  Clone ID: SORBI-28MAY03-CLUS24669_1
gcggaaacccaagcttgcgcggaatccaaggtgagaatccatgggcggcggcggcggcgaactcactcccaccagcaccccttcctcaccgtcgagctcgtcggagccccttcatcctgagttcgccgagtacgtggccgtctcgccgatctccgacgacgacgaatcatgccgcgtttgcgacgacgacgaggtggacgccatccgttgccgccaactgcgtgaggcgaaagagcacttcaaccgccaactgcgtgaggcgaaagagttccacttcaaccgccaactgcgtgaggtgaaagagctcatcaggaggtataagcctggtgactgggttgaaggagttggcggcgcaaaggctggacattttctcttgcctgagatcaccacattgctgctggtgggccctagaggttctggcaagagcacacttgtaaaccgaattacaagggtctttgacaaggatgatgatccttttgcaccagatcgagcacaggtgtcatgcaattcaacatcaaatcgtacaatctttcttcatgagtatccaattccaaggaattcaagtgccatatgtatttatgatacatgtggctggtcaaacgacccaaagaaaaatttcaaaatgctgcatcaatggatgacaaaaggaataagccatggggagacaataatgtgggataatgatgaaggcaataagacagggggcatcaaaccattggggaggcaatacagttttcttcgttacataaccaggaaggtcaatttcgtgatatttgttgttgacggtgtcgctgtccttgagtcaattgatagcaacaataaaggatacactgagatactccatcaaacttttatgtatccattcttatcgattggagatgacaaacctgttgttgttgtcacacatggtgatagactatcgatacagcagtgtgctcatgttcaaaatgagttaacagagctactaaacattcctgcccagcaaatttatgctataccaggatctgatgatttccaaactgatatggctgtattggatatgttacattactgtgtccgacg

SEQ ID NO: 1463 - DNA, 526 bp, Sorghum bicolor
  Clone ID: SORBI-28MAY03-CLUS24686_1
gcacgaggaagcaccacaatcaccatagcagtatttccttctccgccctccgtgttgctccttacgtccgctacaggctcggttttgatccttggctcggcgtcagaagcatggcagcagctggcaataagtcatcggccacggccaccatggaggagacggcggcggcggcgggcgccgccgcgcgtggtggtcggcgcgggattgaccggcaggccgtcgataggggcatcgcctacctgctcatggtggccgccctcgtcgccacgtacgcgcttcactagagctccgctccacggcggcagagagctcccgcaggaaaggagagaaggcttttcgtgagctttgcttccccttcccggccggcgcggcggcctcagcctgagagttcccctgcaccaaacttcattcatttgttttccactcttgtatggagatggagacgcctgtgtacgtactgtggtttagtctgtaccattaaaaaaattgttttgtatatgctccttctgtgattaatctgtaaaaa

SEQ ID NO: 1464 - DNA, 611 bp, Sorghum bicolor
  unsure (1)..(611): unsure at all n locations
  Clone ID: SORBI-28MAY03-CLUS2470_1
cgtcncgggatagaagcagcagctgcagggacagagtcatcgtcctcgaccctccccgtagctagcgcagcgaagccggcacaatgccaggcgccgccgtagcctcgcctctcctcctctcgctctcctcgtcctcctcccccttcctctcttcctcatccacctccttcctcccaccccactccgccgccgtcaggacgaagacggctgtctccgtcctccgtgcgctgcgcgccgaggcggccaccctccccgtgctctcattcaccggagagaaggtcggggaggtaaccctcgacctcaagtccgcgccgccctccaccgcgcgcgctgtcgtgcaccgcgctatcatcaccgaccgccagaatgcgcgccggggcacggcctccacgctcacccgcggcgaggtcagggggcggagggaagaagccctaccagcagaagaagaccgggaaggctcggcgcgggtcgcagcgcaccccgcttcggcccggcggtggcgtcgtgttcggccccaagccccgcgactggtccatcaagatcaaccgcaaggagaagcgccttgccatctccactgccctcgccagcgccgccgtggcagaggacgcctt

SEQ ID NO: 1465 - DNA, 468 bp, Sorghum bicolor
  Clone ID: SORBI-28MAY03-CLUS25163_1
gcacgaggctcccggcacaggccccgcgcgttcggcccggcctgcccccgccatcgctccccgccgacctctgccctctcgagggtccgcgagcggcggccctcccggcgcgcccgcccccccccacgcccctccgccccggccccgttccccgccgcgcccctcccgctgtccgccgcagcatgccccgtgccctccgcgaccaggctctcctttcggctccactggcctgcctggccgcggcgttccccccccgtgccagccacctccctcgcgaggccggcctcttcccgcacgcccccagggctgcccacctggtgttcccgctccctctcctcccggcacctgctcctctgcggccgggccagggaccccgcgctccccctgcggcggagggcttcgccaggcctcctccgcaccttgcgcccctgcccatccaggccaagcaccggatcaactgcatcagga

SEQ ID NO: 1466 - DNA, 643 bp, Sorghum bicolor
  Clone ID: SORBI-28MAY03-CLUS25198_1
ctgacgaccgagggcgctcgtcccccactcccctggcggtgccctcctccccatcggcgcctgcagagagatctcggtgagcggccatggtgcggcagcgcggctctgctgcaggcccgcgcgcggcgtggctcggctcgcgcgcccgcgccgcgcggaccgtcctcgccgacgcgcccgctggccccctcgcgagttcggcctcggcccggccccccccctcgtcttccctccgtcccccccccggccctgccccggccccgccccctcccccgcgcccagctccaccgcattaccacacctcttgacaatgtggcagtgggctcaatcactggttatatatttttctttttgctggcatcaccgatagttgaggatctcctggtagccatgtaggtgcacatatggatttgcctatgcaggtgagtagaaaaaacacttttcctcttattgttcctactagtagtttctagtggtcaaaaatatatatatatatctgctatgaacgcatgatgaaatatccatagagcttgcttgcttcttgtttcttccagtggcagggtttttatgcagttcagggttgctggttttgcaagtaaatttggtcatccgtgtgcctatgcgatttgaatacaaattgtga

SEQ ID NO: 1467 - DNA, 743 bp, Sorghum bicolor
  Clone ID: SORBI-28MAY03-CLUS25245_1
gcacgagggctaaatgtcgatctgggcccagcaatacttcttagagtgggcatagctgggatgacttgatagccttttttccgttgcggctatagacatgacctgtaaactaccagagacacagattttggtatggttagcttcttttctatgtggctcccttaacagccagtgcatagaatgttattgacaatagtgtatagctgtaaaattcttctgtaattcagtgattgagcattagtaattggcccttcagtcactattgtcatattgtgcttgtgccctgtcattttgtccttagtcacacagtgctgttttttcattacaacagtagtgtgatctatactgaagcttcatgtttagggtttctgcaacacagttgacagcggtatatgtaaccatggtttgactggacatgggaaaacaatacatttcaatagtccagttttcttcctcgttaatatcttgtgcaggatacataccagttctctactagttggctggtagctttggaagggatcacacaccagatgaccaagagtgctggcctcaatctgtggctttcctgatgaactatttaagggactagatgctgtcattttaccttattgccaaacttttagtatttccctttgtaagttgagagcattgtttatgacgattaatcttggtcgaatgtatagttccatcttgctgatatgtttgtactccgaaatgtggatgagaatatcttaccagactgg

SEQ ID NO: 1468 - DNA, 619 bp, Sorghum bicolor
  Clone ID: SORBI-28MAY03-CLUS25246_1
atgtgctctcatggaagcatgaaggtgtcaaaaaccttcctttgcaggacaatggatgggactgcggcatgttcatgctgaaatacattgacttctacagcagagatatggacctcattttcggacagaagcaaatgcattacttccgcaggaggacagcaaaggaaatactgagtttgagggctgaataaaccttggaggacatcataggtcattttggctaggatcagatattggttggaatatgtacttaacaaaagggcgcagcggcttaaaggtatagcactgagtgcaaggattttgaaagttatccggttgcacaatggcaccatgtgatggtcaagcaataagttgaagggaattgtgcatgagcatagcggcacctttaagttttgccaatgagcctttgcgggacataaatgcgtagttttctgctggcattagattgcaatgagattcctcggagatagggaggtatgggttaacttgaaacatatatatataccagtgatcttgagcatcctgtgagctgtgaccaagtgagcaaccaccgggttaggctgtatgaccagcctcggtgcaaagttttgtgtattccctcaaatccttttcattttat

SEQ ID NO: 1469 - DNA, 589 bp, Sorghum bicolor
  Clone ID: SORBI-28MAY03-CLUS25254_1
aaagcttgatcagggccatcaggaggctggaggaggttctgcagcagctgattctggcatccaagtctattggggaaaccgagttagaagcaaaactcgaggaggcagtcaacaagatcaagagggacatagtgtttgcagcatctttgtacttgtaatgtctagatgggtcaggggctaggtcaaaagctcatagggaattaagcgctcttaatttgctgctgttgtcagagtgctgttggcatgatgaagctgcctgatttgctgttagcagtaatgtggcagtgaaattttgttagggttacccatgcagggtctatttgaaggtcaagaatttttgtaggaagcaatccaattctggcagaaattcaacaaactcccagtaactgccttagcatgtacgataaatagctaattatttgttaggaatagtccagggatgcaaatctgtatgcagaattacaaatgtcccggattgcaatatatacgtatgtgtggagtataaacaagtgtaagatttagtgcttgtgttgtattattgtaagtgcaattcaaagtcggtcgatggagatgtccctggatggaacct

SEQ ID NO: 1470 - DNA, 611 bp, Sorghum bicolor
  Clone ID: SORBI-28MAY03-CLUS25257_1
tgatgagatgagggagtgtaaaattggcccaaattcccgtacttatgatgtaattcttcattatctgataaaatcacagaagtttgaggaggcttataatgtattccagagaatgggaatggacggctgtgagcctcagctcaatacatacacaatgatggttggcatgttctgtagtaacggaagagttgatatggcattgaatgtgtggaagcaaatgggggagagaggtgtcctcccatgtatgcatatgttttcggcattgatcaatgggttatgcttcgagaacaggctcgaagaagcttgtgtatatttccaggagatgctggacaaaggaattaggccacctggtcagcttttcagtaatttgaaggaagctcttgttgaaggagggagaataagtttggcacaagagatggcctcgaaattggacgcaataaggaaaacaccttttcggggttaagagatgcgtttgttcataaaaaattacccaatcagaatatttgggcataccaatagctacagcaatggacaaaagcaatgtgtacttcagatcacaaaaacaaaattttggctatgaactaaatagtctttgtatgaaaacttgatga

SEQ ID NO: 1471 - DNA, 569 bp, Sorghum bicolor
  Clone ID: SORBI-28MAY03-CLUS2526_1
aagaatattagtttggttgtcaaagtatcagtttttttcaattataacatttgttgatgctcaacttagttataatcacatagatccatcatgtaaaccaaggggactaaaactttgttttatccgtccgccaatactccagctaaagatgaaaaacgagttaattggatctgattatctgagacatgactgttctgtccatattgtggatgttggcttcgtcctgctattatgctcccatcctctggagaatcagcaaataagctattccccttgccatacaagatgctaaattcccggtgcttctctagtctgccatcaatgtgagattcgtccagttggcagatcactgattcattcgctgacccctacgaatccaaatgtttgtgaaggcatagaagaactagaccaagtccttccacctaacgtagtaaactaccagtatatgtaatttttacctgcacattgtaccgtatgcatatacctatacaaatgtactatacccatcgtgtacatgtatatctccatccccatggttttattatgggcattaacaacatgtgtataac

SEQ ID NO: 1472 - DNA, 713 bp, Sorghum bicolor
  Clone ID: SORBI-28MAY03-CLUS25258_1
actacaagtgtgatagcagcactgaaactggagatcatgagcttggacccaatggcactgatgatgtatcaaaaaattctgaacaatctgaaactgagcaaactgttcacgtgccttcaatctgctttgttgatctgcataaactgaaggtttttcatactctgaagctggcaaagggccaggacatcacagcaattgctctgaacaaagagaacacaaatcttctagtttctactgctgataaacagcttatagtctttactgatcccgctttgagcttgaaggtagtggatcagatgctgcggcttggttgggaaggtgatggcctacttcagtaatgacccgtgacaaagattcaatgttcagctatcattgcctgcttccagatttgccatctattagttatcatagacagtagtaaagtaatgaaagggatccaggcgtgggagacgccatttgtacagaattgaggagggttacaatggttgtgcaaaggctaggtcatttagatgaggaaaccaaatattagaagagaactaagagaagtagccttgtaaaaatctcagatgattttgtagaatgagtggatagtaattgtacacaattttgcaggccttttttttttggtcttcagtacagtgcattgcagcacagtccgtcaagcactttatgtatatctgaaacaaatctcttgtgactgtggccccatgcag

SEQ ID NO: 1473 - DNA, 713 bp, Sorghum bicolor
  Clone ID: SORBI-28MAY03-CLUS24845_1
gcacgaggggcgcccaggggcatcaagacggactggatcatgcacgagtaccgcctcgccgacgcggaccgcgcaccgggcaagaagggctcgcagaagttggatgagtgggtgctgtgccggctgtacaacaagaagaacaactgggagaaggtgaaggtggagccggagccggaggcggcggcgcaccataaccggcagagcgcggcggaggattccatgtcagacagcttccagacgcacgactcggacatcgacaacgcctccggcatgcagcagcagcagcagcagcagcagagcttcttcggtgacatggtgcaggggcaggccatgaacatgaggaacaacggcattggcaccgtgacggtgaaggaggacaacgactggttcaccgacctgaatctggacgacctgcaggcgtcctacaacatggcccatatggtgaatccgaacccggtggtccagacggtgaacctggtggctgggcaaggccatggctacttgcagtccatgagctcgccgtcgatgaagatgtggcagacaatcctgccaccgttctgagagagttgttgagatggaaggggaagagatgctcttgtaaataagggggcataggagtggttagactggactagaaacagcaagtttgaaatttggagggtatgaattctgcaactgttgctgtaggcttgtaacgtttagtattcatttgt

SEQ ID NO: 1474 - DNA, 690 bp, Sorghum bicolor
  Clone ID: SORBI-28MAY03-CLUS24902_1
accagcccctggcaccaatctgtgaagtttgtggtacagcaaaacctaaaattgcaaaggcaaagtacatgacttggtcttgtaaattttgtactctagagaacagcactaagcttgacaaatgctcggcatgcgatcaatggagatactcatatgggccacctgtagccacacatggcccaagctatgattgaggtaacaatggaggctaaagtagtacagatgacacttctgagcaggcatctgctgaattgtcgatataagttgtcttatctgcaacagttcctgctctattaccactcatatcatatcaggtttcataggtctggagaaatctgatacctgttaaactggtagtactacctaagccaccctcttttgtgaacgttgcttggagcaatgcacggatttggtaaaaaagaaacaatcgtagtccatggctggtaacgtttgccccaagcccggggcatgcagcctctgagcccgtgtctcgccgtctcggtgacaagtaacagctcgcacctagggcacactggcgaattggtctttatctattccagatgtcgtctgctcatgatgcagtttgggtgactgggtgagaaaatttattacattaatgtaaatgttaatacaagcatctgcaatgctcttttaaaagaaatttgcctgctcgtcagatctaacccagaa

SEQ ID NO: 1475 - DNA, 628 bp, Sorghum bicolor
  Clone ID: SORBI-28MAY03-CLUS24927_1
ccacgacggcgctggcattgtgaccagggagtccggcgagacgagcagcagcagcagcagcctggacgccaggcggtgctactccatgggctcctaccagtacgtcctcgccgaggccagcctccaggtgtccgtccacaggaggcacggcgacggccatgcccgggccggggcgaggctcagaggcgtcggctccaaccccgcaggcaccgagaccggcggcagcggcggtaccgaggggaagaggatcggcgccggcagcaagggcgacagcttctcggtgtccaagatttggcagtggccgcggaacggcaaggggaagcttcccgtactcgcgtccgatgactcgccggcgatgaacatgaacggcggcaggctgccgtggcagaggccaagtcctggggattcgtgaatcgtgacacaaagaaagcgtgtgcgtggtggtgcgtgctcctgagctgatttgctcgcccttttaaccgctgaaatttgttcataggcattcgtgttatcttactagtaaatctcatctgcttgtggttgtggtgatcttggctttctaggtgcatgatgaagatgaaatttgtgtgtgtgtgctgattataccatgttcaacagagcatcccta

SEQ ID NO: 1476 - DNA, 561 bp, Sorghum bicolor
  Clone ID: SORBI-28MAY03-CLUS25296_1
cgctccctcctgtcagcttcaaggagtgggatgggcttgtgaggatttgtttcaaccggaagaacaggaccctgggctccctcttcaaaacgaaacgtgttcttgaattgctagagaagaactacaagactatgcagtctctccaacttacacgagatgcagacatgggcgagcaaaagatgtctgcggacgacgtcgcgttgctggctaatatggttgaagatctgaacatggagactggggatgagaaggaagatgatgaaatggaaatggatgatgcagacatggctggagatggtgctgcaagctttaaagaaaagattatgggtattttgcagcagggcgattttgcagaaaagagaggttccaagctgagccaagttgatttcttatacctgctgtccctcttcaacaaagctggcatacatttctcgtgattggttctctaatgggccagcccccctgcagaagtagtatatttctttttgtttttcatgttgtgttattatgattgtattaagttactgaatcaagacctctaagcttgcggtcataaaattt

SEQ ID NO: 1477 - DNA, 955 bp, Sorghum bicolor
  unsure (1)..(955): unsure at all n locations
  Clone ID: SORBI-28MAY03-CLUS2532_1
gcagaggatcctgcagcaaaaaggtttatcatttcctttggcgctgatcgtgttgtcagcctggatgggattgattttgtcaggtgtgaagttgttggacagagtttcatgctccatcagatccggaagatgatcggtcttgctgtagctgtgatgaggaactgtgcacctgaaacaatttatgatgttgcctttcgcaaggatgtcaacctgaatgtgcctactgcccctgaggttggactgtacctagatgaatgcatgttcacatcatacaacaagaaatggaatgattcacatccggcagtttccatggaaccttattatgaggaggctgaagagttcaaggtcaagtatattttccctcatattgcggcgatggaacacaaggagggagctgtagctttgtggttgcactcattgaaccacagaaattatccagatttccgctacatggaaactgctgagcccaaggttggtgctgaggttaagagtatcgatgctggtccagaggccaaggttggggctgaagttgataatattgaagaagcacaaatgccaagcggtaatctaagtgagtaataaattttgccatggggcatgcaaaaccgatgaggatatctgtttgtggtatgtactgagagggacctgaggcatttctagtgagatatcataatatagagaatgaagactcacatattctccaatggaatatgaacatcaagaggttaatgtgcatggctttatgccatcatgatacctgtattaatcttctgaaataagaatctataggtatattagtcttatctgaacttcattcgttgcttccagacagttgtatgacaaatgatggcatctngaaaatgcttcagcatgttnttgtctgctgaaaaaaaaaaaaaaaaaaaaaaaaaaaaaaaaaaaggccggcggccnnnnnnnnnnnnnnnnnnnnnnn

SEQ ID NO: 1478 - DNA, 774 bp, Sorghum bicolor
  Clone ID: SORBI-28MAY03-CLUS2531_1
cggccgggccgggatctcccgcgacccgcgcgccgcagcctcccgtttcatcaattcctccagcgcaagccgtctcgtcgtcgtcgtcgtccggtcgtgaggagagatggcgggccgtggcaaggcgatcggcgctggcgccgcgaagaaggcgacgtcgaggagctccaaggccgggctccagtttcccgtcggcaggattgccaggttcctcaaggccggcaagtacgccgagcgcgtcggcgccggcgcccccgtctacctcgccgccgtcctcgagtacctcgccgctgaggtcctcgagcttgcgggaaacgccgcgagggacaacaagaaaacccgcatcgtgcctcgccacatccagcttgccgtgcgcaacgacgaggagctgaccaagcttctgggcggcgccaccatcgcgagcggtggcgtgatgcccaacatccaccagcacctgctccccaagaaggctgcctcgtccaaggccagcgtcgacgacgacgacaactgagtctccccgccgcggatgggactcgagggccgtcttgtttcgtaggattagcaggctgttggctttgatttcttggagagctcgatgtgctgggaagctgaagtaggagagggtcacaatagtttcttggggttggttggttccctagattctttgcaatgcgatgtgaatacggctaagttttttgggttgtgaaactcagggatgtacgccagataatttaaacgttgagaagaaaatgaaagggcgttaaagtttgagcc

SEQ ID NO: 1479 - DNA, 579 bp, Sorghum bicolor
  Clone ID: SORBI-28MAY03-CLUS25330_1
ctgggaaaggacttcaatcctaatgagatggcaagaatgatagcctgtgcagctgcatgtgtacgccattctgcacgtcgtcggccacgtatgagtcaggtcgttcgggctttggaaggtgacgtgtctttggaggatcttaatgaaggtgttcggcctggtcatagccgcttctttgggtcatacagcagctccgattacgattctggccagtacaacgaggacatgaagaagttcaggaagatggcatttaacaacaactacaccagcagccaatacagcgcgccaaccagtgaatacggccagataccatctgcgtcaagcagtgagggccaccagacgcaggagatggagtcaggcgcaatgaagaaaggtggctacagcggctacagctcaggatacagcggagcctcgtgagggaaattcccttttctccttttgttttatttttcttttgatgtttccattattgcatttgtaaagtctggccgaattatagaccaaagttgctgacttgcgcgtgatgtatctaagtttgaccgagtatagttttatgtagctgcaatcgttattctttca

SEQ ID NO: 1480 - DNA, 656 bp, Sorghum bicolor
  Clone ID: SORBI-28MAY03-CLUS25338_1
catggtggcaagaagatacgtatggatctacgcagcggttcagttcctcttggtcgtcttcttcacccatctgttctacagatatctccatttgcaggctgtgatatccatcatcctggcgaccttcgccggtttcggcgtcggcatgaccggcaactcgatcgccattgagatactacggtggagggcgaggcgggtggcgcctcctactcagcagcaggctcgccgtcaccgcagggcgcgtgcaccgcctcagcagcaacaggctgctcctgcatctgattctgatcatcaaccttccagtcagccttcagctgcagacgtgggagtgggagtgggagttggacagcacgacgccatggccgccgccggagatgttgagaacccacccgtccctcaggcggcatagaacagtatcgcatatacgattctcttctagtttatatactgtcgatcgagcttgtagcagtttgtagtttgttagtttaccagagaggttttgcattgggaccttgttacactgtataaaaggtagtgcagatggactctgaattttgtttctctgatatatgcatgccttgtgaaagagatcaccatttggtgctgtaatttactgtatggacattctctgttcttgcctaacgaaatcttcagga

SEQ ID NO: 1481 - DNA, 602 bp, Sorghum bicolor
  Clone ID: SORBI-28MAY03-CLUS25335_1
cccagaagtaggggagatttgggcgatctaccgcaattggtcacctggctgggttccttccagcaaggatgcctgtgaatatgccattggcgtgattactgcgcgcactgaagctagcacgaaagtcttgtttctgactcaggtagatggctacagaactgtattcaggccagacactgagaggagtatcctggaggtgccaacaaaagatggcttgcggttttctcaccggataccctcgttccatctgacaagagagaagggtggcgcgctctgtggcttctacgagctggatcctgctgctcttccgggtcccttcctcgctgggggtacccccggccgccccgcggtggccctgttgggccgtcggcttgatgactcccggtctttgttccggtgcgtctgcgtgcgctgcccactcgcgttggcggctcgggcgcctgctgttgggcccggcccctgcggttccggctcagccctcctcgttggcccccttcggtcgccctcggcgccttcctgtcatgtctgatccgggcgcctgtcaaactataatcaccatttggtagtgctgtctgcagccgagagcagatgcagaacagcta

SEQ ID NO: 1482 - DNA, 963 bp, Sorghum bicolor
  Clone ID: SORBI-28MAY03-CLUS25355_1
gcacgagggttgacacacctcccgccgcgcgcctgcctgcctgcctgcctgtgcggccggcggcgggaatggagctggagcttgaggcggcgacccggcgcttccacctctggttccgcgggctgcgctcgctgcgccgggacctggcgtcggcccggtggtcggacgacgcggcggcccagctccccgctcttgtgggccgcttcgtggcccacctggaatcctactgcgcggcgcgcgcggggctggacccggtgtggacgctgtcggcgccgtgggccacccccgcggagcgcggcgccgcgtactggctcgccgggtggcggcccaccacgctggtccacctgctctacaccgagtccgggcgccgcctcgaggcgcagctgccggacctcctcctcggcgtgcggtcggggaacctgggcgacctcaccccggcgcagctggcgcaggtcgacgacctgcagcgccgcacggtggccgaggaggacgcgctcgcgcgggagatggcgctcgtgcaggagggccacggcgtcgtggccgctccgtcggcggacgggtccgggcttctcgacgtggccggcctcgtgcgcacggccagggccgtgctggacagggcggacgcgctgcggctgcgcaccgtgaagcgggcggtggagatactggagcccgcgcaggcggccgagctgctcgtcgccgccgcggacctggagatcgggttccgggagtttgggctcaagcacgggtcgggccgggacggatgacatgtctggcccagttttttcgagttctcctgcactgcctggcctagcccagtttttttttggctcgtcccatgattttgccgggctgtacctgtctgggccgtgacaggggcacgagaacatgaataaaatgcacgagattgacgagtggattgtttgattctaaattaacgagtggaatgtgctgcgcacaaaacca

SEQ ID NO: 1483 - DNA, 675 bp, Sorghum bicolor
  Clone ID: SORBI-28MAY03-CLUS25385_1
ggagctaatgggatcaaaataactcgcccatgtgagatttatggaataccttgatgtaaagccattcatggaccccagctttgtcgacaaaggaaggaccctctatcgtctagctggtgttgtacagcacattgacattggcaacggcaagagatccttgaagtcaggacactacattgcgtacgttagagcaagaaggcttggacatcagcaagagggtagcagctgttcttcctcatggttttgtgcagacgacagtgatatcaaacaagtcactcttgaagaagttctcaactgtgaggcctatattcttttctatgagaggatggaaggcgaagacatttctggcataagacgtcagaactaaagaatgcagtaatagaacaagcagatgagtgagataagcaaaccttctcttgaccgcaaggatccagtcagtcaatgttcatagtaaaacaggctcttgaccaagcccatttttgttgctgggcttcaaacttactgtaactttgtgccaaatcggagttttttttttttctttccgatcttctcaactcagctgatctgctctttccattgctttgccttttaggatgaaactgtgaatagaatagtggtgagattggtaaatcagtgatacgggcttgtaaaggttctgttggatgctgtgttaca

SEQ ID NO: 1484 - DNA, 701 bp, Sorghum bicolor
  unsure (1)..(701): unsure at all n locations
  Clone ID: SORBI-28MAY03-CLUS2509_1
gccggccgggccgggatcggctcggtaccacctggacccataccatacccactcaggcctgtataaatgagcagccagcagctcccaaggcaggcagcagcaagcgaagcaccatagcagctaggaccagtccagcctctctctcttctcgtcttgtcttggcatccttgcctttgtctcaaggctagcaagcagcagctagctcgagactgcactgcacgccggcagagccaagctgtgagagcagagcggttcggtcgaacgagatgaagagccggaggcagagcagcgggggcagctcggccgcctgcgccgcgggggaggcgaacacgcacacgcacagcagcggcggcggggggtgcaagctggagaggaaggacgtggagaagaaccggaggctgcacatgaagagcctctgcctcaagctctcctccctcctccctcccgccgccacgcacgcctccctcctcgccgatgcagcggcggcggcgtccaatcccaacaacaaggactcggtgacgcagctggaccagctggacagcgcggcggcgtacatcaagcagctcagggagaggatcgaggcgctgaagcagcggaaggcgggaggtcctggtccagncgcgggctgcaacggcggcggcgcggtcacggcgtcggcgtcggcgtcgagcgcgtccggcgnncgcgcccgcgtgcggatg

SEQ ID NO: 1485 - DNA, 674 bp, Sorghum bicolor
  Clone ID: SORBI-28MAY03-CLUS25145_1
gcacgaggtgggtaagaaagaagactggtgtgccagtcattaggcttcagtctaaggagtcagctgaggagctcctcgaaaaggaccagacctttgttattggtctattcaagaattttgagggagcagaacatgaagaatttgtgaaggcagcaaccacagacaatgaagtacagtttgtagaaaccagtgatacaagtgttgccaaagttctttttccaggtattacatccgtggagaaatttgtgggccttgttaaaagcgagccagagaagtttgaaaagtttgatggagaatttgaagaaaaggcaattttgcggtttgtggagctcaacaagtttcccctaattactgtattcactgagctcaattcgggcaaagtatattcaagccctattaagctacaggtcttcaccttttcagaggcttatgatttcgaagatcttgaatctatggttgaagaaatagccagagcattcaagacaaagataatgtttatatatgtggacactgctgaagaaaaccttgcaaaaccattcctcactctttatggccttgaatcggaaaagaggcctactgttacagcatttgatacaagcaatggagccaagtatctgatggaggcagatatcaatgcaaagaacctgagggagttctgcttaagccttctggat

SEQ ID NO: 1486 - DNA, 784 bp, Sorghum bicolor
  Clone ID: SORBI-28MAY03-CLUS25153_1
gcacgaggcggcagcgagctgttgggagtccaggaagtgaaggcttcatgtttgatctagttgatagttctcagctagacacaacaacaatgcctcgattatcaccattatctttaattccgattgatcaagactcttcaggcactttgtctgtacaaataccacagaagtctttccgttccttgacccttcaatttcgtggagacatagccaataatgcagaaagaagtgctattaaaaagaaagaaggcacgttaaccaacactactactgaagccgaaaaggatgttttggagaatggtgatgtcaataagtctatcaaacatgcacattccatccttcgtgacatccacaagtccatatttctcgtgcaggtatttgatatggtgatccgggagacatttgtccaatctcaaggcatcaatgtcactgggatgtgcgaagattttctccaattagcgattggccaggagtgttctttgtgcctttcgcttgagctctctcgacagaatagtatctcagaaacagtagggcaggaagatcatatggatacagattatactgaaaatcttgcagtagccactgtaaatgggaaggagtcttcaaataaggatgtgagagggtttcctaaccccaaatgcttagaaatttacctgctacatatgttccatgaaaacattcttaggaaactcagggagaaatctcgtcatatggttcgttaccaaagttctgctcaggctgcacctgacgattgtgggctgctaagtgatttttgcatgacagt

SEQ ID NO: 1487 - DNA, 599 bp, Sorghum bicolor
  Clone ID: SORBI-28MAY03-CLUS25452_1
gcacgaggcccttcccgcccgtccgctgcatcctgctcttccctcctcctcctcctccgcctcctctctccctcgcgcgctccagacgacgactgttgggccgccgccgccgccctaggccaggtgctgaggctttccttggtctcttcgccggcgacgagcaccctaccaggtcttttcagttcagcacagcatatcaagactgtctctgttaatttgtgtgtatgagatcagttaacggataaggacatgtgaagcactagtgaagaaggactgatgatcagtaatttgtatgctccagattatagtatcctctgagatggacggaagagaatcaggcttatggtaaatcctggtgaatattcatgggaggtcagcaagttctggcctgactaagactagtaaaaaaaacagcgtgcttcatctcagatcatcatggtgagaatgaggttcccgaaacgttatctcattgtattgctaacattcgtctgcacaaatgtttgctacattgagcgtgtcggtttctcgattgcttacacagttgcagctgatgccatcggtgtgaatcaagccaacaaggggatgatactctctatgtt

SEQ ID NO: 1488 - DNA, 355 bp, Sorghum bicolor
  Clone ID: SORBI-28MAY03-CLUS25427_1
gcacgaggattttcttcagttatcaaaacgctggaaccttgaatacacatagtgacaaaaaaaagagtagttgcatgcatcagaaattttgagaaacaccatggcttgtttggatgcccatgtatggattgggggggaaactaaactaatttccactccaatccacctcaacacatgcggattgatatgaatacatggacattcaaacaaggctttagaaattgtgtttaacagggtaacacaaacacaactcttttggggagataaaaaaggcaagcagaaaaggaaggcagcaataaactctcacacctatctttgctggaattttgtcaggatcctccactctttctttttt

SEQ ID NO: 1489 - DNA, 625 bp, Sorghum bicolor
  Clone ID: SORBI-28MAY03-CLUS25453_1
cgttgacaaaattacagacccagtggaacgacgagctacacaagatcaaatagcttactttggacaaacaccatctcaactgctgactgtccctcacatgaagaggaagccattggcagaggtcttacaactacagacaatattccgaaatccaagtgaacttaaatcctatgtgcttccacatccagatcgttgcaatgttcctgccagtgctatgcttgtatcaaatgactctattgtagttgtagatgtaaatgtgccagcagcacatgtggcacttcaccagtggcagcctaatactccagatggtcagggaacacctttccttttccatcatggtagaaattccacaaattcaaccagtggcgcactcatgcgcattttcaaaggatctgctagttctgcagaagattttgggttcccaagggctatagcatttgctgcttctgcaatccgcagttcagcagttgttgctgtgacatgtgacaaagagataattactggtggccacgttgatggttcattgaagttgatatccccagatggagcgaagacgattgaaactgcttctggacatattgctccagtgacatgccttgctctgtctcctgatagcaactacctt

SEQ ID NO: 1490 - DNA, 541 bp, Sorghum bicolor
  unsure (1)..(541): unsure at all n locations
  Clone ID: SORBI-28MAY03-CLUS25456_1
gcacgaggatgaaataaatgctcctacatgggtccaagcatttacctatcaaacttcataatgctgggcgcgaggctcaggcacacctatatggtgatcttgccatttactgccgtgtttctatgttatggaaatttgaagagcgctgatgttacctgtagtgctctctaaatttggaacatggagcatgcactgatcagtagaaggtttccaactgatcccaatgagtataagttatatgaggaaattggagaaggcgttagtgccacagtataccgagctctttgtgtaccagttgacattttggttgccatcaaagtgcttgaccttgagaaatgtaacaatgacctggatgggataagacgggaagtgcaaactatgagtttgattgatcacccaaatcttcttcgtgcatattgctcatttacaaatgggcaccagctttgggttgtcatgccttacatggccgctggatctgctctccacattatgaaaacttcttttccagaagggtttgatgagccagtcattgctactctnt

SEQ ID NO: 1491 - DNA, 586 bp, Sorghum bicolor
  Clone ID: SORBI-28MAY03-CLUS25459_1
gcacgaggccacttttttgtactccacatccactcagctccctagcgaccccccgcttcgtgtgttgttttcttcttctttttctccccgaaaaggctagacggcggcttcgagagctcactcgtcgccggcggccggcgacggaaggatttttccaccattttattgacaaagaaagaaaaaaagaaggctaatggcgagaagcattgattcagattatattgacttctcacatatgggtggatttgacatgggcatcgattttaacggatttgaggaaaatgtgaaaaagttcatggagctcccgatcaagtatcttgattcggctcatgataaggctgtcgaattcattgaagatgttcatgcaatattttatggtccctttactgatcatgaggtgccaaataacgatcaatccaattgctatgttatcactgaatcttcgccaacatcaattgaaaaggagctagttggaccaaacattgaaccctcaactcctgcatccttcattaccatggagaacagttctactggctgtgatactgatcaaaccgaatcattttcaacaaaaagtacaggtttatcc

SEQ ID NO: 1492 - DNA, 609 bp, Sorghum bicolor
  Clone ID: SORBI-28MAY03-CLUS25493_1
ctggagcgtggtgtctctgtctccgactctccgtccctggcaccggcggcgtgatggcggactgggaggggatcccggcgcgggagcggcggcagatggaggagatcctgcagctcgacatggaggagctcaacgtggaggtcgtcgacgacaacgacgaggaagaggaggaagacgagggtgacggcaacgaggaggacgacgtcgtcgatgccttcctcagagataacaatggagatggagtggctagcacctctggacctttcacattcaataggtctctagcctcattgcacacataccttggcgaggttgatgatactcggggtagagttactctcttagatggtggcacagtcctcaacttaccaatgttttatcttcaaggtgttgttctatttcctggagctaccctgcctctcagagtaattgaggatagattagtagtaactatcgacaaagctttgaggctggtcgatgctccatgcacaattggtgtggttctcatgcgccgactcccaaatcgtcgacattatgctactgcttctgttggaacaaccgcagagatacgtcaacttggaaggttggaggatggttcattaaatgttg

SEQ ID NO: 1493 - DNA, 496 bp, Sorghum bicolor
  Clone ID: SORBI-28MAY03-CLUS25488_1
gcacgaggccgaatcgtcttctccatcccagttgagccgcgaggaaagcatcgaatcgaatcgtcttctccatcccagttgagccaattccgccattgttgatcgcccgctcgccttttttttctttcctctgccaccactgctctgcgatcgacggctgattggcaaggaaccgatcgagccactgtccagatttcaatcccaagattgcttctggccttccctgccagcagagccggccatggagaagaaggagactccgccgatgcatagcagggacctgcaggacgaggccactgcagcaagtgttgtttcatcagagcaacggccgcggccacatctctgcatcgacatcccggcagaagatcacctcccgacgccgacgcacggcggcatgagcatcatcactaccccaccttccaccaggagggggcagcagcagacaagcagcaacatcgccaccacgcccgtgtcttcccccagctccagcaggccg

SEQ ID NO: 1494 - DNA, 837 bp, Sorghum bicolor
  Clone ID: SORBI-28MAY03-CLUS27511_1
gcacgaggcattgacaaggaacgtagaggagattacctaggaaaaactgttcaggttgtgccgcacatcacagatgaaatacaagagtggattgaacgtgtggcaatgaatccagttgatggcacagaagaggcagctgatgtttgtgtcatagaacttggtggcactataggggacattgaatcaatgcctttcattgaagcattaggtcaattttcataccgtgtagggcctggaaacttctgcttggtgcatgtcagtcttgtaccagttcttaatgtagttggtgagcagaaaacaaagcccacccaacatgctcgtcgcggacttagaggacttggactcatgcctgatattttggcatgtcgtagtacacatccacttgaagaacatgtgaaagtgaagctcgcgcaattttgtcatgttccgataccaaatatcattaatctccatgatgtcacaaacatttggcacatccctttgttgctcagagatcagaaggcccatgaagctattttgaaagtgttagaccttcagtgtgtgggtaaagttgctcgagaaccccaattgtctgaatggactgaaagagccagcagatgtgacagattgaaaactccggttaggattgctatggttggaaagtatactggcttatcagattcctacctatctgttatcaaggctcttttgcatgcgtcagttgctttggacaggaaacttgtggtggactgggttccttcctgtgatcttgaagattctacagcagaagagactcctgatgcctatgagaaagcatgggagtcgctaaagggtgcagatggtgtgttggtgccagga

SEQ ID NO: 1495 - DNA, 538 bp, Sorghum bicolor
  Clone ID: SORBI-28MAY03-CLUS27530_1
gcacgaggcgtgatgaagcagcagaaccgcgccgaggaggccatcgaggccatcaagtcgctgcgccaccggggctccgaccacgcgcacgagtccctcgacaacatcctcctcgatctctacaagagatgcgggcggctggacgaccagatctcgctgctcaagcacaagctgcagctgatccaccagggccacgccttcaacggcaagcggaccaaaacggctcgctctcagggccgcaagttccacgtcaccctcgagcaagaagccaccaggctccttggtaacctgggatgggcgctgatgcacaaggagaactacacggaggcggagggggcgtaccgtcgggcgcggcttatcgggccggacaacaacaagatgtgcaatctgggcatctgcctcatgaagcagggccgcgtgctcgaggccaaggatgtgctcaagcaggtacgccccgcggcggtcgacggtctgcgcggcgccgactcccacctcaaggcctacgagcgcgcgcaagagatgctgcgggacctcgaga

SEQ ID NO: 1496 - DNA, 1058 bp, Sorghum bicolor
  Clone ID: SORBI-28MAY03-CLUS27533_1
ttcgacgcggggacgcccgagcgcacgcgcgaatcgccgcggacctcgccggaggcggcgacgagcttggatcccggcgatctagtcgccggaggcggttccgatggctcggcggtcgtcttcctcgtcgtcgggggcctggcggtacctgaacccggcgtactacctcaagcggcccaagcgcctggcgctcctcttcttcgtcttcgtcgcggccactttcgccttctgggaccgccagtcgctcgtcagcgagtacgagtctgagatttcccgattagaagatgatataaatcggttgcatgaccagctaagaaaggctggagttcatctggatgaaaatccagtagtaagcaacaggaattccagaaaagatcttgtagaaattgatcctgtcaataatgaaaggcgggaaaaagttaaagaggcaatgctccatgcttggaattcttatgtgaagtatgcctgggctctcctcgagccccagccacaatcgaagaatggtatcaatagcttcggtggtcttggagcaacccttgttgactcacttgatacgctgtatataatgggcctgaaagatgaatttgagaaagctagagagtgagttttatttattttttcatcatgtagagttgtagacctttattcccttgctctttcctttggctagtaatattgagttagcagtctacttgttgtaatattcagttcaatagactaggcccagtgccccctgtatttttatcatgaatttataaagcaagattattggggcacttacatgcaaaattcatgaccgtatctccttgaccccttattatagaggattatacaatctcttttttacttcacatttcttcatgattctatcattttcatctgttccatattataaaatgacatttattttgtatgcttttatattgctatttttgcatggtaatactccttggaattatttcagtgctttattctgattttatgctgcacacccaatctgactaatgcctatgtcataacagctgggtggcggagtcattagactttgacaaggatta

SEQ ID NO: 1497 - DNA, 918 bp, Sorghum bicolor
  unsure (1)..(918): unsure at all n locations
  Clone ID: SORBI-28MAY03-CLUS25517_1
gcacgaggccgccgccggcgatgggcgcccttaccgacagccggaagcgcctctcggcggaccactgcctctcggccgaccaccgcctcccctacccctcctttcccccgccgtcccttacccctccctccaagcgggccaagctcgccccattccctgagctcgatccctccacctccaccgtcccgcctatccgtccctctccccaaatcatccactccaccgccacggcatccgcctcctccacgccgggcccttcctcctcttgtatcaccaccgcttccaccccgcttccgcaaaggcgccgactccctccgccgccgccaatccagcgcccgatccacgccccccagcggaacctccgcgtcttccggcttgggggcgccgcacggacccacgccgccggctactcgtggctcgccccgtcatcacccccgcctcgttctctcggactccagcagttcgttgagctcgtcaaaagtgtctcacacccggcaccgcccactcccgctgccacaaccgatgctacgaggcaggcggaggcggaggcggacgcggtgcccctcgaggtgatcaccatcgaggaggataaggaggtgaggaagcagcaggacgaggaggtgagggggggcgtggtantgagaagggggccaatatacaaggagctgtacaaggcgtcgcaacagaagcgggatgccaagctcaagacgctcgagtttgaggtgcggctcgctgaggagggccgtcttggccttgagcggcttgccgaggccctcccgcgaattacgccaaagaaggaggaggtgcctgaaccttttgttcctcttactgatgaggacgaagaaatggtccgtcaggctcttaatggcaagaacagccgtgagagggtagcattacatgaaccttcaaatattgtga

SEQ ID NO: 1498 - DNA, 515 bp, Sorghum bicolor
  Clone ID: SORBI-28MAY03-CLUS25530_1
gcggctggacgacgcggctctggctacggctcctggggcgtcggagcggaaaccgacggggaagtcgccgccgaagggtgtggcggagggaagcccgccgaagagatctcgaagcccgcggaataaatctccgcggcggcaggacaaatggcccgcagcggcactgcctctgcttacggttcctgagtcgtcggagctgatcgtggaagcagcggggcgggccagcgatgagaagcggtgcaagtgcaatcacgtcatcactgacagtgctatcgagaaattgattgcatcgctcaggtccaaggacgcatggacttgctatggttgttggcacgaattcaagaaggggatcatcagaatcaggcccgagaagagcgatctcttgatctgcgtgacatgctacgaccatctctgctgcggggttgggtcaattgcttacccgtttgggcactctcgagcacacgccctgaagaagaagcactggtttgctgttctgtactgtgatccagaaagag

SEQ ID NO: 1499 - DNA, 532 bp, Sorghum bicolor
  Clone ID: SORBI-28MAY03-CLUS25534_1
ctgcgatggccgctatgacacgcagtttcactccctgttccggactctagatacagcgcaccacaaggatttccaccagcccaacctcactggtgcgtccatcaacaatggtgggccgagggagccatggcacgacatccactccaagatcgaaggcccagccgcatgggacgtgctctacaactttgaacagcggtggaggaagcaaggaggcagcattgatctcctcgttgacctcaaagctttggtgaacctgatcataccaccgtcgccagtgatgttcccggaagaccaggagacatggaacgtgcagctattccgctccattgatggcggtgcgtgctatggcttccctagcaccccagaggctgcagctcaatctggacttgtcagtggcaagaataatgtccttgacaggagcatccaggatgcctacatccatgccatacgccgtgccaagcacttcatttacatcgagaaccagtacttccttggcagctcattcgggtggaaagccgacggcataaagcca

SEQ ID NO: 1500 - DNA, 661 bp, Sorghum bicolor
  Clone ID: SORBI-28MAY03-CLUS25543_1
acttgatgaggtaaccataaagaggaagcagatacgtgaaaatctaaaggttcttcaacaagcttataaaactttggacgagataccactagacgcagaggcagtagagaggggtggatactcctccctggattctgatgcgattggtctaccaagggcccatgggctttcttcatccctccacggattcaatgatggaagctcaccatattcaaccccgaagcagtcaaggtcaaggaggtcaaatcattctggcgagcagccccctttcaaccctaatatgagtggcaatggtttttgatgccaccctacacgacggccacccagattggttatggaaccaagtgtgcagcaagcacaccttattctgcttcaagtttgttggcacccatagataattgttatttctagttaaattctttgtagcgctgcgccgatgaagcctgacatggtgcgagttttgtcatttcgccttttgtacagtatatatctttgcccagtcatttcgtcttgaaatgttatcaagtgatgggtatagttttgttcggacccagggaaagcaatgaaaaagatctgctaggtgtactagtgcccagcgtctgagtgactatgtaactacggatttgccgtgcaaaatagacatggatggtatggtagtggc

SEQ ID NO: 1501 - DNA, 645 bp, Sorghum bicolor
  Clone ID: SORBI-28MAY03-CLUS25544_1
tgattcaagtgattgctcctgtctgtgcacttgtaggaagtttgagtttatgggtatcccatgctgtcacatgttgaaggtgctagattacagaaatatcaaagagctacctcaaaaatatatgttgaagcgatggagaaggactgcaaaatctgcggatgaagacaatgaaggtaatgcaacaaatgccaatgggtcatcattgaatgcccctgctcctcctgcaaatcaccatgggcttcagagcttcagtgcaatgattcaagatgcttctgtttctaatatgcattagcaattagcattcatctcatagaagctcttaatgcagggttaatgccaacgatgcatgtaagactccacaatgttggccattgaagcattggatcagccaccatcaagcacccatgcatttaccttgtaagactccgcatcgctggccatggaagcattggttaggctgctgtcaagcgcccctgaataagtagggcaacctgtacattgttcagccgtaggagattttagtttctgtcttagtgaggcaacaatccttagcatagactgtagagtagttttttaatttaaaatcataatgcttgtatcccgcttcaaataattcagaaattttgtgcatgccctataaatgct

SEQ ID NO: 1502 - DNA, 585 bp, Sorghum bicolor
  Clone ID: SORBI-28MAY03-CLUS25556_1
ggggcatatggtggtgcctatggaggtggtgcatatggtgctccaggaggttatggtgcgggaggatatgacagctatggtggggctggaggcatgggtggtggtggcagcgccggtggtcggggctccagcagataccacccttatggaaaatgatcatccagtttctctaggatctgataataaatctataccttccttgatttctgctactgagaaaatgggacattccattcaccttgtcgaatcagcggcatctgaacaatttttttccccctggagctattcattgcacaacaaagattctagtctagtcgctgaaccctgaactgccccactccccctgagctttctgtagaagctgcagctaaaattaccgtagtctggcatgagccttagaaggctcttgtgaaactataagctttgtgatagtaacaatatggtgtcatggaacaggtgtatttcaatgtaacattcgcatcactgatcagtaacttgctatctctgttcatgtgtggagagaaactttgcaaaggactggactgatactattaaattgtgtgggctgctatctttatcgtgatt

SEQ ID NO: 1503 - DNA, 696 bp, Sorghum bicolor
  Clone ID: SORBI-28MAY03-CLUS25574_1
cacccacactggtgcatgcctcaattcagtcgacactggatcacaagtgtgcgcgctgctctagaacaagaatgagagagagctgctgagctcgcacggattcactcagaatcaactcatcttgtggaagtacccatcaatggttaagttggctgaactcaatggccacacatcacgcgtcctgttcatggctcagagccctgatggatgcaatgtggcatctggtgcagcagatgagacattgcggatctggaatgtgtttggaactcctgaaactgtgcctaaggccccctacactgggatcttcaatagtttcaaccatatccgatgaggaaatgccatcattgttatcaagagcccttccggaacctgctcacctgttgataggaacggatcctttttaacatcaccgcaagtccgcaacgcacaaggaaccgctgccctgatgttccatagagagattcccatcagcccctattatgtgttgacatgtgtacagttgtcggctatttggggttttctagggatataatcccatgaagttatatttcaacttgttatattctggtaacatgtggttgctgccatactggtccatagtgtacatatgatttttctccagtgttgctacgttgtaaaagagttttggtcccccaacagaaaatcccggatcagagccagtacgatccaattttt

SEQ ID NO: 1504 - DNA, 617 bp, Sorghum bicolor
  Clone ID: SORBI-28MAY03-CLUS25577_1
agatgatgaagcacaaaccgtacggtcgaaaagtcgatgtctacagctttggccttatcttgtgggaaatgttttctggaacgataccatatgaagagctgaacccatttcaagcagcttttgctgtttttgacaagaatgtgaggccggtgattcctactagctgcccagcaccagtacggcttctaattgagcaatgttgggcctcgcatccggagaagcggcctgacttctctcaaatagttcagatactggagaagtttaagagtgttcttgacagagatggcacactcgacaatatgccaagctcgatctgccagctggagactcacgatcacaagaactggcttgctcattgggtccaaaagctcaaacatagccatcctgatctctctgggccgcctccgccaaaactgttgtaactattcaccgttctgtaccttccctccctttcaaaccctgctaatcccataggtaacaaaatgtaatttcagttattttctgtctatagatagattaaaaaaaaagattagtagcacagttagcacttgcttcgcttcaccacggtgttctctttcaatacacaacaaaatgtaatacaaaggttgctgagaatg

SEQ ID NO: 1505 - DNA, 228 bp, Sorghum bicolor
  Clone ID: SORBI-28MAY03-CLUS25399_1
ggccaactacctgctaggcaagctgccgctggtctacggctggcgcgccatgctggggctcgccgcgctgccgagcgccgtgctcgcagtcagcgtgctcgcgatgccgcacgcgccccggtggctcgtcatgcagggccgcgtcgaccaggccctcgtcgtgctcaggcgtgtgtccgacactcccggcgaggccgatgttcgcctcgccgagatcaaggcccgcgg

SEQ ID NO: 1506 - DNA, 562 bp, Sorghum bicolor
  Clone ID: SORBI-28MAY03-CLUS25413_1
gcacgaggcaactgagctatgggtacacacgaagtttaacaaggaagtgttacatgagctaggaagaaagttggtaaatccttagcaccggcagccatggcacatgagggcttggaagcagttcactagttgtttggatagtagaaggacaaagaactttcgcatctaggactctagcactactgctggcgctgccacgccctcccgtcctgattgccctcccaccgctaaccgccactgcaaaatcatttgtccctcaaaccctccactcagaaccacgatttgatgcgtcgcctcgcccgcccagcctccaccctgctcggtaggtccgtgaggagtggcccctgcacgcttgccacggatgcacaaggactgttcgaagaaatgcctccacctcctgctccaccaaaactgccatgccacacactgtttgtccatgcctgccaggtgctcagccgaacacacacttcagggttttgtactgtggctcagcggttcacggatgagcacgccagtgcagagccactgcgattcacagtcacgccgggcgatgcctttgggg

SEQ ID NO: 1507 - DNA, 816 bp, Sorghum bicolor
  Clone ID: SORBI-28MAY03-CLUS25421_1
gcacgaggctttgttgccgcctagcctctccctcgtccctccctcctcccaaggctgctgctctgtgacgtccgcaccgccagcgccacccgcgtcgccatctccaccaggcacatccccaccaccaccaccttgggcgccgggccctccatgtccatgcttggctttgccaactagagtatagtgctgtgtgctccatcgtcttcttctcttatataagacgcggacgcatgtcctcggaggaggaggccggctgaggacaagatatagagagaggcgttgcgttgttgcccgccgtgccacaccatcgccggatatacatggccgtgcacgcgcaccgcctcctcttagcgcaacaagggcaagggcagaagcaattcaccaacgcggcggcggcgggatggccttggacgagtaccggcgacgaagctagatgcgcgacggcggcagcgaggccgagccatcatcatcaacaacaggccgcggcggcggcgttccagttccagcagcaggccgcctcgtgcgtcggcgtgggcctgccggcgccgccgcctccggtctcgtcgtcggccgcgccgtacgctgctgctggtgggcaggtcctcgtgggcgacgcggcggagagcggcgtcacgttcggtggaggcgcgggtgcggcgcagcaccaggaggtggtggcgatggcgatggcggcggcgacggcgcccaggaagcggaagcgcgtcgtcgagcaggggcaggcgccgccggttcttgagatcggaggcgcggccgacgtggcggcgcactttcatcagcaactcgtcgacgtcgacc

SEQ ID NO: 1508 - DNA, 654 bp, Sorghum bicolor
  Clone ID: SORBI-28MAY03-CLUS25614_1
ggttccagctaatgagcccagtagtggccagtggttctatgtggatgttcccatgattgctcgtgcttgtggacttcctgagaatactgtttatatagaggatataaatgaagatatatctccaacaaacccttatcctgttccaaaagatgtcaacaccttgattcgtcactcagtgatgccagatgaccatcttaaatacacgtttacatggtacactctttctgctgctgtgacttatatggcttccaagcggataaaagcaaagaaggtcaggatgtagcagggaaggagtccaaacttccatacggacgtccatttgcgcatggtttctgtcgctgctcgggaagatggccaagctactggttctttcgtctctataacattgcacttttttgttccaaggtgttgtacattgactgtcggcatctgagagtagagctcagagatacagcaattttgttagcctgatttctgatgattagaacttggaaggcctgtaaggctgtggtttccttgtagtaatattttggcggggagcttttagctgcttgttcttttagcatattcatgttgactgctccacccgagaaattgatgttctgtcgcaggctcgtgtcgaggacaccagcccaaaacagagtttgtgccctg

SEQ ID NO: 1509 - DNA, 583 bp, Sorghum bicolor
  Clone ID: SORBI-28MAY03-CLUS25622_1
acctctcgagcctggcggggatcatcgcctcgctcgcccgcctcccccgcggcctcccccgcctcgcgcgcccgccgccgccccgcccgcccccgcgggcggcgctgctgtccatcgcgacggtgttcaccttcatagcgtccttctccgtcggcgtggggcccatcacctgggcgtacagctcggaggtgtacccgctccggctgcgcgcgcagggcgccagcgtcggggtggccatcaaccgcgtcatgaacgccggcgtctccatgacgttcgtgtcgctgtacaaggcggtgaccatcggcggtgccttcttcctgttcgccgggctggccgtgctggcggccacgttcttctacttcctctgcccggagacgcagggccggccactggaggagatcgaggaggtgttcacccgtgggtggcgcgcgcggctcccgtcatcggaggcacctgtcgtggagcttccggtgtccagcgtcaccgacggcaacgccaaagcgcggccgtgacgcgatagcaacaaaatatggatgaatcatatattcgtgctagtacatgtgtttgtatatgtccactttct

SEQ ID NO: 1510 - DNA, 710 bp, Sorghum bicolor
  Clone ID: SORBI-28MAY03-CLUS25642_1
caggcatcaccagcacgggagatggcaagccaggattgggagggtcgctggcaacaaggacttgtatcttggcacgttcagcacgcaggaggagtcggcggaggcgtacgacatcgcggcgatcaagttccgtggcctcaacgcggtgaccaacttcgacatcagcaagtacgacgtgaagcgcatctgcgccagcacccacctcatcggcggcggcgacgcgtgcaggcgctccccgacgcagccgccggacgcgccggcgctcgccatcgacgctgctggcgccgaccggtcgtcgcacgcgccgggcggcggcgaccaggccgtgtccgacaactcggacacctccgccggacaccgcggcgcgcacctgctgcacggcctccagtacggccaccccatgaagctggaggccggcgagggcagcagctggatggcggcggcgacggcggcggcggcgcggccggtggcaggcgtgcaccagctaccggtgttcgcgctgtggaatgactgttgattgtggcaaccaaccgcgcgcgtagagcacgtagtagtagtcgtagttagtgaagaaatgcatggcactgcacctgcatgcacgaggtgtaagtgtaacgacgacttcggcagtagtaggggcggtgaagaagcgacgaacagctgaactttttgtgacggacctctgcaagccagatgcatgttgcacgctc

SEQ ID NO: 1511 - DNA, 555 bp, Sorghum bicolor
  Clone ID: SORBI-28MAY03-CLUS25643_1
ggaggcgcaggtgtggcgcgacctggcgcagtccaacgaggccgccgccaacgcgctccgcggcgagctgcagcaggcgctcgacgcccagcaggcgcgcttgtgcggcggcggcggcgccgacgacgccgagtcgtgctgctgcggggagaacgacgtcgccgccggggccggagccggagcagcgggcgcggaggacggggagacgtcgtcgtcgccggcgtacgggaggaggacgtgcgcggtgtgcggcgagggcgcggccgaggtgctgctgctgccgtgccgccacctgtgcgcgtgcgcgccgtgcgcgggcgcggccagggcgtgcccggcgtgcgggtgcgccaagaatggcagcgtctgcgtcaacttttcgtgatggtcctgaaaccgataggattactggattagagtaggttttttcttttttttttctttttgggccatcttgttggcgcgacggttcagtgcagatgcggataggagacggatgcatctttgtacttgcctttttttttggttctcagaactctcaacaagaaaaaaata

SEQ ID NO: 1512 - DNA, 730 bp, Sorghum bicolor
  Clone ID: SORBI-28MAY03-CLUS25672_1
gcacagtaaagatcccatggcgaaggataatattcagtctacctgtttgggcgatcgttgtaaacaatttcaccttccactatgccctgtatgttcttatgaactggctccctacctattttgagcttggccttaagcttagcctccaggatatgggttcctcaaagatgcttccttatttcaatatgttcattttctccaatatcggtggtgtgattgctgatcacttgattacaaggaggattttgtctgttaccaagacaaggaagcttctgaacaccattgggttcattgtctcagcatttgcactcatggcccttcctttatttagcacaccctcaggcactgtaatgtgttcagcgatatcccttggtttcctggctctaggaagagcagggtttgctgtaaaccatatggatgttgctccgaagtttgcagggatagtgatgggggtctcaaatacggcgggaacactggctggaattgttggtgtcggcctcactgggaatattctggaggcagcaaaggcttctaacaaggatctaacagactcggaaacctggaaaacagtcttttttgttccagcatacctttgtattttcagctctgtcatttttttaatcttttcgactggcgaaaagatcttcgaataaagggtggctattttttactattcttttcttcccatttacagtgaggcaggatagcaaaacgggaatctcacatgttg

SEQ ID NO: 1513 - DNA, 737 bp, Sorghum bicolor
  Clone ID: SORBI-28MAY03-CLUS25679_1
tgcaggaacttgcatttcacatgactcgagcacaagtgtgtccagctgtgctgatgatccaagtatgttgactgataacatggttaattttgtggatgtagacctaaggcatggtcagaagcacatgaaaaatgacaaaattgaggtgtacccagtccatcaacgagaaaacgcatcatttaagaaaatgtttttgaggaacctgtcgaggaaactccggtggtcaaagaagcaggcagatacgaatcaggccatgacatttggatcacaggacgcagaaaatcttggacgatatcaactggtttcttcatcggatgatctagaggatggttgggaggtcttgtaaaccgcacatgttttgtttcagctcttatttacagacatatgagatgtcgcatgtgcagcacatccatcggcataaatgtaaattctagttgaggctatgtgaagcagtttagattatctttgagaccttaaatgcatgtagacatgaaaataaggcatacgtactatatatatgtagtcctcttctcactggtagaagtggtggccaattttttttccccataatggggaaagcacacaaattttggtaatgtttaccaatttgccatactgtgtaaaatgcatataaaactgaggccttgtttagttcgtgatttttttttttattttgctactgtatcactttcgtttttatttgacaattattgtctaatcatagactaattatgctc

SEQ ID NO: 1514 - DNA, 733 bp, Sorghum bicolor
  Clone ID: SORBI-28MAY03-CLUS25682_1
aatgctttcttgaagatggcacattctgtagagttcaaagcggatgctacacatgaacatgttttaccgtctctagctgaggagacaaagaaacttctgaagaaagatacaaccatttttacaccgctcgtggcaaaatggcatccacaggcagcagttgtttctgcttctctcatccataaactttatggaaataaattgagaccattccttgagcatgctgagcatcttacggaggacgtggtttctgtatttccggcagctgatgctttggagcaatacacaatgtctgtgatggcttctgttactggagatgatggtttggatagcatatgcagaaataagctagctccatatcagattgaaagtaaatctggtacattagttttacgctgggtgaatggccaacttgagagaattgaaacttgggttaaaagggctgctgaccaagaggattgggaccctatatccgctcaacaacgccatgggaattctattgtagaagtctatagaatcatagaagagactgcagatcaattttttgcatttaaggttcctatgcgagatggagaattaaatagtctatgccgtggtcttgacaaggcattccaagtttatacacagcttgttactgcacccctagttgataaagaagatttagctccgcctgttcctgttcttactcgatataaaaaggagcttggaatcaaggcttttgtaaaaaaggaggtcc

SEQ ID NO: 1515 - DNA, 540 bp, Sorghum bicolor
  Clone ID: SORBI-28MAY03-CLUS25686_1
gcacgaggctccaaaccctaactccaatcggaacggccgaaaaaattcgcgaaaatcgcgcaaatcgcgcacaatttcgctacagactaccttccgggcggtgatgcaatgatgcacatgctagtggccccggatgggggcggaggggagctgcagccgtacggcgcgccgccggcggagcaggagctggagctcctccgcgataacgccgatgacggcctcgagggccacgtgcggtgtctgcggtgcggaatatccggcaatgctacgccccatatgcggcgtgggcctgatggcccaagaactctttgcaatgcgtgtggcattgcttacaggaaggggaaaatgagaagaatgatagaagctgaaccacccatagatgaggcttcgcttgcgaagctggttccagaggtaggcatggaatttgtgagtgaggaaaaggcatacgagttctacaacaaatatgctgggcatgttggctttagcgttaggaaaagtacatcacacaaatcttcggaaaatattaccaaagtaagaact

SEQ ID NO: 1516 - DNA, 609 bp, Sorghum bicolor
  Clone ID: SORBI-28MAY03-CLUS25928_1
cgcccgcgtggctgctcctccagtggcagtgcctggccgcagacggcgccagcgggcgtgtcagggtgaagtactgcgactgggcggggtcggcttgcgagcgctgggtgttccgcaacgacggcaccatcttcaacaccggcaccgggagggtcttggaggtcgtcggagcatcaaagggtggtgctagcggcgggcaggtcgtcgtgtcgaaggccggcaatgggagtcccactcctacccagaagtgggcgctcatgctgtgatcttgagcatgcagcatgtccatgtgcgtgagggcagtactgcaacggcagtggattgcaggactagaggagccagcgtgttttgtgtgtcacgagtcgcgagttgttgggttgttcttctcagcagacagcacgaagacagcaagcagtagatagttcaccaccagtacaataatgcatgcttgcttgctagtgtaatgctactagctatagctaggagtacgtgctccaataaagtctatagctctgtgtaccatttgcctgcagcgcgctgatgcagtgctgtaccccagtaaaatctgttttgtgtttaccatgccgaaaagtacactattcaaatata

SEQ ID NO: 1517 - DNA, 371 bp, Sorghum bicolor
  Clone ID: SORBI-28MAY03-CLUS25504_1
ggaggttggaggagggatggaggacgtcgtagcggtcgtggcgccgctacccgcgccgccggcgccgacgtttagccccgccgcggcggggctcacgctgatcgctgcggcagcggcggacccgatcgcagcggcggtcgtgggagccatggaaggggtgtccgtgcccgtgactgtgcccccggtcaggacggcgtcggcggtggacgacgacgcgctgccgccagaaggggaagcgcgagggggagacccctctgtggccgggagcccgtgctcggtggccagcgactgcagcagcgtggccagcgctgacttcgagggggttgggctgggtttcttcggcgcggagggtgggcccatggtgttcgagg

SEQ ID NO: 1518 - DNA, 757 bp, Sorghum bicolor
  Clone ID: SORBI-28MAY03-CLUS25509_1
aagccgcagtgccgctccctgctcccccgaaaaacggctgaacgcctgaaccctaaaccctccctgcccaccacccgccgcctcgtttcaccccgcccatggccgccgccgctcgcgccgccctcccgcggccccacctctccctcccttcctcctcccgccgcagcagcccccgtctgtccctcacgccctcctccgcccctcctgcccggcgcggcggcgctgccacctccgtcgccgccggcacctccgccgcgccgcagcagcaccaggtcaccgcgcgcctgggcgacgtgatcgaggcgcagcagttcgaccgggacgcgctgaacgagatcttcgaggtggcgcgggagatggaggccgtggagcggggctcccacggcgcccccagccgcgtcctcgaggggtacctcatggccacgctcttctacgagccctccacgcgcacgcgcctctccttcgaggccgctatgcggaggctcggcggggaggtgctcaccaccgagaacgcgcgcgagttctcttccgccgccaagggggagacactcgaagataccataagaactgttgagggttattctgatattattgttctgagacattttgaaagtggagccgcaaggagagcagcagatactgcgaatattcctgttattaatgcaggtgatgggccagggcaacatccaacccaggctctgttggatgtgtacacaataaagagagaaattggcacactagatggaataaaacttgg

SEQ ID NO: 1519 - DNA, 779 bp, Sorghum bicolor
  Clone ID: SORBI-28MAY03-CLUS25511_1
gcacgaggcactttttgatgctatgcaaaatcttggcatcaatcaaaaagaagtgaaacaagtagcatggaactttgtgaatgactggcttaaaacaacattgtgcctacagtataaaccccagtacatagctgctggttccctttacctggctgcaaagcttcacaatatcaagcttcctttgcatggagcgcaagtttggtggcaccaatttgatgttgccccaaagccgctggaagcgctcgtgcatcaaatgatggagcttacggctgtgaaaaaattgatgcctgctcgtcccaatccggttaagctaaaggaaactttatgtgaagctaaactgagcttatctaatagcccagactctgtgttgaatcaatcaagcttgttaataagcagctcaagtcctgatattggcgagcctgaccaagtgcaggtggattcctgtcaatacttgataagcagtcacacgggtgattgtagagtctcaggtcctgacagcagtttgttgaatacttgtgctaatagaaatgtttcttgtaaagcacatgatgaagagagcttggatcaggccttaataaccaaacatgacaatgggatgatgtcttctagtaatcagacatcgttagatgctactataggcactgagggcagtgctatgaagcaggatgtaagccattgtaatgacttcaatatcagagtcaatgacgaaagcttgaaccaggtgtcaagaaatcagcatggtggtgtcccattacctgacgtggtatcactggatgcca

SEQ ID NO: 1520 - DNA, 610 bp, Sorghum bicolor
  Clone ID: SORBI-28MAY03-CLUS25719_1
gcacgaggcatgcgtctcatgactctccctatcgcaccggtagacatgtccctctcagtcaaagccgccacgatcctctcacgtccgttgctacaagtgcagtcgactcccgcgcagatttgacaaatccctacgatgatgatcaacccaacacgagctcaaattcccctacgggaattggctctcccactcgcccatactcgccagggatgaggtccttcgcatcgcaaaaacggagttcaaatgatcaaggggacagtggggaaattcaaatgcaaagctttcacgacggcgccccgcctcctccgccaattgcccactcctggaggaagattgaacgctggttggaaaataatttcgaagaattgttcgacaatctttgtgaaggctgcacacagaatgacataaatgagttggagcatgaactggattgcagtttgccgctggaggttcgggagtctctgatggcccatgatggtcaagagcgtccgggattgcctactggagttatcttcggttgcatgttattggattgcgaggaaattgtgcaggagtggaagaattggcgagttgtcaatgacgaattcctcagtaataacagcaactccgc

SEQ ID NO: 1521 - DNA, 863 bp, Sorghum bicolor
  Clone ID: SORBI-28MAY03-CLUS25723_1
tgaccctttaggcccaatcaaacgcgccctctccccgggctcgcacccgccgccgccattcacgctcgcaggagccgccgccgccgctcacgctccaggctgcgagcccactgccgctcgcgagctcctcgtcccaggtcccatctgccatctgccgtcccgatcgggcgacagcgaggcttcggtggccggcggccggcgcgcaatctgcgggtcttcgtcgaccgtcgtcgtctccctcctctcggccgccggtgcgatgaggcggctgctcgcccacctacacccccatgcccagagcctcctcgctccgctgcctagcaaaccctccatcgccaccaagctccccttcctccttccccgccgcctcctgcccgaggccggctcgcctcctgccccctcgcttccgtctccttccccgcccgctaccgacgtcacgaacacagagctgaagaagaggttggagacttactatggggtggatgaagaggcagagttaccatctgtcgctgaggctgtccttgagcggaatctcacgggtgcccatagtgagactgatgatgaccttattgaggagctgcgtagaaagccaccttcctgaagtcggtgaccaagactttgagtctgattttgaggagatgcacgataccgacgaggagctgagtgacctctacaatgcgagggagcatgttgagaagaagatcaagaacaatgagttgtttaacatggatgataccaagtgggatgcctggatgaaggaggccacagacaagggctgcttccctaacatgaaggtgtgcgagggaatcctcgaggacatgctctactgggacaagttactacctgatgagatcaaacaaaag

SEQ ID NO: 1522 - DNA, 893 bp, Sorghum bicolor
  Clone ID: SORBI-28MAY03-CLUS25726_1
gcacgaggcttctcaaagaattcattgacaccgatacagttacggacaatgggaaaatagttggaacccagaaagaggaggttcaacctatgtctggtggtcaggagcgtgttcttcgtccagttatcagactgcctgacaggaatgcaattttgactcgcatcaatccagagaatcgtgataccagtgttttcgtaaagctcaggcccgcttgggaagaattgaggagttacctaactgcaaaaggacgaaaaagatttgaggtttatgtatgtacaatggctgagagagattatgctcttgaaatgtggagacttcttgatccagcacgcggcttaataagtccacaacagctctcagaacgtgtaaattgtgtaaagtcaggttccagaaagtccctgcagaatgttttccgagacagaggatgccatccaaagatggccatggtaattgatgaccgacttaatgtttgggatgataaagatcaacatcgagttcatgttgtccctgcatatactccatactatgctccacaagcagagatggccaatgctgttccagttctatgtgttgcaaggaatgttgcttgcaatgttcgtggtgggtttttcacagagtttgatgagaatctactgaggaaagtgtttgaattatactatgaaaatgggttactggatcttccatatgctccagatgttggtgactatttagtctgcgaggataccaattttgtaccaggcaacaaagatcaggctcctatacctgagggcatgaggggaaatgaagtagagaagagattaaacgggcagtcatatcggtgggagcaaagggagggacagcaaatgtcattctcaacccgttcaccagatgacgagggaatgcctatccgaggt

SEQ ID NO: 1523 - DNA, 628 bp, Sorghum bicolor
  Clone ID: SORBI-28MAY03-CLUS25732_1
gcacgaggcttatcacagaatgaggaagttattttactggaagggtctcaaggctgatgtggacaactttgttaagcaatgtgagatttgccagaagagtaagcactctactactcttcctgctggctcgcggcaaccattaccaattccatctagagtttggcaggatatctccatggattttattgaagggcttccaaagtctgaaggttatactgtcatcctggtgatcattgacagattgaccaagtatggccattttattcctctcaagcatccttatacagctactatagtggctcatgcttttttagacaacattgtcaaattatatggcttaccaaggagtatagttagtgatagggatcaaatttttacaagccggttctggcagcacctgttcactaagtacaaaatcacattatcactgtccacagcatatcatcctcagactgatggccaaactgaaaggctaaaccaatgtttggagatgtatgtgcgctgtgcagtccaggatgcccccactacttggaaagcatggttgcctttggcccaaatttggtataattcttctcatcattctgctctgggctgttctcctgcaaaagctctgtatggcattgatcct

SEQ ID NO: 1524 - DNA, 623 bp, Sorghum bicolor
  Clone ID: SORBI-28MAY03-CLUS25741_1
gcacgaggcctcacctcgaggatagaagtggagccaatgggattgaacactactgaaggaggcactctcactggcactagacaagtggggccaagggggaagagcatgggcaaagagattgattccataagcagaggtttagggactatgataccaatcattgtcaaggaagggaaaagaaggctagaggctcctatgcaagctgcaaagctagcctcagagagtgggatcataattaggcaacatataccaatatacacaaattggacagagtacaagaaggatcgtcatcaacttaataacttaaagggcaaactcaaaggaagactcgccatgcacgtcgatggcctgccggggtcggccgcatgggaagacttccgtatgggcgccccgcgacagatgaggtatacgcgatgcgcaaggtccttcttggcgcacccgcctttctcgggaggtcctctccgcccttgatgtgtgtgaccgagctgccatgggcactattgggggacaggcggcctggccccttgctctgggccggtcgcgctcaccacctaccgtatcgtggaatgcttctctgtcagctccggccgctcatactattcaaatgcttgttttggttaagc

SEQ ID NO: 1525 - DNA, 533 bp, Sorghum bicolor
  Clone ID: SORBI-28MAY03-CLUS25761_1
gcacgaggctcgaccgcacgtggcggcatcgctctccaagcacctccgcctccgcctgcgcggcggcggcgagcactgcctcctcccctcccgcgcctccacttcccacacctcatcaccagcacctccccctccatcgcgtcctcccgctgcggccgcgccgccgcccccaggggcagccaaggaggccagcgcgtggtccaaacttttcctcttcgctcccggcgctatcaccttcggcctcggcacatggcagctcttccggaggcaggagaagatagagatgctggattacaggacacggaggctggagatggaacccgtggtgtggaacgaggccgcctcatccgctgcccttcgtgatccggcagcactggagttccgaaaaattgtgtgtgaaggtgacttcgatgaggagaagtcagtgtttgtcggacctcgctctcggagcatctcgggtgtgacggagaatgggtattatgtcatcactccattgattcctaggtcgactgagtctggcagcttgcagtcac

SEQ ID NO: 1526 - DNA, 574 bp, Sorghum bicolor
  Clone ID: SORBI-28MAY03-CLUS25779_1
gcacgaggctccattctgctcttccccaactcgcgctcagcggcgctcaggctcggccctcagcgacggaggggcagtcccaggctcggcggcggcgtcgggccctcagcgaccgacaggcagtctcaggctcgccggcggcgtcagcggatcccccgcccgcttctcgcgagccgcctcgcgccctcgcctccgtcctccgcgcaccgaccggcgaccctgcatttgtacatgagtgtgatcttcccattgtgaagtcagaggcaatcaagtatggcttcaagggcaatcattagcagaaggaagtatttcttggatcatgttaacacacctgtcatttcatcgtccgccttctctaccttccaacatggaagactcaggtttgaggttgagccaagaacagaacagcaatttcttgagcgtagttctggggattccaaatgtgagaaggagcaacacagtatgaatttgataaaaaaggatctactaggttttggttatgggtttcggcaacatccagcttatgtgatttctctttctcatggtggaattggaaagaatgaatacgggctgc

SEQ ID NO: 1527 - DNA, 801 bp, Sorghum bicolor
  Clone ID: SORBI-28MAY03-CLUS25781_1
gcacgaggcaacaatcttgagtgattgcaccatacaacagaaattggtatttagcttaaatggtaaagagcttgaccggtctgttactctgtatcagtcaatactgcaggatcagatcaacgtagggtctgacataattctggacatgcagttttggcgcagtgttcatgacataactttcagagctgctaacccagaagcaaatataacagctgttaacccagaagcaaatggctcgccgagacattcctctactgcaatgtcatcaataaatgagaacataactgggtttacatggcagatgctccctttctttcctagtatgttgcttggtaaacttccttgcaaactcgacagatcaggtccttcgtatgacatattgtttatgttacacattttagagggattaaacaggtattcttttcacctcgtgtctgatgagagaaaccgttcttttgcccatggaaggataactaacctcaatgatctgaaagctgaagttttctcgattcctcagcaagagtttgtcagtgccaaattgacagataaattggagcaacaaatgcatgatccattagtttcaaaatctttctgcctgcctttatggtgcaccgaactgatgtctgcctgccctttcttattttcatttgaggcgagatggaagtatttccagctgacagcatttggttctttgaaaaatcatcatggccatatgatagatgcaagtgttaacagtgtcgcagaaagggcgtctaaccactcacggaaaaagttcaaagttgatcgcgatgatatacctgg

SEQ ID NO: 1528 - DNA, 681 bp, Sorghum bicolor
  Clone ID: SORBI-28MAY03-CLUS25581_1
aagtgttcgtctattatgagtctataaagagaacattgcttggaggaccaacatgtagtatttcgagatcaagtccagaattctagcccagccagaaatgaagaatatcatttccaggttgaactagcaggattgattctcgggaggggcgttggttcggacagagaagctgcgaagcttctggctgcagaagaggcactgaagaccttaaaatcaacctctgaccctcaaattaagaagtatctgagacctgtaagatgcaatggctgatttccttccacgctctgagctccacattcaaatgaacttaacattcaagaaggatgtaatgtgagggcaacagctcatcaccgttacagaagtcgtcattgatttagcagaagtgcatcaccctttctgtgagtatggttggcatctcacctcgagcacatgatgtgtgtcaaactgtaagcacatgtcttgttctggaaagcctggttttgaaggtggtaacatagagagcagagatggtgctttatggattcttttgaccatcttcatcaaagaatcttcccatgtacaacttgttcccatacaagtatagatgttctgtctggtttaggatagtgcatagttggctgtaaagaagtaggagagtagatgtggatctaacattataagttgttcttaagggtgggtgac

SEQ ID NO: 1529 - DNA, 635 bp, Sorghum bicolor
  Clone ID: SORBI-28MAY03-CLUS25604_1
catctctcccgaaactcaaggaagttatgattgataataagtatagtcacagtgtaaagtgggtggacgacctgagggcccagcttgccaggaatataaacaaaccagttgtgaagtttattaactgacgtcatgctccatcgatccatttgaggagcagcgatcggtacctttccgacaggagtttgaggagcagctcctacaatgcatccatggggtttggattctaaagaaggcacaccgcctaagcttgagctgttgcttgcaataattgcaaggggccaaatctcttttatcggggctgtatcaatgtctccggagtctcaaggaagttatggttcataaggatgcaaagttggtggatgccgtgcagccccagcttagaatggatccaaacaagcccgtgctttattcgtttttatttatattaccttttctgcttcctgtttccctgtccccctccattttatgtgtgtttccatgtatgcgtgttaaattcaactcgtgtggtcgttgtaccgctagtggcctgtgtgtttcatctgatggttaccaaagttgtattaatttcctttgtggtttatgtatgtggatcagaataactggcttgctttactcactacagcccgatgtgt

SEQ ID NO: 1530 - DNA, 460 bp, Sorghum bicolor
  Clone ID: SORBI-28MAY03-CLUS25817_1
gcacgaggcttttttcactgcaaccccttagctgcttttatgaagattctccagagcaaagtggcaagaaagtaaattgcataatccacttaggtccatcatctgtgactagatctgttgactatcagaactggatgaaaaaatttggcgcaacacaacatatcatggcaggacatgaaattaaaaatatggaaattcctatcttgaaaggtagtgcaaggatatcatcacgcctcaattttgtatgccctcagctcttcccatcctctggattttggtctgtacaacctccaaatgatgtcatggagaatgataagaatgcttcattggaagcctgtggaagtgtgtctgcgcaaaacctactaaagtttcatctgcgtccatatgctcaactgggtttggatagagcttctattccaaacttgttcacctacaaggatattgtacaagagcttgtatc

SEQ ID NO: 1531 - DNA, 837 bp, Sorghum bicolor
  Clone ID: SORBI-28MAY03-CLUS25836_1
gcacgaggcacaagccgcagtcgtccgtgatggaggcgttcagtgggttctacgtggacgagaaggcggcgcgggtggagaacatcttcctcgagttcctgaagcgattcaaggagtcggatggcgcgggggagccgttctacgaggtggagatggaggcgatgcggtcgcgggagtccactaccatgtacgtagactttgagcacgtcatgcgcttcaacgacgtcctccagaaggccatctccgaggagtacctcaggtttgaaccatgcttaaggaatgcatgcaagaggtttgtgttggagcaccgggctggcgagaaccgtgccccaatcatctcagatgatagtcccaacaaggatatcaacattgccttctataacatcccgatgctgaaaaaactgagagagcttgggacagccgaaattggtaagctcacagcagtaatgggtgttgtgacacggacaagtgaagtgcggcctgaactattgcaaggcaccttcaaatgccttgactgtgggaatgttgtaaagaatgtggagcagcagttcaagtacactgagccgataatatgcgttaatgcaacttgccagaaccgaacaaaatgggcccttctccgccaggaaagcaaattcacagattggcagcgggtcagaatgcaggagacatcaaaagagatacctgctgggtcgcttcctcgttcccttgatgtcattctgcggcatgagattgttgagaaggctagagctggggacacggttatatttactggaactgttgttgcagttcctgatgttatggcactaacttcacctggtgaacgagcagagtgtcgca

SEQ ID NO: 1532 - DNA, 527 bp, Sorghum bicolor
  Clone ID: SORBI-28MAY03-CLUS25843_1
gcacgaggggaacatgatatgcaatccttcgtgtcttcaaaagatgaggctgcacaagggctaagaaagagtgtacaaaagctcaaagtcttgcatggttctggtatcactgctttggatgatttagcgggtgaaattgacatgaattcgcagacaacatttgagagattaaattcacaaatacaatcacatacatcagcccttgagaaatgtttcggaggaattgcttcggaagcagatagcttgttaaatgagcttcagtgcagcctatcgaaacaagaagagagactagcccattttgcaaagaagcagagggaggtctgcatcttgtcgaagcataaaatcatttgctgttctcctaagctgctttgtgttgtaacttttgttgctgggtgcagggacacctgagagctgtggaagcatcacgttccatctcaaagatcactgctggtttcttccactcgctagatgttcatgcatctaagctcaccagtattttggaagacacacaaagcgtgcaagatcaa

SEQ ID NO: 1533 - DNA, 670 bp, Sorghum bicolor
  Clone ID: SORBI-28MAY03-CLUS25887_1
gcacgagggaacaatttgatgaagattccaatggcgaaatagataaagaagaactgaaacattgttttcaaaagctggaaatctcattcacagaggaggagatatctgatctctttgaagcttgcgatataaatgaagatatgggcatgaagttcaatgagttcattgtctttctgtgccttgtctatcttctcaatgaaccagctgtctcagaagcaaagataaagatgggactaggaaatcttgaggcaacttttgagaccttggttgatgcatttgtcttcttggataagaataaggatgggtatgtgagcaaggatgagatgatccaagcaataaatgagaccacaacaggagagcgctcttctgggcgtatagccatgaaaagatttgaggaaatggactgggacaagaatggaatggtgacattcaaggaatttctctttgccttcactcgttgggtagggattgatgaaaatgaggatgacgatgaataaggactttgaaggctggttattcttcaagggttgggagaagatcagccccggagaggctggaaattaatgacagataaaagtagttggtgttcattggttgcttgttgatcatgatgttcatgtcattgttaatagaaatgtctcaacatactcctagtaggatgacttgcatg

SEQ ID NO: 1534 - DNA, 586 bp, Sorghum bicolor
  unsure (1)..(586): unsure at all n locations
  Clone ID: SORBI-28MAY03-CLUS2589_1
cgacgacggtgttcccggtgggcgagccgggcccgcgggcggcggggacgacgacgacgaagaaggcggcgccggcggtgaagctgctgacgaacgtggagaagctgcggctgctgacgaaggcggagcgcgcgggcctgctgtcggcggcggagcgcgcggggctgtcgctgtcggcggtggagcggctgggcctggtccgcaaggcggaggagctgggcgcgctgtcggcggccacggacccgggcacgccggggaacctgctggcgctcgcgctcccgctgctggccgcgggccccgccgtcgtgtacctcgtccccgaggagcaggcgtggcaggtggcgctgcaggccgtcgccgcgctcgtctgcgtcgtcggtggcgccgccgccgtcgccgcgtccacgttcgtgtccaggctgcagggctcctccagctgagacgatctcgcacgcgtttgcagccggattagcaaggcattgctctatgcttgtaacattttttttttggggatttgtgtgctcctgtgtnaagataattgngatttatatatatatatgtatatatatatatatatatatatata

SEQ ID NO: 1535 - DNA, 453 bp, Sorghum bicolor
  Clone ID: SORBI-28MAY03-CLUS25906_1
gcacgaggctttcaaatcaaagttcatcgactgtcacgaggactctgttcccggccttgcagatgcttatgctgcggctcatgctggtattgtgccctctaaagtctaattttgcatctccttttgtgttttaggtaggtggtggaactgtaactcatgctcattagcagctgtccactgtgcacgcattttcgattctgatttctgcaagagaaccactagtgaattctgattactgatgtatatttcaatttcaagtaattttttaaggagctgagtgcggcttattctacagccttgttagtttcttaatgaaccactagtaattttttaatgtgcaagcttgttagtttcttcttctacttagaagttaggacatggctgaaagttatccttaacttagttttccttctctgaataagtctttgtgtataacttataagcttattggat

SEQ ID NO: 1536 - DNA, 622 bp, Sorghum bicolor
  Clone ID: SORBI-28MAY03-CLUS25903_1
gcacgaggaggagggtttttatgttactgctatggccacagcaggaagtcggtgggcagtggtcatgtctcggaattctggcttttcggcacaggttgtcgagcttgatttcttgtatccaagtgagggtatccatcgacgctgggataatggatttcgcatcacagctactgcagctacatgggatcaggcagcgtttatcttgagcatccccaaaaggaaacctgctgacgaaacacaggaaaccctaagaacgtctgctttccccagccagcatgtgaaggacaaatgggcgaaaaatctctacttagcttccatttgctatggaagaacagtgtcatgaggtctgccctgtttggctggtgtacactgtagagtttatttatatggattactgaattactagatttggaattttgaacggcaacaatatttctaatttgccctcctataattaaccaatctgatagaagcggaagcctgctctgttcagttgatagttgccttagctgcctagcatggttgtaaaaaaaaaatcttgtggtgtttgggtgttgtacttgcttgttcatagattgttaaaatcattgtgttgtaatttgtaaactatctatcttgcata

SEQ ID NO: 1537 - DNA, 762 bp, Sorghum bicolor
  Clone ID: SORBI-28MAY03-CLUS25703_1
gcacgaggattgagtcagggggaaaaagtcaaagcgcatgaagagttcattgaagaagaaaacagatatttccaaacatttagatggactcaaaaccagtcctgttgctgacagcagaacactggacaagaagacagtagatgatgttttgagcgagagaaaatctgggcgcacgctgaggtccatgagcaagaaggaaggcgcgtgggagggtttgaaaaggctggcaaaggatggaaatgaggaattaacaggaaaaagcaaagatgcctcggttcttaaagaaaacaatcagaggtatggagcaggctctgcacacaagaggggtagaatcacagaggatgggtatcatagacttggagatagcaatgctgaggatctcacttctgacaagagaagatcggggcataatgaaaactcaataagcaagcgggtgtccatctcggagcatggtaggaagaagaagaaactttctgaactcatggcagggacaggcaggcctaattctgcatcgggtggcaaaactcgagggaagcgtttgttgcatgattcagttgagaaagctgaggatcctgatcatcactctaaggatacattggtgactaggaaaagaaagaagctcaacacattgggggatttgtcttcacagtcagagcctctctctcgtaagaagtccacaaaggttggagaactgatgagcaaagcagctgggaacagcatacaggcagcacctgctgtcggagctaatagtgcagtgtctca

SEQ ID NO: 1538 - DNA, 774 bp, Sorghum bicolor
  unsure (1)..(774): unsure at all n locations
  Clone ID: SORBI-28MAY03-CLUS25718_1
gttacaggtacgaccttgccgttgcggctgcggtgctacaaacaaaacccttcttcccgtcctccgctgccaaccagtcctccatctcggctccccgatctcatcgtcctactccgccgccacaagcgaatccggcgatcggggcgacaaggacgggcgccgtctcgcgaccgaatctcatcgttcttgtttgtgataactgaagtagcacatcccctccggcggcgtcgcggccccccgggctcttgcccctccagacctaaaccatggacgtaggaccgaactccatctcgtcgcacaagagccgcagccgcagccggcgcgtggcggcgccgcggccggcgctctaggaggcggggtccaagccgtacatgccaccgctcagcaccgggtcccgcaacccattggccaagtgctacggcgacaggttcatcccggagcggtcagcgatggacatggacttggcgcactaccttctgacggagccgaggaagggcaaggagaacccgactgctagggtttccccggccaaggtggcataccggaagcagcttgccgagaaactgctcaacaaccgcacaaggatccttgccttcaggaacaagccgccggagcctgaaagcatgctcaccgatccccgtgctgatgcgacccaagccaagccaacgaagcagcgccgacaaattcnccagtctgcggagaaggttctggatgccccagagctcgttgacgattattacctgaacttgctagactggggaagcagcaacgtgt

SEQ ID NO: 1539 - DNA, 783 bp, Sorghum bicolor
  Clone ID: SORBI-28MAY03-CLUS25983_1
gaaggggtggcaacaggcggctgttgcatttggttctgcgtttggggccttgcttgacccaagaagggctgatcttatagctgctcttggagagactactgggaagccagcgtttgatcttgtgctgcaacgaatgaagaacagtgcagaaggcagggaagttcttttggagcgtcctcgcgttatatcctcgcaggtttcccatgcctgggacatgcctcagaacacatttggtgcggcgtatgctcagtttatgggatcaaggaacttctcaccagatgatcgcccacctgtccgtttcatggacactgatgagcttgcctacgttgcaacccgtgcccgtgaggtgcatgacttttggcatgtgctatttggccttccaacaaacctgattggggagactgccctcaacgtgatagaatttgaacagatgttcctgccaatgtgcatgctgtcagttgtcgggggctctgcaaggttcagtgagaaacaaaggacgctgtttttccagcattacttcccatgggcaacaaaagcgggtctcaagtgtactgatctgatgtctgtatattacgagaagcactttcatgaggacctggaggaagtgagaagaaactggggaattctaccatgccctaatccccaaaagagcaatgtatagactatacactagcatattctgcatgaacttgtatttgtttcatctttggttccgttagttgcccaattcttttggaacaacgccatgacctaatgttactggatactgatacattagaaagt

SEQ ID NO: 1540 - DNA, 498 bp, Sorghum bicolor
  Clone ID: SORBI-28MAY03-CLUS25987_1
tgtggggctacttcagccagcgcacggggctgctcatccagctcgaggactcgcacctgctgcgcatgaagtccggcaagggccaccgccgcagcgagaacatcttctgggagaccagcatggagtccgtcatctccgactaccgctgcatcgacggcgtcaacatcgcgcacggcggccacaccaacgtcacgctcttccgctacggcgagggctccgtcaaccacaagcgcaagctggaggagacgtggacggtggaggaggccgatttcaatgtgcacggcctcaccgcggactacttcctgccgccggccgacctcaagaaggacgtcgacgatcagaataagtagtgatcggctagcgtttgatttttgactgatattaattggttggaggacatccaaattcttcatccaggcaattttttcgatagcaatagcaggggtggccatagttgtattttgtgttcttccatttctctgtttttcagatggaatg

SEQ ID NO: 1541 - DNA, 433 bp, Sorghum bicolor
  Clone ID: SORBI-28MAY03-CLUS25993_1
gagtcggacctgccactgcgtccgccgtgctcgccgcgtatgcacctgatgtcgcaccgttcatgtctgacgaggcgatgctagcagccttggccaatgcaaaggagtacactctgaagcagtacctttcatttgctgacaaattgcaagcaaaagcaaaggaactgagcataggagaagaaagtttcacaccctcgagatgttgagagagcactgtggagctcagcaattgcatccaagtcaccagcaagcggcaacccaaagagtgaatcgaagatgcatggcaagaggaaaagatgatttacactgcacttctttactaagcctagaagggttttactgactgcaggtctaagattcttagttgaacattttagtttttgtaatcttaatctggggagtggaatcctttggtggagcagaatgtgaaatg

SEQ ID NO: 1542 - DNA, 521 bp, Sorghum bicolor
  Clone ID: SORBI-28MAY03-CLUS26005_1
gcacgaggcaatttcaggattttggcacctttcgttctgagttcgtcgcgactgtgagatactcctgcagccctactcgcaagcgagcaggcagaatggagcgccgcgccgtgaccgtgaacccggtcctcgtcgtccttgtgctccttgtgctgtcctgcctcctcgtctaccccccttcgccacctcccccacaccacccgtactcctccgttgccatgccaagaagtctgcgcgtggggagccagcagcagcaccctacggctctgaagctcacttcttctcaggagatggcgacgccggcgataaactttgaggtagatgactacccaccgcctgaccataagtccataaccaccaccatggcccgggccaatgaagagcttgaatgaagctggacccaataatcgttcgtctttaccagtgtagtactacaaagtgctttgttagtgctcctgtatcatagaataattaaaaaatactaatggtccctaactccctatattgaagaaggttgccag

SEQ ID NO: 1543 - DNA, 511 bp, Sorghum bicolor
  Clone ID: SORBI-28MAY03-CLUS26051_1
catcattgtcattgcgactcgcgacgcatgcttcagcaagcagcagtcggtgatccagcagctcctttcgcgcaaggggcgcctgatagttatgtgctcgaggggagacgcttccgctgtatgccctagtggatcctgcagagtcattgaagttccacaggttgcagattgtctccagccagtgattaacataattccattacagttgctggcataccatctgactgttctccgtggattcgatgtggaccaaccaaggaatctggcgaagagcgtgacaacgcagtaggtagaggtggatgagatgtgcgaacgacgacttgtatccctatgttgtactgggcaggggttctatagagaggcatgccggctatatacagctgttggtttagccatttttctttgtgcatgtaattattcttattcttgatcttgagaggctggtagtattactgtacgttaaacaagggagtggtttcgaaatgcatgatacatacaaaaggtattttcg

SEQ ID NO: 1544 - DNA, 718 bp, Sorghum bicolor
  Clone ID: SORBI-28MAY03-CLUS26081_1
agcaaccaactggatgcaagattttcatctgctgtcactgctgggtttgaagatagtgacatttcaagcaaatcccttcttagttcttttgacgattcattaaaattggaccatggtatttgcgacaatgtgaaatccatcgtgatgacatccagaacagaacttcatgacttagaacatggtcactatgagaagacaaaagtagtaacagggaatgccgatagatctctgggagatgattataaggtggatgaagcaacttgttcaacaccgagaaggcgtgagatcaacattccggacagccaatcgatcagggggttggtaaccccccttgatgatctcgtgaaggcattttgggacagcagaacaccgacgaagcttgctttaactggaaacgggaagcagcagttggcagggtcgacgacacccgaaacacagagagcccctcttgccgcgataaactaggtgcatcattgctgtatagacaaagtttcaggtggcagtgtcttggaattgaaccattaaaaatctgcagttggtgtggtcaagtaatattgatcaagaaggttgagagaagttaatggtaaaggcctatctgtttatatgcatattttgttcagggtgttaggtgtatgtatgtgtcttcagattcatcatccaatgtatgattgatactagcaggctgtacactagtgaatggaatcatacatgtatataa

SEQ ID NO: 1545 - DNA, 457 bp, Sorghum bicolor
  Clone ID: SORBI-28MAY03-CLUS26121_1
gcacgaggatagccgccggattcactcgcagtcgcagttgctgcgggttgctccccacatttgtcgacggtcgccggctccccgtgcaacgcgccgcgctaacgatggccgagacggtgggcttcgcgagcggcgacgcggcggcgtggcgcgcggcgctggccgcgtacgaccgccgtctcgcggccctggacaaacccgacctcgtggcagtggactccttctaccgccacgacctccccgccctcctgcgctgccgtgacccggaccccttcctcgccaagcccgagctggtgcgcctcctccagtggaagctctcacgcggcaagtggagaccgaggctgatggatttcgtcaagggcttggacgacgccgtggtggagacggcgtcgcgcaaggcgttcgcggctttgcccgacctcagaagggccatcaccgagctcaccttgctcaaggg

SEQ ID NO: 1546 - DNA, 871 bp, Sorghum bicolor
  unsure (1)..(871): unsure at all n locations
  Clone ID: SORBI-28MAY03-CLUS2609_1
gcacgaggcccgccctcgtcgtcgacgccccgacgcaactgctcccatggccacggccgtgcccgccgcgtccctccgcgcgccgtcctcctctccagcggccgccgcacgccgccttggggccggggccccgtcgctgcgcaagcggcattgcgccgtcgcgcccgtcgccgccgcctgtggccccgcgccgccgcggcagctcgacaacgaggaggcggcttgctccggacggcggcgggtgcttgtggccggtgccgccgcgttcctctcccggcctaatccggcggcattcgcagcagaggctaagaaaggtttcctgcctgtcgtcgacaagaaggctggctactccttcctctacccgttcggatgggaggaagtggctgtgcaagggcaagacaaggtgtacaaagatgtgatagagcctctgcgtccggtgagcgtcaactctattccaactagcaaggaggatattcgtgatcttggacctccggataaggttgccgaagctttgataaaaaaagttctggcaccgccaacacagaagacaaagttaattgaggcgaaagagaatgatgttgatgggagagcttactacacttttgagttcacaggtcaggctccaaactacaccagacatgcacttggtgctattgtgattgcaaatggtaaattttacacattgaccactggagcaaacgagagaagatgggaaaagatgaaggataggctgcatactgttgtcgattccttcaaaatcgaaaatagaatatgaggaatgcctgaattgctgtgctgtttttccttttgttgatttgctttcttttggagctgcnatggtgagattttagtantaaatgtcgggaatgtg

SEQ ID NO: 1547 - DNA, 641 bp, Sorghum bicolor
  Clone ID: SORBI-28MAY03-CLUS25792_1
aaaaagcaaattaatttgtcgacacatctctgcctttccttcacactttccaattcagttcaattttcattcgaattcgttttcgttttccgttcgttttggtttttgttcctttctcacccgaacacgtccgtcccgtccgccccctccgcccgccgccgcccccccccccccccccgccgcccccgtcccccccccgcccccccgccgccgccgccgccctacccccccatcccttctccccctagcctcggcccatctcccccccgtcgtcccgccccctcgcgtcccctccgccccgctcccccagtctggggtttcgcgccccatggcctcggcggtgggcgtcgcctcggcgcgtgcggcgtgcgatcgccgggcggggtgtcctgagagcttcgcggaggaatctagggcttgaggagatgattgcggagaagccaagctggattcgccacgagggcctgcagatcttctccatcgacatccagcccggcggcctccgcttcgccactggcggcggcgaccagaaggttcgaatatggagcatgaaatctgtggataagaataatgccaacaatgattccagccaagggttgctagctacaatgcgtgatcattttggatcagtaaattgtgtg

SEQ ID NO: 1548 - DNA, 535 bp, Sorghum bicolor
  Clone ID: SORBI-28MAY03-CLUS25814_1
ccgaaccagcccaccaccaccgccccctctccaatgcgcgccgccgagcccgagccgactccgccgccgccgccgctgtcccagccaaggtagccagccatgtacacggtgcgcccgcacgcggcgacgtcgacggtcatcctcaactgcacggaggcaccgctcgactgcctcccgctctgccccggcggcggcgaggcgccctgctccgcgtacgccctgcccccgccgcccccgctcccggtgatcccgcgcgcgccggtcgccgccgaccgccacgcgcccgtgcgcctcctcctcgtcatctccctgctctccgccttcctcttcctctcgctcgcgctctccacgctcctcctctaccgccgccgccgcctcatcctgcggcgccgccgacgcctcgcggcggcggccgccgccgaaggggccgacgacgacgacggcggcggagggttcggcgacgaggaggagggcggtggaggaggggtggtgcaccacgtgtggtacatccggacgggggggctcgacgaggcca

SEQ ID NO: 1549 - DNA, 507 bp, Sorghum bicolor
  Clone ID: SORBI-28MAY03-CLUS26202_1
cactgttaagtctgaactagacaagtacctttcagaagataatgaggagcatagtaaaggttttgatattctgaaatggtggaaggacaatgcaactagatttcccatcctatctcgtatggcccgtgatcttctcgcaattcctatctcaacagtagcctctgagtcagcctttagtgcaggtggaagaacactggatgattttaggacctcacttactccaacaatggttgagcggctcatttgtgcaaatgactggaagtggaacctctcctgcaccccattggtcaactactcagctccccagttatcagaggagggagcatcatagtcagcaactgcagcatagtcaagggcaacaggagcctcctcttcttccagcttgtttgtttccactggatcccaatgaaagaaaagatcaacctagataacgagaaacaaccccaacagatatgaaataagtggacacaaaactgttgcttaagatcatcgaagtttactatgact

SEQ ID NO: 1550 - DNA, 499 bp, Sorghum bicolor
  Clone ID: SORBI-28MAY03-CLUS26197_1
gcacgaggggtgagtttgttgatgagcctaagccacaccggtcagaagactgtgtatctctacttgctgagctcgacacattcaacaaccaacaaggccagtcgccttcaccatcaaatgtgcaagagctcgccgagaggacactgaaagcatacctcaatgttcggcgaggcgttgagcagctgatgagcaagtacactgtgaaagcatgtgggtactgctctgaggtccatgtccgtccatggggccacaatgtgaagctttgcggggctttcaagcaccactggcgagatggcaagcatgggtggcacgacgcggtggttgatgaggtcatccctcccaactacgtgtggcatgttcctgaccccagtggccctcctctcagatcctctctcaggagtttctatggcaaagctccagctgtcgtggaactgtgtgtgcaggcaggggctgaaatacctgacgagtatcggcccatgatgaggactgacattgtcgt

SEQ ID NO: 1551 - DNA, 581 bp, Sorghum bicolor
  Clone ID: SORBI-28MAY03-CLUS2622_1
gcgtccggtggttttagcaatggcttcttccccttcataattgctgagaaggatgtatgctctgaggtttctgagctggagagcatatttgagtcctccagtaacgaacatgcaaatgttaatgatgatgctagggaccaagctctggagtttataaatgagctgggttggcttcctcatagagcgaacagaatgtctaaagaggatgaaactgatacgtctctagctgcctttaacatgtggagattcaggaatcttggtgtatttgccatggagcgggagtggtgtgctgtgatcaaaatgctgttagatttcttatttattggccttgttgatgtgggatcccgatctccagaagatgtggtgctttcagaaaatttgttgcatgctgctgtacggaggaagtctgttaacatggttagatttctgctgagatacaaaccaaataaaaactcgaagggaactgcacagacatacttatttagacctgatgctctgggcccttcaacgattacccccctccatatagcagctgccacaagtgatgcaaaggatgtgttggatgtgctgaccgatgatcc

SEQ ID NO: 1552 - DNA, 560 bp, Sorghum bicolor
  Clone ID: SORBI-28MAY03-CLUS2625_1
gcacgagggatcaatgcttttgaattcacacaatggtgctgtggaagttgatgaaatagagattgaagttcaaaataatccaggtggtggtgttgggatacagccagaaagacagactgtactagaaaaactgaaagaattatcttccctacgacagcaagcggccatatcttcccaggattgtactgattctggttcagatcaatgcgtacctgacgtccgccagaccaacccaaatctttcctgtggcctgtttgatgctacaatggaagataaaacctcatttgacgagtgccatggaaatgctgaggtgatgcaaatcatcactcatttacagatgagaactgaagcattggagaagaagctgattgggtcagatagagaaatactttcgttgagggaagtagttaaagactcaggaagaaaagttcagcaactggaataccttgtagatgagttacaattcaaatttgactcttcgctgtctcttcttggaagcatgtgcaatactctagccaagccatcaatattcctgattggtggttataatggtgtgacct

SEQ ID NO: 1553 - DNA, 259 bp, Sorghum bicolor
  Clone ID: SORBI-28MAY03-CLUS26349_1
tctgcaatctcaaccagacatgtggataggccgtgccgcgcctctgcctgttgggagcagatattatggcaattgcttatgatatcactaacagataatcttcaactaaactacacagtagattggccagggagaacggtatagcatatggttgtatacacttgaaaaaggtctaaagtattaaacttagcaatttttttctaaaaaattcttactacatattgatgctggatagtaaggcaaattaatgttgtgattg

SEQ ID NO: 1554 - DNA, 208 bp, Sorghum bicolor
  Clone ID: SORBI-28MAY03-CLUS26388_1
gaacagagcagggaggaggctttgagtttgaggccgtgacagcgcaaccgactgcgtttctgtaccactttctttttctggatggatggttctcaagatgtctggatatgttttatatctgaatgaaatccgaaaagggtggtaggcgggcaaagctaaccagctaaactctgcttccactttttgaacatggtaaaatttcgtttta

SEQ ID NO: 1555 - DNA, 177 bp, Sorghum bicolor
  Clone ID: SORBI-28MAY03-CLUS26386_1
tgcactcagccaagtacaaccacagaataccatagcatgtatcttacgatctgctgtctctaccatctgatgtagaccaactgctcttggagaagctggaggcagagattcagtgctttatccttacaagagcttcgcaggattggaaactcctgaccaaggatcaatttgctcgta

SEQ ID NO: 1556 - DNA, 714 bp, Sorghum bicolor
  unsure (1)..(714): unsure at all n locations
  Clone ID: SORBI-28MAY03-CLUS25931_1
gnncnagggaggacaaagaatttgaaaaccagaatatctcagagaagggcctatcagatgcttaccaaaatgtcttaaataggcttgcccagctacagaaacttgggaaggttggtaaaggtgctgacaggaggaagcgatnnnnnnaggactggagctggagccatgtatggacgctgtgaatgttggttggaaaaagaacatgctgcttgaggatgtggtggatattgacattggctatgatgcacctccaccatcgtttactgctggtatggagttgcagaaggagaggagagcacgtattgaagctgccaagcagcgaattgatgcaattaggaaggctcctgctgctccagctgcaaaagcaaataattcagaagatgttgtaagtaatgaatatgcccctcccccgcaaaaactgaccaggaagagtcgagggggaaagaagctggatgatacagatcatatccttctcagtgacaatatggcagatagttcaggtgtcaggaaaaagagacgaagaagaggttcctgtgacggtattgattgggaagattgcattattgagctcctgctactgcatggtgcgaatgaagatgagatcgaacaaggccagtacagaagattgttggagttgcatgtattcagtgcagtaagtggggggaaattgaatacatggcaatgctgtgtctcaagtcttcagtatagatccta

SEQ ID NO: 1557 - DNA, 512 bp, Sorghum bicolor
  Clone ID: SORBI-28MAY03-CLUS25945_1
gcatatccgtgcagatcaatcaccaagatttactacttgtgctagacgaaatttaagggaacaaattcgtaggccggccgagccgagaagtatcacgcgatggccgcgtcgaccaggcgagccgcagcggcgatgctgtggctggcggtggcgattattgccgcggcgctggcggcggagacgggcggggcggaggcggagcagctggggtgcttctgcgactgcatgaagaaccgatgcatgacgctcggcgcgagcgcagacaagttcgactgcgcggccgcctgcaccggcggctgcacgcagatcggccagccgggccagcccagggccgacgacttttgcggcttctgatgagcccgcaggctcttgggcttgcaggttagcagcccagttggacgccacggcgaccggcccagtccagaatgatgaattcatgcatcatgtgtgcatggatgtcccaaaacatgcgtgtaaagctgactgttaatattttgttattattattatta

SEQ ID NO: 1558 - DNA, 801 bp, Sorghum bicolor
  Clone ID: SORBI-28MAY03-CLUS25815_1
gtcctgcggcctcgcatttacaccgcgcctccctaggccagcggtaacagcaggtcgcacagccagccaggcggcagccagctgcgagcggcgagttctttaaggaggcggcaggccggtgccggtgcctttgccttggcgtggagtggagtggcctgcctcccataggctacagccttcccggagaagacaagcaaagcgagcgccgcaccattccgttcttgtccgttgttcctgctcccttgctgctgctgcttctcggagccactagttgctgccgtgctgtgctgcctcttcgtactgtgcgcgaggctctgcgcgcggtcgcccgctccctgcgcgcgtcaccttgctggtctccctcttcgacctctccccggcgccagggcgtccagcgcctcccggttcatcaagtgcgtcacagtcggggacggcgccgtgggcaagacctgcatgctcatctgctacaccagcaacaagttccccacggattacatccccacggtcttcgataacttcagcgccaacgtcgccgtcgacggcaccaccgtcaacctgggcctctgggacactgcggggcaggaggactacagcaggctgcggccactgagctaccgcggcgcagatgtgttcgtgctcgctttctccctcgtcagccgggccagctacgagaatgttatgaagaagtggctaccggagcttcagcattatgcaccgggtgtacccatagtgttggctggaactaaattggatcttcgtgaagataagcactacttacttgaccatcctggcgcagtacct

SEQ ID NO: 1559 - DNA, 129 bp, Sorghum bicolor
  Clone ID: SORBI-28MAY03-CLUS26400_1
taaacagttcctgcaatctaactaggttgtacttccagcagaactgcacaacttccactggcatggccagaccactacctcctaatccatcaactagctttgtctcgtcaacaacaacgataaacttgg

SEQ ID NO: 1560 - DNA, 479 bp, Sorghum bicolor
  Clone ID: SORBI-28MAY03-CLUS26406_1
accatattctcaggttctcttgtataacataaaacaagcatgtctcatattgttccagagttgtaaccatatgaatactctgcaaaccagagtaaagaaaactcactaatagtacatgcaattttagttcaagaaaacagcctgttctataaaagaacagcaaagcacaactaacttggagcagcattattcttcaacttccttctttatttcttccatgagttcatccttgtaatcctcaaatgtgccgtcatatctattcacagtcccatcctccacaacccatatctcactcctttgctcatcctcacaaacacgagatattaaccgtgagtcgtggctaaccaagacgacacctccagtgaattcgtccagtgcgtctgccaatgcatcaatactttgcatgtccaagtgattcgttggctcgtcaagcaggagtatgtgagggtgagacattgatatagaagtgaacacaactc

SEQ ID NO: 1561 - DNA, 119 bp, Sorghum bicolor
  Clone ID: SORBI-28MAY03-CLUS26408_1
tatagaccagggctgttccacttccataccaacaaccagagtaacatgtcgaagttatgcaagttcttacgagatggatccatcatctttttccctggacacagatgccttgagaaatc

SEQ ID NO: 1562 - DNA, 116 bp, Sorghum bicolor
  Clone ID: SORBI-28MAY03-CLUS26420_1
gtagctatcatcatgccaaaagcagagaatggaggttacgtaacaggatcctgctgccacagtcattgtgtctggtggactaatatctccccaatgcaaaacttggattcaggtta

SEQ ID NO: 1563 - DNA, 131 bp, Sorghum bicolor
  Clone ID: SORBI-28MAY03-CLUS26432_1
taagccattgtttcgtctcacaagctgccgatcctacctgtcgagcagccgtgtcgccgcacgcaccggagaaacggtcttgtagagaaggcgaaatgcagaggctgaccagacattgcgcaggtgtggtg

SEQ ID NO: 1564 - DNA, 117 bp, Sorghum bicolor
  Clone ID: SORBI-28MAY03-CLUS26435_1
tataaaactatatactatgttctataacttggataagcagcgttctctgcattatgtactagaatctggaagggtatgtagaaaatttccaaaggttttgggagatccatgtgttta

SEQ ID NO: 1565 - DNA, 560 bp, Sorghum bicolor
  Clone ID: SORBI-28MAY03-CLUS26446_1
tttgcccatgcatcatgagcaatctcaatgttcttgatttgctgtcatcaagagcttcatgaagagcactaatggcaatatcattacattgtagtttcttctcttctactcgtgttggtgtattctgatttgcaacctcaaactttgtttcggtcactttccaaacctctctattgattgacctgagatgggcggtcatcttaaccttccaatatgcataatttgtgccatcaatgtaaggtgccttattggtgttgttgatatgcaaagtaagagccattccttcaccgaaggttgtcaagcctcaaataaacggtgcctcggctctgataccacttgaaaggtccaaatggctagagggggggtgaatagcctattttaatttttctacaaacttcaactagacaagttgattagtaaagcaagtggcgaagctattctagcactagcacaactaagctatgcaagccacctacacaagtctagccagaaggctaaacactaagccactacaacctggctacactccctaaccagatagctaagctaaaccctcgtgc

SEQ ID NO: 1566 - DNA, 452 bp, Sorghum bicolor
  Clone ID: SORBI-28MAY03-CLUS26470_1
taaagaatcaaacctagattcatgcttccagctatgaaatgattggcgtttgcacattacaaaacctgctagttacattacatacatcaacttgtgtcggggggttctgaagatttttcatatcagcagcgtattagccaggctatatggctggctcatctgatcacggtgaagaatggctgagatatgacaaggcactatcatggtatttttcttcttaaaaagaaaaagggacttcgctaaggggaagagatgcagggggggagaggaggacccactagctagatacgtacatccaccacttgtaaagaccgaacccgtagatcgtcgtcagcatggcaaccctgagaggatagggcttgaatttccagacgtcgtgctcccgctcggcggcggcggccgctgccgtgcgtcgggaggcgggcatgggggtgagccactgggagtagtcg

SEQ ID NO: 1567 - DNA, 648 bp, Sorghum bicolor
  Clone ID: SORBI-28MAY03-CLUS2647_1
ggacgtctgcctctctcgccccctctcgctctccgacgactggtgggccaccgccgccgccctaaggcaggcgctgaggctttagttggtctcttggccggcgacgagcaaccaccaggtatttgatcgacaagcctcctaacttcgaagtttttgcaaaaagtattggtgtgcacccatgtctctttactggatccgcgtccgattcagcaccactaactccaagtggcgatcaccatggcagagcaatctggggcccagaatgcttgggatatgctatctgatgagcagtcacagaaacacatcactactggtgctggtgacctcaatgacatacttggtggcgggattcactgcaaagaagttactgagatcggtggtgtcccaggggttggtaaaactcaactggggattcaactagcaatcaatgtacaaatcccagtggaatatggtggccttggtgggaaagcagtttatatcgatacagaaggaagtttcatggttgaacgtgtctaccagattgctgaagggtgtatcagggacatactggagcactttccgcacagccatgagaagtcctcttctggcaaaaaacaattacagcctgagcatttcctggcggacatctattacttccgaatatgcagt

SEQ ID NO: 1568 - DNA, 402 bp, Sorghum bicolor
  Clone ID: SORBI-28MAY03-CLUS26155_1
gcacgagcccctgcccaccctcctccctctcccggctcgcgcaggcaggcaggccaggtgcaggcgacacagcgagaggctaaaaccctagcgcgaggaggcgagccggctcagcgatgacggcaccggcggacaagggcaagaaggccaagaccgaggccgacggcggcgaggagaacgagcagatcgacggcgccctcgtcctctccatcgagaagctccaggagatccaggacgagctcgagaaggtaaatgaggaagcaagtgacaaggttatggaggtggagcagaaatatagtgagattcgcagacctgtctatctcaagaggggtgacattatcaagaccatcccagacttttggctcacagcgtttttgagccatcctctactaagtgagcttc

SEQ ID NO: 1569 - DNA, 506 bp, Sorghum bicolor
  Clone ID: SORBI-28MAY03-CLUS26171_1
tggttggcttcgagatttcttgtgggcacaggcatcccaagtaattcagtcttatggttcctcattatctgcatatggtctttttttcttaggcgctcattttgtctgggctttcagtttaatgtttttattcagcggccgtggttattggcaagaactcattgaatctatcgtttgggctcataacaaattaaaagttgctcctgctactcagcctagagccttgagcattatacaaggacgtgctgtaggagtaacccattaccttctgggtggaattgccacaacatgggcattcttcttagcgagaattattgcagtaggatagtggctaggaggatttgaaaggcattatggaattaagatttcccaggtttagccaaggcttagctcaggaccccactactcgtcgtatttggtttggtattgctaccgcacatgatttccaaagtcatgatgatattactgaggaacgtctttatcagaacattcttgcttctcacttt

SEQ ID NO: 1570 - DNA, 374 bp, Sorghum bicolor
  unsure (1)..(374): unsure at all n locations
  Clone ID: SORBI-28MAY03-CLUS2619_1
cgtccgatttactgcatgatttatcctaaatgtcatttgaaatgaaactaaaatatcgatcttatcagctatgcatatgtgggttccagattgactccacttatacactaagaatagacaaacccactgaattttttactactaatgatccatctactctggtagttttaattttgcctgtgtgaccaatatgcagggttcaaattcatggatcatgtgtatatatacaggcactgttgaacataaactaaactttcctgtaacaatacttacctactaatatagcccgaagaagcgctcattgaactaagcttggaaatacanntgtnggttaatngtanaccttgtnnaacttggaagatactacatatata

SEQ ID NO: 1571 - DNA, 593 bp, Sorghum bicolor
  Clone ID: SORBI-28MAY03-CLUS26543_1
cgcaaaatcaagaccatatatccatgatttattaactcattcatgttttgcaactctcatcactgaggaataggcaaagggagagtcagagtgtttgattcagtaacgaacttgaatctgaacattcacacgaactcacgaagcacatcacacggtcaggctccacgcctgctccttctcttgagtaaccttgccgggctgaaaggctcaaggtcaacgatcttggccttaccgtcgaggatgagctccgcgagggccgcgccggtggccggaccattgaggataccccagcagctgtgcccggtggccacatagcaccccttcacgcctggcatctccccgatgaccggcagcccgtcggtggtgcacggcaggtagcacgcctgctccacgaccacctcagcgccttcttccttcttcagctggctggacaccttccctgcaatcttatgcagcattgcaatcgagtctggttcgcctgttattgttgctgggtcatctggcgggttctcgtccttgctcattccacaaatgtacacctccccggtgggccgcgggtacacctcagggttgagcatcttggcgccgggctc

SEQ ID NO: 1572 - DNA, 601 bp, Sorghum bicolor
  Clone ID: SORBI-28MAY03-CLUS26535_1
gtcgctgcacggcctgccgccggagagggtgatcgggccggcgccggagctggtggacgacgacaagaacccgaggatgtacatggacacggacttcgccaccttccttgaatacctcacctcggccgagggcaagcacaagtccttcctccacaccaggagactcatcaccagctgatgttgataccagctggacgcattcttcttgccagacgccagctgtcggcatcaggaagagaaaagtcaacacgcatgtgaacacgtatgtgcctgtggttgcgggccaacaggttgaccggtcaaacccgtcgcgcgccgtttagcgtcccggactgcgagactggtcgtgctcctctccctcccatcaggattgctgcttttttgtgtaccctacctactagccagttaaataaataaagaaacatgtaaatcaggaagccgcattgaccaaatttaaagctacgaagcctcgtcatctggaactagagagtgttggatcagcagctaaaaagcccgtgcaaggtcaaccgaattgttactgtatagtggagtattacgagtggtatctacaaggtcttggtgagagttttattcgcattta

SEQ ID NO: 1573 - DNA, 252 bp, Sorghum bicolor
  Clone ID: SORBI-28MAY03-CLUS26545_1
ccagggtactgtgacgtgcgtagagaggcagcgttcaatctgcatataatctataagaaaagtggagctaccgatcttgcaagacgaattctgaaaactttctgcactatctaaaagttggtattggacaatgttgttgggatgtgaatatcagccctttcaaggttccttgcattagcataggggtaaagttgttgggatctgaatatcagatccttagaggttctttgcattagcttagaatcgagatag

SEQ ID NO: 1574 - DNA, 513 bp, Sorghum bicolor
  unsure (1)..(513): unsure at all n locations
  Clone ID: SORBI-28MAY03-CLUS2662_1
cgatctcctccgccggcgcctacnngcccgtccgcgagatctctcggcagtcccgtctctttgcggcgttgtccaagaaggtgatagatctcgatgaactgaggatgctggcggctcagggagtcccagacgccgcgggcgtccgggcaactgtgtggaagctgctactgggctatctgcccaatgaccgctcgctgtgggagcaggagctggcaaagaagagagcacagtacgctgctttcaaagatgagttccttagaaaccctgtagaaatatcgcgacaggtgcaaacagaaggccaccacaacgtaaatgaagagcatgttgacaatgggttcctgcacaggtcagaggtaacaagaggggagcaccctttaagccttgggaagaccagtgcttggaatcagttttttgagtgctcagagattatggagcagattgaccgtgatgtaaagcgcacccaccctgacatgcatttcttctgtggcgattcatcttttgcaaagtccaatc

SEQ ID NO: 1575 - DNA, 691 bp, Sorghum bicolor
  Clone ID: SORBI-28MAY03-CLUS26556_1
cctgtgatggcaggagttgttcttaaacagcagctgctccttcagtttgttcagcgcttctgatatctgattgtattgaccgagagcacccaccttgccttctggtaccaactgaatgagctgctgatgccgactcatctgcataatggtagattaggtgtggctgtagaatgagatgcttacccatctttacgagctcaggccatgattccagcagcactgtgacctggggtgcaaatgtgaaggccctgcaagcactttccaggccacaccaatcctgctccttcttgaagatccattttttactatggtgtcacctaaataaaagccatttctggttgttgttatgtctatccttgacatgtcaacagattagtgttgggctgcagtcatgctgtgtttaagtctctgagaaggcaagtcattcctgcaagcattgtgattgtcaggcacagaagtactcaaaagtgagagcgacttgttgccagcaaatggagaagggcgatatttaggttgataatcaaattcagttctctgtatacaagccgcagattttgtttagagttagcttgttagattcatcatttcattcttctgagattcatcatttcatttcatttcacagctgattctgtgtgttgtaactcctgagtacgagtagaaattagaatgctaactgaccttaattttc

SEQ ID NO: 1576 - DNA, 435 bp, Sorghum bicolor
  unsure (1)..(435): unsure at all n locations
  Clone ID: SORBI-28MAY03-CLUS2663_1
gcgccnaacgcgccggcgtacgtcggcgtgctgaacgcctgcagccgcgccgggctgctcgaggacgggctgcggtgcttcgaccgcatgcggctggagcacaagttcgcgcccaacgcgcagcactacggctgcatggtggacctgatggcccgcgccggaaggctggacgacgcgcgcgcgctcatcgggagcatgcccacggggccgacggacacggcctggcgaagcctgctgaacgcgtgccggatccacggcgacctggatctcgccgagagcgcccttgaggagctgagaagcctgggcgccgccaacgccggtgactacgtcatcgtcgcggacatgcacgccagggccaagaattgggccgctgccgcccccacccgtccggaggcggnggactggggcctcgcgcagncccccgggnncngcgcc

SEQ ID NO: 1577 - DNA, 614 bp, Sorghum bicolor
  Clone ID: SORBI-28MAY03-CLUS26639_1
gttaggtctgttcattttggatccggtgatatattggtttttttggtgtggacggaaagcggtggagacggacgacgagcggcgaagaagaaaaccatgtcgtcctcccagtttggtggttgtggttaggggggaacaataataataaaattggtttgagagaggtgttagctgctgcaagaacaagaaggccctgcattgcaagaaagtattcatggggggtttatcttggagatgaaaagaaaagaagtggtcatttccccatccatcaatggcttgcttgctttgggtgctaccagcagtccagcacatacccagctaaggcctctcttaaacctcttttttgcaacttttttacttgcaaaagaagcttgccgtgggctccatgaataagggcgtttgctttgttatgctagaagtattatcaaaggatttcatttgtgtttctcttgtaccagggctagctagcagcagcagcagtagtagtagtaaaagtgtcccatgactttcgttacaagggtcattaggagtgaagtggctagttgcttagccgctgcttgttgcaggctatgcagtgtcaacagcagcaaaaatatatatatatatttcttggt

SEQ ID NO: 1578 - DNA, 659 bp, Sorghum bicolor
  Clone ID: SORBI-28MAY03-CLUS26642_1
atacatgacgaatgctgttgtctcatttgcactgggcccaattgtgctcccagcattgtatttcgtagggcaagaggttttagagcatgctgtcaaagatgaagagtatgatgaattatttaggctaatgagcacttgtgggaggctcctcaatgacagtcaaagcttcgagagggaaggcaaccaggggaagctgaatagcgtttctctacttgtccgccacagtggtggttctatgtccatagaagccgctaaaaaggcactgcagaagtccatagacgtctctaggagagacttgctaagattggttctcaggaaagaaagcgttgttcctaggccatgcaaggagctcttctggaagatgtgtaagatacttcacttgttctactttcagactgatggatttagctccccaaaggaaatggtcagtgcagtgaatgctgttatcaacgagccactcacagtccaaaatactactagttcgtttttgtctagttcatcagggaagtgaggatcacatgtaatttatcctgttcatatggatcagaagcagcagcggcaagcttaagatatttgtaagtttgtaactgggctgatgtagattggtgaaggtacatctttgctgtatgtggatcaaggtatggggaacacctagtcat

SEQ ID NO: 1579 - DNA, 833 bp, Sorghum bicolor
  Clone ID: SORBI-28MAY03-CLUS29349_1
gcacgaggctttaaagaacatctggtagctggcaaaggagaaactccatcaaacacacacacatatagtcatgtgattccacagttccaagcacccaatatatatcacaacactgttcctcgcaaaaaaaaaaagagagatgacagcactgttgaacccttttctttgagcttcctgaaccttcacaatggttttcctcgaccaatcagcaaagcagtgcgctcaggcggccaataagttggaccacaattaccgaacaaaaacacaatcagtgaaaatatattgcatcgtactcgtacgtatacgtatcctcctctccatcacacggcatacaattctctaatgagtgtcgggagaccccttaattaactagcttgtacttacttgtatcagatcagcaggccagttccagtgtcgcttgcactacgctcatgccgccaagagatctgagagaggggatggcgggatgctattcgtctgagactgcaaggcctactgaactaattatagttccacgccatttaactgacgatagacgatgttattattactgtagtaatgatgcgtcccgttttactactgcaatttgcctagttactattatcgcctcgatctgaaaaggtgaaacataggtgtggtcttgcacagggtctgggaacatgtttggagaggaagcgctgattgtgtcctgaaacctgaacgtgatgtgtcttgttcagagatagagattggaccaggcagggcattcatcattcggtttgggccacgccatgccgtgcgtgctgcatctgcaattctgcatgcatgcatgtatatatccatagtagcgaatt

SEQ ID NO: 1580 - DNA, 939 bp, Sorghum bicolor
  Clone ID: SORBI-28MAY03-CLUS29318_1
gcacgaggaacacattgcaatttgcaagtgatctggcttggccctgccactcagcctcctagtgagagacgatggagaaggcaatgctgctcttgttgctgagcttgtgcgcctctcgactcggcggcgcagtggcgcagcagtaccagtactggacgccggccaccgcgacgttctacggcgggagcgacgcgtccggcaccatgggcggatcgtgcgggtacggcgacctgtacagcgccgggtacgggacgcagacgacggcgctgagcacagcgctctacggcgacggcgcctcctgcggcgcgtgctacctcgtcacctgcgacgcgacggggacgcagtactgcaagccggggtcgccgtcggtcaccgtcacggccaccaacttctgcccgcccaactacgacgacgccaacgggtggtgcaactcgccgcggcggcacttcgacatgtcgcagccggcgtgggagaccatcggcgtgtaccaggccggcgtaatacccgtcaactaccggagggtctcgtgccagcggtccggcgggatcaggttcgccatcagcgggcacgactacttcgaccttgtcaccatcaccaacgtcggcggcgccggcgcggtggccgcggcgtggatcatgggcaccggcggcacggactggctggccatgagccgcaactggggggagaactggcagagcggagcctacctcaccggaaaggccctgtcgttcaaggtgcagacggacgacggcaaggtcgtcgtggcggataacgtggcgccggcgaactggcagttcggcagcacctaccaggcctcggtcaacttctactagagttggcccagttggccgcgccacttctgattataatgagtgggccatgttcactaacagcccatgagccccgcagagaatccttacagtaaacacgagtataaat

SEQ ID NO: 1581 - DNA, 659 bp, Sorghum bicolor
  Clone ID: SORBI-28MAY03-CLUS26676_1
gccccgagcggtggctgtccgccgacggcaccaggttcgagccccacgactcgtacaggttcgtggcgttcaacgccggcccgcggatatgcctgggcaaggacctcgcgtacctgcagatgaagaacatcgccgggagcgtgctcctccgccaccgcctcgccgtcgcgccgggccaccgcgtggagcagaagatgtcgctcacgctgttcatgaagcacgggctccggatggaggtgcgcccgcgcgacctcggcgccgtcatcgacgagctccgcggcgccggggggtacgacgcggcggccagagccaccgcggcctctgcctagaggttcgtgctggtcgcccggggaaggaaacggcggcggacagttgggaacggcaaatgaaaagttatgtagatatagacagtaagtaattaaagagttcggtgaggtatattactcaatttggaacaaaaaaatgcatgtgtaaaaagtccatgtcattttgatttggatttgaatggaggacgaagaaaagagggctggactgctggggggagcaataataataataatctctcatgtaacctgacgcggaggcgccaaattcgtttgggcggcttgatgggccgcccggactgatgttgtttgtaaaacaaaacccaagcatgactc

SEQ ID NO: 1582 - DNA, 492 bp, Sorghum bicolor
  Clone ID: SORBI-28MAY03-CLUS26682_1
cggccacccaccaggccgcggcgccggcgacgcccggcgaggcgctggcggaggcggccgggtcccgcgggtggctgcgcgagtacgtggaccgcctcgcgtcctcggcctcctccctctccgggcggtggagcgctcggtggagccaggggcaccacagcgcgcggtggagccagggccagggacaccacagccgcagccagagccagagccagagctaccggcaggaagactcgtggcggtgggacccggaggcagcgacgggcgccgcgatgcaccgcgcgcccgacgaggaggagccggcgttcgtggccctgtaccgttggatcgtcggggtatagccaggaagctgtaattactggatcgcacgagggtgtttttgtgaactccttccatgttcaatttttttttattttacttaggacccccattccattgtaaaaacacaagaaacaagcagcagggtctgcagagacctgaggtgagtttagc

SEQ ID NO: 1583 - DNA, 672 bp, Sorghum bicolor
  Clone ID: SORBI-28MAY03-CLUS26687_1
ttgataggagcgttgctttctgtaatcaagataagaagcaaagaaatgaggagagcttgccaagcacatcccactggagaagcataaagcaacatgtgctatctcatggttcttcaaggcctttatccctaaagcattccttggacacctccttgagtgattcaagggaggcatcaacaagtttgcctgcagagggcgggccaatgttggtgaacatccccagaacaacagaacagggtgttgaatatgggagaccgccgtctgtgccatcatccactctggttgaactaacaaccaggctagatttcttcaaagaacggcggtcacaattgatggagcagctccacagcctcgatttagggcatggatccacatcccatggtttcccatacaaaccttcgtcaccctggaacagcccaaagtagggggttgttcagttgctgcagttccacgtctctgtatattcttggtatagaatctcttttttgtttcacttttatctttgtagaagctggtagcgagaatgtatatcccttgccttccttcacgtgttttgctagtgcttgcagcagacctttttcgagcgtgattttgttttgcttttgtatctattgtatgtaatgagttaaggggattgtgacacggtttttatatgctttggcaatatagatg

SEQ ID NO: 1584 - DNA, 743 bp, Sorghum bicolor
  Clone ID: SORBI-28MAY03-CLUS26701_1
tcggcctcaagcactgcgggccctgcgtcaaggtgtaccccaccgtgctgaagctgtcgaggtccatggtcgacaacaccgtcttcgcgcgcatgaacggcgacgagaaccgcggctgcacggggtgccgctcggccacgagcaccgccgcggcgcccgcttgcgcctcctgctgggccgcgccctccggcgcccccggccccgcctccggctgggccccgccctgcggtggctgccgcggtccctgcgccgccacgccctcctcccgcgcaggcacggcgaccgccacgccgcccgcttcgcgctcctcagggccgcgtgcatcgtcgcggtgccctctttcgtcgccagccgccccggtcaggtcggcggccgctcggggcgtcgctgccgaggcctccccccccccgcccccccccccaaacagaaatttgtctcacatcgcatgcatgggtgatccttcgttgttggtgcttaggtttctttggatattgtcgttgtatgggtttgtggtgttctagtcttcccccttcctcaacagaaacttgttctcacgcgcgaagggtgatccttcgtcgtcgtctcgtcggtgctttggtttatttggttattgtcgtcgtgtgggtttgtggtggcgtatagtcttcttctttatatcagtacatgcatgtgggtttgttgtgttgtagtcttcttctttgtcaatacatgcccgacaaatctcttgtcggtagctcttcgtt

SEQ ID NO: 1585 - DNA, 699 bp, Sorghum bicolor
  Clone ID: SORBI-28MAY03-CLUS26708_1
tagaaatgttcttattaggcttgaggctgaggtggctaaagttgttgaaacacaaacaggcttggagcgtcaacttgagttgatagaaactcatcagcgcgaggtggacaaggctctacagagtatggaggaggaagctgaacgcatattccaggatgaacgagtgttacttcgtgaagatgatgctgcttcagcaagagatactatgtatgaacaagcagaagttgtggagcatgaactgcaacatatgacagaacaagtaaaatccatcattcagactatgaatgctactcagggtggtgagcttgagtccgctgatagtatgacaccatttgatgttgctgtccggatactggataatcaactgcgttccctgatgtggattgatgaaaaggttaacgagttctctggcagaatacagaggctgcccagcaacagcgcttcagctgaacgtgactctgggattcccaggttttggttaagctgattaattcacggcatttgcttgctgctctgatcagttttagtaagcattctttgcttggttattctgctgctccaccagccaaggtttcgcattattttgtacccgttcaagtacttcggtgccatgtagctctagctggttcactctggattgataccatccaatgtcacttgatgctgtttgatttcagcataatttctgcttgttaacct

SEQ ID NO: 1586 - DNA, 640 bp, Sorghum bicolor
  Clone ID: SORBI-28MAY03-CLUS26739_1
gtcgtcaacgaggccactgctagtgatggtaacatgcatttcattgcaggggacatgtttgagtccattccacctgctgacgctgtcttactcaagaacattttacatgaatggggtgatgaaaattgcgtcaagatacttcaacgttgcaagcaagctattccttctagaactgcaggaggaaaggtgataatcatagagatggtgagaggatcatcacagggagatagcaaaataaacgagatggaagttatacggaacatgttcatgttgtgtatcaacggggtggaacgagacataaatgaatggaagaagatcttttctgatgctggattcagtgacgattacaaaatcatgccagtgttgggccccttttcagtaatcgagatctacccatgaataatgcttgaactacggtattactatacaaggcagagttaccatgttgtctgagttagcagcaggataggatgcatgcatctgttgtcatcctttctgctcttggggtataaatatgatatatatgtaatatgtgtcacccatatattaagcatatagttgttccttgcagctggtttgtaactttattttaatggatataaataatatatgaaaatgtcattgttgtatgaaaaaaaaa

SEQ ID NO: 1587 - DNA, 433 bp, Sorghum bicolor
  Clone ID: SORBI-28MAY03-CLUS26715_1
ccgccccccgccagctactacccctacccgtactacggcaatggcgacggcatgggccacgccaaccccctcctactaccaccaacaaccgcagcagcagcccgacgtcaaccagcagccgcagatggcgtacccgccgtacccgtaccgtttcgacatggcgccgccgccgcagctcttcagcgacgagaaccccaacgcctgctccgtcatgtaacggaaacggccgccggcggcggcggcggcggcggtgggtgtccctagcttggtatgcgtcagcgagctcactgatccgtcgtcagctttaacttagccgtccggccgggaaaaaactcgacctgtacacatcgtcgtcgatgaggattcagccttggtccagagctctaggattaattttctgatgaaattttgcttcatttgtttaatccttccg

SEQ ID NO: 1588 - DNA, 754 bp, Sorghum bicolor
  Clone ID: SORBI-28MAY03-CLUS26748_1
ccttttacagcacgggcagccagtacacgccggagcagtacgcggagtccctggccgacgactactcccgtctcctgcaggtgatgtaccggtacggcgcccggaaggtggcgctgatcggcgtcgggcaggtcgggtgcagccccaacgagctggcgcagcgcagcgccgacggcgccacctgcgtcccgcagatcaacgccgccgtccgcatcttcaaccggcggctcgtcgcgctcgtcgaccggttcaacgcgctccccggcgcgcacttcacctacatcaacgtctacggcatcttcgacgacatcctcagggcacccggcgcccacgggctgacggtcaccaacgcgagggtgctgcggcgtcgggcaggaacaacgggcaggtgacgtgcctgccgttccagacgccctgcgccaacaggcacgagtacctcttctgggacgccttccaccccacggaggcggccaacgtcctcgtcgcccggagggcctacagcgccgcgctcgccgtccgacgtccaccccgtcgacctccgcacgctcgctcgcctctagctcgctgtatggcgcgcctcgtcggcctcggcccgtgttgtggagctgtgcctgatatgcctcgccctgtggggcggttctctccccgttccggccttctcgtgattgtactattgcgtacgcaaagggatgtgtgtccatctgaactatatatataaatataaacatgatatatacagggtttcttatggttt

SEQ ID NO: 1589 - DNA, 602 bp, Sorghum bicolor
  Clone ID: SORBI-28MAY03-CLUS26500_1
gaatctgaactaaatcgtctgatagaacgttgacaaggttcagtatctgaaactagaagcaggaactactgccaagctccacaccacatacatacaaaagcctcgtcacacgatatcccatgttagtcttgcataggaaaggtaactaaatgctcattgctaacagcacagattaacagatggtaagttaggaaagcagcttagaacattaggaaggacgaagtcttcattttaaagatcatcggttgactcctggtttgcaccagctggtgtcagccaatcctgagtacaaacaagctcttcaacccattgtttactaccggactcggatattgctagtgttgcggttcttgttgcagccttccagtcactaatgcatggtagtgccaacacatcacgcgccatccgagcaaccgtgggatagttcctgctgtgttccttccaccactggagatcactgggttttcctactgctccttttaaaccaacaggctcacttgtcgtgagatgtggcgcttgcaaatactgatcaagttcagtcatcggtctctcactacactggccccaatgactatggtactccaccagcgtatcagcatcta

SEQ ID NO: 1590 - DNA, 135 bp, Sorghum bicolor
  Clone ID: SORBI-28MAY03-CLUS26509_1
taatctgtggagtgtccggtatctgaatcgaagtctgtggtcgtgcagatgtggtagatatagttagagcaggctgcgtgttgcttccagatccagtaaggtacaatgcagattgtcgcctatctgatcgttccg

SEQ ID NO: 1591 - DNA, 766 bp, Sorghum bicolor
  Clone ID: SORBI-28MAY03-CLUS2653_1
gccggccgggccgagaacctagcgcccgtcccgccgccgccgcagccgccgctgcagcaccaccgctccgtttcacaaccatgggtatcgacctcgtcgccggcggccgcaacaagaagaccaagcgcacggcgcccaagtccgacgatgtctatctcaagctccttgtcaagctctaccgcttccttgtccgtaggacaaagagcaacttcaacgccgtgatcctgaagcgactgttcatgagcaagaccaaccgcccgccgctctcgatgcgccgcctcgttaagttcatggaggggaagagtggtccgcttgcccgtccggtgggcaccgtgactgacgacaagaggatcaacgaggtgccggcgatgaaggtgtgtgcgctcaggttcactgagacagctagggccaggatcatcaatgccggtggagagtgcctcaccttcgaccagcttgcgctccgtgccccgctcgggcaaaacacggttctcctgaggggtcctaagaacgctagggaagctgttaagcacttcggccctgcaccaggagtgccacacagccacaccaagccttacgttcgctcaaagggaaggaagtttgagaaggcaagaggtaggaggaacagcaggggcttcaaggtctaaggagccgcagccatgcaaatccatgtcattttgctctaatcagctatacattactgttttggggtatcagagttgcaatgttttacatgtcaaaatctcaagttattaccagatattggacc

SEQ ID NO: 1592 - DNA, 476 bp, Sorghum bicolor
  Clone ID: SORBI-28MAY03-CLUS26806_1
tgacgcttcaggcagctcccaaccaaatcagagagcctattttgcctcagatagcaaagagctacctaagaatcaaggacagcaacatgaaggtggaggtggtgatgaagtacttggccgagaagctaggcatcgcgcggtctcatcaggtggagcttacatgcagagggcaggttcttcctcccttgctgctggtgaaatgcgtgagggagacaatctggtgctccacggcgctgagggaagaagaagccgtcgacctgtacttcgcggcgctcatcagctgctactgaccatgtcatgacactctgttacagcacaagtaggaacaccaagctagtagcaccactcaacctgtaattaacttttaacttattggccgacaagttctttggtttttctttttctttcttttcttttgtttttaccaatgcatgcaattccccctgctgatctgagattaactgactgtgatgcag

SEQ ID NO: 1593 - DNA, 740 bp, Sorghum bicolor
  Clone ID: SORBI-28MAY03-CLUS2682_1
cgtccgtgtatcccgccgtgggatcggagggagaggccgggaggcgggcatgtgcgatctggtggcccgcacgggccggcacctgcagcgctacgagaacggccgtcgccttgtggccgggtgcataccattcagatatagagatattaatgatgaagcttctgatgatgaacaaaagaaacttgttgaagttctcatgatcagctcccaaagtggaccaggtcttctatttccaaagggaggctgggagaatgatgaaactgttgaagaggcagctgcaagggaagctatcgaagaagctggagttcgaggagatttagtgcaactgttgggcttctatgatttcaagagcaagcaacccgaagctatgtgcagagctgcaatctttgccctgcacgtgaaggaagagctagcctcctggccagaacagaacacccggcagaggagctggctcactgttcctgaggcggcagagcagagtcgttacccatggatgcaggaagcccttgtgacaggcttctctgcctggcttgagaactggagaaatggtggtggccgtgtggatcgaaatgaaagatgacacctaccttaagcatcaggggggcagcatctgctatttcttggggttccctttgtatcttgcttggactaaatttccagaacctgacaatacatgagggctctctgatgctctgtagtttgttgacttttgttcctttacccatccttaggataacaac

SEQ ID NO: 1594 - DNA, 536 bp, Sorghum bicolor
  Clone ID: SORBI-28MAY03-CLUS26832_1
tcgagtctcctctcgttcttcagcagggccggcttccgccccgccctccaacccagccccagcggcgccgcccacagccccaggtcccgccgcccgaccccagcgccgcctccagtcgtgagcgcggagaggattgagcgggcctccggggcgagcgccacgcgcagacggcggttgaggagcctgagaaaaccccggtcctccttcaagatcctggtgggttgcgcccggcgcggcgaaattccctgatgtctatgtaggagtcttgctcttgctgtttttggattggtgcctcctcccatggggtcttgcaggtgcgggagggtgtattccatctgattaatctgcggagagcaagcgggtgctccggctgcgcgagcatggcgggcgaggaggctccggagggcagcggaaccaggaggcgtatggatctaaacctgtatctcggcctccctccattgccgcggcctccagtctggctggacacaacgatgatttccccgacgttgatgcccaactcgactggtgctgcgccg

SEQ ID NO: 1595 - DNA, 989 bp, Sorghum bicolor
  Clone ID: SORBI-28MAY03-CLUS26837_1
gcacgagggtgcaaggctgacgcccgacgcctgtggcgcctactacttggtacagcctcggccgccgtccccggcagcagccgttttctagccgcttcccgctggttcgcggccgccgtcctgggcgtctgagctgagcgagtggtaaccctgccctttttttttttgttcctggggtgttcctcagctcgcaccgctgccgcttcccccaatccaatcctccgtaaccgattggcgcgggatggaggcgctgaagaagcaggccagcaagctccgggagcacgtcgccaagcagcagcaggcggttctcaagcagttcagtgcgcgatataatcaagatccttctcttgttgatgaagcggagcttgagtgccaccaaaatctccagaggctttaccgcgcggcaagagcagctaagcatttccagcgaaatattgtacgaggggtggaaggtttcattgcgattagcaccaaacagatggagatagtgaaaaaactagccgaggattgttgtaaatatggaaacgaccatcaacattttggttttgctcttgcaagggcatctgaggagttcggtaaatctcataaacaaatagagaaagagcgggaggatcttcttaaaagtcttggagagcaggtttttgagcctctccgagaaatgataatgagtgctcctcttgaagatgctcgattgctaacttaccgctatcaacggatcagacaggacatggagtctcagatagctgatgtgatgagaaagcaacttaaatccaaggaaagtagtggtaacacagataactctgtgaaactgcaacatgcagaatcaaaattatcagatcttcgaactacactggcagcattaggaagagaagcaactgcagctatggaggctgtagaggctcagcaacagcaagttacatatgaacgtctccttgccatggttgatgctgagaggacatatcatcaaaatgcagctgatattctgaata

SEQ ID NO: 1596 - DNA, 644 bp, Sorghum bicolor
  Clone ID: SORBI-28MAY03-CLUS26850_1
ttcaacactgccaccgtaggtgtgctcgcggacgggttcatggcgcgcgacctgacgatcgccaacacggcgggtcccgacgcgcaccaggcggtggcgttccggtccacgggtgaccgcacggtgctggacggcgtggagctgctgggtcaccaggacacgctgtacgcgcacgccatgcggcagttctacacccggtgccgcgtcgcgggcaccgtcgacttcgtcttcggcaactccgcgacggtgctccacgacacggccctggtcgtcctgccccggcagctgcggccggagaagggcgagaacgacgccgtcacggcgcagggtcgcaccgacccggcgcagcccacggggatcgtcctcagccgctgcgccgtcaacggcagcgacgagttcctggcgctgtaccgcgagaaccccggcgtgcaccacgtgtacctgggacgtccctggaaggagtactcccggacggtgtacctcgggtgcacgctcgcggagatcgtgcagccgcaggggtggatgccgtggaacggggacttcgcgctcaagacgctctactacggcgagtacgacagcgccggacctggcgccggcgcggcgagccggagggtggcgtggagcagcaaggtgcccaaggaaca

SEQ ID NO: 1597 - DNA, 505 bp, Sorghum bicolor
  Clone ID: SORBI-28MAY03-CLUS26889_1
gcccagatatcaatgctactcttatcgatgctgccttgagagaagacgcagacagtgtgaaatactacaagctagagttccgagttgaaagcccttctttccaacgacacaatgttgcggtctgttgtgcaagggatggcaagctttacaccatgaatgcacaagcaccagaatcggcatggaaagcagttcagaaggagttctttgcaatggcggattcgttcagcttagtgaacgatgcttgatacagttaggcacacgcagttttgaacccctgagcgttttcaccagtagtttgcaagttctcaataacgagataccagtggtttggtgtagagaactaggacaattgtatcataaaaatgtttctgttataccttacaatcatgtctgaagtttttttctgcatgcattggatagagaatcaaatcatatttcatcaagttacttcaaacttctgtcctcatttatttatctgaacaaccattttgccgggtaggcattt

SEQ ID NO: 1598 - DNA, 559 bp, Sorghum bicolor
  Clone ID: SORBI-28MAY03-CLUS26844_1
gcacgaggcccccgtccccgcgcgcgatccaacccggccataagacgccacctccccgcatctatcgccaccttatcatctcgcctccaaccccgacgagagccaggcacctgcccgcggcggcggcccagagagatggacggccggcggccggagatgcggcggacgatgacgctgtccgagcagctgtccacgcccgacccggccatccgcgacttcctcaagatcccccacgacgccgacgtcggcgaaggcaatagcacctcggtcggcggcggcagcgacaggacgaccggctggaagccgctgcgggaccggctccggctccggcgcgcggtgggcgcctggcagaagcctaagcccggcgcggccgcggcccacgcccggacgaacagcggcgacgtcggcaacatcagcagcgccaataaccgcagcaacaagtacaactacagccccggcgaggcggcggcggcgttctcccgcaccttctcccgcgcaccctcgctccgggcgccctcgcttaagtcgacgcccacgttctctcgcgtcgcgtacaccc

SEQ ID NO: 1599 - DNA, 603 bp, Sorghum bicolor
  Clone ID: SORBI-28MAY03-CLUS26655_1
gccacggccgctgcgttggccgcgctgttcggcaccgtcgccgccatgtccgcgtcggcctccgccgccgcgtgctcctgcaagaggaccgcggcgctcatgtgccgcgccaagaaggtgtcggaggaagagatggagacggtggcgctcgtggagcggctggaggagtgcatcgacggcctggaggccggcagcgacaaggtgttcaggagcctcgtgcagaccagggttgcgctgctcaacatacacacccacatcttctagcagcaccagcttccaatctaatcagtgcagataccacacatcatttaggcgacctccgtccattgccgatctgcgttgctgggaatccagttagcagatatttggagatcaggaaggatggcattgaggcaagtggggacagcaggaaggatggcgatgaggcaacatctattcagttagatttatacttatatatggtgggtgtgtgagggcgtggtgtgaacatgtcatactttttatcctagagggagcagaaaacctgagaacctaacaattgtagtgggtatttggagatgaaagcttatgtctgtacgaaagattttaaagtttcgatgcatc

SEQ ID NO: 1600 - DNA, 678 bp, Sorghum bicolor
  Clone ID: SORBI-28MAY03-CLUS26661_1
gtaggtggagcgggagcgcgtccgtgtggaggcggccgaggacatcgctgcggcgagggcggcggcggagcggggcgcgcaccaggaggcgatggagatactcatgagcaggcagcaagcggtggtgcagtcgggggcggcgcttggcggcgacgccgcgatgcagtcgctgggagcagagctgcaggagatgggccagctcgtttccaacgggaatagctacgcgcggtcggggcgcgctttcatgctctctggaatgtccaggcactcgcaccaacgcgccagcgccaacatggtaaacatgggcggttacatgaacatggccgcggaggcgtcgtcgtcgtcgttcgcgacgccggccatgcgagccatgctgctgcggtcgcggaaggcacgggaggagtcctcggtcgagcagcagcagccgtccaaggcaagaaaggaagcagaaagctctgcactaccagaaccaggagtggtaaaccagtagacgtgttgccctgtgaaagttatcttaaattcactatcacactagcaataaaaccatgcgcggaatactattttggttttgtttggtttctagatgcaaatttgtgtaaggaatggatgagtacattgaaattcagagctcctttgcctccttgtattgctttttggacgttttcgttaagaacaggt

SEQ ID NO: 1601 - DNA, 585 bp, Sorghum bicolor
  Clone ID: SORBI-28MAY03-CLUS26949_1
gcacgaggatagagtgagattaatcatatttagaaacattttaagcttgttaatttatcatgttggaaacaatattctgcataatccaagatatgtgtatgtgtcaagtaaagtgtgcagagtatgtacctgaattgtggagtggtgtagtcgaagtgtgtttggcgtgtcgagggatctcccccatacttgttttctgctttcttgcacaaaaataaagtagagacacacaagacataattataataataatactctttattaatcttgaggcatttattacaaataactagtagcaaacttgacgataatcgtagtaaactggcacgaggagcaaacctaaaccgaaatttaaagataaatgactaagatgcattgcctcaaggtctaatctagataacttagcggcgctctaattccttgatcttcttgttggcactggcaagatcctgcctgaggcctagtataacggtgttgtggttagagagctgcctagtgagggaattaatcgaggactggaggtctatgataactctgtctagcctgcgaacgtcctcatcaatatctactatagtcttgcgacgc

SEQ ID NO: 1602 - DNA, 565 bp, Sorghum bicolor
  Clone ID: SORBI-28MAY03-CLUS2696_1
cgtccgcggacgcgtgggttgaagtagtgactggggttgccaagaaacaaaacaaggagaagggccccaatagtaccagcaaaagcaacaaaccaagttcgaaaatgacatcaagacccgagtctcattcgaaggcgacaaaagtggcagcgccccccaaggatgacgatgatgagagcggtgaaaaatatgaagaagaggaagagcgtgataacaccttatgtggatcctgtgggacaaatgatggcaaggatgaattctggatctgttgtgataagtgggagcggtggtaccatgggaagtgtgttaagatcacacctgcgcgtgccgagcacatcaagcactacaaatgcccagattgcagcaacaagagggcaagagcctagcgtcaagcccttttgtgaccctggagtgaagtaagcgccaaatcattgatgtctgcagatatatgcctaggcctagctgtctagcttgtagacttgcttttcatttcaaatgaacgctgttgattgactcggttgcccgcagcagctcatgttgcttgggcttaattgtgtttaatgtt

SEQ ID NO: 1603 - DNA, 667 bp, Sorghum bicolor
  Clone ID: SORBI-28MAY03-CLUS2698_1
cgtccggtcctctctccccccttttgctgccgcctgccggccggaaggaagggaggtgcgctcatctgtgcagcggcggcttcggagtccggaggggctccgaggggaggtccggcggggagccatggcgcggaagcacggctggcagctcccagcccacaccctgcagatcgttgcaattacggttttcttccttctggtggttgcgttttatgccttctttgcgccgtttttgggaaaacaagtcgtcgagtatattgcaattggcatttatactcctgtggcacttgcagttttcatcctttacattcgatgcacaagtataaaccctgcggatcctgggatcatgtcaaagtttgaggatggccttatcaatataccaatcaacggctctgaaatagaaggcatgaatttgccccagaaagtaaacaatgctactcgaaactactaaaaaacgtctacttgcagaagttctctagatgggcattctaatcaaagaggttcatcaataggggaggcaaacatgaatctaggatcacaactgccaaagaaaagatcaagctgttggttgctaggtgggcttctgtgtgctatatttgtcaaggaggactgccgaaaaactgatgactcagagcaacaagcaaatggtgaggaggctctgttttgc

SEQ ID NO: 1604 - DNA, 1059 bp, Sorghum bicolor
  Clone ID: SORBI-28MAY03-CLUS27000_1
ctactgatttctctgcctcttctcaccacgaacaagcggaacacctgggaagcatccggctcccagatctcccgaagaaccctaaccccccacaaccttctagaatctccccgcatggacggcctcgcggcaccgtcgccgtcccactccggcgccacctccggcggcggggcctcccaccgcaagcggaagctcccgccgtcgtcgctttccgacgccaccgccgacgaggacgacgacaccaccgctccgtcatccccctccacggccccatcctcgccctcccgcccttcctctccatcttcctcacactccgacgatgacgaggacgactcgctccacacgttcaatgccgcgcgccttgacggcgcgccgggtgggggctccgcctccggccgtcctccgaagccggattcctcatcagtgtctgctgcgtcggccgccgccgcggctgcggcgggcggaggacccaagctggagcctggctcggcgaccgccggcgacgggaaggaggacccgaagggattgttcacggacaacctccagaccagcggcgcttacagcgcccgtgaggaggggccccaggcgccaggaagattcgggaaggctgaaatttctctgttattctaacgatggtgttgatgaacacatgatatggtggtttgaagaatatcttcgctcggcagcttccaaatctgcccaaagaatatattgtgcgccttgtcatggatagaactcacaagtcaatgatggttatctggaacaatattgtcgtgggaggctttacttatcgcccttatgcaagaggtttggagaaataccgttttgtgctatcacagctgatgagcaagttaacggctatggaacaagattaatgaatcatttaaagcaacatgcacgggatgctgatgggctcacacatttcttaacctatgctgataataatgctgttggctattttgtaaagcagggtttcacaaaggagatcacattggacaaagaaagatggcaagggtacattaaagactatgacggaggaatattgatgcagtgtaaaat

SEQ ID NO: 1605 - DNA, 633 bp, Sorghum bicolor
  unsure (1)..(633): unsure at all n locations
  Clone ID: SORBI-28MAY03-CLUS27001_1
gagtggtgccccgcggcacagtgtcactcttgctctgctgctctacttgtgccgacgctctgttcgacgatggcgcggggggccgcgctgcttctgctcgcggccgccttcgccgcggctctcctgccggacgccgccgagtcccgcatcctcctcacgctccacgacttcggcgccgtcggcgacggcgtcgcggacgacaccaaggccttggccgacgcgtggacggcggcgtgcaccgccggggacaacgtcatcctcaacgtgcccgcagccgggaccttccagatctggccgctcacgctcgccggcccctgcaggagcgagatcaagctgctcatttcaggggacatcgttgcgccggagagccccagcgactgggggcaggggcagcgcagccagtggctccactttcacaaggttcaggacctcaaaatcaccggcgggggcatcatcgacggcagagggcagcagtggtgggcgcagtcgtcgcttatgggcgcgcagcccgctcccaaggctgttcacttcgaggactgccaggggattagcgtgaagggcatcaccttgcagaacagccagtcgtaccacctgacgttcacccggagctccnacgtcgaggcgaattatctg

SEQ ID NO: 1606 - DNA, 777 bp, Sorghum bicolor
  Clone ID: SORBI-28MAY03-CLUS27021_1
gcacgaggggacctgctattatcccagctcaacctttatggccacatcctcatcctccacagcctactggatttcagcagcctcccttccagtcctatccagctggtcctgtagggtttcttggcaggccaatagttggggcttctgctgtgactacggcctttgccaatgtgcaaccacctggtgtgtcaactggtggggattggaaaatacaagcatcaacaaatccgggatctgaacagcccactcatgcttcagctgaaccagattctacaggacatggcgcgcgggtcaatgaacggctggaggaaaatagaaatactggagttcaggattcagatgcatggtctgctcacaaaactgaaactggtgttgtatattattacaatgctttgacaggagaatcgacttaccagaaaccaactggttttaagggggagccggagaaggttgcaacacaaccagttccagtttcttgggataaattggctggtactgactggagcatagtaactacaagtgatggaaagaaatattattatgatagcaaacaaaaggttagcagctggcaacttccgccagaggtgtgtgagatcctcaagaatgcggaatctggttccttaaaagaaggttcaacttcagtgcaggatgctgctactatagagaataagggagtaataagcattgatgcaagtactcctgccatacagacaggtggccgtgattcgttgccacttcggcaaacagttgcccctgcatcgccatctgcattggatt

SEQ ID NO: 1607 - DNA, 496 bp, Sorghum bicolor
  Clone ID: SORBI-28MAY03-CLUS27041_1
gcacgagggcgcagcgagctccatcgatcggcggaggcaggcatggcgcccagcttcgcccgctccatctccttccctctgagcccctccaggtcgtcgtcgaccaagtcccgcgcggcgtccggttaccacgcccggtccgtcagcctcccgtgccgctcccacccgatcctcgcgcacctccacgcgcacatcagcgccgtgcgcgcgtgggcgcaggacccggccgccaccggcgccgccacgggcctcgcgcacgtggacgcgctccacgccgcgctcggcgacctcctggacctccccgaggcgcaggccgcgctcaccctctccgccaccggcgaccgcctcctggacgccttcctccggctcgccgacgcgcacggcagcttccaggaggccgtggtggagctgaagcgggacgtggccgaggcgttggccgccgtgcgccgccgcgacggcgcgcgcctggcgtccgcgctcaggtcgcagcgcaagg

SEQ ID NO: 1608 - DNA, 583 bp, Sorghum bicolor
  Clone ID: SORBI-28MAY03-CLUS27047_1
acacctcgtaaacctcgtgcattccattccataatatcatcatccttcgaagcaactcgatcgacacggaaggtaccgaccagagcaatccttgcgcgatatgcctcgccgccatgggcgccgccggcgggcaggccatcttcacggccgagtgctcccacaccttccacttccactgcatctccgccagcgtcgcgcacggcaacctcgtctgcccgctctgcaacgcgcgctggcgcgagctgccgtccgtggtgcagccgcagccggcgccgatgccgcgcacgcaaccgcagccgctgcgacggccggagcgcatgcaccatgtgcaaccactgccgatgagacatgtgccgctgcatggctggcagccacagctccatcccgaggagcctcaagtgttcgacgacgacgagcaggtggagccgcccccctccggcgaccaggcggctgcttcattcagatccggtgggacgttggctgtcacgacgcacaccgagtactccgccgtcgcgagggactcgtcgcgcgacaacttcgccgtcctcgtgcacatcaaggctcccgggatgactgatgccga

SEQ ID NO: 1609 - DNA, 641 bp, Sorghum bicolor
  Clone ID: SORBI-28MAY03-CLUS26759_1
gatataaattcccaaaagatactccccttgttttctacaaaggaggaaagccaattgaacctccacttgacatacacagcggactgaaagtagtcctcaaaagtattgcttcttacatcgaaagggaggttcctaggaaaacactgaagctgtggcggacgcagtcacctaggcacttctatggaggtgagtgggatcacaatggcagctgtgtatctgatagacttcttgaagagcatgagctcaattcttggtttgatccccggtttgggggagtgaataaagaagcgagaatggtgaatttagcaattcaggaagccctagctggctcagaaatcccgttcctcaacctcacttacatgagcgagttccgtgctgacgcccatccagctatctggctcggcaagaaggacgcggtggctgtctatggacaggactgcatgcattggtgcctgcctggcgtgccggacacatgggtcgacatcttggctgcacagatcttgcatcacttcaagcaagggaaaggctaatcacttttgttttcttaatctgtagttatgttataactacagcacatattatagatatatgtagttttgtgatacaactctttagatttgtaatttagttccaaagtacaa

SEQ ID NO: 1610 - DNA, 797 bp, Sorghum bicolor
  Clone ID: SORBI-28MAY03-CLUS26786_1
tgctccgcgcgtaggaacaaggagcgcgccgttagcgccggcgccgtcgtgccgctcgtgcacctcatcggcgagcgcggcagcggcacgtgcgagaaggcaatggtggttctggggagcctcgcgggcatcgccgagggccgcgaagccgtggtggaggctggcggcatccccgcgctggttgaggccatcgaggacggccctgccaaggagaaggagttcgccgtggtggcgctgctgcagatgtgctccgattccccgcataaccgtgcgcttcttgtacgcgagggcgccatcccgccacttgtcgcgctatcgcagtccggctctgcccgtgccaagcacaaggctgagactttgcttggctacctgcgggagcagcgacaaggagttggctgcagagctggagcagttacagctactagtttggctaggtaaagcaagaattaagtggtcgaaatctgctccattctctgtgggagtcttgagaggagatcagctacgacaggggggtgcgacgttcagatcatctgtaaataacagctggttctggttggtttggctatgtgaatacacatgtggtttgcaagtgaggatgcttggttggttactaacgtaatgtcagttaagagggaggattcagggtatgctagaagatttgggtggtaatgatgatgatgctggtttgtagtagctgtgtacaggatgctagggtgtggttgctttgtcttgtcaggttatagggaatgttggatcgtcacccatgtgttttttgcttgaggttccgagtccaaaaa

SEQ ID NO: 1611 - DNA, 538 bp, Sorghum bicolor
  Clone ID: SORBI-28MAY03-CLUS26794_1
cctaggcgacctccagtggaggcacgaccactccaacgtgccaggcggcccttggcggcggcgtggccaggaccatgcgctcggcggtcctcggcggcagcacgccctcccatatcgacagatctggcgacttcgaccttcccctccccactgcaacagcgtcggcctcttctgcctgcaccagggacggcgctctcccaccaccactccatggatggcgagtagggacttgtcctacactggcagatctagttgactgcataaatccgggctaccagaggatgacgagacaagcgatgacgtgaagcctgtatctttttcagatgcggtcctgtatcgtcaaaacatcaatcgataatttttagctttgaagtatcctcggatacttcttttttttagattgaggcctcacttgaaactttctggaatttgtgtgtaccactagatacttcagattatagtagaggcaactcgtacattgttctacatttttctaaagtattgtatgctatttgacattttctactttgtatactat

SEQ ID NO: 1612 - DNA, 503 bp, Sorghum bicolor
  Clone ID: SORBI-28MAY03-CLUS27074_1
gcacgaggcagcgccgggcacaatgccgcgtctccgcctccctctggtcctcctcctccccatagccctcaccctcctgctcttcctcctcttcccatcttccccacgcccgcgctcgcccccgccgcagccgctcccctgcggcgccgcgctctccgatgcggccgacggccggtgggtgccgaccccgtcgcccgcgccgccgccactctattctccgtcctgccccttccaccgcaatgcctggaactgcctccgcaacggcaggccccagctcccggcgctctcctgggcgcccacccgctgcggtggcgccgtcgtaccgaggatcgacgccgcggggttcctggccgcggccagggggcgacggattgggctcgtgggtgactcactgtctgagaacctcgttgtcgcgctcctctgcgcgctccgctcggcggacgacggcgcccgcaagtggaagcggcgtggcgcgtggcgcggagggtacttcccgaaggagg

SEQ ID NO: 1613 - DNA, 1054 bp, Sorghum bicolor
  Clone ID: SORBI-28MAY03-CLUS27093_1
tgcgcttgagaaccgtagaaattgttaccggcaccgccaccacggccactcgagcagccgccaggcacccagcaagaacttcccactcgctccctttctatccaggctctgtcctctcgcccccctcgcgtcctcactgccacttgaaatattggtgggcgcgaccactccagtgttcaactgctccgggctgtgatttggtgcgacttggtggtggtggtggtggaacacgtcttggcctctgcttccttggaggaattggagccgttggaattcaggagcttgctggccatggtcgaagggttcggggatggattgaggcgtggaggaagaggagggtagtagcttcctcttcttcggtgctcggctctgggctcgcgggacggggtcgtggggcccggcgtggcggcgggttggaactgcgacagggtcagctgatcttgccggatagaccactctattgtgttatctcattataagtgaagcccccactgatgaaaagctgttatcttggttgctttcttgaggagtactggtcaccagatggtagcatgttctcttctgtgtgattgggcttgattatggactgatgctcctgatcactcttgtcctgtgatcatccagagtatatcatctgtcagctagtctttcctctattggaatcacctccctttatgaaagaatccttgttatagggcaaatctcctttggcaaacattgttcagggtgcatcactttgttggatatcctgagcatattctcctcgtcgattgaacagcagcaaagagacttccaaatgatatccgttaggaaattctcatttagtttgatggaagtttcataaggtttcttatcatctgatttgctgggcaaatctcctttggcagtacttattaatagctcttttgggcaaatctcctttggcattagctgcttcagatatctctctgggcaaatctcctttggcattagtttctagctgtttcatattgctcttcgggcaaatctcctttggcactaaataccatttatatttactatttttggtaaatct

SEQ ID NO: 1614 - DNA, 806 bp, Sorghum bicolor
  Clone ID: SORBI-28MAY03-CLUS27101_1
tctggaggaaaaataattaaaatccaagtcttacccgagtccccttcccgatccgccggccgatccacccaccgccgccatgccggcgttcaaggccccggcgccgggcttcgccgtgcgcttcagccccttccacgagaaccgcctcctcgccgccacgtcccagcacttcggcctcgtgggcaacggccacctcatcgtcctcgacctcgccgccgccgggcccgggcccggggccgccccggtgccggtcttctccttcccgacctccgacgcgctcttcgactgcgcgtggtccgagtcccacgactccctctgcgccgccgcgtctggggacggctccgtgcgcctcttcgacgccgcgctcccgccggcgcagaacccggtacgcctcctccgcgagcacgcgcgggaggtgcacggcctcgactggaaccccgcccgccgggacgccttcatctccgcctcatgggacgacacgctcaagctctggtcccccgaccgcccggcctccgtccgcaccttccggggccacgagtactgcgtctacgccgccgcctggtccgcgcgccacccggacgtcttcgcctccgcctccggggaccggaccgcgcgcgtctgggacgtccgggaccccgcgcccacgctcatcctgcccgcgcacgaccacgaggtgctctcgctcgactgggacaagtacgacccctccatcctcgccaccgcctccgtcgacaagtccatccgcgtctgggacgtgcgcgcgccgcgggcgcccatcgcgcagctcgctggacacggctacgccg

SEQ ID NO: 1615 - DNA, 656 bp, Sorghum bicolor
  Clone ID: SORBI-28MAY03-CLUS27102_1
atacgcgcgcacacaccagtacagcgtccaaccaactccccaccatcccctccccaaccccatcatcatcaccactcgccaccctcccgcctgcccgcctgctcgccatggtctcgctcgctggctcccagatcccctcgccctcgccggggcagagcccctgcgcggccgcgcggccacagcgccgccagggtcaccccgtgcgcaccatccgctccgcgctgctgcagccagactcctccccggggtccccgtccccggcctcgcgcgatggcggcgccgacgcgggcgactcggacattgagaacctcaccgactccgtcatcgacttccacctccgcgagctcgccgccaccgcagggcccgcgcacccggcggccgtcgccaagtcgtcctccgccatcaacgccgccgccacggagctgctcgacctgtcgcgggacttctccgactactccagcttcaactccgacatctccggggagctcgagcgcctcgccgctgctgcgggggcggcggtgcccagatccgacgcgccggacgccgccgccgtggatctgaacgacctcgagtccatggatctgtcggcggacgcggcgccgctggagcgcgtggagccgttcgtgctggcgtgcgtgcaggcgctcgggcccgac

SEQ ID NO: 1616 - DNA, 607 bp, Sorghum bicolor
  Clone ID: SORBI-28MAY03-CLUS27103_1
atagcttatccgtcagtcttgagagtctttgagtcttggagtgctagtctgctagattctgtctccattctcagtcacctgagcagccgaaccttctctcctacgcagctacgcctgcaagtcaggaaccaacgatgccgggcatccaccgctacaccgccgtgctggtggtgctcaccatcagcactcgcctcctgcttctggccgcggcgtggccggcgttgcccgacccagcgtcgctccagccgtcgctgcttttcccgtccacgggcgccacctcgccaacgcagacccagtcagctgggggcgcctccacaatcccggccttcccggagcagtcagaggccgccgcggccgctgccacctccgtctgccagctcaccccgtcgcctccgctccttccggctgtcctagcatcctgcaacgccgatgccggggggagcaagggggcgcttccgccgcggctaagatgctgcccggcgctgaccgcgtggctgtacgccgcgtacgcgcccacggcgctctcgggccgcggtgtcggagaagcgtcagtggccgcgtcggcggaggccgccgctgtggtggacatgccagtgctgccggacga

SEQ ID NO: 1617 - DNA, 473 bp, Sorghum bicolor
  Clone ID: SORBI-28MAY03-CLUS27120_1
gcacgaggcctacttcttcatcaatccatatacatgcgtgtatatatgtactaattaacaagttagcttttttgcactcatcctagcagccgaggtgcaggaggccggtgattgagatatgagatgcaccgcacgatggatgagctgtagctagagatcgatccgtcgatcgagacatgatacgtaccacacggtcgaggtcagtagcagcagcaggagcagcacgttgtcgccgccatggtcccaacaactaggaacatgttgcaccatgacggcaagagcagccgcggcaggtcgtgctaccaccaccccggccagtactacgtcggcatcgccgcccaattggaggcctcggcggcgtctgcgcggcagcaggaccagagcaagccgtcaagatcccctcggctgctggccatggcagacgatgacgagctggacgcggcggccgccgggcctggcacgagctccccggg

SEQ ID NO: 1618 - DNA, 618 bp, Sorghum bicolor
  Clone ID: SORBI-28MAY03-CLUS27153_1
gaaagatttgtatatgtgtcagctgcagactttggtttgctgaactatttattgcaaggctactacgagggcaagagagcttctgaagctgaattgctgtcgaagtttacatatggaggagtgatactgaggcctggttttattcatggaactcgtcgagtgggcagtgtaaagatacctcttggtcttgtcggttctcctatgcagatggtgctccaaaatgcaaaactattgactagattaccacttattgggccgctgttgactcctcctgtgagtgtggcctctgtggggaaggtcgctgtgagagcagcgacagatccggtgtttcctcctggcatcgttgatgtctatgggatcatgcgttacagcgagcaaaactaagctgtcacatgcaccggccagtatatacatgtggctgtacttctgttacagccgtttcatggttagttttacatgtactggtgtccttttttaactcacctacttactagatgaaaaacattgaataaattggtattttgacaacacgtccgtggcagtgatttttataatgtatttcatcctatcttggagtactcaactgcaatgtagaaaaaaaaatatgtttgccgtgct

SEQ ID NO: 1619 - DNA, 612 bp, Sorghum bicolor
  Clone ID: SORBI-28MAY03-CLUS2693_1
cgtccggcccaatgctggagtcagtcctctacttctgcagacggatgaccaatgaggcccttattaccattgcaaagaaccggcccaactttacttgcttccgcctatgcatcattgagcctcacactccagactacactacacaccagcctcttgatgcaggttttagtgccattgtggaatcatgcaagggccttaggcggctttctgtttcaggccttctcacagatagtgtatttaaatccatcggggctcatgctgatcgtcttgagatgctctcgattgcctttgctgggaacagtgatttgggcctgcattacatcctatcaggctgcaagagcttgaagaagctagagatcagggactgcccatttggtgataagcccttgctggcaaatgctgccaagctggagacaatgcgatccctttggatgtcgacgtgctcactgaccctgggcgcatgccgacagcttgcacgcaagatgccccgccttagtgtggaggtcatgaatgatcctcgacggggatgccccttggactctttcacagatgagagccctgtcgagacattgtatgtctaccggacaattgcaggtccaaggtctgacacac

SEQ ID NO: 1620 - DNA, 661 bp, Sorghum bicolor
  Clone ID: SORBI-28MAY03-CLUS26940_1
atttcattcagatgccaggcgagatgaaatacaaactcggaacccatcaggtcccaatgtttttagtggttctggcaacaaaattcagggttctacaggaactataaaagctcatagtggagcgccccaatctagcttaagatcattgaagtcattgcggtcagttgagcaatattaccacacactgcagcaaatgaaatggggtccaatgaccgagcatgttctggataatcttcattgcaagatagatgcacgccgggcaaatcaagtactcaagctgcttcatgaccacactgtcgctcttggtttctttcagtggttaaagaggcaacctggattcaagcatgatggtcatacttacacaaccatgataggcatccttgggcaagccaggcaattcggtgttttgaagaaacttctggatgaaatgagccgagctcactgcaaaccaactgtggtgacatacaacagaataatacatgcatatggccgtgcaaattatcttaaggaggctgttaaagtatttgaggaaatgcaggaagctggttacgagcctgatcgggttacatattgtacattgattgatatccatgctaaagctggatacctggacattgcaatggatttatatggcaggatgcaagaagtaggcctgtcacca

SEQ ID NO: 1621 - DNA, 468 bp, Sorghum bicolor
  Clone ID: SORBI-28MAY03-CLUS26947_1
gcacgaggcccaagctcccgtcgtgacaaagcaaaacacgtagtcggcagcaaagcgacgcgtgtccgtcccgcgatggccacggcggccgtggccaggcaccaccaccagcagcggagtgcgcagcgggcgcgggggcgggggcggcgcggcgggatacggtgctcgtcgccggcgcaggagttcgcgtcgctggccgcggtgttccggcggaggctggtggtcggggccaccacggcggcggccgcggcggtgggggccaacttcggcggcgtcaccagcttcctgctgagcctctcgccggagctcggccgctcgctccgcctcgacgtgctctaccccgtcggcggcttcacgcgctgcctcgactccgacaatggattcgaattcatctatccatcaagttgggttggagaccagactctactgtacagagaagtgaagaaagcagaactgcaaagatcacta

SEQ ID NO: 1622 - DNA, 413 bp, Sorghum bicolor
  Clone ID: SORBI-28MAY03-CLUS27213_1
caaaaaccaaaccgagctagggttttagggggggagagagaagcagacggaggcgacatggacaaccccgagatgcagcgattccttcagcaagagcagcaaaaggcgatgatgaacgacatggttggcaagctaacgagcgtgtgctgggacaaatgcatcaccagcgctcccggaagcaagttcagctctggggaatcaacctgcctgaccaactgcgcccacaggtttctcgacatgagcgtgctgattgccaaacgctttgagatgcagtgaggcgtcgtcgcacaaaaactgttgcctactcaatcgccttaagtttttcctttgatttgaggttccatggagcacttggaacgattcaacagagagtttaatgtactttctatatcttactatctaaaaaagaaaaa

SEQ ID NO: 1623 - DNA, 553 bp, Sorghum bicolor
  Clone ID: SORBI-28MAY03-CLUS27221_1
tcttcaacctcaggctcaaggagaccgtggcgagcctccggaagacgcaccctgacgccgcgttcacctacgtcgacgtctacaccgccaagtacaagctcatcagccaagccaagaagctcggcttcgatgaccctctgctgacctgctgcgggtacggcggcggccggtacaacttagacctgagcatcggctgcggcgggaagatgcaggtgaacgggacgtcggtggtggtggggaactcgtgcgaggacccctccaagagggtgagctgggacggcgtgcacttcaccgaggccgccaacaagttcgtgttcgaccagatcgtcgccggcgtgctctctgacccgcccgtggcgctgaggcaggcgtgccatagcagagggcaatgaaccggaccgtgtgtcgctcgtcgggatgactacgctgcagctgctgctgcggctgcttctcgctgtgtaactttgcaagtgtaaatcgaaggagcaagcatgctcgacagctcgaggatgtaataagggacctgcaaatcagagcagagatcgaagagcaa

SEQ ID NO: 1624 - DNA, 813 bp, Sorghum bicolor
  Clone ID: SORBI-28MAY03-CLUS27266_1
gtcaaggcgagcaatgttctcctggattcaaatttccaagctcgggttgccgactttgggtttgccaagctaattccagatggtgcaacgcatgtcaccacaaaggtgaaaggcacacttggttatctcgcaccagagtatgcaatgcttgggaaggcctctgaaagttgcgatgtcttcagttttggaattatgctcctagagcttgccagcgggaagaagccagttgagaagcttaaccccaccacgaagaaaaccataactgagtgggctcttcctctagtccgtgacaaaaagttcaaggaaattgctgatccaaagctcaaggatagcttcgtcgaggatgagctgaagcgaatggtgcttgttgggatcgcctgttctcaagacaagcctgaacagagacccataatgtctgaagtcgttgagctgctcaaaggagaatctactgagaagctttccaacctggagaacgatgatctgttcaagcctgatagctcattccagagctcatccggacctgatagctcagactgcgtcaccgaggagaggagtcccaaagctgatgcgatagaggaggcagttgattcaagtgagacagttccctcagcaaggtagcgtgatgcatagtggtgttgtctgtaggtgccctgagctccttgcctgggagaaatgtgtttatcagtgtgcttaatttgggagcttccttgcccagttctcctatgtgctgtcatctcttcgtgttggcatggtactattagcttgtaaaattctgtaaatctgggcctgattccatctgtagcactgctgtta

SEQ ID NO: 1625 - DNA, 650 bp, Sorghum bicolor
  unsure (1)..(650): unsure at all n locations
  Clone ID: SORBI-28MAY03-CLUS27291_1
gcacaaggcccactactccaccagcccaccgccaccgcgcaccgctagtccgcgacgccagcgcccccagcctcgctccctcactcctcccgcgctccccaccgtgccgccacaagcgacgcgacgccgcgacacgcaggggagagggaaatggccacggccgcgactgccaccggcaccgcggggagcagagcagccgcgctgccgctgctgctgctgcttctctcgttggcgctgccgctgcgggcctacggcgcgggcggcgactgccacttcccggccgtgttcaacttcggcgactccaactcggacacgggcgggctgtcgtcgctcttcggcgccgcgccgccgcccaacggcaggaccttcttcggcatgcccgccggccgctactgcgacggtcgcctcgtcatcgacttcatcgctgaaagcctgggactaactcacctcagcgcgtacctgaactcaattggaagcaacttcacacagggagccaattttgcaacagctggttcgtcaatcagaagacagaatacatctctgttcgtctcaggcttcagccccatttccttggacgtgcagntctgggagtttgaacaattcatcaacagaagccaactcgtctacaacaacaaaggcggtatctacag

SEQ ID NO: 1626 - DNA, 803 bp, Sorghum bicolor
  unsure (1)..(803): unsure at all n locations
  Clone ID: SORBI-28MAY03-CLUS27299_1
agcccgcccaatcatcgatgccctgtctcgcagtctcgcctagacgctccttctctcgctctatagcactcgcgccgccgaccgccgccgccgtccatagccgccgcccgccgccctccagtgctctgcagcggcactgctcgctacgccgctcgcccgcgtagtcgtccgccgtcctccgtgggagcaacttgggcctagagggatccagagcccgccctccgccgtgggagcaacgaacgagggcaggcagggatgagggaggcggtgacggtgcaggtcggcggcttcgcgaacttcgtcggctcccacttctggaacttccaggatgagctgctcgggctcgccgacgaccccggcgctgccccgggattcaggaccgccgcgctggacttggacgtcctgtatcgcgccggcgagacacagcagggcgtcgccacctactgccctcgcttggtgtcagttggttctcgagggtctcttggctcgttaagttcctctggtactctaggttcgagcagtagtgctgcagatcagcccaacatcttcacatggtctggaaatgtaacgaaatcagtagcaaaacctcatgagcggaacttgttcctacaaagtttatctgaaggagaaagcaacccaagctctagcaatggccgaaacaatgccagagaaaatattgaagataaggacnnnnntgaaaatctagagaatggagtcattttttggactgattattcaaaagttcagtatcaccctcagagcttgtatgagttatatggatcatggacagactttgacaagtt

SEQ ID NO: 1627 - DNA, 487 bp, Sorghum bicolor
  Clone ID: SORBI-28MAY03-CLUS27328_1
gcacgaggcctgaatctcccctcgagcggcagctttgcttgcggcttcttcccacactcgtttccccgtctcggatttcatgccccagggggcaacgcgttcgcgtgcatgccgcgcaaggagcagcggggcgcggccgtggtgtcgcgcagcaagcggatggggagcgcgcggtcggcgcgcggcgggcccaagctcacgcccgcggaggaggagctcctgcaccgccaggcgctggccatggccatccaccagcacctcgacgccggcggctctatgtcgcgccgcatcgacgccggggcctccctgtcccgacgcatggcccccggctcaaccagctcccgccgccgcggcgacctgccggactccgtcacgaatgccaagcccgccccaattgtcctggagaatttagaaacaaagaaaatagtccttgttcatggagaaagatttggtgcttggtgctggtacaagaccatctcacacctgg

SEQ ID NO: 1628 - DNA, 607 bp, Sorghum bicolor
  unsure (1)..(607): unsure at all n locations
  Clone ID: SORBI-28MAY03-CLUS27329_1
aggaagagcaggaaacctcgcagatccgcgccccgtccgctcacaggttcaccgcatccccgccactaccgtttccactgccggctccattcgctccaccaatccctgctcaagccgctccagctgagagacggagagccctgcgggaaggcgagacgagggggaggtccaaaccctagccgtagattgcgggctcctcctcctcctcgccgccgccggcggggatggagatggtggtggcggcgccggagctccccgccgaggtggagagggctctcatccgggacataaccgtcgcggactgatgcccacgctaaggacggcgacaccttcttcctcatcaccaccaggcggtggcaaagttggattgattacctcattcaagatttgactggtgcaacaagtaatggttatcatcatcatgactttggttcaaagactcctagaaggccaggagctattgacaataccgatttaattgatgatgcgtcatttgaagtctccaatacggagattgagatacatgataacttggttgagggtcgggattacatactggttcctcagcaagtttgggaaaagttgcatggttggtatggtggnnnac

SEQ ID NO: 1629 - DNA, 434 bp, Sorghum bicolor
  Clone ID: SORBI-28MAY03-CLUS27059_1
gcacgagggtggagttgttactcgcccactccagactttgccaccgcacgcccactgcagttgcgagtccaccaggcgccggcgaggtgcccatccagcgagcgccggcgaggggcgcgtccagtgcgcgtcggcgaggggcggatccagcggtcactggcgagggggtcgtccagcgggcgccggcgagggagcgttcgcgggcgccggtgagggcctgggcagcgggcgccggcgagggcctaggcagcgggctccgacgatggagcgttcgcgggcggcggcgagggcctatgcagcgggcgccgtcatcgtcctcctccctccactcagacatggcaggtgctgcgccggggcccccctccccccggtctgcgcggcgccgcggcccccgcccgggcccccgaacggccgcaccttctacaggaggaggg

SEQ ID NO: 1630 - DNA, 453 bp, Sorghum bicolor
  Clone ID: SORBI-28MAY03-CLUS27042_1
gcacgaggaggtctacgcggccggtacagcttccccctcgggccccacccccatcctcctcgccgccggatgatcgccgccggcgccgcctcgatgggccgcgccgcgactccatccccgggggcccagtcctcctcccggttgccgcgcgccgtctcgaggctgcggctcgtgcttcgctcctcggaagcggcggcgaggagcggcagcgagaggtggatggggtgcttccggccggcgccgtcgctggccaccgcggcggcggtgaaggaggcgaagggaaagcggccggaggtggaggtggagccggcgcgcggcggaggggaggacgtgtggagcgccgacgctgacgcggaggtggcgcagggtggggcgttccccgagcacctcgtcatcatggtcaatggcctcgtcgggagcgcggacgattggaagttcgcggcggagcagttt

SEQ ID NO: 1631 - DNA, 822 bp, Sorghum bicolor
  Clone ID: SORBI-28MAY03-CLUS27066_1
cgcgcgcagccagcccaaacccttcctaccccagacgggcgacggcgatggccgccgcgacagagaagacggccgaggacatccgccgcgagctccaggagctccagcgccagcaccgcgagatcaccgagcgcctgcgcgacccccgtggccttcgccgcggcgcccccggccctggtcctggacctgggggggcccgcccgctccgcggcttcgtgagaccccctgtgggtgcggaatcgggggatcagcctccgcagaagcgtcggcttctatcggccgtagttaaggtggatggcgctgaaaataataataatgaggaaggcacaaaggatgtagatggcgcggggcacgagccaagttcaggtgtcactgaaggcagtgacaggaggggtttcaacaatggtgggttcagaagggatggtaacctgaggatgcagaggagggtggactataattcgctgccagagccagctccaagggagcttcccaggaatgaagacccgaatttggtgagaaggaataagaggatgctggggcagcttcttgtcggtacattagagaaatttcaacaagaggataaaaagttatccaactctgaggcttttctgcgcagatcagagactcagcgaaaggctgagcaaaaggttcgtgaagaaagtgaaaggttgcgacagcaggaacgtgagcaaattgcagagaagcgtaagcgtgatatgacacttcgcgcacgtgtagccgctaaggcagaagaaaagaggttggagctgttgtacattcaatggactgagcatcataaaaggctgtccaatttcttaagga

SEQ ID NO: 1632 - DNA, 661 bp, Sorghum bicolor
  Clone ID: SORBI-28MAY03-CLUS27424_1
gaaagcatactgagcctagaggagatgaaagatgacggggaatcggtcccagtgagagcacccggcaacgatgggccttcatgtgggattaagctgaagagagggagggggttgagagattttcagagggaaatattgcctgggcttgtgtctctggcgaggcatgaaatatgtgatgacttgcactccatagggtacgaaatcaggaaaacccggtcacggagaagccctggtgatgagggtagtccaccaacacgaatacgactgccaaggcgttgttctactgcatggaaccgatgaacacaaacaagaagtcctcaacgtcacactgtgacatcatttcacagcattcattcagcggcaagaaacaggaaggaaaagcagagttagctttgaaggccgccgaacctaactggctttgtgaatcgagcggtgcacggagcatgcattgctggaaatgaaacccgttgtatcaatagccatttgattggagagatttgtttcaattgtaatctgcaactgtggccaaaggcgaatcgtcgcgttagatgtaattgtgctttaggaggtgcatatctgaatgtagcaactgatgatgaatggctagctccataggattgaattgaatggaatggaataaaatgtttggctctgttcttgt

SEQ ID NO: 1633 - DNA, 605 bp, Sorghum bicolor
  Clone ID: SORBI-28MAY03-CLUS27457_1
catcaaggaaccttgcataagcatttaacacacgagctccctgaagtccttgagaagtacgacctctgccaagctgaccgtactcattgtagccccatgcttgcagtaaaccatcctcggataaagccatgacatgaacagctccacaagaaacctgcttaatcaccgtgtttggtgtgaaagctccccaaaatagacgagggtaatcagaaccctgattttgtccccaaacccaaagcctgcttttggataccgtgccatcattttctcgaggctcagcaacagcagctgtacaatgtgctccacaggatactgattttacaaactcagtctccaatgacttgaccttcttgggttcctttgcgctctcctctgttccatctcccaactggccaaactcattagcaccccgggtgaacggtcgtcccccaggcgcggcgccgcctgtgggcccgcggccgcttgcggtggcggccctcctggcgcccccccctttcccccaccggtggagttggcctcggtccctcgtgcggcgcccccggggccccccctcgcctttcgggcagtctggccactgtggttataaccccatatgtaaatgcgct

SEQ ID NO: 1634 - DNA, 671 bp, Sorghum bicolor
  Clone ID: SORBI-28MAY03-CLUS27466_1
gagtttggaagaggagagggcatatatagcaagtggtttgagaaaattggagcaaaagctccaattctactccaacaacagtgtttctgttgatttacccagtccagatgttaaggatgacctctctgacaaagtatatgtcatagaagacttctcgttagaccgccaggaaagctcgatagagagcaaagaagctggctcattgacaactagtgggaagattgatctagatgcagtgcaggaagaaatttcaaaattgaacagaagactgaagacactagaaggagatcgcagttttcttgaacatagcatcaactccctcaggaatggcgacgaaggtttgatgtttatacaggaaattgcttgcaatctgagagaactgcgagcaattgctattgacaagaaatagaatttaccaaactgtgtataatagtcattttcaaacttatttgtgcgataggtatcttctttctttctttctttctttctttctttctttctttctttctttctttctttctttctttctttttttttttttttttttgcgattgcaataggtattgaatcaacatatgaattgtgcatcatgtgtatcatctaaatgaaaagaaattcttcttgtatgtaggcaccagatattgttgtaattattctgaaggaaattcaca

SEQ ID NO: 1635 - DNA, 780 bp, Sorghum bicolor
  Clone ID: SORBI-28MAY03-CLUS2748_1
tcttcagcgtgctactgttgatagcaaatcccaagttggatcaatatttcaagttctcaacacaaaagaatctcctccaacatatttccagacaaataaatttactacagcgttccaggaaattgttgatgcgtatggtgtggccaaatatcaagaagcaaatcctggagtatttaccattgtgactttccctttcttatttgctgtcatgtttggtgattggggccatggaatttgcctgttacttgcaacactttatctgataatccgggagaagaaactagcttcacagaaacttggagacataatggagatgatgtttggtgggcgttatgtaattatgatgatggcagttttttcaatctacacaggattaatatacaatgaatttttctctgttccatttgagctttttggtaaatctgcctatgaatgccgtgatccttcttgtagtgatgctactactgatggactaattaaggtcagagatgcatacccttttggtgtggaccctgtctggcatggtagccgcagcgagctgccgtttctcaattcactgaagatgaagatgtcaattcttctcggagttgcacaaatgaaccttgggattgtgattagttacttcaatgcaaaatttttcaggaacagtcttaatgtgtggtaccagttcattccccagctgatcttcttgaacagcttatttggttacctgtccttgctcattattattaagtggtgcacggggtcaaaagcagatctataccatgttatgatctacat

SEQ ID NO: 1636 - DNA, 570 bp, Sorghum bicolor
  Clone ID: SORBI-28MAY03-CLUS27497_1
atcatgctgacggcctcgccgtcgtctcaggtgaagccgcaacaatgggcgacgtgccggatcagcgtggcatcctcggcggcgtttcttccgccgccaccggccgccgccggacggtctgtcgtccccgtcgagtccaggaggacgacgacggttgcctccgccgcgcttgggcctgtgtccaccgagcccgcagaaaggtctcccgcgccacagcctccgccacagtccagcgacgacgacgacgaggagacgatgctcggaaactacgtcccggtctacgtcatgctcccacttgaggtggtgaccacggagaacgaggtggaggactcgggggagctccgggcgcagctgcggcggctgcgggaggccggcgtggacggcgtgatggtggacgtgtggtggggcatcgtggagggcgccgggccgggcctctacgagtggcgcgcgtaccgggagctgttccggatcgtgcaggcgcaggggctcaagctgcaggccatcatgtcgttccacgcgtgcggcggcaacgtcggcgacgccgccaacatcccgatcccacggtgggta

SEQ ID NO: 1637 - DNA, 601 bp, Sorghum bicolor
  Clone ID: SORBI-28MAY03-CLUS27484_1
ctgagatgaacaatcagttaagagttggcattcaggtgggtagaactgaaatggtaaaaagtatgtagtcgccatgtccgtctggacctctctctgaactgctgccgtgcagactattgcgatcattcctgtcctgccacggggtgtcctacaattaggatctactggtttggttatggaaaacacaaattttgtgatgtttgcaaagaagttgtgttctcagctaaacaaccgttcaagcatggctgtatctgcttcagctaagaacggttcaagtcagcatggtcagtcgcgtcctgatactgcaactgtgtcaactagcacaccgccacatgcattgctgaatgcatctttgcttaaggttgtgcaacagaatggtcaccctgttagagagcacactgtctatgctaagcctgatcttcggtttctacaacaagcatccttctgcgagagccaatttggaagaaatttatggagtgttggtatgaactcaagtttgacctccccaagcttgacatcagttaaaaatcattcactcttgatgaacaacattgggcagttacagttgaataataatgcacattcatcagcagatttagca

SEQ ID NO: 1638 - DNA, 598 bp, Sorghum bicolor
  Clone ID: SORBI-28MAY03-CLUS27502_1
tttactctagtccactatgagccgctcctccgcctcccgctcgccccctccctccacctgactgtctcagtccccctcggccttctcccctccacacggcgtcgcccgctcccctcccctctttcgccggcgccgacgatgaacggaggcggcggcgggcggcggcggtactcctcggagcagctcctcttcgacgtccccaccaatgccggtgccgccgcccggtgggcgcagcagcgcggcggggtgcggcgcggggacggggagatcttcgtgtcggtggagcccgcgacgccggcgcggctgcgcggaggggacgctgcagctggggattcgccgggacagaggcagcagctcagtcccgggttgctcgatctccatgcgttcgacaccgagctaatccccgattttcaagtaccagggatgtatgatggtgcccaaaagtttggctatggaggaggtttagatgaatctgatatgagattcacagcaaacaagctgatgagcaagtctactgtttttcctgatggtaactatctgaaggccttcactgagaaagaaaaggcagcacctgtcgcaaaaatcaaagtggtggtgc

SEQ ID NO: 1639 - DNA, 668 bp, Sorghum bicolor
  Clone ID: SORBI-28MAY03-CLUS27158_1
cgcactgcatctccatgcttggtccgctgctcgccctccctcagcgttgaggttgctcctttggcggctgggtgctttggggtgttcgcccttctggttggtcacccgtcgggctcgacggttgtcggacccaacggggggcggtccgcccgtgccgtggtccgcccgtgctgtcgtgctgggatgccgcgtctgggctgtctggctccggcccgcgcgtcggcttccctcccgcgggcggccgccgccgctgccttcttccatcatctagaggcgacgagccaggttgccggaggcctgctccttccgttcctctgcttgggctcggcgttcttcctcccctgcccgcagcagggctccgcttcaggcgagtagccagttggggggtcgccgcggcctccggttcggttactgggcctaggttctttgctgcgcggggtcgcagcaggccggcgcctcctttccctgtcctgccgcgtgctcgtcgctgttgccccttgggtcattgagctgcggctctctgctgggctggggcctgtcagccgctgggcccccatgcctggcttgcctctttctggatcccggggacccaccgctcatggccgggcggctctcctcttggctgttgcctgtaatctgcttgtgcaccatggtaagcttggttattg

SEQ ID NO: 1640 - DNA, 755 bp, Sorghum bicolor
  Clone ID: SORBI-28MAY03-CLUS27173_1
gtttatctgacatccaaatgcagaagaaagaggctcgaggcatttttgaactcatcaagtctcttttcaatcaggctgaaagagagtgggtgggatttctgggcccaatacatatatggcaggggatggacgaccgagtggtctcgccgtcagtggctgaatttgtgaggcggtcggttccaggggctacggtccacaagcttcttgatgaaggccacttctcatacttctgcttctgcgacgagtgccacaggcagatattctccacgctcttcggcattccccagggcccaatcaaccctgcgccgcaacccagcgaggttgtttcagagctcaccgaagaaacaacagtaccagacaatgccacagatcaggaacaaggaaaatcaggcctgccctgatcaagatcagttttcaggatcaacagtatagatacgagatgttactactactaaatacaataccccaaatagtcgtgcctttcgtcgctgcctgtggactgagctgctcctcttgcgagaagtcttgaaggatgaagacaaagcattggatagaggctgtgtgccgtttcacttcgatgtacaaaaatgctcatcacaaattcgcacggcacctgctcggtgcgcttttagtatagtcggtattaaaattggattaacctgctatgactccgttataggcttctttttgcacatttgcgccctcagctgaattttgttcctttattaaggctttatggcatgatgcaatagtcc

SEQ ID NO: 1641 - DNA, 542 bp, Sorghum bicolor
  Clone ID: SORBI-28MAY03-CLUS27205_1
tgtcacccgtttcttatcatgggatgacaccacctcagagtcacagtcaccttgtaacccaaggctgagttctcgtctccctgatgtagatgatgatgagtcagaacgccatgtccttgtgcaaaatataatgtcatcagctggattaggcacttcgcaatcatgtatggttttcaccggttggcattcacctgatcaccctcttgacccggtactgtgcaacaaattatcagagctgcaggagaaaagttcatacagaaggcttctatttgactgtgtgaatgttgctctgattgagatcggtgagaacgctttactgagtgcattcccatggagtaaaacacactccaggacatggagaggcacctcatctcctgatctgggtgtagcagtctggagtatcctgaaggactggatatatggggccaggatgtttgtggtgagcaagagagataatgctgggatcatattggatagaattgtgaagcaggaggtcgaagcaagagggtgggtgaaactgaggatggcgcaggggttgacat

SEQ ID NO: 1642 - DNA, 579 bp, Sorghum bicolor
  Clone ID: SORBI-28MAY03-CLUS27579_1
gcacgaggctggtatttcacaaattccagttatgccaagtgatgagctaccacaggttcctggtgagattgaaccatctcagagcacaagtgaaggcaacgctgatccatatacatctcagttcacaatactagaggagcactatgctgtttcagaagaaggaaatataaaaggtattctggaacaagttgatgtgccagaaattactggcagatcaagtggtgagtttcatcagagaattgcgtcagcagctgatccacatacaaatgaactggtgctagagaacgctcatcatggtgcttcagaagacgcaaatcagaaagataattgcggggatatccatgtttcacaagttagtgctggttccaaaacatgtggtgaagttaataaaattgaacccactggtgacatgggggcacacaaactgatagtccaagatccttctggtagtgctcccaaagatttaatagataaagattatgtggacgaacctcatatatcagcaactaccgtaagatcaagtggtgaaatacctcaagatcatagtgccaccgaggaatacccaaaaacaagtgacag

SEQ ID NO: 1643 - DNA, 654 bp, Sorghum bicolor
  Clone ID: SORBI-28MAY03-CLUS27588_1
aaaaaaaaaaagagaccgcccggctccgatcgaagctgcccgtgcccgacgaccatggcgtcagctgcgagaaccacgccggggccgggcaggtccgtcgtcgtcctcgtctccctcgccacgctcctcctcgtcaccttcgtctccaccgtggagagctacgacggccggcatgccgtggcgcactcggccatggcgcggcggtcccgcctggggacccgacacgtgcagcaccaccaccgccgcaccaccacggtgccgcaccggtacgtcctcgcggagaagagcagcccgaccggcggcggcagcagtcccaagaaccgcagcagctcccctgcgacggccaacaacgccagcgcgccggcgccggccgcctcgcagagtgacggcgggcgtcgccaccgcagccacaagcaccgggtgcgcaactggatcatcggcttcgtggtgggttccgtggcgggcgtcatctccggtctggtgctgtcggtgctgttccggctggcgctcaactgcgtccgcgggcggtaccggtcgcgctccggcgtgatgatcttcaccccgaagctgatccggcggccggagcacctggcgttcctggagaaggaggacggaggcaccggcacctgcaccggaacctccggcgggctttcg

SEQ ID NO: 1644 - DNA, 557 bp, Sorghum bicolor
  Clone ID: SORBI-28MAY03-CLUS27626_1
gcacgagggtcctctccattctcaccaccgtcacattgctccacctacaagctgcagatgagtccatccattcatatgtgcttcaatatcgtctacgagaagattgtagacaatttcctcctgatagtcgctgtgccactcaccattgccgcagctactattgcgatggcaagactagagcctaacgaatccgcagatccaattcaaaccttcagtcattcacagatcttgtcaattttgttgttcttggctaccgcggtgatcgtatattacatgcagcgcccacgcatggtgtacctcgtcgactatgcttgcttccgcgccacatataactaccgtgttccctctgctgcttttgttgagcatgtccgccaagtcagccatttcagtgagcgcagcgtccgtttcttgacacgcctactcgagcgatcaggccttggagaggagacatgccttcccccagtgggccagtacattgaaccctacaattactgcacgttggaggttgctcgcgaggaagctcagctcgtcgtcttctcagccattgacgatctatt

SEQ ID NO: 1645 - DNA, 620 bp, Sorghum bicolor
  Clone ID: SORBI-28MAY03-CLUS27561_1
gcacgaggggtaattccagctccaatagcgtatatttaagttgttgcagttaaaaagctcgtagttggaccttgggccgggtcggccggtccgcctcacggcgagaaccgacctactcgacccttctgccggcgatgcgctcctggccttaattggccgggtcgtgcctccggcgccgttactttgaagaaattagagtgctcaaagcaagccatcgctctggatacattagcagcgcgtggcttccttcgctcccggcccttccgcgtcccccctccggtccggccgatccatcgagcgccccgggccggggcttcccggtgtcgccgtcccggctggagttcctcggcctccgtaaggcgcccgccggcggcggccggcgccacccatctgctcggtgctcatgtccgcacggtgcgggctcggggacgaaggaggagatggcaggtctgagcgacttcgagtttttcaagatcctgatcccagggatgtacgaggaagcactgaggctgcccacaaagttcggtgagatcctcggagctcgccgggatctgaagctgcggctcaccggcggagagatgatgccgctgtgggacgtggaagtcttcgtcgacgagaaa

SEQ ID NO: 1646 - DNA, 571 bp, Sorghum bicolor
  Clone ID: SORBI-28MAY03-CLUS27639_1
gcacgagggtcttctttccaccaaaccccacctcatcttagggtctcaagcagagacacacatgtgttcccacaggcgatatcccagtggcaggcactgccccgctcgtggcagcattgtgccaacaagaggaacagcaatgacagggtgatggacgactctgcaaactacaagaactcaaaccatgactggcagctatccaagcacgaggacagctacagcatatcgaagtgcgtccagatcctgaacggcatggtggagctgtcacaggtggagaaatcagttgcccccgatgtcttcctgcagccaggcaaccgggaaattttcatctccctcagcggcgatgtgcgcgccatgtggctgaagcgcaagattcagcacctggcctagggtgggttgccttgtgccgtccttccgagtggagattggaggggacattgagttatcttttagatcttgcgtgttctgctgatcgtgggcatgcacaggattctaggttttttttttcccctgtatattgagtgtattcctggattataaccattatgtattgtctttgtagagagcccat

SEQ ID NO: 1647 - DNA, 956 bp, Sorghum bicolor
  unsure (1)..(956): unsure at all n locations
  Clone ID: SORBI-28MAY03-CLUS27647_1
tgttggcctaatcatcctatcatcctaaacctcagaaaccggcaatggaggcctcctcctcctcctacgcttccgcccctgcagcgctcctcccgctgctggctgccccgccgcgcttcctccacctccctctccgccgtccctctgctcgccgcaacggcttcgcgatttggggtgggggtggccttttgctccagccgccgctgctgggccccggttcccgcgcccgctgtaggacaacctgctgcgcgtcgagccccgagcaggcggaagtgctgctgggcggggcctcgctcgttagcttggcggcggtcgctcttctcaccactctgcagctgatatggttgcggtggcgcagtgcgaggcaaggggatttcccggagattgtacatgaacatggcaaagctcgtggaaataagacccttggtgcatcaaaagcaatgtatgacagtaattgggcaacacagctaactcaggatagtcactggctttcagagccttttgtttctggaagagtaactgttgatgaaatgcatggcaaggctggtaactttccttgtgcaaactctgtacataaagaaacacaggcttattctataattacaccatggatatctatggatacaccgttatatatttctagacctgaagaagttagttgctcaacttcaactgcaaatagttccatcaataaggatacaagtctttctgggatgccacactctgtatcacaagggcaagataaatccaagtgtttatctaacagaacaggccgggtagctgggcttccatatcagtttttatccctttcaggacaaaagaaagaggcacaaaatagtcaaggtcataatgataagcaaatggataccaataccaaggatgctaatttagttggatgccctcagagtgatcaagaggaacatcttgattntacatccctttcgtcctttgaaaga

SEQ ID NO: 1648 - DNA, 568 bp, Sorghum bicolor
  Clone ID: SORBI-28MAY03-CLUS27648_1
gtgttcccctactcagccgtgccgccgccgccgccgccggagtgtgtcatcgccgattcgcctggtatggcggcgccgcccggcggagcggggatagtgtggcagacgccggccaacccgccagagtcgcacgactacatcatccgcaacggtcggcgctacgtgaggccttactacttcgagttcatctcccatgtgaagaacagatgggctggaaagaccattgttgacctcttcactgatgagtccaaagggcgctcccgcgattactatgttcatgcagtgaagtgtgggaggcttcaggttgatgggcaaacggttcacacagactatattgtgaaatcatcacagaagataagccacttcttgcacaggcacgagccacctgtcttggcaggtgatatttcaatacttcagaatgaagttgatgtcgtaactatttgcaaaccagcttccgttccagttcatccatgtggccaataccccaagaatactgtagtcgggattctgcaggctgagcatgggttaacacccctatttccggtgcatcggttagatcgtttggttt

SEQ ID NO: 1649 - DNA, 799 bp, Sorghum bicolor
  Clone ID: SORBI-28MAY03-CLUS27370_1
gcacgaggctcccccgctttcggcttcggatccaccgccttctcgttcggtcagtccacggcggccgcctcatcggccgcgtccgcgccatccctcttcggcgcaacgcccgcatcctccgccggaacaacccctagtttattcggcgctgctacctccgccgcaagcagccctggcctcttcggcgccgcctctgctgccgcaagcagccccggcctcttcggtgcgtccgccaccggctctgcagcgacctcctcgggtctgttcggcggtaccgcctccccgggcctattcggcggggcctcctccgcagcgaccaccccgagtccattcggggccacctcatccgcggcggcgacagctagtctgttcggccccgccgcttctgctgcgtccaccccaagccccttctctggagccgccacgggctttagctttggctcgtcggcgtccggttccaccactaccacacccgccgcctcggcaccatcattcggcttctcgttcaactcgggggcggccgcgtcaagcgctgcctccaccgcgacatcagcaccggctttagggtttggcgtggccactggctcgtctctgttcgcatccaccacctctgcgcccctcttcagcagcaccaccgtctcttctccagcgcctgctgcgacgaccacgccatcctttgggttctcttcctcgccagcaacaaccgcttccgccccatcgtttggctttacaccgccagcaggaagcgcgactacggcgaacacggctccttccttgttctcatctgcttcctcgagca

SEQ ID NO: 1650 - DNA, 289 bp, Sorghum bicolor
  Clone ID: SORBI-28MAY03-CLUS27403_1
ctcctctcttccctcccggccctcctgaaattctccgctcacgccaatcgaggcacgggaatggctgagagcccgagctgagcaaccagccaagcgagaaatccacttcgagaagcttctggatctcccgaacggaggtggggaggggagctgcgcctgcgggtagggtttctctctcggcccgatggcgtccgccaagtcgtcgaggtcgcggcccgccggccactccggagtgttaccggtgaacgcggcggccggcgccggaggcaacgacggcgcggtgcaagtc

SEQ ID NO: 1651 - DNA, 810 bp, Sorghum bicolor
  Clone ID: SORBI-28MAY03-CLUS27405_1
gcacgagggacgatcggtcgagttttaatttgcagtgaagcttgttaaccttgcatcatgacgcttagactccttgccgaagtgagcccacaggacttgctcgtagctctttccgagctccaaacccatgtgctcagttacatcaagtccatggctctcaagtgtgcagtggatctctccatccacgacactatccaccgccatggcggtgccgcaaccctagccgacatcgcagccgacgccaagatacacccagccaaggtgccggacctccagcgcgtgatggaactactcgccgctacgggcatcttcactgccactgccagtaaaaaagacgacggcagtgctgaaaccgtgtacggattaaccacggcgtgccgcttcctcgtcggacatcgcaacctgtcccctatggtgcccttcttggtgagtcctctcgtcgggtcctccttcttcagcttgtctgactggctacggaaggagccggctgctgccggcgccggcggtgccgggtcactcttcgagctggcgcatggatgctcccatagggagatggcgaagcaggatgccgcgtttagcagcgttgtgaacgactctatggcggctgatagccagctgttcctcgaggttgttattatggacaagggccgtatctttcgcgggctgagctcgctggtcgacgtcggcggcggccatggcgccgccgcgcaggtcatcgcgagggcgtttccacgcattaagtgcatggtgctggaccttcctcacgtcgtcaacgaggccactgctagtgatggtaacatgcatttcatt

SEQ ID NO: 1652 - DNA, 494 bp, Sorghum bicolor
  Clone ID: SORBI-28MAY03-CLUS27713_1
gcacgaggcaccacctcgacacgcagagcaaccaccaccagcagcagcagcaatggcccgcacctgcagcatggtcctcatcgccgcactcctcctggccgctgtcgcggtagcaccgtttgcgggggcagcgcgcgacgtcgctgacaacgagggcagggacctgtcgtccgccgacgcgccagcctccgacgcgcccgccccggggcccgacgccgcctcgtccccagactcctcggaagcaccatcgtcgagttctgatgcgtaaccagcgtacataacttgaccatacatgatgatacatttcaatttggagtttttccattacctttttcttcccttttcgtatgcactcatcgcccatggtgcgataagacaattattggtttttattactttattaagagaaattttcctttacctttcccttccattttcatatgtataccaactattctaaactccgtttgcattcataattgacccccgggaca

SEQ ID NO: 1653 - DNA, 809 bp, Sorghum bicolor
  Clone ID: SORBI-28MAY03-CLUS27723_1
caaggcaccgcctgctcgagctccaagtctcaagaatgtgcaaggtggtgatcacgatcccgtcgctcgtcaggctgcgccgcacgctgcggcggtggcggtcccgcgccgcggaggccgcttcatcctcctcctcctccttggcgtcggtgccggcggggcacgtcgccgtgtccgtgcaagggacggcaccgtcttctgggccgaggcggttcgtggtgcgggtggcgcacctcagccacccggcgttcctggagctgctgcggcaggcggaggaggagtacggcttcccggccgcaccgggccccatcgcgctcccctgcgacgaggaccacttcctcgacgtcctccaccgcgtgtcctcctcttcctcctgctgctgtggcccggtggccgcccggcgcgggcgcggcgacgcgcggccgctgctccaaggcatggccgtcgagaagctcgtctggtgaccgtgacacatgcaggcgagcaagttcggcagccagcacgcggggggaaaaaaaaaagcaaaagcgactcgccggctggcgcgccgggaagaccgtgcgcgcgcgcgcaggcatgcagttcgtgtcggggcatcggagtaaaggacgtcctcctcccgtgtcctacgtgtaggcggcgccccaacggcgacggccgcgagggcaactggggaaggcacgggcattgttagcagcagcgtgccagcagcaactgttgctgattgctgtagtggttgtttagctaggaggtagctagtagatggtacttggaagaaattgctccaaggatcaagatagtatgggcga

SEQ ID NO: 1654 - DNA, 756 bp, Sorghum bicolor
  Clone ID: SORBI-28MAY03-CLUS27728_1
tttacccttgagttttcatacacacgttagtgatgcttcttcttgtgaagtagcgactccgttcaattagcttgccgctggaagtgattgtgctagtttgaagtgtatttgcgtcatgcttgccgtgagtagctcacagttgacagattacagaataagctcgagggacctgttgccggccccgcggcggcaggttgcccgcgcttcgtccggacccgcggcgtggcggctcgaggctgctctcttccacccggccctcggtgttggtggtgctgagagattgattgtcgatgcggcttgccaccttgctgcccacggccatgatgttcatgtcttcacatcacatcatgataaaaaccgttgctttgaggagactgtttctggtttgtttccagttactgtatatggagatttcctgccccgtcatgtgttttaccgctttcatgctgtttgtgcttatcttcgctgcatttttgttgcactctgtgtgctactcagatggcccttctttgatgtcatattggtagaccaggtttctgttgtgattccactacttaaactaagggcatcatcaaagataatattttattgtcatttccctgatcttttacttgcgcaacatactactatgcttcgaaagttatatcgcaagccaattgacatgattgaggaaatcactactggtatggctgatttgattctagtcaatagcaagttcactgcagcaacttttgcaaggactttttcttgtttaca

SEQ ID NO: 1655 - DNA, 592 bp, Sorghum bicolor
  Clone ID: SORBI-28MAY03-CLUS27738_1
caagctggtggttctcaccgtaggcaagaatcagcacaagccagctttgctcacttcggcacgaccagtcctttcggctccttcggtctcccaccgagcagacagttgggaccaacaactggcaatttccgcttcgggatggttccgccgggcatgacgatcccaatgccctctctaggatcacttgcccctacaaagatggtaggaagttcatcaagcatgcaggggtacccagggcttatgatgccaggagagcccaaggtggagcctgtctcgcaacccctcttcccaatggcaaatgcatctccaccagcttaccaacagatgctgagcaggcctccttttggtcatcagatgtaaataaataggaaagagaaaaaggatagatttggttcagcttgtatacatgatagcgacactgcaacatggctttgttctagtgttcatggatcgtccaattcttagctttattttatttttctgctcacgcatttctttgaagcaaagaatgctgaggatgataacctgtcctgctgttgtaatcagggaaaggataccttcgtctttttgagactatcgaaatggaaaacga

SEQ ID NO: 1656 - DNA, 507 bp, Sorghum bicolor
  Clone ID: SORBI-28MAY03-CLUS27748_1
gcacgaggcccgcgtccctggatccggacaccccgttctccgacgccaccccgaccctcgccgacgcctccgacgccttcctcgcctcggacgacggcatcaccaacccgttgggtggcgccgccgggaagcacatgacgctcgcgccgcccgccgccaagaagccaccgtccaagaagaagggcggcaacagcgtctggacccgcccggcctcccgcaagggcaagaagaaggcgcggcagccgggaggccacggccccggcggcgccgcgggggccgctggcggatccaaccccagacccagcgccgccgccggcgaggagttcgtcctcgtccccgccacccgcctcgccgccgagcgctccgacgacgcgcccggccagcccgtgctcctctcccgcgtcttcaagtcggagcggatcgagctctccgaggaccgcctcaccgcgtccagcaccaagggcttccggatggtgcgcgccacccgcggcgtcgcgtcgggggcct

SEQ ID NO: 1657 - DNA, 560 bp, Sorghum bicolor
  Clone ID: SORBI-28MAY03-CLUS27758_1
ccacgagtgaactagccacgaaggcagcagcgaacagtcgctcgagcgcaaccaggcccgcccgccgcccgccgccgcgagatccgcagtgactaccagtctaccacaacattgaagaagatgccttcaatccagaaagccttgcctccggaacttgctgataatgtgctcaggttatatcgtgaatgcttacggagggcaaagtatattgggcatcagaaacacaatacagagcttttagtcaccatggtgaggcaacaattcaagaaaaacatgcatgaaactgatccagagaagatacagaaaatgaaggatgatgctgcaaggggccttatcaatcatattctgtatgagtctgagaagattacaggacgcaaattttcaggttaaaacggaagttaaaactagacttacagtgtgctgtatgaataatagtaaaaacaatttactttcttgccttgaattattccaactctattgtacgaggatctgcaaatgtttccttccgattgctgagtactcaaattattacaacaaggattttcagtaacaatgagttt

SEQ ID NO: 1658 - DNA, 507 bp, Sorghum bicolor
  Clone ID: SORBI-28MAY03-CLUS27769_1
gcacgaggctcctcccccgcttctcttgcgcgcgccggcctcctccccgcttctctcgcgcgcgccggcactgaaagagaagggcacggagacggaggttcttccccgacgcttcgctctctgtcccggcttcttcggttcttccctggtgcctcgctccccgtcccggcctcctctcaggcgcaccgcccggatccggcatcccgccgtgttcccgttccgcgattcggaacgaggttcccggtacgtggaacgcacccacgttcccgttcccctgctgccaactccgccgcaaccgcaaccgcaaacgcaaccacaacgcctccatccccgtccccgccgcctggagcgataccgaggcgcggcctgccgcgcaagcctgacctggcgcatctaccagcagcagcagcagcctcccgaagctttgtttcaagtggttattaggcttcatggatacgtctcaggagcaagaacaagattttggcgtactgctgaagcagggggcag

SEQ ID NO: 1659 - DNA, 470 bp, Sorghum bicolor
  unsure (1)..(470): unsure at all n locations
  Clone ID: SORBI-28MAY03-CLUS30703_1
cgcacgaggcctgctgctgctgggtctggtattcctgaagttaaagcatatcttaatgggggcgaggcctattctatattagctcctagtacactctttgttaagatttttgggtcaatacttggagtttcagctggatttgtgctaggaaaggaagggcccatggtacatacaggggcatgtattgccaacttgctcggtcagggtggatcacgcaagtatcatcttacttgtaactggctacgatactttaagaatgacagggataggagagatttgatcacatgtggatctgcagctggtgtggcagctgccttccgtgcacctgttggcggtgttctgtttgctcttgaagaagcagcatcatggtggcgaagtgctcttttgtggagaacattctttacaactgctgttgttgcggtggtattgaggggactgattgagttctgtcgcantggaaaatgtggtct

SEQ ID NO: 1660 - DNA, 564 bp, Sorghum bicolor
  Clone ID: SORBI-28MAY03-CLUS30719_1
cccagagaggtacgggtccaggattctgatggcaacataactgaaaagatttgtgacgccagcggtgaagacccagattgttgcaggtgcctctccatgttcagcttgaggattcaggatcatttcgcttacgtaggagtcgatatggaagcggacgattggagcacttgtagaatcattacagctcaaagcgttcggcaattccgacgggagctagccagcaacatcatcatgacaaagcatgatatcgacgtttccattgttgaacctagtgtacaaacagatcggagcagttgtagttagctggagcattccttttgtccaaaaagattcagagaagaagcagcctcttcttaatgtaatagatttgttcagcgaagaaggcgagccttgttttctctattatagtccagccagattggcatgcttttttagataaaggaaataaatccggtttcatctcttgtaacaaagagaatcagagaccatgatgtaaacatgtagactgtaggtatgtacataagaaaggaaggaagatcatagacacagtgtatgtggagatga

SEQ ID NO: 1661 - DNA, 448 bp, Sorghum bicolor
  Clone ID: SORBI-28MAY03-CLUS30722_1
ccgacccggcagaacaagtgcacgggcgtggtgggcgtgttcaactgccagggccccgggtggtgccgcgtcgtcgcgctcagggtccgcggctgcggccggttcggcgcgtactgctcgcggaggcccgcgcggcgccggcggcgcccgcccggggcgcgccgcgccccatatccccgtgccggagcaggagttctacagatgggacctgcagatcgatgtctagaggttctccctgcctgtcgatctgtggcaatggtgctttccgcctattcattcttgagtggttttaccattaaacgcgtgtgtgcgacatggaaaggcgtgtgcaatgcatgatctgatcatgaaatggacacggtccgccattgacgcgcctcttttcgtccctagaagaataagctagcctctgctgtactgtttttgctgcatcacccatttcccacgt

SEQ ID NO: 1662 - DNA, 598 bp, Sorghum bicolor
  Clone ID: SORBI-28MAY03-CLUS27828_1
tcgaagactcctccgaatccgagggctcaagcgaccgacggcgagcatggcggcagacggcggccccgcgacggcggcgctggacgaggccctcaagcccttccaggaaagagcctccgaggctgagatacgcatagcaaagctggaagccttgctgtacaacaaagatgatctgagccgtggatctgaggcaacttcctctgccgtgaaggatcttcggtcaaagctggatgcggctactgcagaatgcttgactgaaaaagagaagaacaagaagctaatcatggagaacgagaagctccagtaccgcatgacccatcttatccgtgcaataaaagaggcagaatcaagataggagcagcctgacgaggcctatgttgaagtgtccccatcttgttgatccttcacgttattcctgaatttacaatttagcttaagctattgttgtgatcctgatatagatcttggttgaaactgtgtcaaactgtcgattgggacgatgatatgcacactattgtctgttttgacctgaccccaacttgaagggcaggtgactccagcattgaacattggcatgcatatactgttatctaaatgg

SEQ ID NO: 1663 - DNA, 630 bp, Sorghum bicolor
  Clone ID: SORBI-28MAY03-CLUS2787_1
cgtttgagttgtttgacttgaccggacgacactggttggtggctgggccgcgatgccggactccgacaacgagtccggcgggccgagcaacgcggacttctcgtcgccgagggagcaggaccggttcctgccgatcgcgaacgtgagccggatcatgaagaaggcgctcccggccaacgccaagatctccaaggacgccaaggagacggtgcaggagtgcgtgtccgagttcatctccttcatcaccggcgaggcctccgacaagtgccagcgcgagaagcgcaagactatcaacggcgacgatctgctctgggccatgaccacgctcggctttgaggactacatcgagccgctcaagctctacctccacaagttccgcgagctcgagggcgagaaggccgccacgggcgtgcgggctcctcctccggcgtctcgcagccgcacagggagtcgacgccgtcgtcagcgcacaatggcgcgggcgggcccgtcggcggctatggcatgtacggcggcgccggcggaggcgggagcggcatgatcatgatgatgggacagcccatgtacggcggctccccaccggctgcgtcagggtacccgcagccaccgcaccaccagatggtcatgggt

SEQ ID NO: 1664 - DNA, 932 bp, Sorghum bicolor
  Clone ID: SORBI-28MAY03-CLUS27882_1
gcacgaggccgtcgcgctgccgagcgacggcgcgcatccgtctcctccgctccgaccctcccgccctgcctcccgcgccatctcgcctctcatcgccgccccgcctcccgcgccgtctcgcctctcatcgccgctccgcctccctccgtcgttcctggctgccgggctccttctccgtcgtcggctacgcgcgtgaggagggagaaggagccgcagcgcgtggatccaggggcagcggcgtccatcccgcgtgagaaaggagaaggagccggtttggatggctgcacggaaagaaaaccctgagcttattgcttgtcaagcacccaatggtcgaatcacgcgagctcaagccgctgcaaatcgtcgaagctttggtgttctcccttctgttccactgcctgcaaaaactgatcgaaaacagactacacaagggaagatgaaaaggggatcttcatatgacaacactagtgcaagtactgcaatttctggcccccagcctaagaggcgcacagttctcagggatgtgaccaatttgcgtaatgctaactctaacaaaacttttgctgctgcaccgaaggttcagacaaggccctccctaaggactggaagaaccgtgaccagaggcaagcagtgcacaaaaaggattcctaaaataccccaaccagctggtaatggtggttcattcgccaatgattcgagcattgccgaagaaacacaagagaaacttttggcacagaaagaagaacctattcttttgcttgagaacaggggctcactgtcattgcagaatgttgaaaggaacagggacagtgcttgtcatgaggcattctttaaggaaagaaatgtcagggatatatgtgaaccttctgtgtcaaagaatggggactcttctgtgttagacattgtagatatcgacaaagataatggcaatc

SEQ ID NO: 1665 - DNA, 921 bp, Sorghum bicolor
  Clone ID: SORBI-28MAY03-CLUS27885_1
atttgtgccactaaagctcctgccgccgtgaggcatttcttgatgcctcccagctcccaaatggccatacaactcacactactcatactcatttcatgtagcctttacagtatgtatccttcttcctcttcttccttctcggaatcgtcttcgctcgcattgctggtgcttgtcatctccacctgcctctccttgctcttcactaacctcagaaagctactcagagacaacaacacccacaaggctaataaggcagctccggcttccatggaggaggctgtgactgtgtttcaggagaagagcattgtgccacaagatgaggcactagaggatttgatgggcggaagcctgtcagattcttcagagtgcacgacgaacgacgacgaggagggcaccgaggaaggctcggtgtcagatgaagctgacgacgacgacgacgacgacgacgagagcctcattgagatctcccttgtcgatggccactatgtgggcggcgcagagcaagctgaacagcgacgcgcatacaactacaagaaggacctgctcgcggagttcttgccggatttgctgctggacaggagagatttcttcgacatcttgtcagagatcagcgaggaggacagcctgatcgagattgacatcgcaagaggctccatcaagtgctctgccaacttggatatcaaggcatgaggttacacaaggtaaaggtttggagaaactgaaagaaacctgacgatgcatttgatcagggaaattaaggcagcagcagcagcagcttgtacctgtcatcatccatgatccatgtaatggtgtaaggtgttctctttttacaagagctcatgtttttttttctttgtggtggatgaaggaagcctgtttcttcgtactctgtttcgtaaaatattatattacagcagaaaa

SEQ ID NO: 1666 - DNA, 746 bp, Sorghum bicolor
  Clone ID: SORBI-28MAY03-CLUS27935_1
aaactcttgtttgcaatttccttcgtatctacgaagcttctcaaaatggggaccaagttgtacgtgcctaacttcctcactgcgttcgagcatatttgcatccatgcaggtgggcgtgcagtgattgatgagatccagcgcagcctaggcctgtcagacaagcatgttgagtcctccaggatgacactgcatcgattcggcaacatatctagcagctgcttatggtatgaattggcatacatcgaggccaagcacaacatgcaaaagagtgatcgagtatggatgattggatttggttctggattcaagtgcaacagtgcagtatgggagtgcatcgttccaacccatagtgaagatgggccatgggctacgtgcatccatcgttatccagtacatgatccttaattattaagatccacaaaacctgttgtactaattaataagtatggataattaaatgatcctctttctatcaatccccctgcaacataatcaagacttcccctctttctcctctttctatttttttcaaagctctgcttttgcacttgatgattataccaaatccgtcagtacctatttggtatccagcatatttccactagttatttaggtggagatgaggaaacttatgttagtggtcttggtttggtggtgcaccaaagcttcaaaaagaaaatatatggttgtttctcttcccctataatatatttgtctcatatcaaaattatgaacaagccaagaaa

SEQ ID NO: 1667 - DNA, 720 bp, Sorghum bicolor
  Clone ID: SORBI-28MAY03-CLUS27958_1
aggaggatgcttcattaggagcagttgcaaatatttccatgaaagagacccgaattgtttttgatccgtgatggtcagggatctacactgctgaggtatctcttcttagaacattaagatctttgaagcatcgactggctgcaggttcaaggttaccaaacgtgacaatcttgttacccacagaaaagaaacaagttgacattgatgaaaaggagaaaacacttaaacttgctggaagaatcggtcaagcagttggctctctcttaaggcgattaggaatttcataccagggggatgagtctcatgggaggatgaggatcaatggcctgacgttaaggaggtggttcaatccaaaactgaataacaaatcctctgctgcggcggctgacttgcttccactgccttcgcggttagccaaagggattgctggtcagcaacgcgacattagaaacctttcactcgagtagcggactagtactacacggctatcctgcagcaaccgatcttgtggcccgtgcgataagaagcgtccaagtttatttttttttaattttgtttgatagttgatgtgcgaagagtttgttcggtggaaggaaatacataatccatcaatctgtaaagacattattcaaaagaaagatatacatgatacatcaaacttttgtataatcatgtcacctaatgggattttcccctgaacatcatatacgtatacagttc

SEQ ID NO: 1668 - DNA, 632 bp, Sorghum bicolor
  Clone ID: SORBI-28MAY03-CLUS27984_1
aatgctcccagacatcacgattttgcacctgaatatattggcaaacaaacatgcttttggggccagcgcatttcatgctctcagaatgtgttctggtataaggaagctaatgctggaatttcttgctcctacagtggtggaggcacaaactacatgcccaccgggttgcatttgcggtgagcaccaaaactgggaaaccgagcacctggtgttgaatcacctcaaagaagtagaaatcactcggatgagagggtctgaacatgaagttacttttgtgaagcatctattcatttgggggacagccttggaaaagatgatggtgtttttcgacaaatcggttactgaaagcgcagccaaggagttgtcccaggtgctacgaagctttgctaggccggaaatacgcatggaaatccacacgtatctggacatggtgatgatgatgtatgaacccgaagactaaaggcaccgggttatcgtgtagttttcctctttttgttgtgtactgcagtggttgaaatcatcaaaaacctacagcacagggaatgtgctggcaggcatgcatgccgaggagtggtgatccatcttgtttggatcatcagtccaatgactcttgactctgtaatgcacattta

SEQ ID NO: 1669 - DNA, 465 bp, Sorghum bicolor
  unsure (1)..(465): unsure at all n locations
  Clone ID: SORBI-28MAY03-CLUS2768_1
cgtccgtgaagcactgcaccgaatgtacaaactagtagtaccatctcttaaacaaaaatgcttttcttaatcatcatgtgtgctacctgaaatgaaacaggtatgtataattgctgaacttgcttaattttgagctgaacagtaatgcttcttcctcaaatcccaatgaccttgcaggatggagacattatcaacattgatgttactgtctatttgaatggctaccacggggacacctcaagaacatacctgtgtggagaagtcgatgatgctactaagcaacttgtgaaggtcactgaagagtgcatgatgcgcggcatatcggcctgcaagcatggtgctagtttcaaggaaattggcaagagaataagtgagcacgcagagaaatatggctatggcatcgactcctttgtggggcacgcgtcgggaggatattctatngcgaacccatcatatggcatacct

SEQ ID NO: 1670 - DNA, 679 bp, Sorghum bicolor
  Clone ID: SORBI-28MAY03-CLUS27699_1
cagctacctacacacacatcactcattcagttgccagtcagtttgccaaggccagttgcgcgcgcagagggaggagaggaccggaggagctgcgctgcgctgcgccgcgcagatgtgggcgccggggtcgccggggaggctgccggcgctggaggagtgcgtcgagggcgaggacggggaggcgtaccacggggccatggcctcctgctggggccgcttcggcgccgccgcgctgtggcgcaggctccggcagcgtctcagccttgtgcggcgcatgcggcggcgcggccgctcctccctcctcggcgccggcgggctcaactacgacccgctcagctacgcgcagaacttcgacgacggatgcctggagctggaggagcacgagccggacttcagcgccaggttcgcgcccgcgcgccacgccgccggcttcccgcggcccacggccgcggcgcgcgacgtcgtcgcgaccgcttgacggcgtaccacacgtcctccggcttttacctcccgtaacgctcggtgctcgccgctcgcccgcgcgcctatggaagggctagcggcaaattcctggtaatattgctccacacgtcttttagttgataaatgtacatacatggcacacgccgtcgatcgactcatatgcatcatggatggatgtaattaagtaggttcgtta

SEQ ID NO: 1671 - DNA, 561 bp, Sorghum bicolor
  Clone ID: SORBI-28MAY03-CLUS27719_1
cgtcgaccagccggtgctgcaggccgaggagagtacattcctgcagaggcacgacgcagaggatgcagaggacggcacttcatcagagattgatctcaacaggtagggggggacgacgaagatggtgatcagaagcatctctgctctgcatgtgcccagcatcggagaagagccaggggatgattggcggggtcaggcttttgagcaacgtctgctgcttgaaacagctggctgcactgcaagtctgcagcagcagcagcagcgacactgctcttcattccataatatgatatacatatatattttcatttatgcaaatggttcttgtgtttcatgtaccctctgtaaaaaaaaaaatatgtatggctggaactagaggcaggcccagctggcagctgcagatgatgcgaatgcaccatgcttgagggtgcaatgcaaggatgaatgcaaagtgcagaactgtggtagctactatactattaattactgagattgatgccttaagagggcaatgtcatgaaaactgaagagggtttagaatgaaaaaaaaaaaaaaaaaaa

SEQ ID NO: 1672 - DNA, 460 bp, Sorghum bicolor
  Clone ID: SORBI-28MAY03-CLUS28131_1
gctcggggcggcctcctagctgccggcgctgtcttgctgtgctcgctggtcatcctcatgttgtggcggaagctgaagcgcggccggcggcccgcacggccgctacagctttgtgcggccgccgtggggcgggggcgggcagcctggtgccgtgtgtctgtttctcgtcttggcacagcacggagtggctgggccgacatgctcgtccgcgcttgccttctgagcgggttcatgtcattgtggtcgagctggggctttgagactggtctgcccccctctacagcgggcgtttcttcgctggcttggtgtttgctgtccttccctgcgtgcaggatgcaagcattttccccctgtgcatatttttttaaatgtttttttaattgtccacaggttttgctggcttgccttcaaagcgttttcatgttaatgtaaagaatttgttgtatttaaacttgacaga

SEQ ID NO: 1673 - DNA, 505 bp, Sorghum bicolor
  Clone ID: SORBI-28MAY03-CLUS28163_1
ttacgaagcaagatgtgaaggacatacttgaggagtatcatgacaacattggggacttggatggacctgaagagaaggaaagagctcaatcgcggaccaaggaaattattgcggtgttgtgatgtgcaaggtggcctggggtagttggttgtgcagcaagcctgagtctggtagatattttgcaagggttttaggagaaagactatgctgagcgattttatattgcaggcagcaagtgtaacttactcggttgtagatgatggatggcagaaacaagagagcagtgcttgcttctaatgcactccctccctttcacattataagttgttctggcttttctagatacatagctctgggatacataggttttggaattgagagaggagggcagtattcggttgttgtgttgtattctattcttgtgtagactagctagttatttgcacacggtttgttgtgcatttgaagtcaggaacgaaggaaaagaaaaggaaaacattgtttg

SEQ ID NO: 1674 - DNA, 727 bp, Sorghum bicolor
  Clone ID: SORBI-28MAY03-CLUS28193_1
attccttctatgactttgggatttctggccaattatcttgcggagttgactttgaccgattatgagttcttgaaatttcttccatcattggtggcagcatcggctgtgtttcttgctagatggacacttgaccaatccgacgaaccatggaaccaaactctagagcactacacctcttacaaatgctctgacattcaattatgtgtctgtgctctacgagaactccagcataacaccagtaactgtcctcttaacgccatccgtgagaagtacaaacatcaaaagtttgattgcgtagcaaacctaacctcaccggagctccctcggtcgctcttcagctgacacgccaatgacaccagttaccctttgatcagcaacgttagctgcagtcgtagctctggctgcgttaacattattgtagcatcccccttccctcttttccccgttttctgatttggttgtgtgttgtcatcgagctgttgtgtcccggcctttttcgagtcgcaagtataagatgaaagacaggtaggtggctcgttggcttttttttttggtttgacatgaggtttacccgattgtaaacaacactgtgtgtagggctttggcttgggctgttattaactgtaagatggtccggcatgtgtaacaaacaacggaatgctgtttgttttgacacaattcgttcattgttagcttcggaatggaaattagtttattgccagtggtt

SEQ ID NO: 1675 - DNA, 357 bp, Sorghum bicolor
  Clone ID: SORBI-28MAY03-CLUS28230_1
cgcgtagctgacagagcaaagcatacatgggcaaagagccaagttgagggcaccgccagcgggagcgagcgctgctagctgacctacgccgccaccaggctgctcggcagagctcacatgaagcgttggccgtgcgcggcttcgtcgagccggactgcagtggcgctcaggcgtccaggcattcgcgagcggcgaccccaagcaccctggcactaccgcgtggcccatgtccctatcagccgcacgcgcggctccatggaaccgccctgcagcggtgctcaggcgttctagcgatatgtttgtgtttcccataatttatttgtatatatagtaaataaaggcagttttaatctcgtc

SEQ ID NO: 1676 - DNA, 612 bp, Sorghum bicolor
  Clone ID: SORBI-28MAY03-CLUS28258_1
gcacgagggtcatcagcacgtcgccggggaagaagcaggaggccatggaccggctcggcgccgacgccttcgtcgtcagtaaggacgccgaggagatgaaggcggcggcgagcaccatggatggcatcatcaacacggtgtccgccaacatccccctggcgccgttcatgagcctgctcaagcccaacggcaagatgatcatggtcggcctgcccaccaaggctctcgagatcccgccgtttgatctcatcatggggaacaagaccctggcggggagctgcatcggcggcatgagggacacgcaggagatgctcgacgtggcggccaagcacggcgtgacggcggacatagagctggtggacgccgactacgtgaacacggccatggagcgcctcgccaaggctgacgtcaggtaccgcttcgtcatcgacatcggcaacaccctcaagaatgcagatcagtgatcacatgcatgcatgcatgtggcgacactgctgcttgtaccttctcggctatatgatgaaccgtttcatatttttgtcggtgatattgtagcaacgacggacgtaataaataatgtagtatgatctaaaaaaataaataatgtagtat

SEQ ID NO: 1677 - DNA, 663 bp, Sorghum bicolor
  Clone ID: SORBI-28MAY03-CLUS28240_1
ctgtgctactcgattctgactggggcactgaaggtgttctgaaggatgaggaagccctctgtctagatggtactttttatgggaatgtggcaaggtttataaaccacagatgctttgattgcaatattattgcaattcctgttgagattgagacgcctgaccaccactactatcatctggcattcttcacaacgagggaagtaaagccttttgaagaactgacatgggactatgaaattgattttgatgatgtcaaccatcctatcaaggcattcaaatgccattgtggaagcgcattttgtcgggacagaaggcgcatgtcaagtgtccgaaggaggatctaactcttgagctctggtgttatcctgagaatattcaagagactcaaggcggggcagaattttgctgggtcctattctttcatcgtcaagacagatgatgccttgcttacctttgaatctagagttaatctatttgctcggggcatggacaaatgttgtcgtctaggatactgattctggggtggttcaagaaacgttgatctaccaggattactagaaacacttgttcttgattatttttgtcagcaagagatgtaagtgattctggaatgtgactgagcactgcgacggatctgactaggttaacttaagggattttata

SEQ ID NO: 1678 - DNA, 631 bp, Sorghum bicolor
  Clone ID: SORBI-28MAY03-CLUS28280_1
tcaaggtcgtgaccacgctgtctctgatggtggcgtccattatagctgtcatcgtcatgtgcctccgcgactacatcagctacgtgttcaccaaaggggatgacgtcgcgcgcgccgtgtccaccatgaccccgctgctcgccgtcaccatcgtgctcaacggcattcagcccgtcctatctggtgtggccgtcggctgcggttggcaggccttcgtggcatatgtgaacatcgcatgctactacggcatcgggatcccgcttggctgtgttttgggattctactttgatctaggtgccatgggaatatggggtggaatgataggtggattgattgttcagacgcttgttcttatctgggtcacacttcgcaccgattggaataaagaggttgaacaagcgcgcatgaggctaaataaatgggaagacaaaaagaagccccttttggcggaagattgaaaaattataaggatggtgcacgcggtcaatgcatatgttatgcatggtgctgatgattgaaaactaataagtagttagcttgtttagcattgaaatggtgaaactgaaattcgaacaagaagagactaatggctctcttgcacgaagttcttttcttcctcaattgggggtca

SEQ ID NO: 1679 - DNA, 684 bp, Sorghum bicolor
  Clone ID: SORBI-28MAY03-CLUS2777_1
cggatctgaggcagctgtgtgaggtcttgtggactgtaataaccaaggtcaaaatataggcaaggttttgagtgatctactgatcatctcttaattaaattggtggcctctatgtcaaagagacctggttttaatttgaacataattgaacagtcgccgtagcgttagcacggacaatatactagttatactcagtgtagtcaatgtatttaatctcttagcatggcaaaattagagtaccgtattattagaaaaaaacctatatcgcacttaattagagtgaccatttaggttttgcagctagcaccactctaataattcatattttccacttaattcggtaaccttttaacttgtatcacaaatctaaaatttgaacttacaacaacattgacaagcaacattttcttctactgaaataatttcttgccttgtcttagtaaagaatcaagaccttttcttagtaaagaattaagaccttttcttgagctatagctgaatattccttgctgctggctttttgcttgcttctggaacagtagggagaaattattaatgtgttgcctggcatgttgttcagtcagatagccacacctgtgaaaatagggtcttctgacattcatctattaactgtagaagaatgtcttcggggtgtgtatattttttttctaaaaacaggatgac

SEQ ID NO: 1680 - DNA, 594 bp, Sorghum bicolor
  unsure (1)..(594): unsure at all n locations
  Clone ID: SORBI-28MAY03-CLUS27773_1
atgaagacaaggttagctcaacccaagaaagctccactagagcagtgcgtgcacggtgcaggtgcacacacatggatcccttttgactgttcgttctagatctagcgattagcgacacttgctcgcaggagattctcgcaagaacagctcaccggcagtagcaacatgccaatatcataagcacaatcgcaagctgcatccacgtcgcacccggccaccagcacgtacccacaactcccaagctagcagcggtggttggcacgtcgcagttgatacggaggcgtagccgcgtagctgtactggttctcccgcgtcggcgtcgacggccgtctccctccctcggcgaagatggccatggggcgcgcgtccgccgccacgctgctcgtcgcgctcgccgtcctcgctcggcggtggatggcgcangcnacctgcgacgacaagctgccggctcagcttgccggcaacttctcggggctcgcctgcgcccccatctggaacaacttcgtgctccggtacgcgcagggcaaggacaacgtgctgcgggtggtgctgtcgaccatgtacagcacagggtgggtgggggatggggttctc

SEQ ID NO: 1681 - DNA, 527 bp, Sorghum bicolor
  Clone ID: SORBI-28MAY03-CLUS27823_1
gcacgaggagcacacagcagatactcctagctacttccagttccagctcggtcttggcctcttggaagagagcagctagttactcttacttgcgacgatagtgtctgtgaattgcgagaaacgagtgagcaatcatatatatggcggcgtctctgctcggactgtacagcggcgggaggggccacgccaggagcggcggccgccggtcggctgcggcggtgaagcggctgctgtcgagcttgaggcgctcttggaggagacgtgcggcgcggccgaggcgaagcgcggtgaggttcgggtatgacctgcatagctactaccagaacttcgacgacggcattgcctcctactcaggccaccaccgcttgtagctgtactgtacctagctagtgtacagtaattccctcttgccacttctgtacttaattagctcgtgcagtcattgactcattattttttatggaagtcattgactcattatatgtaagagtaacactaaatctgcgatcgattagcagaataataat

SEQ ID NO: 1682 - DNA, 513 bp, Sorghum bicolor
  Clone ID: SORBI-28MAY03-CLUS27785_1
gcacgaggctcctcgaccgccgcgccggcgcgctcgccgccctcctctgctacctctgctgggccgccagcggcgccctcgctgcccgcctcggtttctccgttgggtggaaggttgtattggtggctcagttggtctgttggactatgcaattcattggtcatggaattttcgagaagcgagcgcctgctctccttgacaatcttgtccaggctttcctgatggcaccattctttgtgctgctagagattcttcacacatttggcgggtatgaaccatatcctggcttccacgacaaggtgagcaagttgattgaggaagcccggaaggaatgggaggacaataaatcaaagaagtcctcatgagatatgtatgaattaatggctctgaactgtgaggtttgcctgctcgagatgaacctgctggattggatgaatctatctcaaggatggttactgaataccgatactgtttatgttgtataagatgatgtgtactatgttgtctgccagt

SEQ ID NO: 1683 - DNA, 529 bp, Sorghum bicolor
  Clone ID: SORBI-28MAY03-CLUS28329_1
gcaagctgcgcagtcgcaaggcaaacaggcaatcaacaatgatcggaatcccaacgtgcggcataccatgaaccttgcacaagacatggctgctggaaaagcgcagctgacaacatctgtggctcttcctagttcccagtggaaaaattatagcgattcaagatctaaaggacaatttgatgccgttcaccacaatcagggtactgtaaacataactagctcatctaacatgcttcctacattccagcacaatgccccagcaaagtgacagatcatatctggtggagcaaagaggaaatgctttgagagttagaggaggcccctgttcctttgagttggttcagagtcaagccttgcacagtctgtagccttgatgtctcatgtatgttagtgaggtggctcctgaagcactgatgcatttgatgatgttagctgctaatatggaagctttgcttgctgttgtgatgactgatgaatgcttgggcagttcgttggactgctgcttaaacacttctttgttgtagttctg

SEQ ID NO: 1684 - DNA, 771 bp, Sorghum bicolor
  Clone ID: SORBI-28MAY03-CLUS28333_1
tgaccacaccaccggcaccacgcacgcacgcatagctcacacgagcctgctgctgcacgaacaggacagagagacacattgccggcttgccgccctctgcctctgtgcgtgccatacactggtacacacacacgagctccagctgctgtgcgagcgtggcaatgcaactgcaagcaagcaggagcaggatggcgggctctttgcatcactcgcagtcgccggagagctacgtgaggctgcagcagggccgccggtggcgacggggcgcggcgagggggttccggctgtgcccgaggaaccggttctccgtgcggcggctgcgcgccgagctgctcacgttcctgggcctcgtcggccgctacgtgcgcctgctcgtgcggaagctgtcgaccacgagaggcggcggcggcggcggcggcaacggcggctgcgcacggagcggcagcaggagggttctcgtcgtgaccgggggggccgggagagacaaggcgccggtggcggcggccagcagcagaaagccggcgccgttcatcgcgcggtccaactcgttctactcgcaggcgatcgccgattgcctcgagttcatcaagcgcaactccgtgcccgtcgaggactacggcagcgtcagcgccaggagggagcacgggcacggacacaagatcgaagaagaaatgctttgctacccgaatggcgtggcatgtttgggtgttcccaatggagcctaaagatgtaattctgatacgtacacgtaccacacacggatgtataggg

SEQ ID NO: 1685 - DNA, 705 bp, Sorghum bicolor
  Clone ID: SORBI-28MAY03-CLUS28337_1
ggaagtggaggagagtccatatggggtaaaccgttcaaggatgagccaaactcaaagctgctacattctggaagaggtgtagttagcatggcaaattcaggccctcataccaacggatcccaattttttatcctgtacaagtctgcaccgcacttaaatttcaagcacacagtatttggcatggtggtgggtggtttgaccacactttcagctatggaaaaggttcctgtcgatgatgacgaccggccattggaggaaataaagatcctaaaagtcagcatattcgtgaatccttacacagagccagatgaggaagaagaaaaggcaaaggaggaggaggagaagaaaaaggatgaggattatgataaggtgggatcatggtatagcaacccaggaacgggtgttgctggttcaacgagtactggtggtggggttggcaagtatttaaaagctcggactgctggctctgttgatgtgactggaagtgctggtgcagctgatgattcaagcaagaagagaaaagctactgcatccagtgtagagttcaaagatttttctggatggtagatgctatgtacttatgtgtatgtatgtcgatttccttgctcctcagagaaaatggtggtcgcacacttttgttgtaccttgatatgttcattcatgtggtgtggtctgttaactgccacaaaacttcacgtatgtcat

SEQ ID NO: 1686 - DNA, 669 bp, Sorghum bicolor
  Clone ID: SORBI-28MAY03-CLUS28338_1
tccgaaccttctcccagccatcccgccccggcagctcaccgatccccggagccgctactactataaatacaaagcttccccggcggtggtctagccggccatggcggcagtcggagcgcgcccagtgctgtaccaccacccggcgccggcgggcgacgccgcctccatgtcctcctacttctcccagggaggcagctccaccacctccagctccgcgtccgccagcttctccgccgcgctcgcgccgacgacgaccacgctcgccgagcagttcgacatctccgagttcctcttcgacgacgcgggagtcgccggcgcgccaggcgtgttcgccgatggctcggcccccgtcgtcgtgtcggatgccgccgccgctgctggtggtggcgcaatcagcgcagccgctgggagcgcggctgcggcggcggaggccgtgccggagcggccgcggacggagcggatcgcgttccggacgaggtcggagatcgagatcctggacgacggctacaagtggaggaagtacggcgagaagtccgtcaagaacagtcccaacccaaggaactactaccggtgctcgacggaagggtgcaacgtgaagaagcgggtggagcgggacagggacgaccccagctacgtggtgacgacatacgaggggacgcacaaccacgt

SEQ ID NO: 1687 - DNA, 726 bp, Sorghum bicolor
  Clone ID: SORBI-28MAY03-CLUS28360_1
ccccgacgggtctggtgcaggtggtgcgccaccagggtttgccgtcctccccgacggacctggtgcaggtggtggtggcggcggcggtggtgggtcactcctcaccgtggcgttccagatcctggtggactcagtgcccaccgccaagctgtcattgggctccgtcgccactgtcaacagcctcattgcctgcaccgtcgagcgcatcaaggctgctgtcgcagccgacaacatcggcggcgggggtgccgtcccccagtgaccatcgccagtggagactgaatctgaggagggatgaagagcaggtcgcatcaaatcaaattgaaatttgggaggatttggcaatgcggggatcgagtcaagaacgcaccgcgtactctccttgcaaagtgttgccctctgatcgattcacaagtagtagcgaggagagcaacaccttgcaaggggatttggttcgggcattgactctcttcctccgtcctcccgtcgacctgccactctcctcttcagtccaagggttgcattgtagtagaagctagctcatccatcagctagaagctagaccatgcatatatatgcatatatagcttgtaattggattttcttccattgtaatgtgtctgtatctggttgtcttctctccctgctgtatggagggatgttgttctatggagactgcaagagtctaaaaccggtctatggaattttttcccatcaaatatccat

SEQ ID NO: 1688 - DNA, 747 bp, Sorghum bicolor
  Clone ID: SORBI-28MAY03-CLUS28365_1
gcacgaggattccgttccgcgcgcctccgttcccttgcccagcaggcaggccgcagcccgcaggagggccccgccccagcgtgcgcgagcgctgccctgggttgttacctgcggaattcgcgactagtaggagccagggtgggacgcgaccggctggggtgtggtgggtatactgatgcgattgcggcggcggtgactcgtgatttgtgcctggttctggttttggggtctctagagctaattgctgttcgttgggaggctcggactgcagttcttcattgccggggtctgtgggtctgtggggggcatggggtgggctgcacaaaatcgcctcttgagtcttgactcgaccaagagctccatttgtcaagcgggtctgattggtgaaattctgccaggagtagagagtgggacatttgaggtcaatagagaagagcatttctggggcaattatctgttggaatgttatgcctgttaggttttgtttgcgcacctcttcgcgagcagcatagcactgtaaatcattttagtgtttcctatgatagagtgagccattgagcttgggtagatcggtagatgttttgatgctttcataccaaattcacattggtttttagtcttcctgaggtttgctggtcaccattgtggagaacgtgtagatatggcattctgcttgaccctatgtgcctgtgtttctatggcctgcaattgtagttgggtacaaacaaatctctttgtgcacaattt

SEQ ID NO: 1689 - DNA, 624 bp, Sorghum bicolor
  Clone ID: SORBI-28MAY03-CLUS28368_1
tggaaaacaaccctagcccaacagcggcccgaatcgagcgccgccgccttgctctcggctccaccactgccccgtctctgtccccgcctcgccgccggagacgcgcaagcttagggctagcagccgtttgcgctgacaagtacccggaggcccggcatgggaaagaagattcgcagcgccaatggcacctcgacgccggtcaggtccatgaaccaggccgtgtcgctccgtgaggagacctccgggaggacgcacgtagacgatgtctccctgctgagggtcaagcacctgcagaggctagcggcgtgggcgggcgcagaggccggggtgggcccgatcggcgcgctgctggggcgccgcctcgccgcgagcgccgaggccgccggagtacccctcgactgccgccactttcctttgccagaggtgtgagacaatcttaaagccaggcttcaactgcactgtccgcataaggaacaagagaaataaagcaaaacgtcgtaagaaatcaaactgttgtcagaacagtgtttcctatgcatgccatttttgtggagatcagaacctagtattaggtagtgggaaagggtgttgttaagagcctgttaccattaagagaccatagta

SEQ ID NO: 1690 - DNA, 653 bp, Sorghum bicolor
  Clone ID: SORBI-28MAY03-CLUS28023_1
cgggcggcaatgaggagcctaggcggggcccgcaccgcctttggcactgctgtgcttctgctctcggggcgccgcgcgcctcttgctgttgcgcacatttcggccctgtcttgcccgggccgctgggatcttgcggtccagcggtgcaccggggtctcagactccctcgggcaggttgccttaacgggtgggtgtggcgcggagctctctcgttctctgcttgccggccccgcgtgttccgggcaccgccaaccggccaccctcctgggctttgccctggcccgctcccccttgggatcagtggcggttgtccgcctggtttcctgctcgggtgagagcggtctgtcgctcgcgcggaaactacttgcctgctccatgtaaataggtcactagcaagcaaccaaccaccttgtgaatacgctgtacatgtccctgtagttatgattgtcgattgtcagccttgtatgtagctgagatgagaacgttctttcagctgataggaacagtatgctagtgaacttagtaagcatccggtttgttggctcatgccatcaccaaactttggctgcgaaggccaaaagggttcagcagcagcaaaaagctctgttgatgttgtaacttgcaaatgttatactacgatttagagctgaacg

SEQ ID NO: 1691 - DNA, 686 bp, Sorghum bicolor
  Clone ID: SORBI-28MAY03-CLUS28049_1
ctttggtcattgctataaccaaagatctccctgatgttgaaggagatcgcaagtaccaaatatcaactttggcaacaaagcttggtgtcagaaatatcgcattccttggatctggtttactattagcaaactatattggtgctattgttgtagcttttaccatgcctcaggctttcaggagcactgtaatggttcctgcgcacgctgtccttgccgctggtttaattttccagacatgggttctggagcaagcgaagtacacaaaggatgctatttcacagtactaccggttcatctggaatctcttctatgctgaatatatcttcttcccgttaatatagagagatcttgtagttcagcatgggctacagtctaaaacataggagcaaatcaaaatctcggagaagtttgcaaagtgcggccttttgtgcatataaagtgtaaaaggtctgttgcgcatactttcaacagaaacaatggaagagcgatgttgctctgctagggttctgaggttgtaggagcttcgaaggttttgcgatgctgaaggcgttgttggagctgtggaagctggtttttgtatcgacacgacactcgacagtgtcccgttctgtatggtcttgattgaggtcttgcttggaaagttggaagtgctttgagcgcataggttgaagctgagatcgatcccc

SEQ ID NO: 1692 - DNA, 711 bp, Sorghum bicolor
  Clone ID: SORBI-28MAY03-CLUS28039_1
gatcacgtcttcctgccactgttagtaccctccatggccattacctttgcagttggaccaaggaaaaaaaattctatctttcgtcataagtaaggccgatttacattattttgtactggtagattcctacagtgcagtaggtgaactagatcaataccaccagaccttacgtaatcaacaaaatagctgtagacttccccggggccggtgctctcgctccgttgcgtccgtcgctgacgtgcaccttggcgttggccctccagggtttgcagggtaccaattctgctggactgttactacgtcctggcttctggcacaggtggatgatggtggacttcatgatactttgcctttgaattagcagatgctgctatctgttaagagcttctaggtgaaattacaaattgccttgagagttctttctcaatagggtgtagccatgaattgaaaaacatacctaaaattatttgttttgtcaagatgaccctgttcagtagcggtgggtttgtgtctcgcatgctgcccgggtcttgtgtccctggtgctcggctcctagtgctttcttcgttcttggcgcgcattgctgcctcaattatttcagattttcagattcagatgcagttttgacatatgctttttttttgcgaaaatgttttgatatatgcttgaatgaatgaaatctggcaaaaggcatacacttttcttggtttg

SEQ ID NO: 1693 - DNA, 985 bp, Sorghum bicolor
  Clone ID: SORBI-28MAY03-CLUS28507_1
tgcccgatatgttattgctgatgttgtcaaatcttgtctcgagatggaggaggaacttatgtccgagtggaagactcatgtgaaacattggccggacaagctcttaccagtcaacaatttcattcaaagtagcattatcaaggactgtgcactctcactctgcagtacaggggacaaattttctgttccttccatcattgcttttgtgtgtatcacaaaggaggctgacctgatgcgtgagctgctgaagcgtggcgctaagcctactgatgacatgatccagcagagcagtgtgattcgtatgtgcgccttaggccttgtgaacctcaaaactgcttctgctgctgcaatgctgggtattgcaaaggaggccaaaatgatgtgtgattggatgaagagagagaacaggcttgttgcgttcagcatgtctgctcctagtgaccttgaggtccgcttgatccggatcaggactttggattttatgatcagcatattgcaagattcttcatttccttcctccaagatgctttgatgatgcaatggcacatgtctagaagaaaggaaatgaggactgggatccctggatttgaagcttcctttacctttaatacactagcctaactatatgtcgtgcatagtacacaagcttttcttagccttttagagagactgccgctaagaggcttagcacgctatttaaaacactgatctggagagaccgagggagagagaggacgagcctttttttggcgacaagaagagaccgatgggagagacggagagagagagagggacggaagaatctggaaggagaagctagagttgtattatatatttattgagttttgttgtggtacactcaaataactgtgtgccgttcatttgattagatcggagggctagaattatctattacttctgcgttgtactgtgtaatctcaaaaaaaaaagatgaaataagtaaagttttagatatagagatctt

SEQ ID NO: 1694 - DNA, 798 bp, Sorghum bicolor
  Clone ID: SORBI-28MAY03-CLUS28525_1
gcacgaggccgacatcctcgccggtggcggcgccgcgtccgaccccgggtcccggccgccgcagctcgcgtcgtaccaggtccgcaaggtgcaccgctgcgagccgcgcggcgtgctcaacgtgtcctaccgcctcggccccatcgtcgccccgcaggccagagccgtcgacgaggccgccggcggcgccggtgccttcgtcgggtatccggtgccgcggcagttctacgcgccgtcgtatgcctatctgccctcgccgctgtccctggcgccgccgccgcctccggcgcaagctgccggtcgcgacgcccagctgcacccacctccgcagtacagcttgcctgctgctacttattcgcaggcttatccacagcagccggctgctaattatccacagcagccggctgccgggcgcgctgctctgccggcgccggcgagcggggagagcaacggcaagctggacttcggggtgggcctcggcgcggggctggtcagcggcgcgatcggcgggatgctggtcgccggcgacgtgatgatgtctgacgcggcggcctacaattccgggtaccgcgctggactggccgacggcggcgcggcggcggtgtacaagaattcttatcgcgttcacgacaaagtcgaagcaaaacgggcggcggtgtgactcacttgaatcgatgcatactgtgtgattgtcattagtctcgtcttgttaacaacccataatagtacttgccgtgtgtatatggaatatataattacgtatatatcataattaataatataagataagagaaattt

SEQ ID NO: 1695 - DNA, 735 bp, Sorghum bicolor
  Clone ID: SORBI-28MAY03-CLUS28593_1
ggcgacgcgggcaagacgaggacgatgaagaagacggtgtgcgtgacgggcgccggcggcttcgtcgcctcgtggctcgtgcagcgcctcctctccagaggcgactacctcgtgcgtggcactgttcgcgatccgagtgatcccaagaacgcgcacctgatggcgctggacggcgccggggagcgcctgcggctgttcaaggctgacttgttggaccgtgccagcgtcgccgccgccgttgctggctgcgacggcgtcttccacgtcgccagccccggcccggccgtcgagcccaccaaccccgatgtggagatcatggctccggcggtgaccggcacgcagaacatgctggaggctagccacgcggccaacgtccgccgcgtcgtggtggtgtcgtcggtcgccgcggtgatcgcgaaccccaccagcatccccgatgacgccgtcgccgacgaagactgctggtcggacgaggactactgcagagccactaagaactggtactgcctttccaagacggtggccgaacgcgaggcactggcatacggcgagaggactgggatggacgtggtcaccgtctgtccgccgtgggttctgggtccgctgctgcagccgacggtgaacgccaccagcatgggtttcgtgaaatacctgaaaggagaaaacaccgatgagaagaggaggaacatggtggacgtgcgcgacgtcgcagacgctctggtcctgacgtacgag

SEQ ID NO: 1696 - DNA, 523 bp, Sorghum bicolor
  Clone ID: SORBI-28MAY03-CLUS28549_1
gctccagggccatcagagacagtggagggttgagcagctccggtcgtccagctactctagctcgctctcgccatggcgtcaggggaagcagagccgctgcagtacacgaccacggcgttgcgagtgtccatccactgcgagggctgcaagaagaaggtcaagaaggtgctccacagcatcgaaggggtgtacaaggtgacggtggacgcagcgcagcacaaggtgacggtcaccggcaacgtggaagccgacgcgctcctccggcggcttcacaaggccggcaagcaggccgcgctctggccttcgccgccggcgccggcggcacccgtcgctgaggctaagaagcccgaggatgctgcgactgctgcgctgccagccgcagccggggacagcggcgccaaggacgcccaggacgcgaagcctaaggaggcggaggccaaggagaagccgcctgagaacagcgagggcaaggagaagaagccagctaaggacaagaaggctgagaaaggcgaggctgcggcga

SEQ ID NO: 1697 - DNA, 698 bp, Sorghum bicolor
  Clone ID: SORBI-28MAY03-CLUS28603_1
gcacgagggggacatcaccacggccacgggcggcagccacgccgctggcgggcagggcaagatgcgcgtgctccacgccgcgctgtgcgagaccatgcggctgtacccgcccgtggcgtgggactcgaagcacgcggcggccggggacgtcctccccgtacggcacccgcgtggagcgcggtgaccgcgtcacctacttccagtacgggatggggcggatggagtccatctggggcgccgacgccgccgagttcagcctgcagcgctggctgtccctgcccgaggacaacgtgacgcctccccccgccgcggttgccgccggcgtatcgccgttcaagtacccggtgttccaggcggggccacggacgtgcctgggcaaggagatggcgttcgtgcagatgaagttcggggccagcaccgtgctccgccggttcgagctcgtccccgtcgacgagggccgcgtgccggtgttcgtgcccctgatgacggcgcacatggcgggcgggctcaacgtgacggtgaggagcagacgggaaccacccattgccgccgctgcagctgcgtcgtctgggaattcgaattgaatactcgtcccatcccatccccggccagtaaaatacttaacactcctcatgtaagtacgacaaattgaaatcaggattgtttagttcctactatactccattagtgttgttatg

SEQ ID NO: 1698 - DNA, 506 bp, Sorghum bicolor
  Clone ID: SORBI-28MAY03-CLUS2863_1
ttcctggtcgacccacgccgtccgcccacgcgtccgggagattctacgtaaaggtgggaggccattggtctttgctacataaatttgcacaggcatcggaaaaaggagtggggtattagaatacagcgatttaagggccatgtgtggatacaagctatacatatggaacctcagaggctaatagtctatgctttattgccttgtaaggacatgatgcaggttggttgatggggtggattggtcgggctcaaccaaacaattgagtggatgctggaaacatttatcctgtcgtaatccctactcataacatatagaattaaattgcttgatggcttcccctacttaagtgtccatgtccgtagcagttcagtacctcaactaattaagagcttccaccaagtgattagctaggttatttagctttatgcttgcccacgtttgctagaatgacttcaatacttgtgcggaacatgtggttctagatacaacattatcatttcgtaaga

SEQ ID NO: 1699 - DNA, 779 bp, Sorghum bicolor
  Clone ID: SORBI-28MAY03-CLUS28653_1
gcacgagggtccttggatatttactgttggagcttctgcccatgacagggtatacagcaactatgttgtacttggcaacaatttgaccattcaaggagttggtcttgcccctggaacggatggtgattgcatgtatactttagttgctgcaccgcatgcactgaagaacaatacagtcagtcctactgaaatgtcccttggggagtgccaagattcaagtcgcctagatgcagatttgataagaggaaagatactagtgtgcagctattctataagatttgtgcttggtctttcttctgtgaaacaagctctagatacagctaataatgtcagcgccgcaggagttatattctatttagacccatttgttcttgggttccagctgaacccaactccaatgcacatgcctggacttataataccatcatctgatgactctaaggtgctcctcgcttactacaatgactccctagtgagagatgagacatcaggccaagttgttagctttggcggagttgctaaaatattagggggtctaaatccaaattatggaaattctgcaccaaaagtaatgttctattctgctaggggtcctgaccctgaggacaattcactgtcaaatgctgatatcttgaaaccaaatctggtagcacccggaagttccatttggggtgcttggagttcacttggattggattctgctgaatttgctggtgaaagtttcgcaatgctctctggcacaagtatggctgcaccccatgttgctggcctcgctgctc

SEQ ID NO: 1700 - DNA, 387 bp, Sorghum bicolor
  Clone ID: SORBI-28MAY03-CLUS28690_1
tactggaccgcctcctccaccaggcaccagcagcagcaccggatagggacacggcagcactagctcgcagagagagagagagagagagagatgggggcggatcggttcctgagcgtgacggagggcggcctgggaggcgaggcgctctactgcgcggtcatcctgtggctgtccgtcatgtcgtggatcatcttcacctgggtcggcggcgacggcggggaagcaggcgggaggaggggaacgaagcgccgcggcggcagccgcgggagcccggtgttcgtcggcgcgtcggggatctgcgacggcaccgggccaggttgcagcggcggctacggcatctgcggcacctgcctcgactagccgccggcccgccgccccccgttccgt

SEQ ID NO: 1701 - DNA, 1033 bp, Sorghum bicolor
  Clone ID: SORBI-28MAY03-CLUS28284_1
gcacgaggggcgagagcttgcaaccgcgcgctgagactgctgccgaattccatcgccacgcagctagcaagcagcagaagcggcgccagattcagaagcctcgccgttcacgcgcagctttccactgaagacgatgcttactcgaccgagccactgaagaaagtgcaagtcacacagagcctccggaggacccgccggaggggaaccggcggcgcgcggcagagcctggtctccgtcggaacgtcgtgcggcggaggcgatcagtggagcagcgacatcgaactgacgttgcggcagctgcatctagacgacctgatcgaggacggacagagggacgcagatgtgctcgtgcaccttctggtccagcagcacactcagtttgggatgtccataaaagggcgagtcctcacatccttcagaaaaatatgtgattcctgctccttgccgtactgcacaaatatcgatgaacgcttcaatctcacggttctgtcttcaaccaggagagatcagagtgggctgcctgatctcggtgacactgatccatcggtcatctatgtgagaccaggagacgaagtcgatcttgactctgtaatccaagagaccgtacgattaactgcatccgctaagagttcatgttcggagacctgcgaaaagtctacagttgtatggcaatatggtggtagccagaagaagaagatttccagccaaaggtggtcaaaacttcttgatctgaagaaaaccctggataaagcgcctaagtgaattacttactacatgcatcagtcaactgccaatgctgtatcatgatgctggaatggaagtggcgacaactagttcaaccaagatgaaaggttggtggtttacaactcattggctctctttttctttttgaagagaagaagaagagagaggggctatcttatagaatggtactccatatgtgactgcatgcccatggactggtcatgttgagaactcagatacagggtgaccccatatcagcatatcatcaaagaataaatgtggtgaagat

SEQ ID NO: 1702 - DNA, 484 bp, Sorghum bicolor
  Clone ID: SORBI-28MAY03-CLUS28285_1
gcacgaggtggacgtcaagggccaggacatggagctgctgccgttcggcgccggccgccggatgtgccccgccaacggccttgggctcaggatggttcagctcgtgctggcgaacatggtgcacggctacgcgtggcggctccccggcggcatggcgccggaggagctgggcatggaggagaagtttgggatctccgtgtctcgcatgcaccagctcaaggctatccctgagcccaggcttccggatcacgtctacttcgggccgtgatgaacatgaaccgcgtgattcgatcagtctcaacgtacgtacacgtacttgatgaatgatgatgtatagaaattcacaataatatccatgtatgtggtggtggtggtgggtggtggtggtgatgatgatgtaatacggactctgcacgtatgcacgtaatggtttttattttattctgtgtgtacaatacacgtcacatggggtttttctaagtag

SEQ ID NO: 1703 - DNA, 823 bp, Sorghum bicolor
  Clone ID: SORBI-28MAY03-CLUS28305_1
gcacgaggcctggcctgtcctctgggtcatcaagggcgcggacacgttgcccgacgacgtcgacgagtggctacagcacaacaccggcggcgacgacggccagtgtctcgcggtccgcgggtgggcgccgcaggtggccattctggagcacccggccgtcggcgggtttctgacgcactgcgggtggggctcgacgctggagagcgtcacggcgggcgtgcccatggccacctggccgttctccgccgagcagttcctgaacgagaaggtgatcgttggcgtgctcggcatcggagtgtctgtcggcgtgacgaagcccacggagggcgtgctgaccggcgccaaagacggcggcggcggcggcgctagggcgaaggcggatgtgggaatggagcaggtgaagcgagcgttggatatgctgatggatggaggagtggatggggaggcaaggaggacgaaagctagggagctcaaggccaaagcgaagtcggctttggagcatggaggatcgtcgtatatgaatctggagaagatgatacaatttgcagcttaattagcttgaaaatggattggtctagcttggtcagtttcagcaagcaactcagtttatttctgcgtaataaaggttaagaaactactaggactgcaagcagctggggtatattacatgtagggttcaggaacgctgtcgctgcaggctgggcaatctctgtccaggattgcaactaggcaggagtagacgaaaaatggcaacatcgatcagagatactttggattgaagatcagtgactcatgtgcgttgtctaagatttactccctagct

SEQ ID NO: 1704 - DNA, 485 bp, Sorghum bicolor
  Clone ID: SORBI-28MAY03-CLUS28813_1
gcacgaggcacagaagctccaccagatatacaccgtgattgctgtgacgatggagggaagaatggctactgtagttgtggtgcttatcctgggatgtttcgtggttctctcacaatctcaactcacaaatcaagacgaatctccgtgctattgcatgcgctacgcccgctattttaccaataagtacttctgctgtgtaggccttaaagccccgaccccaagccaatgctatagctcagactatcaatgtaacagaaattgctgcacggcaacagcaccggcaccggcaaccggcaccaataccggcaccaacaccagcaataactcataagtccttttagctaatggaaagtatgatcgactgcatcctccaaaaaaacaaaaaaaggaggaagcagacgaaaagttgttacatttcaacatcggagagggcaatcaataattaattagcattatggatgaatgtaaccagtaaatgtccattt

SEQ ID NO: 1705 - DNA, 730 bp, Sorghum bicolor
  Clone ID: SORBI-28MAY03-CLUS28828_1
gcacgaggctcagctgatatgctacaagacactatgggcaaaaagaagctctaccttgtcgaatcttgtggtgcattgctgatggtacgcaggatggtttgctgtagcgtggcaggtgaggcagctgtgtctggacagtgtgagtttgaggttttcaaggctgacttagagcgctcacggtgggtgaatgtgacatcgctgggggatgaccagatgattttccttggacgttcatgctctaggcccgtgactgcatctcagtatggtatgccaggtgaccaaatcttcttcttggatgatgttatggagaactgcaagtactcctttcatgaggagaccacttctgtcagtgtctatgacatgagaaccggcgaggtctcctcccctctgccgatgatctggaagcatgagatgattcttgccacatggctgttcccttaagactgaagtgaagaggttttctttgaccattgtatggcgattaagtactcctaagctatgttaacttcaccagtatttgtctggccttgatgtgctgcctacttctttttgggggaaatatgttggttactagtcctgtgctgatgcatcctgtgaaatacatttgacacttaattatctggccatggtttgatccatgagtggtacctgtaagaacatcggagttgcctatggaagtgcaatgctcatgtagtgaacttatcgtgatgaatttgtgctaatcgttgac

SEQ ID NO: 1706 - DNA, 689 bp, Sorghum bicolor
  Clone ID: SORBI-28MAY03-CLUS2890_1
tccgtccggattcccggtcgaccccctgttccatttacggctgttaaaaccaacaccacgaactgaaccaaaaaaaaaatctgccacgagttccttttgctgatccacgtcagatgcgagtctgattggtgattggaaaaaaggacaccgctgcctgcctcacatgtcgaatagcagctggaaaacgatgggcacgtgcttgaggaaccgcatctctgcaagtctccatcatccatgcatgaattagtaaaataaattataataacacgcaacaaattgtttcccacatgtggcgactgatgattcttggccaatgccaagcacaacctgcacgtgctcgaattctcgcatagggttagcgtgtggttagctgagattcttttcatgaatgaatgaataatataattttgctatttgggtaaaaaagacttatagtccaacaatcgggtgattttaactgtttttcaggtggatttggatgaagcgaatcgtattcaaatgaagcacatgattgaggcggctctgagtcagctagatgccgccgggagtccgccaagtgcgatgagctattagaaagggataatcacgatgctgacgtcagcccgcctagctagctagctagctattgtggtcgaccatgcatgcaggagtcaacaaatgcgaagccaatggtgtttcctgtgctgctc

SEQ ID NO: 1707 - DNA, 437 bp, Sorghum bicolor
  Clone ID: SORBI-28MAY03-CLUS28869_1
gtgaaaacgactagcatacagtgtcggcgtatctattcctcgatcggacgaagcaatagttcattacatctgcgctctgcaactgcaagccgcgtgctcggtgatctccgtccgcagcacggcaatggccgcctcggaggccaataataagcagcagccgcgacgccaccacttcatgctggtgcacgggatatgccacggcgcgtggtgctggtacaaggtggccacagcgctgcggcgtgccggccaccgcgccacggcgctcgacatggccggctgcggcgcgcacacggcgcgtctcgccgacgtgcacacgttcgaggagtactcacgcccgctgctcgacgcgatggccgcgttgcccgccggggagcaggtcgtgctcgtcgcgcacagccacggtgggtccagcgtcgcgctcgccgtcgagaggttcc

SEQ ID NO: 1708 - DNA, 670 bp, Sorghum bicolor
  Clone ID: SORBI-28MAY03-CLUS28902_1
acctgggcggcgaggagcggacggacgcggaggtcatgctggacgggaaggtgccggtggtcaccgtgcggggctcggactggatgtggcgggcgttcctgccggagggcgccgacaggaaccaccccgccgcgcacgtgaccgacgagaacgccgacctggcggacggctttccgccggcgatggtggtgatcggcggcctcgacccgctgcaggattggcagaggcggtacgccgacgtgctgcggcggaaggggaagccggtgcgggtggtggagttcccggaggccattcacacgttcttcttcttccccgagctccccgactgcgccaggctcgcggaggcgatgaaggccttcatagatgacagcaacgcatcctccgtctcggctgcttgactgatcatcaaccgtaaggggtcccgaaggaagcaacgtggacctacgtggcccgtgcaaatactttttttttccccacgcatttgcatggtcctctctccgtgtactttatccatgtgcaggaaactgtgtagtttatattgatgtcaaattaaggccttgtttagatctaaattttttttggattttgacactatattatttttttttatttgataaatattgtctaatcatggagtaactaggcttaaaagattcgtatcgtgatttac

SEQ ID NO: 1709 - DNA, 663 bp, Sorghum bicolor
  Clone ID: SORBI-28MAY03-CLUS28985_1
agattttgaacattctggggttttttagtgaaccacagcagacaccaatgacgtttgtgcctgctacattacaaacagcggatgcaacctcctctcttcctggtgcaaccctgatgtgaatataatgttgtggaagccatcagatgcaagaaaggtcgatgcacatacagatcttcatagacaatagtgcgcagaatggacggatcatcaatgaagattgctgcccctctgatgtgtactattttgcaatggctggttataatcaactccgcatggagaatgggagatgctgacaggagccaaccgaggtgattgtgtcctggagatcagagttttttctcctgtggaacggaagtcatccaacttgtatagtagctttactattgtggctaaatgtagtcccgttgtcgtggttctgggagtctggcccttgcaggcagaggcaaaggaaaaaggacggagaaggctgtttaaagcaagtcagattacagctgctgcattcatttcattgggagcaggatttgactaatttactctaaccattgttgtaacaatttgtctgtatacattagttaataattgagtttttgctgctagtgttagggcattcccaatgggtagtttttagaggtagtttccaagagcaattaatgtagtaaatac

SEQ ID NO: 1710 - DNA, 792 bp, Sorghum bicolor
  Clone ID: SORBI-28MAY03-CLUS29312_1
caacgccggttggctagcagaggtagcagatcgacgatgaggccttcgacggctcgggctctggccaccgcggccatcgtcgcggcgctcgcgctgagcgccgacgtcgtcggcggcaccccggagacgacgtgcgcggcggcggcggcccacgaccggcgcgtggactacggcttctgcgtgtcgaggctgagccaccaccacgacagccccgacgcggacacctggggcctggccaaggtggccgccgacgtgggcgtggccatcgccggggacgccgtctacgacatcaaggcgctgctggctaccagcagcaagccgccgggcgagggcgagggcgacgcccaggagcgggcggtcctggagcagtgccagaggctgtacgacgcggcggagtcggcgttcgcggaggcgtacgacgcgatcaaccggcgcgactacgcggcgggcaagggcaaggccgccgaggcggcgtccctggcgcgccggtgcgacgacgccttcgcgcgcgccgcactgcgcccgccgccgcaggtcgcgcgctggggcgaggagtccgccaagatcgctgtcgtctgcacggccatcaccgacctcatcgactgagccgagccgagcgcgcgatgggtaccgtaccgtgtaccaggtgatgcgctggctgctccgtcgtccgtcgcgatccggcgccggcgtgttgtgtgaacttgtgatccgttggttacacgccagacaaaacgcggacgtgatgatggcagttacccgaacttgtgttgccgttaaaaaatgtaatgt

SEQ ID NO: 1711 - DNA, 1165 bp, Sorghum bicolor
  Clone ID: SORBI-28MAY03-CLUS28386_1
gcacgaggggatatgggttttgaacctgaagtcagggcaattttgagccaaacatcatctgtacgtcagatggttatgttcagtgcaacttggcctcttgctgtccacaaattagcccaggagtttatggatccaaatccaataaaggttgttattggatcagaagatcttgctgctaaccatgacgtgatgcaaattgttgaagtattggatgatagaacacgagattcaagattacttgccttgcttgacaaatatcatcaagcacaaagcaacagggttttggtttttgtgctgtacaagaaagaagctgcacgagtggaaacaatgcttcagagaaggggatggaaggctgtttcagtccatggagacaaagctcagcatgacagaacaaaagctttatctttatttaaagaagggaaatgccctttaatgattgctacagatgtcgcttcacgtggacttgatattcctgatgttgaagttgtcattaactatagttatcctttgaccactgaggattacgtccacaggataggaaggactggtcgtgctggcaagaaaggtgttgcacatacctttttcactcaagcgaacaaggcacttgctggtgaacttgtgaatgttttgcgggaggctgatcaggttgttcctccagcccttatgaaatttggcacacatgtcaagaaaaaggaatctaagttatatggatctcatttcaaggaaatcacagcagatgctcctaaatccacgaagatcacatttggtgattctgatgaggactgatctaatggcagcagcttactgatctttcacccctgcttatggaagcttgattttgcggttaaagatgctatggctataatcagatcaggcatttggaagccagtttctgccatggacaaccaatgtggcagcgggcaatcccaaaatatagctctattgttttaggttagtttattatttgcagcattcagcttatgttttctggaccatccacattagcttggctgtatgtagcataataagcagcattctgcttattatgagccgcattcatcatgtggagagtagttaaattcaatgtgtccttagtacaagcagcttggttatggtaatgatgggctggttataggaaaaacaatatgttttccttgtatagtta

SEQ ID NO: 1712 - DNA, 637 bp, Sorghum bicolor
  Clone ID: SORBI-28MAY03-CLUS28418_1
ccgtcgacagtcagatgaacgcggcggactcgggggacatggacatggcggcgacactggcggacatgttcgatacgggcgccggcgccggcgccggcgctcctcccaagggcatgccggccgccgccatcgcggcgctccccgtcacggccttcaccgaggacaccgtcaccgacgcctccggggagcccatcggctgctccgtctgccttcaggacttcgaggccggcgagacggcgcggagcctgccggagtgcgggcacacgttccacccgccgtgcatcgacgtctggctgctccggcacgcgtcgtgcccgctgtgtcgccgcgcggtctagtctaggccgctagctgcgcgcgtttctcgacgaccatatgcgcgtgcacatcatcacacgtgtcacggaccaggagcagagtatagtaggctagtaggtagtagcagcctagcaggacaaattggttgttctctcttgcataccttgatttttctgtttgttttttgttcgtgttgggcacgcatgtacagatacagtacgtggctcacactgtcacacacacacgatgtgtaaatatgtatagaggtgaatgctgtaaataatgtaatagactaatagttgtagaattgagatttttt

SEQ ID NO: 1713 - DNA, 586 bp, Sorghum bicolor
  unsure (1)..(586): unsure at all n locations
  Clone ID: SORBI-28MAY03-CLUS28460_1
gaccccgacatcgcgttccagctcttcgacgacgacatggtcgccgacaacnccgtgcgctccacggccgcagtcgccgcgcgcgacggcatcgcccacaacctcctccaccgcaacagcagcgccgccgccggccctggattcgtcttcaaatgaactctgaaggcagggatgtgaggaaaaacagctcattttttcggcgggatcgtcagagaagaaagacgccacaaggctcaggaatcaaatcgctttttttcttttgccgtctttcagtaagtaattaggagttcttttagtcatggtaaatttgtcggacggagaacagagggcgattctttctcttttttcgcttgtaataagttgggaacagagcaaggggaggtgatagtgatacatacatagggttcaaagatacagtaggtgattggttgataggatttgagattgttctgcaattttttctagaatcaaacaaagattcaatcatttttcagatttggtgagactagagcctgtatagtcaatactgttgtgcagtctattttgccaccagactttgtaatcaatcaaaacagaagttgatttc

SEQ ID NO: 1714 - DNA, 335 bp, Sorghum bicolor
  Clone ID: SORBI-28MAY03-CLUS29245_1
ctttcgacaaaaacagaggagttgtgccaaatttaagaggaagagtcctgagcagcgaatcagagattgccacagtagaaagaggcttgtacgtggtaggatggttaaagagaggaccagctgggattgttgcaacaaatcttcactgtgctgaagaaacagtggctagcattcttgaagatgataagaagggtgtattaaggcccccatctggttcgaagaagcatggaaggacagggcttcttgagatcctagaacaaaagaatgtccgttttgtgccattcagtggatgggagaagattgattccatggaaaagatgcaggggagagtgaga

SEQ ID NO: 1715 - DNA, 666 bp, Sorghum bicolor
  Clone ID: SORBI-28MAY03-CLUS29249_1
ctccagctctcctcctccgcctgcgccgccgcggaccaccccgtcgacgacgacgcggcgctctgctactactactaggcttcggattcggattcggcccggcatccccccgacacacctccggcgcccaccaccaccgctctcctccccgtcgccgcatcgcatttgccgcggagggcgtaattgagatttgcccttgcccccctcggtgaacccaaactgaaacggcagcgccaagtgctgctcgttttcttcttaccgaattacccctgcgtggggcgcctgtgcttgtacatacgggagggttaagttaactgtggtggatccgtggatgtggggtacaacggggattttctcctgcagctcaacagttttagtgcctgctgtctggtagtaggatttttctttcttttttcttttgtctgctcctcccgtgtttttgggtcttcttcgtctagatctagctcaggcaggcagtcttgctgtagctctagcggtggttgtaatggagtagtagtgactgggcactacctgcctgttgttatgttttttttttttttcctactatgggttttgagatcttaacaatactccaatgtactgaactcaagccgcaaggctggtgaatggtgatctcgtactgagaccgaggaaatccagtgcaca

SEQ ID NO: 1716 - DNA, 871 bp, Sorghum bicolor
  Clone ID: SORBI-28MAY03-CLUS29267_1
gcacgaggctcatcacaaacaggcaaatggagcaatctcgtctcagcagctgttccgtttgtggtttattatgttgctcgtcctggcgtcctggttggcaatgccttgtattggatgcctcttggtcatggctatggcattgctgagtttgatttggacacacatactctagcgttggttgagtgttcttctggtgcaaaagatttaaagggccgttctcgaatcttgctagcacaaaatggtgtcctgtgcctagccattctgtcaggccacagcctccaaatgtgggagaggaaggtttgttctgaaggtgttgccagctgggtgctgaggaagtctgataagctgcagaagattcttgggcggagatatcatctccaaaaatcatccctatgcaagtatatatggttcaggtttgtatgctgaaatggacaaggaagagctgattgagggtgttaacaccatgctgagagtggcagaaagtctgctggtggcacgacgcgggactgaaggtggtgccaagcaactgacagatgaagaacactaggagaagaatgatatgtcggaatgaagaaacactgagagcttgacagggggggttgggtcgtatgtttgagcttgtgctgatgtttgtttgctcttgggtttagtctgtttcagatacttgtatgctgccttgtcagattggggattttttgggttgcagtctggactcttgagtcagagctgtagactgtaaccggttctggggtattttactggtagctttccttttctcccctgttacaaactcatgtatttccgtggctttcgacgatctctgtagacgttaccagttgagacttgaatagatttatgcaatatgtcaggt

SEQ ID NO: 1717 - DNA, 535 bp, Sorghum bicolor
  Clone ID: SORBI-28MAY03-CLUS29282_1
gcacgaggccgtcccctgctccccctcccgcgcagcggcaccgccaccggcaccggaggcaccgaccgcggcccccggtcccgccaacgccgcccaggcggcgccggctcaacttcggggagcggctcgggatcgccttcgccggcgtggccgtcgcaatgcaggtcgccctcggcgccttcctggcgctgcgcgcgtggcagctgcggcggctcgacacggccgaggtgtcctcctccacgcccctcacctgaccaccgacccccatccccgcccgaagcggcgccgtgagcgtcagtcgcaggtccgtggtttatttgtgatctgtgatctgatgctgctgtaacacccgaatgaatccatggtgtagtagctgctgcgtctgtccccctgttcgacgccattctttccgttctgctgtactaccgtgtacaatctgcttctgctccgtgcagagcaccactagttgagaggctatgtgatatgagagttgtgctgcagctttgattggttgttaaaaaaaaaaaaaaaaaaa

SEQ ID NO: 1718 - DNA, 605 bp, Sorghum bicolor
  Clone ID: SORBI-28MAY03-CLUS2927_1
cgtccgaatcgctcaactcatccagtgttgacttatccaattataaaaaggttgtttcaggaggtgtcgcatcaaacaagtatgttaggactcgcttgaatcaagttgctgagaataatggcctacaacttgtatctcctcctccaagcctttgtactgacaatggcgtcatgattgcttggactgggattgagcacttcgctgtggggagatttgaggatccacctgctgctaacgagcctgatgacaagcagtatgagctgcggccaagatggcctcttggtgaggaatattcagaaggaagaagtgttgcacgatcattgaagaccgctcgagtccatccatcactaacttctatgatacaaggctctcttcaaaagtagttgagttggttggcatcgattattggtctcagatgctttatgcagttgagttccctgtcgtcttctcgttttcggttcacacatcacaatctagctaaccgttatttgtattcgctgaattggagtaacaaagctgcaaaaggactgaactggttgtttaattgtacatatgaggcaatatacagatccagttcatatatatatcagaagatacttatactc

SEQ ID NO: 1719 - DNA, 932 bp, Sorghum bicolor
  Clone ID: SORBI-28MAY03-CLUS29288_1
gcacgaggctgagcttggtatttatcctgctgttgatccactggattccacatcaagaatgctttctccccacgtgctgggtgaggatcactacaacactgctcgtggtgttcagaaggttcttcagaactacaaaaatcttcaggatattattgctatcttgggtatggacgagctcagtgaagatgacaagttgacagtcgctcgtgcaagaaagattcagcgtttcctgagccagcctttccatgtcgctgaagttttcacgggtgctccagggaagtatgtggagctgaaggaaagcgttaagagtttccaggtacagtttaacccttttttttgtggctcagaaatggctgtttgaaataaagaattcctcgtctagtaatgcttagtaaaccacacctggtgcttgctgagctttgccatatttttttgaggtctcatatttagttttgtcagacaacccttagactgtgtacatgttgcaggatgatgtttctatttctccagttatttttaagtcatgcaagacttgtttacgatgtgcttttctatgaaatcttctcttgtgcagggtgttttggatgggaagtatgatgacctccccgagcagtcattctacatggttggaggcattgaggaagtcattgctaaggctgagaaaattgccaaggagtctgcttcataaggaggcttcttgcttgtcgaattcgaatcctgtacaagttccatttttggattttaagcgtttatttgtgcttttcgcagttaggcaggacgagctggagagccatctcctgctgagagatgcttgtttttctcttttttgttcctccaccttacacccaaataagcaactgcagtgacattgattttggctgcaccaaaattacatgactgaagaaacttgggccctgtgtaatgcgacccca

SEQ ID NO: 1720 - DNA, 643 bp, Sorghum bicolor
  Clone ID: SORBI-28MAY03-CLUS29290_1
tcctggaatacgcctggagactgtacaagaaaggtcggaccctggagttgcttgaccccgcggtgaagtcgtcggcggtgccggagcaggtcgagctgtgcgtgcggatcgggctgctgtgcgtgcaggccgacccgcggctgcggccggacatgaagcgcgtggtgatcatcctgtccaagaagcagagcaagctcgaggagccgacgcgtccgggggtgcccgggtcgcggtaccggcggaggccccacggcctgcgcggctcgcactactctgccgggtcatcgtccggcaccagctcgccgtctacgtccgcaacgacgtcgcacgcgtcagcgtcggcgtcggcctccaacgccatgacgacgtcgagcacgcacaccatgagaagccaaggcttgccctcgcaccgagaagacgaggagtcgtagcagtaacagggcgagccccaactgtacatttgtctattctttccctttttcttcaggttggtgttcattcaaggatgggattgcagagtataggtatagatgcgcatgattgttttgctagttcataggatctgccttttggatttcgttaggatgctgctgattaagctgttgatcggtccgtctgtggtagactgcaggcaacaactggg

SEQ ID NO: 1721 - DNA, 416 bp, Sorghum bicolor
  Clone ID: SORBI-28MAY03-CLUS2871_1
cgtccggtcttgtctctcttttgaagctttcctcccggtttccaccaacatcggagaggataaaagatatagttgctcaaaataaagggaatactgtgcttgagttgcagcaaagatctattgagttcagttccattatacaaagacatcagtctataaaatcatctttgcttgaacggatgcctgtattggatgaagctaattatttggtgaagagagctgcttctacacaggctgcagtttcatctgtaaattctgctccagcagccacttctggagggccacttaagcttccaaatggtgtagcaaaaccaccagcagctcctttagctgatttgcttgatttgagctctgatgatgctccagtgactacttcggcccctactacagcacctaatgattttctacaggatctg

SEQ ID NO: 1722 - DNA, 625 bp, Sorghum bicolor
  Clone ID: SORBI-28MAY03-CLUS28750_1
gcgatactcatcggagaggagaccgcccaacctcgccctataggtggctccgcctctgctgccaatccccgagatccacagagacgctgccgatggcgaagccgaggaaaccccgcaccttggctccagatccgtccgtcgccgccgctcggcttccgtggcacccaccggcaccgccggtccccactgccgttctgatctcgctggccgcgctcctcgtccgcgtgctggtctccgtgggcccctactccggtcagggtgcggcgcccaagttcggcgactacgaggcgcagcggcactggatggagctcaccctccacctcacgccctccgactggtaccgcaacacctccgacaatgaccttgcctactggggtctggactacccgcccctctccgcctaccagagcctcctccacggccgcatcatcaatgcctcactccccgaggccgtcgcgctccgctcctcccgtggctacgaatctatggaatcgaagttgctgatgcggtggacggtgctgtcgtcggatctgttggtgttcttccctgctgctttgtggttcgtgtgggcttacatgaaagttggaatcggtattagtggggaggagagaagggaggggtggat

SEQ ID NO: 1723 - DNA, 685 bp, Sorghum bicolor
  Clone ID: SORBI-28MAY03-CLUS28757_1
atgcgatcaagattttgttgcattggtggagcatatgccatggctgccgctgagaatgagatcaagataggtcaggtcgacgacgtccaggagctgcaccgaacgggcctgacgacggtgcccgatcggtacatcagagacggcgacgaccggccagacggcgacaacgtctgtgccctcgcgcacatcccggtgatcgacgtcggcgacctcccgcgcggcgacgacgagctggacaagctcaggctcgcctgcgaggagtggggtttcttccaggttgtcaaccatggcatcgcgcacgagctgctggacgagatggagaagctgacgagggagttcttcatgctgccgctggaggagaaggagaagtaccccatggcgccgggcgggatccagggctccggccacgcgttcgtcttctcggaggaccagaagctggactggtgcaacatgctggcgctgggcgtggagccggcgtccatccggcagccgaagctgtggccgacggcgccggcaaggttcagggagaccctggaggcgtactccgcggaggtcaggaagctctgccggactctgcttgcgcacatcgccgagacgctgggcctggcgccggccacgttcggcgacatgttcggcgaggcggtgcaggcggggcggatgaacttctacccgccgtgcccgcggc

SEQ ID NO: 1724 - DNA, 724 bp, Sorghum bicolor
  Clone ID: SORBI-28MAY03-CLUS28760_1
gcacgagggccagtagtcatatgcttgtctcaaagattaagccatgcatgtgcaagtatgaactaattcgaactgtgaaactgcgaatggctcattaaatcagttatagtttgtttgatggtacgtgctactcggataaccgtagtaattctagagctaatacgtgcaacaaaccccgacttccgggaggggcgcatttattagataaaaggaaaacttgaggcgccatgttagagatgttctaaatcgaaagaggatggtcgcgtatgtgctcctggatagccccgaggattctattattaatctaaaggaagcatgctttaaagtaggggagaaggtagagctgaaaaaatacatggattcatttccattcccgtattatgttatgctacagaacattgaagctcttcctcgcacattggccgacctgattagacagtggtttgagctcatgcagagcgccaacgagtgatccttgggacgttagccaacctaattttaccgagtagggcgacgcgtttagctgtacagcaaactagagcttttatttttgcttgggcctcgaaactctgtgatcgcaggcttgattgtgtacaaataccgtcccagttcaaatcgcttttgggaatatgatccgcgatcgcaagcttgattgtatgaaaataccatcacaactcaaatggcttctgggaaaagtgaatagagtttccttgctcacgcggtt

SEQ ID NO: 1725 - DNA, 666 bp, Sorghum bicolor
  unsure (1)..(666): unsure at all n locations
  Clone ID: SORBI-28MAY03-CLUS2939_1
cctcaggctgccttccttgttcctccgtctgtccgtcagcgccagaggtgaccggaaaaccacgccgttcttgcatttctccccggcccaaattgctgactggatcaatccaagaccttgcaggattttcgatccgattgcggcatgatccgcttcatcctgctgcagaaccggcaggggaagacgcggctggccaagtactacgtcccgctcgaggactcggagaagcacaaggtcgagtacgaggtgcatcggctcgtggtcaatcgggaccccaagttcaccaacttcgtcgagttccgcacacacaaagttatctacagaagatatgcaggactgtttttctctatgtgcgtggacatcactgacaatgaattggcatacttggaatgtatccatttgtttgtcgagatattggaccatttcttcagcaatgtgtgtgaacttgatttagtatttaactttcacaaggtctacttgatactggatgagttcattcttgctggagagcttcaagaaacaagcaaaagggcaattatagagaggatgggcgagcttgagaaactggaatgaaaagaaacaacggtgtggtactggggtgtacattagcataagtctggagctagttctgcccaattgacaaggtacttccatattnttaacgat

SEQ ID NO: 1726 - DNA, 667 bp, Sorghum bicolor
  Clone ID: SORBI-28MAY03-CLUS29411_1
tccgcgaggtcggcgcgctctgcggctagtagagccagcgtcgccggagccggagcgcgcgcgtgcaacccgtcgtcgtcgtcgtcgtcgtcgtcacttgctgctgctgctggtggtggtctctgtagatacacgggtacgttacgttacgtaatttaggggaagccgaggggggttggagcgaaatggccgtgtgagtgacgttaataagacgtcgtcgtttggttgctagctgtacttggagtgtacgagttggttctgtgctttgctttgctgtggtggggcggctggggtgagagggttgggtaaagttgaggagttatgtaagaaatgtctgggtctaaatgtaattaatacgttttttttttcctgcacaagtttgttaattttgtctcaactggttctcctctgctcgcttggctagttgtgatcttttatttactactagtacatgtagttgtagttggagggaccatcgtcgagaaaaaacggcggcgagcgagataaggtatattaaacgagggtgggtgccgtagacgtcactggaacgagtgaagacaacgtactcagcgtatatgcacgctcacttaaggcaggttgtttatttatgtatctctgcaaaactgaacttttatatttctttagaaaaaagaaaagaaaagcagag

SEQ ID NO: 1727 - DNA, 822 bp, Sorghum bicolor
  Clone ID: SORBI-28MAY03-CLUS29412_1
gctgtctggacttaggctttgtttacttccaccccaaaacctaaattttttcaagattcccagtcacatcgaatctttagacgcatacatggagtattaaatatagatgaaaataaaaactaattgcacagtttagtcgaaatgtacgagacaaatcttttgagcctagttagtccatagttggacaataattaccataaacaaacgaaagtgctacagtgtcacgaaaattttctcttcaccaactaaacacggccttagcttgtcagttgttagtgtaaatttacgtctacctttagttgagagctcttatgcaaatggttggatggtaaaagaaatgtcgtcacacagcattgttgattagcttacagatttctggggagctgacacctggtgttcctttcttatctggtaatgataaattgataactatacaacatacagttcacttgttttttttgggtttctttgtcttttctttccttattatcttcatactggaatccacattcctactaactaataattgaacttcaaggtttcatggcacaagtcttctaaaattgcagatctcctagaagggatagtcaactgaaatgccctagtattttaagtctgaacttttgcaaacaaattaattcggtttacaaattaactggcggctgttcaatgcttatactctcaacttcaacatattttaggtttactccttgccttttattacgaacccacaatattctattcaattcattcttttattctcaatgctttattatgcccgtatattgtatacttcatacctctttagtattttatgaagca

SEQ ID NO: 1728 - DNA, 716 bp, Sorghum bicolor
  Clone ID: SORBI-28MAY03-CLUS29463_1
tgttgaatctcggtcagtaagcaaggtgaataccgtacaagttaataaatgtgagcagaatggtgcctctgctattttccatgaaaaaatgctctctggatcaacaaggcaactagatggggattatgagcattgtgtaaaggtaatacggcagttggaatgcgatggacacattgaaatctgtttcaggatgaagttcttgacctggtatagtctgagatcgacagaccaggagcgcaaggctgtgaccacatatgtcaaaacattaagcgacgacccaagcagcctggctgagcagctcgtcgattcctttggagaaatcttaaacagcaagaaggcaaaaactggtttctgcaacaaactatggcattaggacaaggatagagctcaagatattgctgactcactgattatccatatttttccctgatcggtggcagtaaagttctagtttattccatcaatttgacagcaatgaaaaggggcgtcggtgaaaataggaaattattttaggcagcaaatagcatgctctgaaataattcttttccatcaggaagtagtggaacttaatttttcattggattactagggtgaatcctgaaattattgtagaatgttatcttagtttttgttgtggctcattgagaaattcttttggagatagtatgttggctattctgggttataatatcatggtaaatggaatttgatggtcc

SEQ ID NO: 1729 - DNA, 677 bp, Sorghum bicolor
  Clone ID: SORBI-28MAY03-CLUS29462_1
gcatgtaacggttgactctcaaaccatgcatcccactgcaaatcatgggttccgtcttcagaatgagcccattgcagaatcgaagaacttcacatattctcttgtgcatgattcagcaggtggcagtgttcaggcagatggtcctatgcaaacatcggagaatttgggccatctgattggccagagcaatcctgttccaaatgaagctcacctgaatgacttttcgggtgcccctgctgatgaattacctatagaagatgcagctcatgagcctgagataccgaacattttgcttcagttcgattgggattaagccatgacctgcctagttgcctcagcttatcctgaacccatgaataataaatcggtgccattgacatgctcctttctaggcctcctacaataggagacaagggtggtgccccttgtacagtaagtaggctatgtactagaagagtttcactgtcatgttgtctgttatcatagtgatcgtatttgcctcttagggctcatcagaagttatggctcttcgagccttagatgttaacatgtatccctccctgaagcataaggttgttgggggggatgttgagttcctattaccatactgttggtcgaatacctatggtttgggatcggatgccaaaatgcatgtccaaccactggtctaccttttt

SEQ ID NO: 1730 - DNA, 816 bp, Sorghum bicolor
  Clone ID: SORBI-28MAY03-CLUS29466_1
gcacgagggtttgattgtttgctcgggacgagcaaaggttaagcttgggggatcttgttgacggtggatataccatagaaatccacatacaaaacaccgtcaacatgcctcggttgcaaggggaaacgacatgacatgaacatattttatccataactagttccacttgtactcttagcttgtttatgcaggaacaacaaattcaagacattatttgacaaagccaacatcagaatcatcaagaggagatcgaggggacaacaggtgacaccctgggcccacagggagggggtcgcccgacccctctttggtgggacccaggtgtgccacctagtccgccgacataagggacccctgtggacactgctggtgggcccagaggcccagaagtggggtcgcccgaccccacatcaaaggcggttccagggtcggtggcctcccaccgaccttccccacatgtcccacatgttgatttgcccctgccgttgatcaaatggcggttgtgaggtcggtttgatccaagggtggagagaagatgtcacgcggatcgatgacgtggcgatggagtaacccctactccatctccctctataaaaggcagcctccatccttcatttcaagtgtgcaattccaaggccaagtgcattacaagttccaagcatacaagtagagtagtagttagtctagagtgggagttagagtcgagtcgagcgaagctcggggtctccggagtcatcttctggagagtctggtatagctcttgtacctttctacttttgtaagactttccttttattaatatattattcttacttt

SEQ ID NO: 1731 - DNA, 605 bp, Sorghum bicolor
  Clone ID: SORBI-28MAY03-CLUS29476_1
ttgtgtaaattatgtctccctctattccaaattataaaatgttttgatatttctacatatattgattttgttatgtatctacatatatagttgtgtctagatccatagtaaattcaatttagaaaagtcaatatgtcttataatttgaaatagtgggagtaaacttatgtacataagttatatagtataacttttttgagaacgactaagttagcaatgttgagttattcctcgaacttatgttgtctagaaacactcctaagttagtactgttaagtttatcgtgaacgttatgctttttaattccgttttataagttataagcacatgcttcttaaaagaatataaaaaaattaaaggacaggtgatctagcaaaagaaagtgaaaaaaaaaatcgaatgtcttaaaagagaaagagaaactattattgttctgtccaaaaataaaaagtaacatatgcactttccaaaaaaaaaacaaaattgctgtcggaaattgaccgctgatttcgtttctgctgaacgttcgtgaaataggggcgtcggtctgtcaggtgacaacaaggtcacataacatgtgttcctcaaagcccaagcccactagt

SEQ ID NO: 1732 - DNA, 656 bp, Sorghum bicolor
  unsure (1)..(656): unsure at all n locations
  Clone ID: SORBI-28MAY03-CLUS29478_1
cgaccaatgagattgagcagatgatcgacgatgccgccaagttcaagtccagcgatgaagctttcacgaagaaatntgaatcgcgccagcagctcgagtcttacatctctcgtgtcgaagagcttgtctcggacccgtccatgtccatgaagttgaagcgtggcaacaaggaaaagattgagtccgcgctcagtgacgccatggcccagcttgaagttgaggattccacccccgacgacctcaagaagaaggagcttgccctcaagcgtctcatgactaaggccatggctaccaggtaaatgtaaatattgctagatcctggtatcaatagcagagaggttggctgtatgctttcatatgcaagagtgaaagccccgatcttgactattgatcgaaagttattaatctgattaaaagcgccgtcccgcttatgaccctttttgggattgagactctttgttatgattgggtactgtcttcctggatgaacgagactgccctgggcagtttatgattttgatgagcctggcatactggtggatctggtcagatcttgagtttgatttcttatttgttctttgtttccttttacttcaaattgttcacgtattagatccagtcagacgactgtaaggtgttacaaaagaataaaaagt

SEQ ID NO: 1733 - DNA, 584 bp, Sorghum bicolor
  Clone ID: SORBI-28MAY03-CLUS2899_1
acgctgcagagagaccagtgaacaaagattctttattgggtagattcattgatggaactgatgcataccgagatgccagatttaaacttataccaagcattgttgagggttattggatggttaagcgtgccgtaggaacaaaagcttgccttctgggaaaagcagtaacatgcaattatcttcgccaggataactttctggagatagatgttgacattggttcatcatctgttgcccggagcattattggtctagtattgggatatgtcacaagcatagttgttgatcttgctattctgattgaggccaaggaagagaaagagctcccagagtacattctgggcactgttcgtctgaaccgtgtgaatcccgacagtgctgtatcaatctaatttagtttttagccgatctgtgcaaatttcttcttatcctcaatttttattctgagagcagcgcgtccgcattttaaaaatgtggagtagtattactatttgctgatccccaatcgaggataacatatgtataggcacgaggcatgactacgttatgcctttcgtaaatagaagaagtcaagtgttattgtt

SEQ ID NO: 1734 - DNA, 706 bp, Sorghum bicolor
  Clone ID: SORBI-28MAY03-CLUS29172_1
gcacgaggtgaaggcgaagcaacttcggttgactggtgtgcatcagaggttggaaagatagcaacatcttctgatgattctacggtacgtgtgtggagtaccaagaaaatggactgcacaaatgtaagctcaccaacagtgattcggaagcggataactgcaccaaacactgagtaccgaaggtccagtagccatgagcatgctactacatcaagagatgcagttgcctgcactagtggtgatggtgaattgcaaagtggttgccactctccccttcaacccagagcactggacttcggcactcctgaatcgacaaagaagagggccttcacattggtccaggaggaggcccttgatgcaaggaagagcccggaagttcagatgaacagtccctcttctgttctgagcccaccaccgtcattgaaacggagaacgattcgggactactttgccagtgctgcatcttgaatcctgacaaatagctggtcctcagaattcttagtggccctgacccatgaagactagggctttctttaacttaacttatggtgaaacagctccaaattttgggaaattcttctgtaggtctagttgtgtgaagttcattattgatcatttggaaatgcggttgtacataatttggtattgcagaaccaccctctttactttgtaatattttttttttttttcaattgagctcggtctg

SEQ ID NO: 1735 - DNA, 604 bp, Sorghum bicolor
  Clone ID: SORBI-28MAY03-CLUS29196_1
cggcaagcagcagcagtccccccatccgcaccagcagcagcacagcggcgcgggcgcgtcgccgtcgtcgtcgtccgtgaccacgtcctccgtgaagcgccgcggcggcggcggcgacagcagcggcggcggggtggagcagggcgacgggtgcgactcgccctccggcggcgcgggcggcggagggatggtggccgcggcgtgccccaggtgcttcctgtacgtgctcatctcccggagcgacccgcggtgcccgcgctgcgagtcccacgtcccggccccgccggcgccggcgccggccgtcagcaagaagccgcggatcgacctcaacgtcggctacctcggcacctagctcgttgttaggtgttagccatggcgtagcctagatggatcgaccggctgccgtctcctaccgtacttacgtcgtaaattagggtcgtgtaatgtggtgatccacggaccgagttgggtatagggtacataggggaggcgccatttttgggtccggatcccgttttaactgatgaaacagagaaatgcatgccctcacgtcctcggttctgtcaggaaatttatggccgatcagacaccccccataagaaca

SEQ ID NO: 1736 - DNA, 604 bp, Sorghum bicolor
  Clone ID: SORBI-28MAY03-CLUS29553_1
acacgatccagaggatcatcgagacggctggtgataatgaggctcaactttttgaggcattgagcattcccgaggaactgcagaaggtcctgtccaagtatgaaaagctcaaggagcctgtctgtgttgagctagagcccgagccagcgatgattccagttaccgtggagcccgaggaatccccccgcactgtgagcaaagaagacgcccatgtaaggaaaccaggaggttctggagatcagtccagtcgggatgacctgctgcaggatctagatgacatgatatttggtaagaaaggtgctacatcctctcatcaggacacaactcccagaaaggataacaaggacgatttcatcagcttctaactgctagatatataataaacctgtaaccagttctgagattctgcctttccatctgttagttgttgctgatatgtggcgtgtgcgtctttatcagttttttttgggtttgttactgggacatgagttgcttgctgtgtacataaatggatgtagcggtttgtgtaatgtaactgattgggagatatggcacatgagtttccatactggattcagaagctatgcattagacatattctttg

SEQ ID NO: 1737 - DNA, 694 bp, Sorghum bicolor
  Clone ID: SORBI-28MAY03-CLUS2960_1
tggaaagccctgaagaccactttgttaaggaagtcacagggtttatttcatttctatctgcactaaggagtcgacgacgtgacattttccagagaagagaatttctaaaatttgaaaatatacattggtatgggagtgatttatctgaaccacgttgggaggatcctactagcaactttctttgtatgcacataaatgcggagctggacgagaagctaccagattcaactggaggtgatttgtatatctgtttcaatgcaaacgaggagtcagcaagtgctactttaccagctattgcagaaggatccatgtggttgcgcttggttgatacatcacttgcatttccaggtttcttttcaagagggtctaatcctgaaatacacaaagtgctaggattttcctcatatcaagtaaacgcacatagttgtgttttgtttgaatcgaagagggttctttcctagtttctaatgtcaaccaggaagctcgtgtggtttcagcaataacaagaaactttgtggataccaactttgagaggacctcagttccaataagatgcaaattgtagatgagaatgtttatgataataaagttcctcatttgcgcagatggttggtatgcctagtttcttactgcctttttgtaacctactaaacaacctgagatgtgagctgatagcttcctttgccatgtttgg

SEQ ID NO: 1738 - DNA, 595 bp, Sorghum bicolor
  Clone ID: SORBI-28MAY03-CLUS29555_1
ttctacactccagatcatggcagattgttgtcgcttggaggacttactgatctctgatgtgctgctcacagtgataaaattgcagaattcacaaatccacccttgattctgatggtgttggctcgagttattttgtttcctgttagtagtttcatgtcattatgctcaagtgcgaccgtgctcactcaagttgttccgatcatgttgctgataaaaaatgtacttttgtcggtttctcatctgttgaacagtttagtaggaatgggtcaaccccccatgtccaagtgttgtcctgtcgaatatctcctgatctgtgtttctgtccgatatgtcaggaatatttagctaccggctctgtcgtttccattttcttaaaagattatgacattcaagtgttgactgctgctcttcaacaagggtgtcaactagtagcagtgtaattttttttaatacataactggaaggtttcagttttgggcatctcttgtaaagtcagggctgaagtctggttattgaggagtctttgggaagcaggaccaattgaataattgatctagttgaccgagcatcaagccacagctataaaaaaggagat

SEQ ID NO: 1739 - DNA, 508 bp, Sorghum bicolor
  Clone ID: SORBI-28MAY03-CLUS29646_1
tctttggagtcatccaagataaaagtgaagccaccgaacgagatcacagatgaagtcagctctgaaccttcaaatttggcttcccggtccacaagcaatccaaaagaaagaccagtgcaagtcaatgcaccagcgaagaagcgattatcccttcctaacaacgcaacagccagtgggggagtaggaaagcgccctaccaacagtagtcggacaacccaggcctcgagattgaagaacgccaaaggagcctccaagtctgaaacaagagaccagccagggcctgctaactctgccgtgaagccagttgagacgctagcctgagagtgaatcccatccatattatttggacacatcgcaatgcccctttgtcattgatgttgttgcatctctgtatatataagcaaaacctgcatctgaacatgttagcgagtagtgccgcaggatattgttgtacaattgtttgttcacgttgctgttatccatcattgtgttatgtatttttctcttc

SEQ ID NO: 1740 - DNA, 531 bp, Sorghum bicolor
  Clone ID: SORBI-28MAY03-CLUS29687_1
tggaagggtctactacgaggcagccatgatggtgtcccagcgagggatggggtcggcttcttcagcttcctcgacctcctctgctgggactgttgacttcactaacttcccgaggttgcacaaggatgtggaggacaacatgttcttcatctgacaccagttttttcaccggtgtcgtggaggtggagcaagctcgggtcgattttgctgtgtggcaacatcgcatggagtttatgctgttgtcttttgctggtcgtgttcttttgcatagtttcaatgtgtttgaagttgttagtttgaaactgcaagtcggtgaaggttatgcttaaagacttagacagtacgcgtctttttttttttgaaactaacagtacgcgtcttcgttttacttttgtgtgtgtcagttaaacagtctgatgatctggtgcaaatatggttctgagttttaacaaactttagtattagtatgctgcagtctacaaattcttgctggatatactgcatgatgtttttttagaaaggctatactgc

SEQ ID NO: 1741 - DNA, 557 bp, Sorghum bicolor
  Clone ID: SORBI-28MAY03-CLUS29689_1
cggtcgtagtggcatcactggcaagcgcacccttggaaccaagccagctgccggcggcggcggcgctcggggttgcgatggcccaaccgctgccgcaggtcccggccgtcccgctacctcaagtacctatcccggcgtctactgttccttcggcggcagggccagggagcggaccgtcggctctgtcgacggttatccggaacgaagtagcgagacaaggagttaaattggctgcgcaggtggtgacgcagtccctcttctctgacaataacaacgttggggatggcgttctttccatgatggctggttctgctggaggcgactatgctgttcagactgcaaattaattgagaaggatgacgatgatgctctgcattgttcttccggtatttgtcagtagctttgagactacgaagcatgcatgtccctgtctttataccttcttgatctcgtttgaatcatcctaagatcgagctttacttttcattatacctgtaatgtaacttttgcccacagtttccatcagaattgtgcagctacacaatttatcgactaca

SEQ ID NO: 1742 - DNA, 537 bp, Sorghum bicolor
  Clone ID: SORBI-28MAY03-CLUS32290_1
gacagcaagtaagaatgatgccaatgtctatgatgtgcatgtggtcgatgacatacgcttctcaacagaggtcaagggcctgattggccgaagcttctcagaggcaacaatgcaggcagagagattacagactcgagctgctgcagatgatctccttgggaagagtctgaatgccattaaaggtgcacaggacaagataaggcatgcagcaaatgaaaggaggcagtcattacagttgcaactcttagaggacatagctaatcagcttcagggaatcaaggatgctgcagaagcagggagacaagtgtactgtgctactcctaaaagctccaagaggagcttgggagttgtattacgccactaatgctgtaatgcatgttggcgtcgtacataagttgtttttgggtttgtagactaggtctgttgatttgttggttcaacaagtttgctgcttcctttttaaataagtacgtattggctattgctctgtacatgtatatatataaacaaccacgggattcgtccccattgtttgtt

SEQ ID NO: 1743 - DNA, 682 bp, Sorghum bicolor
  Clone ID: SORBI-28MAY03-CLUS32311_1
ctcccccgccggccgcagttcccgctcgcctccgtggcaggcgcgctgcagcggcggatcaacgcgcggtacgacgacctcgcgcgggccagcgaggcgcagtgcctcaccatcgaacaggttaatgagtttgttaacagtctcatagatgctagaaacgagctgctgcagaggtatgagaatgtagaaagaagcttcaaaataaagaaggcaatgctatccaaccatcgaaactataggtcttcatatgaacggctctttgaacaggtacgcagattggaaaccgagcgtgataacctaaagaaagatgccgccatctacaactacattcaagagcgtcttcagaagtcagcagcatacaaaatgatcatggagctcggtactatggagatggaggcccaagagatatcattcgaggagctgctggctaaggagaaggaggacaccgccttctggcagcgcaacgggaagatgagatcattctcatccaagtaggacacaatgtccctacctgggctcactgacgatggcagatctcaacatcggtagtctaaacatgaaatcctagcctgctccttgagagcagctgctgtatgcggtatgcctgcataccgtttggtgtaacgctgcgctcgtctgacaagatgttgggcccctgtcactcaggagtctcctggcatat

SEQ ID NO: 1744 - DNA, 625 bp, Sorghum bicolor
  Clone ID: SORBI-28MAY03-CLUS32332_1
gcacgagggccttcttcgccttcgacgtttggggcaagcatggcaggcatcccatcgggtgaaggcagcggcgatgcgcggaatcgcagcacgatttgggaacggtttccgccttaccctgctcatgttgtcaggttttaccatgagcacaaggacatcctcggggagatcttgtctggcttaagtcatcttccgacacacgaaatgatggacgcccttggagagaaattgaaagaacactcgctgtccaaagtgcctttggtacactccagcgacgatgaggaggacgaagacgatgaggacgaaggtgataaggaggacaaaggcgaggaggacagggagggaggaagactgaagttgatggatgatgaaaagaaacctcttggtgctgaagaacatcaggtctatagtgaatgtgaaagagaatgcaagaagccaaagattggctgaatgcgttgagtgccatggacatggagaagaagcctgaggctcgagaaataaataatcctcttagcctgtaatgatttatgtccaacttaattattattatggtgcactggtttctgttggactcttagcatctattctagctttgttcatatcagctgcaaaactctacctaatt

SEQ ID NO: 1745 - DNA, 829 bp, Sorghum bicolor
  Clone ID: SORBI-28MAY03-CLUS29871_1
cgcgcagcagccgccgcagaacggcaagggcggcgtcggcggcgccccgggcggcgggaaccagcccgggcagggcaacaagggccgcgtccccgccggcgccggtctcggcgggcccatgatgggcggcatgctgccgccggcgtgtggcatgacgatgaggccgccccacatgacgggcgcgggcggcggcgccggtttccccggcatgggctcaatgggtggcggcaggccccttggcggcatgccgatggcgatgggccaccccggcatgggtggcgccggcatgcacccgggcagcggcggcgcgcacggcaagccggctggcggcatgccgatgcgccccggcccggctcccgccggcttgccccccggcagcggccccgcccgccgcgaggcgctggccatgtcccagctgccgcacggccaccaccatggccacggccacggcggccaggcgtatccaccgccgccagcgagcggctacgggtacgggtacggccggccgccgatgctgcagtacccgccgccgccgccgccgtactactacgcgatcccgccgcaggataactttttcagcgacgagaaccccaacgggtgctcggtgatgtgaggcgaggaggtcggtcgccggcagcctgctgctaatgcatgctctcgggagaaactgaaccagcagagttatggccatcattgaacatgcttagtagtgtgcttgcttgctctaaacatcaagaagccattttagaggttgcctctcgtaggagattaggtcgtgtagaagagtggatggaaacaaaagggatataattgtcttgagacataggaa

SEQ ID NO: 1746 - DNA, 606 bp, Sorghum bicolor
  Clone ID: SORBI-28MAY03-CLUS29872_1
gcacgaggcccggcactaagcggcggcggaggcgggagcagcgtgcggccgtgggggtcgagcggcgggacgtcggtgtcttcgtctgggaaacggatacagaaggagctgctggacctcaacgcctccgattgctccgcggggcccaagggcgacaatctctaccactggctatccaccatcatcggaccccaaggatcgccatatgaaggaggggtatttttccttgacatcgtgtttcctcctgattatcccttcaaacctcccatggtaactttcaaaacaaggatttaccactgcaatattgattccactggtaaagtgcatttggacattctgaaggatggctggagtccagctttcactatttcaaaggtgttattggccatcaaagacatcatcagcaatccagatccatacaccccgcttgtgatgaacatttcacgtcagtatctgactgatagagctaaacacgatgaaatagcagctgagtggacaatgagatttgcaagataggggatctgtctgtatctaagcacaatgaccttgtaaaaaaaataactcttaatgtggccgtagatggggaatgttggcaaaggagccagt

SEQ ID NO: 1747 - DNA, 593 bp, Sorghum bicolor
  Clone ID: SORBI-28MAY03-CLUS29886_1
tatgaagagactggggctgcagtccacaaaattgaaggatttaaaccaaaggtaaaatcaatacgtcagtttggcaagtacgagagggagaatatgaagaacagggcaaatggtggcgatggacctgtccctatttcggttttcctggttgctagtgtcctgaaagagaacagtccaaagcttctgcaagaggctcgagggattgatgacattattaggatattgaatgatgttaacgggaatctggacgcgaaaagggcttgtgttgttgcactgaagcttcataggaagtaccacaaaaagttgcaggaaaagaaatcctaacatcatatggcgagataccgagattgcacgcaacacagggttgcaaagatcctaacatcatatggcgagatacgtaccgagattgcacgccaatattcgccatactgggttgcaaagagcagcagcatatctagagattttagggtaattgttggcatgagtattaccccatgtttttgttccttccacttagagcatgtctaagagtcttttcaaatttcacactttgaatcatcatttggaaaatcatctgtataaaattgttttct

SEQ ID NO: 1748 - DNA, 613 bp, Sorghum bicolor
  Clone ID: SORBI-28MAY03-CLUS29900_1
gtcttactcaaccaatcaatgctttggcttttgtttttgatggtatcaattatggagcatcagattttggatatgctgcctattcaatggtccttgttgctattgtcagtatcatttgcatcctcactcttgaaagttatagtgggtttattggaatctggatagctttggtgatctacatgagcctccggatgtttgctggattttggaggatagggacggcacaagggccatgggcttatcttcgcggctgaacataagtgcaaagctattaatctgacttaaccaacacgatgagcacacgatttattggtcacgaaagtggcattcctgtgatcttgtacatatgccatacggactcaattcgtcaaacttcattctgtgacccccccgggtttgtaggcactcacgctgttaaacaatctgttgtactagccctctgtagttggaagttgtgacagctgcaaaatcatgttacggttggctactatgcatagcagagttgaatacgtgcccaccagggagcttgtcaaagtttagcacaatgttgtaccaaggcgtgtgaactgtgctgacatgccaaatatgcaattaatagtccagaattaaggcc

SEQ ID NO: 1749 - DNA, 805 bp, Sorghum bicolor
  Clone ID: SORBI-28MAY03-CLUS29905_1
cctgataaagaagagctttaaaattaatggtggaatgggcaatggcagagcaaaggttttcatcaatggctatcccatttctgaccgtgctgtcaggaaggcggagaagattgctggaccaatctatcctggtgaatactggtatgactatcgtgctggattctggggtgttatgggacagccctgccttggcatgatacctccatatattgcggaatttaactatcctatgcctaagaactgtgctggcggaaacactggcgtgttcatcaatggccgagaacttcaccagaaggacttggatttacttgtgggtcgagggcttcccgattctcctgatagatcatacagagttgagatttctggtaaagtatccgacgaagtatctggtgaagagctttattgccttggcaaacttgcaccaacggtggagaagatgaagcgtgggttcgggatgcgagtcccaaggatcattcagtgaaattggttcgcatcaagaagcagaggctctgaaatttgtgtcccgccacgcctttgtggtatagattgctaatgtaaccctctgcctggaatcgttgcatgtcgtagaggttgttttgatcgagagtgtcatggtgtgaccatgtaattttgtctgtggattgttgaagcttctcaatgcaagttttctgttgtgtatgttgtctatgaactcccttatctaaaaaaaaaatgtagctatgaactttactgctcctgttagtgtctgtgaacttgggcttgggtcaattcaagtgtgagctgctaaatgtgcttttagttctgc

SEQ ID NO: 1750 - DNA, 675 bp, Sorghum bicolor
  Clone ID: SORBI-28MAY03-CLUS29922_1
aacagagatgaagaaagtgttgaatcagtatcttgaggagaagactgatttagagagagttattaatagagagaaacagaggtcagcacgtacaaagttatcccgattgaaaattcttcatgagtgtcgactgctgcgggagcgtctacaggaatgcagtgctaaatttctagcagaagaacaagataactttactattgatccgtcatccttgcctgatgcattagatcttctagcgacatcagacaatagaatacgcctacttgttgccgaggctcaacttctagcacgagatgatgaacaaggctcttctgatgatggtgacaattctgatagtagatcctcattaactatgagcagtgaagatgcaaaagttaccgatgaagatacaacaaaaatgctttctgatctgctcattgacaatgcgcagctgaggctacgcctcaatgctgtcatccgcaatgctgtaaatacggccgtgaagccagagaaagaaggtagtggcgaggttctccccaaaaagacagtccttaactggttgttagacagatgagaaaaacaccaatgtatatttcctgtgaattagatcttgaaacttacgcggcttgatcaaaattatatgatgagcatacctatattgccagagtagcatcaggataaaacattccttccaga

SEQ ID NO: 1751 - DNA, 543 bp, Sorghum bicolor
  Clone ID: SORBI-28MAY03-CLUS29950_1
cctactggatgggtagtcactgtgaatccgcatccaacaaaccctgcttcccgttccccccgcgtgcgcgctcctgcgagggcgaccgctgccgccgccgccgcctccgccaccaacgccaccgccgccgccgccgctctacgccaggtgcctaggccttcgttgagcacttcgccggcgacaagcacccaccagatggctgggtatatgtcaagagggcccccaaatggttgtgtgtatgtctgcaatctacctcctggaactgatgaggatatgttggctgaatattttggcaccatagggttgctaaaggtatgggtcttaccagaaggacaaaaggactgggcgccccaaaatttggatatatagggacaaagttaccaatgaaccaaagggtgatgcaacagtcacctatgaggatccacatgctgcttcagctgctgtggaatggttcaataacaaggatttccatgggagcactattcaggttcacatagccgagtcaaaaagcaaagaagcatttgataaccccacaagtttgaa

SEQ ID NO: 1752 - DNA, 644 bp, Sorghum bicolor
  Clone ID: SORBI-28MAY03-CLUS29935_1
tttcctgaggatggaactgagagtaatggtcaacaggtgtttgacgagacagagagtcaaaaccagctagagaatttaaccctgagccaggttggctcaagtttgccagtcagcatggaggacaccacttttgatcatgacactgtgacactcaagacagataccaagcagcaagcaagaggcacctgcactcctggaaacagccatgtcgacagggaattatccatccgcgacaattctagccaggccatttccaagaatgctgagaagaagatttccctgttgggtcatgggcatcacggtaaacaagttgtggaacttttgctttcaaatggtggggaagaagctattaaccagttctgccaaagatggaggcagatctttgttgaagctgttcacccccgttatttaccttctggctggaatattaaccacagtggacggcgggatttcggtgacttcagtgtctacaagccaccaaggaaagatgctcaatctgcaagggattaggctacgcggatgtcatcagtaccattgctgtcgttgtaccctgaggttcaactttttacttcccagaattggttgcatccccttaatcctgatattttgtacttgtatgtatcactcagtctgtgtgcttgttc

SEQ ID NO: 1753 - DNA, 464 bp, Sorghum bicolor
  unsure (1)..(464): unsure at all n locations
  Clone ID: SORBI-28MAY03-CLUS2952_1
tcgacccacgcgtgcggagcanactctacaccaacacaatcccaagaacaccgagagaatccgaagatgagcgtggagatcctagacgggagcacggtgcggagcttcgtcgaggacgaaggcgccttcaactcctcggtggacggccggttcgccgcgctggacgccgaccacgacggcctgctcacctacgccgagatggcaggggagctcatgagcctgcgtgtgctggagaagcatttcggcgtggacgaggccgcggtggcgcccgacgagctcgcagggctgtaccgcagtctcttcgcgcggttcgacagggacggcagcgggatggtggaccgccatgagttccgggcggagatgaaggaggtgatgctcagcagtggccaacgggctcggcttnctccccgtgcagatggtcgtcgaggaaggcagctttctcaaggtcgccgtcgacagggagc

SEQ ID NO: 1754 - DNA, 676 bp, Sorghum bicolor
  unsure (1)..(676): unsure at all n locations
  Clone ID: SORBI-28MAY03-CLUS29507_1
atnggcgtcatgggcagctcgctcggattcgccagctacaccgccttctgctacttgattgcatcaatgggacttcaaatgctgtggagtttcgcacttgcttgtcttgtcggttgggccacgcccacctactcgcgtctctcctgccccctgctcgtgcgcttgcctgtcgtcggagtctgggtaacagcaattctgtcattcgccgcagcaagctcatctgctggtgtagtaattctatttcaaaaggatgtgttcttctgcagaaggtatacccaacttccttgtggaaaatatgagctcgccacagcgtttgccttcctgtcttgggcactcagtgctacatcagccttgatcatgttttggctcctcgctgcattctgactttgtgtaaaatttggtggtagcgatgtttatagtgcctactttgctgttctctcctcatagctcttacaactatatcacatatttagcagaccacgtagcccaaaaatggaaagatgggatcatgtaaagtccttggagggaacagttactaatggaagaaattcactgaacagataattttgctatctgctgagttaattgcctttcgctatctttgatgcaaggtgtccttgcacgctgcaatcaagcagttctatgtaaacaatctgaagcaagaccttgcaatttt

SEQ ID NO: 1755 - DNA, 745 bp, Sorghum bicolor
  Clone ID: SORBI-28MAY03-CLUS29522_1
gacgacagcatgcagccgatgtgacagttacctatttacgaactgagaaatattatgaagaactagcaagctctgttttttgtggtgtcctgccaggggatggctggagtgggcgtatggaagacagcatgcttcaaggatgcattcctgtaataattcaggatggaatttttctaccatatgagaatgcactcaactataatagttttgcagtgcgcatacaagaagatgacatcccaggcctcataagtacacttcgaggaataaacaatacacaagtggagtttatgctgggaaatgtccgccagatatggcagaggtttttctatcgagactctatattgttagaggcgcagagacagaaaggactgttctctgaagaggcaccctggtctgttgaggtctcaaaactacctcacgatgacgatgcctttgcgacatttatacaggtattgcattataagctgtacaatgacccttggcgtcaaggtctcctgcaaacaaaggaaactcggctgccgaacatctgctcaagaacatcctgaagtgtttagtcaggcagaattacaactgtaaagaataggcatacatactcctgctccctctcaagaaaaaggatagatctgacatactcttaggaaggaatttacagatatatcttacattctgggtaatgttcttttgactgatactcaatttagatcatttcctgaaaaaagaaaagggaaatgcaccattttcatct

SEQ ID NO: 1756 - DNA, 584 bp, Sorghum bicolor
  Clone ID: SORBI-28MAY03-CLUS29527_1
gatcagcaaccaaaaagtgctcccttgctccaccccttttcactaccccctgtgccccctgttccaccatatggcatgcccttgcttcaaccattcccacctcctaagccgctgccattgcttaccccagcatcttatagccaggtggtaacaagagagcaagtaggcgctgcactgctgaggcttgcacagaatgataatttcatcgacatggcttaccgggagatggctaagagaccgtaaccatgaagagaacatggtggtgtgtctgcggcagctgcttaggtgtctcatcttttgccttttgcccagcctttttggacacatctgtggaatgtggtggctgcggtttaacagcactgtttgagttgtagtctgatatatcaaatgcagaggccaatgggttttaaacaacttttgtagtttgagccgttgtgtgggaatgggaatgttcccgggtatacaacttgctgcttgcgcagctggcagctgcacccaacatctgaggtgaggcggtgagctcgtgtataattttatccgagtttacattctactttgtgaaatcaaaatctgtctgttagttc

SEQ ID NO: 1757 - DNA, 442 bp, Sorghum bicolor
  Clone ID: SORBI-28MAY03-CLUS30055_1
gcacgaggggggtacggagaggaggaagagcgactctacgcgggggaggtcagcagcggcggcggcgagggagaggagcttcgtgagctcaagtattcacgggggcttctttatttgtgcgatcggaagaatcgatcccgcgacgcagctgacggaggtttgatttgacgcgatgctgacggtgtgtaaggtcgtgatcatacttctaatctgggcccctaaatctgtaggacatgtgctgtgagtcgttgatcttgtagggaggatttgcccggagaagatttcaattatagtatagatgaaattaaaataagtaaattactaaaaagctatgaggctgttctttttatcttggtagcaaaaaaaaaacaaaaaactaaacttttgttaccatgaatgctacttttacatagtgggctaagaaaaatttgtgaaacctgct

SEQ ID NO: 1758 - DNA, 418 bp, Sorghum bicolor
  Clone ID: SORBI-28MAY03-CLUS30100_1
gcacgaggctcctccggtcctcttccttccttgcttgattcaccttttcttttgggagcttctctcccggccctctatctcctctctgtccaagaacttgctgctcgatcgtcccgtgcttaggttcttgcgctcgcgtgagagtttggaaccgtcttgttttcgcttctgtttgatccggtcctgtccgtccaatccaatccaagctccttgcttcatcctcgctaggaagatcctccatggccaggcgtgctgctgtccaccgtcgccatggcggcgaccggtcggtgctctgttcttttccatgagcaccgccgccgtaccatcggcctaacgaaccaaccatcatcctcatccgtttctcggtagcacctgaactcattctcgatcactcgcgtcgcgtcgcgtggcgcgccca

SEQ ID NO: 1759 - DNA, 517 bp, Sorghum bicolor
  unsure (1)..(517): unsure at all n locations
  Clone ID: SORBI-28MAY03-CLUS30114_1
gcacgaggcgagaacgacggcctcgcatcgaacgctgactcggctcagttccagtcggatgaactggaggtaccagacgttactgaagagacgatgtgcgatgccggcgtggctgatgctcaagccttgaacagagttcgagtggtcccaccaccgagcgatggacaaaaaatattccagattgaccccatgctgcaaggctataagtaccatcttgagtatcggtacagcctctataggagaatccgttcagacattgatgagcatgaaggaggcttggaagccttctcccgtagttatgagaagtttggatttaatcgcagcgcggaaggtatcacctatcgagaatgggctcctggagcgctcgcggcagcattggtgggcgacttcaacaactgggatccaaatgcagaccgtatgagcaaaaatgagtttggtgtttgggagatttttctgcctgacaatgcanatggtacatcacctattgctcatggaactcgtgtaaaggtgacaatgg

SEQ ID NO: 1760 - DNA, 674 bp, Sorghum bicolor
  Clone ID: SORBI-28MAY03-CLUS30131_1
gcacgagggcagcaccttcgatgagagggaccagattagggagcggagaaggatgcagtatgccagatggaaggaagaatgcaaagaaatggattctcatgttggcagtggtaaaattatcactgccccggttataactgaggatggattccctatcaaggatccattggtattactggaggctacttcagacacgcaaggtacttctaccaccaccaccaccaatggcagcagtggaaatggaattgatgttgataacaactccatgaaccttgtcttggataaacaaatcattggctggaagcttacattacatcaaataggccttgatgttctgcgcactgaccgcaccatggtattttacgagaacaaagataatctttcaaagttgtgggatattcttgctgtctatgcatggatcgacaaagaagttggttattgtcaagggatgagtgatttatgttcacccatgatagtgctactcaacgatgaagcagatgcattttggtgctttgagagattgatgcgtaggctgatgtacacagcagtcagttggggtggaaaaccagcttcagcatcttgcttctatcattcaggtgcttgatccaaagttgcatggccacctagaaacacttggcgggggtgactatctctttgcattccgcatgttcatg

SEQ ID NO: 1761 - DNA, 602 bp, Sorghum bicolor
  Clone ID: SORBI-28MAY03-CLUS30164_1
gcacgagggccacatgtgctgaagaaagttagtcatgaggaagacaggagtaacttccctacagttactatcgcagatattgatcgaaccatgaagaagtactccgcgagccttttgcatgcactggaaggtgtaagctcaaggctttcacagatggagggtagaacgcaccaactcgaaaactctgttgatgagttgaagttaacaattggtaactataatggtagcactgatggaaaactcaggcaccttgagaacatgctcagggaggtccaagcaggtgtgcagattatgcgagacaagcaagaaattgtcgagacacagctccaccttgcgaagctccagacaaccaaagctgatgcccagttatcagaaaatagtgggtctggacaggctggctcacagcagcatacagtggctcctccacaagcagccattcagccacagcaagtcctaaccccttcgcaaccacctgcccttcctgcccttcctgctccaaatgcaccacctccacttccaacgctccaaagccaaccaccatcacagtttccaagtcatttacaacattcacaggtaccatctgtgccttctgttgcaccggt

SEQ ID NO: 1762 - DNA, 556 bp, Sorghum bicolor
  Clone ID: SORBI-28MAY03-CLUS30173_1
gcacgagggccttcttcggcttcggcacgctctggctcgccgtcaccaagaccgtcgccatgccttactgggtgttatggatagctttatgtattggcacaaacagcagtgcatggttgggcactgctgctcttgtgaccaacatgaggaatttccctctcagccgaggcactgttgctggtctcatcaagggttatgttgctgttagtgctgctgtctacactgaaacgtttaatggaatgcttgggaattcgcctacaaatcttttgctgttgcttgcgttggggatcccaacagcatgtattgtggtgatgtattttgttaggccttgcactccatcactggatgaggacaactcaacagaacacagtcatttcatgtacacacaaatctcaagtgtggttctcggaatataccttatggttgctacaatacttggtgatactttaaaactaagtcaggctgtcacctatcttttatttggtataatgatacttttgctccttgctccacttgcaataccaataaagatgacactttatccaaacaaacaaac

SEQ ID NO: 1763 - DNA, 643 bp, Sorghum bicolor
  Clone ID: SORBI-28MAY03-CLUS30206_1
tggggatgtacctggcagcgggatgaattaactgctggatttcttgggtgatttgagagggaggtgataacagtctgcttcgcctgctctctctcctccccaggacaccagaaagaagtgatctttctcgccccctcttgttctggaacgagatcctctaatcctcgaccccccgctgcttgaggcactttccccaccccaccgccgctggattttgccgtcacgcggtgcagcccttcgcgtcgacgggcaaatcggctgccggatgaactaaagtttgtgttatgatgggataggtgtgctcctgctcgcgtctctggggacatccggcgctacatgtggagctcacctttctccggctagcgttgtgtcagggggattgtttcttggtccctcgggagctggttgagttgtctttcgtttgtcggaaatctgtgcggcagcctaaaattgctgattcgggggtttggatggcaccggtggggaatcatgttgtggacatcagctccgatgaggaggacttgttcatgggcacttcactaaaactccccgaacccctcgaccccccagttaacttgtcacggtttatggatcacatctgcggtgtggctgattatgtgaccggggaggatatcgatgacct

SEQ ID NO: 1764 - DNA, 681 bp, Sorghum bicolor
  Clone ID: SORBI-28MAY03-CLUS29765_1
caaagaacactacttatgcagttcgttttagtttgacaagcttttcctgcaagaattcagaatctcagtgatgtttggtggacatgggtgacgtccagagggtgttgtaccatggctaaccatgctaatttttgaaatacaatctagtcaaatttgacaaataagggagcctgcttcatatcagccgtcatctagcccttgagcatgttcgggttccaatcttttcgacagagcctcggcagctcgtgcccgacgctttgttgcatcctttcatcccagggagcagcctcgacagggtactttaggtgcacccttcgcgtatgcggtcccacggtcagctggtgctattggccctgcgctccttgctggccccgcgcgctctgccggctctccttcaggagggctggatcagcataatcttcagcgatgagatttgctccccttggatggtggtcttgcttggtatagggatcaccatgatcatagttttggtctcatttgctgtaacgacgagaaaaagaacgtctaagcttaaggtttaaccagaattcatttaggctagattttgatgtacagtctgatgatgcccccaaacattacgcttagcattctttggggcagagctgttagtgcacagaatcatgtatattcgtccggtcgtactgggtgccagacaatttg

SEQ ID NO: 1765 - DNA, 600 bp, Sorghum bicolor
  Clone ID: SORBI-28MAY03-CLUS29753_1
gatgaatttggcaacctgaaaaagaaatttcgctctaaagctctgcatactgaaagtgcacaggcacttcctgggtctggacgtgctggatgggaagttgagcatcgaggttctagtgaaagggaaggcagggagaggagcagggatcgtcgtagggatgactatgatgaaaaggaaaccaggaacagagatagaggtgatcatggaagggaccaacgccggagcaggagccggagcagagaccgtgaaagggaaagggggagggagaggagaagagaccatgagtatgagagaagtcaggagcgtgaccgggaccgccgccacaggtgaagagagaaatgacaagtatgagagaagtcgggagcgtgaccgggtccgcagccacaggtgaagagagagatgacagggccttctgttcttcttacattgtactccgtatttgccaatttttgtagccatgggacccgtggtcttgtgttagtaactgggagccggaattgttgctctgaatctgatttttgatttgaatgattcgctgcactggcattttccagatattccgtttcttatgtgattatatttgtggaacacgtaaaaaaa

SEQ ID NO: 1766 - DNA, 658 bp, Sorghum bicolor
  unsure (1)..(658): unsure at all n locations
  Clone ID: SORBI-28MAY03-CLUS29842_1
cggcggcgaacccgaactcccggatcggcatccagtacgagcccgggtccagcctcggggtgtggtaccagtcgtaccgcctggcgcgcggcgcgctgccggccttctaccagggccaccgcaacaccacggtngctgccgctggcgctggccggggaggtgcagctggccaccgccgtcgtgtccgggttgcaggacgcgcagcggacgggcgccgtgccgctcgtgttccgcgccgacgtccccgtgcgcgtcgaggtcggcagcgtctaagctctggaaggtcacctccagggtgcgctgcgacctcgtcgtcgacaggctcatggacgtcagtagccccatcaagatcaaggccagcaactgcaagttcagcctgaagctgtgatcgattcattcgttcgttcgttgccgcggttttctttcgttgggttgtctgttctcctctcttttgggagactagagagtcgtggcgttggatttcttctggcagagtgctggccgtgtggtggtagtatttggctatttgcacaggttcagacgtgcagtgcactcccgccaacttcgtcggtgttcatcccggccatgtacagatggtatggtagtatatgattgttgttagagaggatataatatgcatgctcatggctagattttt

SEQ ID NO: 1767 - DNA, 616 bp, Sorghum bicolor
  Clone ID: SORBI-28MAY03-CLUS2987_1
cgtccgccacgctctccaatccggcaatccctccctctcgggcggcatggccgccgccctctgcctcccccgcgccggggccccgttcatcctcctccgagcctctcgtttcgcgccgtgggcggctccggtgctccgtcgtcgactcctctccgggcctcccaccgccggcgagctcccgcccccggcgctcccgccgatttcgaagctcgctgacccgccggtcgtggggacgcccgagcccccgctgccgtttaggtccgtggaggcggagatcctccgcgatatcgaccccgtcgtccagctcatcaaggatatcctccactcggagagatacggagatggtgaatgtctctgcccaaaggatgaaaatgtcgtcgtggagaagctcctctcctaccatccacgcgcgcacgacaaaattgggtgtggacttgacgcaataatggttgataggcaccctgagttcgttgagtcaagatgtctttttgttaaccgcacagatggtgtttggatggatttctcataccagaagtgcctccgtgcatacatccgagaaaagtatccgtctcatgctgagagatttatacgagaacattttaagcgtccatgacag

SEQ ID NO: 1768 - DNA, 558 bp, Sorghum bicolor
  Clone ID: SORBI-28MAY03-CLUS30228_1
gcacgaggaacacttccgtcactcgtgctcgtttcgaggatctcaacgccaagagctttgctggtaccttggacccggtccagcaagtccttaaggactctggacttgcgaagagccaggttgatgagatcgttctcgtcggtggttccactcgtattccccgtattcagaagctcctcagcgacttcttcgatggcaagaagcttgagaagagcatcaaccccgacgaagctgttgcttacggtgcggctgtgcaggctggtatcctctctggaaaggccacttctgctgaaacccaggaccttctgctccttgatgttgtccctctctcgcttggtgttgctatggaaggtaacatcttcgcgcccgtcgttgcacgtggccagaccgttcctaccatcaagaagcgcactttcaccaccgtcgttgacaaccagaccactgttcagttccctgttttccagggtgagcgcactaactgctcggacaacacctcccttggcgagttcacgctggctcctattcctcccatgagggccggtgaggctgcacttgagg

SEQ ID NO: 1769 - DNA, 702 bp, Sorghum bicolor
  Clone ID: SORBI-28MAY03-CLUS30257_1
gcacgaggggtgaactaaggcttggtgtacggagagccattcagcttaaaaatgaggccctttttgaagatttcagtgctcgcggtacaaagcggcatacattgtcggctgtagctgattccttgaagcacagaagtgtttttcacatttcttacaatccaagagctactgcttcagaatatattattccataccataagttcctgaagagcctcaatcatccagtctgtgttggagcaaggatcaactttcagtgccataatgaagatgttagtgaaaggcgatctggaatggttgttcgcattagtgaaatagatcccatgaaatggcctggctcgaagtggagaagcctgctggtaagatgggaggatggtgctgaatgtaacggccaagatagagtatctccatgggagatcgaggtagctggtggttctgtctctgttgctcattctctgtccgcatctagttctaaaagaaccaagttgtgtgctcagggaaatttggacgttccaacaatgtggaatggttgtactgactccgtggaaactggaaagttacccagggtcttgcaaggtcaagaattgatgggttttaggactcgtcatgttccgtgtgctcctcaaactgctgaggctgcaaaacttcaatcttctgatgctagtaagtttcttagtaatgcacgtgactgcgcattgagtgctc

SEQ ID NO: 1770 - DNA, 500 bp, Sorghum bicolor
  Clone ID: SORBI-28MAY03-CLUS30261_1
gcacgaggccgctgagcacgagcgccggcacacctccggccctccccatggcgcggcggcggcggcggcagcggcagcggcagcagcagcgctgggagccggagctgaacgaagacgtcaccgcggagatcctcctccgcatcccgccggacgagccagcgcacctcttccgcgcctccgtcgtctgcaagctctggctccgcgtcgcctccgacccggccttcctccgccgctaccgcgacttccaccgaggtgccccgctgctcggcttcttctacaatcccgattcctcagggcccttccctggcttcctctacaatcccgattccgcagcctcgtggcggccccaaccgaggcacggcaagggctgtgctagatgcgtctatgactgccgccacggccgcgtcctcctcggagagattagcaggagtaaacttgttgtctgggatccgttctccaatcactgtgaggagctgcaggcgcccagctccttgtgccca

SEQ ID NO: 1771 - DNA, 580 bp, Sorghum bicolor
  Clone ID: SORBI-28MAY03-CLUS30298_1
tgtctcgccccgctgtcgtcatcgacaacggcaccgggtacacgaagatggggttcgcggggaacgtggagccctgcctcatcacccccaccgtcgtcgccgtcaatgattccttctcctcctccggccagcccgcggcgaggggcgcccccgccagggggaactggctcgctcagcacagcgccggcgtcatggctgacctcgacttctacatcggcgaggaggcgctggcccgatcccgcgccagcacctcgcacagcttgagctatcccatccgcaacggccaggtggagaattgggatactatggagaggttctggcaacagtgcatcttcaattacctccggtgcgacccagaagatcattattttcttctaactgagagccctctgactgcccctgagacccgggagtatactggggagatcatgttcgagacgttcaacgtgcccggcctctatattgctgtccaacctgtccttgcgctcgctgctgggtacactaccaccaagtgtgaaatgacaggtgttgtacttgatgtgggtgatggggctacacacattgttccagttgctgatgg

SEQ ID NO: 1772 - DNA, 622 bp, Sorghum bicolor
  Clone ID: SORBI-28MAY03-CLUS30315_1
cgccaccgccgcgcccgcccgccgcgccggagctcgatctccgaaacgccctcggccgccttacctgtaaaagccccacctttagctagctacctcttcttcccctagctttgctagctagctagagaaggaaggaaacggtagctgacagacagttgattggtggtccggggtacggtgtgttcttcagtcgtgaagcgaccgtacagtgggctagggcgttctctccgggttgcgtgcaggatggtcgtcaagggcccggggtgaggaggagggcagctctgctcgtggtcgtggaggctaaatgtaccgcaagaacgactcggcactctcctgcttctacctcttcctcctctggttcttcttcttgaaatagaccaccagctcgccaggtagctactagctctagcagtagcagcccagttgcttgcgattggggatcggtcgtcgccgcccgggctctcctctcagctcgtttgtttgcaagtcgttggaagctagctagctagacgagggagatggagctggatctgaacgtggccgaggtggcgccggagaagccggcggcggcgatggaggcgagcgactcggggtcgtcggagtcgtcggtgctgaacgcgga

SEQ ID NO: 1773 - DNA, 603 bp, Sorghum bicolor
  Clone ID: SORBI-28MAY03-CLUS30333_1
gcacgaggcttgaatgaacaccatttccaacgattgcgacgcctcgcgcctccatcgaatagttgatccttgtcaggcctgtgagccgccggcgcctctgcctgatcctgctcagctcccgccggccgccgcttcggcggaggcctcacgcccctcaccgcgtccgcgcagccgtgcttgccctgatccaacccccgcctggctccctcgacctacggcgtcatcatcgacgccggcagcacggggaggcattctctgcctgatgcccggatgatagtttgaccatgctcgcaatccgttcgacgaaatgccctgtggcatttgtgggcgtagccggcgccctggtggtgcttgtcaccgctgttcatgtgttcatggtgccaatccttcctgcctccttggattacttcggtgctcgcagcagtataagccgcccaaataatgttcttccggccgtcggggtggtggactctcgtctcagggggcgcttcccttctgattcatatggcgccgtggcatttcgtggcgcgccatggaaggctgagattggtagatggcttgctgggtgtcatgccaactcttcgtctgttgatgttactgagg

SEQ ID NO: 1774 - DNA, 455 bp, Sorghum bicolor
  Clone ID: SORBI-28MAY03-CLUS30334_1
gcacgaggcaacccaccaccccttcttcccttcctcctcaatcacctctcaacgcaacccctgtcaaatcgccacgctgatcaggccgtgcaaaaatccaaactttttcgacaggaccctgctgctgctatactctcggacgcagaaatcctctgcttccgcttggcttgcgatgcttgtttgagtgcgcgggcctgcggtgaggtgaggcgacagcggcgcccggcggttgcatggtggttgatggtggccgatggagagtagacgaggagggtcgacggcggcggcggaagatgcgggcggggggatgccgagctttgggccacctcagcacgccatccacacagatgtgaacagcatgcaaccttctcgagttaccgactttggggcacttgcgcagtcagctggattccgaatagaagatcttgctaacctcaatgcaaatgctttgttca

SEQ ID NO: 1775 - DNA, 506 bp, Sorghum bicolor
  Clone ID: SORBI-28MAY03-CLUS30035_1
gcacgagggtaggccccacgaaacagaggagcatgaaggtgaggagatcggaccctgtactagtgcacgccactggtgatgatgcggccacccaagaatactacttcctctccaacctggatcagaacgtcgccgggctcatgaagacagtccacgtcttcagcgtgccacgtgagacgcgcatcgtcgacgacgtggcagcgctgctcagggactccctgagcagggtgctgtctcactactaccccttggagggccggctagccgtacgcgaggacgggagactcgccgtccgtcggaacgacgaccgccgccgcggtgtcccattcgttgaggcggtgtccgattacgagctccaccaggtggtcggcgatctcgcggcggcggccccgggtgctgaattccttggtggtgacctcgtctacgtcgataacgacatgcagaacgagaacgccctggaggcgccattgctgaccgtgcaggtgaccacgttcaagtgcgggcgg

SEQ ID NO: 1776 - DNA, 807 bp, Sorghum bicolor
  Clone ID: SORBI-28MAY03-CLUS30038_1
gcacgaggggcactgcagacctgcgccattttgccctttatgcctttgctgggcgtagtggcgaccgtagatggagccggaagaatgagaacatccagtcacagccatcagatgcttctgtgatgttaccacagcacaattacaaacttgatgttcatgccctcaatagtcatcaacctggtcagtttgaatgtcgtgaatttagagaatcgatccttggcatcatgcctcatcattgggataggagagaggatactaccctacaacttgcacattttaggaagcataagaggaaacaagttaagaaaacgcctggaaaggctgttattaatagcgtgaacaagcccacggggcacaatccacctgggaaggatgcttccaatagaatacctagagcgcttgggaaggctgcagatatggctggctcaaataaagccaggaaggcacagaggatgcagtacgttccgacaatcactaatcatactcaagtttggtgggttcctaatgttattgttgcacatgaaaaggaagggatagaggctgtccatctagcttctggacgtacaatatgcaagcttcatttaaccgaaggagggcttcatgcacatattaatggagatggagttctagatcatgtccacgttgttggtggaaatggtattaaagagcagactgtcgtgagtggatcaatggaggtgctgaaaccctgttgggcagttgctacatctggagtgccagtgcgggagcaactgtttaatgtctctatctgccattacaaccattttaatatggtccatcatggtgact

SEQ ID NO: 1777 - DNA, 648 bp, Sorghum bicolor
  Clone ID: SORBI-28MAY03-CLUS30381_1
gcgcagtgggcggggctctgcaatgggatggcggctggggtgatgctggcggccagctttgatcttgtgcaggaagggcaggtgtatggcagtgggagctgggttgtgtttggaatactcggtggaggtatatttatttggctttgtaagaagtttcttgagcaatacggagaagtaagcatgctggatataaaaggtgcagatgcaagtaaagttattcttgttgtgcgcgtggtgactcttcattcttttggagaaggctctggtgtgggtgtttcctttgctggctcaaaagggatctctcagggccttctagttactatagctatagcagtgcacaacataccagaaggcttagcaggagagcacggttcttgcatcttggggggtgtccccccaaaaggcaatgatatggagtatcattacatctttaccacagccaattgttgctgttcctgcattcctttgtgctgatgcattccagaaggtgcttcccttctgtactggtttcgcagcaggatgcatgatatggattgttatagctgaggttcttcctgatgcttttaaggaagcaactccatctcaagttgcttctgctggaacacttgctgttgctttcatggaaacattaagtacggtgcttctggg

SEQ ID NO: 1778 - DNA, 486 bp, Sorghum bicolor
  Clone ID: SORBI-28MAY03-CLUS30383_1
ttcggcacgaggcctttctccgcccgcacgcctccgggacccggccccaaccatggcgacccacggcggcggcccgcgcccctgccacctcctcatcctcctcgccgccgccgcgctctactccgcgtcctcccccgccggcgccttctacctccccggcgtcgccccccgcgacttccagaaggatgatgaacttcaagtgaaagtcaataaattgtcatctataaaaacacagcttccatatgactactatttcctggattactgcaaacctgaggcgattaagaacagtgctgagaacttacgcgaagtccttcgtggggaccgcatcgaaaattctgtctacaatttcaagatgaggagggatgagagttgcaaggttgtttgtcgaaagcagctttctcaagaagctgcgaagaatttcaaagaaaagattgatgatgaataccgagtaaacatgatcctagataatcttccagttgtggt

SEQ ID NO: 1779 - DNA, 194 bp, Sorghum bicolor
  Clone ID: SORBI-28MAY03-CLUS30398_1
gcacgagggccgcacccgcgtgggccggcccagcggcctcaaccggagccgaagcgccattgatgagcccagagcctgccgtcgccgcagccaggcgatgcacaagctcctcccacgcgccgcctccttcctcgacgccgcggcccccgtgctgctctcctccccacgcatgcccacgctgtgcctgggtggta

SEQ ID NO: 1780 - DNA, 658 bp, Sorghum bicolor
  unsure (1)..(658): unsure at all n locations
  Clone ID: SORBI-28MAY03-CLUS304_1
cgcgtccgcaacctccagggnanactcgctgtcgcctgcgcgggcgcggggggatcgcggcacctcttcctggcgaacaacatcagcttcgtactgagccgcgtcgcggacggcgacggcgtggcggccatgctcggggccgcgtttgccgcgcggcgacggagcaggctcgagcagcacctagcgagctacgccgcgtcgtcatggggccccgtcgtcgctctcctggacacgcccgtgtgtggcagaggcaagccggcgaaaattctggcggagttcaacgccgcgtttaccagaacgcgcgacagcgaggtgtgccgggaggtcccggaccccgtgctccgagcggtgctgcggcacgccttgtcggacatggtggttcctgcttactgcgcgtttctgcagaagcaacccaagctttggaaatctgtcaggtacacggctgatgatctggccgagtcgctgtcggagttgttcgaaggggaagttacggatgccagaaaaatctagtgcttttgtgaacgtagaacattttcaggttgtaccaaactgacgaccgcttgaccatctgtaaaactacactgcaaagttccatttcttcatggatgctatatatagcaaccagtagtagcagtcagagttctttattagcatgcac

SEQ ID NO: 1781 - DNA, 521 bp, Sorghum bicolor
  Clone ID: SORBI-28MAY03-CLUS30411_1
ctttggttcagccgaaaaatgttgaatagagatcattttatagcaaggcattcagtcattctttgcttaatagaaaaaaattgaagctttccatttccacttatctatgccaatgcattgttcaatttcaatttgtagcagaaccactcacaataattaactcatggaatcccatagctagtgaggacttgtttcatttacgctcttgctcccttcaaagaatttttttttttacacaattaaaccaaatatgctgaagatgaagatattttcttgtaaaaaattcagcaaaaccatctgtaacatgatcccttcctttacactttagcaaaccttacaggctcactttgcaaccttatttagttattccccaaaagtttacttgtgctgcttgatctctgtgaccacacatataaaggcatttgggacatttacacaaataggtggaactttgactagaaaattatatgaaaatatgatttataagatgaagatgattatgtcttgaaagtacttttcat

SEQ ID NO: 1782 - DNA, 581 bp, Sorghum bicolor
  Clone ID: SORBI-28MAY03-CLUS30402_1
gcacgaggggacagcactcttgcaactcttttggagtgcgtccattgcatcagtgccactagagtcgtttataatcgtctctacgtgttacggcgcctggccttgctgcggaggaagtaggaaggagagacgggggagtgttggcgtaggggtttgcggcgagctggagccgtgatctgctatttgcggcaacggaggggacgaggaacaggagcgccaggcgcctaagggagataagaatatctcaatcccaggctgaccttctattattccatatggttagcctttataggcattacaagacctgccaataatatggctaaccgactccacaagtcctggactcctaaaacaactcttaaccaaccaatctaacttaacttagactctaactcttcctgctatccgactctgtagacacagctcatgcatgtgcgcctagaattaggactcccaatcatgacctgaccgcatgctgggattagccacgctgcctacgatgataggtcttaccgaccataacacatagacttcagttgaaatacattagtaagtgctatatttcacttatatctgcatag

SEQ ID NO: 1783 - DNA, 469 bp, Sorghum bicolor
  Clone ID: SORBI-28MAY03-CLUS30444_1
gcacgaggtgcagatgtcagagcagttcaaccgggagctatcgttgactgggaaaattccctccggcatgttcaatagcatgtttgatttttctgggtgctggcagaaagatgcagctaacaccaagtcacttgcctttgatggttggtacatttcgctatacaccgtcgcgctatcaaaatctcggatcctactgcgtgatcatgttactcacgcagttccttcaacctgggaccctgctgctttggcaaggtttattgaaaagttcggaacacacatagttgttggtgtgaaaatgggagggaaagatgttatctatttgaaacaacaacattcatcaagcttgcaaccagccgctgtccaaaaacgactcaaggacatgtcggacaagagatttctggatgcaaacggacagtatgacatgaataacaaggatgtttatgggaaggacaagcatgatgcaagagac

SEQ ID NO: 1784 - DNA, 383 bp, Sorghum bicolor
  Clone ID: SORBI-28MAY03-CLUS30149_1
gcacgtggcgcggcgccccccgtcccacctgctcctgccggccctgccctctgcctccgtcttcctcgccggccgtcgcggccccccgccacaagcaaagaagaactcaggatctgatgcttcttcagacactgaccatgtgaagtaccttgaagttcttgagagtttaccagataagaaaggagcagcatctgaagctagttgcgctgttcgagaagcagacaccaatacaatcgaagctaggtcagaagagagatttgtacccaacagaatggtggcggctgcacatagccaatctggattcagtttcgatgataaccaaactacttgtgcacccagctgcaccatgaagcttgaacctgctatcagagatgacaacaggg

SEQ ID NO: 1785 - DNA, 628 bp, Sorghum bicolor
  Clone ID: SORBI-28MAY03-CLUS30220_1
gcacgagggttctgccgggcgcgagacgcacggggcgctggagctcctctttggtggtgagttggatttggggggaaatcttccatcgctcttctgccttcaaaaggggatgtctttttcagatgacggaaagatgaagggctgtcagccaaacctttttcggacaaaggataagaaagtcgccaagaggacagaccgtgcaggctgctccacatctaagagtggatcaagcaactcaaagtcaccatcttcatcccccttccggaaactttcagaagttaggagcatacgtctcagccattttctaagtcactcttcaaatgctacaaaatatgaacatgttaggatatttgtctccacatggaacgttggaggaaaagcgcctaccgccgagttgaaactggatgactttcttcctgctgatgaccattcagatatttatgttttaggttttcaggaaattgtgcctctcaatgctggtaatgtccttgtgatagaagataacgaaccagctgcaagatggcttgctcttataaaccgtgcactaaatcaaccagttgacactgatgctgatatatttcagcacaaaccatcgccctccctggattcacctcatcccagtcaacac

SEQ ID NO: 1786 - DNA, 519 bp, Sorghum bicolor
  Clone ID: SORBI-28MAY03-CLUS3024_1
ttttatatacacgaatttctgaataaaatcaccgcataattcatgacaatagcactggtcactgcagtatttacaactacattttccatagtaagattggaacgttacaccacaggtgcaagttattggatgcaagtattcggctacacccgttgaatcatcaacatagcatcaacagggattggcagagtagacgcacacggtacacctgatgttaagctaaactgttaaagctgccgacaacccttccaactgtgatagatactgacagacgatgaagaagcagatttttttcagtttcacttgtgaagaacactccttttctgcagtttgattttcttctgtggttgagtctttcccttctccaaagattcgaagtctatcctgttcttccatgtgctcttccgtaatttgattggccggtttccgacatatttaccattcatctccttcaaggcagaagtaagatcagatgcattagcaacactaacccatccatatctgttcggttgcgagagc

SEQ ID NO: 1787 - DNA, 573 bp, Sorghum bicolor
  Clone ID: SORBI-28MAY03-CLUS30504_1
gcacgaggccttcttctcttcgacggcttccacacactcgccggtcgccgccctccccgctcccttcccgtccgccgtccgagtggggttgcctcctccataccggctagggcaggacacccaacgcgccaccttgtacggcctctgcctggtttgacgaaaccccagaagcttccggcgctcgcgctagcctcgttctcccccaagcactgtttcgccgccgttcgatagccgaggccagacgcggataagtctctctcggagatgtcggtgctcatcgtcaccagcgtgggcgacatcgaggtggatctccacaccgaccggtgccccctcaccaccaagaacttcctcaagctctgcaaaatgaagtactacaatgggtgtttgttccacaaggtggagaaggatttcttggcacaaactggcgatccaactggaactggcaccgctggcgattctgtatacaaatatctctatggtgatcaagctcgattttttgatgatgagatccgtccagagttaaggcattcaaaaactggaactgttgctatggccagtgctggtgaaactgca

SEQ ID NO: 1788 - DNA, 546 bp, Sorghum bicolor
  Clone ID: SORBI-28MAY03-CLUS30507_1
gcacgaggctcacttgggtggtgaggactttgacaaccgtctggtcaaccacttcgtcaacgagttcaagcgcaagcacaagaaggacctcactaccaacgctcgtgctctccgccgtctccgtactgcttgcgagcgggcgaagcgcactctctcctcggctgctcagacctccattgagatcgactcgctcttcgagggtatcgacttctacacctccatcacccgtgcccgtttcgaggaactctgccaggacctcttccgtggcaccatggagcctgttgagcgtgtcctccgtgacgccaagatcgacaagtcttccgtccacgagatcgtcctcgtcggtggttccactcgtatccccaagatccagcgtctcgtctccgacttcttcaacaaggaccccaacaagtccatcaaccccgacgaggccgtcgcctacggtgctgccgtccaggctgccatcttgtccggtgacacttcctccaagtccaccaacgagatcctgctgctcgacgttgcgccgctatccgtcggtatcgagac

SEQ ID NO: 1789 - DNA, 615 bp, Sorghum bicolor
  Clone ID: SORBI-28MAY03-CLUS30523_1
gcacgaggcaaggtcctacggccagtgggcccgtggccggtacctagccctctccgggaatgagctcaccggcgagataccggaggagctcggcaacctgacaacattgagggagctgtacctcggctactacaacaacttcaccggcgggataccacccgagctcgggaggctgcgggcgctcgtccgcctcgacatggcgaactgcggcatctccagggagatcccgccggaggtggccaacttgacgtcgctcgacactctgtttcttcagatcaacgctctgtctgggaggctcccaacggagataggcgcaatgggggcgctcaaatcgctcgacctgtcgaacaacttgttcgtcggggagatcccagcgagcttcgcgtcgctcaagaacttgacccttctgaacctcttccggaatcgcctcgccggtgagattcccgagttcatcggtgacttgccgaacctcgaggttctgcagctgtgggagaacaacttcacaggcgggatacccacgaacctcggcgtggcggcgaccagtctgaagatcgtcgacgtgagcacgaacaagctcacaggcgttctgccatccaagctgtgcgccggcgagcg

SEQ ID NO: 1790 - DNA, 479 bp, Sorghum bicolor
  Clone ID: SORBI-28MAY03-CLUS30562_1
acatggctatccaaaacctgcagtgcttcccgagaagtgatttcagaagtacccttgagagtatggtgaaatataaccttgaaaggattgaatagatggattcagttgattcctgtaccagtccactagatacaggcctccagtatggtattggtgtaactccaaaacccatcttttcagccccttctcggaagatacggtttcaaagaaagtactaggagaaattgatctatttcatactattctggggaactcctgtgaagcaggccagagttatcttgttgattatatgagatgatttatgcaggatcatcagaaagcaaggacctagctgcatactcttacgcgttgagcctgcatctgagtattctacttttgcagctcttgtaaatataaggagcttactgtatcctagcattcttttatttttgctatctgcgcaacaaattaagtgctatacttgtatgggaacataacag

SEQ ID NO: 1791 - DNA, 585 bp, Sorghum bicolor
  Clone ID: SORBI-28MAY03-CLUS30526_1
cggcacgaggtgccggacgtccggtcactcgagcgatggcggagatcgccggcgacgaggccccaacgcctcctcctcctcctcccacctccggcgaagcctccagagacccgcatacttctactcctgcctctaccggcagcaacaagccgccgttgcgcacgacgaagcccggcgtgaagcgcctcattctcaccgcctccgtcctcctctcctttctcgtcggactgcccttcctgctgaaatctaccgagatccatcgttcgccgctgccttcggacgcaattacggcactcgcccaccgcctccactccactccgccctccttcccatgcagtctccacgcggtcttcctccggtcggttcccgatcgctctgatgcctccctcagccgtcgccttgagcaatcgatttcggcccagctccagcttctcccagccacatctactgccggtaatgtctcggtatcagtcaccgttgagttggctggtggctgctccagcagcagcagcagcagcgttggctcagattggcagtgtggcactgtgaccagtgcagacctggtgattggcgatgaggtgttcg

SEQ ID NO: 1792 - DNA, 606 bp, Sorghum bicolor
  Clone ID: SORBI-28MAY03-CLUS30569_1
tggatagatttgatgagaagcctgttgatttccaaatcagggtaaaagaaatggctggcgccaatcttcaatttgcagtgaaggatggttgcactatctttaattgtaccactaaatatactggtggtaaaggactactcattgttgttgatgctaccatgcccaagcaaagctatgtcagatctggacaaaaagatgaggagcgcaagctgaagctaaagcagggctcaaataggaaataactggtcatcaagttggataacaccattggatgatggtccccagccgttcttctaatgttgcctcaggtcaagtcggatagcacccctgaatgattacccccagccagttccttttttttttttttgactttccacagccagttcttcaaatactcattgcactctgtacccccccatgagtgatcagacaatgttcctttgtctgctttgccgagacttcgtccccttggtttgacagcactattctggctagtggctatggcgctatatttggttaggctctggtaatagtagcttctgtttgacagcactactcagttgtaacatacaaaattttgggagcagtactttgcactggtaagag

SEQ ID NO: 1793 - DNA, 562 bp, Sorghum bicolor
  unsure (1)..(562): unsure at all n locations
  Clone ID: SORBI-28MAY03-CLUS30579_1
ggtttctgcatggacctgtggcattaaggaactgcaagctcttaccattttctttgtagggagcatatttggtcccattctttcgttgcagatcattgcattgattcttcattggaaatttcactgaagtatttgacttacacatcttcattgaaactttccttcgcaatgacagtaggttatgttatcgggcaacttctttttccttttccgttttctacatttgctccataataggttacagtgctatcatctgtaccgtccattttaatcttagagcatcaataggctgcactgttcggtcagcttggggcatcatgaattctgtggcgtgtggctgctctgaagaaggatgattatcaggctggatcaggactgcacctgtgtctgtgggatgaagcaggcttggtatggacgttgacgaatccgagctaaccatgtcttgtcagtaaaatggttgtgctgtatcttcggtggatttgcattttcttgctgactcttgttgggaatgggaggaatgatgntttaaggtgcagaacgtctgccttaattaatgttatat

SEQ ID NO: 1794 - DNA, 607 bp, Sorghum bicolor
  Clone ID: SORBI-28MAY03-CLUS30340_1
gcacgaggcccggttctacagacacagacacagagcagcgctgcacatcgatctccaatcccgtccagaaacccgcgctgagaaaaacctcacggcaactagggttcccggcgagggcgcgcgcgtccatggcgcggagcaggcgcggcggcttcggcggcggcggcggcaacgtgaaggtgacgccgaacctggcgtgggaccgggaggggacgcggatgctcaacctcagcgtgctgcggcgactcgaccccggcgtcgccgacatcctcatcaccgccgcgcacgtcgtcgcgtacagcttcgacgagggccagggggagtggacccggaagcctgtggaggggtcgctcttcgtcgtcaagaggaacacccagcccagattccaatttatcatcatgaatcgtataaacacagaaaatctagtcgaagatctcttgacgagttttgaggttgaggtgcaaagcccctacttgatgtaccgtaatgctgctgatgaaatcattggaatttggttctatgatccacaggaatgtcaagaagttgcacatctttttagcaggatagcatatgcatattcaagggcgtcacccaagacaaatctttc

SEQ ID NO: 1795 - DNA, 903 bp, Sorghum bicolor
  Clone ID: SORBI-28MAY03-CLUS30336_1
gcacgaggcacaaaggagggatttgctgttgcagctcgtgattgtactcatactttcatagaaaagttcgataaaggatctgaagatgctgctattcaacaagtgaaatgggacccctcaaaagttaaggataagcttaagtgtgacattgaagcacatgtggcttcagttcgtgcagcaaagttatctgaactttgtgccaaatatgaggcacaacttacgaaagctctggcagaacctgttgaagccctgctagattcagcctgtgaagatacctggccagccattagaaagctgctccaacgtgagacaaaagctgctatttcaggtcttgaatctgctctttcagcttttgaactcgatgaagcaactgagaaggaattgcttgtgaaactggaaaaccacggaaggagtgttgtggaatcaaaagcaaaagaagaggctggaagggtcttgattcgtatgaaggacaggttctcaactctattcagtcgtgatgctgactcaatgccaagggtgtggacaggaaaggaggacataaaagcaattactaaaactgcacgttcagcttccatgaaattgcttgctacactggccgcaattcggttggatgaggatggtgacgacatagaaaacactctcaaccttgctcttgttgatacttcaagacctggaactactgatagaagtattcaatcatttgatccacttgcctccagttcgtgggaaaaggttcctgaggagaaaactttaattagccctgtccagtgcaaatctttgtggaggcaatttaaagctgaaacagaatatacagtcactcaggccatagctgctcaggaagcaaataagaggaacaacaactggctaccacctccctgggcccttgccgcaatggctatcctc

SEQ ID NO: 1796 - DNA, 526 bp, Sorghum bicolor
  Clone ID: SORBI-28MAY03-CLUS30368_1
gcacgaggcggcctccagagtccagacccaggcttgcgctgctcctgccgtctcctccttcccagacgaggccgctcgccccgccgcgccgccacttattcgattcgattcgatccggaggtctgttttacctcgcgcgtccaaccgggcacgcgccgaggatctgatctcgcgcgcgatcccggcttcccagaatcgttcgaggcgtctcactcaggaacgatggaaatgtacttggtcgaggacctggatttgcttgacgacgacgacgagttcggcgggtttggagtcaccgtcggcagcggtacccccaggccggataagcaaacgtatgatacttctgctggggagtacagaaatgggaaagacatgcaagggataccgtgggagaggctgaactatggtagaaatgactaccgtaggatgaggttgaaggagtacaagaactatgagagcctctccagatcacatgagttggtggattaggagtgcaaacaagtggacagaggaagcacattctatgatt

SEQ ID NO: 1797 - DNA, 639 bp, Sorghum bicolor
  Clone ID: SORBI-28MAY03-CLUS30376_1
gcacgagggagaggtcagagactcgcacgaggggaaagtgaggaggaagggaggcgattttgcgggcgccggtggtggaggaggaagcagtcctgcgcggcggctgtgagaattagagtaatctggactgataaagcactctggcaagatgggcgacaatctgatggataaagtcaacgcccttggtgagcggctcaagataggcagtgcagaagttagccgcaagatgtcagttggcgtcagcaacatgagtttcaagatgaaggagttcttccagggccagaacatggcggacaagattgttgatgaagccacgttggagaccatggacacccctgattgggctaccaaccttgagatatgcgacatggtgaacactgacagggtcaacagcattgaagtcatccgggccgtcaagagaagaattatgttgaagaatccacgcgtgcagtatctatctctcgtcctgcttgagaccattgttaagaactgcgacaaggctttctctgagattgctgctgagcgggtgctggatgagatggtcaagctgattgatgatccacagactatagttaacaacagaaacaaggctcttatgcttattgaagcatggggagaatctggagatgacctccgcta

SEQ ID NO: 1798 - DNA, 669 bp, Sorghum bicolor
  Clone ID: SORBI-28MAY03-CLUS30613_1
tgcatctggatgtgagaggagctggagctactttgagcatgtgcactctaaaaagagaaataaactagagcatcaaaggtttaatgatattgtgtatgtgcattgtaacctaagactgcgtcaaaggtccaaatcctctactagaaattatgacccaataagtttggaagaaattggaaagggaatgaagcttggattttagaagatgatccacctcgccttaactcagaagagctagaagcctttcgcactgaattatctacactgagtatacaatgtagtgatgatttggtgttaaacttggatgccttggaggaaagcgatgagattatggaggaccaaagcctaaggcatcaggaagatgcatttgattatggtggtatttcacttgatgttggcagaccaagtcctggtggtgctgatgctgcagttcaagatgaatgggatccactgaacttttattgagtcccatcctatatgggtttctatcttatcatcacgcacttgatatttgagttatgaacttgtgaggctatgtagctgtctgatactcagtagtgagtactgaatactatgattctatatttctgtgatgtgcgaactatgtgcgaagtgaagtgtgacccttatgttatcagtttatccctcactttgtattttaaatttgag

SEQ ID NO: 1799 - DNA, 701 bp, Sorghum bicolor
  Clone ID: SORBI-28MAY03-CLUS3062_1
cgtccggccctgggccagtttctagcacactccaaggttatgccatggccaacatgctcttctacagtggtagcctgctttggggagcggataggactgatcctgtcatgaaattgtctttcctctggaggcggccacgggtggtgagaaaacacatggattttatagctggtgtattggacggacacattcttctgggctgtgacccgggtacctggaaagcgtatgtgtcgcaatttatgttcctggtggtgaagtttgttccatcatggttgcgggatataaagctggaaacgctaaagaagatagcagctggacttcggagttggcatgaacatgaccttgctctatctcttcttgagcgaggaggaccgcaggcaatctctcttgtagtcgaggcctttatgtgatcctgccatttggacatcttgtccccatctgacatagcagccgttgttagagttttgagggtttgagattggtgagtagaggtctagctgaagtaatgagggtaactcatccagaattccacttgagctatcatgataactcttccagaattccacttgagctatcaggataacagaagttctcatgtatggcgagcccttcagggtttttgtgaatccaatactgaagaacatgcaacctactaggagtgtattaacttcagcccgtaacatgtaatatatggaaagttc

SEQ ID NO: 1800 - DNA, 592 bp, Sorghum bicolor
  Clone ID: SORBI-28MAY03-CLUS30634_1
gcacgaggctggtcttggcctctcttctgtggcaactctccaagccttccaacctttctttgtggagctcacaatgccctactctgtgatccgtggagaagccttcacgctcaaggccactgtgatgaactacctccctacaagcttgccgatggcagtgcagctggaagcttctcctgatttcacagctgtcccagtgggaaacgaccaagattcttactgccttggtgccaatggaaggcacacctcatcctggttggtaactcccaaatctttagggaatgtgaatttctctgtgtctgcggaagcacaacagtccccacagccttgtggttctgaggtggccacagtgcctgaaaccgggagaaaggacacagtcgtcaaagtcttgatagttgaggcactcagcgctatgagttttcctcttagcacagctttcattgtgtcccgtaagtttggcctgaaggaatcaagagagagcatactttcagctcactgctctgtgcatcagatgctgagctatcagaaacattgtctctgctgcttccaccaacagtagtgaaagattcagccagagcacatttctctgtga

SEQ ID NO: 1801 - DNA, 459 bp, Sorghum bicolor
  Clone ID: SORBI-28MAY03-CLUS30660_1
gcacgaggctgggaggacgcggcccggggcacgccgcctcgactcgcctcggccctcgccgccatggccggcgaggccgcggagagggtggccgccgccgtggaggcggtgggatccggtggctgggagttccggaacgcgtacaggcgccagctgctggcgctgtcgcggcggatccggctcctcggcccctttgccgaggagctccgggaggcgcgccgtgggcggcccgcggaggaggaggaggaacaggagcgggcgctggcgccgctcgccgacgcgctggaggaggcgctcgacctgctccagctcggccgcgatggcagcaggatcttcctggtccttgataggaataaagtaatgaagaagtttcatgaatcaattgctcagctggagcaagccttgtgtgattttccatacgataaattggatatatctgatgaagttacagagcaggtt

SEQ ID NO: 1802 - DNA, 395 bp, Sorghum bicolor
  Clone ID: SORBI-28MAY03-CLUS30640_1
gcacgaggggagcggcggcgattcggagggggcaagcgtcagtggaggcccttcagctgcggagcttcgccgcgagctgcacacggcgcttggcaccgccaagtggcagcttgatgaacttgcgcgggcaatcagatcgaacgacctggttatctcagcaggaaaaggcacaagagctaggcatgatgactttgttatggcaattggccatcgcatattagaggttgagaaaaacttgagagaatccaatgttgcagaggggagggggccgttgagctgggttcatttggatgaggatgaacgggatgaccttgcagctttcctatctgccagtccttttcaacagaaagacaaagtggtcacaattccttcagcaggtgatattgaagtgggca

SEQ ID NO: 1803 - DNA, 1088 bp, Sorghum bicolor
  Clone ID: SORBI-28MAY03-CLUS30665_1
attccgagcaacccagcgagctcaagaatcgccaccgtactacctctactaccagtctaccagcagaggaggattggaacagaggatccatcctccatgggtagctacaagtacaagtactgcatgtgcttcacgcgcaagttccgatccccggacgcccagccgccgcccgacgtccgcgccgcctacctctccttcgcctccgacgtccacgccctccgccgcttcctctcccaggcgcaggccgagcaccccgccgacgtcgaccgcatcctcgccctgctcacggctgcctcggtcggacatggcatcgcccgcctcgtcaccaggtcgccggcgccggccatgcccacgctcgacgacttcttcgccttcctcttctcgccggaactcaacccgcccatgggccctcctcaccaggttcaccaggacatgtctgccccattctctcattatttcgtgttcaccggacataattcttacctgactgggaaccagctcaatagtgactccagcgatgtcccaattataaaggcattgcagaggcgcgtgggagtcattgagctcgatatgtggccaaattcttcaaagaccaatgtcgatattcttcatggagggtatgaattctgttttccaaacacattcattatttttaccacatggaattattggtactgcaagtaaatacaactgcttatgtgtgatgatgctattatgggtgtggtgtgaccagtactcaaagctcccaaaacaagatggcattatgggtacacatgaagaaaacacatattattcatatgtagcatggtattcctagcatcactctttttccaagaggaaggatgcattcagttcttttgtagcaagaaacatatttcccctgaaataccactgcatagttctatatttgtataggccagtttgtccatgcttcttgaatttgcaaccatcctttttgtcctctctggctttgcaaaaattgtctccccgactcatcttttttcttggcattttaaaggacgttgactgcaccggtagaaatggtcaggtgtttgaagtccattaaagaatatgccttttgtgcatca

SEQ ID NO: 1804 - DNA, 525 bp, Sorghum bicolor
  Clone ID: SORBI-28MAY03-CLUS30699_1
gcacgagggttccaagtccctcggcagtcagcaccgcatctgtctcgcgctccggctctctgtgactctgtcccctcacggccgtagccctttccaagggatatcggagggagaggagggggaggcgggagcagtaggaaggggcgttcgtgtcgtgggtggagaagatggagaacctgaggaggctcctgaatccgctggcgctcaacctgcagaagatggagctggagctcacctgccccgtctgcctgaagttgctcacctcgccgacaacgctgccgtgctaccacacatcctgcagcaagtgtgcccttacaccgacttcaaaaggttacagctgcgccatttgcaaatctggctattgttctcaagatttaaggccagcttctcatctcgagtcgatagtgagcattcacaggagcctcagctctaccgtatgcaccatgattgaacagcaggatgctcaagttaacattcctggtacatccatttcttgcataatataaactccaagcactggcaata

SEQ ID NO: 1805 - DNA, 572 bp, Sorghum bicolor
  Clone ID: SORBI-28MAY03-CLUS30449_1
gcacgagggtgaagagttgatgtgggataaagttgcaaaatcagaatatggctctttgttaagcatggatggttctttagacacatggtcgtggagtctcaatgttcctgtgcttaatagcctttcagaagacgatgaggtagcacgaggctcccaggaacatcgagatgctgtagaatgctacaagcaacagaggaggaaggtttcacatttgaagaaaacaataaggagtactaagggtttcaaagaattccaaaagatcatcgacataagaaattttacaaaagagaagattgagcgtttggaagctagatcccgtcgcttgactcgacggataagacaaattgaaccgaccggttggaaagaatttctccagattagcaaagtcatacaagaggctagagcattagatatcaatactcaggtaatctatcctttgggtgagacggcagcggctatacgaggggaaaacgagctctggcttgctatggttctaaggaacaaggttctcttggatctaaagccatctcaactggcagcagtttgtggaagtttagtctcggaagggatca

SEQ ID NO: 1806 - DNA, 525 bp, Sorghum bicolor
  Clone ID: SORBI-28MAY03-CLUS30467_1
tcccgcaagaacctctgcgtccacccgcaggcgtccgccgccgcggcgcgggactccgtcgacaccggctgccgacgcctcgcgccggcatgggtccgcgagaaggccgcctccgacccggaatccaccccgctgtgcgagttctacgagacgttcgatcgggccgctgccgccggcgacctcgcctccttcatgccgcctggggggtacactctcgccgacctccgcgcgctcgggagggagcgccgggtctgcccttacttccttgccaggcagatggtcaagtacgccaatgttgtcgtgtacagctaccagtacctgctcgaccccaaggtggccagcattgtgtccagggagatgcagaaggagtgtgtggtagttttcgatgaggctcacaacatcgacaatgtctgcatagaggcgttgagcgtcagcatccgcaagcagacgctggaaggagctgagcgaaacctgcggcgcatctcgcaagagatcgacaggttcaaggccactgatgccaatagg

SEQ ID NO: 1807 - DNA, 450 bp, Sorghum bicolor
  Clone ID: SORBI-28MAY03-CLUS30486_1
gcacgaggccgcgggccggtcgcgccacggggcggcggtgacgcctcgctgcggccgtcgccgcagaggtggagctcgccctcacccggttttttgctggagctcgagtcggttcgggtgtgaggtgatgtacaggtgctagctgttgaaggcaaagaagaaaagactatcatggggatttcagctaagtggatcaaatcacttgttgggataaaaaagcatgaaaaggggcgaaacgccgaatgcagcgatgcgaggagctgtgttgttcagttgctacacaaacaggagcattctgtaaatacagaaagtgttcctgtggctgaagaactcagagtacaggctgaaccgttggcaggtgacataaacacagagacaatatcaaattccgcttcctcaccgagcacatctcttcaagttcaaatttctcagactgaacttggtacaaag

SEQ ID NO: 1808 - DNA, 590 bp, Sorghum bicolor
  unsure (1)..(590): unsure at all n locations
  Clone ID: 30967614
agctcgatgtctcgatccctctctcctcaccccgccgccgccgctgcctccgcccctcgctgcgcagccttcacacagccatcgcttaggcatggaagccgcatggcctctacggcatgagggcgcacaagaccccgggcaaaactctccggcccctccctagcctctcctccacatgcagcatgctgggatgcccttgaccaccaccgatgtcatcaccgcttggatctcggccgctggcattcttggcctccggcagaggggcaagagggagatcatctgccgctccttcccaagccatatccttctcccacgagcattttgtctaagataaggcctcaacaatcgcaaatcctatcacgacgggagtagattgaggtgtctaccagcaccactgtatgtcccttttgcttttagatgtcctcagtgaggtggcggccttgactcccctctcttaatctctcaattccacatctggtatccttcaacaaggtacaggcgtcatcttctgatttctttccattnctctatggttccattcatgctggaggatgactcatgatgtggaaccatggagcgacagcctgcac

SEQ ID NO: 1809 - DNA, 396 bp, Sorghum bicolor
  Clone ID: LIB3481-017-P1-K1-G12
cgtccgtgaggtgtctaccagcaccactgtatgtgtgagtcctctccccaagcgctctagatctactgtcctaggctgataatctacttctgctccagcccttttgcttttagatgtcctcagtgaggtggcggccttgactcccctctcttaatctctcaattccacatctggtatccttcaacaaggtacaggcgtcatcttctgatttctttccattcttctatggttccattcatgctggaggatgactcatgatgtggaaccatggagcgacagcctgcacaacgcacatgtgggtaagcagcaagcagtaagccatatccattttgttttctaatctggctcttcaaattggcttgatttgtacagcctcatgtgctcgggcctacaact

SEQ ID NO: 1810 - DNA, 644 bp, Sorghum bicolor
  Clone ID: SORBI-28MAY03-CLUS30725_1
ccgtgggcgcgcacctggcgtcggggtcctggacgctgagccgcgagcaggggaacaagctcctggccagccgcttccgcggcgaccggctctacctctgcgactggccggggtgcgtgcacgcagaggagcggcgcaagtacatggtcttccgcggcgtgttccacaacttcgcccgctcccaggtgcggcgcgcgctcagggacacgcgccgcccccaccgtcgccgtcgagtgcgccttctgcggctgcaaggaggcctgggacctctactccgccttctgcctccgcggtttctacggctaccgcgccggcggcgagcccgtcgtgcgcgcctacgtctgcgagaacggccacgtcgcgggcgcctggaccgaacgcccgctctactcctgatcttggagtggccatgccactccgactgacatggtattgtattgcttcaaagactgccccccatgccattgccagatgaatgatgctcctagtagcatatgccttctgctgtttctagacataattatgcgtgtctgcatatagcagaaaatgcggattttcgtaatgttctggatatttatagagtatatatgtatggaggatgtgtattctttcttcttgttgttgtttatgaggatggctatgag

SEQ ID NO: 1811 - DNA, 749 bp, Sorghum bicolor
  unsure (1)..(749): unsure at all n locations
  Clone ID: SORBI-28MAY03-CLUS30727_1
gcacgaggctggaggctgcccgaagttctggtgatccacctcaaaaggttctcctacactcagttcacaagaaacaagctggagacattcgttgacttccccaccaccgatttggatctgtcatcctacatcgctgacaagagcaagcagccaagcagccattatcgcctgtatgctattagcaaccactacggaaacatgggagggggccattataccgccagcatctatcacgaggaagggaaggggtggtataagttcgatgatgactacgtgactcctatgagcgaagacagtataaagacctcggctgcttacgtgctgttctacagacgagagtgactgaggatacaatacaatggcattttctgcttgcggtggtttttggttggcaactccagtctaatctccagaacactcctccncccctccctacacactgctgcttcagacgtgtccgagtttcctaacatctcggcatttgaatctctcaagccacactgacacctaccaatgatacaacagcattctgtacagattcatctgccaacaggagagaagagatcccaaagaaagatgtagctgatgcaatgcaatattctttttccccccagcccacacagtatccttatatgggcaacattcttttttcccccccttagctcacagtaattcttatatgggcagtacatggaccagacccccaacattgtaattcctcccaactccattcaccagtcaggaaaggc

SEQ ID NO: 1812 - DNA, 644 bp, Sorghum bicolor
  Clone ID: SORBI-28MAY03-CLUS30742_1
actttttcctttttggtgctgtggctctcctgattgctgggctgcggtttcagagtgctgtgggtctgttggcgccgggcccaagactggcggacgtgcaggactgtggccgctggcgggtcttggggacctgcatccagggtggcgcgctgcgttctgggctagcaaatggagggtcgggtcgcgcagatgggtgccgtctgggcatggtctccccccggttccttgggtgcctgggcaggggtgatggagccttccgtgttcgcggctgctgctcaaggtcctcggtcctctccaccgctgcttcatcctggttcagctgcgtgcggacgattcagcagtgcgccttggtcctcggggatgcctgcccggtcggcctgcccttgccacgtggataccggcttcttgcgccgttatttctgtcacccctctcgctcctgctgcagtccgtgactccgtcgttgggcctctgcccctgggcgggttgcgcccggcccctcaggtttgtgtagacaaaatcaggcaagatgaggtaggcatcgataaatgctggtcaccgtcgactatgcatggtatataattcatctgttgtaatattcgcagcgctgttcattaccttgcccgaatatggttttgttgtgtgt

SEQ ID NO: 1813 - DNA, 616 bp, Sorghum bicolor
  Clone ID: SORBI-28MAY03-CLUS30746_1
attaactcagttttcttctcgtataatgcaggattacaaggtgagactgttcctgagattattgcaagattgaagagggatctagttcccaccatcaaaagtgggcttttgtattggccaacttgtgatttcattactttcaagtttgttccagttcatttacagccactagtgagcaattcattctcatttctttggaccatctacataacatatatggcaagcttaaagaaagcagatgtggaggtggccacgagtacctaactgctgtcaaatgactcaacatggctgttatctgtcgattctttgtacaaggcagacttaatgtgtgcctcttggaactaggatgtttctgccgttttatcgaccaacgattttaggctctagatagatggattgcttccaatgcatccttcacttttgtttagagtatagtgtccacagggattctacttgccaatcgtttttggccgaagaccattttgtctggatgatcaaattatactaggtcccttggtcttctgtgatatctttgtacggtctttgatcctatgggtcaaaagtacatttacttatactaaaatctctgtatctagttatggagatgtaagtgaac

SEQ ID NO: 1814 - DNA, 699 bp, Sorghum bicolor
  Clone ID: SORBI-28MAY03-CLUS30766_1
aggaggttcagtggaggtggccccgtcattgttgatcagggaacggtgtttgtgactttcatttgcaacaagaatgccattgccgggctgcagccctttccacgggacatcatgtcatggagtggtcagctatatggcaaagtttttgacagatttggtgaatttcatctacgtgagaatgactatgcatttagtcatcgaaaattcggtggaaatgctcaatcaataacaaaaaatcgttgggttcatcacacatcgttcttgtgggattatgatgtgaaaaatatggattatctcaaaatcccaaagcgtgcaccggaatatcgactggcatgatcccacccggttgtcttgtgccgcttgtcggcgtcctttccgccccggcctggtgtctccggtggggtctgtgcggccccggggggactctcctctgtgcgccccttggatcttcatgcaggtctctccggggttgtcgggctggtgcctgctcctcagctgcgggctctcctagtccctggggaaattgtttcctccaaagaatcccctagagtacagaaagtcgaagcatgaccatgattgtcgtttttttttgttgtgaaatctgagcaattatctgcgctgtggattcattcaacttcgagtccgacattatggtcactgaaccactgacattgttttttcgaaacccagtacatagaa

SEQ ID NO: 1815 - DNA, 648 bp, Sorghum bicolor
  Clone ID: SORBI-28MAY03-CLUS30769_1
gcaggagcgggggttcctgcatccacagtgaagagaggccgtggtaggccaagaaaggagaagacattggaaactggggacttgaaagttgcacagatgacggagggtcaacataaagctctgcctgcacaagctgtagaccaaggtgggcttatgcaaaatgaagttgaagctaggattttgcaatcctttggtactcctttgatggagaagagaggtcgtgggcgacctagaaagaggcctctggaaactgaaactacagaaacccaagttgatgcattggtgaagaagcgagggcgtggcaggccaagaaaggccaggccttttgaaactggatctgtggaaactgcagttgaggtgtctagggacttggcagaagatgggcctgaaaaagatggggatgttgtgtcagggaagaaagcagaagctcaaggtgtacttttggttgaggagatagacaatggcactgcagatgctggatgtttggtagtgccaagagaggaggtagcaattgctccaatggatgctggaggtgtgctattatctggagaggaggcagccgtcgctcccatggatgctgggtgtgcaacgccaagggttgatccgatggatgtgggcaccaagagtcattagtgctctgatggtggc

SEQ ID NO: 1816 - DNA, 873 bp, Sorghum bicolor
  unsure (1)..(873): unsure at all n locations
  Clone ID: SORBI-28MAY03-CLUS30582_1
ggcgtncaggattcatccggtaccgggagcatcggtttcatacttctttagaaaaaacaagaagattttatcctcatgtcaataacatggatggattttttgtagctaagctgaaaaagttgagcaatacaatcccggtgacatctgagccgtctaaagcgtctgaagaagcagctgagaaggctgatggcgaagatgagaaagctatttctaatgaacaagagacagctgttcctggtgaagacgagaaaactgttcagatgaaaaatcagaaaaaggccaaggtgactaataaaagaacaagtgtcaccaaagatactggaggccataaacatgaatctaataggccaggaaagcatctcaagaaaaataaggataaggataccaaggaaattgatggccctgaaagcactgaaacaaatggagacaggaaagaggagcatcgtgaacaaaccaagcaaagaagccacaaaaggaagtttgcctctaataattccaaaaaagctggccctgagagcaatttgggtgtcaaagagaagagacaggtcagtgacaagaagccaaaaaggaaattcaagctgaggcgagaatgggaagctgaaaagaaaaaagatgccaagaggaggaagatatgaagtgagtattcagatgtccacaaaccccaatgaaatttgatgcgctgtacaagggcaacagaaaattttgagcaatcatgaggttgcagccagggaaaatttttgatgtatgaaatagcgattgtatttttgattcgatgtacgtgtaggcatctcaagttttatctttaacgagtgacatctggcagagaaactgaagcaaattatcttgatgaatgctatgtgaattctgctgctg

SEQ ID NO: 1817 - DNA, 725 bp, Sorghum bicolor
  Clone ID: SORBI-28MAY03-CLUS30610_1
gcacgagggagcaaaaagtgaacatcaatcaaaacttgccgctaggaagtatgctcgcatcatccagaagcttggttttccagcaaaattcaaggacttcaagattcagaacattgttgggtcttgtgatgtcaaattcccgatcaggcttgagggtcttgcatactctcatggtgctttctctagttatgaaccagagctcttccctggcttgatctatcggatgaagcagccaaagattgtgctactgatttttgtttcaggcaagatcgttctgacaggagctaaggtgagagatgagacatacactgcctttgaaaatatctatcctgtcctcacagagttcagaaaagtccagcaatgataactaattggaagctagcaggggagtgctgaatgggaaaatgttattgctggcagccagctccaacttccaagtgtacatataatctggacctcggaggagcctataagctgccatgagacctggtgcgtgcgatgcacttgtagatgcccacacagctcaactatttgtgatggatggataatgcttggtcgagtagattcatggtcatgggcagtgattgtagcttgcaaagccttagtggaagtggtacgccaataagactgaaaagcaagttttggtcctggcttttcaaaagtctttctctaaatgtttcctccgtagatgaaaaaggcaaatgtagtgtatgtactccttacca

SEQ ID NO: 1818 - DNA, 598 bp, Sorghum bicolor
  Clone ID: SORBI-28MAY03-CLUS30596_1
atgggaggaggggcagcatacagaatttaagaatgaagaaagagtctgctgagacagaggcagttgatcaggatgttaatagtgcagctgcagaacattctagaggcactggacctgtggctgatggagttggttcctcgaaacaaacctttccgaacgacactactccgatgtccatagatgaaccaaacgttctgaaagttgagcaacagagtccaaacaaattgcaggaccaaccgacgatgcaccagaagccatgatcaccttaacatagtagctaatgtcatctgtagcctgtcgattcttttgtgcaaattcatttgactgtaggcaagccgtgcatgtcacaaggctgaagcagggagcagaagcaaatgctaaccaagaagttgtgcatctgaaatctatagtgttttgcgcgttgcatttgtattacgaacagttgaaaacgatgatttactggtttataatcatgaaattttgtcttccatcctttgcttatgcagaggaaggaattgatattgtcgtatgcatcagttaagtagtgcttttgtcgcagatgtccatgtgattgtaatgtgcaggaactagaggaatt

SEQ ID NO: 1819 - DNA, 524 bp, Sorghum bicolor
  Clone ID: SORBI-28MAY03-CLUS30835_1
gtgaaccacatgcttcgttgaagatgctgcacatcgcaaaagcagtaataaccttccttctcgtaccatttggtaaggtttgatttgctgacaaatgcagcatctggtgagtttctccataggttcggtctccgtgcgctgctcctggttcaggaactgcagtatgttagatggatgatgactcacctactcgtgttatcatgccttcagaggacccaggttagtgagtgccagaaagtgaattcacctggccaaatgctacgttgagccgactttggcttggctctgtgatctccacttgcttccacatgctgccttcgacgaaggaagtcttcctcgccttgtgcttccttctctgcagcatcctgtttgatattcttcatagatgcttcttcgagtgccatacagtcatcctgattgatgttcatcacatcatacagcctgtgttgacatcaaatctcctccatccatcatatgccaccattttttctctctaatggacaatgtagttacattcttattag

SEQ ID NO: 1820 - DNA, 927 bp, Sorghum bicolor
  Clone ID: SORBI-28MAY03-CLUS30847_1
gcacgagggaaaagggcacccaccccagagacatatcttgccaagatatatgcccattcatcaattggccagcttcaaagggcttttggtacattgcgtgaatttgaaaatgcctatgggaactctgaggacattgatttagagctcttctcaccatttacttccttgcatcctcttgttgttgcttgctgcaaagatggctttaccacactggattcggtttatgttcagttggagaatctgagtcgtgcagatccaccatacaaatctgtttctgctctcaactgtgttatattagggtgtgcaaacatttgggacatcaatcgagcttatgaaacttttgtggctattaaggaaaaatttgaactcacgcctgacatccattcatacaatgcccttctgtgtgcatttggaaagttgaaacagacaggagaagcatgtaatgtgttccagcatgtattaactcttggtgttaaaccaaattcaacaacatactccctgcttgtcgatgcccatcttgccaacaaagatccaaaagctgctcttgccataattgatgagatggttgatgctggcttcactccttccaaggataccctaaggaaggttcgaagacggtgctctcgtgaatcagactttgacagtgacgagaaagtccaatccctggctaagcagttcaactaccgactgggtggtgagaatcgaagagagatgctttatagcatagaatataatcctgtgtactgaagcagcagttcgtgctgagtttgctggccgtttggagagcacggacatcgtagcgtgtaaattacttggatgtaccaggattcttaagcaattttcagtttctcaatcatcatttttgctcgcagggttgatgctaggacttgctaataaggctggcatactatttgtttgtttaaaatc

SEQ ID NO: 1821 - DNA, 551 bp, Sorghum bicolor
  unsure (1)..(551): unsure at all n locations
  Clone ID: SORBI-28MAY03-CLUS30862_1
cacttttatggaacacagtttgaaattaaggagcgtatatactgacgtggaggattttgatggaacaaaagacgccagcaaggaaccactagtgacaagctacaacagaaaattcatgggaacagtagactacatatgggcctcggaaggtctgcatactgttcaagtcttggatacatttcccaaagagattttgaaacaaacaattgggttcccgaccaagaaatggggaagcgatcacattgcccttgcctgtgaattggcttttacaaaatgacgcctatttatcaggccgagagggcacctgcatagtagctagtgaccaaacacatacctcaggagaaagaatagtctactgtctacaggacgattaactgtcatttctacatttattatgctgaaccattttttgctcttttagagctcgttaatttcttttcttttcttttttttccccggcatgcccctgtgatttgtgcatgagtaccggagaggatacatcacttgggtccnagttttagagacattgttcttgtttgattgagagagtg

SEQ ID NO: 1822 - DNA, 804 bp, Sorghum bicolor
  Clone ID: SORBI-28MAY03-CLUS30890_1
gcacgagggatctgcatccctactgggtaatcttccaacacagatagcagcaacaatagatgctgggtcagatgccatatctgaggaggtggaagccaatgcagagcatttgacgtgttgtgaccatgtaacagcatgccaagctgccaggcggaatggtgtgcgcagccgtctgtcactcgatgggtacaactggaggaaatatgggcaaaagaaagtgaaaggcagcgagttcccacggagctactacaagtgcactcaccctagctgccctgtgaagaggaaggtggagacgacaatagatggccggatcgctgaaattgtgtacagtggcgaacacaaccacctgaagccaggcaagccttgtctccccaggaagccattgtcgtcgacaagcacagaggttgtggtgtgcgacatgcgtggtactgacgacacgatgagggagtagaaacgacgaagacgattagaaggcgcgttgtggacaattaaggaatgaagtggcttgtttaacaagaaggtgcttgcgtccccaatggtgatcatttacaagactctaatgttgatcaagtcgtggctccctaaagcgaaattggaacccatggcggaagagatgataaacctgatctcgtcaagcgcacattaagtcgtatctcttgtagttcagttagtcttttgctctttgaggggagttatatcgtttgttggtcagttgaactatcgctgagagaaagtcgttgtctgtcaaatttctctcgttctcgttgttgctactatgtaaactagaatcccaagtagcgtacc

SEQ ID NO: 1823 - DNA, 646 bp, Sorghum bicolor
  unsure (1)..(646): unsure at all n locations
  Clone ID: SORBI-28MAY03-CLUS309_1
gcgtccgcggccgcgtggggcggcatcatcatcaactcctcggtcgagctggagccgggggttctcaccgctatcgcggacggccgctgcgtgccgggccgcccggctccgaccgtctacgccatcggcccggtgatctggttcgccgccgcgcctgagcatcagcagccgcacgcgtgcgtccagtggctcgacacgcagccgtcggcctcagtcgtgttcctctgcttcggaagcaacggggtcctggacgcagcgcaggtcagggaagtcgccgctggcctggagcgcggcggtcaccgcttcctttgggtgctgcggggcgcgccggccggcggctcgcgccacccgacggacgccgacctggacacggcgctccccacggggttcctgacgaggacccgggggcgcgggctcgtgtggcctgcctgggcgccgcagaaggagatcctggcccacccggccgtcggcggcttcgtgacccactgcggttggaactccatcctggagagcctgtggttcggtgtgccgatgctgccgtggccgctctacggagagcagcacctgaacgcgttcgagctcgtgagggagatgggcgtcgccgtccacctcagaatatggacgtcnaccgagcggacatggtcgt

SEQ ID NO: 1824 - DNA, 715 bp, Sorghum bicolor
  Clone ID: SORBI-28MAY03-CLUS30918_1
ctgctcccttgattacaccaaagttagaaattggaaacatgaaggacagttccaatcctctctcaaatcctgcttacacaagggcgcttttaatcaagcagcaagagcagctgcttcagcaatttaaattgggtagtttgcagcagctgaggcaggaacagcagctctacataaaagggccagctctgtttgagaatgatgacccgccaccggttgggccgctgggaacaaggtgccagctctgcaagcttgatattgctttccggccacaaggggatgcaggccgtgatgccaatgctcctccagtcgttgcggttctggcatgccaccatgtgttccacagcaggtgcattgaatcagtttacggacttgctgagcctgcccagtgtcttgcctgcctggagcctggggcagcgcactgatcactaaccagaaacgtcagtttagcttgatttgagctatggtataggatagattttcatcttatattgcatatagagggtgaggtatcatctgcattgatagaaaagcttctgttggtataacggtgcagatcaaaagtctgagtgccccatttctgtgggcattcagatagtgtaagtagctatcattggagttcaatcgggagctgaatcatgcaacttgccttatatttttttttttcctcctgttgtcctcatagttaaaatctgcagtcaattgacagtgtcatttg

SEQ ID NO: 1825 - DNA, 390 bp, Sorghum bicolor
  Clone ID: SORBI-28MAY03-CLUS33521_1
gcacggggctcctgctcatctagctagggacacactgcgaaatactcgtaacaatggagaggcagaggctgttcgccacggcagaagcacggtggcagggccctgtacaggctccacgccgtcaccgtgttcctggggatatgcctgctgctcggctacagggcgacgcacgtcccggctgccggccccggcagggcggcgtggctggggatgctcgcggcggagctgtggttcgccttctactgggtcatcacgcagtccgtgcgctggtgccccatccgccgccgcgccttcgtcgacaggctcgccgccagatttggagaccggcttccctgtgtggacatcttcgtatgcacagcggacccgcagtcggagcccccaagccttggc

SEQ ID NO: 1826 - DNA, 674 bp, Sorghum bicolor
  unsure (1)..(674): unsure at all n locations
  Clone ID: SORBI-28MAY03-CLUS33526_1
gcacgagggcctgccgcgtcgacaccgcgatgcaggtgtaccacgacatgctcgcgtctgcgcccttctccccctctgccgtcacctaccgccacctcaccaagggtcttgtcgctgccggccgcatccgtgacgcgctcgatctcctccgagagatgctctcccgcaacgctggcgccgactccctcgtctacaacaacctcatcgctggatacatcgacctcggcgactgggacaaggccttcgagctcttcaacgagctcgcagagaggtgccttgtctacgacggtgtcgtccacaccaccttcatggagggctactggaggcagggcaaggacaaggaggccatggacaactaccagtcccttcttgatcggggcttcaagatgacgccggccacctgcaacgtcctgctcgagacactcttcaagcacggcaagcacaaggaggccaacgacctatgggagaccatgatcgacaaccacaccccgccaagcttcatcggcatcaacgccgagtcctacaacgtcatggttaaccagtgcttcagggagggcaagttcaaggaggcgattgaggtcttccaccgccagcccaggaagaatgtccaaatggacgtcggctgcttcaacaacatcattggcaaactctgtgaaaatggcatgctangtgaa

SEQ ID NO: 1827 - DNA, 597 bp, Sorghum bicolor
  Clone ID: SORBI-28MAY03-CLUS33528_1
gcacgaggcagcccccaacccggactgccccgatgcgaggcacaatgccggccaccgattcctcgtcgccggcggccgcgccgctgtcctccatcggccgctccatcgcctggtcgctccgccgggatcagaaccagatccactccttcccgccgccgccgcccgacgacgccaccgacgccttccagcgccgcgccgcccatctcctcaacaacctcctcgcgccccctgctgccgacgacgtcctctccctcgcctggacgcgccgcctcgtcgacgccttcctcctctgcctcgaggagttccgagccctgctcttcggctccggggacgcgcccgcagcgcggcccccgctcgaccgcctcgtcgccgacttcttcgaccgcgccgtcaaggcgctcgacctctgcaacgccgtccgcgacggactcgacctcgtccgccagtggcgaaagcacctcgccatcgccgcagccgtcctctcctcctcctcctcgccgccgccgctcggggaggcccagatccgccgcgcccgcaaggcgctcaccgacctcaccatcctcatgctcgacgacagggacggggggggcgtcgttg

SEQ ID NO: 1828 - DNA, 604 bp, Sorghum bicolor
  Clone ID: SORBI-28MAY03-CLUS30946_1
ctactcatggcgttgacataggatacttctctgttgagtttgagtctatgcaggttgagaaaatttgtggcctcaggaaccttctatatgccaaacagtacactggttttccaccgtcattgtgcctaccaagaatatgaagtggtgactacacaaggtgaatgaagtgtgctggctatccacagtaatctggtggtttagaaaggaagcaaaggattcatgtatgaactactagcagggtcattaaggagtgaggacttaaggactgaggagctgttggatggtctgtttttcagtcctttagggtgtgtttggatgcagccctggcctggagcgcccgctggtgtaggcaactttcccgtgccgctatccaagcatgcccttatatttcttcgtcatgccaatattttgacgtgattttgcatccacttctaacagagttttgatgctatgctgcatcatatcctggaaggctggaaatgtttatttggtgctcggcatctctctgaacttgatgatttttttctcaaagcggacaccagtctttgtttaatggacttagcgtgtgctgttacgtgctgttattagccgctgtttgctataa

SEQ ID NO: 1829 - DNA, 549 bp, Sorghum bicolor
  Clone ID: SORBI-28MAY03-CLUS30967_1
aagttccttgagaaagcagaattaaatcatccagaaggcactaaagaaactgatgttcagaacagtaatggtgccacacaatgtataactgttgttgtccccagaggttaccacggcggcgcggtatcaaagagcagccgaccatcaggcctcatcaagagatggagatctggaggatgctgtgattgcggcggatgggatcttggctgccccatcagagtacttaatggtgatggttgtggttccttgcctgaaggagagtcccaggatagcagatcagtagagctatcaatcaagggtgcaaagaatgaaacgatgttgaagctcgtgaatatcacagaggacctgtatatcctctacttcaactcaagtatttcaccattgcaatgcttctcaaccgggatagcgattgtgcacagccaagcaccacagctttgccccaaactgtgaattacaaagcttggtgaaacgctatgcgtagatgtagatagtagaataacatttcttgtcatttaatactataattttagagagaaaattgcaggctgt

SEQ ID NO: 1830 - DNA, 736 bp, Sorghum bicolor
  Clone ID: SORBI-28MAY03-CLUS30985_1
cacagctgcagagctcaagcaacagcctacttgagcaaagtgcaagattaaactcaaattttagtgcgccatcttattcagacaacaatcaattctaccaacctgcaacaattcatgggtaccagctcacatcttacttgaaacagatgaatgccagcagaaacccttactctagcatgccactggacccacagcggcttccaaaatcatctgtgtctgctgtgccaacctatgttgattccctgatgaatgctcgtaatcataatctgcttgcttcactgggtgctactccttcacagattcctgcaacatcccgtgtaggctcaatgatgcctgaaagatcgtattacgatccttccactgttgatgggaatgaaaattctggttcgcctgcttactcaaaaaagtaccacagctcacctgatatgtctggaataatcgctgcaagtagagctgcactgttgaatgaagcaaagttgggtggtgccattggaccccagtcataccttagcaggctggcgtcagaaagatctcaatatgcaaactcagcagccaggcctgcggctccattagcatttgatgagctttcacctcctaagctccagagtgatatcttctcggcgcagtcaagcatgagcccaagtgctagatccctttgggctaagcaaccatttgagcaactgtttggcatgtcaagtgcagagctcagtaaaggtgacttcaatctttcaggcag

SEQ ID NO: 1831 - DNA, 525 bp, Sorghum bicolor
  Clone ID: SORBI-28MAY03-CLUS30988_1
gcacgaggtctaaatacggtgatagggtgccacctagattgacaatggactaaattagcacttgtcagttgtcacttcaattatgaagtgaaacagaattagtatgtgctcattctagggattctacattacttgctgatctggggagcttaataacgtataactactgtgcagagtggactacaacacacgaatcagaagtgaaagatagcttaattgtaaccttatatcaatatgtcaatcaaactaaaagattcttttcatgttggtctgttcttgcacacttctctgatgacttcggaagtcaaataactttcatggcattcaacattcttttcatgttggattgttcttgcacatttctctgatgaacttgccttgtggtttcatatgtagatattctctgcaaatagagggcacttgaagtttgccatccaatctcaagagttctttaggacactgcaacggtactatagtaatgcctatatggatgcctacaaacaagcagcgataaacttattttta

SEQ ID NO: 1832 - DNA, 538 bp, Sorghum bicolor
  Clone ID: SORBI-28MAY03-CLUS30992_1
gcacgaggccgcgtcgcggcgcgcagcgtggcgtgcggtcggggcgtgctgggcccccccccgcccgcgcctccgcccccccctccccggcagccctccccgcctcccgcgcatcgcgccctcgctgccccgccgctgcacgcgcagccgtcgcgtcgtccgccccgccgccgctgcggctcgccaccgcctcccccccccacgccgccgcctctggcgggggcgccctcggcggcgttcgcctcgcgggcggttgcgggggtgggggcgggcccggtcgggctcctgggccgatgccgcggcggggctccgcgcccggcgccgcgtgcggcccggacctgcggggccccggcccgcccgccgtcgggcttcctggtgtccttggctccattggctcatccgccatggcgtcatgcacctcgctccacgcatggccccctcccgcggtccctcccgagcgctggtctcccctgaaggcttaccatgcaactgctaaaagtgtccttgatgcgctgctgataaactggaatgcgacata

SEQ ID NO: 1833 - DNA, 470 bp, Sorghum bicolor
  Clone ID: SORBI-28MAY03-CLUS30996_1
gcacgagggccgccgccgccgccgccgccatggccactgccggagccttccacgccggcggccgcctcctcctcccgctccgacgcagcccccgcgggcccagcccctcaccatggtcccacgtccgcacccacctcatctcctccaagccgccgccctccgctcctctcccgccgcccgtgccgccggcgcgcccgtccccagtggggtccgccttcgggtctcttagcaggaagaccggcgcgttgggggccggcgctggcgctggcgcgggtgtcgtcgggtggtaccttggcgtcctggacgcgcggcccgtgctgaccaagagcgtcaccgccgctgccatcttcaccgtcgcggacctctcctcccagatgctcagtcttggtcctgaggattcatttgattatctcaggaccatgcgtatggctagttatgggtttctgatctcaggacctaccctccatctc

SEQ ID NO: 1834 - DNA, 519 bp, Sorghum bicolor
  Clone ID: SORBI-28MAY03-CLUS31020_1
gcacgaggcccccgtttccccaatccccagatagtagtagtagtagtagtagtagtagggggaaaaacaaggggaaagaaacagcagcagcagctagcggatgcaaggcgaaatggtggttcccgtcgcgtcgccttcgtcggcggcgccggcaccctccgccggccgtctccatccgacatacaaggagatgatcatgcaggcgctgacggagctccgggaccccggcgggtcgagccgcagcgcaatcgctaactacatcgccgaccacttctccggcctccactctcgccacgacgccctcctctccgtccatctccgcagcctcaggtcccatggccaacttcgcctcgtctctggcaactacttcgtctccgccgccactcagcagcctgctccgggtcagaagcgtggtcggggccggcctcgcaagaacccagatttagccccttccgcctcggttccggcgtatcagggccccaagcgagggcgtggacgcccacgcaaggacgcccaaga

SEQ ID NO: 1835 - DNA, 526 bp, Sorghum bicolor
  unsure (1)..(526): unsure at all n locations
  Clone ID: SORBI-28MAY03-CLUS30793_1
actgcctcagagatcaggtntcctatgttctctgcatgcaggtggcatgcaaaacagatgtgggagttaaatgcgaatggaaatcttgtgagcagctattcaggattatgtgccaaagtggaatcaagggacgaaggaggtaccagtggaggtcgtgcatgggttgcaactggaagtaaaggagaaatctatcttgcgttcttcaacctcgactccgtgagcaggaagatgaccgtacaaatatcagatcttggaaaggttctcagaagaacttttttgaaaaaagagctatgcagctgcactgaagtttggagcggaaagaatttcggtcctgtgaaggaagagatttcagcagtggttaattcgcatggctccatggtgttcgaaatcacatgttgagattgcagtactgggccagtagttcgagaagttcgcagtgataatttgctgtcagctccatttctattgatcctttacttgtaggcagaggtggaatggatacgttgataaaccattaactagatgg

SEQ ID NO: 1836 - DNA, 659 bp, Sorghum bicolor
  Clone ID: SORBI-28MAY03-CLUS30805_1
gaaggagccctgcaagggaacgggatagggaccgtgaccgtgaccgtgaccgtgacaggaaacccgaaaggcatcacagggacagagattatgatagagatcgggattatgatagggattatggaagagggcgggaaagagaccgagatagagatcgtgaaagagacagaaaccgggatagggatcgagaccgtcaccgcctgcgagatgatgactacaatcgtgacagggatcgagacagggagagggatggtagggaaagggagcgccgagacagagaccgtggcaggcacaggagccgctcaaggagcagagatcgacgggacagagaccgggaagatggagagtaccgcaggaggcgtggtcgtggaagtgcaagtcctcgaggacgtggtgaggacggtggcccaagagaggaaccgaagaggaagaaggaaaagaaagagaagaagggtgaaggaaatgctccggatccgaatgaccccgagatcatagaaatgaacaagctccgggcctcactcgggttgaaaccactgaagtagtgtaaaccagaaattttcaactggacgtgcatccaaccttttttgtgctggacttttttcagcttgatgtaattaaattgttgtattacttgatgtagttattatatgcatcaggga

SEQ ID NO: 1837 - DNA, 492 bp, Sorghum bicolor
  Clone ID: SORBI-28MAY03-CLUS30818_1
tccccttctacaccctcatggtcgtcgcccccaacgccgacatcaccaagcgcaccgtggagagcagcgctccctacgtcgccttaggcctcctcggcgcctgcctgcccgccccctcctccacccccggcacccggcgcgccatgttcgccagcaagtactggctccctgagttgccgggcatcgttaggatgtttgcgagcgagatgaccgtcgcctctgcctggatccacctcctagcagtcgacctctttgcggcaaggcaggtgtaccacgacggcctcaagaacaacatcgagacgaggcattcggtctcgctgtgcctgctcttctgcccggttgggatcctggctcatgtggtgaccaaggtattgacaggggcagttggccgctcacattgatgattggaattgggtggttgtatttaggattccattgtttagctggtggattttatttgatttggatatgaataaaattggtttcaagggc

SEQ ID NO: 1838 - DNA, 685 bp, Sorghum bicolor
  Clone ID: SORBI-28MAY03-CLUS30829_1
gcacgagggagggtttggggacgacgggatggcgcggagcgtgtcgtacgtttcggcggcgaagctggtgtccatggcgcgaggcaatccccgcctcgccatcatcgacgtcagggatgaggagaggagctaccaggcgcacatcgcgggttcgcaccacttcgccagcggcagcttcgaggcgcggatgccggagctcgcgcgggccgccagcggaaaggacaccctcgttttccactgcgcgctgagccaggtgcgaggtccaacttgtgctcggatgttctcagattatctatcggagaccaaggaggattcagggataaagaacatcatggtactggagctcgggtttaacggatgggagggttcggggcagcctgtctgccgctgcacggacgctccttgcaaagggacgtgctgttaagcacatgagttaatctcccaggcattcaacgacgatcgacatggcctccatttctgttgtcggttacttcacctcactaaactcattaaaatgataacacacgcaagattattgggttggcaactccatttttgtgggaactacatgcataactaatactacccagtgtattcacttcagatccactggattgtggatactgttctttgattccgcatgtgccttatagatctgtgcatcaaactgaagcagtgttggagt

SEQ ID NO: 1839 - DNA, 448 bp, Sorghum bicolor
  Clone ID: SORBI-28MAY03-CLUS31141_1
caaccgctgccggccgcgcacggccgcccacccaccagaccagtccagtccaccactgcagcctcccaccgccaccacagcagctgccgcggccgcgcggccggcgaggatgagcggggccgcgctgtgcgcggcgctgacggagctgggggtcgacggggaggacccgctggacgcggacgcgctggagtggccgttccagtacgaggaggcgcgcccgctgcttgcctggatctgctcctgcctccgcccctccaacgtcctctccccgtcccacctggcccagtatgaacagctcgtggaagagggaagactgttagagggtgaagatttggactctgcttttgatagtatttcagcattttcaagcaagaaagataatcaagaggctgtgtttggattggaagaaaccattcttgatatccgtgaagcaaaactagcatataga

SEQ ID NO: 1840 - DNA, 767 bp, Sorghum bicolor
  Clone ID: SORBI-28MAY03-CLUS31156_1
gcacgaggagagggaggaagagctgcttgcgtactggtggagggagtacgctgaatgcagcgcaggaccgagaggatccttggttgaaagtgatgactctgcgtacctttataaggtggaggaagagcgagttggggttcctgtgaaaggtggactatatgaggttgatttgatgaggcggcattgcttccctgtgtactggaacggtgaaaataggcgtgtcttgagaggccactggtttgctcgcaaaggtggcgttgattggattcccttgcgtgaggatgtctctgaacaacttgagttagcgtataattgtcaggtctggcatcgtcgaaaatttcagccttcaggcctatttgcagcaagggttgacctccaaggaagtacaccggatttgcatgctctttttactggagaggatgatacttgggaagcttggcttgtctttgatacaggtcctaaacttggtagcaacacaatcaaattaaggcgcggattttctccttctgaatctgcaagtacaaacccttcacaggatgagttgcgtcagacaaaagaagaggaaatggatgattactgctctcaggttccagttggtcatctggtattcatggttcatggcattggacagaggctggagaaagctaatcttgttgatgatgttgttgatttccgtcgagtaactgctaacctagctgaaagatacttaacttcttatcaaagaagtacccagagggttctatttattccatgtcagtggaggaagg

SEQ ID NO: 1841 - DNA, 673 bp, Sorghum bicolor
  Clone ID: SORBI-28MAY03-CLUS31184_1
agctcccgggtcaggcaggcaggctccccactcggccgcagccacagggcgctagggcagagacagagacgccacaagaaaacaacaagaaaatcagctgcgaaattccggattaaaataagattcttcattttaagatatttgaaatgtcagtagggcttggccttctggaatgccctgctaaaccataggcgtgttctgttggaagttggaacaaaaacttgattgaaagttcaagcctaaacaaaaccatggagagtgaaatcatggccccctatgaaaccaagcagaactgcgaaataagggtattcgagagttcagacgagatggcaacagatctggcagagtttatttcacaagcttcagaaatttcagttaaggaaagaggatactttgctattgctctttctggaggaccccttgtcagacatatgcggaagctctgtgaagcaccatacaacaagacccttgattggtctaaatggtacatcttctgggctgaagaacgtgcagtagcaaagaaccatgcagagagtaactacaaattagcaaaggaagaatttatctccaaggtgcctattcctaatggtcatgtctactccatcaacgacaatgcaacggtggaagaggcagcaactgactatgaatttgtcatccggcagctggtcaaggt

SEQ ID NO: 1842 - DNA, 470 bp, Sorghum bicolor
  Clone ID: SORBI-28MAY03-CLUS31212_1
gcacgagggagagtatggcatccttgagcacctcatatgtgagatggtggatgaactcgagggaatgtctgaaactatacatcctttcccagtccgatctatctcttcgaaacaattgggtggcaagaatgttcagacaagacgtgctactgaacaaggttagtttgatgtagtcctcattcgctgacctatcacaacataatgttgtgaaatgtgacaatagtctggtttaggttaatatatcaagatcactgaaacaagtgaatatatgttaacatagcagcaggcgtaggtacagatattgctgaacctggagatatcaggaactgcactctctgctctctgtactgccaaggtctgaactctgaaactgtacatgattttactttctactccttcgactccatggactagcacctgaataaacgaatggcgtctggattagtttggaaaaaaaaaaaaaaaaaaaa

SEQ ID NO: 1843 - DNA, 513 bp, Sorghum bicolor
  Clone ID: SORBI-28MAY03-CLUS31256_1
gcacgaggggcatttgtgagcacgtgtatgaaatcgtaggactcgttgttacaacagagaaaaaaaagagacgtgcagacatgtgatcaaaaagctcgaaaggggctggaggaagcgggcgagaaatgaggtcgaggaggggcagggcacgttcccgtcccggtcgtgcggccgtgccgtgtgggctctgtgctctgtagattccgagtcgcggcggcaaaccggaaccagaaccaccggtgtgctctccttggtttctactccagctgctacaactacaactggtggtcttgtcaaaaaaactacaactggtgtggcctttttgtttatcgtgtggctgtaaaccgaagccatcggcatcagggtcagggggggcaccagcctcgcctgtcagcgtcgtgcttagttgaccggagcagatttttttggtttgggattaaccacttcctggaaatttcacgtgagttagctggttagaattgggctctgaattgtgcgctgcagtcacgtacg

SEQ ID NO: 1844 - DNA, 695 bp, Sorghum bicolor
  Clone ID: SORBI-28MAY03-CLUS31278_1
gctggaagcacgcgtcccaccgaggccaccagcgttcccgcatcccgtgtacgacgccgcgcccagctgcataccgccggcgctggcgccgccggagggagacatggtcgcgagggcgttcaccttcacccgacacgacgtggcagctatcaaggggtccctcccgacgcgccgccgtggctctgccgccaccaccttcgaggtgctcacggcggcgctctggcgcgcacacacggccgcgctagagctcccggcgcacgaggaggtgcgcctggcgttcgccgtcggcttcaggggcgtgcgcgagctggggcttcccgccggctactacgggaacgtggtcctgccctcggcgatggtgaccaccgccggggagctgcaggccagctcgctaggcgacacggtggagatggtgcgggaggcgaaggcggcggccgtcaccgccgagtacgtgcggtccaccatcgacctcctcgtgctgcgtgggcggccgtccatgctagctccggcgaacctcttggtcgtgtcggaccacaggcacctagggctccatcgcctggacttggggtggggcgtgccggtgtacggaggcattgcgacggtgttctctggagccatgtttcttgttgcagtcagggacggcgacggggaggaggatgctgtggccgtgccgatcatgctgccacggccggacc

SEQ ID NO: 1845 - DNA, 427 bp, Sorghum bicolor
  Clone ID: SORBI-28MAY03-CLUS31284_1
tccagccggatgcgcggcgaggcggcggcggtggtggccgtgccgccgtcggcgctcccagtcatccgtccggccgtcccgcggcatccggccacggtagcaccgccgccaccggagctccagctcctccccgcctcctccgcggcggcatcgtcatcagcgccaccgctgactagcacctccctgtccaccaccacaaccgcgtcccagaaacaagaagaacgaccacacgcggcggcgacgacgacgaagctgcagctctccatcggccccatcgtcacggcgacgggcgccgacgctgctgccgtcgtcggcgaggatgaggaggactccgaggcggaggagctgcggcgcgcgatggaggagaaggccgcggcggacgcggcgcgggagcgggcgcgaggggaggccgcggcggcggagcgcg

SEQ ID NO: 1846 - DNA, 318 bp, Sorghum bicolor
  Clone ID: SORBI-28MAY03-CLUS30923_1
catagaacatagaagtcactaaacctttgcttttctaatgcaggttgcaacgttgcacacggtgctttaaccatctgcaaaagattcaacgaactttgaatccattgattatgcggggtggtcaagctgcacaacttgctcaagaactacatctttcattgcaagatttggtggtgatctaggtcgcaggaagttcatgtatacgacagagtagatcccattctttttggcaaaaattacccacagttgtgtagcttgtaattttgtcatagctttgcaagtgggccatgcagttgtgttttgacttgggatggcatt

SEQ ID NO: 1847 - DNA, 417 bp, Sorghum bicolor
  Clone ID: SORBI-28MAY03-CLUS30928_1
catcgtcgtcacctccgccaagtccggcctcaactgacctcgggtctgactagattattatccgtccagaccgccaggggattagggcctccgatccttgttaattaatcccccacccatcctaggttccttgtcttggtctctgtacatagtactactactctgattgtgtcattagcagtagcatgattactgataggattaatgaaatggggggtagattagggggggcctgcatctgcgtcagccgtcagcagtgcagtgcaggggggattttatcgaattgattagttaattttgggcgcttgatgagccaccagctagcgctagctttatactactactatgtacatgtactaccattaattgctgcttgagctcgacatgccattatgtgatgaatttgatgcttcagtt

SEQ ID NO: 1848 - DNA, 642 bp, Sorghum bicolor
  Clone ID: SORBI-28MAY03-CLUS30936_1
ttcgtcatcgaggacatcgactgctccgtcgatctgcagcagcgtgcagaggaaggtcaggatggtggtacaaaatccagtcctcctccttcagaggacaaggtgacattatctgggctactcaacttcgtggatggtctgtggtcaacaagtggggaggagaggatcatcatcttcacgacgaactacaaggagcggctcgacccggcgctgcttcggccaggcaggatggacatgcacatccacatgggttactgctgcccggagtcattcagaatcctggcctccgactaccactccatcactgaccacgacacataccctgagatagaagcactgatcaaggaggcgatggtgactccagcagaggtcgcggaggtgctcatgaggaacgacgacaccgacatcgcgctccagggccttattcggttcctcaagggaaagaagggtgatgccaagaacagccaaggcgaaaacgtggagcacgtgaccaaagaggaggagaaagagatgatgccgacaaaaaaagatgacccagtcgatcaaaatctcaatgatgcaggcaagcaatgatgccaaagtagtgtgcatatcaaatgttgtagtgccagaataacctgcttaaattgtatcgttttggta

SEQ ID NO: 1849 - DNA, 602 bp, Sorghum bicolor
  Clone ID: SORBI-28MAY03-CLUS30940_1
aaccagatctgcagaatgccctcaactgggcatgtggtccaggcaacgtagattgctctgccattcaaccaagccaaccctgctaccagccggacactttagcttcccatgcttcatatgcattcaatagctactaccagcaaaatggagccaacgttgtggcctgtgacttcagtggtgcgggaatacgaacgacgaaagatccaagttacgacacttgtgtctatttggctgcaggcaataagatgagcacaatgaattcgacatctcttccagctcagagcaactctggtccagttccatgcgccaaatacttcaccactttcctccccatgctggcccccgtgatggctgcagttatgctgtgatctatggaaatgctccagctagcctctgcagatgtggagatgaaaggtgaattgcgtaatgctggtaaccagccgatgttctgttttgctatgagcagtagactagtagtagtctagtagagaggcatattatgctgctgtaggaattctctggtcagttgagatgtacatcgtcgcgcagacaatatatatcagcggcccttaagaactcgataacctttctgctgtccttcg

SEQ ID NO: 1850 - DNA, 574 bp, Sorghum bicolor
  Clone ID: SORBI-28MAY03-CLUS3136_1
tgcataaccttttctgtatatttatatgcaatttctagtgaggcagcgaagtgagaagtgacacctgacagatgctaattagtggtattacatttgcactgaaaagatagagagagagagagagagcgtccgaatgatgtttattcaaagtcttgttccaggaagcagtaaggtttcagcagtttagaggagcagcattggaggtcctttctttatcaattcccatcggcatctttcagcttcagtttggacaagtactattgctgtccagctacatataaagaacagtgaaagattcacaacaatagaccagaaaggcattgtgctgcgattatctaagcattatgttccatagtggcatcaataaggtgaatgcctctctataatgcaataagtactgtgcgtcaagaaccatagagtagttatctcttgtactattagaaatctttaggctactgctcatgtatttttaggttgtggctcattagactgatactttgtagcctaagttgtatcaaagtttgtaaatgaatttattgctgaaatggatgaaacatgtgtaatgtgggagatc

SEQ ID NO: 1851 - DNA, 795 bp, Sorghum bicolor
  Clone ID: SORBI-28MAY03-CLUS31382_1
gcacgaggttcctgacgcggtcgctgctcccacttcccctcctccccccaaagtggcagcggcggcggggtagcattcgcgctacgagggctgttgccatggcggcctcggggttcggcggcagcgaggcgttccggctctcggccgcgccgggggccggcacactgaagctgcacaagggcgacatcaccctctggtccgtcgacggcgccaccgacgccatcgttaatgctgctaatgagcgaatgttaggtggcggaggtgtggatggagctatacatcgagctgctggaccagagctagtgcaagcatgccgtaaagttccagaggtcaaaccaggagttcgttgccctactggagaagctaggattactcctgctttcgagcttcctgtctctcgagtgattcacactgttgggcccatatatgatatggacaagcatcctgaggtgtcattaaagaaggcctatgaaaatagcttgaagcttgctaaagataatggcattcagtacatcgcattccctgctatatcttgtggtgtttttcgttatcctcccaaggaagcatcaaaagtagctgtttctactgcacaacaattttcagaggatatcaaagaggtgcattttgttctgttttcagatgacctttacaatatttggcacgagactgctcaggagttgctatcacagtttcagaaatgaatggtctatatgttgttgtctagtgttgagatgtgagcgctgtaggcagtttccatgatgtaacaaaatgagtgtatcaagcaacattttaatc

SEQ ID NO: 1852 - DNA, 583 bp, Sorghum bicolor
  Clone ID: SORBI-28MAY03-CLUS31385_1
accatttcctgaatctgccctcaatgaacaagctggaaagatgttacttgaaaactacgaggagtacgcacggcatgcaaggctatacactggcatccacgcaattaaacccaagaacaaatcgaagagtggagttatttctgagtcaaccacagctctaaatgtgggccagtccaatactgttctcggtgagaacacacctttggcttcagcagcgatatctacgtctgctgcagccaaagcattaggtaaaaactcactggatcagaatgctgctacgtctgatcctgttgtaggagcatccgccgcgcccaagaaggacgcgccacatgctgtcaaagttccagttgataagaagaagatggatgcaaggaagaagagcttgaagggattgtaattgtaaccgaataatccagggaggcgatggggagcgcttagcggtagataagttaatgatggcttcatttgtttctagattcagcagatgcccgggtggaactgagtgtaaaatagcgccagaagcatctcatgggctgtactctgtttgaacaatctgtccgtgcaatcacaatcatttattcat

SEQ ID NO: 1853 - DNA, 456 bp, Sorghum bicolor
  Clone ID: SORBI-28MAY03-CLUS31388_1
cgcaaagagaagaaagagagtgagcatgctgatggccctgtccagctttccaagtttcttggacgcgacaaagaaaaggaagaaggtcctcaaaggagtgcaatctctggtaaaaagataatgatcaagcttgagaagacaaaggaagataaggcagctgagagcaagcgaaacgaactgttgaagttcctgaatgccagttatgattgatatgttggaattgctgacgctgaaggtgcagaatgcccttttgattgtcttcgcactggtgcttctggtgatacttataagtgttttgtttttttgtctataacttggccaccaaagtttttttatgcttaactagcaaccgagtgaaggtctactgtaattgatttgaatttgatgttgccagtcgtgaattttcatcttttaaacatgttcttgtgattgctctggggattcagtgttcttatg

SEQ ID NO: 1854 - DNA, 436 bp, Sorghum bicolor
  Clone ID: SORBI-28MAY03-CLUS31413_1
gcacgaggctcaaacaatcatattgttggcattagctctaaaacctatcacccatggcgaagtgtcagaagcacgtgagcatccaagcactttggcttctttccatggttcttctggcatcctcagttgtttatgcacgcacaataaatgggcaaaccaaagaggacatcaacaccaggagtgtgacgatgatgacaaggtcagcaagctccataattggtagtggcgaacatccattgagaggtacatgcgttgagacacataatggatggtggttgtgcggaaaaatgcagttcaggaaaatatcaggactgcgcagcgtattgcagcaagcactttgttgggaattcggactaataagtgctctgttatctaatggtattattcttgaagccctggtgaacgatgtaacactatcctcaaatcaataaagtgt

SEQ ID NO: 1855 - DNA, 716 bp, Sorghum bicolor
  Clone ID: SORBI-28MAY03-CLUS31419_1
tgacaacgccatggccttctccgctttctcatggccgtttcgccgccgtgggagcggcggcggggctggcggcagtggcgcaagtaagtccgctgccacggccgcggaggaggaggagctgggcgtgaccccgcagctgctcgacttcctccggacgctctcgcccgacgccttcaaggccgccgccctccagctccaaggaggctccacggaggcggccgccggcgacctcaccagctggcaggagcggcacgccgtgctcgtgctgtccaaagctaaggaactcgccaagattcggtacgatctgtgccctcggcacatgaaggataagcagttctggaagatatacttcctgctcgccaagagttacatctcaccgtatgagctacgcgccatacaaaaagaaaaaatcagacggatggagacagaaaacggcaagtcaaaagaagtgattactgttgaagtggagatgcaagaatcgaaaggcagtagtctctctcgaacatcagaaagagatttagaatcccaagtttagctttgtagttatagcttctaacaggatttagcttaggtaatgcaaaggagtagtccttttatgattccttcacatatcaaatagctccacaattcttcaaatgatgcatggcttggatcgactcttgctagactcagtatgctgtgtgcttttgtgtactgaaaccaagttgttcagcata

SEQ ID NO: 1856 - DNA, 362 bp, Sorghum bicolor
  Clone ID: SORBI-28MAY03-CLUS31430_1
gcacgaggctcatcgtaaatcaggtgttgccaccatctgcatccgactgcagattctgtgctgcaaagaggagggaagaagcacgtgccttccgtgcgatactggaggaccatcaacttggcggcctgaagctgatccaggctcagctccttgacatggaggtgaaaggcgtccctgcactccgattcctcagcgattcagtgtggaagtagcaacgtagtacaaacctttgcccgtgtctcacaagcaaacctgccctgcataattcattgcgtggttacttggatctgtccgagctaattgtaatgagttagctagctttattagatttaattagacgtggttaagcataaaaaaaaaaa

SEQ ID NO: 1857 - DNA, 577 bp, Sorghum bicolor
  Clone ID: SORBI-28MAY03-CLUS31037_1
gcacgaggcaggcttcctggaaaatgcttgccttgttggccttattccagtggtgatgaattttgcagagccaaatcgcccaaaggatgttcgggtgcaagcatccttgtttcttcagcagctttgtcaagccagcaccttgacattgcaaatgttcgttgcgtgccaaggtatccctgttttggtaagctttatggagcctgactatgccacgtgcagggacatggttcatcttgcaattgacggcatttggcaggtcttcaagctccagcattcaactccaagaaatgacttctgtcgtatagcggcaaaaaatgggatgcttcctaggctggtgaatacactacacagcctgaacgaagcaacaagatttgcctcagtctcagggtcaggtgcttcagtaacacagaatggctcaaccccccgacgaagatctggccaattagacccttcagttcttgaaagttgcaaggcacgactggaccatcatcattcatctggttctctgcaatctctacaagcagatgcagataagcaccatatattaatggacgcctcatcatctcctaggttcagc

SEQ ID NO: 1858 - DNA, 595 bp, Sorghum bicolor
  Clone ID: SORBI-28MAY03-CLUS31022_1
aatgctccaccaaacgctcatcccttcctccttttccccctccgtctccgcctcctcctcctcgcctttcctccacgcccccaacgccgccaccaccaccaccaccaccacagcccccggtggttcctgcaccccaccagccttcccgcgaggctcctccgccatgccgtcgtacgcgcaccaccatagcagcagcccgctggatgatggcaagatggacgtgctcaagtgtggcaacagcgtcccgccggaggacgacgctgccgccgccggggcgctcgttgagaaagacgggctctcggttgaggacctgctggacctcgaggagttcggggagcctgacaaggacggcgccgaacacgaggatgacgcgccggcgctagccgccgcggtcgaggagcagccgaaagcggagtcgcagccgttgtcggtcgtgacgtacgagctcccgccgccgccgccgccgccggagctggttgacctgccgtcgcatgacgtcgaggagttggagtgggtctcgcgtatcatggacgactcgctctcggagctcccgccgcagccgcagcctcctatggctgctgtggtggcgtcgttg

SEQ ID NO: 1859 - DNA, 678 bp, Sorghum bicolor
  Clone ID: SORBI-28MAY03-CLUS31051_1
atgccggctcgcgcctagggttttgtgttcaaaccccaatccaatccccaaccacgtccgccgccgccgtcaccgccaccgccaccgccaccacctttggtcaccgctaccgaagcgcgccgcgggcgcggcgcttaagcgatggcgaaccgcacggatcccctcgcgaagagcatccacgggacgaacccacaaaacctggtggagaagatcgtgcgctccaagatctaccagagcacctactggaaggagcagtgcttcggcctcaccgcggagacgctggtcgacaaggctatggagctcgaccacaccggcggaacctacggcggcaaccgcaagcccacccctttcctctgcctcgcgctcaagatgctgcagatccaaccagacaaggacatcgtagtcgagttcatcaagaacgaggattacaagtatgttcgtgttctcggtgccttctacctgcgcctcactggcaccattgctgacgtctaccagtaccttgagccgctctacaacgactaccgcaagatcaggcacaagctcagcgatggacggttcccccttacccatgttgatgagttcattgatgagttgctgaccaaggattactcctgtgatacagccctgcctcgcatccagaaaagatgggttcttgaagcgtctggaactctggaaccg

SEQ ID NO: 1860 - DNA, 696 bp, Sorghum bicolor
  unsure (1)..(696): unsure at all n locations
  Clone ID: SORBI-28MAY03-CLUS31511_1
gcacgaggcggggtcgctgtgaattatgggtcatcactatcatcaaatagtaaaggggctagtaggagctgggagaggaatgagcttccacaagatcaccgctactctacatctgagggtgccatttcgtatctcaacagcccagatgtcagcttccagaaccaccatattatgctaccaatgctgcaagattctagcgttgatgaatacatgagagtttcagttgctgagcctattggtgctttattattgtcagaggtaatgtcaggacaacagaatagtggtggttccacctcctctcgctctgatggaagtgaatatgatattgtacctaaatcatacacatcaacgccccgcaacttcccaagtcgtcgatcattcctttcaaagccaatccaccctgtttcatttccagaacatgcaccagaagcacaagaaactcaaagtcctgttgccatcgcaaggtccaacaatcctctgtgctctgaattcaacggaacaggagagcttcgctttccaggtcccatggactatggtagtggtagtcatggggagtcaggaaattggagtgccgcaagtagcatggatcttactgatttatcagaacgacctgaagctggacaagctggaccactgcgtcctaataatgtaatgcagaanacaaggtgtgacctctgtgagaagcttctgacaaag

SEQ ID NO: 1861 - DNA, 356 bp, Sorghum bicolor
  Clone ID: SORBI-28MAY03-CLUS31543_1
gcacgaggctttcttctccctccaaaatcccaaccaaacctagcgggcggcggccgcgaccgccgacggggcgctgcgcctgcgctgagcgcgtgggcggcccgtggcggggccgcagtcggcagcgcgcctagacgcctgcgcctccgggtgccagcggccggctgctcgggctgctgagcgattgtaggacagagtctatgctggcagcagcacttcggcaatctgcagagataccgaggaaggagaaggtctgacctctgcggtcttcagcaagccgacaactgggaatcaaattctctctgtggcgtgggtgccagttcagtcggtgctctcgagatggcccgcggggtgtg

SEQ ID NO: 1862 - DNA, 732 bp, Sorghum bicolor
  Clone ID: SORBI-28MAY03-CLUS31553_1
gcacgaggcaccaccgcccgcggcgccgacgatcacctccggcgtgcgcggatatggggcgccgcggctcctccgaccgcctcgaggcgctctccctcgagatcgagcgcaagctccagaaggctctggtctccaactcccagcgtcttcagatacttcagcaattgtttgctgacattgcattgaaggtcgatgatcgtgctcgagatgcgattatgagtgagaatgatgatggcattgctccagtagatgaacgggaagatggttggctatgcttctatgagattctttccagtcattttgttagagtgcctgaaagtggcaggcgtatactcgagttgatagtgcaactctggagccagtccttcgcgtccaacatatttgcacttctttttcacaaatggttgtttgaagcccctcttgatgaaaaggaaatatcgctacgatatagctctgctcttgttcaaggtgctacaaatgtattttggattgacatacagacaaatacaagacattttctctctttgtatcattttctctagattcatgttcttctatgatcaagatcacttgctttctagtttcctagagcatttccccacttttccaaattccttcttggttggtggaccagcagattactttgtaattgaactcactgatcagcttcaaaagctaaaaattgagccagtactactgcactacctctcccgcatgagcatacttcaaggg

SEQ ID NO: 1863 - DNA, 798 bp, Sorghum bicolor
  Clone ID: SORBI-28MAY03-CLUS31630_1
acagctgcacctgcattgcattcttcatcctcgcttcacctcaccaccattgccgccatccaagaacaaagcggacacagaaaacaagagagaaaaatggggcttcgcggtcgcggagctcttgctctgcttttgctcctgttcgtccacggaggcggccagcaggcagccgaggccgccggcgggggtgcgttcgtgagggtccaggccccccgcttcgtgcacaacggcaagccgttcttcgccaacgggttcaacgcctactggctcatgaccctcggcgccgaccccgcgcagaggggcaaggtcacctcggcgctgagccaggccgccggcgccggcctctccgtggccaggacgtgggcgttcaacgacggcggcggcagcagcggtgcactacagtactctcccggccgctacaacgagaacaccttccaggggttggatttcgtgctagctgaggctaggaagtacgggattaagatgatactgagccttgtgaacaattacgatagctttggagggaggaagcagtacgtgcagtgggcgagggagcaggggcaggccattggatctgacgatgagttcttcactaaccctgttgccaagggcctccacaagaaccatatcaaggccgttctgacgagggtgaacacgatcaccggcgtggcgtacaaggacgacccaacgatcatggcgtgggagctgatgaacgagccgcgctgccagtccgacgtgtccggccacaccatccagtcgtggatcacggagatggcagcgcacgtgaagtccatcgac

SEQ ID NO: 1864 - DNA, 678 bp, Sorghum bicolor
  Clone ID: SORBI-28MAY03-CLUS31635_1
gcacgaggctgcacagccagcacctcacctcgatgatgcatccgctccgccgattcctcctcctcctcctcctcctcctcgtcggcctcctccccgcggccgtgtggtccctggcaccgccccgattcccgaggcaccagcaccgctcgcggccgggagttaatggggtgggggactacgagtacgagacgcgatacttccggcagcggttggaccacttcagctttcccggggtcgcggacgaggacgaggcggcggcgttcttccagcagcggtacctggtgggccgcggcggtgggtgggccggacccggcggccccatcttcttctactgcggcaacgagggcgacatcgcctggttcgcctccaactccggcctcgtctgggaggccgccccgcgcttcgccgccctcgtcgtcttcgccgagcatcgctactacggagagtccatgccgtttggtagcaaagctaaggcgtacaatgactccaagtccctagcgtatctcacggccgagcaggcgcttgctgacttcgctgtgctcctcactgacctcaagcggaacctatctgcagagggcagccccgtcgtgctctttgggggctcatatggtggaatgctagctgcttggatgagactcaagtatccccatatttctgttggagctctctcatcatcag

SEQ ID NO: 1865 - DNA, 673 bp, Sorghum bicolor
  Clone ID: SORBI-28MAY03-CLUS31695_1
aatctcatcaaagcctaggccccccctcctccaccgcggctccgcctacccacggccgcgaggctcgtgacgtgacgccgccgggccgcgcgctctctccgggccggacgcctcgcgccgccgttcgaatccatggacgccgaggcaggtgtcgccggcgccgatcagctgccgcggaggcagtactacatgaatctattgcttttagcttaccagagctttggtgttgtttacggggacctaagcacatcgcctctttacgtttataaaagtacattctctggaaagctcagtcagtaccaagatgaggagacggtgttcggtgtgctttccctgatcttttggaccttcactctgattcctttgctcaagtatgtcaccattgtcttgagtgctgatgataacggtgaaggtggaccattcgctctctattcgctcctttgcaggcatgcaaaactcagtttgcttccaaatcaacaagcagccgatgaggaactctcttcatactacagaaatggctttgcaccccgcaatggatcttcgccttggttaaaaaggtttctggagaagcacaaaaaaatgagaactgtgctccttctcatagttctctgtggcgctagcatggtgattggtgatggtgtccttaccccagcaatctcagtcctctcatcta

SEQ ID NO: 1866 - DNA, 394 bp, Sorghum bicolor
  Clone ID: SORBI-28MAY03-CLUS31715_1
tgacggcgaccacccaaccagccagccgctccactcatcaagagggttcacgccgtgaactagtctgtctgccgtcgtagccgcaggccgcagcgcgctaaccatcatcgatctccacggccgccacatgcagggaggcggcggcgtgagctgcgcggtggccggcgaggcgccgacgcccgggccgccgcaccaccggcaccgcgtgggcgcggggggccggctgggcctgaccatcgacccggcgggcggcgacgacggggaggcccccgcggagcggatcgggcggctggtccgggagagccccgtggtaatcttcgcccggcgcgggtgctgcatgtgccacgtgatgcggcagctgctggcggccgtgggcgcgcacgccacggtgatc

SEQ ID NO: 1867 - DNA, 768 bp, Sorghum bicolor
  Clone ID: SORBI-28MAY03-CLUS31348_1
gcacgaggctactctccccgcagtccacagaggagcgaaccctagtgtccttccgcacgccgtcgccatggccgctgcccgcgccgccctccgcctgcagcgccagagcctcgccgccaacccctttctcttctccggccatggcctccgctaccgcaagctcgaggtcatcctcactacgacgattgataagctggggaaaacaggggatgtggtcaaggtggcgcctggccacttccgcaaccaccttatgcccaagatgctcgctgtcccgaacctggacaaatttgccatactcgtccgagagcagcgcaagctctatcaacgtgaagaggaggtcgtggtgaaacaagtcacaaaggaagatgatgatgcccggctacaggaagaaagactgaagcagtaccaagcagcagcaaagcggctagataatgcactcttggtgttgaggaggttcatctcgactggaaatgagctgcgtactcctgtaacaaaagatgaaattgtttccgaggtggcaaggcaactcaacatcaccatccatccagagaatctgcacctgcagtcacctttagcgtcgcttggtgaatttgagttgcccctccggttaccacaggacataccgcgcccagaaggtaagctccaatggactctgaaggttaagatcaggagaaaataagcgcagaaactggggaaatttcttttgctcccacaatatggtgcatgatacccaaccattgtagccttgtggaataggtttccattgca

SEQ ID NO: 1868 - DNA, 686 bp, Sorghum bicolor
  Clone ID: SORBI-28MAY03-CLUS31344_1
gtcggctggagtgacgctcttgtatttgataattggcagaacaccttttggcggagatcctgaacaaaatatcaaggaaatagcgaagctgaaaggcagcgaagaactatgggaagtagcgaaattgcacagctgtgaatcttcgtacccatccgatctctttgacgtcaaatttccattgtgcccagtgaatctaagggagtggtgtgcagccaacacacgcaggccagatttactcgagatgatacctacctccttttttaatcttgtggacaaatgtttggccgtcaaccccaggtgcaggctctcatcagaggacgcgttgaggcatgagttctttgctccatgccacgatagcttcaggaagcccaggatgctgaggagatcagctggttctgatgctgcatgttcatcgtctcaccagaacacagcacttacagcaaaacaatcataggtcgttccaccgtacatacctatatattaacaccagtaagctgattgtgaccatctagctatacaggcaagacaatagcctaaatgtgttcccgtcttgatgtaagtaaacacttgtactgaagacgtactaatccgttgtgttgctagtgttgtactgtagtatactaatatttaacttgggcgtgcaccgtacacggcaagcgtgcgatttgcgccttttttagatgtat

SEQ ID NO: 1869 - DNA, 606 bp, Sorghum bicolor
  Clone ID: SORBI-28MAY03-CLUS31358_1
gcacgaggaccacgtcggcgtgcgcacgtcagtgaaggacgattagaagcaaagctaagctaaagccccagctccagctccggtcgagccggccggcctccgcgatgcgagtcacgtcgtaccagaggctgtcgtcggagcggcccgagggtggcgccgccgcgagggcggcgtgggcgtgggcttcgctgaggcgggcagccgcaggggtcgcccggctctacgccgcgcggcggcggcggtcgtgcatgcggaggctgtgggtggcccggccgctgcgggcgaaggcggcgacgaggtacgagtacgactcggcgagctacgcgcgcaacttcgacgacggagcgtggatggccgatgagggcgtgtcatggaacgcgcgttcgttcggcgcgtgtagggtcgccgccgtcgagtcataaggagagcttccctttcatggcttcatgttgcttcttattagaattagtgactgattatttaattaggattgattattcattgaaatcgtgtgtagaattgatttgtatgccgttttattttttcgtctctctctctattatattgaatgcttcgtcagacgtgaaacatttcgaggtaaaataa

SEQ ID NO: 1870 - DNA, 492 bp, Sorghum bicolor
  Clone ID: SORBI-28MAY03-CLUS31941_1
tcttcctcttctcccacacggccgcacctagggtttcgtaccccctcccctcgtccaggcctccaccacccggaccaccgccgggcggcgcgcggcggccagcccctccccgccgcctgagacttctccactatcagcagtctcaattgcctcatcgttcgctcctcggcagcccaggtcgttgcctgcgtacctacgagccgggggccgacgtcgatctatcggtcgtacagccagccggaggcggtggtaggccggtgacgaagaaggggcggtctcttattgtcctacggctcctgccattcgtcgggtgctgagtttgcgccaaaggtgttattttggtactgcaggatttataagtgaagttgctgaagaagcggttttaaagctgtctgctgctatttcttcgatggcaaccaacgagaacctcccaccaaatgtgatcaggcaattggctaaagagttgaagaatcttgatgactcacctccaga

SEQ ID NO: 1871 - DNA, 901 bp, Sorghum bicolor
  Clone ID: SORBI-28MAY03-CLUS32008_1
gcacgaggcctcactccaccccacgacggccatgctgccccatcgccattcccctgctccctctctcagcgcatcgtcgctctcatggtccgccgccatcgccgtctcccgcatcccgccggcccgtggcctcgcgctccacccatcggttccgcctcccgcctccggcaaccgtcagagcccggtggtgtgcgcggcgtggacgcggcggtcgcgcggggaggcggagcagcggcccaaccgcaagtcgtggaagcagcgcacggacatgtacatgcgccccttcctgctcaatgtttttttctccaagcgcttcgtgcacgcgaaggtcatgcacaggggaaccagcaaggtcatagccgtcgccaccaccaacgccaaggacctccggctcaccctcccgtcccttgtcgacgacaatgcctgcaggaccatcgggaggctcatcgccgagaggtcaatggacgccgacgtctttgctctggcctatgagcccaagaagaacgagaggatcgagggcaagctcgggatcgtgattgacactattaaggagcacggcatcatcttcgtctaggatagctgaactcttctccctccccttgttcgtggaaaattacatctggaagaaagtgggtaaatggtatgacaatttgttggaaagaaacaacaatgcgtcatagttctggcagctcgcttatctttaatatcctcctgcttagcaaagtgggggtagttctaagtattctctttctttaagtgactgtatgactgtattttctatacttatagtttcactgtatgattgtattgtctagatcttttaagtctgtcattgtggaatgtttttccaatggtaagtaatgaaaatttatctgttaagagctcatcattgtttcaacca

SEQ ID NO: 1872 - DNA, 614 bp, Sorghum bicolor
  Clone ID: SORBI-28MAY03-CLUS32009_1
gcacgtgcggctcgagcgtgagttgtgactagagagacgatgcgcttcatctggcatggccatcactgagacggcagcacggaagctcctgcatggcggcgccgctggcaccatcgcccaaggcgtcgccgacttgggcggcatcagcttcggcctgtgggagatggtgaccagcttcttcgccgacatcatcgcctacctcttcgccgcactcgcgggcgcagcccacctgctcgtcctgccactggaggtgctctggcagtcgctcgtcaccgtcgtcaccaccgccgcgggcgccgtcgcttccggcctcgatggcctgtgccactacgtcacgggcttcttcgcccaaatcttcgcggccatcgccggtgcggcccacctgttggtcctgcccctagagacgctctggcagtggctcgccaccagcgcgaccgacgccgcgggctccatcgcttccggcatcgacggcctgtggcagcacgtcacgggcttcctcgcccacatcttcgcggccatcgccggcgcggcccaccaattcgtcctgccgctagagacgctctggcagtggctcgctaccagcatgacagacgccgcgggcgccatcagctccg

SEQ ID NO: 1873 - DNA, 816 bp, Sorghum bicolor
  Clone ID: SORBI-28MAY03-CLUS32027_1
gcacgaggccccgaggtggcgcgcgggcaggagcaaggacccgccgccgacgtctgggcgctcgggtgcatggtcatcgagatggccacgggccgcgcgccctggagcgacatggacgacctcctcgccgcgatccaccggatcgggtacacggacgccgtgcctgaggtgcccgcgtggctgtcggcggaggccaaggacttcctggccggctgcttcaagaggcacgccagcgcccggtccacggcggcccagctcgtggcgcacccgttcgtcgcttcctcctccgccgccgcccgcgacttgcaggacgcgcagccggcgaagcagcaggcgttgttcccgtcccccaagagcacgctgcacgacgcgttctgggactcggacaccgaggacgacgacggagcggacgagatgtcgacgggcgcggccgagaggatcggcgcattggcgtgcgccgcctccgcgctgcctgactgggactccgaggaaggctggatcgacctccaggacgacgaccgctcgggaaccgtcgacgcaccaccggcagcgacggcggatgtcgcggactacttcgtctgggcggagccgtcagatgcagcagagctggagcatcaattcgtcgccgccggcgccgcagatgtcagtgtccatctacatcgtctcccgtcgcgcattgcaggagcggtggtagctggtgccaccaccattagccagggaagttacttgcctacgcatttaggcgtccatgatgacgggataggaaaggtggaatcccaccgcgctttaacagaaacagagtagtaataacaacaa

SEQ ID NO: 1874 - DNA, 740 bp, Sorghum bicolor
  Clone ID: SORBI-28MAY03-CLUS3203_1
cgtccgcggaactcgtgtaacgcgtctcacttgaggagtgaagcggtatcagctggcgtttggagagtccatgcatcaagggacagcgagctgcaaggcagtagcgctagcagtccgtttgacaggcagcaaggtgaagggaggggtcctgcgccaccctttccagcatcttcagttggaaacaggcaagctcaagctcaagctcaagcctcctctgggagcagggagaatccgagcagagtcattagggttgttccccacactgcgcgcactgcttcggagtcagcagcgcggattctccagtcaatacagatggagaggaaacaaaacgacccctgactcgcaaccgcatgctgtatgttcttgacccgtagagttactatacttgtttagctgagagcagctgagagcctagacaactagtacttagctactgtattatttttgaccgataatagctgttatatatgattgccgtaaattggctgacctgctgttttgttcagtgtaaatatgtggtgattcaggtgtctgtcagaatgatggccttgtaatacatctgtagctatgttggtcatggtgctgtatacaggaactggaatttgtaaccttgaaggaattttctacttctgtgttaaggaaaaactggggtttgtcttgacctgcaaaggttgtgttgcaggtatgctaagaaattcaaacctgtgtgttaatttatatatgctgatgtgcaatgtcta

SEQ ID NO: 1875 - DNA, 717 bp, Sorghum bicolor
  Clone ID: SORBI-28MAY03-CLUS32052_1
gcacgagggaagaggattgagtcaaaagaaaaagctattttggagttttatcaacaatttgcttgtgtaggtggggacctggtattttcggagtccttatgcgaggaattacaaaagaaattttttcaacaaaaatgtgaattaggaagagttggtcgacgaaatatgaatcggagactgaatcttgatatccctcagaacaatacattcttgttaccacgagatgtattggccgctacggatcatttgattggaatgaaatttggaacgggtatacttgacgatgacgatatgaatcacttgaaaaataaacgtattcgttcggttgcagatctgttacaagatcaattcggactggctcttggccgtttacaacatgcggttcaaaaaactatccgtagagtattcatacgtcaatcgaaaccgactccacaaactttggtaactccaacttcaacttcgattttattaatcactacttatgagaccttttttggcacataccccttagctcaagtttttgatcaaaccaatccattgacacaaacggttcatgggcgaaaagtgagttgtttgggtcctggaggattgacggggagaactgcaagttttcgtagccgagatattcatccgagtcactatgggcgtatttgtccaattgacacgtccgaaggaatcaatgttggacttaccggatcgttagctattcatgcgaga

SEQ ID NO: 1876 - DNA, 564 bp, Sorghum bicolor
  Clone ID: SORBI-28MAY03-CLUS32083_1
tggaggtgcccctcaccgccaactggtcctactcctccgccttcgtgtacttcgtggtggcgaacgcgatggtatgcctgttctcggcggcggcgctggcggcgtgccggagccgggccgccatggtgcccgtcatggtgggcgacctgctggcgctggcgctgctctactcggccgtgggcgccgccgccgagttcggcatcctgggcgagcgcggcaactcgcacgtgcgctgggctaaagtctgcaacgtctacggccgcttctgcgaccgcgccatggccgccgtcatcgtctcactcatcggcgccttcgccaacctcgtcctcctcatgctcaacatcctcaccatccataagagctcatcctactactagctagctactagtatagagaagaggggcaggcagatctagaagagaaaaccatatagtgtaattaagctactaatagctgtcgctgggaattaaagatagacagactatgcttgcttgcatcggatgccaattatattggattggagacaggtaatggacacacttactttcagtaattaatttctat

SEQ ID NO: 1877 - DNA, 627 bp, Sorghum bicolor
  Clone ID: SORBI-28MAY03-CLUS31432_1
tgccgccggagggaagggaggtgggggagcacaggcccggggggatgctagaggcgaagccgccgtcgccgggctccggcgcggccggggcggcggcggcgcacatccacagtcaccggcggtgggcggcgccgctgctggcctcggtcctgctctcgtcgctcctcatctccgcgtcgctcttcttctcctcctcccgcgcgctgctcctctccttctcgccgctcccttccgcggcctccgccgagcctctcttcgtcgaggccaagctccgccagcagatgcgcgccgaggagcgccccgcgaggggcgccgtgcccaggatcgcctacctcatctccggctccgcgggggacggagccgcgctgcgccggacgctcagggcgctctaccacccggccaacacgtacgtcgtgcacctcgacctcgaggcccccgccgccgagcgcgccgagctcgccgcggccgtccgcgcggacaccgtctacgcaaggttccgcaacgtcaaggtcgtcacacgggccaacctcgtcacctaccgtggcccgaccatggtggccaacacgctgcacgcggctgccatcctgctgcgcgagggcggtgattgggactggttcatcaacctct

SEQ ID NO: 1878 - DNA, 544 bp, Sorghum bicolor
  Clone ID: SORBI-28MAY03-CLUS3148_1
gcacgagggttgaatcctgtattcctgcaggtgcttcaagcaatggttcaaatgggtgtccttgttcctacgtccgcccacgcgtccgcccacgcgtccgctcaatttttccttaatagctttgaagagcgtctagcagcacaaaggaaggagagagagatggcaactgcagaactgggatttaaaaagcaattaactaaggaggagaagtttgaaaagaggaagcagagacttgctgcaatcggagaggatcttttggcgattgctgctgatcaaccatttcgcttccctgccacatttacatttgtggtcagagcattctcagttctagatggtattgggaaaggccttgatcctaggtttgatattacagagattgctaagccatatgccaaggaattgctaagatttaatgaagctggtgttgaagtagttgtgaaggatgcaaagaagagatgggaaaggcagtcccgtgccttttacaatttgttccgccaacccgacagagttgaaaagctggcacaaattattgaacgtttggagc

SEQ ID NO: 1879 - DNA, 425 bp, Sorghum bicolor
  Clone ID: SORBI-28MAY03-CLUS31510_1
gcacggcgcccgcccaataataaccaacctaaccaagctgcggactgagcttagctgttgatgagcaggtgagctagctagctagtagctaggtacagtcacggagctagtctgccatatgggcaactgcgtccagagcagcggcggtggcgttagcagctgcgccgtcgccgtagaagcagggcggcagcagcagcagctgctgctgcagcggaggaaaagcgctgccggtgatgaggaggaggaggtaataattgatcaaggggcggcggcgccgtcgtcggtcatgaaggtgaagatggtgctgacaaagggcgagctggggtggctggtggcgcagctcaaggccggcgaccgccgcctcgaggacgtgctccaggagatggcgcgcaagcgtgatggccgccgcagcgccgaagccgacg

SEQ ID NO: 1880 - DNA, 531 bp, Sorghum bicolor
  Clone ID: SORBI-28MAY03-CLUS32167_1
gcccggggcgtgggcctacaccctgatccgcttcaccaacaagcccctccgcgagatcaccaagagcacctccttcctcaagagcatgagcaccaacaggatgaactccgccgccgcctgaggcgagcaccaccaccgtggccatggccggccggcgtgtcctgctgcctcctcctgtggaagggctactactgctagtaatttagcctactacacctattcacctgtgtgtctgtctgtgtgtgtgagtatatatacaattcctgcgtgtgtgtggatggatggaaaacagatggaaaagggtacctagctacgacgtactgtggtttgttggagcattcatgtcgatgtggcacgtacaagcatgcatgcatgcgagggaagaggacgaccgtgtcttcgattccgggcaactctatagctgggttaactatagttggtctaccccgtgaatgtgcttaattataagcaattgctgcattgtcatgtactacgccgcctattttgttaactccaattaatgtgttgctg

SEQ ID NO: 1881 - DNA, 141 bp, Sorghum bicolor
  Clone ID: SORBI-28MAY03-CLUS32189_1
tccctatataggagtaagtacaagccgtaattaataaggatggacgcggaaagttccgattgatataggatgtatacaagcaagagcgctcgccattcgttggttattagtagcatccctccagcgtccgggtggaaatat

SEQ ID NO: 1882 - DNA, 222 bp, Sorghum bicolor
  Clone ID: SORBI-28MAY03-CLUS32198_1
ggcggtttaccagcagggcagcagcaacggcggcgatgtctgaaatgatagtagactctgactctaacgacatcaaactatcaaagacagtcagctgtgggagctgtggtgctcttgtgccaaagtactacacgaatttgtagggtagtagtgtttccaattagtgtaatggcaaatggcatagttgattgttattatgggaaaaaaaaaaaaaaaaaaaaa

SEQ ID NO: 1883 - DNA, 531 bp, Sorghum bicolor
  Clone ID: SORBI-28MAY03-CLUS32205_1
gcacgagggaagaccccgaggcaggaggcgagcgggggaaggaagaagaagatgaaggtccgcgcgtcggtgaagcgcctgtgcgggttctgcaaggtggtgaagcgccggggcatcgtcttcatccactgcaccgccaaccccaagcacaagcagcgccagggcttctccaccatcgccgaagccgccgccgcgtgcgtccacctgccgccgccaccgcccgccagcggttccgcctccgccgcagcgttcgcggaggcttcaaaggtggcgaggcaagagatgtctatgaagttcaattggccgctaggtttagctgccttgctcaagaatggagaaaaataatgcatcaggtctaccatatgctgacattttaagcagatgttgaatagagccagttggtatcatgatatgaagagaagcatgtagcaaaaacttgaaactgtaccatcatcatgtatttgctattactacacatcagttgaagtcatgctacggtggaataatatcagcaaaaaaaaaaaaaaaaaa

SEQ ID NO: 1884 - DNA, 448 bp, Sorghum bicolor
  Clone ID: SORBI-28MAY03-CLUS32202_1
gcacgagggttttgtactgcaagaaatggatattgttcatgttcatagttgccatgttcatatgtgaggagttccttccatctccaagcaagcaggcagcggaggggaaatctttgtcatatcagacttggagtcctcagttattcttttggggtatctgtattcaatagaaaatgggcttggcaataaagcggaggtaacattcattgcacattgcgttctcacagcatgagtcaggtggattcatgctgtgttggagagattcattctgtgttggagagattcattcatcaagcttcgatttgatttcatttctttttcttctctgtttcatgtttagacagctgctgagatgatgtagtgctgcatttggttacttatctggtgttgtggtaattagtctgattgtgatcatctacatttgttgccatttattttacatccacta

SEQ ID NO: 1885 - DNA, 707 bp, Sorghum bicolor
  Clone ID: SORBI-28MAY03-CLUS32248_1
cagcaagtatggtgcatcctgcaacggggtactcagtggttagatctttgtctgaggctccaagatatgcttctgtgatatccgacatcttaaataaccgagttcctgcagaatatttgcttggaaattctcaaaattacagtccatcaatgcttgcatggagaacactatggcctcaagaaaggaaacgtcagcgatccttcttccttttcggattagcgttgataatccaactgaataatgaaggcatacaaacattctttgaagcctttttcagggtgccgaaatggatgtggcggggatttcttggctcaaccctttcatcggtcgatctcatactattttcattctacatgtttgcaatagctccaaatcaattgcgaatgaacctcgtcagacatctcctctctgacccgactggctcaaccatgatcaagacctacctgcccttataaaaccttctgcaccaggctgcaagaactcttagaaactgtacagttttgtagttgtacataagttagaggggatcttgggggttccttttcttattcccgtatggcggcggatctagggggttaccatcaacactataatacgctcgaaatcttttatggttgctgtggtgatgggtgcatgatggagtggaagaagaataagagagatccggtgatggtcatggttacctgcattggccatttttaggtctt

SEQ ID NO: 1886 - DNA, 674 bp, Sorghum bicolor
  Clone ID: SORBI-28MAY03-CLUS32278_1
ccacatccagcagcagagccagccaacgaaaatgtcgcgcgtcacagctgcggcggccctcttctacatcctcgccgtcgtcgctgccctcagcgcggccgccgaggccccggcagcgtcaccgaaggctgccactgccagagctcctgccaaggcacccgaggctgctgctgccaagaaaactcctgcccccgctaaggcccctgctgctgctgccgtcgcctccacccccacccccgccgccgccgcgcatgccccatcgccgtcgtcgtcgtcgtctaggaagtctggtccagctgcagcgccgaccaccgcctctactacaccgccttcttcttcgtccaccgacgaggagttggtcccttccccggcagccgcggcggcgacgcctgccgctgatgggcctgctgagggaccggcggctgctgatgactccggtgctgctacccttggaagcggagctgccatcgccgccggcgttgccgctgcggtcgctaccatgatcttctactgaattccccagggatcggccgtgccgtggaacgagggtggacacgtaattggctgtgccgtatttgctcttgcatggtcgggagggacgaccaatgcaagtgtgtttctgctttgctcacttcgtttgctcttgcaacattatggggtcaaccgttatatat

SEQ ID NO: 1887 - DNA, 678 bp, Sorghum bicolor
  Clone ID: SORBI-28MAY03-CLUS31726_1
gcacgagggccgtcactagccagccggcggtccggcgccatgctccgggcgctcaacccgtccccgtccccgaccccgctgcgcgcgcgcccggcgtgccgcgcgtcgccacggcggcgcccgcgtggggcctgggcgcgcccccgcgcctcggcgcagccgcccgtgcccccgcctgccggggaccggctgtgcgcgccgtcacggggcgccgcagcccagctggccgcgcctgatgtcagcgcggcggcgcccggggcgcggggcgagctggaggcgttcctggaggtggtgcccgctaggatgcggcgcgggctggcgctgcaccaggaggtgcggcacctcgtcgaggtcgtcatggacctcggccgccgccccatcgcacggttcccgtccggggactgggtcatctccgaccaggtcgtcaccgccgacgctacctcctccaggccgtcgccaaggtaggtgacttctccgaggacaaccgatctggaatcaatcactcattgcaccggatcagcgctatccggaaccggaaagcgcaaatcttagggctcacttgccgtgttggtcgagctatatctggcagtgctgagatgatccgtgacctagtggtgggcggtggttcaatactggtgattggacctcctggagttgggaaaaccactctgatcaggg

SEQ ID NO: 1888 - DNA, 471 bp, Sorghum bicolor
  Clone ID: SORBI-28MAY03-CLUS31767_1
gcacgaggcacggatcgacgcccgccggcccatcacaccccgcaagctaagctaagcgcgcagcaatggcggcggcgccggggcggccgctgacggtggacttcgaggcgttgagctacatcagcagcctggtggaggcgttccaggcgttcgattccgacagcgacgggctggtgacggcgccggagctgcggggcctgctggcgtcgctggggctggacaagtcggaggccgaggcacgcgacatgctggcgcgcgccgacgccgaccgcgacggcaagctcagcgtcgaggagctgctggacgtgatgaacgccggggagctcgggctgggcgcgctcggggagatgctgcagtcggcgctgccccagctcgaggccgccggggccgcgctcgtcggcgcggatgagctcgccagggtgcttggcactctgggcgacgccagccgcgaggactgcgcggctattgttg

SEQ ID NO: 1889 - DNA, 482 bp, Sorghum bicolor
  Clone ID: SORBI-28MAY03-CLUS31780_1
caatttcgtttgccgcgcacaaaggcacgtggtgtaaatgggatcagtgtacgggtgaaatactgcgatacttgcatgctgtaccgaccacctcgatgctcacactgttccatttgtaataactgtgtggaacggtttgatcatcactgtccatgggttggccagtgcataggactgcgtaattatcggttcttctatatgtttgtcttctcgacgacattgctctgcctgtatgtatttgccttctgttgggtgtatgtgatcaagattagagatgctgagcaattgtcactttggaaggccttgttgaagacaccagcttcaattgttctgattatctactgctttctttgtgtatggtttgtgggtgggttatctgtcttccatttatacctgatgagcactaaccagacaacatatgagaatttcaggtatcgctatgatcggcgcgataacccatataacagaggtattctagacaa

SEQ ID NO: 1890 - DNA, 590 bp, Sorghum bicolor
  Clone ID: SORBI-28MAY03-CLUS31940_1
gcacgcgcgtccatctccccagcggcgaggagagccggccaccacagggagaaatggcttccgcaagcaatgctctcagggtgttcttcatcctagcgatcctatgcgcggtatgcacagcgaaaaggaccggagcaaagacgggagactcggcagcagactctgctgcttctggagccagcgggacgttcgacatctccaagctcggcgcgacgggcgacggcaagacggactccacaaaggcggttcaagacgcgtggacgtcagcgtgcagagcgaccggaagcgccacggtgctcatccccaagggcgactatctggtcggccctctcaacttcgttggcccgtgcaagggcgccatcaccatccagctcgatggcaacctgctgggatccaacgacctggccaagtacaaggcgagctggatcgagttgtcgcacgtcgacaacatcgtcatgactggctcgggcacgctcgacggccagggcaccgccgtttataaaaaggccaaaaccggcactgtgaaggcgatgccaaacacattggtgctgttctacgtgaccaacggcactgtctctggaatcaaacta

SEQ ID NO: 1891 - DNA, 776 bp, Sorghum bicolor
  Clone ID: SORBI-28MAY03-CLUS32355_1
cccgtccccaagcaaaaagctagacgtagaacacgaatagataaagaatgacgcagcagtcgatggtggcgctggtcgccgccggcgtcctcctcctcgccggcgtggcgtcggcggagaaggcgggcgggttcgtggtgacgggtcgcgtgtactgcgacccctgccgcgccgggttcgagacgaacgtgtccaagagcgtggcgggcgcgacggtggaggtggtgtgccggcacttcgaggcgagcaaggagacgctcaaggcggaggcgacgacggacgacttcgggtggtacaagctggagatcgaccaggaccaccaggaggagatctgcgaggtggtgctcaagaagagccccgacccggcgtgcgccgagatcgaggagcagcgcgcccgcgcccgcgtcccgctcacctccaacaacggcatcaagcagaagggcacccggtacgccaaccccatcgccttcttccgcaaggacccgctcaaggagtgcggcgcaatcctccagaagtacgacctcaaggacgcatccgacacgccatgatcatgtgtatcatatcgatcgttaagcgtccatcgacgacgacgacgacgtcgtccggccatccgttacgtacctcgatcgatcgagcaactaactgaactgtcatatatacatatatatgcatatatggtagtagtagtagtagtaggtcccgcgcccggccggccgttgttcgccggcgccggagaagatggtagtagctagccaccaagtgtcttcctcgttttt

SEQ ID NO: 1892 - DNA, 718 bp, Sorghum bicolor
  Clone ID: SORBI-28MAY03-CLUS32361_1
cgctgccaacatcatgcagaacctcatagcaggagccaaccaattccagcagcagtttcagaacccgaacttcagcgacgcaggagccaaccaattcccgccacagtttcagaaccagaacttcagtggcccgggagcaaaccaattccagcagcagtttcagaacccgaacttcggtggcttcccaaaccaaacgccgatgccctttcctcagttcatgccccaaaccggaacgcctgcaaatccaatgccattcggtggcagaccaccagtgaactctccatttggtccagtgcctatggggcaaggcaactttggtcagcctccaaattcacaaggatttacaaacctggcggcgccaccccgtggagacggggaacaagattcacccccgcagttcagttctaggcagtttcatcaagggagcccgtcctttggccggggaaggacgcagcagcgcggtggccggcattcctctggcagaggtggcagaggcggccggcatcgcagataggtgtctctgcctctctgtggctttgcccccggtgtactatgtttcttgtagtcgagacaccaaagttatgtaataccagaaagatgtttcttgtaatgatgcttgctgaatggattgaacatcctgtcgattgctaccgtgccagaaaccagaaaacaccctgcgctcactataatttagtggaaagggataattttttttcca

SEQ ID NO: 1893 - DNA, 593 bp, Sorghum bicolor
  Clone ID: SORBI-28MAY03-CLUS32409_1
gcacgaggcccggaccccagcgctgctcgctccgagcggcgacgggagggccgcacggcttgatcaggatggtggtaattctatttctacaacaatgcttaggcagcgcttgatctgtgccattgacagtgaattggaagcgatctctgaacaagtggaaaaagagaagcttgagaggtgtaggaagacattgcttggataccttcagagaatctgtgccctaggtccttcacatgttggaccaaatttccttctcttgcctgactttgaatcaaaatgtggtgtcacagctagcccaaatggaaaggaagatattcttgtgagtagcaagtgtcatgtatcagagatattggggtttgcgcgtgcacctgatgcagagacaaaaaatgccactgaaagtgaaacagagacatcgacgtattctctcgattctgaagcgctaaggaacagcatcgtctcaggttttcagtttgccacaaatgcaggtcccatatgcgatgaacctatgaggggtgtggcattcattgttgaggcacaccttctgtctaacaactctgatgttgcaattccctctgatgataacatcttcactg

SEQ ID NO: 1894 - DNA, 514 bp, Sorghum bicolor
  Clone ID: SORBI-28MAY03-CLUS32445_1
gccttataagcgcgcgcagcctaggcagctcgacgcatcttcgccgccgcacaaggctcccccacacgaaacctaccttcctccgggagacgattcgacagggagaggaaagaggcaagaggagccatggacgctgccaactcggtaacgccgggcgccgtgtcgcacatcctggcgcacccgtcgacgggctccgacggcgccgtgccggatctcgtcgtccaggtcctcgacctcaagtccatcggcacgggcagccggttcagtttcatggcaaccgacgggaaggataagatcaaggcgatgttccccaccagcttcgcgtcggaggtccgctccggcaatctgaagaacctcggcctcatccgcatcctcgactacacttgcaacgccgtcaacggcaacaatggcaaagtcttgattgtcatcaaatgcgagcttgtgtgccaagcgctcgacgccgagatcaacggcgaggccaagaaagaggagcctccaattgtgctgaagccta

SEQ ID NO: 1895 - DNA, 455 bp, Sorghum bicolor
  Clone ID: SORBI-28MAY03-CLUS32453_1
gcacgagggagagaactagtctcgagttttttttttttttgagcattagaaaatatttgtatagtacaacaatcctgttttgaagagtagaaattattatcatgctatgtttcttctaaaataggcctaaatgtatatatcagagactaaacaaatatagctgtaatttaatggttggctcctgctggatttcagtccaagctccaccagtgtttgtgattgtcttgagcctggttgtggtgagaagctaatttagtggcatcagactataatagtgactaatgtttagtatgctggctattttttattcctatctgacccaattacaagtgtatacatgtattatgatattgagcatttggttgtcagatccactattttacactaaaaccttctattctaaaaaaataggctacctagctggatctataaaagggtgattcaaacctgtttaa

SEQ ID NO: 1896 - DNA, 481 bp, Sorghum bicolor
  Clone ID: SORBI-28MAY03-CLUS3250_1
accaaggacgatggatgcactctttgcacagatgaagcgtccgcgcatgaggaccgtaccacagcagcaggcaaaccctgcccctgggcgtcatttcaaccagcagcgacgtgttcagcagcagcagaggcgaggtagaggatatggtggccggaatgttggcaaccaatgaattcaactaagcatatctgctgcatcgaagcccattctcttcactggtcttacggaccttggaagaaaagacgcccctgggaaaatctaacttggctttgtttttttagaggaaaggttgtggacagaatatgaagcgaagtttgtgtggagttttctagttacctgcttccgtttcaacatgtataatgacctatggaaattatttggtgctacattatgatgtcgtgtttcttgagttgattaggttcatctcttcttcaaaagaattaggagtaatttgccttttaccctatgatgtataaatttt

SEQ ID NO: 1897 - DNA, 486 bp, Sorghum bicolor
  Clone ID: SORBI-28MAY03-CLUS32557_1
gcacgaggggtggctgtgctcgcgggcgattttatgtttgcacagtcttcttggtttcttgcaaacctagaaaacattgaagtcatcaagctcatcagccaggtaatcaaggatttcgctagtggtgagataaagcaagcatcaacacttttcgactgcgacgtcacgctcgacgattatctgctgaagagctattacaagaccgcttctctgatcgcggcaagcacaaggtctgccgccatattcagcggcatggacaccaccatctgcgagcagatgtacgaatacggcaggaacctggggctctccttccaggtcgtggacgacatcctcgacttcacccagtcagcggagcagctcgggaagccagcggggagtgacctggcgaaaggaaacctgacggctccggtgatcttcgcgctgcaagacgagccacggctgcgggagatcatcgactctgagttcagcgagccgggatccctggcg

SEQ ID NO: 1898 - DNA, 649 bp, Sorghum bicolor
  Clone ID: SORBI-28MAY03-CLUS32144_1
tatgtagaggcgatactgttgctataaataattcattggagcgctatcaggacattgacccaaccttctcggggacacgtgaatacaagcttttggcggaccttgcagcctctatggatgaaggagacgttgacaagtttactgatgctgtaaaggaatttgacagcatgacacgcctggatccttggaaaacaagtctccttctaaaggcaaagaatgagttgaagaaaaaggatgaggatgaggatgatctaacctaggctttgttctacaaaaggttccatgatttcattgaggatgccgtgaagtctttacacaagattgtttgacatatgtatggatatacaaaacctccttgataaatgctttccctatggacacctgtttggactttggagtactctggttaccgcttaattcaccgccgcatttggaatctagtagctactatttgtgtcatcctatatgttgcatttgttccattagtgttcatgactatatatgctgcgcatatgactccaggctttctagtataaataggtttaaataatagggagtagtgtggattttgttttagatgtgtttgagagtatgtaatcagagagggaagggagggagagttgaactatgtttgttttcattgaattga

SEQ ID NO: 1899 - DNA, 692 bp, Sorghum bicolor
  Clone ID: SORBI-28MAY03-CLUS32139_1
tgggccaggaaaagcctgttttcttcagtttaaatgccatcataagccacatcaagcctgaccagaatatgtggtaccgtgcttgcaagacctgcaacaagaaggtgactgaagcttttggatctggatactggtgtgagggatgccaaaagaacgactctgaatgctcactgagatacataatggtcctcaagatctctgatcccactggtgaggcatgggtgtccgtgttcaacgagcatgctgagaagatcattggctgcagcgctgacgagcttgatcggatcaggaaagaggagggcgatgacagttacattctcaagctcaaggaagccacctgggttcctcaccttttccgcgtcagcgtcacgcagcatgaatacatgaacgagaaaaggcagaggatcaccgtgaggagtgaagcaccggtcgaactatgcagctgaatccaagtacctgcttgaagagatcgcgaagcttactgcttgctagaagatgcaatctttctggtggttcgtgaaggaggactggcccctgatatggttccctcgcaagggttttgagctgtagtaactttattactgttctgtgttgctctcattggtctttagcacttctgtaagatatgtagatgttggttcaccttgatgtaagcacaacagatgctatgacagttcaagcataagccttgc

SEQ ID NO: 1900 - DNA, 547 bp, Sorghum bicolor
  Clone ID: SORBI-28MAY03-CLUS32147_1
acctgtttaattttgactgcttggtgttcgtatcatattatatcacctgcaacatggtcagctggtcagacaatataatcatcttttagtaagaaattttcatcccattaaaagctagagagatgtactctcatgaactcacatacaagtacttgcagaaaaaaatattgtggactgcagtgccatgttcttatcatcagggctaataattgtggactgtagtgccatgttgtatttttattaatcctgtccgatggaatactattaaaacttcatttgatcttgtagtgttcatataacaggcttgtgattgcaagaacctataaagggatcgactagagagaagatgaagttaggccatccagcattggccaacaacgaggtgccgaccaaagaaacacttaaggagatttctcagtacataggactgtagataactcatgtttattccattcatgttttaaagaaatccaaattagagggcactgatatgttcataagtatatgtgatgggttatggttcatataaatagaaatcttatatcct

SEQ ID NO: 1901 - DNA, 474 bp, Sorghum bicolor
  Clone ID: SORBI-28MAY03-CLUS32660_1
gcaccacgggctggcgctgctgctcgtggtggcgctggccttggcggacgcggcggcggggaggttcgtggtggagaagaacagcatccaggtgacgtcccccgacgagctcaagggcaagtacgagtgcgccatcggcaacttcggggtgccgcagtacgggggcaccctgcacggatgggtcgagtaccccaagtccaaccggaaggcgtgccagagcttcgaccagttcgacatctcgttcaagcccaagcaggctgggggacgacccaccttcgtcctcgtcgaccgcggagaatgcttcttcacaaccaacgcatggaatgcacaaaacgctggagctgctgcagttcttgtcgtggatgacaagtcagaacctctaatcacaatggacaacccagaagaaggcaaagagcacctagaaaacatcactattccctcagtgcttataacaaagaaattgggggaaagcct

SEQ ID NO: 1902 - DNA, 853 bp, Sorghum bicolor
  Clone ID: SORBI-28MAY03-CLUS32668_1
gcacgaggatgaagcagaggtccttccaccagtcccaaaaattgaaatacagttagaaccacatcatcagactcttccagtagggactatttcagctataatgggtgagagagtaattgttgaaggttcagtccaacacaaccccctgaatgagggttcaattctctggataacagaaagtaggacgccacttggtatagttgatgagttgtttggacccgttaagaacccatactaccttgtgcggtacaactctgaggaagaggtacctgctgggatcagtgcaggaaccaatgtctcttttgtagcggactttgcagatcacatcctgaatatgaaggagctctatgcaaaaggctatgatgaatctgatcctgtaggcaatgaagaagaagaagatttacctgatttctctgatgatgaaaaggaggctgagtacaaacggtcattacgtcaagcaaaaaggcggactgatagacagcatgagcctatgaagacttctggtgataggaagagatcacagtctagaggtagtgggatccggaagcccatgccgccaaggaacctggatacatcagcaccaggtcaccagccacggcctcattttcgccgctcagatatggctcgtgcaggtgctgaaaatacagcacattcattgggtcctcaaaatgcacctatgattgctccaaccatgctgcctgctggcacaatgaaccctgctatgccatcacctgttcctcttgcaaatcagatgggtggctgcttcatgaatccagcacagcagcagttcttaccgcaacaacctaatatggtttggcctggtggatttccacagcctcctcatccgaacatg

SEQ ID NO: 1903 - DNA, 683 bp, Sorghum bicolor
  unsure (1)..(683): unsure at all n locations
  Clone ID: SORBI-28MAY03-CLUS32703_1
gtgttgcagatgttgggatggttgaattacttttgcagtatggtgctagtgtaaatatgaatgatctaggggtcggacaccccttcatcactgcattttgaaaggaagacatcagcatgcaaagcttctcctctccagaggggctgattcacaagccatggatcgagatggtaggacagcattacagtatgcaatcgacagtggaacaagcgatgaagacattcttgcgttgttagaggaccatagtagataatcttgcaaccacacctgcggtaaattgaggtcctcttggtgtggtcgactcaactaacagggctccagccccgccctgccccgcccggtcccagcttgtcgtgcagacaatccaaatttatggcaggaaagcaacctatgtacatgtcgttgtagggcttcagtatcatgatgcgcctgttgtttctttccccaccttttgcttgtttagcatcagtggtccttatttagtcatctggcaaacggtttggttttgtttgctgcaggtgatgcatagtaagcttgtaaatggagttgcttctctttattttctagtcatctttcatcattgaagtagatgtgccattctgatgaaagatgattgtacatatcgagatgtgctngttgtggtatatgaaatatgagcatggtgggagtgtttatacgaaagt

SEQ ID NO: 1904 - DNA, 622 bp, Sorghum bicolor
  Clone ID: SORBI-28MAY03-CLUS32729_1
cggcgggccctgtcttcgcctcctgcttggtcttccggtctccgaccgctgcgaccctctccggtgctcgcatccttatgcttcccctggcggtcttcgtgccagggttggtcttccgggttcccatctctgcagtggatgcggttcgttctggcagctccctggcccggtgcactctctccggcgccgtgtggcgccgggtcccacgacggctgcctgcgcccccgcgcgctccaggttctgcgcctccggacctgtcaagtattcaggtgctcatgcgtccccgggggggctgctcgcaggctagggttttgcaacttcgcattgctgctgtgcctccggccctttctgacagttggctcccccagcggagtccgaccctggcgatatagtgctgggttcaatgaaggctgcataagctagggctcgcaatagtttcttcacttcttgaagagagaattatatatgtactcatgcgtgtgtggtgaggttggtcatagactagtaaattggaacttcttatagcatcttttcctccttccatttgtgatattagtctccagtatcagaattcaattccttattaggaaggttgatttgctgtggtgtctatgcttatcct

SEQ ID NO: 1905 - DNA, 545 bp, Sorghum bicolor
  Clone ID: SORBI-28MAY03-CLUS3274_1
gcacgaggcatgcacgagtttcgccttgagggcaagctcccgcagccgtccccgcgctccgccaaggacgagtgggccgtgtgcaaggtgttcaacaaggagctggcggcgaggaccgagccaatggcggcggctgtggccggcgccgagctcgagcgcgtcggttcgctgggcttcctcaacgagctcctcgactccgcggagctgccggccctcatcggcgccgacgtggacgaggtgatcgacttcaagggccccgcgtccacctccggcctgcacgccggcgcgccgggcacgagctaccttccggtgaagatggaggagcacgcgctgctgcagcagatgcagtaccagcagcagccgcccccgatgttctactcgagccagtacttctcgctgccggcgatgaactccggcgacctccctccggcgatccggaggtactgcaaggcggagcagcaggtggtgtcgtcggggcagacggcgtcggtggtcagcccgtcccgcgagaccgggctcagcaccgaccgcaacgcggcaggcgg

SEQ ID NO: 1906 - DNA, 571 bp, Sorghum bicolor
  unsure (1)..(571): unsure at all n locations
  Clone ID: SORBI-28MAY03-CLUS32787_1
cccntagtccccagcctgtaatgactgggaagttcagtcctgttgtttatgttcaaccagttcctcaggaggcaatgcacggaacaccccttggttttcaaggatggcctcgccctgtgctgttgaattcatatcaacctagcatgcagaagttccaaggcaacaccccggtgtatttggcccctccagtcatggcaactgggaacctgccattggtggtaccaagccctgcaccacttgtgcagccgttccaggccattcatcccatcatggtccctgctgcaagcagcatggccccaggaaaatacatgtaaacttgtcgtaccaatgacaatatcctcttgttggaagaatcctggcttaccccttcggtttggggtatacgtctgaaaggactccgcgattttgcctagtctgttgattcacttgtcagttgctggtctgtgtccgtattttagttggaagggctttgcaacttcttgccattcttcatgcttggtgtgggtttccgaaatattctttttaggggggttccatggggcagtaaaatgaaatagagagaaattcagca

SEQ ID NO: 1907 - DNA, 554 bp, Sorghum bicolor
  Clone ID: SORBI-28MAY03-CLUS32797_1
ctggtcgtgctatgagctttgtttgcaaaaaagatgaccttgactctcccaagttacttggttacccgagcaagccaattggtctcttcataaggcgatcgatcatctttcgttctgactccaacggcgaggatctggaaggttatgccggagcaggattatatgatagtgtaccgatggatgaggaggatgaagtcgtacttgattacacaactgaccctcttatagtagatcgtggattccgaaattcaatactctcaagcgtcgcacgggctggccatgccattgaagagctatatggttctcctcaggacgtcgagggtgtagtgaaggatggaaaaatctatgtagtccagacaagaccacagatgtagcatgtatgtattagctagctcaataagcactgttgtacgcttgtatggttgggacatatgggtgttatggcatgtatagtttatgcctagatgtacaacacgtgtaaactcttatatatgtatatatgctgaaacaagcattggtcctgcaatttcattgtgaccagtcttgaaaataac

SEQ ID NO: 1908 - DNA, 633 bp, Sorghum bicolor
  Clone ID: SORBI-28MAY03-CLUS34807_1
agaaactccgcgccgccatcctagccgacttcggctcctacaccgacccgcgagagatcaccttctccaccctcaaatcctgcacatacctccagcactgcctgagcgaaaccctgcgcctctggaccgtcgtgccgggcaactcccgccgcgccaacacactcaccacgctccccaagggaggcgggccggacggcgagggccccgtcgtcatccccgcgcacgccgaggtcaactacagcatccacgtcatgcaccggcgcaaagacctctggggcccggacgcggacgagttcaaacctgagcgcttcgtgggcaggcgtcccggctgggagttcttgcctttcaacggcgggccgaggatttgcatcgggcagcagtttgcgctgacggaggcgagttatgttgtcgtcaggcttttgcagcgtttcgacgctatggagccggcgaaggggcagttggatgatgttgttaggagtaaattggcgttgaccagttgcccggcgaagaatgtgacgttgaggtttagggaggccaaggagtagggtgatgtgggctttttacgagctccccagaggagtggtgtgatgatttatgagaacggcccttgggggacagacacaatctttgcac

SEQ ID NO: 1909 - DNA, 636 bp, Sorghum bicolor
  unsure (1)..(636): unsure at all n locations
  Clone ID: SORBI-28MAY03-CLUS34810_1
tcagtcttgcatgttcctccttgattcgcttgatgctgctggcattgatgctgattctgccggcaagattgagaagttcctgattcagccaagaattgaggattcagtgcttgggcggggcaaggtggacaagccaattgcatggagaagtgcatttgcaggtgctgggttcgcacctgttccgcccagcagtttggcggaggcacaggccgactgcctcctgaagcgggtgcaggtccgcggattccacgtggagaaatgtggcgtcgggctcacactatactggcagcgaggcgagcttgtcactgtatcagcatggcggtgctgatcagcaatgcacgcctgtgcgcacgactttttcaccaccatttgctggcatcttcaactccagtaatgtgtattttgtcttgcaatttaagtgttgcaaaggaaactagtatattggtgttgaacccttcgtgttgattatctttgcaacttcttagctagtggatttttagcaatgttgatgtcaatgtctctagtataatgatgttgctctaggattttaaccctgcttgctcttgggtcactagacattnctcatgtcatttgaaaccctgcttgtgagaagagaggtataattaacctatcaaa

SEQ ID NO: 1910 - DNA, 637 bp, Sorghum bicolor
  Clone ID: SORBI-28MAY03-CLUS34814_1
ttccttagaagaggtctcatctagcattccggatgatcaacttagaatgatcgacaacatcaattctttgatgtcagagttagcagtggagagagaagagctgctgcgagcactgagaattgagtcatccaactgctccaagctgaaggacttgaataaggacctaacacaaaagttggagattcagacacacaggcttgaactattgacttctcaaaggatggctaacgagaatgccctagcaaaaccaattgacacacgctccatcaatgatgcagcaatttatgcggatgaaggagatgaggttgtggaacgggtgcttggctggataatgaagctcttcccaggagggccaaagcggcgaaccagcaaacttttgtaatgaaaatagagctcctagtataccagatgtttccttcatttaaggcttgtttagatgaaaggggttgccctaggagcaccaagtatttagttcaaatttgaactaaattttaaggaatctgttccaaatccccaatatccaaacatgcctttgtataatttgtttttttgtttgcccggggttttgctgatagcatggtgagaagctgtatattggagccatcaatgtaaccattttttttttttgaaagaagat

SEQ ID NO: 1911 - DNA, 617 bp, Sorghum bicolor
  unsure (1)..(617): unsure at all n locations
  Clone ID: SORBI-28MAY03-CLUS32823_1
actggtaagatggcatttaaccttgaaggccctgagaacgagaggagcctttcgctacacttcttgagcgccatgaaggaggatagactcatagacatcatagatgaccacataaagagtgacaatgatacttggttgctagaggaggtcgcggagcttgctcaggagtgcctggagatgagtggtgatagacggccggcgatgagagatgtcgccgagaagttggatcgactttgcaaggtcatgcagcaaccgtgggtgccagcacaacacgaccctgaagagatggaaagcctgctcgggcagtcgtcggtggccagcttggagattgtcagcaccggaaatttcagcatggagaagaggatcctgcaatggctgctggaatctgggcgttagattcgccccaatcataccatacattctaagtttcatttcatgtaaacgtgatagtcctttttaattagtgtgctgcatatgtatatgtacgacaatacctgtatgagcctaccctgatttggacacaggatccatcagcactacttgtacattattttcagaacagtttgtccaatatactataagtgcatgggttgtccagttatagtttacgtanataa

SEQ ID NO: 1912 - DNA, 673 bp, Sorghum bicolor
  Clone ID: SORBI-28MAY03-CLUS32836_1
gagagagtcctggaaacatgtctatccttgagcaaaattattcaaaagtaaaatttattgtgcgcctaaaagacgaaatggacgggtgaagcacctttatgaggacctgtatattgatggcaatgatatcaaatttgattctgctccttctgtgagtatagaagtgaaccaaagtctagtgcctaaggttcagttcaatcttgagctgtcagagaaagagcgcagtgacagggcaaatgttgttctcccttttgaacatcaaggaaatggtgaaccaattcgtatatatgatggtcgccggtccctacctgaggctcagcgtgaccccaatttaaccgcaccggcccttgtggatgaaatgaaagctcccaaatctggaactgcaaagggtgaaatacattacttccgtgattcagatgacgagcaacctgactcagatgaagatccagatgatgatttggacatataagagtgtaggtgctctttactttagtaggtggcatgcgcatgcagatgaactttaaggtataggtttggacatacaagtctgagcgttgagaattgctatcttttgtaggtttgtcttttgtttagcacttccacgctttaccttgtcaatcttagttgcacaaaccttgcagcgctaaaattaatgaattgtattacttatttt

SEQ ID NO: 1913 - DNA, 688 bp, Sorghum bicolor
  Clone ID: SORBI-28MAY03-CLUS32842_1
gatgatcgtggccagcgccgtgccggacttcctcatgggcatcatcaccggcgccggcatccagggcgtcatgatgctcaacggcggcttcttccgcctccccaacgacctgcccaagcccgtctggcgctaccccatgtactacgtcgccttccacaagtacgccaaccaggggctgtacaagaacgagttcctgggcctcaccttccccaacaaccaggccggcggtgccgccaccgtctccggcgggcagatcttgacggacttctggcaggtggagatgggatacagcaagtgggtcgacctcggcatcctgtgcgggatggtcgtgctctacagggtgctcttcttggccatagtgaagctcactgagaaggtgaagcccatgatcaagggattcaggttcaggaacaccgcgccgtccgtgcacgtagccgaaaaaggctccggcactccatgaatccacgccaaggccgatcaaacgtagatgtgcgatatgtatagctagtgaagagctagtactgcaattgatatgcaagcgaaatacgtgcaatcttgtcatcttctcattgacaacgagggccatattccaagagcttgcgtaatgctagtttagggctgtttattcccggcttgatggaatgggtttatcagactttattaccccgttttatagaagcttaagtag

SEQ ID NO: 1914 - DNA, 543 bp, Sorghum bicolor
  Clone ID: SORBI-28MAY03-CLUS32862_1
gctgcgcggggctggagacggtgctgcagagcagccgcaagtgcctgtgcgtgctggtcaaggacagggacgacccaaacctggggctcaagatcaacgtcaccaaggcgctccgcctccccgccgtctgcaacgcccccgccaacatctccgactgcccaaggctgctgaacctgccgccgggctccaaggacgcgcaggtgttcgagcagttcgccaggcaggcggcggcgcagggcaccgcacccagtggcggcggcagcgcggcgaaggcgagcgcgagcccgcagaagagcggagcggccgccggtcacgcgcagcggtggttgggagtggggagcagcagggtcggtggtggtcgtggtgatggcggcgcacgcgcggtggcggtggcgctcgcactcttcgccgccggcccgctcgccttcttgcttggatagttggcgccggccggctttgtggcgtgtgtcgtcgggtgcgtgggtgcgtgcgtggtgctgtacttttcacactgggaaaccggaaaccaaagaagttgtatca

SEQ ID NO: 1915 - DNA, 659 bp, Sorghum bicolor
  Clone ID: SORBI-28MAY03-CLUS32849_1
aggccaggcaaagcgaaagcaagagaacaatgtcatggttgctctacctccatccaggaaggcaatgcccaataagagagcatttggtactgatcttacaaacatggacaataagcgaggcaagttagacacttcagcggagaacaaagtcaagctcatgcagggtgctggcaacatagtgaagacctttgagaggcagctggggcaagggaaaaggagtgactttgtttatgggcccttccaccctgctagtgcaaagaaacaggaaactgatgatcaaaccgttaagcagcaggagaggaagaccattcaggactgggaaaaccttgctgtgtccttccgtccacaatatcagaatcaagccctgaacgatctgtttggccattatgtggaagcatggaaatcatggtacttggaccttacccgggaaacgagatcatgaagcaggacgttggcagatcagttgtaacttgtacgtcgattccagtaggtagatcaactcagttgttgatgcttgcttagggaatcgccctttacaagatgtaataaaaacttgaaggcgttattgtctttcgattgtatttactcatgctagaaatgaggccattttttctaaggaaaaaggcagcaaaatgatcgaatcggcaaattgttgctgg

SEQ ID NO: 1916 - DNA, 334 bp, Sorghum bicolor
  Clone ID: SORBI-28MAY03-CLUS32879_1
aacatgtaagacgccacatgtgattgctggtacccactggcatatatggatgctggtgtagtggtgttaccgcaaacgccttttgtaaagtctgcttccctagcccgatctggtagaatagcctgacctcgtcaaaccattagttctttttaggagaaaagatccaacaaatgaggattgatgcttcccgcaatagcgagcaatgtataatatattcattgctgtagctgacagtaacaatgtagttttctctttttggaatatactggttatccagtctgtatgtttgccaacagtgagattacgtttatttacaaaaaaaaaagtgagattc

SEQ ID NO: 1917 - DNA, 498 bp, Sorghum bicolor
  Clone ID: SORBI-28MAY03-CLUS33013_1
gcacgagggagaaaccctaatcgaaatgggcaagcttctctgcgacccttccgccgccgccgtcgccgaggccctgccgccgtccccagccccggctccgccgccgccgctcctcgcctggtccgccccgtccccggtcccctcccccgagccttcaacctcgcccacgggctgggacgcggtctgggcgctcgaggaccagcagcgccgccgcctccaccggatctgggagcgcggcgtcgcgtggaagccctcgtcgccgggcgccggcgaggctctggctgctgcggctgcgccggcgccggcgccggccgtggtcttccgcctcgaccacggcggggaggtcgacgccgatggcaactgcctcttcaccgccgcgcggacggccgccgctgccaaggccgacgcgcgcgagctcaggcaccgcgccgtgcgccggttcgccgaggtctacgccgccgcgggggaggacgacaaggccgccgtcgacgccgccgt

SEQ ID NO: 1918 - DNA, 765 bp, Sorghum bicolor
  Clone ID: SORBI-28MAY03-CLUS32579_1
gcacgaggaaggcaagaaaatactagtagtttctactgtagtccttctccttcgggcgaggcaaaggcaagaacacggacggagccgtgctcaggtggattccgcatccgcttccgcccaacggattcaattcatccattcgttccacaaccctcctcctcctgccctgccctgccctgcccaaggaacaacaagaagccaccagcgcgcgctacctgcagattgcagcacacgcaagggagcacaagcaaggcaatccagggagagacagcttgcacatccgcccgccccgcaagcgcaaggagttagagggcaaccatggcttcgctaagtgacataggcgtcgccgcgggtttcaacgtattgactgccgttgccttcttgctcgcatttgcattccttcggctgcagcccatcaacgacagggtctacttccctaaatggtacctcagaggaatgagagacaacccaatcgtctctggtgcagctgtgcagaaatttgtcaacttagacgggagatcctacttgaagtttttaaactggatgccagctgctctcaagatgccccaggatgagctcattaaccatgcaggccttgattctgtggtctatctacggatatacataacagggctcaagatatttgttccaattacagttctggcttttcttgttctggtcccagtcaattggaccagtgataccctaggacacaacaatgtagtctacagtcctatcgacaaactttcaatatccaatgtaccc

SEQ ID NO: 1919 - DNA, 541 bp, Sorghum bicolor
  Clone ID: SORBI-28MAY03-CLUS32580_1
gcacgagggcaagctgggttggctaaatgtgcaacccaatgatagccaaaaatatagaaaatgtgttggttaccagggttctagtgtccccaccagctaaaatactactaatgcaaaatgttgtgatttttttaatatattctaaaaactcatgtgcatagtacatggagttaaagaaacttgaaagaacttcaatttcaaattaatctgttatattatgtttcaagaaacacaagtggtactttaatcacataataaacaatgctttctattttatttcttgacatctatataatattttgcaggataacagttagcttatttctttatgcaatacatacatgatttgttttgtaagatccaacatactaaatccgttagtggacacgatcccctagatacaaagtgcgcaaccattttataaagtttccacctctgaattgctgtgtttcttaaaaactcattgtccttggtattgtctattagttaaaatctgaagctgctgttcattaatcatgaagttgttccgctgtcataaata

SEQ ID NO: 1920 - DNA, 390 bp, Sorghum bicolor
  Clone ID: SORBI-28MAY03-CLUS32613_1
gcacgaggcaaaaccctcgcgaagttctgagatccatccagacgcatcgccactcaaaccctaggttgacggatcgctccatggcgatcatctccgacttcaaggaggacgaggctccgcagcaggcggcggctgcgccggcgaacggccccggcgtcgaggaggccctcgtggcggcgctggagaggagcggcggcgcgctccccttcctcgaggcggccatcgatgtcgcccaccgcaggtccggactgttccgcgaccctgcggcggtgagcaaggtcaccgcgatggcggcggccgtcagggcgcaggtggaggccgaggagagggcggccagggaggccaagagaaaggtggaggagaccgagaggaaggctgccgccgaggcgc

SEQ ID NO: 1921 - DNA, 764 bp, Sorghum bicolor
  Clone ID: SORBI-28MAY03-CLUS32641_1
aagggatatggtctctcagaggagctttgactggcttagggaaagggatcaacttcgagcggaaatgaaggcaggaaatgtgtttcaaggaatgcgtgaaggtccaatcaaatttcctccaacctacaaattccaaagacaccagttgggtctctcagggtatgattcaggcgagaagaagagaatacctgcttggtgcgatagaatactatatcgagatagccgttctgtatctatagctgaatgctcattagagtgtcctgttgttgctgcaattacggcgtatgaagcttgcatggatgtcacagatagtgatcataaacctgtgagatgtatatttagcgttgatattgcaagagtagatgagctgataagaaggcaagagttcgaaaaaataaccgaatctaacaaaaaagtatgctctttgcttcgagagttgcattttgttccagacactatcgtcagcacaaacaacattatattggaaaatcaagatgatgttatccttcgaataactaataactgtgaaactagtaaggctgcttttgaaatcctgtgtgaaggccaatcaatcggaaagcaagatgggactaaatctgagctgctcctaagggcatcctttggctttccactttggcttgaggtccaaccatcaatcggtctcatcgaacctggagaaacaatggaagttgctgtgcatcatgaagacttcttcacacaagaagaatttgtcgacggagtacagcaaaactggtggtgtgaag

SEQ ID NO: 1922 - DNA, 772 bp, Sorghum bicolor
  Clone ID: SORBI-28MAY03-CLUS36060_1
gcacgaggccacagctagacatcctccgaccgatggccgttgaggtcgtcacctccgagctggtggcgccgagcgagaccacgccgcggcgcgcgctctggctgtccaacctcgacctcgccgcgcggaacggctacaccccgacggtctacttcttccgccgccgctgtccccagccccaggacggcagcggcggcgacgacgacgaccgcgcgccgcagcagccgagcccggacttcttctcggccgacgtgctgcgtgcggcgctggccgccgcgctggtccagttctacccgtttgccggccgcctacgcgcgggccgcgacgacgacgggcgcgccgagatcgactgcaacgccgcgggcgcgctcttcgtcgtcgcgcgttccgccgccgcgctcgaggacttcgacggcttcgcgccgtccaaggccatgaacgacacgttcgtgccgaaatacgactccacggccggccccgacgcaccgttgctcctgcttcaggtcaccttcttcaggtgcggcggcgtgacgctcggcacggccatgcaccccttcgtcatcgacggccgcagcgccttccacttcatccggacgtgggccagcatcgcccgtggagacaccgccgccgccgccgtgcccccgtcgcttgaccgcacgcccctccgggcgcgcccactgccgacggtcctcttcgaccacacctacgagtacggcggccgcacctccaggccaccgacgacaggaggcaacaacaaggcggcggagtacgc

SEQ ID NO: 1923 - DNA, 527 bp, Sorghum bicolor
  Clone ID: SORBI-28MAY03-CLUS32958_1
gcacgaggctcggccgcgtccgcggccacggtcgaggcggaggccagggtcgcggctggtgggaggagcgtcttcgccgtcgactgcgtgccgctctggggctacacctccatatgcggccgccggccggagatggaggatgccgttgctatagtgccgcgattctttgacgtgccgctctggatgctcaccggcaatgcggcggtcgatgggctcgatcccatgacgttccgcttacctgcacatttctttggtgtctatgacggacacggtggtgcacaggtagcaaattactgtagggaacgcctccatgtggccctactggagcagctgaccaggatagaggagaacgtgtgtgctgctaacttggtagacatggagttcaagaaacagtgggaaaaggcctttgttgattctttcgctagagtggacgacgaggttgggggcaaggcgatcaggggaggtggtggtgaagcaggcacaagtaatgctgctgtggcgctcgcgccagaacctgtggcacctga

SEQ ID NO: 1924 - DNA, 507 bp, Sorghum bicolor
  unsure (1)..(507): unsure at all n locations
  Clone ID: SORBI-28MAY03-CLUS32979_1
cctactggacgcatcctctcttccgcagcgcccggcttctctctaaaccctagccgcctcgcgcctcgatccgagcaaccctaggtctccgcacgaggtagctccgattgatttggccccaagatggcggaggacaaggtggggcggatcttcgtcggcgggctgtcgtgggacaccacggagcgcacgctcgagcgcaccttcggccagtacggcaaggtcatcgaggcacaggttgtactggaaagggagacaggccgctcgaggggatttggatttgtcacattttcacaacctcgggctgtggatgctgccattcggggaatgcataatggacaattggatggccgtaatatttctgtgaacaaagctcaacctaggaactctgatgatggctatggatatggtggtggtggtggtggtggttactcnnctggtgctagaggtggatatcgtagtggaggtgatgtagttccagcagcaagtgatgattgtttcaaatatggc

SEQ ID NO: 1925 - DNA, 651 bp, Sorghum bicolor
  Clone ID: SORBI-28MAY03-CLUS32983_1
tactggagtttgtctccactcccctggcgtcgaccccgaccggtagcggagcgcgcgcgggcgcacagacaccggacacgaccgagcacggagcgacgcagtagcgcgcccccgcacggccacgcgcccacgccccaatcctgccgggccgcgtcgccgactcgcgccgcctgttgccattcgcctctgcagatccggcaccgcgcgcggctcctcgccgagttgttcccggcggcgcatcagaaggctgtctcctgggatcagttactcgcgtggctcgcacgacactcggggagggactctgacctggtaccaaacagcatctgcatcttctccgcccccaggctttggatctggccttcgtctcagttcggcgagctgccaaggacagctttgatttggtgcccaaagtgatgtagtgtgagaggcagaggctgacttcttgagagcgcgatgagcagccagggaggattcggtacggggagccccaagtccttccgctaccccagaggcggcggcgacttcgatctcgagtccgggtccccccgcaagggccgcaagcccaagaaccctcacctcgagacctcgatcgtcatgaggatccgctacttctacgaggcgcaccccgtggccgtggccctcctcctcctc

SEQ ID NO: 1926 - DNA, 765 bp, Sorghum bicolor
  Clone ID: SORBI-28MAY03-CLUS32995_1
caccctcaccccgaaacaagattagattagatagcaaaggcgaacccacggttaaccgccaccgccatgatgcctccgacggccaccgcgacggccgtcttcctctccgcgccgcccccctctttctcaacccgccgtcggcgcagccgccttcctgccatctccgcatccctttcgccgtcctcctcctcttcctcctccgaggagccgctgctggtgcgcgcggcgcggggcgaggacgggctcccgcgcccgcccgcgtggatgatgcggcaggcggggcggtacatggcggagtaccaggcgctggccaagcgccacccctcgttccgggagcgctccgagaacacggacctcatcgtcgagatcacgctgcagccgtggcgtgccttcgcgcccgacggcgtcatcctgttctcggacatactcacgcccctgccggccatcggggtgcccttcgatatctccgactccaaggggcccgtgatccaatccccagtgcggtccgaagagcaggtgagggagctcgtccccatcgaccttgatatgctccagttcgtcggggagtcgctaaagattctgcgaaatgagattgatggaaaagctgctttgctaggatttgtgggggccccatggacaattgcaacttacgttgttgaaggggggatgaccaacacatacacaaatataaagagcatgtgccatacagctccagatgtcttgaggagtcttctttctcaccttgcaccagcgatatctgactat

SEQ ID NO: 1927 - DNA, 612 bp, Sorghum bicolor
  Clone ID: SORBI-28MAY03-CLUS32992_1
gcacgaggcagggccttctgcgacgcgccggactccggggcgcgcaggtcgcaggatcacaccgagaaggttgctggcgtgaaggctccgcctgatgtgctcgacgttgctattgttggtggaggcatggtgggcttggcagtcgcttgtgcactgtccaatatgccattaacaaaacatcttagagtcgctattatcgatagcaatccagcgttgaagtcaagaggttacctggataaaaacagtatacccgattctagggtcagtactgttacccctgcaaccatgtccttcttcaaagatattggtgcctgggagcatgttcaacagcaaagacatgctttctttggtaaaatgcaggtgtgggattacactgggcttggatacacgaggtataatgcaagagatgtgggcaaagaataccttggatgtgtggtggagaacaaggtgctttgcaactcgctgctcttacgtttacaggaagaattggatgatattgaaaatgtgatatatcctaccagattggtgtctcttactttcccgttgaagagcagacaagcaggaatgaaaccaacgtcaagtgaaccattatctgttggtcatactacagaa

SEQ ID NO: 1928 - DNA, 554 bp, Sorghum bicolor
  Clone ID: SORBI-28MAY03-CLUS33002_1
gcacgaggtatggcttcaacgagacttcagcatatatgtctgcaacctttttgacacaggccaggcttcaaaggtcttacagatggaccgtaacagcttggagcatcttttgcaccatttctgtggagtaactgcaaacaaagaataccaagctgcagattggagattgaggccccttcctgatgaaatgatcaaatatgctagagaggatacacaccacctgctgtatatatatgacctgatgagattgagactagtgaatgagtcatcaggggaaaatgatcttcttttagaggtttgcaagcgcagcaatgaaatttgcttgcaactatatgagaaggagcagctgactgatacatcatatctacatatacatgggttgaaagaaaatgaactgaatgcaagacagctgtcagttctttctagtctatatcgatggagagatggcattgcccgtgctgaggatgagagcactggctatatattacccaataaaactctacttgagatagcaaaggagatgcctgtgacaagtgggaagttaaaaagaattg

SEQ ID NO: 1929 - DNA, 507 bp, Sorghum bicolor
  Clone ID: SORBI-28MAY03-CLUS32800_1
tggatcctaaaatgaaagaagcattcgagaatatcaaattttacaaattttatcctgtaaaaaccccagacacacctgatgtaaacaatgtaaaggctaggtacatcaacagatactacaggaatgcccattatctgatgtaatggctttcctgatgacctgatctcatgtgcttggccagcatgtcatttgaggagttgatagaagaagatttttgaaacccgggaggagaacaatttggtgacatcttcgaatgtggtcttactgttgtattgtactagagttgccctcaggtctcaggttttcattcccttgggcatcttctttcactgtacggtgtatacaatcctgcaggatagattattgtgtagcattcagagggtcaaggtagttttgagactaaacaaatcattaaggaacaatttgttccatttttatcatctaaatagtgaagcttcagcacaagattcatgagtttaacatcgttatagcacagcctgatggtta

SEQ ID NO: 1930 - DNA, 988 bp, Sorghum bicolor
  Clone ID: SORBI-28MAY03-CLUS328_1
gcgttcgctcgcttggctagcaggcagcagggcggggggggggctgcctctaccagaggccagagctagcgtcatggaggagaggcggaggccccgcgcccgcgggagcgggaggcgtccgtcgccgcgcgcggccggcacagcgctgcgccggaagaaggtgcgggagctgcggcgcctggtgcgggggggggaggaggcgcccgcgggggcactgctcgtccgcgcggccgactacatcgtgcggctccgggccagggtcgagctcctccgcgcactcgcggccgtctacgacgacgtcgacgtcgccgccgccgcgccgtcgccgctggaactggccgtggccgacgacgacggtgcggacgccgctagcgccgacgctgatgcgtgggcggcatgacctcatcaaaccattatacgccgtagatttgtgcgtgtatcgtcgtctcgtcacgcactgcagggttaattcgtgcatgcagtttttttttgttattttttcaaaaaaaaaaggatgcacggcatgcagcccccagctcgtccgatcgaagcacgtaccgatcgacgaacactgatacgcgtctgcgcagcagttaactccaatccagttggagaaatgcacgtgaaattcagaaattgcaggagagatcgatgttgtctacaattttggattcattaattattattccactcttcttttctatcttattgtttaactagcaggttatgtatgttcccaaaatgcatgggtctatatgtctattgaattatttattcccgggatctcgaactcggttgcgggttaacaattcgacctgttttcaacaaaaactggcgattttcgttccttcctattttcactgatttcgctattttttttctatatcagttccctcgaatatttatgtctactcggggtttctcgttttcttttaggatagaaagaaaaaacggaagcgagagtttcagttcatgctgtatatattcc

SEQ ID NO: 1931 - DNA, 469 bp, Sorghum bicolor
  Clone ID: SORBI-28MAY03-CLUS32806_1
ggagacacaaacagtgttggttgccaagaggttggaacctgtaacggagtggttaggtgttatcgctgcacaattttgatctgtaaggtgtaatagcatttttataataccaagaatgtacattagagagagggggcgatgagagggaagacttgagattcttcatcatttatagtagttggatggatttgagctgctgctggctgagataaatctgcttgtgcttgatttgttccaaaagttggcacttgaccctcacctttcctgtgtatatataactatagcttacatagatgctgatgtggtagcggtacttacctgaggtttgtaattttactctgtccgacggcattgatgttgaggttctgtcatactgtcgtgtcacctcgtgtgtgccacattgctgagttgtgatcagaattgtggagttttgaactagcaataataataacatcgtttgacccttggc

SEQ ID NO: 1932 - DNA, 557 bp, Sorghum bicolor
  Clone ID: SORBI-28MAY03-CLUS32810_1
gttctcagattccaaagttagagccctttccccagggttctatattggaagcaccttaatccgtgcgctgcctcatgtgtatgatgtgttcaggcgacagcattttgtgcccagcttgagaccatcttacatgtatgcgagccctcatgatgatctcttcagccttgcttgggacatcgtcataccttgcggagcactactactgtcggtgcttctcttctttcagcagtggcgtggaggagctttcttcctttgttcgaagaacaggaagacaagagagtatgaaatggtttccacagtcagttcttaagaaaagtaagtggatatgaaatgtttttacagtcagttcttgaaaagctttacatcattgttgcaagggaattataggggaggtttacatgtagactaaaagaatagctctttcctttcccaatcgttgtttccttttgcaaatgtgcttggttgcaatgaaaatcacgtgcatgtatacgaaatatgattaatacacaagttgagcaagtattgggggtcctgatttaggattcttattccctttt

SEQ ID NO: 1933 - DNA, 623 bp, Sorghum bicolor
  Clone ID: SORBI-28MAY03-CLUS33133_1
ttaggcactaagcggcggcgaggatggcggaggcggtcgtgaggtgcctccgggacgcacggcgcgacggagagcacgcgccggcgctggctgtggagggatcgctccagtgctgctcgctcgcggcgggcgcgatgctccacatcgcggccgcattcgcctcccaggtcgccgcagggaaggcgcaggccagggggctggttgttgtggcatttgatcggagcccgcaggtgtacctggaattcatgcagcgtcgcggccttgacgcaaatgctttgaaccgatgtgttcgaatattggattgctattctgacccccttggatggaagcagaagattcaaaaccagcagcatcaagggaacagtgcaaagctctcaacaaacaaagagaacattactgtttatagaagtgtgaaggatgttacaaaattgctgtccttcactactgaacttggaggagattttgaaggagaaggcaaaaagtatttttctgtggctgttgactcaattagctccatgttaaggcatgcttcagtgccatcaatttcaggccttcttagtaatcttcgaagccatgaacaagtatcatcaatattttggatgatacgttcagaccttcatgag

SEQ ID NO: 1934 - DNA, 557 bp, Sorghum bicolor
  Clone ID: SORBI-28MAY03-CLUS33116_1
gcacgaggaacaacgcaaaatttgccaaatgcttttgtgcccgaggattcttcaccacctgatgaagatgcacaacaccctgcggaaaatacagaagaagtcatcagagatttggacttgcatggtcatactgctagtgctatttccattgaggatcaaagggctactgaaggttcttcggtgaacatgtcaggaagcagcaatggaaatttggacaagttgagctggtctagtgcgaaaactatcagctctgttatagatgatgttgctgaatacgaaataccatgggaagaccttgatattggagaacgtattggtttaggttcctatggggaagtttatcatgcagactggaatggcacggaggttgcagtgaagaaatttcttgaccaggatttatcaggtgtttcactagagcaatttaaatgtgaagtgagaataatgtcaaggctaaggcatcccaatgttgttcttttcttgggatatgtgacacaacctcctaatctctctatattaactgagtacctcccaagggggagtctatatcgcctgttgca

SEQ ID NO: 1935 - DNA, 455 bp, Sorghum bicolor
  Clone ID: SORBI-28MAY03-CLUS33134_1
tgcacgaggcaaaaggctggagcggccgcagtttgagtctacttgatccaacttatgcaagcaagtacatccccatcattgctagtgtcagtgaacaccaacctcctacctggccctcttattttatggacattaatgtgttggccttcctgattcctgctgggattatttcatgcttcttgcctctgtctgacgcaagctccttcatggtcttgtatttagtcactgcagtgtatttttctggagttatggtacggcttatgcttgtccttgctcctgctgcgtgtattttatctgggattgctctatctgaagttttcagtgtcctcacacgatccattaaatttcagctgtcaaaattttttgatgacagccctacttcttcaggtgatagtagccctgagagttctacaaattcaacaaaaaatgaaaatagaaatgaaaaatctgaaacg

SEQ ID NO: 1936 - DNA, 563 bp, Sorghum bicolor
  unsure (1)..(563): unsure at all n locations
  Clone ID: SORBI-28MAY03-CLUS33138_1
gcacgaggcacagcacaagtaagcaagcacaacacgagcttttgctccagcaggggccagggcgccaactgttccagtcttcgctagctagcaagctcaacatcccacgcgcgcgccggccggcgaagcatttgaacatggcgtccgggcagcagcagcagcagcacctcccaaacgtgccgagatggacgccgagcccgccgcggcgccagcaggcccacgaggagggcggcggcggcggcgacgaggtcgacgcggacggctcggcgttcggagggtccatgcgcagcaccgacgggtcggcgttccccttcggcagcggccgctcgttcccgttcccgttgccccagccgtcgctggagatcagcgtgctgcaggcggcggcgaacggcaccggtggtagcggcggcgttggcgtcgacggccccgtggcccgcgagaagtcgctgcgccggaccgacgaaggcgtggtgatatcctgngaggacctgtgggtgtctgcggccggcggcaagggcggccgcgtgcccatcctctgcggcctcaacgggtacgcccgcccc

SEQ ID NO: 1937 - DNA, 477 bp, Sorghum bicolor
  Clone ID: SORBI-28MAY03-CLUS33139_1
gcacgaggcgcgcgcgccacgcccgcctgcgtccatccagatcaggcgccgcgcctccgcccccactgcccgcgtcgccgcgctactcggggccgccctagggctaggggcggggatccgctcgccccgttcgccggccgcgtggatcgattcgcaccaactcctcttctcggatttggaggctagagtaatgaaataaaatgctgctcaaaagcaagtttaagttggccacagccattggcatcgtgctgtcgatgctatcgctgctcgtgcacctttttcttgctaattattcagctgggggcattacaaactacagcatgcacatggacgatgtccttccatttggacagaggcctcgaccacggagactgtggggtccattgatcccacttgatcacttgcatccttttgcgaaacctagtaaatcatatgctgctcccagtaagcataatggttttatttatgcaaagatat

SEQ ID NO: 1938 - DNA, 352 bp, Sorghum bicolor
  Clone ID: SORBI-28MAY03-CLUS33206_1
gcacgaggacaacctcccccacccgagctccccgccacctccccccggcgatctctcctgacctgaccatggccggctacccgcctcccggctccggctacccctacggcccgggcggcgggggtgggggctacggcgccccgcctccctacggctcgtcgcccgcgccctcggccccgccctacggcgagacgaagccgcccaaggaaggcaagacctcctcctcctcctcctccggcggctccgcgcccccctactacggcggcgcgccacccccttcccatccctcctacggcggcgggggcggctacggcgcgccacccccgcaggacggcgcgccaccgccccaaca

SEQ ID NO: 1939 - DNA, 1111 bp, Sorghum bicolor
  Clone ID: SORBI-28MAY03-CLUS33505_1
tggagaagacgcccaaccagtatctccaatggcgatatgccaacggtgacgaccgtgaggtgctcatgaagcagactcgtgttctcactgccgaagacaaggcccagatggaaactcccattgaccttggtgatggcagaggtcctcgcaagattgaggcgctcattggtcgctccaagtacaagaagtccttccagtacgaggtcaagtggctccacatgctccccaagttcaactcgcacctctcgcgtgagaccctgattgagaagggtttcaccaaacttgtgcaggagttcgatgaccacgagtcttcgcgtgagggtcttggttaccgtgtccttgagcccaaggtcatctccaagcactttgaggatctgggcttggaccctgagattgcgaaccacaatgagatctctggtctttccggaggacagaaggtcaaggtcgtgcttgctggtgccatgtggaacaatccccatcttctcgtccttgacgagcctactaactttttggaccgtgactctcttggtggtcttgcggttgccattcgtgactacaagggtggtgtcatcatgatttctcacaacgaagagtttgttggcgcgctctgccctgagcaatggcatgttgccgacggtcgcgtcacgcacaagggtcaccttgccgtcaacatggatcgctttgaggactctcgcccaggatctagcaacgtcagcagcaacgtcagctcggcggccccatctactaacggtactcctgtcatgagtgaggctgagggtggcaaggacgacatgaagttcagggccaggaagaagaagaagatgaccaagaaggagctcaaggagagggaggttaggagaagattgagatacattgactggttgaacagccccaagggtactccccagcctccaaacacggatgacgaggctgactaaatgtgttcacgactgtttggttttctggtcgcataatatcttagactttgcagacttgcatgacccggcgttctatagaggtttggaggcaatgagtgcgtttggctgcaccaagcgatagatggcatgtctttcgtttggtggaattttttatttataaccaaaagtagctt

SEQ ID NO: 1940 - DNA, 730 bp, Sorghum bicolor
  Clone ID: SORBI-28MAY03-CLUS32882_1
gtcaaaggcgaagaatgaaaagaaggggaaaggtgagggcaagaagcgtaagcgtgacgatgacaccgaagatggggatggcaaggatgggaagaaggtcaagaagggggctgaggagaagcaagatatcatgtacgcgaatgtgtttgttgacccaaaggaagcaaggcgcaggaagaagaggagggttaagaacaagaagaaggcgctggagcaggctaaacggttgcaagaggctaagaaggatcctgagaaggcaagcaagattgcttgggatacagccagaagacgtgctgctggggagaagctgcatgatgaccccaagctgattaaggagagcttgaagaaggaggaaaaacggcagcagaagcatgctgcacagtggaaggagaggcagaagactgtggacaagcagaagaaggagaagcagaagaaaaggacagagaacatccgggatcgggcacaccagaagaagatgcgcaagattgagaagcgcgagaaaaaacttatgcgccctgggtttgaggggcggaaggatggttatgtcaatgagtaacatctctgtcaaggttgtatgggtgatgagttactataccctctttcagagttccatttgctgatatgatatgggtagttggtacttgtaataggtccagttcatggcttctaaagtgccttaatcatcgaatgaaccaaactttcaatatttagcagttctatagaggatttt

SEQ ID NO: 1941 - DNA, 498 bp, Sorghum bicolor
  unsure (1)..(498): unsure at all n locations
  Clone ID: SORBI-28MAY03-CLUS32930_1
ctggaaagcgccagcatgatgtcagaggcacacatcatcacagaaccagcgtngaaaccctgaaaaaccaattgacttgcttaggaaagttgatggcaataatatgtgtgctgactgtggtgcttcagaacctgattgggcatcattaaaccttggtgcacttctatgcatagagtgttctggggtgcacagaaatctcggagttcatatatcaaaggtaagatctctgacacttgatgtcagagtttgggagccatctgtaatcaatctctttcagtcattaggcaacatgtttgtcaacaatatttgggaagagatgttgccagatgataattcaagtgctgatggatcagacacatcacaatacctctctgttagcaagcctaaacacaaagatgtattctctgccaaggagaagtttattcatgccaagtatgtaaacaaagaattcatacggaaccatagcatggatgagaatcagctagctcagcagatgtg

SEQ ID NO: 1942 - DNA, 484 bp, Sorghum bicolor
  Clone ID: SORBI-28MAY03-CLUS32933_1
gcacgagggacaagtgcgcggcgcgaaaggatagcagcccacccccgccgcccagccggatgcggtcttccacccgaactgacaagtctggatctgctgccaagagcgcgctggatgagctgcgggcaaagcggactatgcggcaacaggctccggaggcacgcaccagcaggttcacggacctgctcccacatagtggctcacccactaggcgcagggctgggagccccccaagtgatgggagcaacgatggtgataacaggggtaggctgaatgaccatgggaggattgctgatgatagcagggatgatgaatttgatgaatcgccgagtaggcttgacccactcaagtttgatgatgtgaagagtattaccctcaggaggtcaaagctggtgaaatggttcatggaaccattctttgatgatctaatttctgggtgtattgtgcggctaggtattggcaagacaaagtctgggaacccgag

SEQ ID NO: 1943 - DNA, 446 bp, Sorghum bicolor
  Clone ID: SORBI-28MAY03-CLUS32951_1
ccacgcggagcccgccctccgcggccgccctgagccgccagcgccgctcccccgccccgcgccccccctgccgcgccgccgccgctcccccttcctccgcctccccctcctcccccccgcgccctcccccgccccgccgtcgcccgcgccggcgccggccgccgtcacgcccacgctcccgccggcgccccccggcccggcgcgccgccgccggcgcgcggggcgccggcggccgccgtcccgcccgcgcggcggcccgcgcccgccgacccgcgggacccggccgggcgcgcgcggcacgggcggccgggtcccggcccggggggcggcgcgcgcgcgccgggcggcctgacgctgctgggcgcggacggcacggggatccggatccgggacctgatggcgtggggcgggctcatggggtccggccacgactactacgagcgcgg

SEQ ID NO: 1944 - DNA, 770 bp, Sorghum bicolor
  Clone ID: SORBI-28MAY03-CLUS33241_1
gcacgaggctgagctgcatggattgaataagaagaacaagagaaaatctgagcaaccaaaaggggttggtgttctggatggtgaagttcaaatgggatctagtgagagtgtgggtccggttagcattagcaaactcgaaactaatgccttatttgctgctgcctgtgaattaagaaatatatcaaatgaagcagatgtcaagcgcggcgcaaatagcagctgcagcacgaaggggctagcaaggggaaaagcaaaagggaaaccaaagaaaaccactgcaaagagacaagccagcaatcgaaaaaataaaagtaaggggggaaatgacattaggcaagctaccgatctggattctgaagttcaatcaggcaaaacagatgaacaggctgagattgatgcttctaaggtgtccgcatatgatgcttccgtgtcagcctctacttctaatgataaatttaaccattcatctgctctcagaaactcggcaaacggcaagccactacctcctgtgcagtttcatgctctagacagtgaccagcacgtgcttgatgtatggaagccatctgttattattgtttatcatccagatattacctttgtaagagaaattgaagtatacaaggcagaaaactcatcaaagaagttaaaagtttacttccttttttatgaagattccactgaggtgcaaaaatttgagtccagcattcgacgggaaaatgaagcatttgaatctttgatcagacagaagtccctgatgatgatacctgttg

SEQ ID NO: 1945 - DNA, 641 bp, Sorghum bicolor
  Clone ID: SORBI-28MAY03-CLUS33242_1
gaaccccgttccggcctcttccccaattccgaacccccctcgctgctttgggcgaacaggcgaaggcgcctccgctcgccccctcccaaaaccccgacatgggaaacaagaagaagccgaagccgagcaggaacaagaagaagcccaaaaccagcgccgaccaggctctggccctagactacgtccgcgcctgggcgcaccccgcgccgccgccaccagaaccctcggcggccgacgccgacgacttcctgccgatcctggctacgcgcggcggcgacgtgctgtttgagctccactcccactcaaaccacagcgacggattcctctccccttccgcgctcgtcgagcgcgcccatcgcaatggggtgaaagttctcgccctaacagatcatgacaccatggctggcataccagaagctgtgtcagcagcttccaagtttggcattagaataattcctggtgttgaaatcagtgcactatataatccaagggaagttgctggtgctggtgagactgttcatatccttgcatactatggtatgtgtggtccgtcaagacctgatgagttggacagcatgctattgaacattagagatgggcgatacttacgcgcaaagaacatgctgcaaaagctaactaca

SEQ ID NO: 1946 - DNA, 387 bp, Sorghum bicolor
  Clone ID: SORBI-28MAY03-CLUS33249_1
ctcttgcgtcggtgtcttccgggacgaccgcatcgaaatcattgccaatgaccagggtaaccgtaccactccctcgttcggggctttcaccgacaccgagcgtttgattggtgatgccgccaagaaccaagtggccatgaaccctcacaacactgtcttcgacgctaagcgtcttatcggtcgtcgttacggcgacgctgaggtccagtctgacatgaagcactggcccttcaagatcgtcgagaagaacggcaagcccatcatcgaggttgagttcaagggtgagaacaagcagttcacccccgaacaagtctcctccatggttctcgtcaagatgcgtgaggttgctgaggcctacctcggtggcaccgtcaacaacgccgtcgt

SEQ ID NO: 1947 - DNA, 729 bp, Sorghum bicolor
  Clone ID: SORBI-28MAY03-CLUS3325_1
gccggccggttctcgatacagtagatccgcgctttatcatcttaacgccagacctaagaaccctttagaaaccctactccgtcgaccatcccgaatacacacaaatccttgatattctatcaaccccacatctaccgcaaacctctaccgaccactcttcacccagaagttctttcacaacaccgccaaaatgagcgaagaccacaagggcgtacacaacctcaagaacaaggagcagttcgaggaggtcatggcagtcaaggacagcctcatggtcgtcgactgcttcgcgacatggtgcggcccttgtaaagtgattgctccccaggtcgtcaagttctctgagaagtaccccaacgcgcgcttctacaagctcgacgtcgacgaagcctccgacgttgcaggtgacctcggtatccgcgccatgcctaccttcatcctttccaagaacggaaccaaggtcgccgaggtcgttggcgccaaccccaaggctctcgagaccgctatccagaacaacatcgatgcatagagcgcacaatcgaagccgccccgcaaatacagacgatcgcatccagcaccagactaggcttggatattgaatagagggttgctgttttgttgagggtcaaatcatgggcagcaggtggccgaatggaattatgataacgtttttcaaataccaaccgctacattctcacatggcaaaaaaaaaaaaaaaaaaggccccta

SEQ ID NO: 1948 - DNA, 532 bp, Sorghum bicolor
  Clone ID: SORBI-28MAY03-CLUS33280_1
gcacgaggctcccattccatccacccctccagaccactcggtgctttgcccgagcccgggagaagccttatcgcctcctcctcgcacgccagctgatcgtcgcaattccccaccgctcgcctgcccggtgcccgccatgccggaggtcaagtgcggcgcggccgagaaggtgaagccggcggcgagtccgtcggcggagaagccctcggaaatcgccggcaatatctcctaccacgcgcagtacaacccccacttctcgccgctcgcgttcgggccggagcaggccttctacgccaccgccgagagcgtccgcgaccacctcatccagagatggaacgagacgtacttgcatttccacaagacggatccgaagcagacgtactacctgtccatggagtacctgcagggccgcgcgctcaccaacgccgtcggcaacctcggcatcaccggggcctatgcggaggccgtgaagaagttcggctacgagctcgaggccctcgcgggacaggaaaaagatgcagctctaggaaat

SEQ ID NO: 1949 - DNA, 575 bp, Sorghum bicolor
  Clone ID: SORBI-28MAY03-CLUS33286_1
gcctcctctctcgctcctctcgacgcgcatcacctcccacgcccatgaccaccgaccgtctcctccactttctccgagcgccgacaggctctccggctgcggcccctacccgcgcggctcgccggggtcctctacaggcgcagggcgtccacttctgtcagggagctgcggtgatgcggcgcgcgtccctgtcctgctcgggcactagctctggccgggaggggggactgacgtacaaggatgctggcgtggacatagacgccggcgccgagctcgtgcgccgcatcgccaagatggcacccgggattggcggcttcggcggtctcttcccctacaatgacgattatcttgttggtagcaccgacggggtggggacaaagctgaagcttgctttcgaaactggcattcatgacacaatcggcattgacctggtggcaatgagcgtcaatgacattgtaactttaggtgcaaaaccattgttcttcctagattactatgcgacgagcaagcttgatgttgatcttgcagagaaggttatcaaggggattagggatgggtgtgaacaatcagattgt

SEQ ID NO: 1950 - DNA, 634 bp, Sorghum bicolor
  Clone ID: SORBI-28MAY03-CLUS3302_1
gcacgagggtcgcctcttctctgatttcttcctggtgtttgccggagtaaggaaggctaggcgcgaggtggggggaggagggcgctgtgctcagccagaggtcatcatcggcgctacgcacgcaagcgcgctgcctggtgtgctgcactgctgaagtatcaggggaaaacacggaaatcatggaaatcagcttattgcatgatgaatctgatgcaggaactaccagtttgctaccactgccattgttgtcctatagtccaagatcaatggttcctatacaagtaccatcgtcatcagaccttgagagtatcctttcgccagatccaatctatagtgatcttcagttgaaagagataaactacaatgctgcagcaatggatgaaagcactgagttccttcacctgattcttagtggcaatgatgaaggatacaatacccgaactgaattacaagtttgggatgttctggacttctatgtctcagaaaacttttctgctctccaatttgatagtttgatgggttttacaaatgaagttagtacttcctacaatgattgtatgaatttagttgacatggtagagcggcccgtggctcgtctgtcttagatgatcaccaaccagtacaggtgtgcgtc

SEQ ID NO: 1951 - DNA, 278 bp, Sorghum bicolor
  Clone ID: SORBI-28MAY03-CLUS33029_1
ctagctactactgtacttgatttgggacttgctatcacaagagtagatttcgtggcttgatgacttcgcgagacgactgatggagccttcgtcagtgtccctgtgatgtggcaacaagtgtgcagcgccatggctgctaaccgtgttctgccgatggtggtggttgcggtgatggtcgccgccaccagccatggtggcgccgtggagttcgcctacgacggcttcggcggcgcgggcttgtcgctcgacggtacggcgaccgtcacgccggccggtct

SEQ ID NO: 1952 - DNA, 932 bp, Sorghum bicolor
  Clone ID: SORBI-28MAY03-CLUS33106_1
gcacgaggaagcactatgagaaatctggatggaacaagaacaggaaagggaagttcccagatagcaattcataccgggacttggtgttccgtttcttcgtgcagaaaggaggcggctctggatatgcctcacccgtcacaattggatcaatgttgtttgatggtaactctttggttgatcaagatccccattttcagcatgtcacagccgagatgaagcaaagactgcttaatgtcagctatgatatctactatgttggcaattggtctctagaatcattccaccgtcgacatatctctgctgagggtgtttatgatactaagacaggttccctttgcatgatcgcttgtcgagaacttaatgtctcatcagattgtggcacgcgggtgactgctcagttttcttctttggatgcaaagggtgcacagcatgtgaaggggacaatcaaaagcttgaggaagaagactgaccctcttttctttaaaacactggacattgcttcatatgggatgtatgtagagcaagtggacgaatcaatatggagaatggacttagaaagcaccatggccttgatctctatgacactagcatgcatcttcattgctgtgcagctatttcatgtcaaaaaggtccctgaagcactccctgccatgtctatcaccatgcttgttgttctggctcttggctacatgatccctcttgtgctgaactttgacgctctcttcaagaacagcaacaaacagactgttccactttcaggtggtggatggcttgaggtgaatgaagttatggtgcgaatcattaccatgataacctttctgctgcagttgcgtcttcttcagctggcttggtctgcacgatctgtggatgtcagcaaagctgagtcatggtctgctgagaagaaagtgctctggatatgcttgccactgtac

SEQ ID NO: 1953 - DNA, 645 bp, Sorghum bicolor
  Clone ID: SORBI-28MAY03-CLUS33042_1
ctactgggtgctccctcgctctccggtttggcttggctccgaccactgcctccgcggctccgccccgtgccgcctagtcgcactcgcacaccgcgcgagatccccttcccctgcgcccgcttcccggcactccggtgcggccgcgcgagccctgccctacggaggggctgggggctggcttacccgcagatgcgtcccctcctggccctcgccgccgcgtgcgccctcctcgtggccgccggcgccgcggcggcagaggaggcgaagaactccaccaacaagttccggcagcgcgaggccagcgatgacatgctcgcctatccccacctagatgaagatgctttattgcagcccgagggtccaaagcatgtggagctgagatggcagactgaagttagttccagcatttatgcaactcctttggtcgctgatatcaacagtgatggcctgctggtcgtccggctgccgtcctttcttctcctcttcgctgtgcctgtggccacggtgggggacggggaatagctttggctacttacaacggtgttgtaaatttctttagggtgtcaggttatatgatgatggacaagcttgaggtacctcgtagaaaagtacgtaaagattggtatgttgggctaaatccagatc

SEQ ID NO: 1954 - DNA, 490 bp, Sorghum bicolor
  Clone ID: SORBI-28MAY03-CLUS33316_1
gcacgagggcggaaccgaaaagtcaaactaaagtcaaagcggcggcggttaggcggccacccacccccaacgccgatggacgcgccccgcggcggcggcggcggccacacgcggcggccggggatctccggcgcggcggcggaccagcgccgtgcggccgctgcgcaggcgatggcgcgcatggaggagatgatgctcgcgcacgcgggcgccgccggcgagttcagtatcatcctcgacgcccctctgccttcgctccagcagtaccgccgcaaccccgcgccgccgtcggctgccccctcgatctccaaaaccaacacctccccgctccgacgcgtcgcgcagggcggcggaggacgcgacgacggagtccccgcgcgcttgcgccgcgacgggagcgggcacgacgccctcggcgacccggacaccgccgcgcgcacctctcgccgcggcgctgtcgacggaacgggcgccggtgcggcacgaccgc

SEQ ID NO: 1955 - DNA, 461 bp, Sorghum bicolor
  Clone ID: SORBI-28MAY03-CLUS33307_1
gcacgagcgcggggggacgacgacgcatccagcagtgcgcacccgcgcgcgccccggccagccatggacgacaacgacatgggtgtcgagagccagcgggagttgatgacggccgcgccggcggcgagacccggcacgggaagcggcggcgggcggaagcacctctcctccatcgccaaccgcgtgctccggcagtgttcactgacattggacaggagtgtcgatgatttggtggcagacttcgagttgggcttaaagactgcagcagtcggcaactattcaagaaaactagttgagttttgcagtcttcaggccctgcaaattatcacatcacatgatattggggagaagataaatgatggttccctaagtcggttcaccttcgatatgatgctagcttgggaaacccctactccatcggatcaacaggtcaccatggagagcatagcgaaagaaaggga

SEQ ID NO: 1956 - DNA, 872 bp, Sorghum bicolor
  Clone ID: SORBI-28MAY03-CLUS33326_1
gcacgaggaagacgaggatgagaaatggagaaagaactggacggtttcaccccgccgggagtcggctatgggaacatcactgaggagacgatccagaggctgaagaaagagaagctgtccaagtccgagaggaagcgccaagcgagggaggccaagagggctgaggctgaggaggactcggccctcgtctgtagccggtgccactcgctgaggaattatgggcttgtgaagaatgacaaggctgagaacctgatcccagactttgattttgatcggttcatttcgtctcgggtcatgaagcggtcggctggcacaccggtcatagtcatggtggtggactgtgcagactttgatgggtcgtttccgaagcgagctgcccgggcgttgttcgaggcacttgaaggaaggaggaattcaaaggtgagcgaaacaccgaggcttgttcttgttggtacaaaggtggatttgcttccatggcaacaaatgggtgtccggttggataggtgggttcgtggccgtgctaaggcttttggagcacccaagctagatgctgtgttcttgatcagcgtccacagagatttggctgttagaaacctaatttcgtacatcaaggagtcagcaggacctcggagcaacgtttgggtgattggtgcgcagaatgctgggaaatctacgctgatcaatgcttttgcaaagaaacagggtgttaagatcacaagattgactgaagctgctgtcccgggaacaacactcggcatattgagggtaacaggtgttttacctgcaaaggcaaagatgtacgacactcctggcctgttgcatccttacataatggcaatgagattaaacaatgaggaaaggaagatggttga

SEQ ID NO: 1957 - DNA, 585 bp, Sorghum bicolor
  Clone ID: SORBI-28MAY03-CLUS3333_1
ggggaagaccggaagagagcaatggaggcaagggtcgcagcaggagtgcccgaagacgaagagtccggcctcctcccccgcccgtccgccaccggccgccggccttcttcccgcggcccccgcttcccgcctccaccggcggcctgggtgacggtggacggccccctcgggctgccgctggaggacgcgggaggacacgcccgccgcttcttcctctggggtttcgcgtgcctccccttcctctgggccatcaactgctactacttctggcccgtcctccggtcgccggccgcatcctcgccctccgccttcgcctccatccgcccccatgttgtgcgatcggcaattggcttcaccatcttctctgttgttctgataacctgggccacgactttcattgttggaggcgagcggttatttggaccagtgtggaatgatctagtgatgtataatgttgccgacaaggcttggcatcactggattcatgggatagcctgtgatgtcttcctcatttcgactggacttggtccaaccaagtccgaaatgatctgttctatggatcttcgtaagaattgctactatctg

SEQ ID NO: 1958 - DNA, 724 bp, Sorghum bicolor
  Clone ID: SORBI-28MAY03-CLUS33332_1
aggtcgccgctctctgctctccctaatggttgctcctcccgcttccatggtcgaggacaccgctcttcgctctccgatgccggtgccggagaagctcgccgatgcccccgctgccgcgccagccaagaagaagccatcgtcttcctccaatgacaagaagaggaaggggaagggtctgccagaccttgctctggctgccgaggctcccgtcaccaagaggaaggggaaggggctgtcgcaccctgtttcgacctccgagatccccatcgccaagaagccgaagactggcgatgtgcccacatccacaactgagctcgctagatctggcatagccatcgccgccactcacacaacagtgcaaacccttgtcacgggttgccggcctcgaggtccacgctgcccctgctccaagatgtggacgctgacggccagacgtcacagcaggtatgctattttttgttggcactatttgattcttcaaattattggcatgaaaatgcaagccaagttttgtgacaatacatgctggcaacatatatatatagcagagacccttaatcaagcactacatctacacaagtagcatattccagtttatttacaggcaggcacatgttgtttaattcgtttccgtaccgttgattacaataggaaacatgcaggataaaatttgctcagttttcagttgggctatgctgttttagataaatggaacatatgtcca

SEQ ID NO: 1959 - DNA, 475 bp, Sorghum bicolor
  unsure (1)..(475): unsure at all n locations
  Clone ID: SORBI-28MAY03-CLUS33385_1
tggaaaaagctctcagttcatcacgcctctccaatccctcctcacacaccggccctccccctccaggctccagggccttctccggcgacgccagcgccgcccctagccgcggtccttcaccggcgacgccagcgcggcccgaatctagggttcccttctcccgccgccgccgccgccggccggatcgcgcccagaggagcctcagcgatgctgccgtgcgcgaggtcggtgctgcggaggagggggntggcgtcttccgtcctgcggaggtgcggcggggagggcgaatgctccaccggcgccgcggggctggtcgccaatgccaggtgttcgagcacgctggccgcgatcgtcggcggcggcgggcgcgtgctcgagcgcggcggccggtgggcatatccgcagaccggcgtgattggcgcggggcggatggcgcgcacgcagaccaggtgtttcctcgggtgcggcgacgggg

SEQ ID NO: 1960 - DNA, 590 bp, Sorghum bicolor
  Clone ID: SORBI-28MAY03-CLUS33354_1
gcacgaggccgcgcccgcgccttcgaatccgcacgcgcgacaagagttcaatgctcttgcttcaatcaccggtgtgatggtagaccgcacgcttcgacatcgtcgctgatcgattcaaacccgcgcacgatgacttcccactttcgtccaagctcgagatgaggcagccgatggagcttcgacaatcgcgtcgaccaagaaacaagtcctctcgtcctgcctcgacatccttcttcgcgctgcagactctcgacaatccagtacccatcacaacgtcgcccgcactgagacagtgattctgttaatcaacaccgccgctctgaaagtccgacgactcggtgacgcagcgcagcgcagagccagaaaagatacgccgtctgcgctccccccttcgcgtcgagcaagaacccacatgagaggcggaaacatggttcaaggtctacctaccaagcatggtgcagaatacgaaccgtatgcccgtgggtgatggtgatacatgatcgcttcctcggtgactgagtgcttctcgttccagcgcgacacgtccctgtcgcgattgatcactgccagcagatgagccacggcatagc

SEQ ID NO: 1961 - DNA, 509 bp, Sorghum bicolor
  Clone ID: SORBI-28MAY03-CLUS33208_1
gcacgagggctccctacaagaagcacccaaccatgcatctttacttgggcctggcgatatggggcgtggtcgcctttgtaatttacaaggcgatcaactatgtcctcgcgaggcgacaacgggccgccaaagcaagagacactggcgcctctgaagcgctctctttccccatcgcgggttttggaggcttccaatatctcaaactcctcctaaaggcagacaaagagcagcttttcccggactggctgatcagacgtcaacgcatcatgagcgagcttcatggccgcgaagtctcaactttcaagacatacaccatgttccatgacacttatttcacctcagaccctcgaaacatccaggccatgctcgccactcaattctccgagttcgaacttggacctgtccgcagtgccaatatgggccagatgctaggccagggtattttcacccaggatggcaaggcatgggagcacagtcgggccttgctgcgaccgaattttgtgagagac

SEQ ID NO: 1962 - DNA, 294 bp, Sorghum bicolor
  Clone ID: SORBI-28MAY03-CLUS33215_1
gcacgaggccacgccgacgcaccgaaaaagaagaagaagaagatagcaggcgaggcgaaggcccaaacgttcggggggcgagcgggatttggaagctgcgcaacgcgcatcccaaatcccccaatcccgacgcccacccgaccccgtcgccagatctcgcgcccctccccggggctcgatcggatcagcggcggccggcgattcggggacggggagatctcgccgaggcttgggccgggccgggctggtgggagccggggagccatggcgtcggcgcaggcgccgtcctccgcc

SEQ ID NO: 1963 - DNA, 513 bp, Sorghum bicolor
  Clone ID: SORBI-28MAY03-CLUS33220_1
gcacgaggctcaatcgtgagccgatcgctgtgaggttgctccccagcagcagctgtagctgtagcagcggcacggcatggccgccgagttgcacaagcccctgggcgcgatcaccgccgacgacctcgcggcggcggcgcctgggtgcgacgccaccgcgctccactcggcgctccggcgcgcgctcgactcgcacggccccgccgcggtgtgggcggagctctgccggtccgtgctccgtccgtccgtccccttcgccgtccaccggatgctctactacggctgcttcgccgggttcccgtcccccacgccgccggcctggacccccgaccccaaggaggctgccttgaccaatgtcggccgtgtcctggaggcgcgcgggagggacttcatcggcgacgcgtacaaggatcccatcaccagcttcccagacctccacaagttctccaacgagaacccagagacgtactggaagatggtatttgaggagatgggtgtccaattcagtgtaga

SEQ ID NO: 1964 - DNA, 287 bp, Sorghum bicolor
  Clone ID: SORBI-28MAY03-CLUS33238_1
gcacgaggcacaagtctcagctactactcctagctcccaaccgaaccgaggagaaggacgccgtgcaggtgcagctcgggcgcgcgcgcggcgagcgccaggaaggagaagaagaatgtaccaggccatcccgtacagcgccggccggccgtggccgcagcccgcgccggcgatgggcgtccaggcgacgactgcagcagcggaggagaggctgctggcggctgtgcggcagcagcagccggcgccggaggcggaggcggcggcgagggaggaggaggttctgcgtg

SEQ ID NO: 1965 - DNA, 585 bp, Sorghum bicolor
  Clone ID: SORBI-28MAY03-CLUS33431_1
gcacgaggtcagcctggactttccggccgggaagatcgtcgctctcgtcggtgggagcgggtccggcaagagcaccgtcgtctcgctcattgagcgcttctatgagccgctgtccggctccattctgcttgatgggcacgacatcaaggagctcgacgtcaagtggctgcgccggcagatcgggctggttaatcaggagccggccctgttcgcgacgagcatccgcgagaacatactctacggcaaaggcgacgccaccatggaggagatcaaccacgccgcgaagctgtcagaggcgatcacgttcatcaaccacctccctgatcggtacgagacgcaggtcggcgagcgcgggatacagctctccggcggccagaagcagcgcatcgcgatctcgagagcgatactgaagaacccgtcgatactgctcctcgatgaggcgacgagcgcactggacgccgagtccgagaagagcgtgcaggaggcgcttgaccgcgtcatggtcggccgcaccaccgtggtgatcgcgcaccgcctgtcgactatccggaacgccgacacaatcgcagtcgtcgacggtggcag

SEQ ID NO: 1966 - DNA, 591 bp, Sorghum bicolor
  unsure (1)..(591): unsure at all n locations
  Clone ID: SORBI-28MAY03-CLUS3342_1
gcgcgtccgaatccttcttaatttgaactgctttgctcagtatgccctgtgtggtctaaacctanggtccggcaggtctcaacggcctcctataggtgttggcctcactatttctgttgcaattggggctgcagcattcgctggtctgtacaatatcatcagccctcttgggaaggattatgatacagaacatgcagatatcgatcaagaagcacaaatcgatgttgcctcaactgagagcggcaggccaacttcacgggttaaatcatttgagaggagatactctttcatccagagtgatgaacgccgttttgtagagagaaggcctcagtgggttggcggactaatggatttctgggaccagatatctattgcgtacttgtcacttttctgcagttgctgtgtctttggctggaatatgcagaggcttggatttggtaacatgtatgtccacatcgcaacgtttctgctcttttgcctggctccattttttatcttcgtcctggcagcttgcaatggttgccaatgattcccttcaagtggcattggtgctgactggacttttcctgtgcttttttggtttactgtatg

SEQ ID NO: 1967 - DNA, 619 bp, Sorghum bicolor
  Clone ID: SORBI-28MAY03-CLUS33453_1
cccacgtgggcatgatcggtgctgtgtctccaccccggccggcctatctcctcattctcctccctcccgctgtccgctctcgcataagctaactcgaacagcgcgagagctagcgcttccgcgaagctctggttgctgattgattggtcaatcagttagcatagctcatcagctgagcaaagacactacgactgctgcaggtacttcccctcccgctcccgcccccccccccccgggtgtgcggccgggccggtgctccgccccccccgtcctcaccgggcggcggcggcggcggctcatcagcgccaccgtaccgccgttgacggcgtgctctccaacgacggcggctgttggaagaagccgcgtgacgttgcgctccgtcggcgaagcgagaagcgagaatcaagtcccatcgttagccacatcaatcatcgatcggtcgcgattgatagggaagtgtacagtcgtatagcgtcctcccagcagaatccctgcgccagtcattatttcagcttcctcggcggcgggaggcggcggcgatggacgctacctttggctgggccggcgccggccaccatgttgacgaatacttctcgcgccaggctgctgctggatgcag

SEQ ID NO: 1968 - DNA, 853 bp, Sorghum bicolor
  Clone ID: SORBI-28MAY03-CLUS33474_1
gaggcggcggtggttggctcttcaatcgccggcacaaaggtcttgcacgcgcacgacgacgccctcgcccggactaaacgcgcaccgccgcctccgcgcgcgccttccggggccgtacgtgtcgtcgcctctgcctcttcatcttcctccattgagcctgcaaggggccaggggccgcgtcgctgcgctcacgcgaccttccctcctctatggccggcgcgagctccctctccgtcgaggtcttctccaaagagcacatggcaccgacgtctccataccatgccggcagccacacgttcctaggccaacatacgcctcgcctacgaaccttgctccctgctctgcctgcccaccatctgttcagtcaaaagcctcaactcaatagctgactctgtatctctgccgtctacagccatgccaaggatcttcttcaattgggttcaaaagctagctgatctcactttttattctgtgtatccgcctctagacggagttgatggattttcgcttgttttatgagggatctttatgtttaagattcagattagagggtggttttgagtccctgtctgttgctggttattatctctggtagcagcatgatctaattttggacctttgcatatggaccatcagagctgtgtgttggtggccgaggaatccgtggtgcaggagccagtgacggatgcaccgctggttcatggagatagataaaggtattgcatgatgtggggactggcctccaatgatgaattcaaggagtgcacttggaagaacctctatgtaacggttgtctgggacattaaaaatacattgtttgttagatttggcactagatgcatgctggtaaatg

SEQ ID NO: 1969 - DNA, 564 bp, Sorghum bicolor
  Clone ID: SORBI-28MAY03-CLUS33490_1
gcacgagggttggctgttgtgccgtgagtctcgctttcggtggtgggttgcttcatgcacctcgctgagaagtaggagcaggggcggccatggcggggtcgaggttcgggtcgttcaagtcggagaagggcgactccgcctccgcggcggcgggggcgggggcggatggagcggcgcagaggagggacccgtacgaggtgctcggggtgggccgcaccgccaccgaccaggagatcaagagcgcgttccgacgcatggcgctcaagtaccatccggacaagaatggtgatgaccctgttgcatcagacaagttccaggaagtcacattctcctacaatatcttgtcagatccagataagaggcggcagtacgatacatcaggatttgatgcaattgaatccgatagtcaggaattggagctggacctatcgagtctcaatactgtaaatacggtgtttgcagctctttttagtaagcttggtgtgccaattaaaacaactgtttcagcaacagttttggaggaggcattgaatggatcggttatggtttctcaactccagctag

SEQ ID NO: 1970 - DNA, 634 bp, Sorghum bicolor
  Clone ID: SORBI-28MAY03-CLUS33494_1
gcacgaggatacagtataaacaagagttgggcactgcaatagtaaacttcgcacgcattgtgccagatggactccttgttttctttccttcatattctatgatggatatgtgtgttgaattctggaaaaataggaaccattcaaattcagcgtctgagaacacaatttggcagcggatctgtaagcacaagcagccagttatagagcctaggcagtcatcaaactttcaaagtgcaattgaggattatagagccaaattacatgattcttcttctggggcaatattttttgcagtgtgtcgtggcaaagttagtgagggtcttgattttgctgatcgtgctgggagggcagtgatagttacgggaatgccctttgctactccaactgatgccaaggttcggctcaagcgtgagtatttggataagcaggggacaccatctaataaaaacacaaagacattgacaggagaagaatggtatgtgcaacaagcagcaagagctgtcaatcaggctgttggacgtgttatcagacatcgccatgactatggagctattctttattgtgatgaaaggtttgcgtggccaaattatcaatctcagatgtcatattggcttcgacgtcatataaagtgcta

SEQ ID NO: 1971 - DNA, 594 bp, Sorghum bicolor
  Clone ID: SORBI-28MAY03-CLUS33506_1
gcacgaggccactttatgaccaattagcgcagaaagctcgagatggaattaagataccattacaagatgtcaagggcctaggaaagaaggcgccggtggctacactccccgcaacagctaacgtgttaagagcagttgaaacatttgggggtggtgtgcatcgggtaatagtggtggatgagcagaatgataatgaagtggtgggcatttttagccaattccgactggtcaaatttctttgggagaatgcccagacctttccggcagtcaaccagttgtatccacagtcgttgggagatctgggagtcgggtcccgccaggtgctgtcgattaacgcggatcggccgctttgcgatgctttgcgactgatggacaatgagggtatatcatcagtcgcagtcgttgataatcagttcaacgtagtgggaaatatatcgtcaacagatgtcaagcttttgacccgatcttcgtcactcccgcttctgcgcaacacttgtacccattttatcacggtgattttatctacacgcggattagctgaaggcaaagattctttcccagtctttcatgtgaatcctagctcgactcttgccc

SEQ ID NO: 1972 - DNA, 668 bp, Sorghum bicolor
  Clone ID: SORBI-28MAY03-CLUS3328_1
taaaggacaagcacctgttgcaactttacgtccgtttggaagtgcaaggcctgcaagaaaggaaatccgttctcgttctgaggcattacaattgcaggaatgggctgctgagcattgctctgcaccttatcgggcccctgaattatgggactgcccaagccatgccgatatcgatgagaggacagacatctggtctctaggatgcaccctttttgctatcatgtacaatgtttcaccatttgagtatgctcttggtgaatctgaaggaagtctgcaacttgccattgtcaacgggcagttgaagtggccagcaggacccaaacctccttatcctgatgagcttcgccagtttgttatctggatgcttcaacctcaagctgcaatgcgcccgcacatttccgatgtgcttcttcatgttgacaagctcattgcaaaatacttgccctagaccagcttgtattttcgattgtctcatttctttgttatgcattatagagtgaatatgatgtaaaattggcttatgcttgacgtcattcagtccttggataggctcaatattgattctttgtagaactttcaggttattacatccaccgaatgtttggggatctttattactcatgattcatgtaaaaaaatgtcagttgaacatcaaaagctgctatatg

SEQ ID NO: 1973 - DNA, 624 bp, Sorghum bicolor
  unsure (1)..(624): unsure at all n locations
  Clone ID: SORBI-28MAY03-CLUS33292_1
gcacgaggcgaatcctcttggaggcgccgtgtatctcgtcaaggatggccaattgccttctaagatcagaactatgtctcgcgatgctgacggctactctgctgcataccgtattacgcagtatgtgacgaggcttttcaaaagtccagatcttttctctgttgacaaggttccttctgcgcttcgagctgcctatcttcgtaacattgcggtttccgtgcagcttgcagatgacaaccttggacttgccggcgcgaatggcttctgggcacaatacaactcggacgttgaagctgaggcgatgaccttcatgtcggatgcgcaaccattcgtgacacacgagctaaagaatcttgttgaaacgtggtcgaaggacgacgacaacgcccctctgttgtcttgggcaacctcactattatcggagatagatgtcggcgcaacttctccagcatactatcacgcccgagcatatgctgtcttgatagccgaccctattgagattactggctggaagaactcacaaaccgcccaacttcaggaaacgctcaaaactacgcgaagttcgaaaaacgtcctccaactccttgcgttcttgaacgctntcagagagcccttgtcgtatgc

SEQ ID NO: 1974 - DNA, 470 bp, Sorghum bicolor
  Clone ID: SORBI-28MAY03-CLUS33297_1
gcactcggaggtgccgggtgcggcaccgcggcgcggcaggtacactacacaccctgttgcgcggtgttggcccttccctcctcccccgactcctccacctcgcccgcggggctccgaatcccggataaatagcagcccgcggacagagccctcgacctttccaattccagagtttcaaggcctcgctttaccttgcttttgcttctgcgtctgcttcgctgcctatggcggcgtgggtgcgggccgcgttgctggccgccgccgccgtggccgcgtatacggcggcggcggcggtgccagcggaggcgctgagcctggacgtccaccaccggtactcggccaccgtgcgggagtgggcggggcaccaccgcgcgccgccggccgggacggcggagtactacgcggcgcccgccccgcgcggccggcgtcggcggtcgctcgcggccgggcccgccgcaggaggaggagga

SEQ ID NO: 1975 - DNA, 729 bp, Sorghum bicolor
  Clone ID: SORBI-28MAY03-CLUS33301_1
gtgatggaagatgaacttattagtgagtctgatagtggaagtgatggggaggtgcacccattgaacgaacaagatttggccgattctgttgatggcattcatggtaacaaatgtgaacatcccactgatgcacctgaaacaattttacaagatgagttcagcaggttgccttcaatgaagacttttgacagatccaataacctaagttttaaagaatctaatttggaagagaagatctgccagaagctattaactaaaacattcagtaactcagagaggcttggaatgatttggcctgaaccaccattggatatgttggcccagtgtcttcctgacagcacaaagtcatttgcttcaggaaaggcattaagatcgtatttgtctttcaagtcagtaaatggagattctgatccatttgcagcggaagttcctgattttaacattaactgtgcagcagttaaaaggaaaagaccatactttgtaaggataataagcaagcagatggttggagtgtacctatcaatatgggtacgaagaagcctccgcaagcacattcagagtctgaaagtatcaactgtaggggtcggtgctatgggctacattggtaataagggatcaatatcagtaagcatgtccatataccaaacacacttttgctttatatgttgtcacctgacctctggagagaaggaaggagatgaactaaaaaggaatgctgatgttcaagaa

SEQ ID NO: 1976 - DNA, 737 bp, Sorghum bicolor
  Clone ID: SORBI-28MAY03-CLUS33533_1
gcacgagggataagatgctttttcagcggagccaacactctagtatgattaatggtctgcatggccgttaccagatgtatggaccagtagttaggctagcaaaaagatggatttctgcacatctattttcttcatttatctcagaggaggcagttgagttggtagttgcgtacatatttttgaagccattcccgttccatgccccttcttctcgggttgctgggtttctcaggtttttgcggctcgtggcaagttttgactggaccttttcacccatggttattgacataaataatgacttcaacctgaaggatgagaaggaaatcaatgataactttatgctgagcagaaaatcttatgaacaaagccctcatgatatagagcctgcaatgtttctcgctacgtcatatgataaagcatctgaagcatggacaaaacagtcaccaagcaagtcggtccttaaacggatggctgcttatgctaaaagcagtgcacagcttttaacaaatcttatacttcatggtcaatctggagaatatacatgggagtgcctgttccgaacacctatgagcaattatgatgctgttattctcctccatcaagagaagctttgttgtccccatcatgtactttttcctgccgaaactccagaaggtaagttggtggtctggggcaaaccaagtaaagatttctgcccctatatgccactcaacaaaggggcagtgaaaggttttcat

SEQ ID NO: 1977 - DNA, 986 bp, Sorghum bicolor
  Clone ID: SORBI-28MAY03-CLUS33542_1
gcacgaggaaaagatatatggagcttactaaaggtgctgctgacaattaccaccgctcttggtggaaaagacatggagttgttcttgatggagagattgcagctctgttctttaagcatggaaattatgacctagctgtgaaatcctatgagaaagtttgtgctctctattctgcagagggctgggaagagctgttggcagatgttcttcctgatcttgcagaatgccagaagattcttaatgatgaagctggttatttgtcttcttgtgtaaagttactttctctggacagtggcttgttttcatctaaagagcggcaagctttccagtcagaagttgttcgacttgctcacagtgaaatgaaacatcttgtgccccttgatgtctcatcactaattacatttgctcgaggtgctggtccaccactagaattatgtgatggagatcctggtacactatctgtagcagtttggagtggcttcccagatgacatcacactggagtctctcagtttaagattgtcagcttcttctagtgcagatgaaggtatcaaggcaattaaaagttcagattctcatgttctcgtaccaggtagaaatatcatctcttttaacattcctcctcaaaagcctggctcctatgtgttgggtgctctcactggacagattggcaaactgtcattcagatcgcatggattttctcaagatggtccagttgaaactgatgaatttatgagctttgagaagccaacaagacctgttttgaaggtgagaaaaccaagggctttagttgatattacacctgctgtgtcctctgcattgcttatgaatgagctccaatggattggattaattgttaagccaatagactattctttaaaaggtggcatattgcatatcgatgctggtgctgaactgaaaattgaggagtctcagatgattgaaatagaaatttacggaagtgatgtggagtgtgctaattctgcc

SEQ ID NO: 1978 - DNA, 665 bp, Sorghum bicolor
  Clone ID: SORBI-28MAY03-CLUS33547_1
aaccccccaccccgcgccgtcccatatcccttccgccggccccggcggcgtctcgccctcaccgtgaccgggcggagagagagagaggtagagcagccacccaccaggcatcagccttgaagggggcgctgaagtggcggcgacggtcgaggctcgagctcccgtgccgcgctccgagctaacctagatgaacatactcgcgaggataagtggaggtggcgacagggcggccgccacggagccgccgcccccgcagccgatgtgctgggtggagatttcggagtccgtctcacggctctgcagcttcgacgccgctggtagtggcggcggcagcatctctgtaaaagttattcaggatgctagacctatccatgataaagttgttgattctttcttgaacaagttttttccatcaggttatccatacagtgtgaatgagggttacttaacttataccagattccgagcactacagcatttctctagtgctatgctacatgtgctgtcaacacagtcgttgctatttgctgcaggtttgcgacctaccccagctcaagcaactgctgtaagttggattctcaaagatggaatgcagcacgcaggaaagctcatttgtagcagcatgggggcaagaatggattctgaaccaaagagttggaggatac

SEQ ID NO: 1979 - DNA, 546 bp, Sorghum bicolor
  Clone ID: SORBI-28MAY03-CLUS33585_1
gcacgaggcatcgattcattgcgcatccacaatacagcgaatgggcagcgtcgtggtcctgtacacatggatggtccggggccacctccacccgatggcgcagctcgccgaccgcttggcgggccacggcgttcccatcaccatggccattgccgacgtcccgtcgtccagcgactcccatcaaaccgtggcccgtctctccgccacctacccttccgtctccttccatctcctccagccgacaaccgcccgttccggggacaaggccgaccccgacgccgaccccttcatcacgctcatcgccgacctccgcgccaccaaccccgcgctcctcgcgttcgtgaggtccctcccgtccgtgaaggcgctcgtgctcgacttcttctgcgggtgcgcgctcgacgccgccgcggagctcggactcccggcctacctgttcttcacgtccggcgcgtccccgctcgctgcctatctgcacatccccgtcatgcgctccgacgtctccttcggggacatgggacgctcgttgctgcacttccccggagt

SEQ ID NO: 1980 - DNA, 630 bp, Sorghum bicolor
  Clone ID: SORBI-28MAY03-CLUS33593_1
tactgatctctctcctatcatttcatctatctatctgatctcatctcctatcttctccctcctctcctcctcctagcttccagctctctctctcctctccgtcttctgcccgccgcccgcccgcccatgtccgtggcgccgtgcgcgctcctcctgccctgcaagctgcttctccagcgaaagcgccgcgccttgacgcacctccgatccgcctccaacgccaccgccgcccaaggaagggcccgggacagagcgttccgcggctaggcagctagctgatcggcggacgtgaccagaggcggcagggagggcaacagaccagcgagcgcccggcgattgctttatttgccttgggtgctccggccggggaaggagagttggtgttggttggttctccttcgttccatgcatggatggcaaggaactcatctcacagtccgacctccaatcattctaccagcagcagcaacaacagcagcagcaccgggcctttggcggcggcggcgggcaccatagcccgtcctcgctggccgggatgcactccgtcatccgccccatgcctaacatgcccaacatgaacatgagccccacggcgatcctcaactccatcggcgggggctccctcgccgg

SEQ ID NO: 1981 - DNA, 516 bp, Sorghum bicolor
  Clone ID: SORBI-28MAY03-CLUS33603_1
gcacgaggcggtactcttgccatgtcttggggatccggtacttctaacttcccatacttgatcactcctgaccaaggtatccagctccaggctgttgaggacggcacccgctacgagagcatcctaaacaacaaccagtggccccagacccaggctctcgtcagccagcccaatgttaccgctatcgttttcgccaacgccaactctggtgagggttacattaatgtcgacggcaactacggtgaccgcaggaacctcactctctggaagaacggggacgagctcatcaagaatgtctccgccatctgccccaacactattgttgtccttcacaccgttggccctgtcctcctgaccgagtggcacaacaaccccaacatcaccgctatcctctgggctggtgtccccggacaggagtctggtaacgctatcgctgatgttctctacggaaaaaccagccctggacgttccaccttcacctggggccgcactcgcgagagctacggtaccgaggtc

SEQ ID NO: 1982 - DNA, 539 bp, Sorghum bicolor
  Clone ID: SORBI-28MAY03-CLUS33617_1
gcacggcgcggggcagtcgcctccgcctccgcctccgcctccgccgctgccgccgccgccgccgcagcaacctgcgagcatgtggtggagaagcccgctatatgcacggccgacgagctgcactacgcgcccgttccgggcaccgagtggcggctcgcgctctggcggtaccgtccgccgcctgaggcgccgaagaggaaccacccgctgatgctgctgtctggagtggccaccaacgccattgggttcgacctgtcccctggggcttcatttgctcgtcatatgtccatgcaaggatttgatacatggattgttgaagtgcgtggtgctggcctgagcatgcgtggatcagaactagctgcagctaacaccaagtctgacatcacccctggtcctaatttggatgaaagttctacaacaaaagcaattgttgctattcctgctgagaatatgttcacttctcaacatcagatttctgaagttccagtaatagcagataagaacatggtaggaacaagtatatcagaagaaccgcagct

SEQ ID NO: 1983 - DNA, 596 bp, Sorghum bicolor
  Clone ID: SORBI-28MAY03-CLUS33393_1
gcacgagggcacaatgtagatttgaagcttttgaaagacagatgaagcccgcggaagaagcacgtggtgatgcaaatgttaagtatggatggttaggatctaggaagagtgacatagttaggattcttattaatggcttgggtaccactgcaaatcctgttgagaaagcaggtttgagtgctggtgtatatctttcaccagaaaaccgagcctttaccagtgtcggtctttgcgatgttgacgaaaaaggagtgcagtatatgttgctgtgccgtatgatattgggcaatgtggaagctgttgaacctggatcacaagagtcttttccaagcagtgagatatatgattctggtgttgatgattgttcaaacccaaagtgttatgtgatgtggccatcacatctcagcactcacatccgtttagaatatcttgttagtttcaagcttgtcccaaaagttcgaaattatttgcttgacttgaagggtttatggtttaacccatcactaaaggaagttggaatggatatttctacacttcaacctgtaatgtgtgaaacaggtgaaggaccaacttccccatggatatcattcagagtt

SEQ ID NO: 1984 - DNA, 449 bp, Sorghum bicolor
  Clone ID: SORBI-28MAY03-CLUS33395_1
gccccgggcccccgcgccccactgatcttccggcgaaatcccgctcccgcgtccccctcctccggccgcgcctcgcttcgcccccgctccgtaaggagcagtaaatcatggcgaccggccaacttttttcgaaaactacccaagcattattctacaactacaagcaacttcccatccaacggatgcttgattttgacttcctctgcgggagagaaacaccttctgttgctggaataatcaaccctggttctgacggttttcagaaacttttctttggacaagaggaaattgctattccagttcatcctacaattgaagctgcctgcaatgctcacccaacagctgatgtgtttatcaactttgcatccttccggagtgctgctgcctcttcaatgtcagccttgaagcagccaacaataagggttgtagccattatcgctgagggtgtt

SEQ ID NO: 1985 - DNA, 590 bp, Sorghum bicolor
  Clone ID: SORBI-28MAY03-CLUS3341_1
ggccaagatgtgagcctaaagcccaaatattgtccatccctaaaggagctggatctaaaaaaacccaatccagcatgatcttgcaagttcagaccttctcgagatgtttgaacatgtttttatcgcgacttgtatatgacgtaactgcctacagtggatggatgaaggtacctgagtgcgggaggagctgctctcgtggggctggctgcctggatgcaaaggtgccgcctagcacgtcgtcggcaatggcagcactccaactggagatgagtgctgatgtagttgattggcccggccgtgtggtgatgtgtgctcatggcgatgtcctggccgcgtggtgatggtgctgcagatcggccggatcaggtgaggtctacggcagcgcggtggtgtcctcgtggcgtagctatcctgcgcatctggggttgggtgaggtcgacatacgcgcgatgaaaggatgtgcccgctcgatgacctagcccgcggtgagcgactcctgaggcgtcggggcttcgacgggggaggggagaaaggattgggtttgtgatgtaatcacgatatgtttctttatttgttgggtgtataaaatc

SEQ ID NO: 1986 - DNA, 754 bp, Sorghum bicolor
  Clone ID: SORBI-28MAY03-CLUS33652_1
tttggttgaattggttcatgggaagcgattgaatgcgcagaagttttcaattggagggactccaaggaaagtgctataccataatgaaagcagaacactgctcgtgctaagaactgggctaagtggtgcatcgtcttcttcagatattgtccaagtagatccacaaaatggggtactactttcgagatataaatgtgaacctggtgaaacagcaaaatgcatgcaaattgcaaaaataggaaatgatcaagttttaattgttgggaccaataagtctgctggacggccaatgatgtcaaatggtgaagcagaaagcagcatcaagggacgcctgattgttctaagcttggcaggcagttgaaagtcctcgtgagagcagttcgtttattccagcttctagttttaatccctcttcatcacattctggttctcctttccatgagattgttggatatacaactgaggaattttctagtaacagcctgtgcagcagtcctgatgagttttgctgcaaccagatccaagctgaaatggcaggacaattgagatcattgactcatgctatattgaatggcgcagttcttgctgtgtgtccctatctagatcgttatgtgttggcagctgctggtaatacgatttatgtatttggtttcacaaatgaaaatccccacaggatgaaaaagtgtgctgttggtaggacacgatttacaataacttgtctgaagacatttgcatcacgaattgctgttggtga

SEQ ID NO: 1987 - DNA, 958 bp, Sorghum bicolor
  Clone ID: SORBI-28MAY03-CLUS33665_1
gcacgaggctctcttctccttgctctcgctgccgcacgccccctcgtccagcgaatggatccggctggctccagcatcgaccgcaacggatcgaactcccctttgttctcttccatgccgttgccccctcacgcgtctcccggcgccactgtcgcttgagcacggggatccaccgagatcggcggtgtagccatggccggcagctggctacacagaagggaccactgacggtccccaagccgaagggttggcgtccacagaatccctgtcacctcactagcgttctttgtcctagcagcacccaccatcacctatgcagaacttgacgtcaacatcaatagcgcacaggaggtgttcgatggaatggccctgaggctagctaatggacattggccgtaacaaagagacgtccactggcatggaagagaaggtgttgaagttggttgtgatgggctttctagaggatccgatgagcagtgccctgaagactgtataatttctcgatgctgtgaaaattataaatattgtgagcattcagaaaagttcagctgtcttgaattctgcactctgaatgttctgaaacttcagaacgccagcagctcctatggccaatctgccccgcgccaccaagttgcttgcggctcaacctgcacggcagatggcgatggtggttatgcaggtggcattttacgacagattacccattattttttaccctgtagtgccggtaggtagcctgtctttctgtttttgtcggatgttggttcctgatagtcttccatgctggcagattattttcttaactggggttagtattttcatttcagcactatctttgtttgagaactcattgtactatgaatttttgttggtgtagtatgtctgatattatgtgttgataccatgattattgtaacaatgactacataccaatgtttgcttaattttagctaacacg

SEQ ID NO: 1988 - DNA, 582 bp, Sorghum bicolor
  unsure (1)..(582): unsure at all n locations
  Clone ID: SORBI-28MAY03-CLUS33669_1
atcgcacgtcggagagatgcgcgcgggcggcggcgcgcgccccagacacgcacccctctccccgaccgcctccgccactgccacgctgctagtacccgcctccgtcgccatgcccgcgccgcgcctcgcgcacctccgccacctcctcctctcacaacgctccgccccggcccgctcgctggcccccaacctaggccacccgctccccgggccgcttcacccgtcccttctcctcgcccgtgccatggctggcgtcgcgcacgcaggtctggcgacggggtcgacggaatacgaggaggtgctcgggtgcctctcgtcgctgataacgcagaaggtgcgcgcggacaccggcaaccgcggcaaccagtgggagctcatggccaagtacgtgcagatacttgaactggaggagtccatcgcgcagttgaaagtggttcacgttgctgggaccaaaggaaagggttcaacatgcacatttgctgagccaatccttcgatcatgtggcttccgcactgggctcttcacttcaccgcanttgatggatgtccgcgagcgatttcggcttgatgggctggacatttc

SEQ ID NO: 1989 - DNA, 503 bp, Sorghum bicolor
  Clone ID: SORBI-28MAY03-CLUS33693_1
gcacgaggcgccactgagatcagcgcatgtgcaggtcgcccctactggccagccccatgccctcgcctcctgctagattgctgcacagcacggcccagagatcacactgagccactgagtaaggctaggtttggagggttgcactggcttgagaggtcataccagttttcaccccactgaatcttggtggttctttacctgaactgctcccctatgcaccctgtttcagtcccctcccagccctttacagcaactcctgcaaaacaagttgtgtcaagcagcaatgctttgaggaaggccatccattttgtcaacctgcggagagctggaaagtctagtggaaacctggctatgaattccatatcgaaacctgcccctgggtccgaaacatctgggagggaggattttgctgtgggggataaggatgctgtggtcattgttgatcatgggtcaagacgccaagaatccaatctcttgctaaatgactttgttgagatgttccg

SEQ ID NO: 1990 - DNA, 571 bp, Sorghum bicolor
  Clone ID: SORBI-28MAY03-CLUS33697_1
gcacgaggctccagctctcgctcgccatccgcctcacctcgcaggccttcctcgccggcgcccctcccccgcccgagctcctcttcggctgcggctccggcgtcgtcgccgaacaccacgctgctggcgacggcgcggatgatccggaggccatctcctaccggctctgggtgaacgggtgcctgtcgtggggcgacaagatcacgcacggcttctacaacatcatgggcatcgacccgcacctgtgggccatgtgcaacgtcgcggaggagggccgccggctgccgtcgctggcggcgctgcgggcggtggacgccagcgagtcgtcgctggaggtggtgctcgtcgacaagggcgccgactcggtgctcctcgacctcgagcgccgcgccctcgacctcgtccgcgcgctcggcgtcacgctcgacctcgcccgcagcctcgccgtcctcgtctccgaccacatgggaggtgcgttgcgatcggaggacggggacctgtacctgcggtggaaggcggtgagcaagaagctgaagaagaggcagaagtgcgtcgtcgtccccatcggcgg

SEQ ID NO: 1991 - DNA, 466 bp, Sorghum bicolor
  unsure (1)..(466): unsure at all n locations
  Clone ID: SORBI-28MAY03-CLUS33699_1
ccgcagccactgccaccgtcaccttctcgccgtctcccccatccttcttgaactcccagctccgtcgtatccaccggcctgcctctaccacgacgatagcttttttcgcacgccgtttctgcggtgtaaaacctagccccaaccgctcccgaggcaagtccgccccggttgccccccccgaccatggattcggcgcactcgaagcggagctctggcgcctccgccgcctcgtggagctgcagatccaccgcttcggcaccgaggccgacgccgcgtaccgcgacctacgctcggcggtgcgcgaggtcagcggggaccgcgtggtcctaaccttccgccgctcgtcgctgcgctactttgccggagcgctcctcttcttgctcgcctgcgccgtcgcggcgcgagtgctactggggatcgtcttacgggcgtggtggcggcgggggttgnggaggggattctgggg

SEQ ID NO: 1992 - DNA, 595 bp, Sorghum bicolor
  unsure (1)..(595): unsure at all n locations
  Clone ID: SORBI-28MAY03-CLUS33742_1
ctgagcttgtgtggcaaagggtggtgcacgtacagcaggaaatagagtttaatcaggaagccctactcttgagtgtagagtgggttggttctgaagatggcaccaatctggttgggtgtgatatcgggagtatgttgcaagatgatctcctagaggaaattgtagctgactttctgggggcaactaaatccgccaggctccgtggctagaattgccaatgtttgcatccgacgccattagaagcatatgcatggattggtcgctggtgagctatagtggaagattagccctcgatggggatgataattccaggagttcacctcatggctactgaagggcatggcaaagatggcgtaggtgatggtggagcatcaaacaagtggggtggaagtttgacctggttgtgtgctcatgtacatgtcacctttggctccgaactcctcaataacgtagaactggaggttttccctctgaactccgaaaagcattttaatttctttaggttcgcataatgccggaatatagatgtacaattttggttttaagganattgtgtaaaataatctgtgggggaatttagtatgtttattattac

SEQ ID NO: 1993 - DNA, 526 bp, Sorghum bicolor
  Clone ID: SORBI-28MAY03-CLUS36017_1
taagcacgtgcggaagattggcttgataaattcagcccctgggagattcccaggcatgatgtggtgttccctgtcagatttttcggccatgttgagattttgcctgacggctctcggaaatgggtcggaggagaagtcctgaaggctttagcatatgattgtccaatccctggatacaagacaaaaaatgcaatcagccttcgtctttgggaagcaaaagctactgctgaagatttcaacttatttcaattcaatgatggtcaatatgagtcagctgcccaacttcatgctaaggcccaacagatatgtgctgttctttatcccggtgatgctacagaagaaggaaagcttctgaggctgaagcagcagtttttcctttgcagtgcatcacttcaggatatgattgccaggtttaaagaaaggaaatctgacagagtttcagggaagtggagtgagttccctactaaagttgctgttcaactgaatgacacccaccctactcttgccatccctgagctaatgaggt

SEQ ID NO: 1994 - DNA, 738 bp, Sorghum bicolor
  unsure (1)..(738): unsure at all n locations
  Clone ID: SORBI-28MAY03-CLUS36053_1
cctactggactacccacatccatctcccggctccccccgcccccaccctcttcttgccaacacaaggcgggtgtccatggccgtccaggcgcagcacctactcaaccccgccttcctcccccaccacgacctcgcccacgccttcagggcgctggaaggtgccgcggtcggtgccgccgtcggcggcaacttgttcttggacgagctcggcttcgtcgggtgcgcgccgccagcgccagcgcccatcggggacgccccgttcgtcgacgcccagccgcgcagcgagctcacctgcaacggcagcggcggcgacaacaacaacaacgtgttcctcccgaggaagcgggcacgcgttgcgccggggttcctggatgatggcagccaccagcagcaggggttggttctgcccctcccgctgccgccgcacgtccaggtgttcgccggcgacgtgcagacctgcagagccggagggtgcggcgcggcgtccaccagcggtcgggccgcggtggcgtccaatgccgtcctctcgcagctctaccaccagggcgtggagatcgacgcgctggtgcggctcgagaccgagaggatgcgcgcggggctccaggaggctcgccgtcggcacgcgcgcgcggtggtggcggccgtggaacgcgccgcgtccgggtcggctccgcgcggcggaggccgacctgatgcgcgcccggtgccgcaacgcggagctggaggagaggcttcngc

SEQ ID NO: 1995 - DNA, 720 bp, Sorghum bicolor
  Clone ID: SORBI-28MAY03-CLUS33797_1
gttaattgcaggcccgttactttctgcagtgcatatatacggagttgttcaagagatgagagcaactcctgtaaatacactcaacccacaaagaacagcaatgattgtggctgattttattaagagtggaaaggtttctagcccagctgagctaaggtacagagaagaccttctgtttcctaaccgagttatagaagaagctggaagtgtgaaaattggacagccactccgcagggtcttgagtccgtcgcttgttgaacagctgagggcaactttcccagatgagaagttcttgcttacccaaaaaagcaacaagacatacatggttcttgagcaaagtgcgagcggagaggacgcgttgagggggtggctggtcgccgcatttgcttcagagatggagaggtcaggcatcgtttcgcgtgacacggttctgaaggaagcctatgagaagacaaagatggtcttccccagttttgtatcagaagttaggagtagagggtggtacacagatcagtttttggatgggaacggtagtcgagttgcatttgcaaagtttcagtagttgcaagactataagtttttatgtttttggaggaagatgcggaaccatgcatgaactcatgcagtgcagggcagtgtagtctaactcttctagttacacagaagatgaactgaccaagtgccacacagttttggttcttagaacttttttttcgtggc

SEQ ID NO: 1996 - DNA, 1065 bp, Sorghum bicolor
  unsure (1)..(1065): unsure at all n locations
  Clone ID: SORBI-28MAY03-CLUS338_1
gtcatagagccgcaggccacagacacctcaaggaagctgctgtcggataagatggcgctgcttcggcttcttgccctctcgctgctcttcgcagtggccactcctatcagagacatcaccgatgcttgctcgtgtcgtgccaccgccagtccggccccgtgttcaaccccaggtcgtccagctcctacacctccgtgtcctgctccgctccgcagtgcgacgctctcaccaccgccacgctcaacccgtccacctgctccacctccaacgtctgcatctaccaggccagctacggcgacagctccttctcctactgcctcccgacgtcgtcgtcgtcgtccgggtacctgtccaggtgctcctacaaccccgggcagtactccaccacgcccatggcgaagagctcgctggacgactcgctctacttcatcaagatgaccgggatcaccgtcgccggcaagccgctctccgtgtcggcgtcggcctactccagcctgcccgaccatcatcgactccggcacggtgatcacgcgcctgcccacggacgtgtactcggcgctcagtaaggcggtggcgggcgccatgaaggggacgccccgcgcgtcggccttctccatcctggacacgtgctttcaggngcccaggcgtcgcggctttgcgcgtnggccccaggtcagcatgngccttnncgccggcggcgcggcgctttgaagctgaagggcgaccannacctgctnnggtggacgtggacagcgnccacnncacgtgcctggcgttcgcgcccgcacggagcgccgccatcatcgggaacacgcagcagcagacgttcagcgtcgtctacgacgtcaagaacagcaagatcgggttcgccgccggcggctgcagctgaggcggagaagctacacgcacagatcgacttaattgtggtaaactaaaacgagcagcgcatctaccgtncgatttcgtctcaactcatcatttggattcgttcacgcaagctccttattaccgattgagcttgcntttntctntatatatatatatatatatatatatatatatata

SEQ ID NO: 1997 - DNA, 626 bp, Sorghum bicolor
  Clone ID: SORBI-28MAY03-CLUS33802_1
gataagttttttggacgctaaggaatgggcaaaatgaaatcatgagacagcaatagcttattagcttagccacgagccacaaacagagacgccgagctgtgatatgggaactcgatcttgcactgtggaaatcattgttgcccgcatcttttcttcaatgtgcagtgatggcagggttgtgaaaataccagcattatgtctggtgtgttggctttatttctcatctggatttggagaacgacttgagcggcatgcatcataagccatttcagtgacagagtaaatgacgacatagaagatcactggtctgtacagacagggtatctggtacacactgcattgcctccacagtttttttttttatggcacggggactcaggtcaacgctttgaacttcagtgaagcggacagtgcatgaaacgctttgatgggtttctagaacatatttgtagtacaatgcctgtggcccggtagcagtggctaatgtaattgtaacacggtcagctgtgtgaagtatctttgtcctgtttgttgatgccatgcgatgtttttgtgtatcgccaaaatttgaacccgtgattcctaggatgtgagatcaatgttacatgcatgagctgtcgattcgg

SEQ ID NO: 1998 - DNA, 539 bp, Sorghum bicolor
  Clone ID: SORBI-28MAY03-CLUS33804_1
ttgttactgttggaatatgtccttgacccaacatacagtttagggatgatgttttcggttttgcttgtaagatttttattgattttctggaaattacctgttgtcaagctggtgactatccgtcccgaaagggttcaagtgagatagggtcaatgccgtttcctcctggtgtgggtgaacgttccagtggtgaaattggcaacagtgaaaactatgaagttattaccgctgatagagcaattgacgaaagcaatgtgggcaaccgtattctacgcaacatggggtggcaagagggactgggtctcggaaaggatggcagcggtatcaaggaaccagtccaggcaaaatccgtggacgtcagggctggactgggaagtcagcagcggaaggctgatccatccctggaggcccaagctggggacagctacaaaaccatcatccagaagaaggccatggcaagattcaaggagatgtcatagctacacagtttctctctattcctgttgttgcattttgtagtctgagttactttttttttt

SEQ ID NO: 1999 - DNA, 591 bp, Sorghum bicolor
  Clone ID: SORBI-28MAY03-CLUS33812_1
gcgacgtcggcgcccgggacggcacgctggccctcttcgccgccggggacgaggccgtggtcgcctggctcgccccgctcttcgcccacctcggcagggtgacccacatgggcggcccgggaagcgggcagagcagcaagatcgccacccaggttgcggtggccggcgccgtggtggggcttggcgagtccgtggccttcgcccgcgcggcggggctcgacgcgccgctgttcctcggcgccgtgtccaagggcgcggcgggctcgcgcatcatggacatcttcggtgaccgcttgctccgccgcgagttcgtgtccgccggcagtgtgcggtacatcgtcaaggacctcggcatggcgctggaggtcggggacggcggggaagaggctaacgtgctgcctggagcggcgctgtaccggcagatgttctcggcgatggtggccaatggcgacggcaacttgagcttgcagggactgatcaccgtcgttgagcgcctgaatggcattggcaaatagcgcaagctgcaggcaaggtgttcgccggaatgcagcactggacttgaaaactccggttttttcctgaataaaattt

SEQ ID NO: 2000 - DNA, 429 bp, Sorghum bicolor
  Clone ID: SORBI-28MAY03-CLUS33836_1
tctgggccgtgcgcgcgccggtcgcgcccgacgccgactcgacgaagcggttcgagggccgcggcgaggcggcgctggaggcgctgctcccggatgggttcctggacaggacgcgcgggcgcgggctggtggtgccgacgtgggcgccgcaggtggaggtgctgcggcacccggccaccggagcgttcgtgacgcactgcgggtggaactcgacgctggaggcggtcacggcgggcgtgccgatggtgtgctggccgatgtacgcggagcagcggctgaacaaggtgttcgtcgcggaggggatgaagctcggggtggtgatggagggttacgacgaggccatggtgaaggcggaggaggtggaggccaaggtcaggctggtcatggagtcccagcagggaaaggagctcagggacagggtggccgtgg

SEQ ID NO: 2001 - DNA, 553 bp, Sorghum bicolor
  Clone ID: SORBI-28MAY03-CLUS33823_1
ggccatgaaccgatgcaaagggaaatcatattctcagtccaggagagaataagcaatggtcattattcgagcccaaccccattatgtaccaacgatgagcagatccagacacataggatgtatatatctgggacatctaatgatctttgggttgcattgtctgtaacatcctgggattgagctgcacgatgtatgagaggagcaatggatgcttagaattccggtggtgcagatcaactatcattgtaattttttgttgggtgtaccagaagcccagaagggagtaccaggacatgtctggtagcacctttgagggaaagcatccatttttgacatcagatcgaagtattgattatttacgtcgtgtagcagtcagaactcagaagttatccggggggttgtgcttctatgctagtatatattctttgttttggcttcctctagagaactggctatagacaagctctattttagctgacggctttggtgtaaggtgaactggcgagttgccacacacgcggaggatatgatgtacgtttacacataatgtact

SEQ ID NO: 2002 - DNA, 733 bp, Sorghum bicolor
  Clone ID: SORBI-28MAY03-CLUS33628_1
tccttccttccccttcacagctccatccactccaccctcctccaatctccatcgccatcgccaatcctgagctgaaagcaagcatcatagcagtctcgcaccacgcgcgcgcgcgagagagaggcaccaacaccagggagactcaccaccacgagacagggacaccgacgggcgccatccccatccaccaccaccctctctcccagcttccgttggcttcactcccactgcatccccccctcactcgctcactgccccccggctcccgtcgcctgcccgcgccacagatctcgcccgccggccggccggaaccctaatgcagctggaggccgcgccgggggagtgacgccgatgcagcgccgggtggtgggcatggcggacggcgacgccagggggcggacgctcggcgccgtcatcaaggagaaggatgaggagctcgcgctcttcctcgagatgcgccggcgcgagaaggagcgcggcgctgctgccgcggccgcggccgctgcggcggaccagctcctgctctccggcgacgcagtcgccggtgacgggatgctgctcctcgacccgccgccgcccgccgagcccaagccggcggcttacaaggtggctggctgcggatttaggagggcgcctgggggagcggacgacttcctcaatgcagacgccggcgacaagaacgattacgactggcttctgacgccaccaggaactcccctattcccatctctag

SEQ ID NO: 2003 - DNA, 806 bp, Sorghum bicolor
  Clone ID: SORBI-28MAY03-CLUS33634_1
gcacgaggccctcttggcccaaacagccaccaaccacaaccaggctcccctccctgtaccgcgccccatacacccgcgcccgctgacactcctccccgccaaccacccttcgcgtcgcccacgactcgtcgtacacccggtcctccctccttcgctgagctcgtcgttcccctccccctccccccccgatcgcgcagcctccgccaaaccctagcgtcgaattccccgccgaaccgacgattccaaggttccgaccggggcgagcgccggggccgcattccgggagcgggtgatggcgacctgccgcaagatggcgcgcgtcgacgtcgccgagctgaagcagcgcctggtgaagcggctgggccgggagcgggcggccaagtacttcgcgcacctcaccaggctgctgaatctgaagctcaccaaggtggagttcgacaggctctgcgtcgccaccatcggcaaggacaacatcgcgctgcacaacgcgctcattaggggcatcataggcaatgctctgtcgggggtgcctccgcccagtcggcaggcggtgacggggcagtcaggcaccaccaccgccccgagcgggcagtgcgtgagcgtcgtgctgccggtggtggggaatgtgggggcagtgcttgattcaggtgatggtgaactggcgagggagcggggggcgccagtcgggaaggtggtgtctgtggaagatggggaggaggtggagcaggtcaggtctgctccgtgcgtccagagccggagcccgataacaacgccattggggatttcagttgctgggggcagtgcta

SEQ ID NO: 2004 - DNA, 553 bp, Sorghum bicolor
  Clone ID: SORBI-28MAY03-CLUS3365_1
gagacaccagttgaggttgttaaggaacaggataaagagtttaataagcaggcaaccgatgccataattccttccatgcctggacatgtggtccaagcttttacattgctgaaatcaagcccggaggctcagagtgttgtagcctcccttgcatcagatagaaatgtctgggaagcagtattgaagaatgagaaggttatggaattttacaagaatcaccagacaactctagttgcgacattccctgaagaagcagccacagtagagtcgctggggaattttgaagacgccacctctgaaaatgcatccaacactgaactccccactggctcacctttctctgattttgtggacaatgcgaagaagagagtgatggatgtgatctataatataaccgactttttcaaggacttgttcgactcagcgggagcacaggacggagcaagcccttcagctgagaaagccccttctgcagcagagatggctctcagcggatcgtcatggctctggccataggggcatactagtcgactgctcaagaggcatgatagct

SEQ ID NO: 2005 - DNA, 732 bp, Sorghum bicolor
  Clone ID: SORBI-28MAY03-CLUS33882_1
ttctctgtgcgagggtttgcagcggcggctgcacagcaacggcactggagtgacggtgcaagccatcgatgctttgaatcgtggattagatgagtttttgcgacggttgattaaaccgggtgtggatttgtcgagggtaagagccagcagtagaagaaatagcaaagctaatgaaaggtttgctggtagaatgaattcgttgcaacaatcaaatcagggtcagtgtacaacgttgcaagattttgcagttgctgtgcaatctgatccacgtttgcttggtccaaattggcccacacaaatcgagaagatacagtcaatgtcctttggaggagaatgatacacagtagcctgttatagctgatgaacttctctaaaggggatgttgtttgctggcattgaagtaaatgaagcagcagaccaacaacagggctacaaaatctgagtattgcagtactcacaagcaagaaataccaaggcccaacaagtgaacaaagggaggtgcaatggacagtgcagcataaattcttttggaatatatagcctgttgataataaatcggagaatcaacaaggttggctgaggtccaggtcaagctgagtaactcattggcaaacataccctcagctcttgacacgaaaagcatgttctgatattacttttagagatttgttgtgatgttgtaatagagaatttcccccttattacagacttaaatggaatcatttttcgcag

SEQ ID NO: 2006 - DNA, 602 bp, Sorghum bicolor
  Clone ID: SORBI-28MAY03-CLUS339_1
cccacgcgtccgctcaatagttgcatgattgtccaaagatgaattgatctagttgaggaaaacgtcttctagtttttcaccgagcattctcattatcaaatgaaagaaggtatacatgtgagttgatcgaactgacaagttgtacataacaaagattccttctgtgatcatagatcagcttgcaaacatctaatcagaatttgcgatacgccaaaagttgctaagtaggtgttctgtcagctgggcaacggagactttcgtctatgttttgcctgagttcggcttgttctgttgagatgagcttgcgaattgaattttgccagagttcagcttgttcttttgcgttgagcttgcgaattgtgatgtgtggatcaaggatcttttcaaagctcaagcagttgtgtattcccttagttcctggtaagaaggatcttctgtaattatccaatttgtgtactgaaggttactcccttgctgtttcgaaaacggatactggtcgtgaatacagacattcctttcaaaaatttaaaaaaaaaaaaaaaaaaaaaaaaaaaaaaaaaaaaaaaaaaaaaaaaaaaaaaaaaaaaaaggggcgggccgtt

SEQ ID NO: 2007 - DNA, 632 bp, Sorghum bicolor
  Clone ID: SORBI-28MAY03-CLUS33903_1
ttttccccaataaaatccgagctaaggctatggctctctgcatgtctgtacattggatcgtgaacttctttgttagtttgctgttcttgcgtcttctggagcaacttggtccacagcttctctacacaatattttcgtcagtctgcgtggtagcctcaatatttgtgcggcgccatgtggtagaaacaaagggaaagactttacaagagatagaagtttcactcctgcaaccacaataaaggtatatatttgacgtgactggaatctggggctacactgtttgctgaacacaaacaagatggccctgcagaagctgattcctgaagtcatctcttgtgaacggaaatgccctacaaatggtctcagggaagttccagatatgcgcctgcgactgctagggcgtttccatagatcatcatgtactgaagttatgcctgtatagccccccctagataggatacgtcctacttttgttgtcatctgttctatctatatacgtcttaatatatcagtcaaaaaggtactactgtttgaccgttgatgagctctgttgaaacgaggaactatcatttgtattcccggtccctcagtaacaatactcgaataataccagtaaccctgcacggatacac

SEQ ID NO: 2008 - DNA, 525 bp, Sorghum bicolor
  Clone ID: SORBI-28MAY03-CLUS3391_1
cgtccgatttcgggctggcaaaggacgggcctggagaagacgagacccacgtgtcgacccgagtgatgggcacgcagggctacgccgcaccagagtacatcatgacggggcatctgacgacgaagagcgacgtgtacagcttcggcgtggtgctgctggagctgctgacggggcgcaaggcggtggacaagaaccggccgccgcgagagcagagcctggtggagtggcgcgcccatgcctgcgcgacgctcgccggctggagcgcgtcatggaccggaggctgctgcacccgacgcccactcgagctgcccacaaggccgccggggtagcgcaccagtgcctcagtgtaagccccaaatcacggcctcagatgtccgccgtcgtagaggccctggagtcgctgctcgctctagacgatgccgttgggagccatttgtatacacggcgccggcggcaacagatgaccgcctgacctgacctgtgtggcatctgtattgatgatgctttccgccgtggtgggtattc

SEQ ID NO: 2009 - DNA, 609 bp, Sorghum bicolor
  Clone ID: SORBI-28MAY03-CLUS33911_1
gttctcacaagataagagcttttcctttcagtctgcaaatgagatcggggatgacgtctctccgaccaacattatctcaaagctttcgctgctagtgcttcattttcctcggcttcgcataatctggtcacgcagcttgcatgctacagcagaaatatttatgtcactgaaaacaaaccaggatgaacctgatgagaaaaaggcaacaagagttggcgtgccctctgaggatggaatcgtggaggatgatgtgaggtctgaaaattacaacacaccagccattgagttcttaagaaggcttcctggggtgacggattccaactaccgagcaatcatggatggatgcaatagcttggccgacctggccctgcttccggtggaaaggttgggggagctaatgggcggtcagaaggctgcacggacgctcaaggagtttctggatgccaagtgcccaaccatgctgtagccaacaagtgatgcttcaggagtcaaagggtgctgtttgtattgtgttcgttcgatagggatacttcagttgctgtaacttgtaaacaaaacagatgttgtacactaccaatgccaagcatgttgttttctggaatttaatac

SEQ ID NO: 2010 - DNA, 608 bp, Sorghum bicolor
  Clone ID: SORBI-28MAY03-CLUS33918_1
cttcagagcgtgaacaaattgatttgtcatggcagttgtcactccaaaaggtgtgggaaaacctgcctaatggcaataaaggtctaaatgatgcaaactctggcagaactagctcagtttttgaatctcttccgttggcaattaaatggctaagggaaactgctcaacaaaaccaatcgattcgatttcaggtcttagttgctggctccctgcaccttgttggcgatgtcataagattgctcaagaagtaacttcatttggaatggcacattgttcagactaaaatggctgcgtacggaccactatggcactaacttgagcttatcgatatttgtgagtgggataacacaatataccaacttggttagaagactggaagaaattcaaaggcattttggcttcagttctgatcactctgtaaaattgttgcatttcatcgtttctttaagttccttgctccctgccttttttttggcattatgtgccactacatccttagtccagaagaatgtaaccaaattttagaacgtacaaacagtgaattatattataccaatcatatcatttattttgtactcctctgaaaaatcagtatatataaatcatgt

SEQ ID NO: 2011 - DNA, 628 bp, Sorghum bicolor
  Clone ID: SORBI-28MAY03-CLUS33940_1
tgctaaatgactttgttgagatgttccgggcgaagactagctataggattgttgagcctgctcatatggagctagcggagcctactataaaggatgcatttggaaaatgtgtgcaacaaggagcatcccgagttattgttagtccatatttcctttcccctggacgacactggaagcaagacattcctgctttagcagcagaggcatcaagggagcactcaaatataccctatcttgtcactgcccctcttgggctgcatgagcttatggtggatatcatgaatgatcgcatcaagtactgcctgcgacatgttgcgggtgatatcgatgagtgtacagtatgtgctggaactggaaagtgccgcctgtactcctgatggagaatatctgggaggcacgtcgatactgcagcttggaatctgactacatatggcaatggatttcaatgccaattgtttctctgtattaccatttatcagttagggttcaattttttttctcctgtatacgagatctgacgagtgtatatccaggtccaccgtgtactgtgaaacctaaagttaccattgcatagttcatcttgtattctcagactgtccatattctgagcagatcgtcacaataaaac

SEQ ID NO: 2012 - DNA, 655 bp, Sorghum bicolor
  Clone ID: SORBI-28MAY03-CLUS33760_1
ggccacgaaatcgcatcgactctgggtgactgatccgctctccccatcttcatccgggccaccaacgccgtctcattcggcaacccacctcgtgccagccaacacgggatccaactcgggaacgtctcctcccatgtcgccttcggcttcgcagtcgaatctgccatctaattccaacctacccatcccggtcctaacatcgcatccggtaacatccggtggtggactgccaccctcactggtgccatcgatcccagcatctgcgcttccaggggcacgcctgtcaggacgacttttaggtgtagtcagcttgacggatatcttgaatgttcaagcacgggctagtggacttagccccgccgatccgacagagcatcgtaatcgccgccgacgcagcagcagttcaagcgtaggggtccggcggagtggagagatcgggagagaattgttcagtcgaggttttcaagcataatttctttttttttttctttttcttttttcttttttcctcatcatcattgagcaatttggtcagaaacaaataactctttaccatgtgagtggttacgcgactgaaaatcctggctgatgatgcaacagggtgtacaggttcatccctaaccagagtacagtacgagaggtacatagctagaaa

SEQ ID NO: 2013 - DNA, 557 bp, Sorghum bicolor
  Clone ID: SORBI-28MAY03-CLUS33778_1
gctcaaggagatccaccagattgagctctcctccaggcacctcatggagatcactgacgccgccgagttcccgttgcacgaggacaaggatgtccaggtgcgggaggccgcgcaggacctagtgcacctgtgcgacaccatcaaggaagggctcgacccgctcgagcgcgaggtcaggcagatgttccaccggattgtgcgcacacgcacagaaatccttgattgcttgagtaagccacatggcacccagtgatgagaatacgcagggaaacagggaacccacactgcttgcttgcttgctgtgatgccacttaaggaaacatccttgtgtgaaatgcagcaggcaggggtcaagcccgatttagatgaggtagcttttctctgcataagttagcaactgctacatcatacatgtgtcttcatagaggcttgtccttctgtttgataaattggtttcttctttctttttttttcatttcattttctcgtctttgtagattgtgaatccttccttacttggcagtgcttcgtagtaatggtactaatactatttattc

SEQ ID NO: 2014 - DNA, 645 bp, Sorghum bicolor
  Clone ID: SORBI-28MAY03-CLUS33783_1
ctcaacaaaggggcagtgaaaggttttcatgacgcaagagataagcttttggtgaactttgacccaactacatacttcttgcgagacttgaagtgtgaattctccaagactttcaagttgtggtatggttcaattggaggagacgctgtgggacttacttgggagaacccaaagaagcgtggcagagaggaggctgatgaaactgagccagagcccacatctatccttaaggaggttggagacgttggtaaaggtttagtgaggggtgtgtatcttgtcaaggcaccaaagcttcagtaaaagaacacgggtacaactgaagatctgaccgaacaagccgatgcacaaggaagacttgtatcatttgcacaccaacacaacttccaaatgtggtagtcttccaactggcaagagaagcaaaggttcgagggcgtttagaggctggcaatgggggagcaattgtatgtagtcatggagtcgtaaacaagtgaagattgtgttgtgtttagactactactacacagctgccaaaaaaggaaatcgaggttgtagagtctcgaaattttgacactgcaggatatgtgaaatgaaatgtaattttgcaatattctgctgcaatgaaaatgccaatcaatttgacgtgcc

SEQ ID NO: 2015 - DNA, 763 bp, Sorghum bicolor
  Clone ID: SORBI-28MAY03-CLUS34014_1
gcacgaggcttgaaaacaaagaaaatttgaagtctatgcttaaggatgctcttcgtgggaaatcagatgtcttcaattctgaaaatccagaggaggacaaggtaaagcttggagaaccaggatggagggataggtactatgaagacaagtttggggcaaggacacctgaacggatggaagaaattcgtagggatgttgctctcaaatatactgaaggattgtgttgggtgatgcactactactatgaaggggtctgctcagcgcgggggttttatccttatcattatgctccttttgcttcggatttaaggagtttgagtcagctcaatataacttttgaacttgggttgccattcaagccatttgatcagctaatgggggttttccctgctgcaagtgctcatgcacttcctctaaagtatcggcaactgatgactgatccaaattcaccaatagttgatttttatccaactgattttgaagtagatatgaatgggaaaagattctcttggcaggggatagcaaaactgccctttatagatgaagaccggttgctggctgagattaaaaaagttgagcatactttgacgcctgaagaagcaaggagaaacagtaccatgtgcaatatgctttttgtgaatggctcccattcactttctccttatatctactcgctcaccagtaaatttgggcatctgccagacaaagaccctcggtggaatcaaagaaaacttgatccttcagctagtggaggaatgaatgg

SEQ ID NO: 2016 - DNA, 651 bp, Sorghum bicolor
  Clone ID: SORBI-28MAY03-CLUS34031_1
gtctccttcgctgctcgcctccgcctcctcttttggcccccgcccgcgcctcgtctcatctaccctcacctagggcacgcgcgccgacctcgccgcctcgtcgccgccgccaacctcgcagccgtcgatccccggcgctccgatagccagagttgaatagagggctacttgattgtttggaatctacttttatagttgattccaagcatggaaaatcgaccaaatggttcagtaaataatgctgagcataataatcaggaaaatgagaagtccatggatgctagtgagcctgaagaagcacgagatgtttttgtttacagagaagatgttgtgagtttgaagtccaaggaggatgtccgtggattagttttggaggtagctggggagtatgattctgaaggtagcatcactgatgatgatattgatactgatgaacataaagataataaatctgctcatggagctgaaaatggtggtgctgatggtgataatgctagtaatggagctgaagttgaaagccagagttctttgcctgatgacaaagttcgagtgttatggatagatggtagtgagaagacagaagacattgatgaggtagttgttgttgatagaagtttccttcatggagatttagttgcctctgcctcagac

SEQ ID NO: 2017 - DNA, 481 bp, Sorghum bicolor
  Clone ID: SORBI-28MAY03-CLUS34057_1
gcccggggcccctcgcggcgccccggccccggcacccccccgcccccccgcccctcccgcgtgccgctcgctccccccccgccccctctccccccgcgccggcccggccccgcgcccgccgcgcgcccctgcccccccctccgcctccgggccgcccccctcgcaggccggcgtcgcgctcctcgagcccggcgccgtccccccgcccctccatggggctggggtgcttgtgaggccccctgtaatgggccgcaaggagcaccggggcggccggcctcccctccaccgcgatcgggcgcgagtcacgcccccggtcactgccagcaaaccgccgccgggtggggggccagctctgttccccaatcgggctggtcccgccgtgtacgtcacggcctgcgaaccgacgcctgttgtggatcaatctaagttgacgaatatttcagatccagtcgaatactttatgaccttggaccagcttgaa

SEQ ID NO: 2018 - DNA, 640 bp, Sorghum bicolor
  unsure (1)..(640): unsure at all n locations
  Clone ID: SORBI-28MAY03-CLUS34089_1
gcacgaggcagctttggtgtatggcatgagctaaggggctgtctttccactctgcccctaactcaggtcgttaagcttctaggtcgggtcatttattagtttttctaacgggcataaatgtaattaattgttaagacgagtgtgggtggatgggtgttgtaacactcccttcttctattaatgcaatgctacacagctttccttcctgttcgagaaaaaaaagtagagttctagacaattatcatcatcatcaattttattctagggtgagacagtgagtaggtggcaatatctcatgccttgtgttgaagataaagaataatgtgatattagtatagaagagatgtgtggggctttcctgcagatctattcctcaaaagaaaagaaatatgatatgttgttgcttaagaaggtgtatctttggttggttggacgatacatagtctacaagtgtattcatagatgcagatgtaagagactctgtaagtattggtattcttggtcttatcatttggaagaatgacgtatttttcttcatgacacatttaaatacatgagttttcaaatttatatattctatatcttgacatgatcaaataatttgacagncaagcaaggagataactgcaatgtcagaagt

SEQ ID NO: 2019 - DNA, 913 bp, Sorghum bicolor
  Clone ID: SORBI-28MAY03-CLUS34133_1
ccacgcccgggcggtttcttcgtcccggaaccaccgcgacgcgccgacaccgtataggtcccaatcggaaattcggaggcggagtcccgtcgtggtggtaggattggggggcgcgcggccctagggtttgctacttcggatcgatctctcggatatatcatcagcccctgatgccttgtgaggtcggagcggcagtgccagcggaaggatccacggcgcctcctctatccaatcccatcggcttcggatcaaataaagggaacaaaattgagggccagatgggattataggcgcgggcatagttgtgtagcggtggccccctagggtttccttgctgacaggaggaaaccctagggttcgtgatctaaatgtgtcacgctccagcgacatacaggaataatcagtaaatagcccggccttaggttctactagtgcttgacttttcacctccctggcgtggtggcgctggttggtaatcagcagagaagatgtcggccggcgttgcaactctcgagcccctccaggaccatcttgctgtcgtgccacaatgcctgcttggtggactccagccactggattcgattctcatttttctggccatacctgggatgccaccggtgccgatccgggtcctggattcagagtctgtcgcctctgtcaagctccgaatccagcgtttcaaggggtttgtcattacaaaacagaggctgctgtttggcgggcatgagctttcgcacaacaactcccgtgtgagagactatgggcttgccgatggcaatgttcttcaccttgttgtccggttagctgaactccatgagattgtaattgagactgcccatgggaagaagtttcgattccaggtggagagtgcccacaaagttgggtatctcaagaacatgattgctgctcagac

SEQ ID NO: 2020 - DNA, 522 bp, Sorghum bicolor
  Clone ID: SORBI-28MAY03-CLUS34151_1
cctggactgagaaccaagatgcctccacttagcgtgtcagtggatgaaaatcttgctagcttcgtgcttcctggcattacaatggatcaagttattggaagcaaccatttgaaggaggagccaagaggatggtaggtcactgccaacaggcttcagtttaggaagactttgggactttattattggtagatggatggaacatatggagaagtactgtttgattttgcacaccaagtggcgacaccaattcaccaaggacccctgctttctctatctgaaagcgaaaggagaggtgactgaaaccgttcagctgccctgcaactagccttaaacattggtggctaaagagcgagggtttttaggaactgcagtttttgtggccttgctgcacctgtaaataactactatgattccttttggtttctccttcagacattaggctaaatagatgtagcggaggaagctcacaagaactagctaaatagttctttaggaagaacccgctacatagcaagaaggtac

SEQ ID NO: 2021 - DNA, 639 bp, Sorghum bicolor
  Clone ID: SORBI-28MAY03-CLUS34154_1
cgtcccatctttgacaaagacctggttcaagagctgcaaatcacgcgccatagtcgttgcgctcgagccatggacagagaaatacgtttcgcagcctgtgatcgttgccgccctcgaagcagtaaacacatggtcggaagagcaagcggcagctgagcccgactcggccttcgcggtaaaagttgtcaaccgcgcgcgcgagattactgcatcatatgtggtcgatgaacaaaccatggcgatgcgaatctctctgccacccgcctttcctctcgcaaatgctcacatagaaggcctgaaccgcgttgctgttaacgaacagaaatggcaatcttggttgaggacttcgctaggagctattacgatcttcaacggcagcctaatcgacgcgctgaccacgttcaagaggaacgtcgatggagcgctcaagggccagagcgagtgtgccatctgctacagtatagttgggtcggatcgcaagttgcctgacaagaagtgtcacacttgcaagaatctcttccacggagtctgtctgttcaagtggttcaagagtagcgatagctcgagctgtccgctctgcagaaccagcttcaattatgcatagattagaaggatggacttggcacgatagactccagt

SEQ ID NO: 2022 - DNA, 873 bp, Sorghum bicolor
  Clone ID: SORBI-28MAY03-CLUS33837_1
tgaagttcagagcatgtaatttactagatgtgaagctgaatggatttacacttagtaatgttagcttatatgagaggccaggcggaggcacaactgatcatggagcaatccgatctgagctgcatttgccattttgtgctcaatgtgaacaccatcttctgcccttctatggagtagttcacattgggtactttgaaagtggaagcggagaaggcattgatcggtcgcattttcaggcattggttcatttctatgggtgcaagcttcaggttcaagaaaggatgacaaggcagatagctgaagcagtttattcagtttcacacaatggggccatggtcgttgttgaggccaaccacatttgcatgatctcaagggggatagagaaaataaggagcaacacggcaacaattgcagttttgggccagtttttgaccgacccttctgccaaggcatgcttcttacagaatgttttggatacagctggttctgcgatatgaatggtatcgctaacagagaaaaaattgtgtgtttgggagttactatccagcaatggcaatgtctgccaatctactggcctagcatgattagcactgataatgtccgttgcgctcttctcgggtgcaaaattttcacctggaagactgtaccgaggatgtcagaagaaagcaccaacagggttttggttctctcgtcttgtaccaccatgtcacttgtacggcactccaaaataaaaaagaatagtagtagttacaactgtgccaaaaaggatatagttattcttacgtctagattgttttcgaattgtcatttgttgttgaaattttagtggagatcactccggctattgttgtactgttgaattgatactgcacg

SEQ ID NO: 2023 - DNA, 604 bp, Sorghum bicolor
  Clone ID: SORBI-28MAY03-CLUS33853_1
cgatacctctaccgattcatctacccctacctcaacacctcttcttccgccgaggaggcttccggtgatgtcgagggtcgcttcggttccaccgctgaggagttcctgcctcctaacgctgtagacggttccgctcagccccgtcttccctcttctggtgctcccggtggtaacccccagctctgggacgttctttacaccgtcaccgccaccatcaagaacactggtgacgccacatctgacgagatccctcagctctacgtcggccttggtggtgagggcgagcccgttcgcgtcctccgtggctttgagcgtctcgagaatattgcccctggcgagagcgccaagttcaccgctcagctcacccgccgtgacctgagcaactgggacgtcaactcccagaattgggtgatcactgatcacgccaagaagatctgggtcggcagcagctctcgtaacctgcctctcagcgcgactctgtagaatggagacggattggtggattatgattcttgcagctgaaaggcgaactaccgagatgtaaatggtagcgtagctttgtgccagttacgtcaatggccagcataattagttttcgcgaaag

SEQ ID NO: 2024 - DNA, 658 bp, Sorghum bicolor
  Clone ID: SORBI-28MAY03-CLUS33868_1
tcaaatttcagccaaggaaatgatggaccctgaactgctttcaaagcttatcttgaataacttttgcacagtaccagcaaaggttttgttacagcttacgaccgcattccgtgatggcggtctgcgcaacaggactggtacttttttcttcaaagagcatctgaacaaaatcaaggtccctgtgcttgcccttgctggagatgaggatctgatttgtcccccagaagctgtttacgaaactgtgaagctaattcctcagcatttggttacatacaaggttctcggagaacccgaaggccctcactatgcacattatgacttagttggagggagaaaggctgtccatgaagtatacccatgtataatagagttcctctctcaacatgacgaagcggcttcttgagtttttgtcattcgtatctgtaattacaatgttcaagaccacgtcgaagtacatagtaaaatcgccagagtggaactaggccatagcaggagaagcactgcggggacgaaccttgctggttgctggcacctcggtgaaaccttaagagccaatgtatgtatgtagttgaattcgaggttgcaaacgtagttcgaactactcttgaaggactcgtgtgagtggcgtggtcatatgcatgttcagcgagtggaccag

SEQ ID NO: 2025 - DNA, 466 bp, Sorghum bicolor
  unsure (1)..(466): unsure at all n locations
  Clone ID: SORBI-28MAY03-CLUS3387_1
cgtccgcactactcgaacccgcagctattggacagtcgctgcccatggctgcggcgccggggaccggccccggttgcctggggtcgccggcgcagtctgcctcgagctcactcgccggggttgaaggcgccccgcggcggctgggcgtatcgaagccgtcgtggatcgtccgcactgagtcaaacgttaggagggagagaccaaaacgacccgatcctccttgcaccatctgcagaggcacagggagaatagactgccgaaactgctttggccgaggtagaacaaaccgcgccgatctggtcatgcttccaaagggcgaatggccacaatggtgtcgaatttgcggtggtagaggtctggattactgcctncggtgccatggaacgggtgaatatcgagaacccatgggcttccacttcacttgccagagaaaacgaggttccgcctgtatgctacgatgtgaaaa

SEQ ID NO: 2026 - DNA, 721 bp, Sorghum bicolor
  Clone ID: SORBI-28MAY03-CLUS34261_1
aggtgcaacctgtcatacacaatccacatgcattgccacttttccgagatcaaccaagtcgcaaacgccaaagagagaagatactgaaagacccgctcaaatcacacaagccagaagcacctgttaatggtccaggatatggtggaagagtgggtactacaaaaggcagtttgctgacacagtacctcttgaaggaaggtggtttaattaaggagacctggatggatgaagatccaagagaagcgattttgaagtatgctgatgctgcagagaaagacccaaagtttattgcgccagcttattctcaaacccagccgaaacctgtttttgcagagtctgattcagacaatgaagagaaataaccatgtgcctggttacctaagcaagcatgcacctgcattctattttctgacagctgtctcttgctgagcttattgcacaaacccagtaacctactttttaacagtggagaaacaaaagagcatattttagggtcttgaaggcaaaataggtaccacaagtcttttcagtaacgtctaatttttggaatggatgataggagctctgccccttaattacagatggataggattaagtaattacaacacttgagcactaaagcctctatgatttgtttgatgttgtacccactgtatgtacttgggtgtaaaagagtggcaaatttatttacatgccttaaacataactgtagtgctgaatg

SEQ ID NO: 2027 - DNA, 669 bp, Sorghum bicolor
  Clone ID: SORBI-28MAY03-CLUS34292_1
ggcctgggaatgcttgagaggatccctcaggcacagcacttggagggcaatgtcgcagcaaggattgggtggctgttgctcttcaccggtaaggtcactgaagctgtcccgtacttggaggatgcagtggagaggatgaaggacagctttggtcccaagcattacggagtagggtatgtatatcccaacttgggtgctgcttacatggagatggaccgaccacagtccgctgctcagatgtttgcgcttgctaaagaagtcatggatgtctccttaggacctcaccattcagataccatcgaggcttgtcagagccttgctaaggcctacgatgctatgggaagttatcccctggctatggagttccaaaagagagtggtggattcatggcgaaatcatggtgccgatgctagggatgagctcaaggaagctatgcgactctacaaccagatcaaggcaaaggcgctcgcatgcctatctcctgaaggttcagcaaacgcattgcctgaacctcaggagcaggaaacagattcagatactgctaaagctgtgcaacgatagactctgcaaatatttggttgaaggatgttttcttgttagttgttacatgtagtattacagatattttggatagccgaaatcaatggctggtgaactgccagctccccg

SEQ ID NO: 2028 - DNA, 709 bp, Sorghum bicolor
  Clone ID: SORBI-28MAY03-CLUS34300_1
gcagttggttccaattgatcatggatactgcttcccagagaagtttgaagattgtacatttgagtggctctactggcctcaagctcgtgagcccttcagcactgaaacgctagcatacatcaagtcgctagctggtgtcgaagacattgcgctcctcaagttccatgggtgggagctgtctcctcagtgcgctcgagttcttcaggttagcaccatgctcctgaagaagggtgccgagaggggcctcactgcgtacgacattggtaacctcatgtgcagggaggtggtcacgagaaaatctgaaatcgagtctctgatggaggaagcagaggactattttcttccagggacgagtgaggaaacgttcttggagactctatccgagatcatggacggttaccttgacaaggtactgccaggtcagttacggtaatggatgtaattctaaggtttcatccagttgtaaacacttttagcagtaggcactccaaataatgaatattttgtgaatatatgacaacgaagatcccagcccagctaaatctcagctgtattttgtgtatattccttgagagatgtgcaggtagttccggtgtgtatgtttcgtttctgttcgcagttgattgtcaacgatttataatttgtaaagtttcaagttgaggtgggatgagaccttttaaactgtcgaacacgcattggttgatctcga

SEQ ID NO: 2029 - DNA, 671 bp, Sorghum bicolor
  Clone ID: SORBI-28MAY03-CLUS34302_1
atagtggcgcagaagctcctccattttgtcgatgcatttcatcagtatgtcatggaccgagtttatcatagtgcatggactgagctttgtgatggcatggcgtctgctactacactggatgaagtcatggaagttcatgaggcatatctctcttctatccaacgacaatgctttgtggcctctgataagttgtgggctctcattgccagtcgagttaagactattcttggattggcattggactttcacaatgttgaacaaactctcagtactggtgggatagcttcagctgtgagggcacgatgcgagatggaaatcgacaggattgagaagcaatttgatgagtgtgtcgtatttctcctgaggatcctatctttcaagctcaatgtgggccattttccccatcttgccgatctagtcacaagaatcaactacaatcactatttcatgtccgataatgggagcttctctgctattcctagttcccggccacggtagcagactagtagttgagcagcagcggacagaattgttggtgttactcaccgattatgaagaacgtatacactagtgtgtgtgttttctcccttttttgagaagagccagagctgtggtttgtttaccttcctttgaaatacctaacatgctgtacagaagatttgaatgcgagt

SEQ ID NO: 2030 - DNA, 574 bp, Sorghum bicolor
  unsure (1)..(574): unsure at all n locations
  Clone ID: SORBI-28MAY03-CLUS34332_1
gcngcnggaattcggcacgaggctgaggcagggccatgagggggactctggggcactggaactggaagtgcagggccaccaccatgacgagcttgacttgtcggagagccacgagctgacgcttgccgagacgncaccacctggggtgttgatganngaatctcgatcagctctcgctcgagcaggctcatgagctcgcactgcagccacatgatctctcccagggtcctcttgctgtcgctcctgttgtccagtcacggaccatggttggtgagccctgagttccagctccaagtggggcaggagtttcccgacgttatgagctgccgcagggccatccgcaacaccgccatcgcctgccactttgagatacagacggtgaagtctgacaagtcccggttcactgctaaatgtgctgccgaggcctgcccatggcgcatacatgcagcaaagctccccggtgtgcccaccttctcccttcagaaccattcatgacaaccacagctgtgtcgggatcaaccatcttggccatcagcaggcatctgttcagtgggttgcaaacactgtcgaagag

SEQ ID NO: 2031 - DNA, 648 bp, Sorghum bicolor
  Clone ID: SORBI-28MAY03-CLUS34336_1
gcacgaggccgcggttaacctcgccaatccggtcccgccgcggtataaatccggccttctcgccccgcacccttcgtcgcaccccgctccgaccaccacccgggcggtagcggcgcgccccggcatgggctagggttcccgcggcgatggagtgggacagcgattccgacggcggcggtgacgacgaggaggaagaagaggtccgccccgggggcgggggcggggacgcgggcccggggttctcgctggccatcgagggcgtgctgggcgcgtgcggcatggtggtctccgacgcgctcgagcccgacttccccatcatctacgtcaaccgcgggttcgaggaggctaccggataccgcgccgaggaggtgctcgggaggaactgccggtttctacaatgcagaggaccatttgctcagaggagacatccccttgttgatgcagcagttgttactgggattcggagatgtttagaggaagggactgagtttcacggtgacctgttgaattttagaaaagatggttctccatacatggcaaggctgcaattaacacccatatacggagatgatgaaatgataacacactatatgggtatccagtttttcaatgattctaatgttgacttgggtccttcacctggctctg

SEQ ID NO: 2032 - DNA, 548 bp, Sorghum bicolor
  Clone ID: SORBI-28MAY03-CLUS34340_1
gcacgaggcttcgccccggccataccactagtgcaaggtcctagatttacacttggtgctacagcttcttcctccctccctcccctctctaggcagctagcacgcagcgcagcacacgaaacatctattgaccggccgcctccgccggggatccataattactatactaccaatcggccagcgtcatgccgacgccgtcgcacctcgcgaacccgcgctacttcgacttccgtgcggcgcggcgggtgccggagacgcacgcctggccggggctgcacgaccaccccgtcgtggacggcggcgcgccggggccagacgccgtccccgtggtggacctcgcgggggcggcggacgagccgagagccgcggtggtggcccaagtggcgcgcgccgccgagcaatggggcgcgttcctgctcacggggcacggcgtccccgcggagctgctggcgcgcgtcgaggaccggatcgccaccatgttcgcgctgccagcggacgacaagatgcgcgccgtgcgcgggcctggcgacgcctgcggctacggctcc

SEQ ID NO: 2033 - DNA, 657 bp, Sorghum bicolor
  Clone ID: SORBI-28MAY03-CLUS33944_1
ctttgccactccatttttcgctcgttttctcattccttttctgtctctctccatgctaaactacagaaaggaataatcctgttgccccaaggaaggagatgagatatagctgaagcagcacaagcgcaatgctgcctcgagttcgttaagtcgcttatctttttatcctcatgcaaagcaaataatcattgcattttgctctcccatgctgccctggggcagcctttgtacagcgattcctagtgctaatagaagttgctcacttgctgtggcctctggggtagttgggtggtctgaatatctgctatccctgaatgttctaactgattctattggttgtgcactaggactgaagatatgtgctctaggagaaagaaaagacagtttcgatgcaaaattagaatagcttacaggatatatagatatagagttactatgcagttctcgaacagaacttctcaggagacatctgactggaagtgatgcgttcaaaattttttttctttgggcagtgtcatttgccaagcagacatgaatagtttggacactgcgaagcatttgtcagggccatctcgaagtggcaatttcaccgatttcatcacctcaagtgaaatttgtcagggccgctttaagtaaactttggcaagcttggtcaga

SEQ ID NO: 2034 - DNA, 587 bp, Sorghum bicolor
  Clone ID: SORBI-28MAY03-CLUS33956_1
cggcaccaccatgtaccccggcctggctgaccgcatgcagaaggagctggtcgccctggctccccccagcatgaaggtcaaggtcatcgccccccccgagcgcaagtactccgtctggatcggcggctccatcctcgcctcgctctccaccttccagcagatgtggatctccaagcaggagtacgacgagtctggcccctccatcgtccaccgcaagtgcttctaagcgccccccccgctcgctccctgggccgtggcgccgtcggcggctccagctcgcgtcttcctcctgtgctgggggtgcacgtcgctggctgtgcggttcactggtccctggctcgccgccatatcgagcgcccctcccgttcgcccgccgtcgtgtctcccgcgaacgtcgttctcttctggtgctcttcctcgggcgggccgcccccgcggctctcgctttggcggggtggcttccaattgctgctgcctgcctgggagtggaatctccttctttttctttcccttcctttgctacgaggctctttgctccgctttgaaatgaatgcacgtttgtagcgagattgaaaccaaaagaaata

SEQ ID NO: 2035 - DNA, 194 bp, Sorghum bicolor
  Clone ID: SORBI-28MAY03-CLUS34002_1
gcaccacgaggcactctgccgctctccaatccggtcgcggcgaagctcggccacccaacccgatgccgtcggggtcgggctcccggggcaggcggccgcggccgcgggcggccgcagaggtggctgctccccgcgttgtacaggtgagctcgtccggctcgggtgaggaagggagcgatgaggaggaggaagaa

SEQ ID NO: 2036 - DNA, 576 bp, Sorghum bicolor
  Clone ID: SORBI-28MAY03-CLUS34394_1
gcacgagggaggtgccctgctggattggatccaatattgggagaaacccttccttttggtgttgcatatcatcatgctggtcttacggttgaggagagggagattgtggaatcatgctaccgtaaaggccttgtccgtgttctgactgccacttcaactttagctgctggtgttaacttgcctgctagacgggttatattcaggcagcctaagataggtcgtgattttattgatgggactcgctatagacagatggctggccgtgctggtcgaactggaatagacacaaaaggagaaagtatacttgtatgcaggcttgaagaggtcaagagaattacaggtattattagaagcaattgccctcccttggagtcctgcctctcagaagataaaaatggaatgactcatgcaattatggaggttgttgctggtgggattgtgcaaactgcaaatgatattcatcgatatgtgcggtgtaccctgcttaactccacgagaccttttgatgatgtcgtgaagtcagctcaagactcccttcgttggttatgccataaaaggtttcttgattggaaccat

SEQ ID NO: 2037 - DNA, 722 bp, Sorghum bicolor
  Clone ID: SORBI-28MAY03-CLUS34403_1
ccgccattaataccaaccgccaccacctcgcctcgccaaccaagaacgcaatccaatcccgcgacgacaagatcaaaccctctcattgatcggtcaattcgtcatcggcttggacatgtccggaggagacatggcggcgcaggcgggcggagacgcgcagcagcagcagcagcaggccgtcggcgggaaccggattcaggtgtccagctccaagaagccgctattcttctacgtcaatctcgctaagaagtacatgcagcagcacggcgacgtcgagctttccgcgctcgggctggccatatcaacggttgtaaccattgcagagatactgaagaacaatggtcttgctgtcgagaagaagattagaacatccacggttgaaatcattgacgaaacgaaagcccgaccaatccaaaaggctaagattgagatagtgctgggaaagactgataagtttgaggaattgatggcggccaatgttggagatgcaaacgcaggagatggcgaggaacaaacctagaaagtttagggacttgttatggctattccttttctaccttttcctctcctctgtcagctctggttaaattgggtgatgctgatgcatacagatggaatatgtttaggtgttttctgttcacttgttgagtgcggcgttcttagaacatacatttgatttatcccatttgttaactgagtagtgtctaatgtgcaatgttttt

SEQ ID NO: 2038 - DNA, 576 bp, Sorghum bicolor
  unsure (1)..(576): unsure at all n locations
  Clone ID: SORBI-28MAY03-CLUS34427_1
gcacgaggaactggcacggggggctgccgaagccgccgccgccattagtggtgatcggcgaggtttaattacttttgcggtccctcgctagggttccattccatcccatccaccccggccggccgcctgtgtgtcgttccttttcgtccatggatcagagctttgggaatctcggggccggagctggtggtgggagcagcagcgggggctccaactccaaggcggcggtgtcgtcgtcctcgttcctgcagctgccgctgtcgacggcgtcccccgcgtactacggcgcgccgctcgcgctcctgcaccaccacgccgccgccgtcgccgcgggcggccccggcccgtcgtcgtcgcagcagcagcagtcgccgtacgccaccaagcacgccagcaccgccgagatgtcgtcggcggaggccgaggccatcaaggccaagatcgtcgcgcacccgcagtactcggcgctcctcgccgcctacctcgactgccagagagtgggcgcgccgccggacgttctggagaggctgacggccatggcggcgaagctggacgcgcgcccgccgggccgncacg

SEQ ID NO: 2039 - DNA, 650 bp, Sorghum bicolor
  Clone ID: SORBI-28MAY03-CLUS34433_1
atccactccacactcgtcctccgcctggctccttttttatctttggccagcacacgtcgcaaggttctgagcggagcgcagaatcatggctgacgctagtcgtagtcgtgctcgcgttggcggcggcgggcgacgttccgtgctcgccctgcttcttctgctttccgtcggcgcccgagcgtccggcgacggcgaggcaggggcaggggagaaggttgcggcggcgtggaccggcgggctgagccggcggagctttcccaaggggttcgtgttcgggacggcggcgtcggcctaccaggtagagggcatggcgcacaaggacggccgcgggccaagcatatgggacgccttcatcagcatccccggcgagatagcaaacaacgccaccgcggacgtcactgtcgacgagtaccatcgctacaaggaggacgtgaatatcatgaaaaggatggggtttgatgcgtaccgattttcaatatcttggtcaagaatattcccaaatggaactggaaaagtgaattggaaaggagtggcatactataacaggttgataaactacatgttgaagataggcattacaccttatgcaaatctgtatcactatgatttaccagaggcactagaggtccaatatggagggctgttgaaca

SEQ ID NO: 2040 - DNA, 931 bp, Sorghum bicolor
  Clone ID: SORBI-28MAY03-CLUS34448_1
gcacgaggctcctccccgctcgcaccgccgcagcgcgctcccgcaggccgcgtcaccggcggcccggcccttgctgcccgcctgcccctacggccctaccacgccgcgctcgccaccggagagggccaatagaataaagaaagcgaagccaatgcaggtcgccgtcaacaccagcactgtcggcgctcaccagcacccaacaaagtcctccttcctccggccatcccctccttgccgcgtctacttccacgcttctccacgtccgaagaacctgagggcgattgccatggccaccaagtcgcagcttcaggagcaactggtcatcactcggcccgacgattggcatctccatcttcgtgaaggcggtgtcctcgaggctgtgctcccgcgcagcgcgaggcattttgggagggccatcatcatgcccaacttgaagcccccggtgaccacaacggcgcgggcggtggaatacagggaggagataatgagggcgctgccgccagggagtagcttcgagccgctcatgacactgtacctgacagacaacacaagtccagaggagatcaagctcgcaagaaagagtggtataatctttgctgtgaagctatatcctgctggagcaactaccaattcccaagatggcgtcactgatatatttgggaagtgcttgccagtcctcgaggagatggtcaggcaggaaatgccattgcttgttcatggagaagtcacagatccacatgttgacacctttgaccgtgagaaggttttcattgacaaaatattggcaccacttgtacaaaaacttccacagctgaaaattgtcatggaacatatcacaaccatggatgcagtgaacttcatagaatcatgtgaagaaggtcatgttgctgcaacagtgactccccagcatctcctcctcaataggaatgct

SEQ ID NO: 2041 - DNA, 538 bp, Sorghum bicolor
  Clone ID: SORBI-28MAY03-CLUS34474_1
gcacgaggcctgtcctccacatgtacggagagcgcgagggaggcgactagggttcggacaccggcagcggctcaccggccgacgatcccctcccgtccgccgacgccgccgccccgggcacgctcgctccctttttccgcgaggtggggtgggttgcagcggcgagcacaccccctcccctcccctcccgtacgtgctcccgccgcagcggtagcgtcaagggcggcccgactgtgcgaggattcgcagcgcgagtgagtgagccaacacttatcggcgcaagaatggatgggaatgctgagccaatccaattctcatggggcaagcgtcgaggagctggtggttctaagatggatacagttttctatgggtccttcacattggacaatgtgaagtattcattgtatgactgtgtctatctatttaagcatggtgatcctgtaccatacattgggaaaatagtgaagatttgggagcaaaatagtgctaaaagagtaaaagttctttggtttttcctccctgatgagattcggaacta

SEQ ID NO: 2042 - DNA, 659 bp, Sorghum bicolor
  Clone ID: SORBI-28MAY03-CLUS34481_1
agctagcagcgtcagccgtcgcgcgtgggacagggggtactaggcctccgtcgtcgctgcaactgcaaccgaaatcctccgccgccgccgccgccgcgtcgatcgatcggaatcaggatccccggccatccatcgattttattattaatggagcccgccgccgccgccgccgccgccactgccatctaccctctgcatcgctgcaaaaccatacacctggttcggcatgcgcagggtgtccacaacgtggaaggcgagacggatcacaccgcctacatgaaaccagacttcttcgacgctcgcgtcactcccttgggatggaaccaagttgaccgtctacgagagcatgtgaagaaatctggacttatggagaagattgagctcgttatttcttctcctttattgaggactatgcagactgcagtgggagtttttggtggtgaaagctacagtaatggtgtcagtgtgcctccactgatggtgaagaatgctgcagacagtggacgcccggcagtttcaagtctgaactgccctccatttcttgctgttgaggcctgcagggagcgcttgggcgtacatccttgtgacaagaggaggagcataacagagtaccgtactctcttccctgccattgatttttcgctgatagagagtgatga

SEQ ID NO: 2043 - DNA, 722 bp, Sorghum bicolor
  Clone ID: SORBI-28MAY03-CLUS34163_1
gcacctctccatcaagtgatctcctggtagcttcatatcgcccgaaagttgagctgccagatgatagtgccactcaagcggctacacaacaatcaccggtactcactggttcaggaaagctaggataccacacactcctcaggaggaccaccaccacatcctttgccaaggaccatatctgcagtggtgtcgtaagtgagttgcgaatgtcaaagtctgcaatcattccctgcggaggcaatcagcatctgtttgcctatggggatgagtcgctgtatggagtccggacttggcagctgccttcgtttcagaggtaccccgatctcatgccccacaggcaaccagtccttgatctaaggtttgctgaaagttccactgggagataccttggttgcttaagcgccgaaaagctacaggttttcacagttaggtagcttaactaagacaatcattgacttcattctttagctttgtttctggtagctgtgcgtgctaacagttggttcctcactagctttgctgtacaagtacagaccactcttgctccgtacagtttttttttttactaaagacagcgtgtaaaccatgctacacatttcagataacctgtcgtaagaggctccaatttacaatacaccggcaagtgaaggattgcatgtgctgttagagttgtactgatgcctcaccgcattgtgtcataatccaaggaaacaaagggtagc

SEQ ID NO: 2044 - DNA, 730 bp, Sorghum bicolor
  Clone ID: SORBI-28MAY03-CLUS34215_1
ggaaaaggccattgggcccaattcggcccaagcccgagcggcgatgcgggcagaggcccataacgtggcctgagcagcggctggaccgtgggttcatttctgaagaatcggagggtttttttgcaaaaatatatgagagagggaagtggactgcgggttgattcgtataaagttggagggcttttttgcaaaacgaccaaggagagcacgatctcgcccgttcatgagcccgatccgacggccgagaaaggtgcctatcttattctggtcgtctttctattttttgcattatttggcttaacaactattttatcgaacggaaagctaaaaggcacaagactcacatggattcagtcttcagccaaaacctagagctcagacgtctacttcaacaaagaaaacaaaatagggtgcaccaccatcttaaacttgggtcatcttctttacagaatgacaagcagcacctactcatgaactaatgtttgtagaatattgcctctgttattttctcaagtagaattgatagaattagccatcaacccgcttcatactaaacttgcataacaactttatcacacacttgacgatgttttctttgcctattaaactctcccgtcttaatgcagtggcacctcctatcgttgtttatagtgtatcaaaactttgttgcaaactttgttgttctatatatatctatcaacttccaataccttctatccacttatctact

SEQ ID NO: 2045 - DNA, 667 bp, Sorghum bicolor
  Clone ID: SORBI-28MAY03-CLUS34257_1
gcttcaatattttcatcaactaactttactccgccatctgagggaaggaacagttcactacgagatgatgaaaatgtcgagctggacatagatgatatcgacattgatgacaacccacagaagccaaaaggaccacatttccctggtctaagcaaagagaaaatcagcaagggactccatacccttagaggaaagttgaagcccaagactgaagaaaagataagctcaggaaacaagaaaactgaagatgaaacatcagtgagtcaagtcgatcagataaagatgaagtatggatatgcaaatgcaacaaatgatgactcaaccagtgttccaaaaatgattggaaacaagctgcaggagaatatgaaaaagttggagggcattaaccttcgggctgctgatatggccaacggcgcccagtcattctctgcaatggcaaaagagcttctccggacaacaaagaacgagaaggggacctcataatacctacaccaatttcccccctcctgttgtgaagttcttcatttaccatttctcgtaccccctattgtcgatctggtgatctggatctgccgttgtcaaactctcttccactacatacaactatacatgcaggttacttgtaaatagtgaatcgagtgtaggtgcaactatgaggtctatacat

SEQ ID NO: 2046 - DNA, 749 bp, Sorghum bicolor
  Clone ID: SORBI-28MAY03-CLUS34522_1
gcacgagggagaaggagtggaaggaggtggacacggatgtgagcacgtacgagcagaagcacatgtgcgattggccggccaacagcagcgtcgcctggagggatccgggattcgtcttcgatggcctcatgaaaggattggagcccggaaggaagtatttttacaaggttggtagtgacgcacgaggatggagtgagatatacagctttatttcacgtgacagtgaagccagtgagaccaacgcatttctgtttggtgacatgggaacttatgtgccttataacacctacattcgcacacaagatgagagcttgtccactgtaaagtggatcctccgtgatattgaagcccttggggataaacccgcctttatttcacacattggggacatcagctatgctagaggttattcttgggtatgggatcatttcttcagccagattgagcctattgctgccagtaccccataccatgtctgtataggaaatcatgagtatgattggccatcacaaccttggaaaccatggtgggctacatatggaaaggatggtgggggcgaatgtgggataccgtatagcgtcaagttcagaatgcctggcaattctatcctgcctactggtaatggtggcccagacaccaggaatctttattactcctttgattcaggtgtggtgcatttcgtctacatgtcaaccgaaacaaattttgttcagggcagtgatcagtacaacttcttgaaagcggacctt

SEQ ID NO: 2047 - DNA, 712 bp, Sorghum bicolor
  unsure (1)..(712): unsure at all n locations
  Clone ID: SORBI-28MAY03-CLUS34607_1
acagagatccaagagagatattttagactctcttcttggctaacgtttctaaaacacgacatacggacacctccgataggagaaaacctcatcacagaagttgatagatatgtttacgggtatatccaatatagtcttccaagtactctagagcagacaatgaagagggatctagaagttcagacgtggatgaacattagatcgaaaactgaagggattgttatggagatctgggagtttgtattggatgagttgatagatgagactgtctttgatttgtggatgtgaagttctgattatatctcgtccatggtgctttgtgagtgagtatagtgagtaggatacatgagttttcgtgctgacaataaccaattctatgcggcagaataacatgatgggctactactactagtcaagtgtgtaactacagtggaaatggttctcgtggattgagaacaaaagtttaggtcagcaaaatctccagagttgtgcagtttgtacggatgaagttgggcacggtctgtcaccagaactcacagccatgcctctgagcagcgaagtgtacagcagtctgaagcgcattgcaattttcctcttgcccattgagatttgagagtttgtgtgcatacgtgtgatgcgtcccattttcagcgggatcggatcacgcttattgtatatggtttgtttttntgtgtgtaaatgtgcaagaaaa

SEQ ID NO: 2048 - DNA, 552 bp, Sorghum bicolor
  Clone ID: SORBI-28MAY03-CLUS34627_1
tagcatatctggcttgcagaacatgaccattgtccatttagcgggtataacgcctaatggcttgacagctactcttatggtttgtggttgtttgacgaaagtgaagcttcatgaagcattcaaatccatgatgccgcctcatatgataaaaaatgttgaggcacgcgggtgtgttttccagtggatcgataaaccattcaaggttgaagtggaaccttgtgatgtatgcaagcaacagtcccaagatgtgcttgtacggtgattagacctagcaattggggaaggcagggcatgcatcttgtggatggatgggtttgttgattggcatccagaagtaatgtctgaaggagctcaaaatcttgatgctgtatactagatgagtagattcagtcccagtcccagttccagttccagtcccaatcccacctttgtttggtgaggtgaacttgcctggggaggagtacattatatttctgtgaagttgctgctgtatagaatattatcatgtaagatgaaggaaagttattgacatggaagagatggttttggttg

SEQ ID NO: 2049 - DNA, 699 bp, Sorghum bicolor
  Clone ID: SORBI-28MAY03-CLUS34669_1
gcactgaagcagagcttgttacagagcacatatggtcgcttcccaaatacagcagcagaaaacagggggacataaaggagagattgaagaatgcatactctgctctccacaaggacttcaggagcattttcgaaagctttgttacagatcaaactgagatctctgatgatgagaaaattcggttttatgagatgaaggcctctgcatggtaccaggtaacctaccaccccaaatgggtccaaaagtcaagggaaatgctcaaacctgactttgaggacatgccagcaaggcttagctttgcatggatcggggtcgagcacctggcacggattaagataaggtgccatggagaagtgaaagtggacagccgaaggcccgttgagaggctcgcagcctacatatctgggagcatgtgagctggcgtgaagctccatgcaatagtgaagcaagaccactctgcccctttctgccatgccatctgaactctgaagcatggctccgcctagtcacttcgtttttttgttttgttttttttacgaaattacatagttgggacacagacactctatatgcacgtacaccgtatacttatctctatgaaccaacattaatgcatttaccagagtcgaacttgtccaaactctattactaccagaatgtttgtggatataaagtattagttcagggtgtctgaattcc

SEQ ID NO: 2050 - DNA, 705 bp, Sorghum bicolor
  Clone ID: SORBI-28MAY03-CLUS34688_1
cgcacagaagagatagaaacattggttagaaatgcagcaacatttattgagaacagacaacaagaagacggttcatggttaggtacttggggtgtatgtttcacctacggggccttcttttcaattaaaggtttagttgcttctggaagaacatataagaatagcctttccatacggaaagcatgccactttatattgtcgaagcaactcagtactggtggatggggagaaagccatgtctctaatgaaactcaggtttatgtaaatatcaaaggtgactgtgctcacgccgtgaatactgcttgggcaatgctcgctttaatttatgctggacagtttgaaagagatccaacaccattacatcgcgctgcaaaagaattgatcaatatgcagttggagacaggagagtttccacaacaagtgcgcgccggtcgcttcttctgcgcccgtgtctccttttacccacacgtccgcttcttcttcccctcctgcgctctcggggagtttcatcgtgccctgtgggcgaacatgggaaatccgtccatatggcttgacacatgcttttgcgttgtgtgaaatagtgcggctcccatctccggggggaccagaatttggttgtgctgtcaggtggtggtgtctcggttttcggtctgcagggttgttggagtgtaaatctagcatgatgttgtatattgtaatatacct

SEQ ID NO: 2051 - DNA, 673 bp, Sorghum bicolor
  Clone ID: SORBI-28MAY03-CLUS34715_1
gcaatagaaaatcctcatattaaagaaataattgacgatgctgcggacagacctgaagagtggaaggaaacagtgggcgatgaaagcagggaatttgggaggtacatgcgacagagagaggagcaagagaagcaggaagaggagttgttcactcgggctcctgtaaccaaacgtgataagcagatcgagaagcgcataaggagacaacttcatgggctaggaggcttaacggatggtttcgaccttggaatgaacatgctaattggcggagacaaggaagatgatggcggttcaagcaaatcgcatggcaagagtggacatcgaaagaagcacctgaagagcagtaagaggaagaggcattagccttgacccacactgatgtagcacttcaacatgccatcaagcctagaagatggttcaagcaaaagccaattgaaagttgaagctggagaaaataccaggagactaagtagaaaaggcttttggttcctcaaaatggaagattattatttctgaaacagaacttgatctgagtgactgagcctgagctattggaacagtatgaatttatatgtcttgaaagtggtaggtgtagcaaattttgttcatcgtagtctcgtagagtatcccagatgatcgacttattgttgcaaattgtttcccacagtctgct

SEQ ID NO: 2052 - DNA, 456 bp, Sorghum bicolor
  Clone ID: SORBI-28MAY03-CLUS3473_1
cgtggcacgacgcgtccgcagccctcacagcgacgaaggccactgatcttttgtagtttgtccaacctccaaagcaaggccagcagccactacccactagaaccaacggcatgtcgtcgtcgtgctccactgccatcgacggcggcgccgcgaacccgccggcggccctggacctggcaccggacacggacgccccggcgggcgatggcctggaactggcgcagttcgcggcgggttgcttctggagcgtggagctgacgtaccagcgcctccccggcgtggcgcgcacggaggtcgggtacacgcagggccaccaccaggcccccacgtacgagctcgtctgcggccacggcaccgggcacgccgaggcggtgcgcctgcactacgaccccaaggcctgcccctacaccacgctcctcgacgtcttctgggcaaagatcaaccccaccacgctca

SEQ ID NO: 2053 - DNA, 1031 bp, Sorghum bicolor
  Clone ID: SORBI-28MAY03-CLUS34343_1
gcacgaggcaacgccgtccttgtcttcaacaacgccggccagccgcgcctgaccaagttctacacacagctggaaaccagcgtccagcagcgactcatttccgagatcttcaccctcgtcgccaaccgtccaaactcagcatgtaacttcttgcccctcccaccgctcctcgccagcagctccaaatctagcacgcccacgactcctcacaacgatacaccgtcactcgtcacctaccgccactatgcgaccctctactttatcgtaatttccacgtctaccgaatcgcctctcgcgctcctcgatcttatccaggtctttgttcaggcgctcgacggcctcttcgaaaacgtatgcgagctagatctgattttcaacttcgagacactacatgcgacactgggtgagatgatagtaggcggcgtggtggtggagacgcagttagacaaggtcattcaaggcgtcaaggcacagggaagagtagccaagaggcccgtcaacgaagggaagaacattggtggaggaggaggcggtggtggtgtcatgggcggactgacattcggcggtctgggaagaggagacggtatgtgggctgggagatgatgaagaagttgcacgaggtttgcgatgccagaactttcaccgtcaaaaccattggaccccccagcatcacccggcagcccacatcactacgcttccatcataccaagaagcgacaagcaacggccgaactagaacttgttcctcgaacagggcttggttctggatctggcccatggaacgctgtcagactcctcggccctactccagacgcgctcatgccatccacaccgactcggtagacattgatataattcttccaggcattacgaggcgtctacagatgcatggcgcatgcttacacaatctgtggggttacttcaggaaattcccccggaccgggtaaacacatggtaaaggtcaagggtcgggagatgttcgaaacgtcgcgcgtggagcctttgccgagctgggattaatggaaacaagct

SEQ ID NO: 2054 - DNA, 513 bp, Sorghum bicolor
  Clone ID: SORBI-28MAY03-CLUS34346_1
gccgtttcgcaaaccgacgcggacgtggtgtcgcaacggacaaccaaatccggaccggcgatggcgatggcgccccagcggcagcgcacgccgctgcgggaacgccagtcgccacccggccgaaatccaagcgccgttcgcccgctccccgccacaagctcctccttccctagtcccctgctccctccacactccagaggcagcacgtgctgtagcaccgctaggccgcagccgcaccaccatggcgggcgcgccgccgctgaggtcggacgtcgatttcgccgacgtattcggtggcccgccacgccgctcgtcggggaacgagcaccgctcgtcgtccgggtccgcgacgagggcacggagcgggggatcggacacgcccgtgttcggggaccgggggagctccgaccgaaggaggcatcccggggaggagttctacaaggacatattctcagggagcgaggcagcgtcgcccaggcggggcggcgccggggattggggggatgtgtttgg

SEQ ID NO: 2055 - DNA, 1017 bp, Sorghum bicolor
  Clone ID: SORBI-28MAY03-CLUS34384_1
gcacgagggatgaacataatcatctagttgctcttcagctgacagtggacctcaaacctagtatcccaagtgaagcagcacgaatcaggcaacgaaggggcagagtattttctcttccagatgaaccagacgttgctcgtgtgtggcttccaactttcaactcgccagggttggccatggcaagatcatttggagacttctgtctgaagaattatggaataatttctatgcctgatgtttcctaccaccgcatcacagataaggatgaattcgttgtgttggcaactgatggggtgtgggatgtgctttccaatgccgaagttgttagcatcatcagcagtgctccttcacaggcctcagcagctcggtttcttgttgaatcagctcaacgggcatggagaacacggtacccaacatcaaaaactgatgactgtgctgttgtctgcctcttcctgaatacagaagcagcaagtgcatcctccagttctgtaaccaaagtttggtgaagaacagagaagtgagcagcggtaagcactcattggctgttaaatcaagcaccggggttcctgcaaatcttgttactgccaaatatgagtggtcttttcttgatggttcctctgggtgtgttacactgccaactctaccaaagcccacttcagttgcgacagatagctcagaagattgagcttgcctgccaattgagatgggataatttttgctggagatttgttcgcctttgtttgcaaccttgcatgcatcagatttgttgtgacgtgaagatagtgccagtttcattggcgaattgagtggaagttattgcgtgctggaattgataggtgtgcaggttttgttctttttgtaaagtattctatcagtttagtgagatcagttggtagtaatgggaattgtaataatactgtgcctattattgatggatggggtgatcagatccatgcataggatgaagtttctccccttgttttgtaatgtaaataattgtttggtttctgcagatct

SEQ ID NO: 2056 - DNA, 955 bp, Sorghum bicolor
  Clone ID: SORBI-28MAY03-CLUS34388_1
ggcacgaggatgcaacctcagtctcagcagaaccagcttcagcaacctcaacaacatatgatgtcgcagttccagtctcagcctaatcaagtgcagcaacaattgggaatgcaacaaaggctccaaacttcagctggcatgctcttgcaacaaaataatattgatcaacaaaagcaatacgttcaggcacagaggggcctccaagaagcacccagtacatctgtggattccactgctcaaactggtcatccaggaggtgatttgcaagaggagttatatcaaatgattaagagtttaaaggaccagtactttgcgcacgtggatgatttgtacaataagatatccatgaagatacaacatattgacaaccacatgcctgctcaaaagtcagcagagcagtatgaaaagatgaagggctttaaactaatgttggagcgcacattgcatttcctgcaagttaacaagaacagcattcagccagcttttagggaaaaaatccctgtttacgagaggcaaattctcagtatcctaagttcacaaagaaggaagcctgtgcaggcacctggacagcaaatatttcagcaatctggtgggcaagctcctagctctaacatttcacagcaacatcagacttcccaaggtttgcagcagcatgatagtcatactaatcagatgcctcaagcaagtataccaagtatgaacacaggagtacagacctctggagcacctggcattcagcatgtacctgcgcctcaagcaacaaactttggtgttccaacaacacagcaaaatgtcacaaatgcaccgcaggctggttctaatctggagaatgctcagggaaatagttttaatcctgtgcagcatggttcaatgggtactgcgttgcaacagggaagcactggtcccatgcagggtgcattaaatgcacagcagcagtccagtagtaacatgatat

SEQ ID NO: 2057 - DNA, 557 bp, Sorghum bicolor
  Clone ID: SORBI-28MAY03-CLUS34842_1
gcgtgcggtggcggagtgccccgtgctcgtggtgggcaggcacggctgctgcatgagccacgtggtgaaccggctcctgcaggggctcggggtcaacacccgcccggcacgaggtcgccgacgccgaggcggagctcgccggggtcgttgacggcggcgacgtcgcgcttccggcggtgttcgtcgggggcaggctcctcggcggcctcgaccggctcatggccgtgcacatctccggcgacctcgtgcccatactcaaggacgccggcgcgctgtggctctgatgtgaagaccaagccgttgttgttgcctctccatcgtcagcacttctttcttttttggtttccctgtccttgcttggaattaaacgatgatgtgttgttaacttatttttatttactcctagatcgactagatagacaggcatgcacataggactttaattcttttagttgaaaaaaaaaggttattactaggagaaatggagtgcgcatgtaagcgatttcctataatatagtatatatatttgtttttccgcatcatgtgaatagaaagag

SEQ ID NO: 2058 - DNA, 658 bp, Sorghum bicolor
  unsure (1)..(658): unsure at all n locations
  Clone ID: SORBI-28MAY03-CLUS34860_1
gtggagctagtgatggatcgtcatcaggcgagcagcctgaggtacctaatcataagaacaagagtatgtcactaagggctctagcaacgccattgagacgggtacgaaggaaacctctacctctcacgatcccgaaggagaagaagaatcgatcactgtggaagaggttaaaaaaagagaggcaagagatgggggaaaacatatcccagcgtctccggttgtgtctccaaggccaggctcgacacaagagaaccaaatcgtcttgacaactgtgaatacacatttaactcttggacaaatctgctaggaactcactgatggttcaccaacagaactgcgctgcgatttggagcttctgacattcagcgccaatcgtgctgttgcctgtgtacattggctgaacattacttagaattctttctgttaggtcatggattgtcccagccccgatgtattaagtattaactgccaatctttcgtttcttatgatttgtttcaatttaatcctgtaaatttctaggccaagaactgttccggacttgtggctggggaaggggcaccagtgcattgctttcaggatcantgtgtagggtttgaaggtcgagttgtatcgacagaatctcatttgtatgctgctcggtaacgtctctgattagct

SEQ ID NO: 2059 - DNA, 712 bp, Sorghum bicolor
  Clone ID: SORBI-28MAY03-CLUS34863_1
caattccatggcatttgtttcaatgaaacccatgggctgtgcatagtaacgaggatgatggaagggggatcagttcatgatattcttatacagagaaacaagaggctgtccctccgagacacggttaggatcgctcttgatgtcgctgatgctctggctttcatgaacaactatggcattgcataccgtgatctcaatgctcggaagatcctgctagataggcaagggaatgcttgccttggggacatgggcattgttaccccttgtagtaatgttggtgaggtcactgagtatgagacatctgggtaccgatggctggctccagagatcattgctggagatcctgaaaccgtcaccgagacctggatgagcaacgtctacagctacggaatggtgctctgggagatgatcaccggagaggaggcctactccacctactcgcccgtgcaagcagcagtcggaatcgccgcctgcgggctgaggccggagatccccagagattgtcctcctttcctgaggtcactgatgaacaggtgctgggacaattcccctctgaagcgccctcagttctctgagatcatatccatcctacaaaagcagaatgttagataattttcccttttttccttctatattatattctatatatcagtttggcttggctgtttgcctaatcatgcaggaaacgcattctgagaaaatataatataat

SEQ ID NO: 2060 - DNA, 684 bp, Sorghum bicolor
  Clone ID: SORBI-28MAY03-CLUS34871_1
tgctggcccgaggagcgaggcacagagctattgggctattgccgagtccaaaggatggtttggaaatgatgagagtgtaaggagccgagcactcactgaggagcatgcacgagatagttttgaaaacctcctatttagtgtgtgccgtttcagagagctcactggaagatacccacaaaacataactgttgttagttatgatttcaaggaggaacggtttgcacaattgcacagaaccgcactcggattcccagaaggaagattcttcttcacaggtacaccagctactccttctgcaagggaggctgctctgaaaggcgaagcagctgtccgttctcagttcctggaagatccatatggatgtctaggatctcttcatgtaaagaggctgaagagggacccgttccaccgtaccattccataccctgatggctgcccagagctgaagggtttgttttcctattgtggcccggtgccttactccgggcacctcccctggactgagtagctagtgtaatgtacctcaatctttgatcgagctccccactgtcactgcacgattccagcaccctttgcactgaccttgttctgaattgatggaaacatattcaaccttgccttcttcattagggagaggattgcttttgcaatacaagtaaatgttacactatcaatatatatact

SEQ ID NO: 2061 - DNA, 629 bp, Sorghum bicolor
  unsure (1)..(629): unsure at all n locations
  Clone ID: SORBI-28MAY03-CLUS34880_1
ctacaagggaatgctttgaagtaccaccgaaagcaaccggtgtagtttctgagagaatggcatttccgttgtcattgatgcattcccatgattatgtttccaaaaggctagcattagttggagacgctgctcatactgtccaccccttagccggccaaggcgtcaacttgggctttggtgatgctgctgctttagcaaaagttattgctgaaggagtttctgtgggctcagatgttggggacctgactttgctacaacggtatgagaaggaccggaaggctgccaatgtggcgatgacagcagtgctagatggtttccagaagatgtactctgtggattttgggccccttaatgtagtgagagctgctgcgttccacggtgcccagtacatatcaccactgaaaaagaacatcatctcttatgcaatgggtgacaccaaatggccactatttcggtgaacagtactgctttgaaactgttgttctgaacttgtgcgatgcacctggcttatagtttcggcttgtnactggatcactaagaaacattgtagtgcagatgcaatattacagtcaatcaataaatttctttcaaaagaaatcctcagtggcctgaggtgaattgaaatcgtg

SEQ ID NO: 2062 - DNA, 863 bp, Sorghum bicolor
  Clone ID: SORBI-28MAY03-CLUS34896_1
tctcggcatccaaagggaaatagcagctgaaactatctacaaggaaagatgcatcactgtagacaatggtgatagttggaccaagtacatgtccatttctggttctgcagaggatgagcatgacattatcaccgtgcagtacacagaggaggggttactgacaatagatgagaaccgagatggccgtgcagctgcatttggtgatgatattgccattgaatgcctagcaactgaattcaagagagaagtttacgtggtgcaagctcatggggcggatgcgatggttgacgaggataactgcgtgttcttcctcccacatcgtcctagaggagaaatttgtgaaccaccaatttttcttttcatgaaaggaacagctgcgtggcgggcgcgtgcccacctgtgtctgcctctgcttgccactgtcctccgccgtgtgccccccgatctggctcctgtggtcctttgagaatgactgcagtttttttttcaccccccatagtttttagttagcggcggagttgagacaattttgttattggagctagagtgctgaactgaggagcaacatcaatgcccaagagattagagagacggccaatctgagtatctgactttgttgcagggtcttgcctgcttatgaagctgtgtaccgtaattcgctgttgtatggtgattttgttgtatgtttatgagtaggttctgactagcgagggtattctgagtggtagaacgtcgaatctagattttttgagggtatgatgttgtttgccattgttggccggcatttttgtattgcctattgtgaggattttcgtttttctggctgcctgtttctagggacatcatgattggacatcccgaat

SEQ ID NO: 2063 - DNA, 790 bp, Sorghum bicolor
  unsure (1)..(790): unsure at all n locations
  Clone ID: SORBI-28MAY03-CLUS349_1
cgttcgcccacgcgtccgcngattctttgatcaactggagacacgaagtaaaggatatgctagcatggaatattcacttatcgggtacagagaaagtcaactagtaaagctagatatacaaatcaacggggatcctgttgaggcgttgtcaacaattgtacacagagataaggcatatgctgttggcggggcacttactcaaaaactcaaggaactcatacctcggcaaatgcttaaagttcctattcaagcatgtattggcacaaaggtcattgcgagcgaagccctgtctgccatcaggaaggatgtcctatcaaaatgctatggtggtgatataacaaggaaaaagaagttgctgaagaaacaggctgaaggaaagaaaaggatgaaggcaataggaagggttgatgttcctcaagaagcattcatggccgtgttgaaactggagaaggaggtgctatgaaagagctcatggaactttgtgtctctgtaaattaaagatctcttcttgtgcacaactccactccgcaagtttactcaagagagttttgagacaacatggcactgtgattcaacctggcagctctggaccaggggaaccagtctaactacagatcactcccagaacaaaagctgctaatctagcgactggcattcactaatgttgtgttgtatgtcaggttatgatggtaaacaatcatgttgaacagagttttgcctggcacatgtatacgaaatatgtcaaaaggcgtcatggaatccaatttcttgtaatgctacacaaacttgt

SEQ ID NO: 2064 - DNA, 666 bp, Sorghum bicolor
  Clone ID: SORBI-28MAY03-CLUS34496_1
gtggccgcgtcgaggtggagccgcactctgtccctcccctctggatcctgcactgctgccggctgcctcgttacgtcacgtgcagcgcacacacccatccgccggccgggccgggccccatcccccatcgccgtcgagtcgcctctgcattccttccttcccaggctgccgagccgatcagtcccccccgccgctcctcccacttcactcccagctcccgagccatctgatctgctctgcccccacccctctccgtcgctttcgccatggcttcccaccgccacttcctccgcctcctcgacaaccccttcttccccttcccaccgccgccaccttcctcatcctcctgcccgttcctccttgacggggtcttagaccacccgtccccgttccccgacctggacgacctcctcctgccctcggcctccgcaccggcgctcgaccccttcttcgccttccccgccaccccgtccccctacactccgctcctcctccgcgacctcaccgaccgcgtcgccgcgctcgagctcgccgtcgccaccgcgcgccgccgccccgagccccccgccacccggaagcgcacctacgtcaccgacgccggcggccgcaaggtcaagtggacctctgttgagaagccgcgcgccggggagcggacgctcaggtggg

SEQ ID NO: 2065 - DNA, 663 bp, Sorghum bicolor
  Clone ID: SORBI-28MAY03-CLUS34499_1
gcacgaggctcagtaattgttagtcagtataacaaccaacaagatacctcatctgaaatccctgatttatccagttttgtaaaagatgctcgacgcttgatactgctggccctcaaagatattacagatacactacaatcgggtcacaatgatgcaatgttcagcagctccaatgtaggtcttcttattgattgtgtacggtccatcagcgatgtaggaactcggaatcattgcttttccttgatagcttctttgggaaaggcttgcccacaactggtctcagaaagtattgttgatttgtttgtcgctattggggatgctattaaacaggatgacagccactcacaacgtgttttggaggatttattatctgtcttagtcccatgttggttgtcaaggaccacaagtatagaaaaacttcttcagatattcattaaagctttagcagatgtgcctgaacataggcgattgacgctcatggtttacctcttaaggaccttggggaaggaaaatagtttgagtactgtgatcatgcatctattacactcattggttgagcggatttcacactctttttctgaacattatgggagtgattgtagattggctatgtcacaggagtgggagtatggattggcagtcaatgtgaccgaccaattttcc

SEQ ID NO: 2066 - DNA, 738 bp, Sorghum bicolor
  unsure (1)..(738): unsure at all n locations
  Clone ID: SORBI-28MAY03-CLUS34511_1
gcacgaggggtctttgctccccgtcctgccatttctctcccccccccctcgccgtccgccccagcacgccccaatccgtcctgacctaaccaactctcgcaatggcctcgacttctctcttccgtcttgcgacgcgcgccgtccgcccctccagcttcgtcagagcttcccaattgccccggtctgcgtcccgggtgcagacccccgtggctctggctatcaaccgccccggcttcagcaccacctcgattcgccgctccggtcagcacgatgacgagacatatgaggagttctctgccagattcgagaaggaattcgacggtgtccaggatgtctttgagctccagcgtaacctcaacaactgcttcgcctacgaccttgtcccctccgttgaggtcctcactgctgccctgaaggctgcccgccgcgtcaacgacttccccactgccgttcgcgtcttcgagggcgtcaaggccaaggtcgagaaccaggagcagtacgagcaatacctccaggccctcgacagcctccgccaggagctcggcgttgcgctccgggaagagctctaccccggcgagcagtaaacatgcacatgcatgtttttgctctcgcttcgttccataccatatcctacctcccttttctatttaaaaccccggaaatctttcctcaattgttccgattatcgtcatatctatgaagataggaaagctgtatacatatnctagaaatgcagtg

SEQ ID NO: 2067 - DNA, 525 bp, Sorghum bicolor
  Clone ID: SORBI-28MAY03-CLUS35048_1
gtggatcctgctactatcaaggaaggtgcagtactgcactacaatggaaatatgaagccatggctcaaaattggaatggagaagtacaagagcttttgggatagctatgtggactattcacatcctttgattcagcagtgcttcatgcgttgattgttgtgtatcacattagaaatttttgtaagctctgtggtagatatgtcctaagcgcatgctccaactgccacacgtaaacattgtagttaaatcaactggcttcgctctcaagttacaatctctgacaaaacatcagtggctgtctgtagcacatgtagttgatgaagcagagcagttacatatctccagccacaggtaaacagcacatgagctaagactgcgatgcagtaggctgctacttgaagtacatccactacatacattcataacttgcgaccatcaatgtaatttttccattttttattttttgggtgaaacagaaccacagaatggagatgatgtagaattgattttaaattattgaggtgt

SEQ ID NO: 2068 - DNA, 638 bp, Sorghum bicolor
  Clone ID: SORBI-28MAY03-CLUS35105_1
gcctccgctccccagcaggcgcaggcgcaccagcaccagcaccagcaccagcacctcgcggagtcgtccaccgggcgttgccactgctcgaagaagaagcggagccgtcagggcctgtcccggcgcacggtgcgcgtgcccgcggcagccgcggccgcaggagcgccggggtcccacgtgccggcgtcgtcggacatccccgccgacgactactcgtggcgcaagtacgggcagaagcccatcaaggggtccccttacccgcgcggctactaccgctgcagcagcgccaagggctgccccgcgcggaagcacgtggagcgcgccgccgacgacccggccatgctcgtcgtcacctacgagggcgaccaccgccacgacgccgccgccgccgccgtccgcgcccgcgcggcctgaagatgatcgtttgcaggcggtggcagctctagtcaatcatcagtgctcgtagtagtagttgtagtccgctcttgtttgatttgttctttggattaattaaattagtggtagatctcctcaagctttgcttgcttctgtaaagaaattaaagagcttctaaacttgaattcgcccatgattttctccccgctttttacagatatacagtatatatatatatatat

SEQ ID NO: 2069 - DNA, 793 bp, Sorghum bicolor
  Clone ID: SORBI-28MAY03-CLUS35051_1
cgggtgtactgttggaaaggactacggttttcggccaggcaagacttggatggttttgctcggttttcagactacgggatcgaaggagttgtaccttcagaactccttccacctgaagtaaatgctaggttttcttctaagcctgccgaaaaggttaagcggacgagaagggaagattcaaaaggcatgtcagctcaacccaaagagcagcaggttgctgcgacaccagaaaccgatggcggtggcagtggtggcgatccagaagaaggggcggcaccaatggattccgacaacggcggggtggaggatagtcagaaacggagcccaggggaggtctctggccctgaaagcgggcagtgcgagcctgaggcggatgccgatgataacgtgaagactgaaaccaccagtagggatgctcgtgctagagtagtataaagtgggcgatgctgaaccattctgcccagattttcgagtgactgacattgggcatttttataggtactgcgagactcgagttgagacgttagttagtacatcctgcagtggtgattggattggatttggatgtaaagtggctgtttcgtagctgtatgtgtaattgttgccctgcagttgttgtttattcagcaggagtataggcagaggctcaagctcaaccggcgtctgcccgcttgtctgatcatatttacagtagtagttcgggaaatgaaattagattgtttgtttatttatttatttatttattgtccacaataaatttgagattcccggcgagccctttcaaatggtaacc

SEQ ID NO: 2070 - DNA, 732 bp, Sorghum bicolor
  Clone ID: SORBI-28MAY03-CLUS35113_1
agtgcctacactaccaatatgagtggtcctaggtatggggagtcagcgaaccagtttgcgcagcaagcaaacacgtatattggggcgtccactccagtgtcggcgacacggaatgtgcagacctgcatgtcttgcgggtcaagtggacacaatgcgcaaaactgccctgcaggcatgtataagcagcaacctgcggcaagcacagcaagctcctatggctcttcgcaacctcgcaacactggccccagaccgtgtttcaaatgcaatcagatcgggcactttgcggactcttgcccacttctggcccctgctccccagcagcagcagcagcagtatcggagcggtggcgcttcatcaggtggttatggtcagcagcagtatcggagcggcggcgcttcgtcaggtggttatggtcagcagcagtcctatcttggagctaccaactactgaaagtcagtatccatcgaatcaggcgtgatgttggttttgcttagatgcctgtcctgaatggcatcgctgcgtctatgtaatgtagatacctaatgttccttttgtgtttgtgtgaagttggaaaccatgtatcggtacttctatatgtttttcgtcttatatggtgtgttataaatcctcgttgctgtgtcagttctgttgaatccgtggtttgtccagctttgcatggtgcttgtaaatcaggcgtacgtactgtataatgcaactcatctttagattgtc

SEQ ID NO: 2071 - DNA, 695 bp, Sorghum bicolor
  unsure (1)..(695): unsure at all n locations
  Clone ID: SORBI-28MAY03-CLUS35118_1
tcaaggaaaacgctgacttccaacgttagagatgaccaaggtcttgaaaaattcaaaaagccaaacaaggaggtgagaagcttcttttcctttcgtgctgctggtgcactgcatgagggagttcggggtcatgcatacaaatcaaataatgtaactccttcacagaccggaaatgtaaagacaaaggctcctgtgcctccacctccgcctctgccaccgggccgaccttattgcactgagaagaaaccgaatgtcaataattcacctgttggtggaagaaagccaaaggtctcagctccacgctggcactaacccagtatctaggatcctgcagcataactctgaagccgcgaaggtaaagctaagcgtctgacgtgacctagaagccgcaaccatcaagcaacgattgatgttatctgttgtagtttaccagcagtcttgtgacttgtcacctgtgttagagtatccgtagcagtgtatgtagcaacgtgtatcatatatatccactaatgtctaatggcaccgtagctgtactgtcctggatttaactagaacattgtatatacctagaataattggagctttagctggagaatatcgacccaggaattatcccctggatttgcaggtcacatgctgcacttgaaccgttgaaagatgttcatntgtagttntgtactagctagcaatgcctg

SEQ ID NO: 2072 - DNA, 653 bp, Sorghum bicolor
  Clone ID: SORBI-28MAY03-CLUS35127_1
cggctggtatcgttaacaggtgacctcggtgaagatgaaactgaattactccattctgaggcagagcaaaacaggagaaaaagaattgagtcaattgttaatctgcagcaagaacgaaacggcctgattgaaccaaagaaagacctcgccatacaaccaggaatgtatgtttctcttcctcccagcacaccagagacagctgaagaagagaatgcggatcccagcaaagacacggctacttcaccctcagaaacagagcatcgtggcctggcaaacaaccccagtagcaataagcccaagaattcaggccatcgaaggagaaacagagctaatgcatcaagaagacagcctcaccctcacggccagcctgctaggcagcagtggcagaggaaagaagcagacccctgaagcaatgaggacgtgacttgtgagttgtttttatcggttgggtatattaatgtcgtgccctgcattggtttcataattgtaaggcatgacacggcaatgttttggcgctgctatggcagttttatgctataggggtactctggaaagaacctgcactggattctatagaactagtataaaactctgcgtgcttggaagtacacactgtattttttttttggggtgtcattgccaggtacttgtca

SEQ ID NO: 2073 - DNA, 590 bp, Sorghum bicolor
  Clone ID: SORBI-28MAY03-CLUS3516_1
caactgataacatgaagaaaaggtattggaagttgtcccttttagtgcacccggacaaatgtcctcatcctttagcacaagaggcattcgtgaaattaaataatgccttcaaagacttacaagaccctgataagagaggtgcaatagatgagaaaataaaaaagaaagaggagatggaacaatttgagattgagcttaaagcaatgcgtgaggctgcggaatggagacggttacaaggtgtatcacttgcaggtgatgatgaacttttagcaggtccaaaagacgtccgggcacctaagagagatgaatggatgaccacattgccaccagagagaaaagcaggagtgccgatgcattcaactaaatcatttagtatgaatggtaaagaaggacgtggagacacaagtgtctggactgatacccctcttgatagagcacaaaaagcacaacaaagctatctagaagcctacaataagacaaaggcgattgcagaaggcgaggatgtaaagagcaaaaacccggatgcttcaattgtagataagtacaatacctccaaaagatcagtgtctcttgtgcagaagcaccgagag

SEQ ID NO: 2074 - DNA, 538 bp, Sorghum bicolor
  unsure (1)..(538): unsure at all n locations
  Clone ID: SORBI-28MAY03-CLUS37212_1
caggacggcgaggaggaggcgagcaccggcgaggtggactacgagaagaaggagaagcaccacaagcacctggagcagctcggcgggctcggcgccatcgccgccggcgcatacgctattcacgagaagcacaaggcgaagaaggagcccgagagcgcgcacgggcacaaggtgaaggaggaggtggcggcggtggcggccctgggcgcggccgggttcgcgttccacgagcaccaccagaagaaggacgccaagaagcagggccagagctgagctaggcaacctctcgatcctgcagtgatatagtatatcgtcgcgtctgtcgcttatatattgtggcgtttaatacttataaattgcgtcgtctttgttgattgccagtgattacttagacatgcatgtccgtgtgtcagggcacgaactggcactagtagttttcctgcgtgccaggccgtattattgactattgtgcccgatctgtttctcagtgtttttcncccaccaaaatattgaagcttctgtttactgatcaaaagaa

SEQ ID NO: 2075 - DNA, 664 bp, Sorghum bicolor
  Clone ID: SORBI-28MAY03-CLUS37183_1
tcttgagagttgggctgcagcaaatggaataagtggtgattttgagtccttgtgcaagaatccaaaagcaaaagaatacattttaggagaactgtcaagaataggaaaagaaaagaagctcaaaggttttgaattcataaaagatgtgcacctggaaccagtaccatttgacatggaccgtgatttgatcactccgacatacaaaaaagaagcgtccacaactgctcaagtactaccagggcgtgattgacaacatgtacaaaagtgctaagtgaactcactctacagtacagaacatccagatgaagattcccaacgctgaatcttgaaggaaccgacagaagttttgctgtgtatatgttcgtagtttgtatgccagaattctttctgtatcagtttttcagaaacgatttgccttgggcatatatacagcaagcgggcaacgtggccagcaggcaagtacagacaccgtttcaatcaaattgcttgaactatggaactggcaattagttaaggccagttttgggggtttcatgtcccagtttgactcaatgtgttagaaacagtgtatataagttcctgccacgtaaatctcatttcatctcacaaaacttttatcatctctcttcatctatctattccaaataatgtcagcgtattctgg

SEQ ID NO: 2076 - DNA, 743 bp, Sorghum bicolor
  unsure (1)..(743): unsure at all n locations
  Clone ID: SORBI-28MAY03-CLUS37257_1
tcagaggaggagcagaaggagcagccacaacagcagcctgtagagaagatggatgctcccagcagggaaagtaaaagtgtaggaagaacattcntagatctaaacgagcttgcacctggaggtggctttgatgatggcccaagcttgacagtgaaagatgacatggacaacatttaggaaataattattttttgatacatttgaatgctgttggtcagtattctgacttccaagcaagggcagatcaatgggcatgatgtcctgcaatgaatggtgcaactatattttggtggtttgagctgatggctgcttcattgatttgcagtaacaggagagtcaggttccactggaagcgactttgagcttcttcggagctattttatacttggaggccatgaggaggtagttttgcttttgattatgtatactacatgaaggtcgcaatcgatcacagctgtgttgtggccagactgatgctgcattgtggccggtctgtatgtaggatataagtttattgcctccatttatttagttttaggcatggtgatgtcaatgagagcatggagggaaacctgtacactgagtgcagtgtgtcggcatttgcgaccttttccacttgtagattgtagcttttaagtccgtgcaggattagttctgtatctattatttctgacagactgatttttctgtcacacctgtgtagctgacattgagctgtccttaaatgcaccggcattgcttct

SEQ ID NO: 2077 - DNA, 723 bp, Sorghum bicolor
  Clone ID: SORBI-28MAY03-CLUS35202_1
gcacgaggcacaacacatctcccgttcggcctatggatctcccagtcgttacataggctcatcacacatgtcccatggatctccgagttactaccttggatcttcagggcagcggattccttacctgaggcactgcacgttgtcaggcccgagcctgttcaccatggtgccccagtcaccgcaacagaaccagtcgcagcacggtggagactcggaaacaaatctgtcagctgctgcatcaactcagtcattccgtcagctttacctgcagcattgtcctgattctgacacgtcatctcagtcgcttccggggtgctgattcttgctgcaaaattcaccattttaacaatgatggtggctccagtaagctccaatgagaaatcttatctggtaccaaattgacatgtggatctgatctcgtgaacataattcaccatgatgataaaataaggtgtgacaactgcttgtaagaagagagaatcggcaaccccagaatgtgagcaattttacttgctgagtgtacagggagtttggagtagttttggatttgcctacttttgaggcacgtaatgcagtcataggttacttctgttcaatagttgatgtgttgctctatcttgaagaagcaaatgcccttgtctggtttcacgagcgtttagcgtgtactgatacaactttgtaggaaccctagatgctgtttgtactattaattttgagacctgt

SEQ ID NO: 2078 - DNA, 591 bp, Sorghum bicolor
  Clone ID: SORBI-28MAY03-CLUS35209_1
agcttgcagtccatctacgagctggagtccgtcggcggcgtcagccggcggcggagggtgcggttccagatcgacgaggaggagcggatcgacccgcaggtgagggacgagctgtccgacctccttgaggccaaggaggccggcgtggcctacatcatcggccactcgtacgtgaaggcgaggaagaactccaatttcctcaagacgttcgccatcaactacgcctactcgttcctccgcaagaactgcagggggccgtcggtgacgctgcacatcccccacatcagcctcatcgaggtcggcatgatctactacgtgtaacccagccggtgccagcaggcgacctcaaagcagcacaggatttttgtgatactgctgttttggacccagacttgagatagtttgtgctctgatttgccccgtacgcgtgtagtgctttcatcgatttaggtgcctagctggtggggtaaatgtgacagtagcagaatcggccggttagcaccgtttgtactccagaccatttgtaaatagatggtgttcatcatggaaattgtaagcattagcttgacaagcctacagcatacagatttg

SEQ ID NO: 2079 - DNA, 650 bp, Sorghum bicolor
  Clone ID: SORBI-28MAY03-CLUS35203_1
aagcgtcgttcacgagattcatcaagaaacagtgggtcaagtgaatagttgacatgtgtatagtgatcaggtaactactgaccaacaacaccccagcaccaccattttgcagcatttcatctgttgtggcacttccttgatcacatgtaatgtctgggagttctgatctagaactagattgaagtattgaattgccattgtggaggtggctgctgcttatagctctcaccccaagtgaggagcatgccccttgtcctcagcaaggttcttgcccaggaatgtaggcagctttactcagtgctttgaccttgatggcacatacaggttgaaagattaaggatgccaaaatgatatggcttgtctattctaaggtcaactgctgcaacgagaattactcttcgtatagagttctgacaaatagctatggcactgtttctgaattaggactaggcgcttacatcaatttttcccgttcaagccggccttaatttatggctagagaccttagagtactaccagtccctgttgaggtccagccttcgctgacaccaatgtaattatcatctaaaaatattctttgaagcagctgtgattcatcagcaagacattagttgtcatgtacaatgtacaaaatcttgctaacaagacag

SEQ ID NO: 2080 - DNA, 632 bp, Sorghum bicolor
  unsure (1)..(632): unsure at all n locations
  Clone ID: SORBI-28MAY03-CLUS35227_1
agattatctatgaggatggttctgtccaaaaaattaccgaagttccagatgatctaaaagcaatttacaagactgtttgggagatcaagcagaaaactattgttgacatggccattgaccgtggttgctatatcgatcagagccagagccttaatatccacatggaacaaccaaactctgggaagctaacttcattgcacttccatggttggtcaaagggcctcaaaacagggatgtattacttaagaactcgagctgctgctgatgcaatcaagtttacagttgatactactcttctcaaggataagcagccgacttcagaagaagaggatgcccaggttaaaatggcacaagtggcctgttccttgaacaaccgggaggagtgcttagcatgtggaagttagattcatctgaattgcagatcgtgctactagttccatatatatagcattaaattacaacaaaggttccctgcctgtgtatgaacttcgatttgtgagaagaaccaagcaaagccttgtttgcagaactttagcgtggaattgtactcatgcttaggctattgtaaatatatatgttatatgtatctatctactatatatattcaagtgtggtgtacaagttcccgttgn

SEQ ID NO: 2081 - DNA, 642 bp, Sorghum bicolor
  Clone ID: SORBI-28MAY03-CLUS35243_1
gcacgaggaaagaaaaaaaaaatggcgcagctggtggagacgtacgcgtgctcgccggcgacggagcgcggccgtgggatcctcctggccggggaccccaagacggacacgatcgcctactgcacgggccgcagcgtcatcatccgccgcctcgatgcgcccctcgacgcttgggcctaccgcgcccgcgcctaccccaccaccgtcgcccgcttctcccccaacggcgagtgggtcgcctccgccgacgcctccggctgcgtccgcgtctggggccgctacggcgaccgcgcgctcaaggccgagttccgacccctctcgggacgcgtcgacgacctccgctggtcccccgacggcctgcgcatcgtcgtctccggggacggcaagggcaagtccttcgtccgcgcattcgtgtgggactctggcagcacagttggtgagtttgatgggcactcaaagagggttctgagctgtgacttcaagcctacacgtccatttcgcattgtgacatgtggtgaagattttctggctaacttttatgaaggaccaccattcaaattcaagcattccataagggatcactcaaattttgttaattgtatccggtatgctcctgatggtagtaagtttatcactgtgagt

SEQ ID NO: 2082 - DNA, 774 bp, Sorghum bicolor
  Clone ID: SORBI-28MAY03-CLUS35244_1
gagtagtagtactgttactatggaggatgaggcatcatcatcagcgaggaagcccaagaggccgcgcgtggccccggcggcggcggcggcggccgcggcctgggagcctcatttcacgtacctccctatcgccgacgccctcaagcagcgtccccgcgcccgggtctgcctcttcgccgtcgtcgctgagatcggcgccgccttccacagctccggcacggatttcactgttacgctgaggattgtggatgaatcgcgcaaggctggaatatctgcaacattctttgctcaagaacctgacctattgccctgtgttaagtcaaatggagatgtgatcagtctccgtgacgtcatggtaaagtgttatcttgaggagttctttattgcagttgacaaaaggctttcttcgttcgcgctgtttgaaagcaaagtatctgctgagtgcagcccatatcagacttctaagaattatcatggcagcaaacatgacaaagaacgtttaacccagttgagaacctggcttcctctaggtctgaaagatttcggtctgaaagatctcgaattgcagttgaggagtttaaagtctgattctacctttgatcttgtatgcaaggttttgcatgtccttaaacataaagacaaatggatattttatgttttgggatggaactgatacccctgcagctgagtttcaggcaatttcggatgctgaggcagttgcatcacccgctctacccagggagcttttatgcacaatgccatgtattggtactg

SEQ ID NO: 2083 - DNA, 532 bp, Sorghum bicolor
  Clone ID: SORBI-28MAY03-CLUS35251_1
gcacgaggcgcacacttacgcagttccgcgccccccgctccatcgtaccacggccgtcgtccctccccgcgccggccgaaccgatggcggcggcgccgacggcggaagccatggacgtcgatgcgccggctaggccgctgactacctcctcggcgaccaagtcgcgctcccctcacgacgtcctcgccgagacccgcgcctccatcgagaaggtcgccgcccggatcctcgccatcaagcaaagacggcgcccccaagtcggagctccgcgagctcgtcactcaggatgtcgctgctcctcgtcacgctacgccaagtgaacagggagatcctgatggaggaggacaaggtcaacgcggagacggaggccgcgcaggcgccggtggactccacgaccctgcagctgcataacctgttgtacgagaagaaccactacgtgaaggccataagggcgtgtctcgactttcagacgaagtacccggggatagagcttgtgcccgaggaggagttccagcgttccgcgccggcagac

SEQ ID NO: 2084 - DNA, 548 bp, Sorghum bicolor
  Clone ID: SORBI-28MAY03-CLUS34946_1
ggcactctttcaaatggcgacagcagaatggatgatgatgtgattgatgatgaagaagatgctcagagcacgaggtcaagatccaaaaagaatgtggtgaaggaagctaataatccagcagtggcctatcaacttcacccacttaaaattatcctccatgtatatgatactgaagattctggtagcagacgccgtaaactgatcaccctgaggtttgagtacttggcaaagttgaatgttgtttgtgttggaattgaagattcagagggtctagacaataatgtcttgtgcaacctatttccagatgacactggtttagatctgcctcaccagatggctaagatttacgctggggaggttccaaacttcagcgacaaggattcaaggccatacaagtgggcacagcatttaggtggtatcgactttttgcctgaagtgcctccatctgctggggatgattctagcagagcattaagcagtgctgatttgtcatccaggcttgctctatatcgtcagcagaaccgtgcacaggctattttgcagagaat

SEQ ID NO: 2085 - DNA, 969 bp, Sorghum bicolor
  Clone ID: SORBI-28MAY03-CLUS34948_1
aggaaaggttttgaaacatttttggacaggctaaaagcatgcgttctagatgttgggctaactattcagggaaataaagctgaagagctgccggaacagatcttatgttgtgttaggttgaatgggatagattacaacaaatatcagcctcttttgactcacggtgcctgaaatcgatgcttacaagaaccagctaaccgtcatttggatgctgagaggtaaccataccaggaccagactcctggagatttcagaccagagcagctgtcaattatcacagcttctgccaaaagcccgaaactccattgtccgagcttagttcatacaagtaacattaacagaggggcaagtgactcagtgaccactggctggtccagttcgatccatggtgctaatataggcgattctttctgaaaatgtgggaaaaaaaaggccgagactgcagtccatgtaaatctgtaaatcattgctggatagctccggttgcctcccttgttgctacccaacattctagatttagtaaatatcactaatttgccctatgatcgagtaggtttaggcgcactgaaacttgtagaggttccattttagttcgtgaatacaagctgtttgatttatagagcagtgttgtagaatatgaacttcataggattgtggcacctctagcccgtaaccctgacagccagccggcttgcattaaagatcccttcggaatgctggaattttacaagattccacaagatgacaggaacatgatgtggtctcggcccaaaatatcgtgtacaacttgcatggtgctgagttggttactttggaagcttcatatggtctagggctctcggccctaattatcgtgtgcaaattcgcgtgatccttagttggtaactttggaagattcttggaatttttgtagagggggtcttaggaatggtgattttggtggaaacccctcctgcaacacctcattca

SEQ ID NO: 2086 - DNA, 1226 bp, Sorghum bicolor
  Clone ID: SORBI-28MAY03-CLUS35_1
cgtccgcacgattccggggagctgttcgcggtcaagtccgcgccggcgtcgtcggcgggcgccgcggagctgctgcggcgggagcgggggatcatggcgggcctccgctcgccgcacgtcgtcccttgcatcggcggccgtggcgggcgcgacggctcgtaccagctcttcctcgagttcgcgcccggcgggtcgctggccgacgccgtggccaggaatggcggcgggcgcgggctcgaggagcgcgccgtcgcggcgtacgcggccgacgtggccgcgggcctcgcgtacgtccacggggcagggctcgtgcacggcgacgtcaagccgcggaacgtcgtcatcggtggcgacggccgcgccatgctcgctgacttcgggtgcgcgagatcggcggaggccgtcggcgggccgatcggaggcacgccggcgttcatggcgccggaggtggcccgcggggaggcgcagggaccacccgctgacgtctgggcgctgggatgcaccgtcatcgagatggccaccggccgcgcgccgtggcgcggcgtggacgacgtgctcgccgccgtgcgcctcatcgggtatacgcacgccgtcccggaggtgccccggtggctctccgcggacgccaaggacttcctggccagatgcctggcgcggcgccccagcgaccgggccacggcggcggagctcctcgagcacccgttcatcgcctccgccagcggcatctccaactgccgggcggcgctggacctggacgccgccgccaagggcaggtgggtgtcgccgaagagcacgctggacgcggcattctgggagtccgacagcgacgacgacgagcacgacgtggtgtcggcacagagcaccgccgagcggatcgcggcgctggcctgccccgcttcggcgctgccggactgggactccgacgaggactggatcgatgtgctgtccacaccagccgaagcatcgtcgtccgacgcgacgaacgcgccggcggacgaggaggtcccttacctcgacgacggcggtgccggaaccgaggaagaagtggcgagggcagaggccgccgagtccctcgacattgacgtcgacggcgcccacaatgtaggagaagctgacgcttcacctgatcacgagtggcatctccgtgtcagttcaccctgtgttggtgaaactccatgtaaattactgtgtgacacaaacaatgcaatggatttcgttcttgcccc

SEQ ID NO: 2087 - DNA, 717 bp, Sorghum bicolor
  Clone ID: SORBI-28MAY03-CLUS34982_1
ctctgatcggtgcgaggacgaagcaacccagttgccgagaaggatgcttgcttctcccccgaaggcgacggcccacgccgctgtctcccgcgccaacaacgccacccccgacgacgacgagccccaccaccattaaatttatctaaggggcagtggcctctcgccgccggcgataaccaccggcaaaaagtcccctggtggccgcttaggcagcgggagtacgactagcttgctggtcgacgtcgcccgccccgcgtcgggctgggtcggctcggtgttccatcttgcttcgtcccggagactgttcgtgcgcttctgcttcaaggtgctcgatggaatgccgctgaggtgaatcaatgtgttgttttggtaaaaaatgacgctactcccttcacatatcacaccatctgacatagagaattgcagagagtttggtggaggcaatggatgatttgagacaatagaagggatcagagagagggagggagacccggggtctattataatccacagtcactggctattgcaggcagtggaagacccaagtgcatgaggacgcgctcttatgaccaattcttcaacagggacttggagagtagaagaaattatatcagagcatctgcacatggacagaagcgttaaaggtgctagagtatttagtaatcataaagccatatatatttatatggtgagtataacatgttttgttttaaggtt

SEQ ID NO: 2088 - DNA, 684 bp, Sorghum bicolor
  Clone ID: SORBI-28MAY03-CLUS35318_1
tgcggcgccaccttccccttccggcactccccttctcgtctcttatggtgcccggccgcgcgctgcgccagtactagcgcaccgtcccctcctcagccatggccgcggcgtcgttcgcgcgcgccttatctctccacgttctcctcctcttcctcctggctggctcggcgctcggcaagacggtgaagagagacgtgaaagcattgaatgagatcaaatcttcactaggctggagagttgtatactcatgggtcggcgatgatccttgtgggcatggtgatctacccccctggtccggtgtgacatgttctcagcaaggggattacagagtcgtgacagaactggaagtctatgccgtatcaatagttggtcctttcccaacagcagtaactaacctgttggatctaagaagattggatctccacaataacaagttgacagggccaattcccccacagattggacggttgaaacatctcaggatattgaacctgaggtggaataagcttcaagatgtgcttccacctgaaataggtgaactgaagaaactgacacacttgtatttgagcttcaataacttcaaaggcgagattccagtggagcttgcaaacctgccagaacttcgttatctttatcttcatgagaaccgcttcacagggcgaatcccccctgaacttggaactc

SEQ ID NO: 2089 - DNA, 509 bp, Sorghum bicolor
  Clone ID: SORBI-28MAY03-CLUS35321_1
tcagactagtaacttgggttccttctcaggcacaaaacaggattcttgccatgacctctagccgttctgattggtgtatttcacgtcagagaacttggggtgttcctattccagttttttaccatgtggactcacaggaacctcttataactgaagaaactattgaacacatcacggctattgcgttgaagaaaggtagcgatgcatggtggcatatgacaactgaggaacttcttccagatagatatcgggacaaagcatctgaatatcgcaagggaactgatacaatggatgtttggtttgactctggctcttcatgggcagctgttttagcaaaaaggggcggtcttaattttcctgcggatatttatcttgaaggttcacatcaacatcgtggatggttccggagctcattgttgactagcattgctactacagggaaggctccctactccagtgttattacacatggatttgtactggatgaaaagggtttcaaaatgagtaaa

SEQ ID NO: 2090 - DNA, 575 bp, Sorghum bicolor
  Clone ID: SORBI-28MAY03-CLUS35322_1
aaagatcttgataactctttcaatttcacaacttggattccaacgcgtgctcaaatcttccacgggatgtctattattcgtaattgctcactgtccatcttgactacccacttttcttttttgacttatacaactcgaagacatgataacttagcatgggtatgcctcctcaggcaggagtggaccaccttgatactcaattcttttccctgatggtgcggttaagaatattttccactgggtagcatagatcactgccctgtgtgcacataaccatccattgccaagaaccaaaggaatattgagtgactctagcacaatgaggtttacagtgaagttttccttctttatgacaaggttgatatttgagcaaacctgatctgcctgcatttctcccattggggtttgaactaacaaaggctttctcgtcggacacttcacccgttcgattgtcttcaccaagtcggcggatatgaaagaatgtgaagcacttcggtcaaacagagcaaaaactagtactgagtccacttgaatatagcctcccaccactttggtggctccttgaatgttatgca

SEQ ID NO: 2091 - DNA, 578 bp, Sorghum bicolor
  Clone ID: SORBI-28MAY03-CLUS35346_1
gcacgaggcgcggggggatctcactctaacgaagattctcttgttgagaaaaaaaggcgacgtgtggatgaggagatagctgctgagggaactttaccatcttatggagatctagaggatgttaaaggtggttctttgaggcatccttccaatgcagaaggctctgaacttgctcgaacaatatcaagtaatgcatctttggcagaacaagtaattgaaccagccctagtaatgtttgaggtgcatgtgccgcctgtttgcatgcttgatggagttcactctcaacatttctttggaacaggagttataatatatcattctgaacatctgggtctggttgcagttgataggaatacggttgctgtatctatctctgatataatgctttcatttgctgcatatcccattgaaatacctggagaggttgttttcctccatcctgttcacaactttgctcttgtcgcttatgatccttctgcactaggagctggagcatctgttgtccgggctgctaagcttctaccagaacctgctttgcgacgaggagattctgtctatctagttgggcttagtagaag

SEQ ID NO: 2092 - DNA, 548 bp, Sorghum bicolor
  Clone ID: SORBI-28MAY03-CLUS35375_1
gcacgagggagggccatggcggtccccgagctcgccttccacttgttcctgcccgccgccctgctctccgtcgccgctcctgcggtggctcggagcccatcttgccctgatggttggcaagtcggtcctgctcagaacaaatgcttcatgtacatatcaacctccctttcctgggatagatccgaggctctctgccataactacagcgggcatctggctgcattatcatcactccaggagcgacattttgtgaagtctctctgtggatcatcgtccttgggatgctgggttggagggcatcactacaacactagtactggtaatggttggaaatggtctgatgattcctctgtttggaacgagactgtctttcttggtgagccattgcatgcctgcagtgatgctgcatgcaaagtagccaccggcagtgatttgtgtactttggtgactaataatggtcgggtttcaattattatggaaaaaaggtgcagtgaggcccatggtctgatttgcatgatgaaccacgtggacagatgctaccatgatca

SEQ ID NO: 2093 - DNA, 534 bp, Sorghum bicolor
  Clone ID: SORBI-28MAY03-CLUS35411_1
gcacgagggaaagcagcagcagcagcagcaccaccaccaccaccaccgcgcggatctgacctccaactccaagcagcagcagagcagagcaggggcaagccatggcggtggacctgatgtcgtcctgcggcggccgggccggggcgtacgagcagctggcgttccaggaggcggccgcggcggggctgcgcagcctggagctgctggcttcgtcgctgtcgtccccgtgcggagcggggcagcgggccgagtcgccgccgctcgggcagatcgcggaccaggccgtgtcccgcttccgccgcgtcatcaacctgctggaccgcacggggcacgcccgcttccgccgcgcgcccgtcgccgcggtggagacggagacgacgctccaggccgcggtggaggagccgcagccgcctcagaagaaggccgccctgacgctggacttcaccaagccggtcccggtcccggcggcggcggcgaccaagccggcagcgccggcgccggcgccggccgtgtccggtacctcgacctcgttcc

SEQ ID NO: 2094 - DNA, 441 bp, Sorghum bicolor
  Clone ID: SORBI-28MAY03-CLUS35434_1
gcacgaggaaaaaacgcggcggtgatggcggcggcgcaagcggaggcggaggaggagctgcggctggagctggaggcggtggcggcggtgtacggggacgacgtacgcgtgctccgcgacctcccgccacacctcgtcgtcgacgtgcggccccgcaccgccgatgactcctcgcagcagtttgtggagctttttcttggaattaaagcatcttcacagtatccgaaggaaccaccacatatttatgctgtggaaagtaagggccttgatgaaaatcgacagatatatcttattaccagcatccagagcaaggcaaaagaactttcaaactacccaatgtttgtgacgttgtgtgaggaagctggagagatcctctcgaatatgaatcatccagctggggattgtccattgtgtctgtatcctttagtgggagaggataag

SEQ ID NO: 2095 - DNA, 678 bp, Sorghum bicolor
  unsure (1)..(678): unsure at all n locations
  Clone ID: SORBI-28MAY03-CLUS35153_1
cgacaggtgtcaataatgattatggtgacatggctggaactcgtgatctaggtanaattactgcagaacagttagcaagacaagcaattaaaaatgtccggaaaagagaaatggatcgcaaggcacaggaaagggcccaacgcgcaagaatccgtcagcacaatgaagatgttctgcgagatgcagctcttgcttcaacttcccattctgcggcagcctatgagcagcctccaggagcacagggtcgacgaggacgccgaggtaaggcaaaggcaccaacgctggcatcaatgctgaaaaagaaagttaccaccaaagacagaattgcagagaggcttctgaacactcgagccacagatgccacaataagggaggtttctcataatgaagatatgagctacagggaagcatttccaaatcagtggtagcagaagcagttagttcttgtataggctgggtaaacacgataggaacgacatcaatgttgtttattggttcataattatcagctaaataatacttattctgttgctacctagatcagcacaaaactgtgaccgtgagtatgttttctgatattctgtttcttgtacagttggcaggataaattcccttgtatatttcnccagtgttcagtctcatgtcttttcgaactgatactacacttgcattacaaag

SEQ ID NO: 2096 - DNA, 669 bp, Sorghum bicolor
  Clone ID: SORBI-28MAY03-CLUS35160_1
tatgcagcagtgacaccatttttgctcccttttgtattgatattctttgggtttgcatacgttgtataccgccaccagataataaatgtgtataatcaagaatacgagagtgcagcagcattttggccaagtgttcatggacgtataatcacagcattgattgtatcacagtttcttctccttggattacttagcacaaaaggcgctgggcacgttcaacacctgtgctccttgttcttcctgtcgtaaccttttatttccacaaatactgcaagaaccgctatgaaccgacttttgtaaaatgtccattgcaggaggcaatgaagaaggataccctagaacgtgccagagagccaggatttgatctcaaaggatacctaatgaatgcctacatccaccctgtgttcaaaggtgatgaggacgatgagaagttctcaatcgctgatgaaccagaaacagagcaagttctggtggcaaccaagcggcagtccaggcggaacacccctgtgcccagtaaatacaatgggtcggaatcaccttcgcttcctgaaattgtaaatgatcaacggctataagatgtctacagttttttcctaatgtatattgagtaaaggatacaataagccttttgaatgctgctagtttatactagtaagcagtgaggccaat

SEQ ID NO: 2097 - DNA, 707 bp, Sorghum bicolor
  Clone ID: SORBI-28MAY03-CLUS35176_1
tcacaagcgcaacgccctcaagttgaggagagaaggaaagactgcagaagcagatgcagaattcgaactggccaaggagctagagagccaacttgaagagccagacaaccaaagttcaagctctgggggcaagtcaagtgaaccaaacgatgcgatagtcgagaatcttcttgatcctcagatcatgtctgccctaagatccattggttggagcgacatggatttatccatgcaatctcctagtgcacaacctcagaaacccatgcagccctcaacttctcaacctcctcaaaaagtggaagcgaagtcatctgtcacagggaccagcaaacctcagagcgagagaagtcaacttgaagaacagatcaaggtggagaaactgaaagcgcttaacttgaagcgggaagggaaacaagcagaggccctggaggcccttcgctcggcaaagcgactggagaagaagttgaactcaacttagctaacaccctcccaaattgctcgtcttctttgtcagttgttcaatttggttacagggttgcagctagaacatagaaccatattgaatcttgtgatcttgtcaccctgtttggcacaacttgtgagctttgagcacataacttatgtcatgtttgtcttgtgtgttatttgagcaggcccttttgtgtatgtgtaaataaaataaaatctgatggtcaacgattcttttc

SEQ ID NO: 2098 - DNA, 1103 bp, Sorghum bicolor
  Clone ID: SORBI-28MAY03-CLUS35467_1
gcacgagggttgaggatgtgttttctagtggcaatcttccaaaagctgcagaaacactggcaactatgagacattgcttgtcagcagttggagaggttgccgagtttgcaaatgttagaaaacaacttgaagtattggaagagaggctagatgaaatggtgcagcctcgtttagtggatgcactttctaatcgcaaggttgatgctgtgcaagaccttcgtggtatactgatacgtatcgataggttcaagtcgctggaggcgcaatacactaagatccatgttaagcctctaaagaaactctgggaagattttgacctaaagcaaaggtccagcagggtagacatggagaagctcagtggcgaaagcattagtggcctctcattctctagctggctgcctaatttctatgatgagacactgctttaccttgaacaagagtggaagtggtgcttgactgctttcccggaagaatacaaatcactagtaccgaaagttcttactgagaccatgagtgagttgaattcaagctttgtctctcggctcgaggtgcaactggggatgttgttcctgaaaccagatctgttgccaaaggtatattggatgttctatcaggtgacttaccaaaaagtaccaagttgcagaataagcatcttcaagcgctaattgaactgcacaatatgactggtacttttgccaggaacattcagcacttattttcagaatcagatcttgcagttgtgctgaatactttgaaagctatttattccccatatgatacattcaaagcaaggtatgggcagatggagcgtgctatactctctgctgagatggcaggcatagacatccgtggggccgtccctcgtggtgttggtgcacaaggtatagagctgagcgaaactgtccgtagaatggaggaatccatcccacaaatgatagtacttcttgaggcagctgtcgagagatgcattagtctgactggtggttcagaggcagatgaactggtactggctcttgatgacgtcatgctgcagtacatatctaatctccaagaaacattgaagtccctgaggatagtctgtggactggatagtgatgccttga

SEQ ID NO: 2099 - DNA, 677 bp, Sorghum bicolor
  Clone ID: SORBI-28MAY03-CLUS35474_1
gcacgaggcaacaacttcggcatcctcctcgggtacgtctccaacttcgccttcgcgcgcctgcccgtgcacctcagctggcgcgccatgttcctggtcggcgccgtgccgcccgtcttcctgggcgtcgccgtcctcgccatgccggagtcgccacgctggctcgtcatgcggggacgcatcgacgacgcgcgccgcgtgctgcagaagacctccgactcccccgccgaggccgaggagcgcctgctcgacatcaagaaggtggtcggcatccccgagggtgtctccgacgccgacgacgtggccgccatcgtccgcgccaacaacaagggctcgcgccacgacggtggtggggtgtggaaggagctgctcatcaacccttcccgccccgtgcgccgcatgctcatggccgggctggggctcatgttcatccggcaggccacgggcgtggactgcgtggtcatgtacagcccgcgggtgttcgagcgggcgggcatcaagtccaagaccaactcgctgggcgcgtccatggcggtcggcgcgtgcaagaccttcttcatacccatctcgacgctgctcctggaccgcatcggccggcggccgctgctgctggcgagcggcggcgggatggccatcttcctcttcacgctggccacgtcgctgcacatgatggaccg

SEQ ID NO: 2100 - DNA, 498 bp, Sorghum bicolor
  Clone ID: SORBI-28MAY03-CLUS35511_1
gcacgaggatttatcctccgatcatcgatttgatgcaagtaaagaggaggttgatcgtgtaacagaatgtggaggtgatgttggaaggctaaatgttgttggtggtgctgagattggcccccttaggtgttggcctggaggtttgtgcctatcaaggtcaatcggagatcaagatgttggtgaatttattgttccagttcctcttgtgaaacaagtaaagctatctactgcgggaggccgacttattattgcaagtgatggtgtttgggatgccttgtctccagaagtagcttttaactgttcacgtgaacttcctccagtgcctgcagctgagcaaatcgttaaaactgctgttcaatcaaaaggactgagggatgataccacctgtattgttgttgatataatagcagaaaaaaaccacccttccatgccacatcctaaaaagcaaccaggaatgggtgtcttcaaaaatatgttcggcaagaaaaaatcatcgga

SEQ ID NO: 2101 - DNA, 903 bp, Sorghum bicolor
  Clone ID: SORBI-28MAY03-CLUS35530_1
ggaatttggccgccgtttgcgttgcgcttgcgttgcgtgggtaggggaaggagtagcaggcggccaggcgcagagccgcaaaagcagacgcggaagcagctcagggcccaagcgagccgaagcggggaggcgacgccgctgcactaccgctcgcctggtcaagcgatttgccgcctcgcgggagccagttttggcgtcggcgtcggcggcggcggcggcggcgttggcggcgagttcccggagaggggttccggtgaccggcgaggatgagcggcggcggcggcggcggcggcggtgggggagccaggggaccgtcggggcccgtgccggcgtccgcgaggaagctcgtgcaggggctcaaggagatcgtcaaccgtcccgacgcggagatctacgcggcgctgcgggagtgcgacatggaccccgacgaggcgggcacccgcctcctctcccaagatacttttcaagaggtaaagagcaagcgtgataagaaaaaggaggttaaagaaaccccagagccaagatctcgaggggcaagtaactcgagtcgatccagtagaggtggcggggaccgtgctggacgcagttcagttcaatctggatccagtgattatatggcttcaaggtcatcaatattggggcctgctgtgccagctacgaatgccatgcagaagccagcagttcctagttcgtccacaaacaaagatgtggttcctaatggatcagttggagcaccacaatcatcatctggttttcagcacaattggtttggggtgccaggtcagatgtcaatggctgatatagtgaaaatgggaagacctcaagtgaggtcttctggcaagcctatggctgcagcaaaacaatctacaagcacagccctaccaactacttttgatcagggct

SEQ ID NO: 2102 - DNA, 574 bp, Sorghum bicolor
  Clone ID: SORBI-28MAY03-CLUS35534_1
gcacgaggggagaaaaggtgcatttgctgtttatttggagccttggcatcctgatatctttgagttccttgatctaaaaaagaaccatggaaaggaggagaatcgtgcaagggatcttttctatgctttgtgggttcctgatctatttatggaaagggtacaacataatgaacagtggtcactattttgccccagtgaagctcctggtctggctgattgctggggtgatgagtttcagaatctgtaccagaaatatgaaagagaaggcaaggcaaagaaagtggttgcagcgcaggccctctggttcgatattttaaaggcacagatagaaactggaactccctatatgctttacaaggatgcttgcaacagaaaaagtaaccaacaaaatcttggcacaattaagtcctccaacttgtgtactgagataattgagtatacaagtccttctgaaactgctgggtgcaatcttgcgtcaattgctttaccacgttttgtgagggaaaagggtgttcctatagaatctcatccagctaagcttgttggtagcagcggatcgaaaaatagatacttt

SEQ ID NO: 2103 - DNA, 681 bp, Sorghum bicolor
  Clone ID: SORBI-28MAY03-CLUS35545_1
ctgtcgaagagcaccttcagggagccttggtcttgcgggtgcgaggcccagcgcgaagaggggtcgctccgcgcctgtgatgctcggttggccctcgcgtctgcgccaaccctcctgtgaagtcctttggtgactgctaaaaccaccatgtcgcaggagcggacattggatgaagttgtttctccatttctaatgcaactggaaagggcaagagttgttcctttgggtccagatgaggatagttcacattcagatattgtacttctgtttgaaaatatcaaaaaagaagcctgcgaagtcaaagatatactcctgcgagtgtctaaatgggaaaatgagataataaatgactttggaggaatagctcgacatttggatgaaatcatagaagaaggcaaccagctcaattcaatacgttccacactccaacttgtaaacactgagatgtccaagttaaaagatcgtatgcaacttcctctccatgttcccatgatcaagccaatagctcccacaaccttgccatcatatgtaccctccaaatgggttcatgcaaaagtttcagagcagtggaaaaggctagaggttgagaggaaaatccttgagagctcaaccatgtctaacttgcaggttagctatgataatcttgatctgcagctgaagttgtgcttgttatgcttctct

SEQ ID NO: 2104 - DNA, 705 bp, Sorghum bicolor
  Clone ID: SORBI-28MAY03-CLUS35572_1
tgaagataagaaggatgaggaagcaaattctcagatcacaccaaagggtaaagtgtcaacttcaaatactcctggtctgagcaagaagaaaggtgtaaaccacaaaaagtcatattcagatgttagttgtacttcatttgcacgacaggcaaatgtattgccatccacatctttaggatcatccaaacagaaggcaaaggttacggatgaagtttttgaggaagtcagctcccagccaacagatataggttctaaggctgtgcgcaatccaaaagataagcttgtgcaagtgaatgcaccagccaagaagcggttatccctcccaaataatgttggcagggaagcagggaagggaccaacccacaggaattcgattaacaggtctggtccaaaagcacaggcagacgctcctaaccagggtggggagcctgttgagttacaggcctgataacacattcctccaatttgcattggtaagccatcctaggtgtgtttctccaggtgtgcatgctacatatgttgtacataacattctcaaacggcatcatgcatctagatctgggctgtgattcatatttctgttgtgtaatgttgtgccttctgccttgtgcggttttttgttccgcatcttcaattttcttgtgttttcaccttccctgtaagttgttctaactgctggaagaaggaactgtgctgtgttgtgct

SEQ ID NO: 2105 - DNA, 898 bp, Sorghum bicolor
  unsure (1)..(898): unsure at all n locations
  Clone ID: SORBI-28MAY03-CLUS35254_1
gcacgagggtactatgagggcctccttgcagcggatggtgaaagagaagacaacaaatgttctgattctccaactacagaatgtgctgatggcaaaccgaaagcatctcaaccattttcttctgaaaaatggaaagggcaaatagagaaggatttgcctagaacatttccaggacaccctgcccttgatgaggatggcagaaatgccttaagacgcttgctcacagcttatgctcgacataatccatcagttggttactgccaagcaatgaacttctttgctggtttgctacttctattgatgaccgcggggaatgcattttgggcattgacaggcattatggatgactattttgatggttacttctctgaagaaatgatcgaatctcaggtggatcagcttgttttagaggagttagtccgagagagattcccaaagttagtaaatcatcttgattaccttggtgtacaagttgcgtgggtcactggtccatggttcctatctatttttatgaacatgcttccctgggaaagtgtgcttcgtgtgtgggatgttcttctctttgagggaaaccgtgtgatgctgttccggacagcccttgcactgatggagttgtatggtcctgcacttgtgacaacaaaagatgctggggatgcagtaacccttttgcagtctttagctggttccacttttgacagtagccagcttgttttaacagcttgcatgggatatcaagctgtaggtgaagcaagactgcaagaattgaggaataaacaccgaccatctgttatctcttncatggaacagagagcaaaaggtcttcgtgtctggagggacaccaacagtcttgcatctaagctatataatttcaagcgtgacactgaaccattggtgtcgt

SEQ ID NO: 2106 - DNA, 629 bp, Sorghum bicolor
  unsure (1)..(629): unsure at all n locations
  Clone ID: SORBI-28MAY03-CLUS3530_1
cgtccgcccacgcgtgcggtgatccaactgggcatatgacatctgcccaagaatggccaggagctggaactatggttgctgcagtaagctgcgtcattacagggagaacccattgttgttggaaaaccttcaggatttttgatggacttcctcttgaaaagcttcaatctggagacgtcaaggatgtgcatggttggtgatagactggacacagacatattatttggccagaacactggttgcaagaccctccttgttttgtctggttgtactagcttaccagaactgcaggatgcttccaataacatccatccagatgtgtacacgaccagcgtgtatgatctagttgggttactgcagaagtaatctcttgcacgcattgcagcgtcagagctctgtcctgactatgttacngcaatctcagtacgctttggatagcgcctattatcaggaattattacgtggatcacttacatgaaaaggtagcagttgtgcttgaacacaagaaatctttntttgggcacctgttctcttgacaatatgcaccaagccagggcagcacagcatattaattgaagtcaattgtagtccttgcattacagattaaaaaaaaaaaaagggcgcgccgc

SEQ ID NO: 2107 - DNA, 863 bp, Sorghum bicolor
  Clone ID: SORBI-28MAY03-CLUS35275_1
gtgtgatggcatcagtgacgaaaagtaccaagaatttcaagctgaccaaaaccttcagtacacatgtgcagcatgccgtggtgaatgctcccagatccgggacactgaggatgcaatccgggagctttggaagaggagagatgttgtcgatcatgaacttatggttactttgcgggctgctgcatgcactaccttctcctgaagatgtgtcaccaccttatccaaactcagatgatgagaaactcggtgcatatgtattgaaaaatgagagtagaaatactctaaagttttcattaaaaagcaacagtagtaagcctccatcagatacacctgagcaagagaagattgtttttaagagccctggatcaaataagaagtcttccaaaaagaaaggtggccgcgcgagggaaacagatgatggccatgatgaaatatttctggagagaaggcatgatgttaaattaccaaatagccgtttgggagatcaaagtatagatggcaatcatgataggagcccttttaagaatgatgataatgcctacatttcatcttcaactcgaagttcagagaagagtttgaaatctccatccaagaaagctgtgccaaacaatgctgatatgatacccaaagtcaagattaaaggcagtaaggtttcaactttgcattacaaagatggtgaagaaaatacccccaagaatgacactggaaaagctaccaagttggttattcatcttggttcgcggcataaaactaggagtggctctcctaagtcagaactgtccaattctcaaagagagcaagatctgggttcaatacatggagggaaagtagatgttacaagccagctgaaaagttcaagaagt

SEQ ID NO: 2108 - DNA, 466 bp, Sorghum bicolor
  Clone ID: SORBI-28MAY03-CLUS35302_1
gcacgagcgcgaggatactccacagataccactcacctaccgctcctcgctcgtccagtccgtccaccaagcagaaaaagctttgcagcatactatctccctttcctttttctcccacctccgtccgcacagcgcgcgcacgcacgcacgcgcagggaggcccgaccgccgcgcgccgggaggaggtccatctctttctctctccgctggatcctccggcctctcgcggcccggtggagcggagatccggccgcgcgggcgtcggctgcttcctcgttgttctgccggagcaagaagctggcatcccgccatgtcgtcgccgatgccctccccgactctgaaggatcatctctccacgcctgcaggccccttgcatctcaaagtatgggaggtcatatgcattgccttgggagctttcatggtgctcgtcttgtttgtcaccgtgtggctcaccatcaggagcaag

SEQ ID NO: 2109 - DNA, 613 bp, Sorghum bicolor
  Clone ID: SORBI-28MAY03-CLUS35599_1
tcttctacgtgatccactcgacgacggccgtgacgttcaacgtggccggcaacctcaaggtggccgtggcggtgctggtgtcgtggatgatcttccggaaccccatctcggccatgaacgccgtcggctgcgctgtcacgctcgtcggctgcaccttctacggctacgtgaggcacctcatctcgcagcatcaggccaccgtggcgaccggcggcggcggcccccgcacgcccagaggccgcttggagatgctgccgctcaccgccgagaagcaaggcgacaagatatagcagcagctgctgctgagtggagatgctgccacagctcttcttgttcttggtcatatcatatcgtcattagtaatagagaaaggaaaggaataaaccaacaagatatacccatctgatctgaatatctgatcgatctaacggcagtttcagtttcagaatccatcgatcatcagagatgccctaatagttgagttttagagaaatggatggaagctgagttggtgtagttgccaattctttttgctcatacacatactagcatcttttctccgtcttttttgggtttgtattgattgatgatgatgataaatttggccatcccg

SEQ ID NO: 2110 - DNA, 591 bp, Sorghum bicolor
  Clone ID: SORBI-28MAY03-CLUS35621_1
agcagcgagtcgctgctgccgatgcaaggcccgaacgtgacgatcgagccgttcgacaggccgggcatggcggtcaccaacggcctcctcgccgtcggccgccctgctggaggccgcgacacgctcttcaacgccgtgccggggctggacggcgcgccgggctccgtgtccctggagctcgccaccaggccggggtgtttcgtggcgacggcccccgcagcgggcgcgaacgccgccacgcaagtcgtctgccggggcagcaagaacaatggcggcagcgcgagcggcgacggcgcggcgctccggcgcgcggcgagctttgtcccgcgccgcgccgctgaggcggtacagcccgctgagcttcccggcgcgcgggacggcgcggaacttcctgctggagccgctgcggagcctgcaggacgagttctataccgtctacttcagcctcgtcgtctccgacgccgggagctgattgatcggtgtgcacgtgagccaactggaggactggatactgatcacgctagtttcgctgtaccattgacgcactgtatcccctatgaacaatgagcaatgagcaatgggagtaaaagg

SEQ ID NO: 2111 - DNA, 598 bp, Sorghum bicolor
  Clone ID: SORBI-28MAY03-CLUS35623_1
tttgacatcgactgtcttcaaaccatcaagggtttggatggaagggagaaaagagctggatctgaaatgcacctgcctaatcttcatcctgaggatgattcagatgcaccacctgcacctgagtactgcatagacgctagttctattggcaattttgccagatttataaatcacagctgccaacctaaccttttcgtccagtgcgtcttgagctcacacaatgatgttaaactggcaaaagtgacgctttttgctgctgacactatacttcctcttcaggagctatcctatgactatggttatcgcttggacagtgttgttgggcctgatggaaaaattgtgaagctgccttgccactgtggtgctcctgattgccggaagcgcctctactagaccctgcagtgtgttctgtttggattttggaggaaacaacttatattgtagggaagcagtcatggtatctatgtagttgacatgctctgatatttagcaaaagaggagcagcttatgatatctccttttagagcattcttaatttgtgagagttagaggacatgctggtcatggtagcgcatattttgcagacaaccaattaacg

SEQ ID NO: 2112 - DNA, 712 bp, Sorghum bicolor
  Clone ID: SORBI-28MAY03-CLUS35630_1
aggtgtttaatgagaactttcttgttgcagatcagaagctaacttatgctttgatgcattgcaattctcaaagcgagtcaaatttgaggagaattttgaagtttcttatccctgtaaagctttcaataggtgtactgccaaaaaggactctcctggagcggtacaatctgcttgagtatgcagatgttgtaactgcacttaagagaggagatctcaggcttctcaggcaagctctagacaggcatgaagaccaatttttgaaatctggcgtctacctagtattggagaaacttgaacttcaagtctatcagagattagttaagaaaatccataacattcagaggcagaaggaaccagccaaggcacatcaaattaagctagatgttgtcgtaagagctctgaaatggcttgaaattgacatggatgtggatgaggtggagtgcatcatggcatgcctcatatacaagaaccttataaagggttactttgctcacaagagcaaggtccttgtcctcagcaaacaagaccccttccccaagttgaacgggaagcctgtttaaacacaattgttgccgagaatcctgtaatccccgtatacagagatggtttccatattgactgaaacgcctgtctgacaaagacatttgtatttaaagcacccctggatgtaacctgtatcaatgtaccattattgcctaatggccttcatttc

SEQ ID NO: 2113 - DNA, 650 bp, Sorghum bicolor
  unsure (1)..(650): unsure at all n locations
  Clone ID: SORBI-28MAY03-CLUS35635_1
ttctagctggctcagcgaggtggatctgatgttttcatatgtgaagaaagcattggagggcaccattgagataagaatattgtcagggtccagttctttttatggaagagtaactgtttgcaccactgatattccaagtcatattctgttgtatgacagtgatgttcatggggcaaataccattggtaatgacagagttctgaagttgctgcggcatgttgtttcagtctctgtcgatcagatgttgatattccatatatatccccgcagtggtgatttgaaccctagaatctttgaatttactccacaaattaaaggcgcagacaaggttgagattacttgtggtggccacaggatgctagtcaaagttacttggtcgatcttgtcagtgaaaagaggatctcttgaggcctcgttcggttgtcccggaacaggctattatgggcctgacactgttcctccgtagtacaaattcctgaaggaaaggttttgctgggaatcaatctcagataaccgaacggagccgaggatgattgcacaaattcacttgtttatcttcatgtattaatatttagactttggtttgtgttagtatccacgttcattgttccgcattctaagaaggcagttattnctatgaagtggtgcta

SEQ ID NO: 2114 - DNA, 689 bp, Sorghum bicolor
  Clone ID: SORBI-28MAY03-CLUS35657_1
atgtaaggcatgtgaatggatcaccaatgaacactgaaactgagagattgcgagtcatccaatgccttgaagcagccattgagcggagggtatcagagggtgtcaagcttgagctgtgcactaatgacaaggtcgggctactgtccgaggtcacccgcatcttccgtgagaacagcctgactgttacaagagcagaggtgaccacgaggggcagcatggctgtgaacacattctacgtccgtggttccacgggagaggatgttgatcagaaggcaatagactccatcaggcaagccataggccacagccttcaggtgaaaggccagcctgagccacaggaggcgcagaagaaagagtcccccacatggttcctctttgccaacttgtttcggccgaggtctctctacagtttcgggttcatgcgctgaccacaacgtcctgattgtttccaagaatcgctgtgtaataagttcatcgttcatgaagcaatccaggaaatgaacatcttcagaaggtggaagccctcattctgccccaatagtgcaggtttggcatataggtagcaaatgggggttgttcatatgtcgtcatcatctgtaaatatgctgattttcactttatgactgcatttgtacatgtaacatgtaaattaaaggacgtaaatataagctgtacagaataggttaaag

SEQ ID NO: 2115 - DNA, 785 bp, Sorghum bicolor
  unsure (1)..(785): unsure at all n locations
  Clone ID: SORBI-28MAY03-CLUS35663_1
gcacgaggcccacctctccaaatctcgcgacggaaaaggccatctggaatcacagggcgcgccagccgccgggagctggagaagagaggaggatatggagccggctgagcgaatcgagtccgggtcggcgctggggaagcggccgcggaccaaggtgctgccgcggacggctagcttggtgacggtgccgtcggcggcgaagcaggggcggcgccaggagcgggcgggcgccggcgtgccgtcgtcctcttcgctgccggccggcggtgccgggataggagccggcggcggtggcggcgccgtgccgagtttctactacggcccattcacgacggtggagacagcggcctttctgaaggcatgcggcctctgcaaccgccgcctcggacccggctacgacaccttcatctacaggggcgaggtggcattctgcagccaagaatgcagggagaagcagatcgagtacgacgagcgcatggaacagacatgctccctgacctccatcaaggaggccccgtccgtggccggcgccagtggctccgaccagtccggcagcggcggggagaccgtggccgccgcctagtccgtgtgcaaggcatggtggagtatgttgttgcgcctttggagcagcaggagcagcgacgccagatcgatcgatcgatcggcccgtagttttcgccatgctagagcgttctgtgcatagtacagctttagctctagtattccggcagtgatgaatgcgtcaatgatttattagtaggtgattgatgcatgtaattntggaa

SEQ ID NO: 2116 - DNA, 1060 bp, Sorghum bicolor
  unsure (1)..(1060): unsure at all n locations
  Clone ID: SORBI-28MAY03-CLUS35436_1
ctgatactctttggtggtgccaccgctcttgagggcaactctgccacgccgccctcgtcggctgggagcgccgggatccgtcttgctggtgccaccgcagatgtccattgttatgatgtgttgtcaaataagtggaccgggcttactccacttggtgaacctccttcaccaagagctgcacatgtagccactgctgttgggaccatggtggtcattcagggtggaattggccctgctggcttatctgctgaggaccttcatgttttggatcttacacaacaacgaccgcgatggcatagagtggtggttcaaggtcctggtcctggtccacggtatggacatgtgatggctttggttgggcagcgattcttattgacaattggtggcaatgatggaaaacggcccctggcagatgtatgggcccttgatactgcggctaagccatatgagtggagaaaacttgagccagaaggtgaagggccaccaccatgcatgtatgcaactgctagtgcccgtgctgatggcctccttttgctttgtggtggaagggatgccaatagtgtgcccctatcaagtgcatatgggctcgctaagcatagagatgggcgttgggagtgggcaattgcacctggtgtgtctccatcacccagataccaacatgcagctgtttttgtcaatgcacggcttcatgtctcaggaggtgctctcgggggtggtcgcatggtagaagactcctcaagcgttgcagtattggacactgctgctggagtttggtgtgataccaaatcagtagttacaactccaaggacaggaagatatagtgcagacgcagcaggcggtgatgcttctgtagagcttacacggcggtgcaggcatgcagctgccgctgttggtgatttgatatttgtttatggaggtttacggggaggtgtgctgctagatgacctcctagttgctgaagatcttgctgctgctgaaacaaccagtgcagctaatcatgcagcagcagctgctgcatccgcaaatgtacaaagagaacctggtagatatgcctacnatg

SEQ ID NO: 2117 - DNA, 591 bp, Sorghum bicolor
  Clone ID: SORBI-28MAY03-CLUS35459_1
gcacgaggcgaggatgcggaggaggagattgcatctatgtcaatgcggagcattagaatggcgtctttgatggctggagagtgggtgcctgagactcaggagaatgaggcagtttttgatgcactgagggaagcacaccggttgcttgtgtcaaagcatttggtcacggtacaggagtggataactgtgcttgtgagggtcaaccttccagacaaccgtttccgagattctgcattgaaggatttcattgatgttaagaatgagataagggctgtgagagatcgttgcaatgaccttggtcttgaccttgataatgttcataggcggaagagtgaccaagaggaagaggacaatgagttttgggtggagggaaacatagaggcaccaaatcgtgccagagtccagagcagtttagatgttgcaagcactagcaaggacaccaggaagggaaagtgtgtggtgggtgcagtgtctgacattggcaaggcaccagttgcagctaatggaacgagaaatcttgacccacaaaaatcagagctctttgctaaagcccctgtgctgccatggagctctgtctttgatcggtggggc

SEQ ID NO: 2118 - DNA, 857 bp, Sorghum bicolor
  Clone ID: SORBI-28MAY03-CLUS35466_1
gcacgaggggagtgctgatcgacgcccccgcctgcgcctgcgcctgcgcctgcgcctgcgctgcgagagaggaggagataaaattcctgccagtgccacactcttcctcttccggcggtgccagtggagaaagcggccgcaagcagggtagggtagggtacgactaggagcagtgcagtgcagcacagtacagtacagcgcagggggtcaccggcgtctcccaccgtcggtcgtgcgtgctcgaccgcctgctgggcttggaggagagggcgccaagacgagcacaaggggaagggggggctcgctcgctcgctcggcggcattcgccgagggatgacggcctgccgtgccgcgccggcggttaattaggccgaccacaaccggcgcgggccggcttcgcttcgcttcgctcctccaagattgctgtgtctcttgttcctgtcaccgcaccgcaccgagataaattcaattggatttcctcccaaactatttaagggacaactatggctactatccaagatataggactctctgcagctatcaacatactgggtgctgtagtgttcctacttgcatttgctttccttcggctgcagccaatcaatgatagggtttacttcccaaaatggtacctcaaaggcgcaagagagagtccaagtcatgggggtacatttgtccggaaatttgtcaatttggacatgcgttcatacttgaaattcttaagttggatgcctgctgctctcaaaatgcccgaggatgagttgattagccattcaggtctggattcagctgtgtatctgaggatttacttggttggacttaaaatatttgctccaatctcagttctagctttcatt

SEQ ID NO: 2119 - DNA, 566 bp, Sorghum bicolor
  Clone ID: SORBI-28MAY03-CLUS35807_1
gtactaattaatgggttgcagcacatcgtatcatcaaatgtaaggccgaagctgcaaactgtggacactttcataaaggcttactatttaccggagactgagtacgttcactgggcacggtctcatccagaatacagcaaaagtcaggtagtcgggttagttaacctggtggccaccatgaaagggtggaaacggaagacgagactagaaacagtggagaagattgaggcagggccatagactcattcgatgggaggaggtttttgcggtgattgtttttcttctgtttcttcagctgcacataggagttgtattttttttttctccttttctttcaccttagaatcaattttgtcgattctttctttcaccctcaggccattctcttgctaacaccatcaaggccatcatcacccgcccatccatggtgtgtgtatgtatatttaagcgttgaccctgtattatatgaagcgagtggggcgggttgacgacactcgccaaaaggaaaagatctgtacacctacagggaacattgattggctcagtaataaatacgaatcgttctt

SEQ ID NO: 2120 - DNA, 666 bp, Sorghum bicolor
  Clone ID: SORBI-28MAY03-CLUS35827_1
caacttggtgggatacttgctggactggtttacctttggctgaagcgtgcattcaatggaccagatccgatcactctcctcatttcaagcattgccaatgtcgtgacctggccagtgaggtttgctcagaatcttctacggtctgctcgctcacagggccgcgctacaggtcggggcagggttggacgccgcatatcagcaagagatagccctcgaggtttttggagatgcccaacctgcacatatgacaattcagtttccacagatatctgtgagatgtgcagcactgcacgagaggaccatgctttttcgcggagacagcatcatcaagccagaggtaacgcggaactctcggttgacgagatacgccgtaggaggctgcaaagattcgacagatgatgtaaatcattgttatcagtatagacattatgtgctgctgaacacagttgaagtatgacagttccattcctctgtttgatggtttaggcacatttgtcccttctcatgatgatgaatgctttactttacataattgaattttttttcattatttgaaggagactgctactgatatagcattatcctgtagattgtttcaaaaccttggaagcaagtcgttagtgcctaattttgtataaattatgccagggcatgtgaattcaaagt

SEQ ID NO: 2121 - DNA, 661 bp, Sorghum bicolor
  Clone ID: SORBI-28MAY03-CLUS35830_1
attcttttagcagaatattaccctgctttttcccattgttggttgatctgatccgctgtgaacatagctctggagaagttcaacatgcactctacaatatcttccaatcaacccttctccccatgatacgagtttgatagcagattgtgacccaccaattgtacagttttgtgaccccactttggtgatgtaattcagttcatatggcatcaccccactatgaggggttatacctataggttgacgtaaaaaatgctgcagggtctgccattcagctgaaggtctatggagcatctttgttaatattcatttaatcaatcatgctcttttcatgtgctggggacaggcagaaatacacacgggtatggaatcatagcctatgcacccaggcaattttccatgacccaaaagtcaggtgacctcggcttcctcaggcccaatgttaccattgtccattgtcatcccacgatcgagtttatatatagcaccagagctaagaaccgttttgaagttactactggctttcacagtcgattcttttttcttttgttacaaaaccataaactagaggtagatgccacctaaataccattgtcaattttgctcttctttttttctttgagttgtatgtagtatttttatccatagaaacaccgaatag

SEQ ID NO: 2122 - DNA, 638 bp, Sorghum bicolor
  unsure (1)..(638): unsure at all n locations
  Clone ID: SORBI-28MAY03-CLUS35865_1
cctactggaccgccgatctgctcctcctggccctcctccgtgcgctgagcaggcatgaggctcctcctcgtcggcgccctgctcctctgtgccgccgcggcggtggagtccaagccgcccctcgacaccctgggcatacccccgcaagatgaggcgtactacagaggcggcgtgatcaaatgcagggacggatcgggcaggttctcccgagaccagctcaacgacgacttctgcgactgccccgacggcaccgacgagcccgggacatctgcgtgccctgaggcaaaattctactgcaagaatgcaggccacactccagtcaccatcttctcatcacgagtgaatgacggcatttgtgattgctgtgatgggagtgatgaatatgacagcaatgtcacctgtaagaacacttgctgggaggctggcaaggcgcccagggagaaattgaagaagaaagtcgctacatacaaaaatggtgttgttattcggaaacaggaagttgaaagggcaaaagaggcttttgctaaagacgaatcggagttagcaaaattgaagggtgaggagaaaatactgcaaggacttgtcgacnaactcaaagaacaaaagagattaatagagaaggcagaggaagaagagcg

SEQ ID NO: 2123 - DNA, 646 bp, Sorghum bicolor
  unsure (1)..(646): unsure at all n locations
  Clone ID: SORBI-28MAY03-CLUS3586_1
ggaagacagcgagaaacgggggcgaccttcccaacagcagcaaagcgaccgagctacctccccgtcgtttccggctctcctctctcctcccctctgcccgtctcccgcgcccgcggcccagccggctcctcctcgctcggagtcggagtcggagccagcaggaggcatcgcgacgtctcgcgccatgcgggatcgcgatctgctagggtttcctccggcggcgggcgcggccatgtcgtcggccgcggcgctcctcctcctcccactcctcgccgccgcgggcgagggggcgccggtctcgcgtccggcgccgccgcccgccgccgccgtcatcctgcggcacgcgtccacctcctgtcggacggtggacgccctggggctccggggccaccgcgccggcgtcgtcgagggggatgatggggcgctgcanaaggcagtagcacttgtgctgcagaacaaggaagattttgtcgctattcttttttatgcttgcgggtgtcctgtttctaaaattttctggacagattttcaaaagctgtcatccttttttccaacaattgctcatttttcttttgaagaatctaatatcaaaccaaggtgcgtctttctaaaagagataaacaactgcagctagattttactatac

SEQ ID NO: 2124 - DNA, 934 bp, Sorghum bicolor
  Clone ID: SORBI-28MAY03-CLUS35881_1
ccggccgttttcccgagccgccggccacaagaccactgccgccgccgacgccgacgccgacgcgaagaccgaccgcaggtccgcagcaagcactcgcggatactactactgcctccgtcccccgctgcacccgctgcttttcgtctccgcgcagtcgtccgatggccaagcggctcgctgccgccgagaaagaggtgctcgtcgaggtggtgcggttcacgcagaagaacggcctcagaggctgtgacggcgggtggaaggatttccttgcccggaacgacaggaagtttggcgcgtcggtgagcgaccccaggaaacgcaccgcgcgtgggctgcccgcgttccggctatcctcctcccggcgctgcctgcagtacttcggcaaattggtgaagcgtcataaggaaagaagtgatgttcagcagtatatgactgatttccctgatgaagtttctcccgagcagaaacttgttcaactgacggcagagcacccggagtacagaaaacactactgctccccatcataccaggaggggtggaaagtattgaggataggagaagtctctagtttaatgagctcaagtgctatgttggcaattgactgtgagatggtcctttgcagtgatggcacagaggctgtggtcagagtatgtgttgtagatgacaagctcaaggctaagctggacatacttgtaaacccctcaaaagctattgctgactacagaacagacatcactggtgtatctaagaatgatttagaaggagtcacatcatcattagttgatgttcagaaatcgctgaagagaatgttatcgaaaggaaatattttgattggccatagcttgcatagagatttatgcgtcttaaagcttgattactctcaagttattgatacagcatacatatttaagtatgcaaatttacctactactgc

SEQ ID NO: 2125 - DNA, 527 bp, Sorghum bicolor
  Clone ID: SORBI-28MAY03-CLUS3556_1
cgtgcgcacatactcgttcaccacattactgcaacaacagtgaagaaaaagcatcaacatgtgagttaaaatctgcccaggatcgatttgatcaatataatggagttatcacgaagaccaattggatgtgtgccatgagagaaaaaggagactgaagaaagatgagaagattttgactgattgatgtatgaatatgcagcaactcaaaagctgcagccttgaaaagacggtagcttgatgctatggatgcatctgggagcagaaccagaatccagtcacatgctatacatattcggttcttgtgatgtatggatagctccatctttcaaaaaaaaaaaaaatgcatggatagctctggatcagccgtacatgaaactttggtgtgaccaattttccaatgggcaaatgggttttttcgacaggattgggcatgctttttcgactgctccatggatagacccatcagtgcttggtatcactcatcacttgcccttgcactacacccctcctgggacatctcattcatc

SEQ ID NO: 2126 - DNA, 1082 bp, Sorghum bicolor
  Clone ID: SORBI-28MAY03-CLUS35579_1
agaagaaggagaaccacatgattgcttaaaggatgcagaagctgcgatgaatctagttcttgtaaaacttaagaatgggtttaatgaccccattggaattgctgcaagcagtgtaattgaatctgatgtggtgaagttgcttgctcatagaattccagtgtacctgccttgccaagagctgtgcaaaattttctctgggaaccccaacattgatgacaagattgattcgcgaatacgaggtgaattttattccacgtgtatttcattcaatgacgtagatgaggtagagaaggcatttgaagaactggatggccaaaagactaaggactcaggtgggagacttcaaaagcatgtagtgctgaagcgtgacaatggagatgtcgtaagcttctacgttcggaagatggtatacggttcctggcccaaacagctcgaagttccaaagaatagaccagagcctacggaggatccagagccaaagaaagagcatgccgagggagttcagcaaaaaaaagaagagaaataacttcgtgagagataatgaggatccagagccaaagaggagaccagagcctactttggatccagagccaaagaaagatcatgccgagggggttcagcaaaagaagaagagaagtaaaaaacacacagacaaggaaaatgcgtcggtggtgtaatgaataacttcgtgagagatactgagatattcctgttacttatgaatgcagagagattggcgatgctgtactctttgagaaggtcattttgaggtgtttgatcatggctttgggaaacccctttgaagaagggctgttctgggcttctgagttctgaccatggggaacctttctcctttaccatatagcatgccagtttacctcatctccagtgcttagttgctgctctgctctggttacgtgtttctgctacattgctagtcgtccacttactgtctgctagtgttaatttgcttattgcattacactgacggagttgagtttgaggttcagaaggtaggatattgttagggaattttgtttgaacagatttgactgctattttgtacttttgtggtaaggatt

SEQ ID NO: 2127 - DNA, 665 bp, Sorghum bicolor
  Clone ID: SORBI-28MAY03-CLUS35589_1
cgctgctggtacgattgcagaggtcacgattcagcactacaagcaggaatctgctaggctgaggcagcagatcactaacttgcagaactccaacagcccccaatgtttcagggccctgataggtgatatcacaaccatgagccccaaggacctcaaacacctggagactaggttagacaaagcacttggaaagattagagcaagaaagaacgaagtgctgtgttctgaactagagtacatgcagagaagggaaatggagttgcagaatgacaacttgtacttaaggagcagggttgatgagaatgaaagggcacaacagacagtgaacatgatgggggcgccatcgacaagtgattatcagcagcagggttttattccttatgacccaataaggagcttcctgcagttcaacatcatgcagcagcctcagttttactcccagcaggaggaccggaaagacttcaacctaggtggaagatagataatgaacctctggagcttcagttatccgatatgatgtgcctcaagtgagaaactggagctacattattagtgtgaaattatatgtaagattagtactactgcttcatgtgtgtgcgcacacgcctacatagtatgcacaatttcatccaactatataaggcttggcactatgtgatatgtaa

SEQ ID NO: 2128 - DNA, 559 bp, Sorghum bicolor
  Clone ID: SORBI-28MAY03-CLUS35919_1
gcacgaggatcatccagtacataccgagcaccttcgattggaaagccacaggcctcactgtcaatcagcaggccaaacccctgttatcaacagacccctttttcaaagtttcgctcaccttttctgcaaagggagatgcccaactagcaaaggttagtgtcaggatcccgtcatggacatcaactgatggcacaacggcaactctgaatggccagaagctcaacctgacatccactggcaactcgactaatggtggtttcctgacggtgaccaagctctgggccgaagataccttgaccctccaatttcccattacccttaggactgaggcaatcaaagatgaccggccggagtacgcgtccatccaagcggtgctgttcgggccgcatctcctcgccggcctgacacacggcaagctgccagtgaccgacagcaaccactccaacgacggcctgaccccgagcatctgggaagtgaacgccacaagcgccaccgccgtcaccgactgggtcactccgctcccctccgagacgctcaactcacagctcgtcaccctgac

SEQ ID NO: 2129 - DNA, 649 bp, Sorghum bicolor
  Clone ID: SORBI-28MAY03-CLUS35933_1
aagctacgggcggcggcgcgtgcccttcgccctgggggcctcccccggcccagggctgatggcagccgaagattgcgatgggcttcccatgtacatcgaggaggatgaagaggaggcagcagcggagaagcagaagcgtcggcagcagagccagaaaccgccgtttaagtattcgtgggagatcgatacgccggaggaaaatgcgagatgggagctcagacggaccatgatgaacaagcttttcgagtttgaccctaagacgggatcccgctcgtacacccaagtttggttcgtcaacctcatcaccttcaaccttgatgatgaaacacaatatggaccgatgcgctttacagattcacttatcggaggtgaccacatgttgaccgactctttaaatgttctttgtctgaagataaggtcttcggatgttggttaccctatcaatgtgtatgggactgtgatagtcagagaccgtttggatatgaaatgcaactacatcttcaagcgcaacaggaacaattgccaacttgttgagtcagagggtgaatctttgattctgactggcccaaccagaggtattgttcttagcactgatgcttattttgagataaatctgaagatcaagcaggatagagagagcgaggacaga

SEQ ID NO: 2130 - DNA, 658 bp, Sorghum bicolor
  Clone ID: SORBI-28MAY03-CLUS35953_1
gcacgaggcatccccaagcgcctcgccgcaatgcagcatctgggcgtgctcctcgtcttggctgcactcaccgcgtcgccgctcgctgcggcgtggcgcccgtggccgccgcgcgccaacgggacgacggcggggctgggcgcttcaaagaagttcgcgcgcgcgtcggagttcgtgaagctagagtaccacatgggtcccgtcctggcgtccgccatcacggtgcacccgatctggtatggcgcctggcccgccgcgcagaagcgcacgatccgcgcgttcctccgctccctcgcgccaccgcccgactcgtcggcccgcatccctcctccgtcggtctccgcctggtggcgcacggtgcggctctacacggaccagacctccgccaacgtgtcggcggccgtgaccctgggcgcggagaagtgcgacgcgcgcatgtcccgcggcgcgcgtctctcccggatggacatccagtccgtggtccgcgacgcggtcacggcgcgcacccgcccgctccccgtcgactccagcggcggcgtgtacctggtgctcacctccccggacgtctccgtggaggacttctgcgggcaggtgtgcggcttccactacttcacgtttccgtcggtggtcggctacacgctgccctacgcgtgggtcg

SEQ ID NO: 2131 - DNA, 680 bp, Sorghum bicolor
  Clone ID: SORBI-28MAY03-CLUS35940_1
gcacgaggataagattaatacttcaagttgctgagttgagaaagagatgcttgaatcaaaagaattccttttttgaagttcaatttttatcagaggacaatatgaatattacaccatgttccattaaaacactcaaggggttatatgatatatcgggtgtagaagtaggccaacacttctattggcaaatagggggtttccaaattcatgcccaagtactcatcacttcttggttcgtaattactattttgctaggttcagttatcatagctgttcggaatccacaaaccatcccgaccgatggtcagaatttcttcgaatatgtccttgagtttattcgagacttgagcaaaactcagattggagaagaatatggtccctgggttccctttattggaactatgttcctttttatttttgtttcgaattggtcaggcgctcttttaccttggaaaattatagagttaccccatggggaattagcagcgcccacgaatgatataaatactactgttgctttagctttactaacatcagcggcatatttttatgcgggtcttagcaaaaaaaggattgagttatttcgaaaaatatattaaaccaaccccaatccttttacctattaacatcctagaagatttcacaaaaccgttatcacttagttttcgacttttcggaaa

SEQ ID NO: 2132 - DNA, 757 bp, Sorghum bicolor
  Clone ID: SORBI-28MAY03-CLUS35961_1
caagacccaggagtagtgttgagagtggcaggtcaagaaggcaagacggaagagccagccaaccgaaggatcaacaacgctgcatcacgccgagaccggcacggcaggctccgtttctacatatacttgtggtctgcgcggaggggcggtcgtcagttagagcattgcttccgtgtggtgtggtgtggtgtggctggtagctcggctcgtctttgagcagagcagagcagagagagaaagggagggagccagcagcacccggcagcagcgatggcgggcggcgggatggcggcgctgggcgtgaagacggagcgcgcggcgcagtacaagggccgcatgacgctggccgtcgccatgacctgcctcgtcgccgccgtcgggggcgccatcttcggctacgacatcggcatctccggaggagtgacatccatggacccatttctggagaaattcttcccggtggtgttccacaggaagaactccggcgggaagaacaactactgcaagtacgacaaccaggggctggcggcgttcacctcctcgctctacctcgccggcctcgtggcctccctggtggcgtcccccgtgactcggaactacggccgcaaagccagcatcgtctgcggcggcgtcagcttcctgatcggcgcggcgctcaacgtggccgccgtgaacctggccatgctcatcctcgggcgcatcatgctgggcgtcggcatcggtttcggcaaccaggccgtgccgctgtacctgtcgg

SEQ ID NO: 2133 - DNA, 766 bp, Sorghum bicolor
  Clone ID: SORBI-28MAY03-CLUS35972_1
gacaagtccagacatacccttcccatttctcgcggcggccacggcccgcggccacgccgtagatctcctccttgtcccagggctccggctgtctcgccggcggtgagccgaagtgatggagctctggagcaagctgcggaacctggatgcctacccgaaagtgaacgaggacttttacagccgcaccctctccggcggcctcatcaccatcctctcctccctcgccatcctcctcctcttcttctccgagatccggctttatctatattctgctacggaaagtaagctcactgttgatacctcgagaggagaaagactacatatcaattttgatgttacgttcccggcccttccttgttctctagttgctgttgatacgatggatgtcagtggagagcaacattatgatatacgacatgacataacaaagaaaagaattgatcatcttggcaatgtaattgaatcaagaaaagacagagttggtgcccctaagattgaaagaccgttacagaagcatggaggtaggcttgaccacaacgaggtttactgtggatcttgttatggtgctgaggggacggatgatcagtgttgcaactcctgtgaagaagttcgtgatgcgtaccggaagaaagggtgggctatcaacaacgtagaattaattgatcagtgcaagagagagggctatgtacaaaggttgaaagatgaaacaggggaaggttgtaccatccatggatttgtaaatgtgaataaagtagctggcaacttt

SEQ ID NO: 2134 - DNA, 625 bp, Sorghum bicolor
  Clone ID: SORBI-28MAY03-CLUS36009_1
gcacgacgacgaaacggcgagctcgtcgcgaaggaaaaaaaaaaccacgagtacgtgttcgaccactccatgcccgcctctacaccacggtcaatggcgatccccggagagctcgacggcggcggcggcgctgctgcgcacgtcatgttcatcccaagcgccgggatggcacacctcgtccccttcttccgcttcatcacggcactctcgagccacggcgtccgctgctccgtcatgaccgtcctcccgacagtctccgacgccgaggccgaccacttcgcggcgctgttcgcggcgctcccaagcatccagcgcgtcgacttcaacctcctgccgctggacgcctccgccttcccgggcaccgacccgttcctgctccggtgggaggcactgcgccgctcggcgcacctcctcgaccggctcatcgccggcgcttacccgcgcgtctcggccgtcgtcaccgacgtgaccctcgcctcccacgtgatcccagtcgccaagcagctgcagctgccatgccacgtcctgtacatctcgagcgccaccatgctctccctcgtcgcctacttccccatccacctcgacaagaagcaggacgacgacgacgcaggtgccggcggcggcg

SEQ ID NO: 2135 - DNA, 691 bp, Sorghum bicolor
  unsure (1)..(691): unsure at all n locations
  Clone ID: SORBI-28MAY03-CLUS35710_1
ttgttctagatgcaccccatgaagactacatcacatttttgtgctcgatccctgacgtcaatcagagcgaagtatcaaacatagcgggttcagcttgcaactccaactccaagggacaacgcccttttgacctcaacatcccctcaattgccatctctcagcttcgaggcacggtgacagtgaagcggaccgtcacaagcgtgtctgacgaaactgagacctacaccatgatgacaagaatgccgccagaggttgccctggaggtgacgcctccggcggtgaccgtgctccctggagcatcaagagagataactgtgtccctgacagctaggtctgttacgggcacctacagtttcggtgagattgccatgaaaggtgaccgtggtcacctcgtcagaatcccagtggtagctatgggattcaagtagatagaagatgctgtgacaggcgctagagagtagagaataggagagcgagttgtggctctgaaatccgaggccttgagctgcagaggaatgctgtaattttttcnatagcctgtagagaataagagttagctcagtgctgtacctgtacgtgttatgcatgccctccaggttgtaaaatatatatttgggtgttgaagcctatgtgacatgatgaccagagtccagagagggcatccctcctctaatgcatggaaattgaatct

SEQ ID NO: 2136 - DNA, 814 bp, Sorghum bicolor
  unsure (1)..(814): unsure at all n locations
  Clone ID: SORBI-28MAY03-CLUS35716_1
ctctctcagtctctctggtgctctgttgtagaaagcctgccacaaggctcatcaagctccacagccattccggccatcgtcgtccccgctctctagggctagggcgagatcatccatggctgacaaggctgctccgcttccgctgaccgccgtgtccgtggagaaggaggaggaggaggaccagcagatcaagaagaagcatgtgctcgcggatcctccgccgttcctccccgccggtgtccgacatgtcatcatctgggcgcttttcaacgccggctgcttcgccttctccatcgcctacgtcctcgtcgtcaccagcatcagccagctgccgtcgtggctgctgccgccgcgcaccggccccgagcccgaggagatgacggacggcgcggtcgacgccgccgtcgtggcctgggtgctgtggtgcgtgtgcgtcgtgtcccaggcggccgccggggcgctggcggcgctgctggagcttccacggcaccggcgacttgtccttgcctacgcggcgctcgtggccaccgccgccggccactgcttgtgggctggactgcacttcttgttcgtcgtcgccggcaacccgggagggctcagcttctggaccggcgtcaacaccgcggccatcttcatctccggggtggtcgacatcatctgcttccgaggcctcatcctcggtggaggggaggagaaggagtaggggcggcgatggtaacgatacgccgagctatatatctactgtgacatccatgcacactgcatgaacacgtacgtgtgtgcatccctnctggtattagtacggttattaata

SEQ ID NO: 2137 - DNA, 845 bp, Sorghum bicolor
  Clone ID: SORBI-28MAY03-CLUS35756_1
gcacgagggagaccagagacgagaccgcgcaagatcgccggagatggagccgagagctgcaatccacagatccggcgccctcctactcctcgccgccatcctcgcggcggccgtcacctccgcatccgccatcggtgacaagtgcgccgcctgcaaggccgttgctgcagagctagagattggaattgccagtgagaagccgagaaatcacttggacttgcgcaaccgcttaaattctaaaggtcagagggaggggaaggtcattgattacagggtcagtgagcttcgggttgtagaacttctagatggcctatgtgataagatgcaagattataccttaaagaagttggaatcaggcgaaaaaggatgggttaaagtaacagactggaatagctttcaagctgaaaagaaggcagcagcacgagcgcattcgaaaaatttgtccaccttctgtggaaggctactggaggaaactgaggatgagctcgctgagtggataaaaacaagctctacagaatcagaaaatgtaagcaaggccctttgtgaagatattagcaaacactgtcaatccacaagtgctaccatccagatagatgatgaactatgacatgctgagcagaccgttgtttggcaaagcaaaacaggcaacaggctaggaaatgtcaaagaacaaaaaagctctaattgtccctgacaccatttagagaggacatgaagctgccaattctgattgtttgtgtttcacttgtatttcttgtaaacgggacatgtaattcgtgcctgatctgtagagaaagcaactggacatcaaatttgaatactgatgaactacagttaaaaacggc

SEQ ID NO: 2138 - DNA, 672 bp, Sorghum bicolor
  Clone ID: SORBI-28MAY03-CLUS35792_1
aatctattctggtcactggaaaaggttgcccataatgtgactgctaagacttatcaacaaatagatgccagagcaaagggcagatttgatggtgtagcaccagaaccacggaaaggagtaagaagtggacatataccaggaagcatatgtgttccattccctgagatgttcgatggtgcaccaagccttctctctgcagatgagctgcggcaaaagtttcagcaagcaggaatttccctagatcaacccatcgtcgtcacttgcggatctggcgtgactgcctgcatacttgctctggggctctacaggattggaagacatgatgttccagtttatgatggatctttgacagaatgggaggcacaatcagattccgattacccaaaaatcactgctcctgcttgttaagctcaccagctctgaaaagattaattcagtttgagcatcttggaccattcagtttagatcgtcagcaagaggatattatgttgtaacaagctttgcactaaataaatgccaatcttatatggatgagaaatgtgcaatatgtgttatgttgtcctgtcgcaaaaagagatgaaagggaacaagtaaaacaggccttctcaactgatttgattcaatattgtaaacattttatttcccatacagattagtcccatgctcccgggt

SEQ ID NO: 2139 - DNA, 565 bp, Sorghum bicolor
  Clone ID: SORBI-28MAY03-CLUS36056_1
gcacgaggcccacgcaggataggtaagtgcgcgcgcacgaaaaaagctcgcaatccgcgaggatcaaggagagcttcagaacgaaagaggaagaggacaagtagctagcggcggctctgcgggagcggcgatgatggcggccgaggtggtgtggctgctgctcttgctcgctcacgagctcctgccgtgcccctgcgcggcctcggccgttgaccgcggccagttccctgacagcttcctgttcgggacctccacctccgcataccagattgaaggcgcatatttggagggtcacagaggcctcagcacttgggatgtattctcccataagctacgtacaatcgaggatggaagcaacggtgagactactgctgatcactatcatcattacttggaagacattgaattgatgcattccttgggtgtcaactcataccggttctctatacgtggacaagaattctaccaattacttcttgttgcaggaggccaattcggacatgttaacctggatggcatagcattctacaatgatctgattgatgcacttctgcaaaaaggcata

SEQ ID NO: 2140 - DNA, 601 bp, Sorghum bicolor
  Clone ID: SORBI-28MAY03-CLUS36066_1
gcacgaggcataaatgtgatgtccgaagtgggcattaaaaatgataattgtttccaatctgaaaagtggcaggatatttccattcaatcaggtgcgcacgcggctgaagctgcaagcaacttttcagcaccactttacccattgcagacagctgaaccagtaacaatgatgggtggccctgtgtattatcagagttctgtaacgtcattaccaccggacttcatttcttcagatggtgcttctaatgcatctggtgtcaaatttgagacaaatcacaatcctgtttctcgccaaggtttggagattaaaacttgccacaatccttccggtgatcctgatcaaaattcatatatgtgcagcgaagatgacagaaacaggacttctgaaccaatggacagcataccagaatctgaaaaggaacagcaggttgatgttgaacagtcatgtttggagcctgcagcctacagttttaacgaaccattatcaagtcatggtgacaccatattaaatgaaaaggaggatgctggagctctatgctatgaacctccttgctttccaagttttgaagttccttttgtcagctgtgagcttgtaaactcca

SEQ ID NO: 2141 - DNA, 698 bp, Sorghum bicolor
  Clone ID: SORBI-28MAY03-CLUS36096_1
caaccctgatgctagtacatcagaaacgggttctccattctatcagcttagaacagatgctacaaaacttgttgcgcaaacatttcaaagaggtcgaagaaatctttggcagctggcaacaagtcgcttgtctgttttattatctagttcagctgtttgttcaactagcacataccaattcctgaagaattatgaagatctcgtcattttcattttggccggcgaagcattttgtgggtttgaagctagtgagttccgccagaagctgaagactgtctgtttgaactacatggtgtcctttcaccggcaaaatatatatgcacttaagatggtactggaaaaggaatcttggacaataatgtctgccgaagcttcacaaataattagtttagcaggtctaactggtgatggtgctgcactgtgctctcctaccagtagaagtctcaagttgccaataaattgttaccatgggaattcaactacagccaactcaggaaacgaaaagctcggatttgctgcttggcttgagattgaaaatccattttcttttaagctagaaaatggatctgccgaatccccaaagtccaatatgctttttgactcatcagttagcaataatcatggcaatggaaaaaattcatcttttgatgaagagaatgaagaccttctagcggatttcattgatgaagatagtcagt

SEQ ID NO: 2142 - DNA, 679 bp, Sorghum bicolor
  unsure (1)..(679): unsure at all n locations
  Clone ID: SORBI-28MAY03-CLUS361_1
gggggatctatctagacctcactcattctacgggggagcggtgttggttgcaatctgcagcgacaattcctcggcggtgctagtcgaatccgtgctcgcttgctcgtttaaatcccgagctgctctctcccgcctgagggaggaccggtcgtccccatggcggggatcctggcgtgggcggggcggggggggcggcggggcaggcggcagcgacgacgaggccgacgacgacgcgcgcgccgcggcgtcggccgccatgaccccggcccagcggctccgcgccgccgacctggacgcgcgggcggcctcgctgcgccgctccatccaggacctccgcctccgggtgcccccgccgcacgtcgcgcagcggctgccccacctccacgcccactccctcgcgtcctccgccgcgctcgcgctccagctcaacgcacactcctccaccaaggagcagacccagcaaagagaagtaactctccaagaagaaaatgcagcctatgagaaagctatatcagagtgtaaacacaaaattcaggaaaaacagatggaggccagtcagcttcagagtaatctggaggaaatggaagtaacggagcataatttaaagacacangcttgaaaaatgctctgaaggagcangaaagctgctcaacataaagcatcaacagcagcctctgga

SEQ ID NO: 2143 - DNA, 590 bp, Sorghum bicolor
  Clone ID: SORBI-28MAY03-CLUS36118_1
gcacgagggccaatctcaatgctattgcatttctacgatactgtgctgttaaacttgctgaggaaggatttgtttgtcaagatacggcttttgaacaacccaggaattcagccgttatgtgtggtggaaatgccactgtgcaaaaagatggtcatatttccctctgggagcctctccttgcaggtttggctaaattgacaactgatccaagactgactatcaagaaaggtgctgtaggagtactttttgacattttaaaggatcacggacacctgttttcgctgactttttggactgatatcttcgaacgtgttgtttaccctctatttagcaatgaaaggaccacaagcagtgaccagatttcaacatcaaattccgttgagtataatttacctgatcttgaaacacaaacatttgcagtgaaatgcttggtgggtttgtttgttaatttctttgatgtgatacggccagaacttggtagaacagcatccattgttacatttttcatcagaagcccctacaaacattgtgctactattggtgtatctgcaattatgcgtttggcagagggggttggtaacaaacttacc

SEQ ID NO: 2144 - DNA, 609 bp, Sorghum bicolor
  Clone ID: SORBI-28MAY03-CLUS36135_1
gcacgaggtctagatcaactagcaagccaattgagactgaaggtgctcctcttgttgatgaagatgcccttaaagctcttattcggttacttcgagttgttcagcctctatacaagggtcagctgcagaggcttcttgtgaacctttgtactcatcgggatagcagacaggccttggttcgaattctggtggacatgcttatgcttgatctgcagggcttttcaaagaaatcaatagatgcacctgagtcaccctttaggttgtatggatgccatgcaaatatcacatattcacgtcctcaatcttcagatggtgttcctccattagtctcacgtcgtgtgcttgaaacgctgacaaacttggcaagaagccatccaagtgttgctaaactcttgctctttcttgaattcccttgcccatcaagatgtcgcccagaagcacatgatcataggcgcggcaaggctcttctcctagaagatggtgaagaacggaaagcctttgcgcttgttcttctgttaactctgttgaatcagccactttatatgagaagtgtagctcatcttgaacagttactaaaccttcttgaagttgtcatgcataacgctgaga

SEQ ID NO: 2145 - DNA, 662 bp, Sorghum bicolor
  Clone ID: SORBI-28MAY03-CLUS36165_1
gtgcaagagataaagtaccctggaaaagtgactcatgtatgagagggaaacatgcaaatagtctgatagtgaaacaagcagtgctcggtcgtcagggtcattggcttatcaatatcggttgatgacacccctacccaacttgggaaccaatagcttgtcacctccacctttgagttcggcctccagttctggctctgcagcacatacaccgaacagtatgcatttttcagttgcataccatcagcctagtcctttgccaaagcctaatggaaaggaagcaataaatttgatttcacattgaataacagcatgccacctatcacaacatctgggccaaaagccacatataaacagtgcgagtgtatccatccctaacatctgatccttgtactgcaagtcatagctgacaattttctgggtcttgtaaaaatattttccatgtaaagagatcaccacggtatgatcacagggagccttgtgaagtctgttgtactgtttgatttctgggaactgattgcatttcaccatgtaacatatttattagggtgtagctgtagggaaaactaatggtcctgattgtgccgacaaataggacattagggttgtagctgtagcatgttgttgttgatgttgtgtaatgatcatacttgatgtaatcatta

SEQ ID NO: 2146 - DNA, 549 bp, Sorghum bicolor
  Clone ID: SORBI-28MAY03-CLUS35889_1
gcacgaggaaaaccacccgcagcagcaaaccctcgctccgccgccgccgccgccggcttcggagttcgcccaagcaagcgccatgccgccgcctcgtcctccaccgccgctggtggatgatctcgtggaggaggtgctcctccgcttcccgcccaaggaccccgcggcgctcgtgcgcgccgcgctcgtctgcaagcgctggcgccgcctcgtctccggccccggcttccgccgccgcttccgcgagttccaccgcaccccgccgatgctggggatgttctgcagcggcgagctcagccgcgtgtaccgccggttcgtgcccacgaccgccttccgcccgcatcatgccgagcggcgccacaggcgcgcgctggacgcccgccacggccgtgtcctcctccttggggaaggcggggccctctgcgtctgggaccccatcacgggcgaggagcggaagctgccctccccgccggtgcccccgcggccctccatgtcctggaccgccaccgctcccggccccgctgccgccgccgccgccggcggtgatca

SEQ ID NO: 2147 - DNA, 538 bp, Sorghum bicolor
  Clone ID: SORBI-28MAY03-CLUS35909_1
ggcacctcccgagggccgacgtctcgcgatttccggctgcaaggttcggttttgatcccaaccccaggctccccacccccgattctcccagtcgcccgccgcttccggcggagcaaccggaggaaaagatcccgattttctttttctccagttgcagttcgtggtgggcgccgcctccgtgttgcgcggttccgatttggcagctgctggggtgaggtggggagcgcgtgcggtgggattcccgttcggatctgcggagggggcggcagctttcctgctccaattcggtcggccagcaatgagggtccttgaatcttgttgatgtgcgcggcccagatgcgggaggcgtactgggagaaggtttcttgaaatcttcgtctgggcttcgtggagtgggatcgccccgtcgtcctatgggctgtgtcagttccaagcaattccacggcggggacgaccatggggacggcaagccgcgtcggcggccctcgagcaactcgctgaagcgcctggttagttacagttccagcaagaagcatga

SEQ ID NO: 2148 - DNA, 497 bp, Sorghum bicolor
  Clone ID: SORBI-28MAY03-CLUS35918_1
gcacggcgcgcccgtgagccctgaccctctttatctctcactcactctctgctaacctctgattagttatctctatcaccagtagctgccgccttgctcgctcgctgccgatagagctgcggcagcacggccggccaccagcaccaccaccgcgtaacgaaacccaacgccgccggtcgccggccggccgtccatccgccgcaccggccatggccatggcgctggccctgggtggtggccaagacgcggagcggaaggtgaaggtagcggaggtggcgctgcgcgcgctgctgtgcgggctgggcgcgctggcggcggcgctggtggcgacggacacccagacgcggaccttcttctcgctgcagaagaaggccagctacacggacatgaaggccatggtgttcctggtgggacgccgccgccgtcgccgccggctacagcctgctgcagctggctgcgcgctgctgcggcggcggcgccatgtccagcggccgcgg

SEQ ID NO: 2149 - DNA, 756 bp, Sorghum bicolor
  Clone ID: SORBI-28MAY03-CLUS35928_1
ctgtactgtacccgtgtaccggcttcttccagcccccgccgccgcggaactcggaaaccccaaaccccaacgcggccgccgtcgctggagatggcggcgtacctgagcatgggtgaggcgcaccgccgcatcggcgactacctctctcgcgtgaccaacgccatctcctactccgacggcgcccccctcgcctccctcctctccgtctcctccgcgccggcctccaccccgctctccgacgcgctcgccgccttcccggacttcccgcgcctcgccggagaccgcttcccccaccttgccgacttcctcgtcccgttgctccgcgccatccactcccaccccgtccagcgcttcgccgacgcctactcctcgttcgagaaggcctccagcgcgttcctgcaggagtttaggaactgggagacgccgtgggcgatggaggcgatgcacactgtggcgctcgagatcaggctaatcgccgagaaggcagatagggagcttgctacgaatggaaagaaccccgacaagcttcaggcggccgggtcctttctgatgaaggtctttggcacactagcggtgaaaggacctaagcgtattggagcactctatgttacctgccagctattcaaaatttacttcaggcttggaacagtaaacctttgccgtagtgtcataaggagtatcgaaactgcaaggaattttgattttgaagattttccagtgaaagacaaggtcacttatatgtactacactgggcgg

SEQ ID NO: 2150 - DNA, 594 bp, Sorghum bicolor
  Clone ID: SORBI-28MAY03-CLUS36223_1
tggccgtagttttttgtttagcctgctgggcaagtcggaagctgctttctacaatggtccactacgggcttccccttgtgcctggccatattgcgtggcccagtggttggctttagccgtcctgcgaaattcatgacttcgctaatttgctgtgttccacaactggcttgccatggtacagcttcttttcgcttgtgccagtcgtgggcgctctttggccggcgtctatcttgtgttagccaacttctcaaatcgcgtctgcacttctgttagcctcgcccatttgttatgcaaattctaaaatagcctccacatcaagaataaccaagctgttggagttgctctaagcatctatgggtgttagagtatattgttatatctctcgagatccaatatgaaagtctacatgtgaggggttaaagtacaagtcaattgtccacctttttctattaccttattaaactgatcagtccatacaactcaataatgagaatgaagcaatacatcggcaactgaactaattctagtcttcagtatggtatcacaggtttaggttctaatgttaggccacaaaccctattagttgcctcgtgc

SEQ ID NO: 2151 - DNA, 645 bp, Sorghum bicolor
  Clone ID: SORBI-28MAY03-CLUS36220_1
atctgaggttgaaatacgctgctgtgggcagacagtgaacctcgggcaacctgtgcgcaacttggtggagcggtggcttagggttggcccggcacgcccgctgcacacagtgataggctcctctgggggagattatgtgatggtgataagctatgggcggccaaagtctgtgtcttcttaaaaacaaaccatcattgacctggctggcgatctcgtaggtagaacaaagggttgctccgccgcccgtgaagaggccatcatcagagttaaagtgtcatatatactcaacggcgtagctggctgctgtgcctcagcggctcatcctctcaccgatgcttctagattatgctctgttcttcaagaatgaatttgtttgtttgttcgttcgttgttaccatacatacatatgtgctgaaagtcgctgtaatttgggatttggtaggctgtgataattgacagaggcgagattgttaacctgaacttaggatggcgatgagttcctaacatgggagagtgctgctgcttcagttttttttccccttgttgaagagagaaaaacaaccataacgtagttcctttatttgtcctgaactaaactgccctaatcaccagctggactggttcatatatacaccctatgcaatt

SEQ ID NO: 2152 - DNA, 963 bp, Sorghum bicolor
  Clone ID: SORBI-28MAY03-CLUS36225_1
ccaggctgatgtccgcaaaacaattgcacaaatcaaggatgaaaccttgggacgtgataagacagactggatcactgttaaggctgcaatctcacatgtacagactgaaagtttttgttatccagcgtgccccttaatttttaatgagaagccatgcaacaaaaaggtcatagatagtggtgatgggatatggttttgtgagagatgtgataagagctctggaagctgtgagtacaggtacatggttaaatttcgaatccaagatcacaccagcactatcatcgctaccgcattccaggaggctggtaagcagatatttggccgcactgcacaagaacttcgcacaataagaaatgttaaccatgacgaggcactattcacagagatcatagaaggagcccgttggcatctaaatctatttaagttgaaagttagggaggaaagctacaacgatgaacaacgtattggatgtaccataattaatgctgaaaagttggatccatccaaagagagtaatgtcctttttgaagccattgacagacttatgcagggcagatcaggcccaagcccaggagatcagggcagcattgccaataaagctggtttcagcaattcaccagatggtcgcagtgccatcaatatgtgtggcacaaatcagtttgggcaacaaggaagcatagatgggagggtgtctactacatctgcaggtttggatagcgagcagcaaccagcgggtggaggcttcacaggcaacaattatggatctgctgctggcaactatggatatgttgctgctggcaatgccaggcagggtccgtgcttcaaatgccatcagccaggacactggagtaaggagtgtcctgggcggtaataggggttttcgggttttgccaatcaagcagcagcatattgattatgtttagctgtaggattgactcacgttgtgtacagtaagtttatctg

SEQ ID NO: 2153 - DNA, 559 bp, Sorghum bicolor
  Clone ID: SORBI-28MAY03-CLUS36259_1
ctcatggcgggcctccgcgagctccggcggcggcacccgggcgccgtcgtcgcttacgccgactactacgccgcgcacctcgccgtgatgcgggcgcccgcccggtacggcttcagcgagcccttccggacgtgctgcggctccggcggcggcgcctacaacttcgacctcttcgccacgtgcggctcgccgcaggtcaccaccgcctgcgcgcgcccggcagagtacgtcaactgggacggcgtccacatgacggaggccatgtacaaggccgtcgccggcatgttcttcgacgaacatggcggcgaggcctactgccgccccgcgttcaaggatctgctggccatgaaagcccagggcaagccgtgatcaccgtcgacacccacgagaatgagaaagcacgttccaataaggaagcgcaccatatgtagttcatatgatcaatgttgcgtgcttttagctaggatcatcagtagaactgcaattctatcgtgaagatttcatgtcatcttcatcttgaaccgttgacatttatcaggcatttataattgaagcccat

SEQ ID NO: 2154 - DNA, 680 bp, Sorghum bicolor
  Clone ID: SORBI-28MAY03-CLUS36243_1
ctctgcccagtactaagtgtgcagcagctttacaaaatatgcactcagtactgggatgacaaatataatacagagagcgtgtcagaagaggtccttgaggagatgcgaacattgatgaccaaggaatcaagccaggatactctggagaatacctttctactggatgatgaaattagcatgcccatatcacttgaggagatagcagattctatggatgccaaagaatttcagaatgttgccccaccacaagagcttactgcaattcctgcctttcaattcttgaagagctgagccctggaagggcgggttaggcctacgttgttgcacgtgcatacacacgcagatacatctagaatcttccatcagatgtaaaatttaacctagggtttccattcttcttgtgccatgtaattatttttttgtccttatagtttggtttgttgtctcaagtttcagttggctcggttggcaataggtaagttgttagttgaggttgggataggttttttgttctgcctcctgagatgcgtgtgtgcagtgcacttgccacttagactgaaatcctcattttcgttgtataatggtagcagctagggatccgttgaaaatcattcttttatccaaatttgattggatttggttctgcagagaaatgtgaataacttgtatagttaaattat

SEQ ID NO: 2155 - DNA, 532 bp, Sorghum bicolor
  Clone ID: SORBI-28MAY03-CLUS36261_1
tgatgcggcgggtggcgtacaagacggggaagcgggtggagccgtggccgtacgtgccgtacgagatggtggcgcacccttacgcgccgggcgcctacctcaagaaggccccccccgggtacgtccgcgacgtcgtcgctgaccctaccgccgcgccgctcgccagggcgtcgtccaccgaggtcaggtacaccgccgcgttcagcgacgagaaccccaacgcctgcgccgtcatgtagatggtggtgaactggtgatgatgtcggtgccggtgttggggggacctggacgacctggaccctcgagaggacggtggtgacagcttttggttctagatgcttttattgtttgatgttggagcttttgctcattttatgtttttttgtttcattttttttgtctcgtttctgggtttgaggtagtagagtagaagagatgtagtagtatgtgttttgattttgtgaaagaaaagaacggatttgtaatggtagtagtaatttgtagtagtgttgggaaaactgaaccggcaaat

SEQ ID NO: 2156 - DNA, 485 bp, Sorghum bicolor
  Clone ID: SORBI-28MAY03-CLUS36282_1
gccatcttctgatctgcgtccacaatacactctagtcaaggattcctctgctaatccacctccagcgcctggaactacatatggacctgttgggtctatgtcaaaggtttatgctccccacacgcttatccgatccccagcttctgcagctgctggcatgcaagcgtcgtaatgagacagttgagagctttagtcccctttctgtcatgaaagatagatcttgggcaaccttctcaggattttctgccataggtggaatgaggtctcggattcttttttgctccagttcgacttcccatcaatcaattgtgaataaaggctgcagctgacatagaaaagtctgaataaatgcaaagataggaattggcaagctcattcacttgccatttttctgtccgtctctgaaatgagaggagatataattgtgattctagtagggttcagagctccattattatcacgtctaagatgcagaggtgcagggg

SEQ ID NO: 2157 - DNA, 706 bp, Sorghum bicolor
  Clone ID: SORBI-28MAY03-CLUS38873_1
gttttggtcagtcagcacaaattggatctgggcaacagtcaggatttgggcagcctgcacaaattggggctgtccagtcaggatttgggcagcctgcacagtttggtgctcaacaggcacttggatcagtgctgggttcttttggacaatcgcgccagttaggaggcgtaggttctggaggatttggtggatttgctagtgcttctacatctgggggttttggttctttatcttcaagtaatgctggatttgctggtgctgcaacagttgggggcttttcagcacctgctgcttctgcgggtggtggttttgctgctgctactggtggaggttttgctgctcttgcctccaaaagtggtggttttgctggtgcagcttcatctggtggtggttttgctggtgcggcccagggaggtggctttggcagtggtggtggattcggatcctttggtggtaatcaaggagctgggttctcggcatttggagcaagtggaactggaagaccgccagctgatttcttgacacagatgagaaagtaggctccaggcaatccccagacaaatttaggcattagctatggccagctgcaagaggcctcggagataagttcaatcgtgatgtcacaaaattatttttatgttccactcttcacctgtatagacttgttaggcaggccctgatgtgtggaaaccttcctcctggtctc

SEQ ID NO: 2158 - DNA, 687 bp, Sorghum bicolor
  Clone ID: SORBI-28MAY03-CLUS38874_1
cgaatggttttccacttttttggggtgcccaactcgactggtgcgctttaacgaagactcagaaactaggctgactgaccctaattatgcacggggttacaaaaccatgttttctgatggcttcccttatctgatagtctctcagggctcactggatgcactaaatgagatactcaaagagcctataccaattaaccgcttcagaccaaatattttagtggaggggtgccacccatatgcagaggatatgtggaaatcagtaaagataaacaagttaacatttcaaggcgtgaagttatgtggccgttgcaaggtgcctacaattaatcaagacactggaatacctagccctgctgaaccaactgaaactttgcagacatatcggtctggtgaagtgctgcttcctagccacaaaaacaaacggcaggtgtactttgggcaaaatgcggtctgcagtgaatccctgtcactgaatagcaaaggaaggatcgtcaaggtcggtgatccactttatgttacacagtcgttctcttcgtctgatgaagtgccagcctgagtgactgaatcagggcctatgtaacagccacttgttctatgtgtgtttttgaacataccacttgttctatgttgagcgtgcaaaaggcgaagaactggtttgttgggaagttgttggtattaacagctgtg

SEQ ID NO: 2159 - DNA, 635 bp, Sorghum bicolor
  Clone ID: SORBI-28MAY03-CLUS38878_1
ctggactacgtcgacatgatcacgctctccggcgcgcacagcatcggccgctcccactgctcctccttcagcagggaccgcctgccgcccagcaacacctccgacatggacccggcgttcgccgccacgctgcaggctgcctgcgcgtcgcccaacggcaccgacaacacggtggtgcaggacttccagacccccgacgtcctggacaaccagtactacaaggacgtgctggcacacaaggtgctcttcacgtcggacgccgcgctcaccaccaacatcacatccaacaacctggtgcgcgcctacgcggacttcgttcccttcctgtggcagaataagttcggcaaggccatggtgaagatgggcggcatagagatcaagaccgccgccaacggggagatcaggaccaactgccgcaaagtcaacggcaggccgtgatggatcagatgcccatgcatttcttaactattgtctttatacctacattatcctctaataatgatcgatgcttcattcttagctgtgtgtatgcctgttgtgatgctgtaattttgattgcgataatatcgtacctttttttgtactagttgacgagaaaatcttcatgatgaatgaagaattaataaccattcgtg

SEQ ID NO: 2160 - DNA, 635 bp, Sorghum bicolor
  Clone ID: SORBI-28MAY03-CLUS36354_1
ccagacaggagaggtcgtgaaagatctccaggtagaaggcgttctcctagtccttacggcagagggcgggagagaggtagcccagactacggaagaagcaaggagaggggtagcccagactatggcaggggaggacgcagccctgataatggccgtggaggacacagccccgagaatggccgtggagtaagcccagccaatggtggcagaggcgatcatggcaggggaggacgcagccctgactatgatcgcgagcgtcgggaagctagccctcgccgtgagcgccgagaagccagccccggctatgacaggtcccccagccgctcacctgggagggacgagagagactagacgcattccatgcctgtgctcaagcatcaagcctccggcaacagatgaatgtgcaagtaatgttatgttgaagttggtgatgttagccagcaggaaacctgtgtactatgtgcgttaggtggtgttgactttccaagttagcttatcacttcccatttcagtatgaagcgactccagaatgtaattcatgtaggactgaatggtactcgtttgaacttttgttggcgttgtagtattgaataggtttcagtactcgattgaacctttgggccgttattttactg

SEQ ID NO: 2161 - DNA, 1033 bp, Sorghum bicolor
  Clone ID: SORBI-28MAY03-CLUS36368_1
gcacgagggttgatgctgtggtggctgaggttgggtcagaccgtgtggggatccgcctctctccttatgccaattaccttggctgtcatgactcggacccagacaggttgggtgtctacatggctcaggagctgaacagatacaacatcctgtactgcagtgcggtggaacctgagatggtcatggtggatggcaagatgaaaatcccacacagtctgcaagaaatgaggaaggccttcaacggaactttcatggttggtggaggttacgacagggaagagggtaacagagttgtagctgatggatatgctgacatggttgtatatggccgcttattcttggcgaatcctgacctgccgaggcgattccagctgaatgctcccttgaacaagtatgatcgatcaacattctacaccgatgatcctgtcgttggctacacggattacccatttcttgagaactctgaaccactaaactccctaactagacggggagggatctaccaaaacaaagaagggatgatctgaattgcctactccctctgtcctaatccttcctcggtcctaaaaagaatgaactgtaaattttggaggagtcgatcttttatttttaattcaactatattcacagaaaatagtatggatatttgtatctccaaatatattttctatagaaatatattttactaatgatgttacatattatactagcctagtgtgtaactctgtgtgtccaactgcttgcttctattctcaagtgtggttcgcacatttgttaatgtagcctggatctataatgtaatcaggggtttgtagcttctgtttgagagctagctagacgggcttggctggttttgtgtggtgtggatatatactgtgtcgcactgaagaggtgtgccattgaagtattgaggtataatattcactcagacccttgctgattgacacaattttgcactgatgcctgattcatgagatgatgattccagctttgaaggtttaccttcacccttgcattgctgtacacgttctac

SEQ ID NO: 2162 - DNA, 709 bp, Sorghum bicolor
  Clone ID: SORBI-28MAY03-CLUS36372_1
tgtgtaagaagtgaactcagcaaggaccaattcaagcttctttgtagtttgtctaatgttacaaatttggtgttgtcaggtttccaaacaatggtgatcggtgaagaattcccagaatttcagaaccttaggacattgttattggagaaatgtgatcttagtgataacttccagatgttgggacactttcttcagcattcgcctaatttggagaagctcactttggaccattgcaagttctcaaaggatcctaagagaaagaaaggaaatgtcaagtcgaacaaggcgtatctgaaccagtttgatgtccggtgcaagaacctcaagcttactaaaattatctacaacgatgacgatgcccaaaagctgctgaaccttttgtttagcatttctagtgatctgcccaagaataacataaaattcaccaaggttggtccaggtcatccttagcctaggttatctgtcgcttgtcacgctggggcttctatgaactttgcttgtgtgcctccgctgtgttgggatgtccttagttaaagtgttgagcatgtgcttttgaactcatttctagataacttagttgtatgagttatggtactgtttttttgttgtctgcacctcaagtctttatatgtaagcttacatgcttcaaagtgaacagaaagttgcatgtttgctgcgttttgttgttatatctgaattcaagtttggc

SEQ ID NO: 2163 - DNA, 769 bp, Sorghum bicolor
  Clone ID: SORBI-28MAY03-CLUS36384_1
acggtcccgtccgccccgcgctgctcgcgcactggggacccgggagcgggcgagaagacgacccggacgtgcgggtgagcgagtacctgcccacccgcggcggccgcgccggcgcgtcggcggcggcgtacacggacatgatgcggcggagcaggttctgcctgtgccccggcgggtacgaggtggcgtcgccgcggctggcggaggcggtgtacctggagtgcgtccccgtcgtggtggacgacggcgagtacgcgctgccgttcgcggacgtgctcaactgggacgccttcgcggtgagggtgcgcgtcgccgacgtcccgaggatcaaggagatcctgtcggcggtgtcgccgcggcagtacatccggatgcagaggcgggtgaggatggtgccccggcacttcatggtgcacggcgggcccccgcgccggtacgacgcgttccacatgatcctccactccgtctggctccggaggctcaacgtccggatcgatgctcatgcacaaggctgaagtatgtatagccgtatagtacgtacgtccgtaccgtacgtgtacgtacaggtgacacgtcacacgtctgatctgaagtctaactggagggagggacattttgacagggttaagttgggatgaatcttggaactactgggtcttgtaaacatttgtcaatagtagaatccaatagtctgcttgtttgtttcagacttgcagtgcatgcatgtagctaagttattctggatcggttaccattgtggcaatgtgcc

SEQ ID NO: 2164 - DNA, 730 bp, Sorghum bicolor
  Clone ID: SORBI-28MAY03-CLUS36418_1
tttcattctaatgggttctctcttgttagaagggtactggagaaaagcggactttccttgagtgaccagctcccaagaaatgatggcataacaactactgttggtgaagctctaatggcaccaactgtcatctatgttaagcaggtgcttgagattattaagaaaggtggtgtgaaaggactagcccacatcactggtggtggttttactgacaatatcccaagagtatttccttctggactcggggcaaagatttttactgggtcatgggaagtgcctcctgtcttcaactggcttcaacaggctggaaacattgatgatgcagagatgcggcgaacattcaatatgggaattggaatggttcttgtggtaagcagagagtcagcggacagaattatcgaagacacccatgggtcaaatcatgcttatcacattggagaggtgatcgagggtgacggggttcagtatgtctgaccttttatgccttcattgcttgtagtggcttgagacttgttggttggctgggcaaagcagcccagtttatgtaacaacataatcttgtggggttaagttctgcaccactgctaccgctagaaagcgaagggtaaccaaataattatttgagtggttccacgggaacttgccctgaaacgagctgataactgttatttgggacatggtccttttgtccagagaaggccactgggggaaattcagattccagattttc

SEQ ID NO: 2165 - DNA, 669 bp, Sorghum bicolor
  Clone ID: SORBI-28MAY03-CLUS36473_1
tactggagcgtgcagcgcacaagagggagggaaaagccaaagaagccaccgcgtccctttcgtagcttccacacctcaccacctgagctcggccggtggcgggctggctgcttccgtccgtccgccgctttgcttgcttgctctgcctccgccgcacctcgcctccgtccgtccagcgcagccagccagcaccaagtcaagcgagaatccggtcgcaccccgactcgacctccccggacgtgcggttcttggtgggggtgtgtttggcgttggcggcggcctcgagttgactcgaggtgtgagctccgacacctgctgcggcgccgttctggaagcagagtttcttcccttcccgtcaagagtgagtgggtcactgactcactgggcggggttcttccacctgcaaaaaaagcagcagcttggattcttgctaggggcgcacggttggtcagctcgaaggagaagctgacctggttgggcgtcgagattttgattgacttttgaggtgccggggtaagactagacaggttgcttcctgcacgctggtttcttggctctgtggctaccgaccttgctggttttcctcccgaattagtggccgagttccatccagaccttgcaaagattgggacctttgtggtctctcttcctcttgattccttgcgttac

SEQ ID NO: 2166 - DNA, 840 bp, Sorghum bicolor
  Clone ID: SORBI-28MAY03-CLUS36465_1
cttttgccgcttgccacaggcagcaaacctgtcgaccgactggcactgttgcttgatcgtcgctcatcactcatggagagggagactgcagccacctgaccgccgttgttgcctcaagcatggggggcaaatgcctagtgccacggcctagcgtccacatcccgctcacggtcgtcgctaggaccaccctaggagaggagtcgttgctggcccaggcgggcacaggcgcagctggccactgccaggccatgccaccatcctcgaccgccggctggccggaaccgaccattttcgctctgctctgcgtcgcacggaggaaggtggaaaacgcatgttgcaagagtatgtttcacatgtttcagaggtatgttgcgagtgtttaatatagatgttgcaaaagtatattaaggtgttgggtaaagtttattttgcctaagatgttgtatatatgttgcaattgttgtatacatatgttgcaatagttgttttcaatgtttcatctattttatcttgatgttgcatgtgttttattttaatgttgcagtgactatagacgtatgttgcaagtgtatgatccgaatgtttggtctgcaccatatgtatgttacaagtgtttttatgtgggtgttgtatatgttgcaataactatacacatatgttgcaattgttgtatatgtatgttgcaataatatgtttccaatgtttcagctattttatcttgatgttgcatgtgctttattttaatgttgcagtggctatacatgtatgttgcatgtatatgatcagaatgtttcgtctacatcatacgtatgttacaagtgtttttatctggatgttgca

SEQ ID NO: 2167 - DNA, 692 bp, Sorghum bicolor
  Clone ID: SORBI-28MAY03-CLUS36166_1
cggcgagtaccagccttaccgcggctgcccccgagttgtcccctattttcagtcttcgcccggcacgcccccagggatgccagtttgatcttcggcgccctgctctggtccgtggtagccgccctgtgcttcggttccttgctgtggtccgctgggtccgccctgcggacattctgctctctgtggtgttctcgggctggtttgcgtacgagccccactcctcggtgatgacttgctttggtgggttggagcccctgttcactccggtgtttgtcatggggtgggtgaagcagctccatgcgccagggttggtctaggtgtttggcttggtgccccatgcgaaccggcgggtcttccggggacgtactcgcccgacggcgcgtgggcgcgctgagtcggcccccgcgctccggccgggggcccgggtcccatccgccgccgccatgtttgctgcgccgggtttgcctgcctcctgcttcgcgcccaagcttctggagcgcccttgctggccgggctgcgggagcgcctgctctttcgccacgcgacctctggtaccggcccggcggtcgccctgtggccgtggtcttggcagcgccggctcgggctgccttttcttgacgagcaaacaaatgtatcgcccttgtaagcatcgcccgagtggctgctgtaacatcagatctatcacaacatga

SEQ ID NO: 2168 - DNA, 719 bp, Sorghum bicolor
  Clone ID: SORBI-28MAY03-CLUS36175_1
ttgctgccaaattcaaacaacgcttggcaattgtatggatctgattcctctcttaacaattcacaaagggaatgtgcaggcagtgctgcaaacaacttgctgaacttatccccagctattctagccacacctgatgaacttgatgagctggtatcccatcatcaagttaaagttaatcagaaagatgtaaatgctgaccggaggccatctttggagatcggttctgaaaataacttggaacaagtatccagtctgaggccccaggattctaataataatctgaagcgcaaagccaatcaagagctcgagccacttgagcttgccgctccatccactggtgctgcgccgcaatcgacagcatctgccccaagaaagccactcagattgaggctgacgactttgggcaaaccaaagccagctgaaggaacttcctgaatcgaattgcccaggagccaacatgcctagagttcgtttttccttgtattgaagcaaggatgtgtggaagcgctcggcacatagcctgctttggcactgcgagttcaaatgaaagggaaaagggtaaaaacggaggccacctgacgtaaatgagtgcaattgtaataaattgtgtatagtccatagctgagttggcatagatgtatgcagtggtacgttttacttgactatttagctacgcttgtaatgcaatggatatggtaaatgacgttaaacggcaatgg

SEQ ID NO: 2169 - DNA, 647 bp, Sorghum bicolor
  Clone ID: SORBI-28MAY03-CLUS36185_1
gcacgaggccgggaggcaggcatcaggtgccggcggcacaacacggaccggttctgggacatcaagttcgacaacggcgtgctccacatcccgcggatcctcgtccacgacggctccaagctgctgttcctgaacctgatcgcgttcgagcagtgccacatggacatcgccaccccgggcggcaacaacatcacctcctacgccatcttcatggacaacctcatcaactcggcggaggacgtcaagtacctgcacgaccgcggcatcatagagcactggctcggcagcgacgccgaggtggccgacctcttcaaccgcctctgcgaggaggtggtgttcgacatcaacgacagctacctctccgggctgtcggaccaggtgaacaggtactacgactacaagtggagcacgtgggtggcaagcctgcagcacaactacttcagcaacccatgggcgatcgtctccgtcgtcgctgctgtgttcctgctgctgctcaccatggcgcagaccttctacagcgcctacagctactaccggccaccccaataatgaataatgatcgatggctatgtcctacttctatcaatcggaattgcacctagtcaaagtttgatctttcctggactggcactgtgcaattttagagg

SEQ ID NO: 2170 - DNA, 542 bp, Sorghum bicolor
  Clone ID: SORBI-28MAY03-CLUS36538_1
gcacgaggcaagatgtgaggtcaaaagtttttccattcaaaaggaagaaggttaatgctgaagaagccgaatctcccattacgctacctgttaaagttaaagagaggtctatctcatcgttggtggtcaatacacctagagtagccccagcagcttcaacaaggaggcgaacaagagcggttaccaggaaggctgctgcattacgtggccttggtcctatcattgtggatcctttaaaaaaggataatgataactcaaataagcaaaccgataattcaagcttgctagatagcttgagcaaaatacctcaaacaagaagacagttattgtcgaatggggacacatcaggtcatccctctgttaaagataaagcaggtgataataaagacttggataagtccgagctctggaaacctttgaatcgtcttgtagacgctgcaagcaaaacaaaggccctgacaagtgcacaaagtccagctttgaagggagataagcccagagaatctcccagtagtgaacattctagcagaacagaggctagg

SEQ ID NO: 2171 - DNA, 619 bp, Sorghum bicolor
  Clone ID: SORBI-28MAY03-CLUS36545_1
gcacgaggctccgctttcctctggtctctggtcatcgcacccgtctccccgctctgactccgtcccgagcggccgactccgcccgcgccgccgcctccaggacgcgggccctcgactcagcgccgccgcctcgtcccgatcgaccctcgaatcgccgggaaccgtggacttcgcgaggctgtcacttttcctctaagcggtgtaacgaagataacagggcggcaggtgaattgcagagaaaaggagaacattaggctgttgcacgatggtggaaggccccaatttcgctggcatgattggtggtcatgacaatggtgggaatttctgccacatggcatactaccggaagctcggtgagggctcaaccatgtcgatagatagccttaacagcatgcagaccagcacacatggtggctccatcgcaatgtctgtggacaatagcagtgtagggtcctgtgactcccatactaggatgctcaatcatcctggcctcaaggggcctgttgttggcaactactcggttggcgggcacagtattttccgtcatggacgggtgtctcatgccttgagcgatgatgcgctagcacaggcattgatggacccaaggtacccgactgag

SEQ ID NO: 2172 - DNA, 735 bp, Sorghum bicolor
  Clone ID: SORBI-28MAY03-CLUS36557_1
gcacgaggggattatctaccatgcccgttggaggttgataactacgcccttgatcaaaacaaatccgaagagaaggtactattggctggaactccagctgaaccacttgtggcattagcgtttaagctagaggaaggtcgttttggtcagctgacctatctaagaatctatgatggtgttataaggaagggtgacttcatatacaatgtcaatacagggaagaaaatcaaagttcctcgcttggtaaggatgcactctaatgagatggagggcacgcgggaagcatatgctggccaaattgttgctgtttttggtgttgattgtgcatcaggcgatacatttacggatggaacagtgaaatatactatgacttcaatgaatgtccctgaacctgtgatgtccttggcagtttcacctatatctaaagactctggaggacaattttcgaaagctctgaatcgcttccaaaaggaggatcctactttccgtgtgggtttggatgctgagagtggccagacaattatttcagggatgggtgagctgcatctggatatatatgttgaacgtattaagagagagtacaaggtggatgcaaaggtaggaaaacctcgtgttaacttcagggaaacaatcacccagcgtgctgaatttgattatttgcacaaaaagcaatctggcggtcaaggtcagtatggacgagtttgtgggtacattgagcctcttccatcaggttct

SEQ ID NO: 2173 - DNA, 705 bp, Sorghum bicolor
  Clone ID: SORBI-28MAY03-CLUS36564_1
gcacgagggtcatttgctgctcgactaaatttgagaacaagaagagtcttcgaaattatgcaacatgcaagaggttattcatggatgtttggaaatcgtgtgccacacatgcttgataatgattacacaccttattctgcagtggatatatttgtcaaggatctgggtatagtatcttctgaaagttccaattcgaggataccagtgcacgtttctactattgcccaccagctgtttatttcaggatctgcttctgggtggggtagatatgacgatgctgccgttgtgaaggtccacgaggcattaactggtgtaaaagttgaagggaaggctcccatgctcagtaaagaagatgtccttcattctcttcctgctgaatggccagaagatccaattgataatcttgtatctattgcatctcatagtagcaaaaagattcttgtagttttagatgatgatccgactgggactcaaacagttcatgatatagaagttttaactgaatggcctgttgaagcccttgtcgaacagtttctcaagctaccgacttgcttttttattttgacaaactctcgttccatgactgctgataaggccatgctgctagtacaaactatatgcagaaatcttgaagctgcggcaaagaaggtccctggtgttagttatacagtagtcttgagaggtgattcaactctacgtggtcat

SEQ ID NO: 2174 - DNA, 550 bp, Sorghum bicolor
  Clone ID: SORBI-28MAY03-CLUS36570_1
gcacgaggcggctttgccccctttctcctctccctccctctccgctcacccttgccggttgccgccaccctcctctggctgccgttccaccggcgtcgccgccagcccgctgaagcctcttgcgcgaggcgcgaccttctagaacttggcctcgatctcggcctcttaccgccccgcagccgcgcttcctcctacaccggagatttgggtttattggtaggccctcgaacccccttgtgtttcccctaattctcggcggaggatggattcctcgcacatggtcagtcactaattagctagcggccggaatgctccgtccatagctcgcttttatgcagctgatttctttggctgctgcaattccgcttacgcgcctttctgtaggctgtagctcgataggaaggaaatctatttgctcagctggtactactcattctgtgcttgcttgattcattggtctgtggtttacagacgacaatgtgctaggagaacgaatttaggtggcacgctagtggtgatccgttgccctccctgagatagcagccatgtc

SEQ ID NO: 2175 - DNA, 1022 bp, Sorghum bicolor
  unsure (1)..(1022): unsure at all n locations
  Clone ID: SORBI-28MAY03-CLUS36571_1
gcacgagggaatcatcctagcagtgtatatcgtacgtacacatctgagagctagctagcactagctgcatgcgctaggtggtgtggtgtcatgtggcggctaaagatcggcgagaggccaagcaacccgttgcttcggtcgccgaatggcttctttgggcgggaggtgtgggagttcgaccccgccgccggcacgccggaggagcgcgccgaggtggagaggctgcgccgggagtacacccgcaaccgcttcacgcaccgggagtgcagtgaccttctcatgcggatgcagtatacaaaacagaaccttcatagtacaaaccttccatctatcaagattgacaatgattcagaagccacgggagaaactatactagctgtgttgaggcgtgcccttagtcaattttcttctttgcaaggaccggatgggcattggcctgngggttacagcgggattttgttcattctaccactcatgatatttgcattacatgtcgcacgagcactacatgaagttttgtcaatagagcatatacatgagatatgtcgctacatttataacatccaggatgaggatggaggctggggaacacataccttgggaccaagctccatgtttggcacatgcgtaaactatgcaaccttaaggattctaggagaggtgcttgatggagaaaatgatgcattatccaaagggcgtgcctggattttgtctcatggaactgcaactgcagcaccacaatgggcaaagatatatctctcggtggtaggtgcatatgattggtctgggaacaatgcaattattcctgagttatggatgcttccacattttctcccaattcatcctggaagattttggtgcttttgtcgaatggtttacatgccaatggcttacatttatggaaaaaagtttgttggacctatcactccaactattttggcaataagaaatgagatctacaatataccatataatgagatcgattggaacaaggctcgcaattcttgcgccaaagaagacct

SEQ ID NO: 2176 - DNA, 569 bp, Sorghum bicolor
  Clone ID: SORBI-28MAY03-CLUS36577_1
tccaacagttggtggccttctgaatgctacatttggaaatgcaactgaaatgatcattgcaatatatgctttgaaaaatggaatgatccgagtagtgcagcagtcactattgggttccattttgtcaaatatgctgttggttatgggctgtgctttctttgctggtggtattgttcatcgcaacaaagaccaagtcttcagtaaggcaactgcagttgtcaactcaggtttactgctgatggctgtcatgggattgatgtttcctgccgttcttcattttactcattcagaagtgcggcaaggagcatcagaggttgctctttcaaggttcagtagttgtattatgcttgtggcgtacgcaagctatctctatttccaattaagtggacggagcaacatgtacagtccaataggcagtgaagagacgcctaatgaggatactgtggaagaagatgaagaagctgagattggcatgtgggaggcagtaacatggcttgcggtgttaacactctgggtgtcttttctttctgagtacctagttaacgccattgaggtattttcttctccaa

SEQ ID NO: 2177 - DNA, 672 bp, Sorghum bicolor
  Clone ID: SORBI-28MAY03-CLUS36286_1
gaactcgtggccagagtgcttctgccagccggatgccaggaaccaagcagaccggtgcccccctgatagcataaatgatgttctcgaaagtcagttccagagtgaagaagaaatggaagaagcaagagccactaatcagactgactcatccagcctaatagaagagccgacgatttaactgaccaactaaggattactgctcggaagcattttgaacacttgcaatgttaatcagagagatccaaatacaacgatcttcatggaatgtattaattgatgtctcaagctccctacgggatagctggagcggttgagatgctgaggtgtggtatctggtggtatccagggagagcattgaaccagactttggataggtctggtcatagttttgaggagaaaacagtacgtatgtcagtttcctcattggaaagtgaaattgtgtgagttgtgtacgtggcagcgacaacagttggaatcctttgcgcaatatggtacagccactaggcccggttatgcttgtccgctccatttttttccacaaacttcattaaccttgtggctttaatataggcggagcggtcgtaatttcgtgtagtaattggcgctttcctggtacagccccatcgtttgatttccccataggctattcgaatttgttgaattgaaatatgt

SEQ ID NO: 2178 - DNA, 433 bp, Sorghum bicolor
  Clone ID: SORBI-28MAY03-CLUS36290_1
tgttccattaccgccatgatggggtcgatcttcagtgctattgtccaggtcttgatggaggggaagctcactgcagggaccgctaacaacctcacaaggatcattggcgaaattgtgcttgtgggaggcgtggtgatcggcctgtgcacggcattccaggtatcaagcattggtcgcaaggggcctgtactcgtctccatgttcaacccatttcagacggtcttctcggcgttcatctccttcattttcttcgggcaatggatcggcttgggatgctttgtggggattgtgctcatgtttgttggactgtacgtggtgctgtgggcgaagaatagggaggacaacatgtttgccgatctggcagcgccgtcgccgtctgaaactggatgtgatatagagagttcactgctgcaatgattagtcaggcaaagtc

SEQ ID NO: 2179 - DNA, 681 bp, Sorghum bicolor
  Clone ID: SORBI-28MAY03-CLUS36323_1
aaatacctcttgacaaagtattggtgacaaaacagattgatcttatgacagcaaaggcatggctttctgcagacaaacaactggagagaaaggtgattaaattaagcatacaaaatggtgttccatcagagtacacagaaatgaccttacttcaaacaaatctggataaagtagacggaacacaaaaggtcaagcaaaaactaaaaggacagaaaggcagagatgagcaacggatcctgatgcacggcctgaaactgggattcggtaacaaagacgctacaagggaaaatctcatcacagggtttggggacaggaatccggcagaaaaacttgtgatgctccataagggaaagggttgttgcagcagcgtcgctgactgcctctgctgcatgtgctgcatcaaggcatgcaacaggatgaatgaccagtgcgccattctgatggcacagatctgtgccgcactagcgtgccttggctgctatgagtgctgttcagaggtgtgctgtggagggtcagagtcgtagtaggaaatagggaaacccaggagttgtgttttgtatattgttatggaagattggagatttggactgtgcataatagagttcgcggaagccaggttgtggcttgtggggcgtggatgaaatacaaaatatatcagcttagattgacgatcggtcttgg

SEQ ID NO: 2180 - DNA, 726 bp, Sorghum bicolor
  Clone ID: SORBI-28MAY03-CLUS36346_1
tgattacagctatctcagaaaacccagcgaatttcaagggaaaggtagtagtgatccgaggagaaggaccaaaaggtgggccagggatgcctgaaatgttgactccaacaagcgcaataatgggtgctggtcttggaaaggaatgtgccctgctgacagatggtagattttccggagggtcacatggatttgttgttggtcacatatgccctgaagcacaggaaggtggcccaattggtcttgtccagagtggtgatgtaatcaccatcgatgtaagtaagagggtaatcgatgttgaccttaccgaacagcagctcgaagaaagacggaggaaatggaccccaccgccatacaagtccacccgtggagctctttggaagtacatcaagcttgtggctccagcgtcgagaggatgtgtcactgatgagtaggatagtgttacattctgttaggttgtgcacatgatgtgttgtcagtcaaaagctgttgccaggaacaattaccctgttagagtgattcatggtagggcggattgcatgtggcaggtataataataaaatgccggtttctaagagcttagcaatgctgcagaaactgctgaataattgggtgtaatcggtctgttctctgttcaagcgtgtgagcaatcacatcttttttagtctctcccttgtgtttgtctcattgtttgtactaccttgttcatagagataatcatgtggattt

SEQ ID NO: 2181 - DNA, 492 bp, Sorghum bicolor
  Clone ID: SORBI-28MAY03-CLUS36616_1
gcacgaggctgacacgcgcgtatactgatgaagctgagaggcgcgtgcgtactatagtcctaagtaccatggatcgatcaagaactagaaggatgctgtgctgcggcgacggcgtgtcgtcgatgtccatgtcgtgctccgacgtggtcaccatatgtggcctcttcgccgtgcagtgcatctacggcctctacatgatgttcctcagcgccctgcttgccgccggcgtcccttccctcttcatcatcgtcgtcgcctgcgccgcttcctccgtcgtcgtcctccccttcgccctcgcccttgagaggaagaaatggcccaaagtgtggagccccatgttggttgttcagcttatcatcatttcgctaggaggggtgtcaatataccaagtcatcatgatgctcggtgttgcacgcacctcgccggcgatagcctccgccatgcctaatctttgccctggcttcatcttcgtcatcgcagcctgcctgaggt

SEQ ID NO: 2182 - DNA, 496 bp, Sorghum bicolor
  Clone ID: SORBI-28MAY03-CLUS36631_1
gcacgagggcgggacgccgccgccgtgcagcgggacacgctgcgccggatcctcggcgacaacgccaccgccgagtacctccggtgccggggcctcgcgggacgcaccgacgccgccagcttccgggcgtgcgtgccgctcgctacgcacgccgacatcgagccctacattacgcgcatcgccgacggcgacacctccgccttgctcaccgccaaccccatcacctccatctccctcagctccggcacgacgcagggcaagcgcaagtacctgcccttcaaccaggagctcgtcaagtccacgatgcagatataccggacttcctacgccttcaggaacagggcgttccccgtggaggacggcaaggcgctgcagttcatctacggcagccgccagttcaccaccacgggcgggctgacagcgacgacggccaccaccaacgtgtaccggagcgaggagttcatgcccacgatgcgcgccatccagtcgcatgtgt

SEQ ID NO: 2183 - DNA, 629 bp, Sorghum bicolor
  Clone ID: SORBI-28MAY03-CLUS36649_1
accggccaaccaaataaaaacacgccgcgcccccccgacgcggcgcgctccgtcttcctccctcctcggtccctgccttccaaatcaaaaccagcctgccttgccagccgccgcctcgtcctctccgtctgccatcctcccggcatcgccctctccctcgccctcaccgcctcggaaccctagcggatcgtcattcgttcgcgcgcgccccgccccgcctcgccatggaggacttcgcgcgcgcggtggaggacgggctcaagctctctaagcggctcgtgctcccgggagggctgcccccgccgcgcccgccggcggggatggagcgcaccgtgtcggccgccgcggcgtcgggtcccgacccgcggctgctccccacggcgccgatggcctacgcggtggtcaccgacccggccgccgtcgacacccccgacgtgcccagctaccagccctacgtctacggcaacctcgacccgcccgcgctcatcccgctgcagatgaaggaggtcgacctgaccgtcgactgcgcggtcgacaccgcgcacgtcaccctgcgcgcgcgctggtggttgcactgcatcacgcgaagccgcgagtgcgacgtgcgcctcgtcgtccccttggtcgag

SEQ ID NO: 2184 - DNA, 497 bp, Sorghum bicolor
  Clone ID: SORBI-28MAY03-CLUS36660_1
gcacgaggctcccctcctctcccttcccctccctcccccacccgccgcttcccgcccccgtgccctcgccgcggcggctaggaattttgctccgggaaaagagtgtttttttcctcccttaccgtttctccggatccgggtccgccgctgtttcgtcccccgccggttttgcttgatttagattccatttccgttcgttcgttcttgtccccttgttcgttcgttcgattggagctagccgctgcccggattccttggtgcgccgcctggatctgccctcgctgagctccggctgcccttatccggattcgattcgccccccgcgcggtgccgttccttccgaggcgtgctcggatctcgtcggagtagaggggaacgaggcctcgcgattcgcctctggccgagatggatcatgtggtcgggggcaagttcaagctcggcaagaagatcgggagtggatcgttcggggagctcttcctcgctgtgaatgtgcagac

SEQ ID NO: 2185 - DNA, 572 bp, Sorghum bicolor
  unsure (1)..(572): unsure at all n locations
  Clone ID: SORBI-28MAY03-CLUS36663_1
gcacgagggtttttgccatgatgcttggtcttgtcactgattcaatctctgagaagtttgattctttgaggaaaggaagaagtgaagtcatagagcagagccacactctaattcttggatggagcgataagctgggatctttgctgaaccaaattgccattgctaatgaaagcttgggaggtgggaccattgtagtgatggctgagagagacaaagaggaaatggaagcagacattgctaaaatggagtttgacttgaaaggaacagctgtaatatgtagaagtggaagccctctgatactcgctgacttgaaaaaggtctcagtttcaaaggcgcgagcaattgttgttcttgctgaagaaggaaacgctgaccagagtgatgcacgggcactgcggacagtcttgagtttgactggagttaaagagggactaagtggtcacatagtagttgagcttagtgatctcgacnatgaagttctagtcaaacttgttggtggagatcttgtggaaacagttgtcgcgcatgatgtgattggacgattgatgatacagtgtgcacgtcagccaggc

SEQ ID NO: 2186 - DNA, 613 bp, Sorghum bicolor
  Clone ID: SORBI-28MAY03-CLUS36679_1
gcacgagggagggatgaagcgggggaaggggggaaggaatgggctgctgccgagctcgctgcggatcatctcgtcccgcctcgagacggtcacctccaacgccggctccgtcgcgtccaccgttcgctcggccggagcctccgtcgccgcctccatctcctcccaggccgaggacgagaaggaccaggttttatgggctggattcgataaactagagcttcatccatcatcgttcaagaatgtcctgcttgttggttattcaaatgggtttcaagtgctcgatgttgaagatgctgccaatgtttgtgaattggtctcaaaacgtgatggcccagttacgtttttacaaatgcaacccactccagtcagctctgaaggcatcgaaggattcagagcgtcacatcccatgcttctagttgttgctggtgatgagacaaatggcctgggtgcggttcaaggtggtcgcttaagtgctcttatcagagacacaaacagtgagcctcaagctggaaattgcatttctacccctacagttgtccgtttctactctatgaagtctcacacatatgtacacgttcttcgattccggtctgctgtatatttagttcgctgc

SEQ ID NO: 2187 - DNA, 495 bp, Sorghum bicolor
  Clone ID: SORBI-28MAY03-CLUS36674_1
gcacgaggaagaagcagagatagctgaaaacaacgcccggatccatcaagttcaagaaagaatcagtgcagtggtctccaaatttcatggctctcagtcagatattgacttgaaactcaattccttgaaggaagctcaaagtaaagtggatctagagactgaagcacttgtgttgaaaaagaacgaaattgataagttcatttctttatcagaacaaaaagattcagagttgagggaaattattggtgcttgttcctctgaagcaaaaacttgccaacagtcagttgaaataagaagaaaacttgcatcatcgattttgaagtcaagagaggatagaattgggttgctaaaaatggaggaggaaattttgcaagagattcaaatgcttaggcaaaaaaattacagatgcaagaactactcttcaggaggtatcttcaaggagaacaagcatacaacaagaaatggattcatttaagcagaagttgagcttcattg

SEQ ID NO: 2188 - DNA, 513 bp, Sorghum bicolor
  Clone ID: SORBI-28MAY03-CLUS36481_1
ctctaacccttcttctccccaccccctcgcccgacgccgccgccgccgccgcttgccggggtgctatagccatgtcacccgcggcagcctctgcatcacccgacgaccgcatccgaaactacgaagacttcgtgcgggtgcacgcgtacctgctggccgcggccggcatcccgccgtcgctgcaccagaggctgtaccgcaagctcgcggacgaggtgttcgacggcggggaggtcttcgccgtcgagccgtgcgaggacgggaggcagcggcgcctcgtgctctccgccgatgagtctctgcgaaaggagtccgatgtcttcctcgtcgaccacgcgtggtccttccgccttcctgatgcgctcaagcagttgcgggaagtgccaggactggctgaaaggatggcagcattgatgtgtgtggatttggaccgcaggatagaaactgaagaggcagatgacaaggatggtcacgagagtgggagcttggagcatgtattgcaggtagtcgaga

SEQ ID NO: 2189 - DNA, 614 bp, Sorghum bicolor
  Clone ID: SORBI-28MAY03-CLUS36507_1
gcacgaggcacgcttccccgtgcctgtaagctccgcgcctcctccactccaaatccagcgagcccaccgcccgggccccggggaaaccccctcgcgccgccgccgccggctcgggcgccctcccgcgcgcgcgcgtcgccccgacagcagccgcagccatggcgcagccgctcgtcgtgaagaaggacgacgacctcgacgaggaagagtactattcgccgttcctcggcatcgagaagggcgccgtgctgcaggaggcccgcgtcttccacgaccctcagctcgacgcgcggcggtgctgccaggttatcaccaagctcctgtacctgctcaaccagggtgacacctttaccaaggttgaggccacagaggtcttctttgcaacaaccaagctgttccagtctaaagatgcaggacttaggaggatggtgtacctcatgatcaaggaactctcgccttcagctgatgaggttatcatagtaaccagctctttgatgaaggacatgaatagcaaaaccgatatgtaccgtgcaaacgctattagagttctttgtcgtattatcgactcaactcttctcacccaaatcgagagggatttgaagcaagccattgtt

SEQ ID NO: 2190 - DNA, 585 bp, Sorghum bicolor
  unsure (1)..(585): unsure at all n locations
  Clone ID: SORBI-28MAY03-CLUS36537_1
gcacgaggggaggcgccgcccgccgagagtccagcgtcggagatctcctccgcagccatggagtcgctggccagcgccatgcgtcgcgagaaccgccggtccaaggccccgtcctcctcctccgccgcctccaccctcgcctcgggcagggtccctctcgtcatggctttcctctcctgcctcgcctggctctacgtcgccggccggttgtggcaggacgcgcagacccgggcgatcctctccggcctcctcgagaagagttctggcagcgtcccgaaggtgctctcggtggaggacaagcttaggaacctcggatgcaaggcgattggaagcaaaattgttgaggcggagatggacctgaccaaggccaagagcgaggggtacctgtgggggaacaggactgcagctgtcgattccgacaagaagcagcagcttcttgccgtcattggagtttacactgggtttggctcccgtctcaagaggaatgtcttccgtggctcctggatgccgagaggtgatgctctgaagaagcttgaggaaaagggtgtagttattcgttttgttattggtcggagtgcanatcga

SEQ ID NO: 2191 - DNA, 343 bp, Sorghum bicolor
  Clone ID: SORBI-28MAY03-CLUS3679_1
gcgtccggccggcgccgcttcccggctcgtcgcggcgcgtgccgctgcctcgggggcgcgcggcgaaggcgacgccgagactgtgttcttcgatggcggcgcccactacggcgacctggcggcgaacctgctcctgggcctgaccctgctgtggctgccgctgacgctggccgccgtgtcccgcgcgttcatcctgcggtaccgtttcacctcccggcgcgtgacggtggtgtcggggctctccggcgccgaccgcaccgacttcccctactcgtgcgtgacgtccgcggtggtcgtgccaagattcatcggcgagtgtggcgacatcgtcatcacgctcaag

SEQ ID NO: 2192 - DNA, 597 bp, Sorghum bicolor
  Clone ID: SORBI-28MAY03-CLUS36851_1
tctgttgaccggtccagttcacagcatgagacaaggtcaagaagtgctcacagtcgaggccggcgccacgaaaatggggatgcaaactctggcagccgacgcacacctaaccgattgccaccagcaccaccaagtggggggagatactaagtacattgattgatcattgcctgtgaccaatcagcatcatatgcccttgtcaggctctcatctgctactgatactggcggaagaacacatctgggaccaaaggacagagagcttactagaagatttggatggacggtgtgtatcaagagaaccaaagttgtttatagaaaattagaaatatataggtcattgatgattgtcatttcccgatcgttttggaggtattgatcttttggatcctcatcctgtgggattttgttcggatcagttggttttggttttgtacgattctgctgtaagtcttcccatcaaactggcaaatgtattctttacacccaatgtttcatttttcttcccattcttttagactaaaccacatgttcattcgtgatgctataccgctgtatgattatatatactgttcaattcattgttgggcgggaatcc

SEQ ID NO: 2193 - DNA, 821 bp, Sorghum bicolor
  unsure (1)..(821): unsure at all n locations
  Clone ID: SORBI-28MAY03-CLUS36892_1
gaagggacttgaaattttgctctagtttcaacaagttgaagtatttgctccttgatgaatactggtgagagcctgctgatttcagtgccctagcttgcctcctcaaactttcaccggtgttagagaagctcactcttcaactatattcagagggacctaaacataatgtggagattaaactgagctgcaaaccaatggagatatcaactgaaatatcacaacaccttaagacacttgaagtcaactgtgaagtgtatgacaagagagtttgcaatgttttgacgtttcttagtaagaaacttaacatatggttccagttcagcggatagaaggctatgcatgagaactgacctactggcacttaattaagtcaaggttaagtttgatcaactaaagcagcacaagaattaatgatgtcatatttgtctgtaatcaggtagctggcgtggtaccatgctatgcagttcaggctaccatctcgcttaataggagcttgctcaagctaattctactatttttatatgttcatttccntttaatgatgtatcangaaacctaatagcacattttgcttgcaatgttgaacctttgctaaggagcgatcacttatattcctcgaagtttgatattctggcctatcgattgtctctagcactgctgcaatggctaaaatgttcagatgttaccgcattttgcgcaagccaaagtctagagcaatgaagtcggtaaaggtattctgaatatatctatacctgatagaagtgtttttggttaaatggttgttggttctttcaaaaaaaaaaaaaaaccgtaaggatttg

SEQ ID NO: 2194 - DNA, 557 bp, Sorghum bicolor
  Clone ID: SORBI-28MAY03-CLUS36898_1
tctacaaggcctacaccagggcaaacgataaggtactagtgcagaagttgctcaagagaatgaataaacaggggattgtcccgaataaaaagttcttcctggatgctttggaagcatttggcacctctgagaggaaacccaggacatcaccagccataaactctgcaagcaaactaggtgcagattctgctggtgattcagaatcaggtacttctaaccagccagaggtaagcgtttggcaagtagctgctacataaggctgttggtttgaacaagctcgtcaaattacctgacatcaggaagaatacatttgatctgcaccagaaccgttaatatagtgtacttggagctacagcagttcctctactcccaacaggaacaggacgctcctttccctactgaagaatgctgagaccttttgtgcttcggcaaaatctgcttgtacatgtactctgttattagaagtaggtatttttgtttctagtcatcgttgggcatcacaaagttcgcggctctactgtactcttcgattattatgataggtccggccttaccca

SEQ ID NO: 2195 - DNA, 773 bp, Sorghum bicolor
  Clone ID: SORBI-28MAY03-CLUS36924_1
ccgtgatcatgcagctcctccgagacaacctcaccctctggacttctagcgacagcgctgagggcgaggccgctggtgctgccgatgccccaaagaaggaggagggcgaggctaccaagcccgctgagcctgccgccgcccctgctgaggagcctgcgcctgctgctgcctcctaaatctgtcaataatccccctcgataccacatgcgtctcggcatataggaaccgagacgtattcttgccccggttacacttgtctgcccccggacacacggatagctgggcctgtcttgggcgggctggatgatagtacgaggcttcttctttttgcgcggtgcgttgcttttttacccatggcgatggagagggaggaatcccaaagggtctggttttctggcaagggaaagtgtatggcgtggaatcttttatcttgttttgtccgtcggactagaaagaagggaagaagggagcaggaaaattcgatccgccaacactcggtgctgacggctatttgtcttcttttcctctcttctacctggcagataaatcgcaaagtttcctccccttttcacacatctttttcctttggcctactttccgtacctaacatctgtgtatctctcaatccccgtcttgttggtcattaagaacgtggacagggcttagcccgtcttgatggatcgtcacgaagaaggctttctcatgttaacgcttttcccccaattgtcttatgtcttttatgtctatctgttcatgtctattggttcgttctc

SEQ ID NO: 2196 - DNA, 737 bp, Sorghum bicolor
  unsure (1)..(737): unsure at all n locations
  Clone ID: SORBI-28MAY03-CLUS36933_1
gcacgaggcgacaagtacctgacaggaatgggaaaccaccttcgccatataagatgcgtattcctagaaagtgtactcctaaatgctatgagagccgagtgttgcctgctcttctaaagaagcatgttgtgtcagttaaccaaatttgactaccgattatcaaataagctagagactgatcttcaaaagcttaggtgtagagtcaattatcatgcactaaggtttacagacccaatcttcacaatgggtgaaatgcttgtccaaagaatgagggaaaaaagtgggcgcttcattgctcttcacctaagatttgagcctgacatgcttgcgttctctggttgctactatgggggtggagacattgagagaagagaacttggtgagattcgtaagaggtggaagaccctgcatgcaagcaaccctgacagagaacggcggcacggaaagtgccctctaacaccagaggaagtagggctcatgcttagggcattgggatttgggaaggacgtgcacctttatgttgcatcaggagatgtatatggaggcgaggagacactggcacctctgaaagcactcttcccaaactttcactcanaggaaactctagcaaacaaggagttagctcctttgttaccatattcatctcgcatggctgctcttgattttattgtatgcgataggagtgatgtttttgtgacaaacaacaatggcaacatggccagaatgttggctggtcg

SEQ ID NO: 2197 - DNA, 462 bp, Sorghum bicolor
  Clone ID: SORBI-28MAY03-CLUS36945_1
gcacgaggcagcccccaagaccccatcacaggcacaggccgcacagcgaactctgcgcatccacctctctccaccgctctctcctctctttgccccgcactggaacgctctcgacttctcgacaccggcagcagcaggaggtggagcacgggcatggtgatcggactcggactcccctgatctcagcctcttttcaccagcgcgagggcggcgcgggctcaagccgggatgggggatctgccggcgctgggcgggaaggcggcgcacctggtgtccgacctcgccaccgtcatcctcaaccccggctccgagcgcgagcgccagcgacaccacccctcccacctcccggaggcctgcgagcgggtcgtcacacttctcgtcctggtcgtgcccgaccaaggttctgggtccccggatgctcctcccgcagcctccgtctgtctttgtctactctgtatcgaa

SEQ ID NO: 2198 - DNA, 358 bp, Sorghum bicolor
  Clone ID: SORBI-28MAY03-CLUS36583_1
gcacgaggctcctctgctctgctcctctcccatcacagtcctcccctcctctgctctactgcagcacacctcacatcagctcagccgcgcctcctcctcgtcttgtggtgtcgtttccccttcccgtcgccacgccctgcgccgccgccgcctccgcgccctgctccgcgccctgccctcgccgcccccccatctcgaggaggcggtgccggtccggggacatgcaggcacgcatccactccgctggcggcgcgtggtcggtgtcgcttccactgcccgacatgctggccgggcccgccctggaggtcccgatacacgcatgcagacggtggagatgaaggtacggatcgactgcgaa

SEQ ID NO: 2199 - DNA, 639 bp, Sorghum bicolor
  Clone ID: SORBI-28MAY03-CLUS36598_1
aaatcttagacaagctgcatcgccaaaaggattgcaaaagttgaaaagcttagcctgcccgtgggagagttggaggaggctgttcttcaaggtggtgcaacagctaatgttgttcgagattaccagcgcagatttcaagaaataaatgaagaaaagagaacacttgaccgtgaactggcacgtgcaaaagttacagcaaacaggggtgcttctgttgttgccaatgagtggaaagattctaatgacaaggtgatgccaggtaaacagcggcttgaagagcgtagattcttgcagggggagatgcaacaacttcgtgacaagcttgctgttgcagaacgtacagcacgatctgaagctcaactgaaggaaaaatatcagttacgtctgaaagtactagaagatggactaagggggccaccaagtggctctagtcgtccacctactgaaggaaagagctttagcaatggcccttctcgccggttatcacttggtggagctgataacatatcaaagttgtctccaaatggcttattgtcaaggagatctccttcttttcattcaagatcgtctctttcgtcaaacagcagcttggtcctgaagcatgctaaaggcacttcaaagtcatttgatggcggaact

SEQ ID NO: 2200 - DNA, 787 bp, Sorghum bicolor
  Clone ID: SORBI-28MAY03-CLUS36606_1
cagcgagcgagcagcactgcagcagcagcagcagcgcaggctcggctccgtgagggtcgctcgcctgcagtagcttcgatcgagcgtcccggtcggcgaggcaggcgcccgatcgcccgcgctccgggagcttccgccggggcccgtgccgtcggatggagccgtacgcggcggcgaagggcggtggggccgacgccggcaccggcctggaagagtcgatgcggaggctggggctcggcgacgacggggaaccgggggaggagaagcttccggagcggccgggcgaggcggactgcgcctactacctccgcacgggcgcctgcggctacggggagcgctgccgctacaaccacccccgcgatcggccgcctccggttaatggagttggaaagaccgcaggtatggtggagtacccagagcgtcctggacagccactctgtgagtactatgcaaagaatggcacctgtaaatttggttccaattgcaagtttgatcatcccagggaaggtggttttgtacctgtcacattaaacagcagtggattccctctacgtctgggtgaaaaggaatgttcctattacatgaaaactggacattgcaagtttggatctacatgtaaattccatcacccagaagttggttttctaccggagacacctggcatgtacccaccagttcaaccatcacctatttcctcctcacatccatatccgcatcttgccaattggcaaatggggaggcctcctgttgtgccagggtcatttttaccaggctcgtatccaccaat

SEQ ID NO: 2201 - DNA, 526 bp, Sorghum bicolor
  Clone ID: SORBI-28MAY03-CLUS3699_1
cacacagagaagccatggcgctgtccctctccctcgcgcgccccgcgcccctcgccgtctctgccggcgccggagccaggagtctccccgcacgcagcctcgccttcccggccaaatcattcttcggcgcaccgctggcagccaccgcggcctccgtcgcgtcgccgctcccgcgcaagccggccacctccacctcgctcgaggtcgtcgcggcggggaagaaggggtacaagatgaagacgcacaaggcgtcggcgaagcggttccgggtgacggggaggggcatgatcgtgcggcggtgcgccgggaagcagcacttgctcgccaagatgaacaccaagcgcaagaagaggctctccaagatggttcaagccaacatgagtgactacgacaatgtgacgggcgcactggcctacctcaaagtgaataggatagctaactgagatctacgtcgtctttaaagtcaagtttaattccaccaatgtggaattttgtgtttcttcgtttgtatttcctttaaaatact

SEQ ID NO: 2202 - DNA, 578 bp, Sorghum bicolor
  Clone ID: SORBI-28MAY03-CLUS37011_1
gcacgagcccgggggtatcatcgaccggcaggatgcttccgcagaaagcgcccaaaatcgcgtctgctgccgccgcagctccggtcgaaggccgcgaccatatcagcaacctcccggacgccgtgctgcagcacatactctccttcctgccggcgcaggacgtcgtgcggacatgtgtgctcgccaagaactggcgccacatgtgggagtccaccactgtcctgcgcttcttgtgcggcagaatgaaggaaccagagtccacggtggagattcaggagttcgtggaccatctgctgcgcctgcgaatccgcggaggcatgccggtcgatacctgcgagttccgtctcctcgagtttgatgaggacgagatgagaagcaccatcctttggatccgtatagctctccagtgcaaagtccgggtgctccagctcatctgtgcaggcaattgtggggacattccttttctcgatggccatcctttcttcatctcccaatacctgaagaagctagagctttatcgaatcgacttgagtatggatagggatagcaggtttcttgacttctcctgctgcccagtt

SEQ ID NO: 2203 - DNA, 468 bp, Sorghum bicolor
  Clone ID: SORBI-28MAY03-CLUS37024_1
gcacgagggcgccggcggcctacgcgacagcttccttctctctctctctcgactgcgccgttacagcctgacgcgatggcctcgtcggcgacgagcagaggtgctcatgcttcgaggccccgctcgccgtccgacccctccgcggggcagtgtgcgcgcggcgccggacgcggaggccatcgacgcgctgccctacatcgacggcgactacggtgacccggcggtgaagcgggaggtcgaccgcctcgtcgaggaggagatgcgccgagggaagcggaagcccgcagacttcctccgggacctgcctcctgttcccacggccggattcgagagtcatcctatgcttgctaaagaatatgaacgagttagggctggcaaacctcctttcatgctagatatgtctcgctatggtttggagccacctccaatgaacaggaggaatgatgttggtgcctggaggcaggctct

SEQ ID NO: 2204 - DNA, 428 bp, Sorghum bicolor
  Clone ID: SORBI-28MAY03-CLUS37026_1
gcacgaggggggactggcaggagctgggccaagcggcggccatcggcctcctcttcgcctacctggtcgccaagctcatctccaccgtgatcgccttcaaggaggacaacctccgcatcacgcgctcccctccgtcctcccccaccgcagcagcccccgccccggccaccccgttccccgcggagcctcgcctcccctcccacgacggctccaccgacggcggaagcgccagcgacagtgactgggaggcccgggggagcaccgagctcgacgaagagttcagcgccgcctccgccttcgtcgcggcctccgccgcctccggcaccagcgtccccgaggaggcgcagctgcgcctctacggcctctacaagatcgccaccgaggggccctgcaccgcgccgcagccatccgcgctcaagctcaaggcc

SEQ ID NO: 2205 - DNA, 606 bp, Sorghum bicolor
  Clone ID: SORBI-28MAY03-CLUS37039_1
gcacgaggtgagggtatttgcaatggtttgcattatcttcatgagaagtggcaagctagcacccctattattcacatggacctaaaacctaagaacatattgcttgatgacaatatggtgccaaaaattgctgactttggtttgtcgaggcttttcggtgaagagcaaactcgaacttgcactgcaagtcgtgatggaacattgggttacatggcgccacggggcttaaatagaggtataatcacaaaaaagttagacatattcagtttgggtgtaataatcatagagatagtgacagggcacaaggactacccagatgagactgacacatcatcccaggaatttattgagctggtgctcaagaattggagaaataggctggaaaaaacaccgggatatacaactgccttttctattttcccatctttttgccgagaaattgattaccaacgaataagaagatgcattcagattggtctagcctgtgtgaaacttaatcgggcgaaaaggccaacaacacttgaaggtgtgaacatgcttcacaaatcagaacgtgcagaatgcagcaatggaaaagaggattatactaatgaacgtccggaagaa

SEQ ID NO: 2206 - DNA, 526 bp, Sorghum bicolor
  Clone ID: SORBI-28MAY03-CLUS37062_1
gcacgaggtgaagtccagaagacatcgcaagtccagcgttagttccaagggcaccgccacacggcggtcgattcgccaaaagttgaccgaactgccccgtcctgcaacggctgacagatccaattcggcactgggctccacggatgattccgcttcgtgtgccgtcgaattcggcgatgacatccgatacgacgcggacgacgatgccagacgactggacatgccccggtcccgggattttggacagcagccgtccagcgtcaacgtgaagcccgccagggaggatcggaaggccagaaaggaacagaagaggcgacataaatcagaagtcatggctgagaagcaagacgccgttgttgacagcgcccccatgccaaaccggccttccctacagtcgcacttgtcggaacccaatgtcaatcgtgacgatcccgaccccgttgacgacattccgaagagaaaatcgccttttagaccggttatgccatcattgctttccaataccgtattttcaagcggacagcca

SEQ ID NO: 2207 - DNA, 803 bp, Sorghum bicolor
  Clone ID: SORBI-28MAY03-CLUS36712_1
cgcggcgccatgcatgtcatcctcttatgaacatgtcctaagcttgccgccgcacgcatgcaaccgcacctcgcaaggcaagacaatcgaagctctagctccggtgtcaaagcactcaattagcaagcaagctagattccttgtgatggaggcatcgtcgtcgtccttgccttgacacctagtccaccaaccaaaaccagctagccaccatgcgcgccaccacctccgccgcggctccttgcttgccctggttgcgtagccatggacacggcagggcctcgtcggcggccgcctacaccgccgtggccgcctgcctactcgcgcttgtgaccttcctggtggtggctgccttctgggaccccaccaggactcaagcttccacctggttcctgtcgtcgtcgtcgtcgtcgtctgcctcgtccttgacgactgccggtggagttggcggtgagcacctcctggccaccgccagttcgtactactccgacggcggcggcggcggtggcggcaggaacagcactggcaaggaggtgcacgaggaggtccgcggtcagggtggtgatgacgatggcttcctctccttggtcaactccagctccggcggctatggagcgccgccgcctcatcagatctccgtcacgccggcgcccgccgcactggctccggcggcgtctccagtgacggggaactcagatgaggtgatccgacccacgccgcaagttgagacgagcagggacatcaaattggagcgcttagagctaggtctcgcgaaagctcggtcggcgataatggaagccatccga

SEQ ID NO: 2208 - DNA, 481 bp, Sorghum bicolor
  Clone ID: SORBI-28MAY03-CLUS36728_1
gcacgagggttgactagcgcgggggccaagttggaaggaagcaaacaaaaactggcagtactgaaagcacagggagacaataagcaagcaacaccgatccttgttcctacactgggaaacaaaaatatgactgcagaaaaggtgagagataaacgaacagaattgcaagatcttgaagctacccacaaggagttaatggaattgacctcgaagcgtctggaggaaattagaagactgcatacagagagaattgaaattttgaacaagttagcagcttttcagaatatactgatggatttcaaaagcattcgctcttccaaagcttttcaacttgtcaatgaccaacttcagaagtcacaagcagaacttgatgatcagcaaacattgttagagaaattacaggttgagatggatacctttgtttggagagagaggcaatttaatcaaaaagctgatttggctgaaatcccccagaaggttt

SEQ ID NO: 2209 - DNA, 585 bp, Sorghum bicolor
  Clone ID: SORBI-28MAY03-CLUS36735_1
gcacgaggactttggatacgtccgaaattgatggttcattgtctgctggaaatgatttgaattatattggttctgacgtcttgaaagagaatgagctgggcacgggggaactattagaacttgaaagacgagagcttattggtgaaattctccgtttaaatccaggatataagacgcctgagaactacaaaccagtacttaaggagacaaaagtccctcttccggcagaagcacatccaggacataatattattggagttcttctaggacctgaaagcaatacccagaagcgactacatgaagaaactggagctgtcattcgagtatatgggactaagaaaatcaatggagaaaagaatgagattcgtcatcaagacataaatgaagcacaagatgcttatgaagacctatacatcaatgtatcggctgactcttatgataaagtagatgctgcagttgtgttgattgagctgcttcttgctcctgtttccgtaaagtcaacagctacttccacaactactgctgttccttcagaagttacctccaaggatgcagtttcagcaaatgtgcaactggtgcagaata

SEQ ID NO: 2210 - DNA, 490 bp, Sorghum bicolor
  Clone ID: SORBI-28MAY03-CLUS36744_1
gcacgaggggaaggaggaccaccagcagcagcaccagcagctgcgggcgctggcggcgagggccgtcaccgactcgctccgcgccgcggcgtcgcggtgctcggccgccgaccgcgccgcgcgcttccgggactgcgtacgcagcctcgaggccgagaaggccaagatggaggtcttccgacgggagctccccatcagcgtccacctcgtcgcagacgtcatccagtggctcaaggacgagctcgcgcaggcgcagcaccgccgccaccctccgccgccgccgccgtcggacctcttcgcgcctgccaccaccgaagcggcgggggcgcccgctccaccgccgcagacgcaggcacaggcacaggacggagccgccgtcaaggcggatgacgccgaggcggacgccaacgacaagcggagctggatgagctccgcgcagctctggagctgcggcagccacgacgacagcaccgccaacaccaatggcgtc

SEQ ID NO: 2211 - DNA, 606 bp, Sorghum bicolor
  Clone ID: SORBI-28MAY03-CLUS37139_1
tacagtgcagagtccattgaaactgatggccaaagtgagaagttaaatttagttaagtttgaaattcagctttacaaaacaagagacgagaaatacctcctggacttgcaaagagtcagtggaccacagctcctctttctggacttgtgcgcggcctttctagctcagctgagagttctttgattccctgtgtctgctttccatcaaactgcattccttgcattacaggaatgcattacactagaggaatgtcgaatcgctcacaaagctgtaaatagtaatcatatctccagtagtttgatttctggagtatgtagattgtagacatgcgaagctgttgtgcctggctaccttctgaaccagactttgtggagcaagatggctcctggttctttacagctggccggctgccggtgaaggcactaggatatacagtgaactagatcagtgctttttgctggctttattgtctatctacatgaataatttcagctcctcataatggttaatccaaagctgagcagcgtacaggtcaagagatgcgttttaaggcattgtttacaaccttttgtggatttttaatctctacctggtaatcagtttgtc

SEQ ID NO: 2212 - DNA, 700 bp, Sorghum bicolor
  unsure (1)..(700): unsure at all n locations
  Clone ID: SORBI-28MAY03-CLUS37116_1
gcacgaggcttatcatagcaatggatgctgcatttggcctggaatatttgcactcgaaaaatattgtgcactttgatttgaagtgtgataacttgctcgtaaatcttaaagatcaatcgcgtcccatatgtaaagttggtgactttggcttgtccaaaataaaaagaaataccctggtttcaggaggtgtgagagggactctcccatggagggctccagaattactttatggaagcagcaataaggtgtcagagaaggttgatgtattttctttcggtattgttatgtgggaaatcctcaccggcgaagaaccatatgccaatatgcactatggcgcaattatagggggcatcgtaaacaacacactgaggcctactgtgccagcttcatgtgatccggagtggagaagactcatggagcagtgctgggctccggatccggcacagcgcccagcgttcacagagattgctggacggcttcgctctcatgtcagttgcagcaaatcaggcgaaagcaaccaaataaattacaggtggagtacttcctttcaatccccaatttgttgggggttcatttctctttttttttcccttctctttttgactggagagtaatacatatacatgtatgttatagagtgctgtaaaaattagtgcgtcaatttatttataccatgtcagtggctggactgtanccggta

SEQ ID NO: 2213 - DNA, 406 bp, Sorghum bicolor
  Clone ID: SORBI-28MAY03-CLUS3716_1
atcgtccggtggaatgttgcttgatctgccacagtagtgatctgggtgattgggtgaactgtggagtatgtggagaatgggcccaccttggctgtgatagacggcaagggctaggcaatttcaaggactactcaaagacaggcgggctggaatacatttgtccccactgtagccatgcgaagtcaccattgcctgtacaagtaggcaatgactcatagaatatacagcatctgcaccatgaaatatgtcaattagcttatgttatttttcacctgttaccccccaattcttaggggtgatggtgtgggtagagaatagtggctatggatgtgcagattgtagtgttgacctgtattattgaatatgatccagaagttttaaagttgatacaccggcaactcattcc

SEQ ID NO: 2214 - DNA, 699 bp, Sorghum bicolor
  unsure (1)..(699): unsure at all n locations
  Clone ID: SORBI-28MAY03-CLUS37161_1
cgcacgggcacctcctgcctataccctaccgtgcactccccctgcgctgcgctcttctcaccgccgccagaaggcctccgcctgtctctctttctctctccatcgcatggctctcgcgtgcgccactcacgcgcgccgcttcctcctcgccggtccggcgagatctttccacgcccagccctaccaagccaaggtcggcgtggtggagttcctgaacggcgtcggcaagggggtggaggcgcacgccgcgaagctggaggatgctgtgggcggcgacctccagaggctcctcgagacccgcacgctgcggctcaagaagctcggcatcccctgcaaacatagaaagttgattttgagttttgctcataagtaccgtcttggtctctggaagccccaggcagatcctaggaaagttgaataaagttggtttgtttttgaaagatagtctactgttatacggaagcatgtttgggacgttgaatagttgctttgtaatttgggggccgcaaatctttgttccctggctctggccatgcttgtttgcaaccattgcacaaacttctagaaaaaatccaacttcgtgtgtgcgtggttttgttcttttgtaataacaaaccttaacaggcgcagtccctatgtctgtatttttccttaggtttcttttcaancaacattgcagttttgtgaatggtattttaa

SEQ ID NO: 2215 - DNA, 979 bp, Sorghum bicolor
  Clone ID: SORBI-28MAY03-CLUS37162_1
cttgctgatgcatattatactaatacacggtttaaaagccttcaagaaaatggaggtggaactagctcacaagagggcaaccgtaaaaagaaggggaaggggaaagctcctgtcacagaaagcagtgctgccaatgatgtgaagggtgcactagcagataacattctggacactgtaagaaggcttcaatcaaaccaccaggctcaggaaggagaggctgaggtgctgtcgaaggatgggtatcgaccttccaagggggtccaaccggcagctggaccttcatctaatctggacagttcagctggtgcaaaagataactcaggcaagggaggaggcaataagcaaccaaagaagacatcaaagtttctcagagctcgtttaggtgacaactcattagccactcttgatttaagtcgctctagtgcaagtcctgaacgtcctgaaagggaatcacaaggcccagaggcggggttaccagtgcgaggtgcttggaagaatggtgggggtcagaaactctttttgagcaatggacggaagtaaagagtcattgcaactgcatttagacgtggagatggggttgccaggtgcttggaagaatgatggcggcagatactcttttttgagcaatagtttgaaataggagtcattgcaactgcatttagacgtgtccatatacctgatcaactaggcaatgtcctgtgcgttgctaatggcggcacacaaatttgcactatatcaaattttgtagccatgcttttcaaactcgtaatgatgtggtgggcagcacgtacttgatgtggtataaatatactatatactagatgatttttgtgtgcgttgcaagggagaacgtttagtatcgtcgaaaaaaccttgccaggctaaagtcaagatatagaggattcgtgtccacatgctgctgtatgtttacaatgctttgttctttaaagtccagatgttgctatatgtttgcaatggt

SEQ ID NO: 2216 - DNA, 708 bp, Sorghum bicolor
  unsure (1)..(708): unsure at all n locations
  Clone ID: SORBI-28MAY03-CLUS37166_1
gcacgaggcttgattacacgcggaaggccataaacaagcttactgagctgaagaagatgctggaaaaattcaaaaatgatgtggagaagcaacaagtggaccaaatggcagattggcaaacaaagcttgttatgatggactccaaggagcggcagtatatcctccaagtctcaaattataaggcaatgcttaatcgagtgggttatacgccggagatcaatcatggtgtgttgatggaaatggctgagcataagaaggatctcgagaggaagacaaaacccatagccgatacattaaggagctaccaggatttgcctccagataaagctctagctgcactagctatagaggacaaaaagaggcagtatgcagccgcagagaagtacctagaagatgtgttgcaatctgctctaaccacaactggcctataatgtgcatagttttgtttggtgtatcttacatgttggcattggtttaaggtcaatggtaattgacttgtaatttgcggcttgcttaaataactgtgtaacatctccctatcttcaccatagaaattaagttctgttgcagtaatgatcttagcgacaaccaagacactcgccagtgatcttggcctgttgtgtatgtgtgtgtcttgccttaatgtgaatgtgattttggatgaccagcttgtctagagatgagcttatgtggtgttttaatggannc

SEQ ID NO: 2217 - DNA, 641 bp, Sorghum bicolor
  Clone ID: SORBI-28MAY03-CLUS37164_1
catattctggaagaagaacctgaaaaacttgctggacccttattagctgccacttaggtctctgtgctcgagggtcggaccgcaggccatcgccacatgctcgccaccggtgacttgtcctttggattgcctgtctctgttaccggtattgcgacccctcacggtctctctgctggtgtggcgtggttcctgctgcctgggcgccagcgcttctgcgtcatgcttccagttccctactgtgctgttgcgccggtggacctgggcccgctcctatttgcccgacttggcctgttgatccccagggaccgtcctgctgattcgattcttcaggctataagagatgagacaatgtatgatccacgtgaaagaattgagatggcacacggccattcactctaccgaccatctctgcttggtcaaccaaaagatgtcaaaacctagaatttattttctttccctttcccttgttggttagaacttagacgatcttgtgagttgctatatgtttatgcacggtgtaattgttgttgtaacattagtgagctctgagaagggacctgattcatgttagcttggtaaatattagtagccttgtatgatgcagggcatgattttaggggaaaaaaaataaaaccgatttc

SEQ ID NO: 2218 - DNA, 497 bp, Sorghum bicolor
  Clone ID: SORBI-28MAY03-CLUS36959_1
gcacgaggctcaacggccgcaaggccaacctctccttcggcgccgcggcctatgtgacgcacgaggacaacctgattggcacactgacagtaagggagaccatctcatactcggcgagtctgcgactccctgacaatatgccaagggaggagaagcaggctttggttgagggcaccatcgtcgagatgggacttcaggactgtgccgacacagtcgtcggcaactggcacctgagggggatcagcggcggcgagaagaggagggtcagcatcgccttggaaatactgatgaggcctaggctgctcttcctggatgagcccactagtggtctcgatagtgcttcggcattctttgtgacggagacgctgcggggactggcaagggatggccgaaccgtcatagcatcggtccatcaaccgagcagtgaggttttcttgctgtttgactgcctctatcttctatcagggggcaaaacagtctacttcgggaaggcctca

SEQ ID NO: 2219 - DNA, 770 bp, Sorghum bicolor
  Clone ID: SORBI-28MAY03-CLUS36984_1
ctactggctgcccagtagcggatagcttggagatggatttgtttggatcagatcctattagttcattggctttggtgtctgtgcctcaaccaacgaccacatcaaatgttgaagcaccggcaaattcaggttttgagacaaatagtttcgtgggcatgcctcctgcttccactggatttggcgagattgatgcctcaaatccttttggggatcctacacctttcaaggcagttcttgatgaaagtccagcactacctcagacacatgctgcaccagctggttctttccagtccagtggacctggtgcggatgtgaaccctttccagcccgcttcagccgcaagctttggttttggagacactcttggtgatctcacttttgcatcaaacgctgcacctgagcagcaagatatttttgcaaacacagcctccttcccttcagagttagcaccagcaaacccgtctgtggttctgcagcagccagctcctgcaaatttcccctctcagccacctcagccagttgctggcccattgcatgctgctcccacagcatttgctccttctcaggccgctcccacatcattcgctccttctcaggctgctcccacatcatttgctcctcctcaggcacctcaggctgcccctgtgtttgcttattcacaagcgccgcctcatcctggtgctgccaaccattctcaatttccccagactgctgccccgtcttttcctccttcgcaggtgcctcaatctgtagcacccagtctgccatca

SEQ ID NO: 2220 - DNA, 510 bp, Sorghum bicolor
  Clone ID: SORBI-28MAY03-CLUS36986_1
gcacgaggctggtacgattggtctatacgaatgtgatctctaccacaccgcagtttttgtttcctgtttgaaattctggcctatgtctagagtccttgggccgatcagctcgctcactgattaccaaagtatcaaacatgcaacacggttctgatgtgcttgctcatcgaaaagtatacgtggcgtttgacactaacgttacgtggtgctgcactcctgcgcttctctttgacctggaagtttctactttaatattttgacagctttggctccacaaaaatcgtgtctgcttctttggtgtttatgccgcctggacgccttgttgcccacctgaggctggcgtcgacgtcgatacaacctttagtttctaccagtatttattgtctttttgcaaaaaaggcaggatcccagcttctgtgaggccgtggctggtgccgtctgcctctctgcccacagaacgtgccaggtgccatgtcgtttggggcaagcgggcaacagctgcacgtgaca

SEQ ID NO: 2221 - DNA, 519 bp, Sorghum bicolor
  Clone ID: SORBI-28MAY03-CLUS36989_1
gcacgaggcatctctggctaaaccctcatacagagtctcaaagaatcggccgatctgatccggattactccctgaaccaggtagaactatgacggcctcgccaaagttcaagggggcacgcgttgccgattcctcttcacccaacacatgattctcggctatgtctcttgggaagtgctgtgagaacaagttgaaatcaaggcgcttatgcaggtgcagattgagccacatattaataaaccaccaggggcctcccaagttgccgatggattggccaagtaggagtttctgggctacctgatggagaaggtggtaaacagcgccaagaaggtatcggccaagaggaaattggccaccgttagctagtctctctgctgccgatagataaacggaagtcggtcctgccgatcgaccacagaatacaaacttgtccagccacatgttcagaaaggtggtttgctcctttatggtgacaggccctctcccacggtacttctgaatgtaccctgaccaaccgcc

SEQ ID NO: 2222 - DNA, 510 bp, Sorghum bicolor
  Clone ID: SORBI-28MAY03-CLUS37282_1
acgttgcttgtcatcaagcctgccagcgatggtagcagcagtggtcatggcaatcggaaggaagttgacgcctttgtttcaggcgcgttcgatggacccttgaggtttgctgcgaaggcagtgatgaagaggcgcacctatctcctggagatgaatgggttctagagacccatatatcttgctttttgatgctttctatgaagaggggcatcttcctcctgtctgatctttgtacatacagtataaccatcatagcggatgatatgatatcagattattattattacctaagctaagcatccgtagagaattgtgatgtctcgctgtacatggtggagcacaccgtttgtgcctgctgagaacacgtgtagcatgaagtatgtgcgtgtcccattgctcaatgaaaggcgtcgaaggaggatacgtttcccaggaagtgctgcaatgaaggcggcctagtaatgtctgttggtcatcccctaaaaaaaagttactatcgttcacatgccc

SEQ ID NO: 2223 - DNA, 550 bp, Sorghum bicolor
  unsure (1)..(550): unsure at all n locations
  Clone ID: SORBI-28MAY03-CLUS37286_1
gttggagggaaacactatgcaggtgtgaaacatgcagcaacttctatgcacaacgaggtattgcatatcttactgacaaggaggattctattgaggaatatgagagaattgccaagcagaagagggagaagaaactggagcagcagcaaggagctgcaacaaattttctgaattcacttgatcatgttcagaaaatagagatgttgagtggcatcaatgacttgaagaatgagttccagtcctttctggagtcctgtgatacatcgaaaccaataacatctgaagatatacgctctgttttcgagaatctagctaagaagaagaaacagaggttatcttagcttgtgccgcatcagaccccacatgaggcaatcgttctgctggacagaggtcctagttgttgggtatctttaggcatcctgagtaaacctaatgttatcttaggtggtactagagttgccagtaatgtggaattctagcaggaacactgtaatgtttaatgcaccgaagtcgcttgcagtagattntgatggcccaagctgccaataac

SEQ ID NO: 2224 - DNA, 431 bp, Sorghum bicolor
  Clone ID: SORBI-28MAY03-CLUS37306_1
ttggcctctcgccgcgccggctccgccgtccgcgttcttcgccacatctctttcttcccggactccggcgctcccccgcggacgtaccggccatggatcccccatccgctcaggtgatgtccacgaccgacgacttccaggacaaggccgtcgacgagtgttgctcttgctgctacgattgctgctccagcatcctggacttcctctgctgctcgtcttgatcgatcgatgtcgatgctgatgctgctcctcgacggccctgcggaatttctcaaggaagcggaggccggccggccacaccgtcgcctcgctgatcttggattctaggatgtcgtgggattcgtatgttctttatgaggtccttcggtgacgatatttgtaaagccggattcagttcgtcagtaacagtaaggaaacttgatagactgcaa

SEQ ID NO: 2225 - DNA, 611 bp, Sorghum bicolor
  Clone ID: SORBI-28MAY03-CLUS37332_1
tcttgataaaccattggttgtgaaggttaagttgagtaaaggaggacctcgtgtatcgttgtatgagtcgtgtaaaaagcttcagtggccaatgcctatgtttgaatttgtgaaagtcgagccaagtgtgtgctcctcttccggtgattcttcacaaaaggttgcaccccaaggatatgcatttgcttcaacaataacattgcatataccgagcggcgatatcatcagcctcacaggagacggacgtgcggataagaagagctcacaggattctgctgcgctgctcatgctctatgagctgcagcggcgaggtagattccaagtccaagaagtatgacgaatcacaacagattcatggttccatcaccaaaggtgtaatgttacctccgattattgcttgggcatcttggaataatgtcatcaccagaccagttgcccttagttggctgctgcgatgtaggaaaataatgtagccgtgtaggttactcttgttcttgccttgtgatgaatcagacatttcatctgtatatatataggcgcatgccaataagagccgtggtcatgatgtgtgtacacatgcagtaataaagcatcacagggtttccagactc

SEQ ID NO: 2226 - DNA, 487 bp, Sorghum bicolor
  Clone ID: SORBI-28MAY03-CLUS37337_1
ccagagtatgcctacacgatgcaggtgacggtgcctggcaatgtgtacagctacggggtggtccttctagagatcctgacatccaagctacccgtggcccaggtgttcggggagggcgtggacctcgtcaagtgggtgcacgccgcgcccgcgaggggcgagacgccggagcagatcatggatccccggctgagcaccgtgtcgttcgcgtggcgcaggcagatgctcgctgtgctcaaggttgcgatgctgtgcacggagcgcgccccggcaaagcggcccaggatgaagaaggtggtggagatgctgcaagaggccaagaacagctgagtgatcatctgtttctctgctgagtgctgaatggctgctgtcgtcccctgcttggaagccgagctaagcctctgaaaccaaaaaaaaaaaaaaaaacagttctggtcatcggttctgagtatgaagtatgaaacccatccagtagcgtttgattctc

SEQ ID NO: 2227 - DNA, 431 bp, Sorghum bicolor
  Clone ID: SORBI-28MAY03-CLUS37352_1
gcacgaggaatttaatagccatggcatacaagaaagtagtgcttggtctctttaccctggccttgttcctcgtggcacattatgtggaggcggtggatgtgtgcacgacgaggaactggtatttctatggcccgtgcatgagcaacaagaattgcgcggcttcgtgcatccaacatggcattggcggcggtggctactgctccccctggagacgatgcaaatgtacacttcagtgtccttggagaaaaatgacgctagccgggatcgggttgacacatggccgggacaagccggaacccttggacaaacctagcatggaactattcaactgagtgttgcatatatctatatgaagttcaccgatggaattgaataagagaataacacctgtagttatgatgttgtaagcaaaaaaaaaaaaaaaaaaaaaa

SEQ ID NO: 2228 - DNA, 670 bp, Sorghum bicolor
  unsure (1)..(670): unsure at all n locations
  Clone ID: SORBI-28MAY03-CLUS37358_1
ggtttggagaaactgtgctgaggattacaggaaccctgtgtcaatatggtttccaaggccaccggggggatacgtatctcttgggtgtgttgctgtcccttcattcgaggagccccctcttgactgtgctttctgtgtggatgagagactcacggaggatgcggagtatgaggagcaaatcgtatgggcatcatctgatgcttacccatggggatgctatatctaccaagttcagagcgcctcactgcatttcatggcacttcgtgtcccaaaagaaaaatctgagcaaaggcccaagaagatgttggagtcattatttgtgcagcgagcatcagagactccatgtcaagacaagcaaacgtgccgtgcatgaagaaggtgtacataatacatatacgtgcgtggaagaaactcgactgggacaaaggactgagagtctcgtgcaagaaagctcgaagaaagccgctgctttcggaccactgcatttctccgtggtcaaagcatacacagagccttgcatcccaacactttagttggcagcaagttttgtaaactagagtagtaggttgaaagttgtaaatataaaatattgtaacgtttggtatagtttttgtccagcattacatgataatagaaatgttcggatggataattatcacgcattgtttnt

SEQ ID NO: 2229 - DNA, 500 bp, Sorghum bicolor
  Clone ID: SORBI-28MAY03-CLUS37086_1
gcacgaggcagcagcagcaacagcaagcagctgcagcggggcgggtcgtcgctgtcgtcctcgtcatcgtcgggcgggtcgtcgttcagggccggcatgcagctgaggcggctgtcggggtgctacgagtgccacatggtggtggaccccgtgagcggcagcacctccatgagggccaccgcctccaccatctgcccttgccccgactgcggcgaggtgttcgtcaggcaggagagcctccacctccaccagtccatcaggcacgcagtgtcggagctgagcgcggatgacacgagccggaacatcatcgagatcatcttccagtcgagctggctgaagaagcagagccccgtgtgcatggtggaccgcatcctcaaggtgcacaacacgcccaggacgctggcccgcttcgaggagtaccgcgacgccgtcaaggccagggccgcagctggtggcggcgccggccagcagccggtggcgatgggggccaacaacaagca

SEQ ID NO: 2230 - DNA, 689 bp, Sorghum bicolor
  unsure (1)..(689): unsure at all n locations
  Clone ID: SORBI-28MAY03-CLUS37102_1
ctgtgatactattagtgtcagcaagaaagcccaatgcgagccattatctanatcctccccagtttgtgtgagcaaacgaggagagcagccaatgttcacaatagaacaggtgcaagagatgattactcaagccctgcaagggttaaatgaagcttgggagaaaaagtttttgtccttggagcaaaagatgcccagcatttcctcatcgcaaactgtttctaatggtgtgaaggagtcatcattggctgttggaagaagcaaacggtgcaaactggcccgacaggatacattagattccatggacgaagaagatccagatgcggaagatgatagcgattatcagatcaaggaggaggagcattcgagctgagtcagccgtgagcttgctgtgagctgtggctcagttctcatgtctttctggagtttgtgcaggacggtgccttggcagttggcactggagccaagtaactgtgccggctggcgacggtccgcgtgtaaattatgtgcatatttcagcgaatgagcgtcgtgaattcgagtgcaactatgtggtgggacggggacgagtgatgaatcgtggtgtttactactagacgtgaattcgtgacaggattttttagaattcgtgacaggatgtctttgtgaagtacactcgcaccctgtttttcgaagtaaacacgccggccagt

SEQ ID NO: 2231 - DNA, 590 bp, Sorghum bicolor
  Clone ID: SORBI-28MAY03-CLUS37106_1
cactgccgaggttgagtcagctttggtgtcacatccacagtgtgcagaggctgctgttgttggtgttgagcatgaggtcaaaggtcaaggaatttatgcttttgtaactttggtggatggtgttccgtatagtgaggaactacgaaaaagccttataatgacagtgcgcaaccagattggggcatttgcagctcctgacaagatccactgggcaccaggacttcctaaaacccggagtggcaagatcatgcgaaggattttgcgtggaattgctgcacggcaactggatgaacttggggacataagcacccttgctgaacctgctgtagttgaccagcttattgcgctcagcgattgctaggttgcaatgtaatatggatggtggatacatcctttgagtgaatgttgcgtttctctgtgtactatgagtagaatgtgtatttcagtatcgagaacttaagtgggatatgatatgatgacatgttgtcgatgtttctttttaaacttttgtatgactgtatctgtatgagatatcaacatataggtccgatagaatgtattattgattgacacaataaatatattaataa

SEQ ID NO: 2232 - DNA, 573 bp, Sorghum bicolor
  Clone ID: SORBI-28MAY03-CLUS37114_1
ttgaggaacgtatcatcaagagagcttttgggaagttaaagctagagcatgtggtgatagggaagggacagtttgaacaagaaagagcaaagcctaatgtcttagcggagggggagctgctggcgctgcttagggacgagcaggacgaagaagaccggatgatccagaccgacatcagcgatgaagacttcttgaagctgatggaccgcagcgacctgtccggaccacctggtgctgccgatgccacaccactgatcccgctgaaaggtcctggctgggaggtcgtggtgccagccaagagcggtggcggtatgctctcgtcgctcgccagctgagcgatgtctgcaccatgtttgggtgcccattttgctagccactcgtcaagctgacgatgaggcgcctgctggccgctgatcaggcggatattttgcatatatgcccccgaaaaactgttgacctgggtgttcagcctgcagcaataggttaggctgtgctgtgaacttgtgatgctctctttaagatagtccttgcactgatgtagctttctgttgtttgaactgctgcctcagagca

SEQ ID NO: 2233 - DNA, 523 bp, Sorghum bicolor
  Clone ID: SORBI-28MAY03-CLUS37421_1
gcacgaggcatgagtaaaatttttgcagtgacatacaaagcggacgaaaagaatattagttgtatatgtggaggtttccaattcagtggcatactatgtaggcatagtctctcaatgctcaagtttcaactggttcgtgaaattccacaacattatattcttgataggtggaaaaaggattttagacagttgcatgtgaagagacgccctccaagcgatcttgtccccaacaatcgcatggatcgatatgactatttatcaatgagatgtttgcaacttgttgactctgcagtcctatcagataagtatcgccttgctttgaggttggtaagggagacagaaaaatttctgctaaatagtaacacacatgatgatacacaaccaaggatcaagtctcgtgttcctaaagtaaataaatcaaatacagtgcctggtcaaaccgtggtgggtgcagctactggaaacagaaatgatggtctcaaaggaccagaggctccagcagtcatgcaagtaccgcaaatcc

SEQ ID NO: 2234 - DNA, 599 bp, Sorghum bicolor
  Clone ID: SORBI-28MAY03-CLUS37437_1
gagacggaagagggaagaccccccaaccggccaaccccaaaccccggccccagccgccagaccatctcgacacgcggccgccgcagacgagatggccgccggggacgcaggccgcgcgccgacggcagcggccgcgcaatcgctggtggagtccttctgcggcgtgacctccgcgaccccccaggaggcggccttctacctcgagagccacaactgggccctggaatccgccgtccgctcctactacgactccgcggacggcgaacccgacgccggcgccgccgatccagtgcccccgccaccagctgcaccagccggaggtggggaggacaccgaggatgaggattacgtggtcggcggcggcggcgacgaggacgaggatgatgaggactacgtcgatggcgacgacggagacgatgaggacgccgcgctcgccgctgaggccgcggcggaagaggagaggaggaggcctgtgaagaggcagaagaaaagccacgacgcgcggggtgggagcggtagcagaagcggcagcagggccagggcgggtggtgcgagtgcgcgggggaatgtgaggacgctctccgatctcggtggtggca

SEQ ID NO: 2235 - DNA, 478 bp, Sorghum bicolor
  Clone ID: SORBI-28MAY03-CLUS3745_1
gaatcatgggacatataatgattgtcaggcaggtgattttggtactatgatagttcatactgaagatggcgacgaagtggcagaatcacccattttcccaagaacagagttcatacctggccttggtagcatcaattctttcacacatgatccaaagagagcggaacttatttcaagtttttgggcggagaacacaggtgatagtgatgccaataaagatcgggatttagatgatcgtcctgacatacaggaatcaaaagcaatcccacctttaactggaacagtgaagaagcatattggtgcagaagggactataagacgccatgataatcaagttaatttgtcaccaggacttgcgaacacaactaaattgaacagcagcccgagccgcaaagcgttttcggttcaggataagctctggtcaatttatgctggcggcaacactgtaccaataccatttcttaaggcaatcgacatt

SEQ ID NO: 2236 - DNA, 481 bp, Sorghum bicolor
  Clone ID: SORBI-28MAY03-CLUS37484_1
gcacctcccctcccctcccctcccctccctttcgcgcagagagagagagagagagagagagagcgagctcggggccggggagctcacccatggcgtgactgacctccggagttgtcggtggtcgggtgcttgcgacgcgcgcgcgaggtcccctgcgtgctctgctctgctccgccgcgactctccctgcttccgttccgtcgacggcgcgggccggccagctggacctgcgcgccatggcgtccgtcaagctcggctccaaacctgacgccttcaagcggcaaggccaggcatggttctgcacaacaggacttcctagcgatgtcaccgttgaggttggggatatgtctttccaccttcacaagttccctttactttcgaaaagggcctttctcgaacggttgatcgaagaaaattcagaccaagaagagtgtatcgtcaagctaaatgagattcctgggggtgccaagtcatttgagct

SEQ ID NO: 2237 - DNA, 451 bp, Sorghum bicolor
  Clone ID: SORBI-28MAY03-CLUS3749_1
atagggtttcaggtcctcctgaagctgaaaatccgaatcgaaggggacatagcagtagtgatgagatgctcagtgctagcagtagagcagatgatagtagcagcaaggatgctaggtctcttttcagtggcgaggatggttacaaatctcggagtgcagtatctttgcccagcaaccaagttcaggctgagtggattgagcagtatgaaccaggtgtatacataacacttacaactcttcgtgatggcacgccagatctaaagcgtgtacgcttcagtcgaaggcgttttggggagcatcaggctgagagctggtggaacgagaaccgtgacaaggtctacgagaagtacaatgtgaggagctccgagcgagtatcgtcggcatcatcgatccggtcagctcgatgaccccctccttcctactcactgcccagcagtggccatcagaaaac

SEQ ID NO: 2238 - DNA, 661 bp, Sorghum bicolor
  Clone ID: SORBI-28MAY03-CLUS37499_1
gcacgaggaagcttctctccccacttctcctcccgggccccaaccgctcgccgcgtgctcccgtcgtgactgaaccgcatcctcccccgcgccgacctgctccggcgagctaggcatggccgtcctcctccgcggcacctccgccgccgcctcgaccgttggtccctcctcggcgctgctcgccaccaccttccgccgctcccgcggccgccttctgccccgtgccgccccgcagcgccgcttgtatgtggcccgcgcctcggcccagccgctcgaggtctgcgccaaggagtccatcaccgtccctggccgcctcggagactgtccgctccctccctcgctctcgctctctccgcgcgcgcggcgtcggcctttggagccgatgctaggcgagcttgcctggcagccaggctggttgcgtgggttcctccctggaggtggggtgcctttcgtgtgccgcgttaagagtgcaactgcaaatgatagctttgtttcacgtttagagtgatggtatattgggtatttgattttcgtgctggtatcatgacccgtatgtgctttatgacgacacgtgaaaaaaaaaaaacataataacctgagattgcatgaaatgcgtggtggtaggttttagctaaacagcgccatttgacatgtctgcgat

SEQ ID NO: 2239 - DNA, 738 bp, Sorghum bicolor
  Clone ID: SORBI-28MAY03-CLUS3751_1
atggtcaaattgaggctctgagctcgccgtacgtgggaggcagcaatggaggtggggacggctccaagcatcagcagcatctccacgaggctagtgtgcacggagaaaggcacagcatatttccagaagaccctggccagctcctgcatgacagtgcaataaagaaacgaggactgcccgatcggcaggatgaaaactgtgaggaagcgaagaaggatctgagaagcaggggcctgtgcctcgtccctgtgagctgcacgctggacgtgggtgtggacgtggtcgctggccccggagactactgggcggcagctgcaccggctttcggcatggggttcggtgggtagatcatggaggacgtgtgtgtacgtctcacgcggcatgcgcgcatattggcctgcatgcatgatgcataacatcaggagcagccatcctggtggaaagagaatgttcaaggctggctcctcttgatgctatgcgtatgcatgatgataaatgcacaccgataatataatgcatgcatgcacgggcatagctagagggatgcagctagctagcaacagagagtatataacttgtgtgtttattatgtacgtgagatcttgtctagagcgagatcaaacaatttggatgccatgcatggagaggggcgctagctagctgcagataattaaggctagctgcgagtgcgtacgtggatctgtaagtaactcatttaagtcttcatcatttgggcac

SEQ ID NO: 2240 - DNA, 441 bp, Sorghum bicolor
  Clone ID: SORBI-28MAY03-CLUS37539_1
gcacgcgggtgccccgctcctccaccaagcattcgcacccggcgccccagccggaatccggtggcgaagaggaggaggagggcgagtcgtcggagtcggagcccgagaacccggtgcctgtggttcagaagaagaggcccgcctcggatcctgctcctaccgggaaggcgaaaagggccaaggccggggaggagaaggctgtggcgggggctgaggcttcccctcctcctgctaaggcgaagaagggcaaggccgagctagagaagccggcgcctgaggccagtccagcaggaaaggcaaagaagggcaaagctgagctagagaaaccggcgcctgatgccagtccagcaggaaaggcgaagaagggcaaggcagagaaggcaggctaacaaagagaagatggatggaaatgcaaagggcggtgtggcaaaggaggctgcc

SEQ ID NO: 2241 - DNA, 688 bp, Sorghum bicolor
  Clone ID: SORBI-28MAY03-CLUS40312_1
cccaaggaaaaaatgatttgagtgagcttcttcccagatatcctgctttaggaaatgatgagaatgtgcatgctgtgtatgaatattggacaagtaagaggtccaagagagctgcaccattgctaagggtatttcagggtgcacccataaggcgaggacatctatcacaaaagtctgccatgaagcgaaagagatcttttaagagacaaaaaagccaagccggtcgtggaaagcctgaagctttattgctagacaatgctgaagaggaggcagctttgcagagagttgcccaagctgaacgtgcagcaaaacaggctgtagaaacagctattcgactgcgcaacagagcccagtctctcatgacaaacgcagagctcgcggcatacaaatccatcatggctctcaggattgccgaggctgctaggatatctgactcttcacgagatattgtttgtactatcctcgactaaagaagaatatgggctgttcattgatttgtgtggagggcgcgggaatactcttttttctttggttgcatcatcgcccatgatattggcttttcgataagctgtgggactatttttaccccctctcgtgttgttaactttgtcaggccaattttgaggcgaatgcttgaactgaaaactgtaatttcttgtataaatgaaagtagctagctagattctgt

SEQ ID NO: 2242 - DNA, 719 bp, Sorghum bicolor
  unsure (1)..(719): unsure at all n locations
  Clone ID: SORBI-28MAY03-CLUS40337_1
atgacggatcaataatggaatatgattctcgcttatatgggttcgatattggcacttgtcttgaggtgatcgaacacgttgaggaggaccaagcaactttatttggcaacgtcgtcttgagctcattccgcccaacggtgctcattgtttccacacccaactacgaatacaaccctatcctccaggggtcagctatgcccagcaaggatgacgaggcagacgaaagcgttgngtccctgcaagttccgcaatcacgaccacaagttcgagtggaccagggcacagttccagtgctgggctactggcctcgcggtgaagcataactacagcgtggaattctctggcgtcggtggctcaggcgaggaaccaggctacgcttcccagatcgctgttttcagaagaatgatgcaggggcacgaagcaatgtgcctggacaaaggtggtgatcaacccttacgagcttctctgggagtggcctaccgcgtgtgaggagaaggagatcggcactgactgtgaactaggagtctaggatgcacgtctaatcaccctggggtttgaaactttgaatcatgcccccggtttagaactaaataatttgtcggggagtttagaactaaataatctgtttggagagtggcgtccgacctgtactaagaacaccaaaaattaacattgcggcatgcaagtgcaggaattcagagtctgcttctagggtatgg

SEQ ID NO: 2243 - DNA, 567 bp, Sorghum bicolor
  Clone ID: SORBI-28MAY03-CLUS40351_1
tctcagccgttggcaactacaagtgctgcagctgttacgccaagagctgtccctcaagcccgaaaagcatctcttgcccgattcttggagaaacgaaaggagagagtgactagtgttgagccatacccgacatcaaagagtccgctagagggcagtgacaccgtaggcaatgctagtgctccaaccaaatcttcattcacagacatcgccccagcaagcaactatggcacagagcctgtgcgccttggccagcccaggaacatcagcttcagcagcgaagtgtgtcccagcacaaaattgcagatctgactctggttgctgtccataaattactactccatgagtgcctacccaccaacacgaaagctggataaatacattttttttgcatctggatgaggcaggaggataggaagatacaatgagatgagaccgatgttcgtaaacttgagtataattttgtttggctagagctgtacccatatatagtgctagcctagccgctatatagcttttgcagcgcgcttgttgaatggttttgtcgtgccccattgtattattcaactt

SEQ ID NO: 2244 - DNA, 613 bp, Sorghum bicolor
  Clone ID: SORBI-28MAY03-CLUS376_1
gctatttctgtgttttcttttatgtatgtctagcaaaataatatagtgtccattaattaataagatggcagcagagctattctatacgacatgtcttcctcaattctttgaacagatatgttgatgaatctttacggattggaagagatgacaaagagaacatattcgtgctagagagagcagacccatcagaagtttgacaaacttggtgatgcagtttatgggcacagctgcacaggcggttcataattttgcgacaggcggaaaagatagcactcttggttattgacagttcgatgcagacattctactcaaagtaaaaaacttttcttcctcaaatgaagtagctatatatacacacagacacatgccttttttttttttttttctttttgagttttaaagagcatagaagagcagcatatgcgttctctaaaaaggattatgcaatgggaaattgatcaaacagcaaacagctgttgtgtttggatattataagtatatgccattgctcaacaattcgtccttgtaagacagagtgtacagctcgaaacacaattgctcaagtattttcgttgcgacggctgctgctgctgctgttgtcgttcctgtc

SEQ ID NO: 2245 - DNA, 651 bp, Sorghum bicolor
  Clone ID: SORBI-28MAY03-CLUS37640_1
ttttccccgaagttcggaacgataaacgcaagagaaaagggcaggcggaaccacgagaaatcgcttctcctctgactctgagcgattcagcccggcgaacgctcgcttgagttggggagagaagcttcgattccaccgtcccagtggatttgggactgccactgccgcgcgggggcagttcatcctccgcgtgcccccatccgtggcggagcggatcgagcgcctcatgaatgaatccgccgctgcctcctccaaccccgacgaggcctccctcgacctctccttctcaggggagggtccccatcgcccccgtctcacgccctcggagcccgctcccgctcctcgcttgcctcgcccggcccggccggtggcgtaccgcgcctctggtgttcccggccggggtattacggctctggtggctctgatgcggatggcgtgaggcgggtatgcgccggctcctggggggctccctgccctgcatggcctcaccccgccggggggggggcctcgccggccccgggtccgccccgtgcctgccttgcacgccgagctggtctgccgtgcgcagtagctgcttctagcgaccctgcttggtgtttcggtccctgtcctctctctctcctttccgcctctcctggctggcgtctgagc

SEQ ID NO: 2246 - DNA, 665 bp, Sorghum bicolor
  Clone ID: SORBI-28MAY03-CLUS37651_1
cacatgggctatgtatggctcgggcgggcacccggcgggcttccccgccggcaggggtggcccggccaggctcccgggctggctcctgcgccgcggcctcggcggcttctcctcctgtgtggcggcccggacggcgcggggtgccgctgggcaacggacgcgttggcgtggtgttgcagggcgccaccttgtcggcttgcgccctgccccacagccctgcctgccttgcctggagcaggctccttggcatcttgtgcggctccgcctggctcggcctcgatgacggtcgtctcccgccctgccacggccctacttctcctcggcgggctgtcttccgcccctgggccctgggcttggccccgttgcaggagatgggggcggggcggcggctggtgcgggcccgccagcgttggcctgtgggggacagtgttagttaagcctaattgctatgtatcttaatttctgcattagtagtagcagtgccttggcatccaagtttggagcaggcatctttacttttgctatagcatattctggagtgggtggctgaccacattgctatataagtggcagaccccccctccctctattgtatcctgttatcacaattttgattcaatccaagcggccaagggccaagctgccctctgggcattcccagatcc

SEQ ID NO: 2247 - DNA, 582 bp, Sorghum bicolor
  Clone ID: SORBI-28MAY03-CLUS37653_1
gcacgaccccccgccccccccccccccccgcgccgccgccgcccgcccccctccccctccctcccttgccccgccgcccgcctcccgctctcgcgcgccctctcgctctcgctcccccgccgcaggcaccgccgcggcgatcgactcggatggctgctgcgttccttgccgcttggccgcggcttctccggcttcgggttggtgcgcccggcggttgctgccttggaccgtgcccggctgcgccccccgggtcctgtcgttgcgccgccccggccggaccccccggcgcctgtcgctccgccgcggcgccccgccgccccccccgccgcctcccccaccggcaccggcgcctccaccggcgccgcccggccgcggtgctgagcccgccggcgccctccgcgccttctcccgcccctcggcgctggactgcgtcccgctcccggttcctggcccgagcttcgccttccgagctttgaagaacgactggaagatggactgcttcccgcttgcggattatagcgagtgcaaggttatctgcgcggaccagtcagggcgcggcttcgtcttcgacctggattcacc

SEQ ID NO: 2248 - DNA, 501 bp, Sorghum bicolor
  Clone ID: SORBI-28MAY03-CLUS37661_1
gcacgagggtagtaacgcacccggggcaagcagtaccgtcgccctccccaccactccaccaagaaagttgcagggaaaggtggccatgatcactggcggggcgagcgggatcggcgagcgcacggtgcggctgttcgtggagcacggcgcccgcgtcgtggtggccgacatccaggacgaggccggcgcgcgcgtctgcgccgacgttggcgcgggcgccgccagctacttccactgcgacgtgaccagcgaggacgacgtcgctgccgcggtggaccacgccgtggcgacgttcggagcgctggatatcatgttcaacaatgctggcgtcagcgggccggcgtgctacagcgtccgggacagcggcaaggctgacttcgagcgcgtgctggccgtgaacctggtgggcccgttcctcggcaccaagcacgcggcgcgggtgatggtacccgcgcgccgcggcggctgcatcatagggacgtccagcgtggcggcggccgt

SEQ ID NO: 2249 - DNA, 625 bp, Sorghum bicolor
  Clone ID: SORBI-28MAY03-CLUS37681_1
gcacgagggaaggagaaggagaaggtggaggaagaggcgaagctgaaagtgactgcggtggtgaaggtggaggggacggagaaggaggtcaaggtgacccggccgccagctggggccagtgccgcgacgcccatcctagcggtgccggtggtggccgtgccttgcttcattgcgcctccagggtttgcgggccagtttgcaatgactcatcaagcagctttggcgagtgttacagcacaggcacaaatgcacttgcagtcaccaacttcatctgcatgttcagaagtgccatcaagtccattttatatgacaccaagatctctagtgccacttcagcaatcaccatcagtaactgaaggaaatatttgtaaaccaattgctgacaagtcattttcatctgattcaaaatcacaccatgttgttgtaaatatggtagctgatggcttcaactggaggaaatatggtcagaagcaggtgaaaagtagtgataattccaggagctactatagatgcacaaactcaggttgtctggctaaaaagaaggttgagcatttccctgatggccgtgttgtggaaatcatttatagaggagctcacaatcatgaaccaccacaaaagaccagat

SEQ ID NO: 2250 - DNA, 611 bp, Sorghum bicolor
  Clone ID: SORBI-28MAY03-CLUS37788_1
tgagtccacttgcagaagttcagcaacctggccagaggaaattctgccttctcgttcaattcgtgcaattttggatgagtcacagtacaagttcctaaggaactgtttccagaccacaccaaactcctggggtcaagtgatagttactgcaggatgggacggcaagattaggtcgttccagaattatggcttaccagcgcatcagtgatcagctcgagcatttgctgaaactacacggcagttttggcgcctcacatggcctgaagagaggtacccaagcacccagctatgctggtccagcgtgtggtttcttggtacaagacatcacatgctcagtgctcctgctgaattgtacatggaccagtgttgtacataatcaacctggtggtcctgcgagatctccgccatcagtggttgttcatggcaggacccgtagattgtaccttttgtagaaaatttttagtgtagatcagatttcttcctttgccccttatcaattgctcattgatatatacaacagaaatgttagtctcagatgagtgtaagttccccctccacactgtattacgggagcccaagcgggaaccaccagatatatatgttgccgtcaa

SEQ ID NO: 2251 - DNA, 540 bp, Sorghum bicolor
  Clone ID: SORBI-28MAY03-CLUS37361_1
gcgccgtcatcatggggagcaagggcttcggcgccgcaaggaggaccagcaagggcaggctcgccagcgtcagcgactactgcgtccaccactgtgtctgccccgttgtcgtcgtgcgcttccctgatgacggctccgccgaggctggggaggccggtggattttctgccgcggttggtgctgaggatgtgctgcaccctgtgctggaggaggaggccgagtaccatgacgctgctgaggagcacaaggatacttgacctcgatgatgcattgtgaagtgaagccctctcggattcagcatgtaaaggttctagtattggactgttggctgggtgctagctgggatttctgcttgagtgcatgtgatgtttcctgaacttccattacccgtgtgtatccgtgctttcactttgtttgtatcttctgtagttctgttacctttgttcatgtagcttgtctgacttccactgcctcgtgaatatctgtctgaacgtttgtagttaatttgcattgcactggttttctcattacaaattaacc

SEQ ID NO: 2252 - DNA, 934 bp, Sorghum bicolor
  Clone ID: SORBI-28MAY03-CLUS37387_1
cagaagcgcttgttaaagcccaagatgatcttagagaaactacaggtcacttgggaatgacattgattaagctggcaaaatttgaaagagagcaggcaacatgtaattccctaagaagacgggctggtgaaatccatagttttgcaaattctgttttgaagatgagcaggtcacagataaaattaaactctgaaattgtgaaacacctgggtagtatccatgaatacttggagatgatgatatcagttcatcatgcgtttacagatcgctctaatgctttacattacgtgcaaagcttgtcagcagatttgttttccttgcacaccagagcagggagacttgaatcttcatcagcaagagatatggggcatgagtggtcaacatatcagaaggtagaggggttgaaagaaacaataagatcagcggaagcagccaaaagtgatgcacttagagaatatgaaagcattaaggaaaacaacaagattgaaataaaaagatttgacaaggaaagacgccatgatctcatcgagatgctgaaaggttttgtggtaactcaggtgtcttattcagaccattttgctaatatgtggacaaaggtaacagaggaaacagaagtatatgcaaacaggagcaactgatatacgtatagggagtgtagagtagttgattttgatctacatttaatttgctccaacatccagcgactacaaccattcttattctaccccagttttgccacattgggttggttgtagtgccacatgagttatgtgcggtcgtttatgtgcagtcgtgaaattgggtcccgacagatgagcttctttaatcctgttagcttgactgataatccagggctaaaagtactttatgttgatttgttgtaagagaaaaacactgttgaatgacagttcggcagataagcccccaacaaaca

SEQ ID NO: 2253 - DNA, 633 bp, Sorghum bicolor
  Clone ID: SORBI-28MAY03-CLUS37418_1
cctactggaagtggcataggcgcaaatatttgaacaatccgagggccattctgcctgcagcccctcgaactttcccgcctgaaaccctctcgcctcccttgccgtctcctaaaatatagggccatagaacagtgcccactagtctctgctctcggcctgttaactgttctgcgttccccttctacggagtatttcttgcccccactgaatttttttatactgattaaattgtcttcactcgtgggaaaaatcaagtggcaagggcttgatctggttggcgacccatggtgggaggaatggtagtcgccgtgccgaatggggtgaaggcggatggcgccctagccgccgccgtcgccgccaaggcagattctcctaaatccgttctggaggacgagaaaatttctgagtccaagactgggaacgcctcctttgccacagagtcatttaagcaagagcaagagcactctgacgatcttgtggatgcaagttcgtccctgcctgttgaccatgaaatcgacagtgctggtgtgccccctgttgttaaggcagtcaaggacgaagagcagcttctggagcccgtcaagcaggataaagttgatgatgaggatgcaagtttatctatacctattgacc

SEQ ID NO: 2254 - DNA, 707 bp, Sorghum bicolor
  Clone ID: SORBI-28MAY03-CLUS4172_1
cgtccgcccacgcgtccgcccacacttccgcccacgcgtgcgctacttgtaccattcttctgccgaggcaagtttggggtgggagcggacactcatgccatgcactatctaaatgctgcttttctacttatagacacagtgcttaacaatatgcctctggcctgatatcgaatgggtttctctgttttctggagctgcgcctatgtaacattccatggggtccttcatgctagtggagacttaacctgggggccggacccatttttcaacctttcataatgtagagctcctctatagtacctcggcatggccatcgctcatatccccggtttctttctgtattggtttattgtcaaggcgaagcacacttatttcccacggatgtttccacatgcttatgttaggacaatatagatccatttatctaaccacgggtcaggataagcctgtataaatatcggtagcatactatttcgacacctgctaggctcaagtgtgcacctgtatagtctcgtgaattcacagcccctttgagatgggtttgagccctgagcacacgccaggactgccatattgttcaatgaatcgcagaggttcactgtcaccctggaaacacggtcttgtgctctgtgtgttcttccttcgcttgaacttgaagtatatatatcatgcacattggaagcatgcccatggtttccctttccctt

SEQ ID NO: 2255 - DNA, 614 bp, Sorghum bicolor
  Clone ID: SORBI-28MAY03-CLUS37840_1
gcagctaccgatcagaccgaagagatagccgacaaggaaatggtcactgacttggacaagaaccacgtgtcgttgaaggtcctcctcgttgacaagaacgtggaacccaaagagaaggagaagaaggcgagcaccaaggaccgggtactgtcgttcaggcgccgggtatccaaagacaatgtgtcaccagtgaagccaggttcgcccaaagacggttcagggcagcaggactggaactctcccgccaggttgcctgttgagaagaaacccaagggaaggaaacagcagtgggtaccgtttatttgctgctcgtcggtacagtgatccatttgccagcatcagctagagggcgtccattgttatgttattatacgctgatgaaaatagtcaggaccttcgttccaggacgtgattggaccttggcatcttgccacttggattgtttactcggtttgccgtttgttattatactctatatttgttggtgtaaattaactagatgcatcgagaggtccttttggtgtaaattaactagatgtgtccagagttgtccttccattgatctgcaaacattgtgcaacttgtttagttcgtaaaatttttggtttttggct

SEQ ID NO: 2256 - DNA, 587 bp, Sorghum bicolor
  Clone ID: SORBI-28MAY03-CLUS37889_1
ttcctatctttaagtgcgtgccagattcaacagggatgcctttccttagtcttgcaaccctccaggggattttgaaatttctttgctcgaagctacaagaacaggctgagggctgttcccttctgcacaatcagcttctcagtattcctattggcacatggtctccacatacgggaaggtcaagtagcaggcaactcagaactttgctactgagttctcctctaaatacctgcctggattttctgcttcaagatagagtaagctcaattcctatagttgatgacaatggatccctccgtgacgtctactcactcagtgatatcatggctctggcgaagaatgatgtttatgctcgcatcgaacttgaacaagtgactgtgcaaaatgctttggatgtgcaataccaggtgcatggccgaagacagtgtcatacttgtttacagacgagtaccttgctggaagtcttggagggattgtctgttccaggagtgcgacggcttgttgttattgaacaaagtaccagatttgtggaaggaatcatctcattgagagacatttttacatttctccttggatagcatctgtgt

SEQ ID NO: 2257 - DNA, 641 bp, Sorghum bicolor
  unsure (1)..(641): unsure at all n locations
  Clone ID: SORBI-28MAY03-CLUS3789_1
gcagctggatggaatccgcaacagaatttngtcggttcgggagtatattgatgacacagaagactacgtgtacattcaacttgacacccagcgtaatgaactctatcaactccagcttacactgaccattgtatcctttggcatagctgccaacacttacattgctggagcttttgcaatgaacatcccgacctctctgtacaacactgatggcagcctcttctggccatttgtcgggggcacctcatccgcctgctttgtaatcaccgtcctcttattttggtatgcctggtggaagaagctgctgggtccttgagcacgaagcgaagacaagatggcagagagccttgtcatgtttgcagaaaggaagcaagcgttctaaggatattagagaactgtggggatagcatgaaaaccgtatataacatctcacgagtggtccataagatgagtacatgtaatttgtcattagcataaatgagatgatgcgatggccaatatacttctgttaacatcattagatatagctgttgctggcaatggacaaatgctgccatgaaattatattatccagcaagggccgatttcttgtacagattgcttttcttcaaaaaaaaaaaaaaaaactcgagggggggccc

SEQ ID NO: 2258 - DNA, 712 bp, Sorghum bicolor
  Clone ID: SORBI-28MAY03-CLUS37920_1
ggtggttttagcagtggggaagagacaatgtactctgctgaaacaagggaaagccggaacattccaagtccaaaggaaaagaaagccgaggtggttggtagatcacagagttttgtgaaccataacaaatgggactcgcctaaaagtgttgaatcttcgagaggttttccttcgaagtcacagaccttcattcctttaaggaaaccacatctacaggctgcagccatttcacagaagagccaagattatttcagcccgactgtctcgtcaaacatgaagaagaggaacctgtcccaaactcccatgaaacccaggcagcgttctcaagttacgtcaaagtggataacttgatgcatccacctgccccaggaatcatacaaagataacatgttttagtttactcagttccattctgcatttctttttccttttcctttatcctttttagctgcatttgtaaatgcattctagtcatgaactgtgctctagtcattcttttctagggtaccatatgttaggagatgctgttctttaccctgtaattctctactgaagggttagacaggttgccattacaaaatacagtttttcccctcctgatacccgtagctaaggagagttgagaagcgtaagacttggtcttcttaactctcaattgtcagcacaagggataattcacaggaatgcattggcccttgctgtattgctcttg

SEQ ID NO: 2259 - DNA, 961 bp, Sorghum bicolor
  Clone ID: SORBI-28MAY03-CLUS37926_1
gcacgaggaagaacaagaaaaaggcaggttgactcctattgtcgaagcattaagtaatgcatattttggtcctgattactctcagccaaaggatactgttgacatatctctaaaggatattgaccaactggctaaaagttctttccctctttgtatgcggcatatgctagataagttgagagaaaatcaccatctgaagcatgggggtagaatgcagtttggtctttttcttaagggtgctggactaaagttggaagatgctcttgcattttggagggcggaattttctcagaaggttggttctgagcggtttgacaaggaatatgcctataccatcagacataattatggaaaagaaggaaaacggacagattacacaccatattcatgtcaaaagatcatttctgcaacacctggtgttggagatcaccatggatgcccgtttcgacatttcggcgaagaaaatttgcgggcagcactcaacaaaatgggcgttggtgggcatgcattggaagagataatggataaagtgaagaacaggcattaccagctagcttgcacattaacctttgagaccacacacggtgtctcctgtgattctggaatcaaccatccaaatcaatatttcagtgaaagccagaaaattctgcgagccaaaaaccaaacaatggagagccaatcacaatcagcaacctaaattgaatcgcagctggagaaactatccgttttcaaaaaaacttaccagctgctggcttggcctagaaagaaaacctccaggctccagctgcgagctgtcataccctacaagtgatggcaccacactctacactagaatagaagtgttacctagtgctgcgaacagcagcaggtcaaggctgtacatgtaattctcgaaagtaccataagtgaatattctgaatttaatgtaggatcagctgtgctgtgctgttatgttattgta

SEQ ID NO: 2260 - DNA, 1153 bp, Sorghum bicolor
  unsure (1)..(1153): unsure at all n locations
  Clone ID: SORBI-28MAY03-CLUS37946_1
agatgcccgtcggctcccgacggaggccgccgccgtcgcaccaccgtcgcgccatgacacccgcctccgtctccgcccccgcccccgctcccacaaagccgctctacctccgcggtccggtcatcgcgggcgccgccgcgctggccgcgttcctcctcctcgccgccgcctacgccaccaggcgagccggttccccaccgaccgccctcctcgctcacccagctgttgccaccaggttcttctccttcgacctggtccgcgagtaccctcacgacccggacgccttcacccagggtctcttatacgcggaaaatgacactcttttcgagtccactggcctctaccacaggtcttcagtccgaaaggttgatcttcagacgggaaaggttttggttaatcaccaaatggacggacaaatgtttggagaaggtttaactcttctcggccacagattgtttcaggttacctggttgaagaacgacgggtttatatatgatcaacataacttctccaaacgcacgagttttacccgctccatcccagccggttcggggtcggcgcctggtggttaggtgctgtccggcagtgatggcacttcaatgctgtataagctggatccaaagtcacttgaagtcatgaaagtggtgactgtcaagtatcacggtgatgaagtcccctaccttaatgagctggagtatatagatggtgaagtctgggcaaatgtcgggcaggttagatgtagttcctcctagctaacatatcttatcatgaagtatcttagtgaaactatgtactgcatttcgcaaggaccactatatcttccattagtatcttagtggcgactccaggatgttagacaaagtacgaatgaggtttaaaggcttctccgattattatttctaggtctgtacctcaactttcctcaaagtgaccaagtttcactgagtgatgctcttcatttggcctattgatgccaaataggttgctgggtccttactacaatgcactcacactgttttttttttcacgataattagccatcttatgggagttcctctacccaattttctctccacttaatgctaagtgattttctgtatttctatgtaattttgttgtaccctactaatatatntttatcaatgtacgcaga

SEQ ID NO: 2261 - DNA, 875 bp, Sorghum bicolor
  Clone ID: SORBI-28MAY03-CLUS37968_1
taatctttctcaattcattggttctcttttagatattgaaaatatttcattactcgggcacgcttttgagtgtgcagcgcatggaatcttgcctggtaaactatcaagattgttgaatcggctgacggagataaccctggagcttgaccttggtaacctgaaggaagcaaacgctgctcactgtttgtttcagattgctcccaacttgcgacgcatggagctacagcttatgcacaggggctattctgcaccaacctcgaatttctgggactcaattgatcaccaggattgtctcttcaagaacctttatacagttgttatgaacaactttactggctcctgtgcagagtcaggcttcttggaacttttgcttaaagatgcacctgtacttagaagtgcgcgaatagaggacaacaacaaactggacaaagaatccctcaaacgtatcctgaagatgagaagagcatccaaggacgcagaaataatcctcctttgaggcgtggtcccatgactccaatagatgcgcactgttggtttcctggtgaagcaatttgatctgttatggttatggtacactatatgggtttattcagttaatcgtatgggtacagctttaactagacaaaagttgcagtctttttgcggatacttatttcagtgtgtcaccttcagtaaagctaaatgtcgcacctgagtcaccagttctgtttcttttaccatttgggttggtactttgaaattcagtctccacgcgttggtcaacatgggtttgcttaactgactttggacaaactggtgcttgtgggttgtgaaacttaacctttgaatggtactgtatgatcattttacctaacctaagacttgacgtgccaaaa

SEQ ID NO: 2262 - DNA, 939 bp, Sorghum bicolor
  Clone ID: SORBI-28MAY03-CLUS37521_1
tggttattgcgtttactaacagcaggtttaacaaggatataagtcttaatgcaattggatttcttcgattctgcgcggcaaagttggccgaaggtgatattggatcctcaagattgaaggacaatccttcaaacagtaatccaccctcgcctcgtttgactaatgatggaaagcaggaaggcacagtacttgttgacaaggaagaccatatacacttttggtttcctttactagcgggattatctgaacttacctttgacttaagaccggaaatcaggaaaagtgctttgcaagtgttatttgacacattaagaaaccatggccatcttttctctctgcctttatgggagaaggtgttcgattcagtgctttttccaatatttgattatgtgcgtcatgctattgatccatctggtagttctccacaaggacaagctcggggaaatgatcctgcaggacttgatcaagatgcttggttatacgagacatgcactttggcacttcagttggttgtagatctctttgttaagttctatgatacagtcaatcctcttctaaagaaggttctgctgctcttgacaagtttcataaagcgtcctcatcagagtcttgctggtattggtattgctgcatttgttcgtttgatgagcagtgctggatctatgtttgttgatgaaaaatggctagaggttgtattgtcattgaaagaagctgccactgagacacttcctgatttcacttatgtttcatctggagcgtacctggaaaatgcaccaacagaaaatggagtctctgccgataatagagaggacgaatctcaaccactagcggatgacaatgaagaatcctctagatcaaggaatctatactttgcaattggtgatgccaaatgtcgagctgctgtacaactcctattgattcaggctgtgatggaggtat

SEQ ID NO: 2263 - DNA, 411 bp, Sorghum bicolor
  Clone ID: SORBI-28MAY03-CLUS37518_1
gcacgaggagaacgccaagcagatcaggtgcgcgcggctcctcaaggcgcaccgcgccgccgggtgcctcgcctcgctggcctccaccgccgtcgcgctaggcggcgcggccaggcgcagggtggccgcggggaggaccgacgctgaggccggcgtggtggctgccaccggcgagagccccgtggtgcgctccaggttctacgccttcatcaaggccttcctcgtcgtctcgctgctcctcctagccgtcgaggtcgccgcttatttcagcggctggggacctcgccgcctccgcgctcgccatccccgtcatcggcctcgagtcgctgtacgcctcttggttgcgcttccgcgccacctacgttgcgccgggaatacagttcctcaccgacgcctgcgtcgtgctcttcc

SEQ ID NO: 2264 - DNA, 628 bp, Sorghum bicolor
  Clone ID: SORBI-28MAY03-CLUS37599_1
cctacttagctagagtcaactggatgcataatagtgctcttgctgttcaagttctcaacagatctcatacgaaacttaaattactgaagtttgatattactacaggtaaaagagaagtcttactagaagagcagcatgatgtatggatcacattgcatgattgcttcactccactagacaaaggagcgcgtggtaaacatccaggtggctttatttgggccagtgaaaaaacaggattcaggcacttatatgttcatggcaatgatggagcatgcttaggacctctcacacaaggtgattggatggtcgagcacattgctggtgtcaatgagagtaatggacttatatatttcactggcacgttggatggaccattggagacaaatctctaccacactaatctgtttccagattggagccttcccttgcaaacccctaaaaggctgactcgtggaactggccggcattcagtaattctcgatcaccagttgctaaagtttattgatgtgtacgacacaataaagtctccacctgtgatcttgctgtgctctttgcttgatggaagtgtaattatgcccctgtttgagcagccattgacagttccgccacttaaaaagttccagcagct

SEQ ID NO: 2265 - DNA, 473 bp, Sorghum bicolor
  Clone ID: SORBI-28MAY03-CLUS38173_1
gcaccacgcgcgcttgtccgctccgctccacccccagctcagcagcagagcagacgcagaagcagagcccccttcacaccaaatttttttcctcttccgccttgccccgccccgccccatataatccaggccggccggccggctgggtcctcgcggcggatgggctcggtctcgcggggctagggtttggtcggtcgtctcgtcggcgtcgtcgagggcgccggcgctgctacctcgctcgcgcagttcgcgctagggttcctcctcggggaccatggtgctgcagcgcttctcgtggccgtacggcggccggagagcctccttctgcggcagcttcaccgggtggagggagtgtcccatggggctggtcggggccgagttccaggtcgtcttcgatctgcctcccggggtttaccagtaccgggttttggttgatggtggctggaggtgtgatgaggcgaaaccctttgtac

SEQ ID NO: 2266 - DNA, 736 bp, Sorghum bicolor
  Clone ID: SORBI-28MAY03-CLUS38201_1
cgcccggcgagggcggtgatactagccctttcctgaatggggactttggggagtttggctatgttgccccagagtatgctagcaatccagttggtactatgaaaggcgatgcatatgcatttggggtgatattgtttgagcttgttagtgggcagcaggctgctgctgtggttactgacgtgacgggtgaaggattcaaggggccattggtggactgggttaatcagctcaaggcttctggtcggatcagtgatgttgttgataaaccattgcgtgggaaaggccatgaggcagagattgaggagttcttgaagatagcttttgcttgtacccagccttgtgtgagggagaggcattccatgtatcgggttttccacgctctgaagagcattggagagggtcgcgatgtcacggagcagttcgatgagttcccgctggcctataacaaggatgattcagacactatgtagctgatgctgatcgccaattggattgtggaaatgtttcgtcatgctcattgatgatatatagtagccttgctatggacggatcagaggcataatgagttgtaatcgaacaatattgtggcaccaaagctagcgccgatgctgggtggtcaattctattgttgcatcaacaggggatgcgataatcatgtaagctgtaagatcagtttacaattctgtatgtcttttttcagttactgctagtgcttgtagtatctgtatggaactgt

SEQ ID NO: 2267 - DNA, 866 bp, Sorghum bicolor
  Clone ID: SORBI-28MAY03-CLUS38208_1
gcacgaggcacctatggccgcgacccgttctggttcgcggtgcaccgccggtccacgaggcagccgctgttcaacaccagcgccggcgtgctggtcttcaaggaccagtacctggaggtgtccacggcgctgcccaaggacgccgccctgtacgggctcggcgagaacacgcagcccgggggtatcaggctgcggcccaacgacccttacaccatctacaccacggacatctccgccatcaacctcaacaccgacctctacggctcgcacccggtgtacatggacctccggagcctcggcggccgcggcgtcgcgcacgccgtgctgctgctcaacagcaatggcatggacgtgttctacagggggacgtcgctgacatacaaggtcatcggaggtcttctcgacttctacttcttcgccgggccgacgccgttggccatcgtggatcagtacacttcgatgatcggccgtcccgcgcccatgccatactgggcatttgggttccaccaatgtaggtgggggtacaagaacctttcagtggtagagggcgttgtggagggttatcggaatgcccagataccgctggacgtgatctggaatgatgatgaccacatggatgccgctaaggacttcacacttgatccggtcaactacccacgccccaaactgctggcattccttgacaagatccatgcgcaagggatgaagtacattgtcctcatcgaccctggcattgctgtgaacagctcctatggcgtctaccagcgtggcatggaacgtgacatcttcatcaaactggatggggagccatacctcgcccaggtgtggcctggtcctgtctacttcccagactttctcaacccgaa

SEQ ID NO: 2268 - DNA, 645 bp, Sorghum bicolor
  Clone ID: SORBI-28MAY03-CLUS38233_1
gcacgaggctctctatctctgaaactcacggacacactctcaatctgctgccatccctccgccgtcgctagagtctgctgtgaagcttgccgcggccgctccctctcctccgacctggccatggcccttccagcgcatctcgagcttgcactcggctcgcatcacccatcagcacagatcgaggtcgccccttgctgtgtcccctccgcttctgccgcttgagctcgcgagccggagctccatttgcttgtgcaggagcagatccaccgctgctccaaggcctcctgctttccatcctcctcctcgttgctcacaccggcatccgctgctgcgctgtatatccccaagcccgctccaacgctccggttccccgggctgccgcgggcccgtggaactgggatcctagagtcgccgtgctcgcggtggctgtctgcaggacgcagggtggggtggtgcttaggatacagaagccggtggagcgctttgtgggcggccgcatgattctggaggtgatggcgctgatggagggcctcgacgcctccatggggttgggcatccacagtgtcactgctgtcactggttccgcctgctctacaaccatgtggacataagggttacccctggatcacatgcaactgaagctgc

SEQ ID NO: 2269 - DNA, 549 bp, Sorghum bicolor
  unsure (1)..(549): unsure at all n locations
  Clone ID: SORBI-28MAY03-CLUS38232_1
tactggtacactttgcttgttgggaaccctagcctggtttatttatttattattagctaggtgtgcctcacagtgngcgattaatctgccttttctgcttcttgttgtttgtttttttctttttttgtgtgtgtgtagggcaacgagattcctgattgcagatatcgtagtgcgatgtcgtcggttctacgtgagattttgagatccatcttgaagtttctctttccaccactttatttattttattctctgaaaagcttcctcgatttcttttttattccgtgccgatgatgatttactatttcaagttgaattcgttgagagattcgtgatgttcttgaggcgttcaactgaggcccggccgaactggaactttaattattgctttgtgctgcatcgaaaatcttggctttaatttccgtaccacaaaattagacttgtattcgtctcaatcttttttattttccttccgaggcttattcgtcttattttgtttgtccctcaaatgtgctaatgatgccgaattctatctacggtgatatgcactgg

SEQ ID NO: 2270 - DNA, 986 bp, Sorghum bicolor
  Clone ID: SORBI-28MAY03-CLUS38256_1
caacctatcgctggcggggagcggtgcggcggtgccacgccctcaccgtgatttctccttcggtccccgttcgggatccccggcgcatcaccgggccggctggtctgtgcatcgcggcaggagttttcgtcgattgcccccgcctgccccagttaaccgcgctcggtcgcagtccagctacgcattagaggcgccgacgatcttctgccccgtcctgccctgcggattctcgacggcggcgccggataccacggcagcgaaggaaggaagggaaagaaggggccgaaaccaacttgcttgtgccggggcaaggacgagatcgggggcagccgagccggaaccccaaaccccaggcgaggttctcgcaatagaagtatgcccgctcgagcgtggaggttcccaaaagaaaagacataaatctgttgcaaatgttgatatcatcagtaatctacctgatgttatcaaagacaaaattctctgctgtttaccaataaaagaagctataagagcatgtctcttgtcaaggaaatggagatacacatgggcttcaatgactgaattgatgttcagggaagatgattttgctttaggcaatggtaatgaagatggtgacagtgtcagatttgcctccttcgtccatacgtttctctccctccactatggccctattctgaagtttgaaatgaatgcccgacgagttcatacgttttcccctggaggacacatccataggtggatgcttattctgtcaagaaatggaattaaagaaattcaaattaagacaaggatatggaggaattacaaaattccttcttctttcttctcatgtgcggaattggaatatgcttgcctgcaaggttgtatatttcagttgccatctttgtttacaggctttaagcgaatgcatacccttcattttattgagttctgtgcaacggaaaacaatattggggaattagtagcaaactgcccgaacttagaggaac

SEQ ID NO: 2271 - DNA, 465 bp, Sorghum bicolor
  Clone ID: SORBI-28MAY03-CLUS38319_1
gcacgaggccaaatcgcccgaaatcccgccgctctcccgcgcgagatccgttcccagccaaaaatttcccgcccgccgcccgcccaaatccttcccgcccgcgccccctctccggattcaaacggccgccgggggtccgtcctttgaaacccgcgcggatctgaccccttccccccaccgcactcggcacacccgcgctctccccgcgccgcgccaagggaggggaagcgaccgaccggatcccgtcggcgtcgctcatggcggtgatcaccgggcggccgccgaagcgcgtgcgggtgacggcggggccgcgcgcgctggacctgcggccgttcccggccgccggcgagccggtgccgccgccaccacgcggggcgttccgcgactgcgtgcgcgcgttcctggcgcggtccgcggtgcccgccgacggtgcgtggcgggtggccttccgcgtcggggaagggg

SEQ ID NO: 2272 - DNA, 677 bp, Sorghum bicolor
  Clone ID: SORBI-28MAY03-CLUS37790_1
ctggctccgagatcaactcatcctgaagaataagtcagtctactatgcttccatgatgctcaaccttgtgctacgcctagcctgggcccaaagtgtaatgaaactccatcttggtatggtggagtctcgcttgctggatttctcactcgcttcactggaaattatccgacgtgggcattggaacttctacaggctggagaatgaacacttaaccaacgctggaaagtttagagcagtgaagactgtcccattaccattccgtgaacttgaaactgattgatgaagacaaagacaagaacttgccagcatgttcccagtatgaaaggaatttaggggggcagaagagttccaggaatggatactgtccctgctagtgcttgtgcaagaattggtgtttaagtggtaataaaaaaatcagagagcataactgcacaagaccaagacgttgcagattttaagatggaataagctcagacggtgcattgtaaatgaggcaccagggttcaacatgaggcgttctggtcaggcaagatgatgttgatttacttactggtcgattgagaattgttgcatgtcaatcgactaacaagatcttaattttgtcaatcattaagttatgaatgtatctgggaattgatgactgaaaaatattgcatgaaaacatatggtcgtcaagc

SEQ ID NO: 2273 - DNA, 687 bp, Sorghum bicolor
  Clone ID: SORBI-28MAY03-CLUS37809_1
tgtaatggcgtcgcaaggtttgacttcgaatatctatgcggtcgcccagtcggagctgcagattatatagcaatagctaggagctaccatacaattttcatatcagacattccagctatgagtatgaagatccgtgacaaggcaagaaggtttatcactcttatcgatgagttgtacaaccatcactgccgccttatatgcctagctgcctcatccattgatgatcttttccaaggaactgaggaaggacctctttttgatttagagagttttcagttcgaaaccgagtccgaagggacaaagctgaggagggatgttttagcaggaggcaatgttggcttaggaccgtctacgaccggacttgtggcaatattgtctggtcaagaagagatgtttgcattccgcagggcgatatctcggcttatcgaaatgcagacaccgctgtatctggagcgtgtgcaggatgtgcatccctcattccggctgcagtgtcctcctggtcttgcaagcaataggactgcagttcctcagcctgctccggcggtttgacagcctcgctgtaccattgctttatttcaaatttcgtatgagaaggcaataaaatcaaccagagatggtaacagtggggcattgtaaataataatggaaacgttgtgatttataataagttaaagtttgccgttgcct

SEQ ID NO: 2274 - DNA, 605 bp, Sorghum bicolor
  Clone ID: SORBI-28MAY03-CLUS37816_1
tgcctcatattcttaccgcacttcagtggatctcaaggacaaatggcgtaacctgatcagagcaaccaagacacagcttccggcacaaaaagaccagggtgcctgtccgcggaagattaacccttctatcataccaataccaccatccattttgttgcgagtgaaggagctaaacgagctgcagtcgcaagggggtggcttcacagcccccgtcaagttctctggacaggacaggaaggttctacagggaaaagggtcaggttttttgtgatccgtgtcatgcagatatagtgggtaaaaggaaagcactagttagttaggtgtacgcttctggacgatgtggtatatatgggtaaatattatacatagttggtgtagccacgttatccatcgtattgttcgctacacgctcaatgcacgttgctggaacatgtgtaaatcagacgtccagaaaatattgctatatctttgtaaagggcagacgtctctgtggcacaagcaccagttaacgaacgcgtcaggaggacatcattttaagagcacatgtaaacctacctaggaagaggaaaatgagagttaatggaatgttgtcgcggccaatattg

SEQ ID NO: 2275 - DNA, 823 bp, Sorghum bicolor
  Clone ID: SORBI-28MAY03-CLUS38330_1
gcacgaggccggagcggcggcgcgctggcgtggcagcagtaccgcgcgctgctccgcaagaacgccacgctcacctggcgcaaccgccgctcggcggcgctccagctcttctcctcgctcgtcttcatcttcctcatcttctgcatcgaccgcgccgtccgctccaggttctccagcaccaccggctaccgcaacgtgccggacccggagccgctcgtcgcgccgcccatcccccccggcgaggacaagttcttcatcaagtccccctgctacgacttcctctggagcgacggcgggagcaaccgcatcaggggcatcctcgacgccatcaggaagaacaaccccggacgacccataccgcccgaaaaggttttaggttttaggactccagatgatgttgatgcttggttgtttcaaaacccaatgcgctgccctggtgctttgcattttcaagatataaatcccactcagataaagtatggtatccagacaaactctactccggtagcacggagaggaacatatgaagacccgaccttcaagttccagataccactccaagttgcagctgagagggaaatggcaaggctgcttattggagacccaaattttagctggactgtcggatttaaggaattcgctcacccagccacagagaccttctctaccattgctcaagcagggccaactttctttcttgccattgcaatgtttggatttgttttccaaatcagtgccttggtgtcagagaaagaactaaagcttcgtcaggctatgtctaccatggggctctatgaatcggcatactggttatcatggttta

SEQ ID NO: 2276 - DNA, 543 bp, Sorghum bicolor
  Clone ID: SORBI-28MAY03-CLUS38353_1
gcacgaggggcacatatcccccgagaaaagccggcgttcgcgcacactcgcgggcgcagctgcggtgcccggctcagcgcggcggagatggagggcgacgccgccggagctgacggaggaggaggaggcggcggagagcggtctagcttcgtgatcggcctcatcgagaaccgcgccaaggaggttggtgttgcagcctttgatttaagagcagcctcattgcacctatctcagtatattgagacaggttgctcataccacaatacaaggacactacttcatttctatgatcccatggttgtcattgtgcccccgaacaaaacagcagcagatggtatggttggagtttcagaactgatcgataagcattacccagcaaacaaaaaggtcactatggcacgtggttgctttgatgacacaaagggtgctggcattgtgaaaagtctttcagctagagacccatctgcgcttggtttagatacttactgcaagcagtattatctttgtcttgcggctgtcactgcaacaattaaatggatagaa

SEQ ID NO: 2277 - DNA, 669 bp, Sorghum bicolor
  Clone ID: SORBI-28MAY03-CLUS38356_1
actccagcccgtcgcctctgagctcgcagacgttctcagggagctcgtgaacactcggatctccgtcctcggcagcttttctgcgagtagcagcttcttgcgaggcagagtcttgcgtcttcctgcttgaggtttctggttgggtcgcgatggccggcggcgtggtggtgaacgccggagggggaaaggactaccccggcaagctcaccatgttcgtgctcttcgcctgcatcgtcgccgccaccggcgggctcatcttcggatacgacatcggcatctccggtggcgtgacgtcgatgaacccgttcctgatgaagttcttcccgtcggtgtaccacaaggagcaggaggcggagcggaaccagagcaaccagtactgcaagttcgacagccagctgctgaccatgttcacctcctcgctctacctcgccgcgctcgtggcctccttcgtcgccgccaccgtcacccgcgtggccggccgcaagtggtccatgttcggcggcggcgtcacgttcctggtcggcgccgcgctcaacggcgccgccaaggacgtcgtcatgctcatcctcggccgcgtcctcctcggcatcggcgtcggcttcgccaaccagtcggtccccgtctacctgtcggagatggcgcccgcgcgcctccgcgggatgctcaaca

SEQ ID NO: 2278 - DNA, 605 bp, Sorghum bicolor
  unsure (1)..(605): unsure at all n locations
  Clone ID: SORBI-28MAY03-CLUS38362_1
tcgacctcaaccgggccttcaccaccatcatcagtccatccgatactgacaccgtcccgcaggtggcgaagcagttcaaggagaagctgaggccgtgctgcgagagctgcgatcccaatggctactgcgggcaggtggacaaggatggcggcgcgcagtacagcgtctgctccaacccggagaagcacttcttctgggacgacgtgcacccgacgcaggcaggctgggaggccgtcatggagcagctcgaacgggacatcaaggatttcctccacatttcctactagctatgtctcgatctattatacgaggattagaaatatatctattatacgaggatttgaaataatttgcatgttctgatcttctattaggtttaggtatcgatcaattttagtttgttgggtaatctgttggattacccagcaccgcactttgctagagctgtgtgcccaatggatgtatccattaggctgttatcttccaatgaatcatgggcatgtttggatcggatttcagagtgaggaatttcgagtagatagtgaaggtagaatctgaatttgggtttgaaaaataagcaatgtttggatctcatnctcatagta

SEQ ID NO: 2279 - DNA, 692 bp, Sorghum bicolor
  unsure (1)..(692): unsure at all n locations
  Clone ID: SORBI-28MAY03-CLUS38381_1
ttctgagtctttccataataatgagagctctggaagttctgaagcctggaagcgacgacgaagagctgacctagataatcaatttgacacccagcctttgtatcaacctccagttatgacaaatggtaataggttgcaggaatctagtagttctgcaggtattcttggttggggtccagttgaaatgagacggtatggtaatgaaaggccaaaacgtggtgttcatcctagtcatttttctactgggcatggacctttgctgtagctgaaggaagtagatgcgaacagccttgtccgttttggcataactgttcccagtgaatttcagcttccatatagttacaaatggaggaactccatcggaattgaaattctttttttccataaccaaaaggaataaagaggaaaaccggacctggatcgcagttttgaattctgtgcttcaaaggtaatgccaggactccagagtcgacgcggggaattgttaacagctacactgaatatccttctgacaccatcacagcaaaacaaatacatggtggcttgtgaactgccaagaggattaatcgaggaagttttgtcggttcagttttgtgatccaatagaaagttggggccatttagaaaagttcatctaaacaatgatctatagttcaatctcaatacatgtattatgttttaccttgcancata

SEQ ID NO: 2280 - DNA, 404 bp, Sorghum bicolor
  Clone ID: SORBI-28MAY03-CLUS38393_1
gagcaaatggaactgttcgcgtccaaggcagatgtgctggtggtgaacgcagggttggaatttaccggatggagagaggtgtggataaatggacggtcaattgctcttgtggagctaaggatgatgatggtgagaggatgctgtcttgtgactcttgccatgtgtggcagcacactaggtgtgctgggattagtgattttgatcaggtgccaaagagatatgtatgtaactcttgtaaattactccacaagcataagagcagtgggcccaggccagtttataatagtggcccaagcaaaagatgcaagattggcacaggagcctttagcccatgtaggtgggggatttttgaggcctcacattggttgacatgtaaatatcaataaaataacagcgagtttata

SEQ ID NO: 2281 - DNA, 523 bp, Sorghum bicolor
  Clone ID: SORBI-28MAY03-CLUS38455_1
gcacgaggcaccgagcagtgcacaggcccgcgcccctccacgagtgggtggctgccgttgcgcagctcgccgtgcagccatgggaaccggccgcgtcgcgctcctcctcctcctctccgccgcgctgatgcaggctctcctccccgcgccggcagagggtttggtccgcatcccgctgaagaagcggcccgccgacaaaaacggccgcctccaattccatgacgagcggcgccgtggcttcctcggcagcaacgccgccgcggcctcggagaaagctgaggcggaggcggagggcgacatcgtggcgctgaagaactacctcaacgcgcagtactacggcgaggtcggcatcggcacgccgctgcagaagttcaccgtcatcttcgacaccggcagctcccaacctctgggtgccctcctccaagtgctatttctcgatcgcttgctacttccatgcgaggtacaaggccagccagtcgaacacctataagaagaatgggaaatctgcttcaatacattatgg

SEQ ID NO: 2282 - DNA, 751 bp, Sorghum bicolor
  Clone ID: SORBI-28MAY03-CLUS37972_1
gcacgagggcctctacttctggtaccgcaagccccggccggccaagaacaacgccgtgctgccgacgaccaccgacggcgcgagcgcggtgcagatgcaggggcaggtgatcgagctggcacccaacacggtggccatcctgtcggtgagccccatccccatcgtgggcgtgcacaagatcgaggtggtggagcagcagcacaaggaggccgccgtggccgccgagacccgcaggatggccgccgccaacccggacggcgccatgccggaggtcatcgagatcgtccccgccgtcgccacggtgtgacccgacgccaatcgccagccaccaccatgcaccgtaccctgctagctagctcggatgacggccggcgacgtacgactgtggtggtaggtggctggcagcggcgagctgcatatatagcagactactgttgcatgcaggcatcatcgtcgtcgccaccgatcgtatctccacgataatcagtcagttaatctttagttggtcgtttagttggttaattgttggattattaattgcgtgtctcgtgtgtgtgattaattattagttactacccttggctcagttcagttcagtgtgagtgagtgagtgaatcaagtagtagtagttgtttgcattggatctgacaatgcaatgcattccaataattatggtggtgagctctagtgcgttgcagtcttcacatacatctgtcttggtcgtaatggtgtacgtacgtacgcggtacgt

SEQ ID NO: 2283 - DNA, 379 bp, Sorghum bicolor
  Clone ID: SORBI-28MAY03-CLUS38007_1
gctgagcgagcaggagaggcatgcggtggacctgcaggacgtgctgctccgcttcgcgttcgacaacatctgcgccgccgcgttcggggtggaggccgggtgcctcgccgacgggctccccgacgtgccggtcgcgcgcgcgttcgagcgcgccacggagctctccctcaccaggttctacacgccgcctttagcctggaagcccaagcggctcctcggcgtcggcaccgagcgcgcgctcgtggacgccacccgcgccgtgcgggagttcgccgaccggaccgtcgccgaccgccgcgccgagctgcgcaaggtcggggacctggccggccgctgcgacctcctctcgcggctcatgtcgtcgtcgccgccgccgcac

SEQ ID NO: 2284 - DNA, 855 bp, Sorghum bicolor
  Clone ID: SORBI-28MAY03-CLUS38090_1
gcacgaggctactctgtacccgccacctctccccgtctccggcgtggcgacgccgacgccgacgccgacggccgaccgatgatactccgccgcctgcatgtacgcgtctcccgcctatccctcgcgtccgccgccctcctcgatgtggcgccgcgcgccttgccctccgcgggcctcttccgtgcccgtggcctccacggcgcggcgggggacgacggcgcctcctcggagcacggacgcaaacccgcaggtcctcttacgctctacaggaatctagtaagccaagggaagctcacgcatgatgctcgccgggaaaatgtagcttctgaattagacaacttacttagtaggcttcaacagtacgagatggaaatggaggattatcataacaagctgtacatctgggagaatagcagggagaaagagcggcggaagcttcttgtccaagaagctgaagataagcagcgtgatggtgtatggatagatgagaaaagaggatttcttgacaagttggttacacggagaagaagaggaaacatagaacctggagttggtaagtgggtctcgtacctgaaccgagagaagaaactagatacattggtaggccatagaccagtcgctcctgttgctcctaaaggattgtatctctatggaaatgttggaagtggcaagacaatgttgatggacatgttctatggggccactgaaggtgtcatcaaacacaggagaaggtttcactttcatgaggccatgcttgaaatacacgatcatatgcatgatgtatggaagagacgtgatgatgacaaatctattcactcaagtgccttcaattggatatcaagccttccatttgat

SEQ ID NO: 2285 - DNA, 659 bp, Sorghum bicolor
  Clone ID: SORBI-28MAY03-CLUS38155_1
agatggaactgccgccgccacgcccgccccggcgccgcggcgtcctgtccgcctgcggcttcgggcgcgcctgcctgctccccgtcttaggcgactcgattaagggcaagctcgtcgaggcgatccaggacggagatgtccgccgcctcaaggggctggtgagtagcatgaaaaagaataccagagccaagcttgccaaaatgaatattgatcgacatgggctgctacaattggcagtgttcctaggaaaactggaggtctgcaggtactttgtggaggacctcagttttgacgtggattgcagtggcctctgtaatggtgcaacacctttgggttgtgcatcattatttggagaagtggcttgtgcgaggtttcttcttgaccatggagctgatccgaacaagatggacgagacaggctctgttgccctgcacaacgccgcaaaaaatgggaatggtgaattaatgcggctattgttatccagaggagccagagttgatattgctatacctcaggggacaccactacatattgctgcttcctatgggaacattgatgctgtaaagatcttactggatcaccatgccgatccagacatcatttcagaagtgtcaggcagccctctggtatcagctcttcaatctactaaacttgtgaat

SEQ ID NO: 2286 - DNA, 717 bp, Sorghum bicolor
  Clone ID: SORBI-28MAY03-CLUS38542_1
aagtaccatgtatatcctgatcagtgggttggcttctaccggcccctttggcttatctctagtgttattaattcactgtattccttctactgggatataaagcgagattgggatctgagcatcctaaccaggattttcatgttcaaaaacccaagcatatggactaatcttctttatgggcagaactgggtattctactgggtgttgggcagcaatttggttctgcgatgcacatggacatacaagctctcagcgcatcttcggcacaactacctgacagtgttcaccatagcagctctggaaatactgagacggtggcagtgggtgttcttccgagtcgagaatgagtggaacaagatgacagccaaacaaaacttggagatgtcatctgacatgccttccgaagcagacaggctactggattctagtaaccatacagtatgagctgaacagaccagtaatctcatattttgtgatacagattcatcaccattcttttagagtgaccattatagccaattttacgtcgacggttcagattttgtctgtagagctcaaaaggtcagggatacatgataggtttctatataaaagaagttgaaatttgttggcggctacggatgtaatcctcttgtgggagatgtatactgttgtaacccacttgaatccaacgagaggtatttgttgacacatgaaagaataatagtaatgctgaaa

SEQ ID NO: 2287 - DNA, 624 bp, Sorghum bicolor
  Clone ID: SORBI-28MAY03-CLUS38607_1
gcacgaggctcccgtttaccccgcgtgcgaagctctctctcgtggcgacgattggaacgccgccgccgcccttcgccaggtcttcttcgggcccttcgccaagtcttcttcgggcttcgccggcgacgagtttgccctccccttcgccccccttcctgctccgcgctgctgggctcccacacccccgcccggcctagctgctgcccgttcgcatcgcgttaagcttctagtcagttggactgattttgaatcatggcggaacacttggcttcaatatttggtacagagaaagatagggtcaactgcccattttacttcaagattggggcttgtcgtcatggagatcgttgctcacgtctccataacaggccaaccatatcaccaactcttgtcctcgttaacatgtatcagcgccctgacatgatcacccctggggtcgatgctcaagttcagggaggaagatcaggcagctgctgcacatacagcccttcagggccgtttttactctggccgaccaattgttgttgacttctcccctgtgactgatttccgcgaagcgacctgccggcaatatgaggagaacagctgtaatcgcggtggatattgcaatttcatgcatgtgaa

SEQ ID NO: 2288 - DNA, 559 bp, Sorghum bicolor
  Clone ID: SORBI-28MAY03-CLUS38639_1
atataatttttatgctggttttattatttgtgggagaggggcacgggggcccagtgtcttacgttacgcctcccgttggttggttcgttggttcgttcgttcatgtcctaaaccaattcgcatccctctctgtctctccgatccatctcctcctcctcctcctccggccgcaccaccggtaccacacctactataccaccaatgcagacccagacccagacgacgacgacgacgcagatgacgatgacgaggcggccggcggcggatcaggtggtcgttcagcaggaggcggcggccaaggcgacggaggacatgaagagccggcagcaggtggtggacgccggcttcgacgccgggaagccgccgccgttccgcatcggcgacgtgcgcgcggcggtgccggagcactgctggcgcaagagcccctggcggtcgctgtggtacgtggcgcgcgacgtcgcggtggtggcggcgctgggcgcggcggcggcggccatggacagctgggcggtgtggccgctctactgggcggcgcaggggaccatgttctgggcgctat

SEQ ID NO: 2289 - DNA, 586 bp, Sorghum bicolor
  Clone ID: SORBI-28MAY03-CLUS38647_1
gcacgaggcagattcgcctcttggggggcctgctgccgcgctccgcggccgctgtctcggcccccgggacgccggcggccctgcgccgcttttggggggctcttgtgacttctctgagtcggcttaacccggtccatcgggacccgctctcggccgtccctcgtcccctttccccctccccgggcttctactaccgctcgcttgcctggctgacctcccactgttggctcaccacttcgtcttgccctctgcctgtctggatggagtcgttgttctggccccattggccgccagtacagccgtgtcctctgcgtctgtgggccttctgtctccttttgctcgcttgttcacgcgtgtgtgcaatgcccgttccctggccctctgtcttgcggcccgtggcggcttcgccccttgggtggcgcgccgtccaatgcatgctcccccgggcaccgccacagggacacctgcatcggttcgaggatttaggatggctgttattacatcactgaaacagtttaacccgaatgatgatgacgctctctctatggtatacaagcactttgacatgaagcatgaggctgcttct

SEQ ID NO: 2290 - DNA, 643 bp, Sorghum bicolor
  Clone ID: SORBI-28MAY03-CLUS38744_1
tttattgttgagccttacatattcgatgacggctctgatgctgccacccactctgatcaatacaatgtcttcagcggtcaagtaatcactgcggttaaagaagcatgcagagcagctgttcttcagaacaagccaaggcttgttgaggctatgtacttctgtgagttgaccaccccaaccgagcagttaggtgcaacttacgcagttcttggtaagaggagagcaagggttctgaaagaagagatgcaagaaggaacctcattatttacagtgcatgcttacctgccagtcgctgagagcattgggttttcgaatcaacttaggagtttaactgcaggtgcagttagtgctctcctcgttcttagccactgggaagctattcctgaggaccccttctttgtcccaaagacacaggatgagcttgaagaatttggagatggttcaagcattgggccaaacctggctaaaaagctcatgaattctgttagacgaaggaaagggctgcatgtggaagagaaagttgtggagcatggcacaaaacagcggactcttgctaaaaaggtatagttgtgtcccaaatccaggtggtaggaaaactgtatctttgtaccaagattttgtcctggtatcctgaaatataaac

SEQ ID NO: 2291 - DNA, 700 bp, Sorghum bicolor
  Clone ID: SORBI-28MAY03-CLUS38673_1
aaatctaagatatacagggatccaccacttgcttccatattcttaatgaacaatgggaaatacattattcacaaggtgaatgacagtgagcttggggttttgcttggtgatgaatggatgaagcagatgatgagcagggtgcgcaggtggagtatggagtaccagcgtggggcctgggcaaaggtcatatcagtgctgcagactggaggtcctggcgttggcagtatcacggtgaagtccatgcttcagaaaatgcagatgtttaacagctacttggaggagatttgcacggtgcagtcagattgggtgattgcagatgagcagttacgagcagatgttaagtcagcgatagtggattctgttatgcctgcatatagaggcttaattgggagattgaggtcatctcctgaagctgcccgagacttgttcatcaaatacaccccagaggatgttcaggcacgcatccaacatctatttgaaggagtggccaagtgattagttaattatctgattttattgctatagctattttagtcgatatcacaagttatggtgacattctggcttctgggctcaatgatgtgttaaaaaaagggctggactttgtcttagatgaggaaatgctatcgtctccagctatgtaatttgtaggtgtttctgtatcaaatatcaactggtaattttaaccctaatgtgtcgt

SEQ ID NO: 2292 - DNA, 646 bp, Sorghum bicolor
  Clone ID: SORBI-28MAY03-CLUS38745_1
gcacgtcccaacggagcccagtgcccagcctgcctcggcgcgatcccgccgcgctgctcgaggtctccttccctgacctgaaccagtccagaacgccgacttcggcgggcgggatcgtccagagccgccgaatccgccgccgtcgttgatgcaccggggccgggtcatcgagattccggcgtgaggcggcgaggctaccgactgtcccttgcgcgcgtagggcatcggaggagcgccccgccgcggcccatggcgtgccggggcttcttcgagtgcgtcctcaagctgctcaacctcgtcgtcatggcggtcgggctcgctatggtgggctacggcgcctacctgctcgtgatgtggctgcaggtcgcgccgccgctcccgccgcccgcgccgtcgccggcgcccagcggcggcgacctcgtgcggctcgggaggccgctgctgctccttgtcgatgcgtccctgtcggactcggatgggaccgcggagaggctctccagtgcctggtttatttttgctttcattggtgtcggtgctatactcttcatcacatcgatctttggttgtgctggagctagaaatggatgctgcctgtctatttactcattcctcattattttgttcatactggtcgagcttggtgcag

SEQ ID NO: 2293 - DNA, 294 bp, Sorghum bicolor
  Clone ID: SORBI-28MAY03-CLUS38325_1
caaacaccagcggcggcgccgggccccgaaaaccctcgcgcgcgacggccaacgccaacggagcccgccagctagcttcaatcgcgagtgatccccaccgccctctcctccggtcctccgaaccctagccgtccccccatggcggcctgaggcgcgtacggatcgcgcgggagatgcagggcggtgtcgtggcccacgccgccgccgccgcggcggccgcgtcgacggtgaccactgcggtggcgcctccggtgccggcgcacgcggcggtggtgggaaacggcggcgggccgg

SEQ ID NO: 2294 - DNA, 646 bp, Sorghum bicolor
  Clone ID: SORBI-28MAY03-CLUS38326_1
gcacgaggatttggtgacagatgctattggggaaaaactagagccctcctctagttggattttcaggcattacatggcttcatcatcatagcccgcggaagcaacctacaacttttcattgccaaagaatacccgaaaaggttgatgatgctgtgccttctccagatgtctcatcagccattacagtgagtgtgaaaagcccggctgcctgtacttctggggcaactaactcccagaaacggagcattaacactaaatgctgccagttcccaggatgtgagaaaggagcaagaggagcctctggttattgtatttcccatggaggtggtaggcgatgccagaaacctggttgccagaagggagctgagggaaggaccatctactgcaaagcccatggtggtggtaggcgatgccagtatcttggctgtacgaagagtgctgaaggccgcactgaccactgcatagcccatggtggcggtcgccgttgtagtcaggaaggctgttcacgcgccgcacgtggaaagtctggcctgtgcatcaagcatggaggcggcaagaggtgccagagggagaactgcaaaagaagtgcagaaggatattctggcctctgcatctctcatggtggtggaaggcgctgtcagtttcc

SEQ ID NO: 2295 - DNA, 601 bp, Sorghum bicolor
  Clone ID: SORBI-28MAY03-CLUS38331_1
ctctcatggccagcgcgggactccaccacttctcctcctcccgccgaacccacgcgaagccggcgtccagatcttctcccccgcggttcagatccccggaccgacccgccgccgccgccgccgcctgaagagtctgcagcagcggcgagtttccacaggttgctttgagtttgagctgtggtggatctcctggcgtggcggcgacatggggctgggtttgggagctcttctcaaatccggcgctctctcggtctcggactacgacgccatcgtctccatcaacatcttcatcgcgctgctctgcagctgcattgtcatcggccacttgctggaagggaaccgatgggtgaacgagtccatcaccgcgcttgtcatgggtctcatcaccggaggcgtgatcctgctggtcactaatgggacaaactcacgcattcttgtgttcagcgaggacctgtttttcatatacttgcttccgccgataatcttcaatgccgggtttcaagtaaagaaaaagcaattcttccgcaactttataacaattattttgtttggtgctgttggaactctgatttcctttgtaataatctctcttggtgctatg

SEQ ID NO: 2296 - DNA, 727 bp, Sorghum bicolor
  Clone ID: SORBI-28MAY03-CLUS38795_1
aaaaaactcgtccatcgctcgctcccagctcctccatctctactaccagtagtctcagatcaggaccaggaggaattaagcgacgatgatgagccctaataagctcgccgtcctcactgtcttcgccctgctcggctccgtgtcttgccaggacggaggctactaccctcctcctccggctccgcccgccccgccaccaccagcatgccctccacctcctccaagcccaagcccacccccacctacgccggcacccccaccacccccagggacgcaactcatggtcggatactacaagaacaagtgcggcgcttacgtggacgtggaggccatcgtcaagaagcacgtcaatgccactgatgctggcatgcaggccgggcttgtccgtatgttcttccacgactgcttcatccgtggatgcgacgcctccgtcctcctggactcgttcagcaacgacacgagcctgaccccggagaagttcagcgtgcccaacttccccagcctacgcgggtacgaggtgatcgacgcggccaaggcggagatcgaggcggcatgccccagcgtcgtctcgtgcgcggacatcgtcgcgttcgccgcccgcgacgcgtcctacttcctcagcggcggcggcatcaacttcgccatgcccgccggccgctacgacggcaacgtgtccctcgccagcgaggccctgccgaaccttcccccgccgttcgccggcttcgac

SEQ ID NO: 2297 - DNA, 576 bp, Sorghum bicolor
  Clone ID: SORBI-28MAY03-CLUS38796_1
gcacgaggcccgaacgaagaagcgcgtctcgtctcgtctcgtgccgtgcctcccctcccctctcccgcgggtctcctctgtcctccgtctcgcctctagctctcccacacgccgccaccacctcccgcactgcaccagccaccgcaccccgcgacgggcagaagctttccatcctgggacgacagccggagggagggagggagctggttgcgtacgtacgtgtcgtcgtcgctagctagctctctccatggcggcgtcggtggtgatgcaccggtcgagctcggacggcgggtcgagcagcgggtggtcggacgcggcggcggccgtggcggcggcggcggaggagcgggccgggtgggaggtgcggccgagcgggatggtcgtgcaggcgcgtgacgacgtcgcggcggggccaggcggtgccccgccgaggccgccgccgccggagatcaaggtgcgcgtcaagtacggcggcgcgcggcacgaggtgtccgtgtcccccattgccacgttcggtcagctgaagaagctgctggcgccgaggacggggctgcagccggcggaccagcagctgag

SEQ ID NO: 2298 - DNA, 560 bp, Sorghum bicolor
  Clone ID: SORBI-28MAY03-CLUS38797_1
gcacgaggctcgtcccaaagccggcgccttttgctcccccatctcactccccgtccacctccgacctcccaacgcgaagccgcggcggcggggcgaccggaagccgactcgtcttttcctattccccccaccttcgcttcgcgcgtaccccgcttcagtacagccctcctgcgggcggtgccgtcgacggcgccgacattgtacttctgctgcgctgcgcagccatcacttttccgagaaaatggtcgcagcagcctttactgtggatctggacaagcctctagtattccaggttggccatctagaggagcagtatcaggagtgggttcaccagccaattgttagcaaggaagggccacgattttttgaaaatgatatattggagttcttaacccgcacgaaatggtgggcagttccacttatctggttgcctgttgtctgttggtgcctgagtacttctatccagatgggcaatacaattacagatgtagctatgatgactgtgtttggaatatttctgtggacactgatcgaatatgtggtacaccgattcttgttcc

SEQ ID NO: 2299 - DNA, 816 bp, Sorghum bicolor
  Clone ID: SORBI-28MAY03-CLUS38826_1
gcacgaggcaagaacactgttgctgaattcgctacccgtggtttccgatctctcggtgttgcccgcaagcgaggtgagggtgcttgggagattctcggtatcatgccttgctctgaccctccccgccacgatactgcccgcactatcaacgaggccaagcgccttggtctttccatcaagatgcttactggtgatgccgtcggtattgctcgtgagacttcccgcccgcgcggtctcggtaccaacgtctacaacgctgagcgccttggtctcggtggcggtggtgacatgcctggttctgaggtctacgatttcgtcgaggctgccgatggtttcgccgaggtcttcccccagcacaagtacaacgtcgttgagatcctccagcagcgtggttacctcgttgccatgactggtgatggtgtcaacgatgctccctctctgaagaacgccgatactggtattgccgttgagggtgcttccgatgctgcccgatctgcctctgatatcgtcttcctcgcccctggactgggtgctatcatcgacgctcttaaaacatctcgccagatcttccatcgtatgtacgcttacgttgtctaccgtatcgctctttccctgcacatggagatcttcctcggtctctggatcgccatccttaaccgatctctcaacatcgagctcgtcgtcttcattgcgattttcgccgatattgctacccttgctatcgcctacgacaacgctcctttctcccagacccccgtcaagtggaaccttcccaagctctggggtatgtccgttcttcttggtgttgtcctggct

SEQ ID NO: 2300 - DNA, 652 bp, Sorghum bicolor
  Clone ID: SORBI-28MAY03-CLUS38829_1
tgaaagagaattggagaattgcaaaatgggttgcacttggagctgttgtatttgaggcattgttgttcactgtggctatcatagtacagtcggggaatcaagctgattatgacagtgacgatgagtacatcggcgcaaggtctggaatacggcagccgttggtgaatcagcaagctgctgccactgatcctagggtgcccaatctcgactaccgcccaatccggaatgacgcatggagccaaagaatgagagaaaagtacggggtggacagctttgatccgaacaggtttcagcaggccacgatatctccaggagaacaaagaaaccgatgcaccattctctgaagcttgattgacagcaaccagtagtggttccaagttttatatacatccaaccgtacaattacatcgagttgcagagaatatgtgcctgattgtgtagcatatgcctgtatctgttttttggtttatatagtaccaaactcagcacaccaatgcataggtgcaggtgccacaatccttttaagtttttctaataagtattgaacctagtttgtgttttagtctaatgttccaatgtgcataaaacttttcctgtttaagtgatggtcactacattcacgaatttgcgaatcagacatgttgttacgcaa

SEQ ID NO: 2301 - DNA, 546 bp, Sorghum bicolor
  Clone ID: SORBI-28MAY03-CLUS38840_1
cggcaaacctgtgcataagacgtgacccacattcaaggcctcgcatgtcccatgttcttcgcattcttgagggcggtatggtcgtggaatctggttctgttactggcagtagtagtgattctggaagcagaagctggagaatgctgaacgaacaacaacattaccaggagcacagcagtagcccggctcaacaagaatcgcaaagggcaggcgaggggaagccctcctacagtgctttgagggccctcttgggaccgggacaagcagaagagtatctccaacagatactagtgctgcctcataatgcagtgaagctgagattgctcaatcctgtattattccctcgccctacctcccggtctcagttttttgggttcttgtgtcttcacttcctagcaatttgtaggctgaaagcttttgctgatacattgtcctggtgtatagtagaaatggtaataggtttacaagtatattgagctgcaagttagctcatattttgtgtatgatttgaggaaatgcgatcacaagtgaccatagttatgctgg

SEQ ID NO: 2302 - DNA, 799 bp, Sorghum bicolor
  unsure (1)..(799): unsure at all n locations
  Clone ID: SORBI-28MAY03-CLUS38845_1
gttttgacctacctgagctaccacctggctatctatcacaaactggggatcaatgcattgaaaataaaaataataggaaagctcaatgcagggattctcattttggaaatcgttccaataataacaaaagaccaaggtatgagcgtggaggttttcagtctaaaagatctaacgtatggaaccgtactccttgtgctgatgatgcaatggccaagagcagagaaccaaccctcctgcagaagcttcttagctctgatataaagagggatagacatagacttctccacgtgttcaaattcatgaccttgaacaatttctttaaggactggcctgataagcctctacagtttcctagtgttaaggtgaatcagattgaaatacgaagtactattggtacagatgacttggataatgccgagatggccaacgacagcatccttggtgtaaatgaaaatggtgattgtaaagagttgagctcgattgatgaagaagatactgatagtgccaaccacaacgatgaagacgtcgatggcgttagtgctgacagcagcattgaggatggggccgaggaggaggatgcgtaccaagagcagtttaatgagcctgaagatgatactgcagtctgaaaattttatttactgaactgggtatccaaattaaaaagacaaagcgcttctccttgtgtaaaggtgactctgcacaacacattctatagctcttcgcatattccaggagaggtctggtgtttaaagaaactttgttgtagttgaattgttatgttttcnccaaggnaatatat

SEQ ID NO: 2303 - DNA, 827 bp, Sorghum bicolor
  Clone ID: SORBI-28MAY03-CLUS38467_1
gcacgagggctagctcgacccgttccggccctctctggccatggcgccgtcgccgccgccatcgcccagatttccacgcttcgtttttttttcccgattcttctgcttttcttgccgtagctcattgcctttttctttttcgtttgaatatgtgtgcctatgatttcgaaaataaggctgaggaagctgtcgcctttgagagaaccggatggctgcatcttgctcgtgccatcccggttccgttgcgggcgtagagaaaaccgataccggttctggatctccgtctgcttcgtcccatccttcgcatcatatcccgttgcgagatggcagatgggttcatgaacaaatccttttcgttcagattcagattcgtctctttcgattgagcactgagcggggccgcacttttcgtttctttcccgagatgagattgggcgtggccatcgacaatcccaggcgagcgagtgatccgtgctcgtctgatacacgcgaggcctagaggttttttttttggagccgcccgtcgatccgccgcctctcttggatcggctttgagttggagctgtgcggctatccgcatatttgttattgtgtggtctcattgcgtgctgatttttaagtttgctgctgatttgcatccatggccttcataatcccggattgactcgcttagctgttcttccgattcatgggaggccgagatcgatgttccctgggagtttcgctgatagcgccttcttcctcgtggaggtgcttcattagtaactcaccacacaagcactgctgcttctgttatctgtcctgctcattaagcattgtttttccaa

SEQ ID NO: 2304 - DNA, 577 bp, Sorghum bicolor
  Clone ID: SORBI-28MAY03-CLUS38468_1
gcacgagggccattcccccctccgctacacgccgagcgcccgcgcccagatcaggcgtctccgctgctcctcgcgtcctcgccccagcccttgcggcctcgcccccgtcatctcccgtggaggactgccgcggggtggtgacgagaggagatccgccggggctggctgctggttggtcggctggtcgagccctttccttcgtttgttggtgcctgagcccggggtttggatagtttctttcgctccgtctgttgcggattggattcctgcggctgctgctgcgtcgccgagtgctgattccagcttgttcccctcccccccctgagattgtacgagacggaccgccctctggcgcggaggccgcacaggcaaggcggcgccggcggcgagatgaagggcgcgaccatcccctcggtcgcgatcatgccctcgccgctcttcctctggcggtttaaggttgtgttgtttcttctctggggcttatgttgttgcaagataagttgggactcagttatgagaatgagtgttgatctcagagacttatttctttacgaggctttcttgtactataatcctc

SEQ ID NO: 2305 - DNA, 1176 bp, Sorghum bicolor
  unsure (1)..(1176): unsure at all n locations
  Clone ID: SORBI-28MAY03-CLUS38497_1
gcacgaggctctcgcaggtcgcttctgcccactacttcttcgaggttgccaccgtcaacggcaaggactctgctcctttccagtacatccgtgacttcacccgtgctaccaagtacaaccccatcaagttctcctccaacccttccgccgatatccgtgacaactccttcgctgatggtgaggacatcatctgcaaccagggtgccaccggcaacggtgcttccactgaggttgccgatgtcaaggccggtgatgtgatcaccttcaagctcggagtcggtggcaagatgggtcaccccggacctaccctggcctacatgtctgacgccggtggtgatgtcaagtcctacaagggtgacggtgagtggttcaagatcatggaggagggtgtctgcaacgccggtggtgacttcaccaaggacgcctggtgcaactacgactctccttccgccgacgtcaagatccccgagggtaccccctccggcgagtacctcctccgtgtcgagcacatcggtatccaccgatctcacgtcaaccagcccgagcactacgtctcctgcatgcaggtcaaggtcgctggtggctccggcaaggtcgatgccgagatggtcaagtttcccggtgcctacaaggccaccgatgactacgccaacttctccatctacaacggtgctaaggatttccccatgcccggccctaaggtctggggcggaaacacctctgctggtggtgccgctcccgccggtgacaacaacgccgctccttccggcgatgctcccgcccagactcccgcccccgatgccggcaacggccagcagggtgaggctccccagcagggcgctccccagcagggtggtgagcagcagcagaacaacggccagcagggtggtttccccggccagcagggtcagcagggcggtttccccggtgctcaggctgccaacaacggcaactctccttgctctgcttaagcgacttctttgaggattcgattcttgtttggttttagatgtggaatgaacggaggaccatgaagtggagggaaaaagttggaggtttctggtcaactttcatgtataaaagagtcctgttgatcgcatcaagttttactgctagatgaagaaggggatggtctggtactgtgctcgttagtcatttagttttgcttaattatgn

SEQ ID NO: 2306 - DNA, 792 bp, Sorghum bicolor
  Clone ID: SORBI-28MAY03-CLUS389_1
tgaaaaaattagctgtacatttgcctttgagaagcctcctgacaagagagaggagcgtgtaattaatttggagcgaacagaatcagagatctttgctgcagcacctactacacctccacctgcacctccacctccgccttctccacctgcaccaccaccgacgccaacaccgccacctccacctccacgaccgccatcgccacctcccgttgaaaaagtaactgtaaatcccattgtacgttcagaaaaaagagttagcaccccgccaaggactggtccctcgacatctgcaacatacttttctgtggcatcacttcagcaatatacaaatagttttcaagagcaaaatttgataagggagagtagattgggaaaagtgtatctggcagaacttcctggaggcaaattactggaagttatgaagattgataatgctaatggaagaataccagtagatgactttctagagttggttgctcgtatatcagatattagacaccctaacattcttgaattagttggatattgtgctgagtatgaacagcgattacttgtgtataaccacttcagtagaaaaacattacatgatgtactacatgaaggggaggatctagatgaaccattatcctggaatgctcgcctccagattgctcttcatgcagcaaaagccttagagtatctccatgacacctgtgaacctcctgtagtacaccagaattttgaaccatccaacgtgctcctcgacaatagatgctcagtacgtgttgctgaatgtgggctggcagaattgac

SEQ ID NO: 2307 - DNA, 710 bp, Sorghum bicolor
  Clone ID: SORBI-28MAY03-CLUS38900_1
ccacgcggaaataatacacgagcgaggaggccgggagggtttcctgtgcgcacacgagtcgcacgcggcttttttccgctcacgacgccgcccagtcgcgacgccgccgccactcgcccaggtgctctaggtgccgccgccagactccatccagatcgagacgaggaaggagcaccgcatcacgtttctggagcagccgccgccctcacaccaccagcggagcaggggctcatcgtctcagggcgctagcggggagagccgtggtggcggcggggagccgggggtcccagaggtctcgcacctgcggcgctgctcattgccccctcgcgcatgttcgccttctgcgtgctccgttgccccgaccgcttgccctggtgccgcccccccgcgcccccctcctcgcctgcttcttgtcacgacctccccctcgccagagcttttggtggaagcaatgtatgttttctgaaggaaaatgtatgctgctacagtccctatgccaagcttatgaaaaggaattaaatttgcttttggatgtatgtctgggatatatggatggagatgatctatgatttggtgacgaatggattagctaggttgaatttcccccttgaattgaatgtttctatgcattggaactatgtcaaaataattcccccaatttgttatgtaaacagccctattcttgagatttttcatcacttctcgttgct

SEQ ID NO: 2308 - DNA, 633 bp, Sorghum bicolor
  Clone ID: SORBI-28MAY03-CLUS38880_1
ctatttggaggtggcctgttgggttacgtgatctatgattgcacacactactacgtgcatcatggccggccatcatcagatcctgcaaaatatctcaagaagtgccatctcaaccatcgcttcagaattcaaaccaagggctttggaataacttcgaccctgtgggatcatgtatttggcacactgccttctaccaaaactgtcgacaagaccgtttgattttgactggatcttctgctttgcaaagcctaatagtgagattattcatgatcggtggaggttttgttggataaattgctatccagtttctgattcttctccgtggacgaactgtgaatgcgatcaccagttgctggctcgcaggcgcgcctgaaggtcttgtccgatccatggtcctttcaagaacagtttagtttcaattcaagtccatcagcgttcgttcacattctctctagtgccagctgttagatcagcctgtaatgtatgtacagagttctcttctctagtaccgtagcctctgcaatgggctgttggtagcctatgtctgcataatttttgctacaagtaaatgcttgactggttgaactttcccccattatatttgtattagtatatatataagccaagtttttc

SEQ ID NO: 2309 - DNA, 564 bp, Sorghum bicolor
  Clone ID: SORBI-28MAY03-CLUS38922_1
gcacgaggcctcggcgcccgtgcctccgccaaggatctcctcggccatgccagcttcgggaaacccgcttctaccgcgaagaatcccggcagcggtgagtctaccagtggttatgacgatgaccctgttgtggctgtgagccgcatccttgaagatgtggagcggggcgatcagagcatcgatgatctcgaccacctcgcgcttacaggtgttggttacgcgctggcgcctgctgatgaggtccagttcagaaggattcttgtgtgcttgcttcggatttgtgggaggactgggaatctggctactggtgttcgggtgcttaagctgatggagtggctggtaatggggttcgttgagtcgaggaagatgcggaaggttcaggtgctctttgagctgatttcaccagagaagtgtgaggctgagggttatgtgctgtttccagtggtgatggcggcctgcggtggattacgggcattgagggttgcttcggcaagataccggctggactttgatccacagctgaagcaagcgcctgagtggacaattcagtttgcatctgagcag

SEQ ID NO: 2310 - DNA, 497 bp, Sorghum bicolor
  Clone ID: SORBI-28MAY03-CLUS38940_1
gcacgaggtgagttttatggtgagtggattggtctagtagctgaatttacaactagatccttgttgtcatggcagtgggccagcaacagtgtctactatcttctaagtctttggtcaaggctggtgacatctgtgccttacttgaaaggcgaaacaccaagtcttcttgataaaactgttcccaagatcacagagggttttatcacttctagaattaattctgttcgcgccagccttgctgacaactcactggaaaatcctttggatagtgtggaagttctccaggaccagctggagtttcttcccttcctttgcagattccagtaccaaagtagtagtctgtacatcataaacatcatggaacctcttctgcaagcttatacggaaaggtccagattaccagctcctggtgatgctgatgagctgtctgtcattgaaggccaaatcgcatggatggttcacataattgcggccattgtcaaagttaggcaggtaac

SEQ ID NO: 2311 - DNA, 648 bp, Sorghum bicolor
  Clone ID: SORBI-28MAY03-CLUS38929_1
gctcgctcgtgaagcgtctcgccgcccccaccgatccaccacccatcaggaggccctcgtccctcagccaccggccatgtcgtcgccgtcggtgcccagcctccgcctcccgctccgccccgcgtcaccgcccctctcccggcggtacctcgccggaggctcccccaacgcggccgcgccccgcgccgccctcctaaaacctctcgcgtccaaggcgcccgcgtcgtaccaccagcccgcgctcctcctccaccagcggcgccggcatggcccgcccccagctgccgcgaccaccacctccaagccggttctcaaggacccgaagaagtatcaggagtgggactccgtgacggccaagttcgccggcgcggccaacatccccttcctcctgctccagctcccgcagatcgtcctcaacgcccgcaacctcctcgccggcaacaagaccgcgctcttcgccgtgccgtggctcggaatgctcactgggctgctgggcaacctctcgctcctctcctatttcgccaagaagagggagacggaggcggtcatcgtgcagactcttggcgtcatctccacctatgcggtcctcgtgcagctcgccatggcggaatccatgccggtgccgcagttcgtggccacttctgtcgt

SEQ ID NO: 2312 - DNA, 691 bp, Sorghum bicolor
  Clone ID: SORBI-28MAY03-CLUS38947_1
acgtgctgacgcgaattgcgaaatcgccgacctcccctcctctgctttcgtctcttccctcgacaaaccgacctcctcccgccggcgaccgccgtcgatccaccgatcgggcggccgaaagacccaaccaccccctccccgaaataggcagctgagacatactacgttcctgtccccgccgccgccgccgccgcggaaaagcctcgcagcctgcgccccctcctcctccccccgccctcctcacctcgatttctctgggggcacggaaccccgccggcgggcgcgcttccggcatctcctactgttcgtgccgctgctggagatccgtacgtccgccacggagtagcgttccttctgctgtggccctgcgtcatctccatcgtccccctcccagtccccttcatcgagtgggaggcgacagctccgagtcctagcccgtgctgcaacctgcgacgagcgcggctccgacgtcctgacgcgcgcgagcgaggtgttggcggctccggccggtccgacgtgtggaaggcgagcgcggctccaggctgaggacggccgagcgcaccggagggcagtaacctgcggcggcgtgcggagctcgctcccgacggcatagaatcggtgtgattagaggtaacatgatgtcttctgaagataaggcatggctagttgtgtcacttcactctcaccaaaa

SEQ ID NO: 2313 - DNA, 528 bp, Sorghum bicolor
  Clone ID: SORBI-28MAY03-CLUS38952_1
gcacgaggcttcctcctattggacagctggagcatctaaggaaactgaagttatatgagttgccatccataaaagatgtcaggtctgatgtatatggaacctcaaatgttgtctttcgttctttggaggagctgagttttggatccatggtaaaatgggaaaattgggcagatgcagagaacagacaattctttccaaacctgcaaaagctgcagattaataggtgctataatctgagggaactaccttatatggtcatgggcttagctatcaaagaactttcactttcacgttgtggttcatattccagtaaagtatcaagttatttgtgtcgactaacctgtctcacacatttaaaggtaaatgattgctcacaaaagttaatccttccatgtcaaaacttggtatcactggaatacctgcacctttcaaattgtaaggagctctgctttgagggtggaattttttgtatgaacaatttgaaagccctacatatttccagctgccacataatcacattatccctag

SEQ ID NO: 2314 - DNA, 660 bp, Sorghum bicolor
  Clone ID: SORBI-28MAY03-CLUS38747_1
tctggctcctcagctgctgtcaccgcacctccctccctctccgcgtcgctccccatcccgtcccatcttggcctggacacctgggctgcccccccttcgtttccgcgcgcgcggacacgctgagtcgccgcccgaatcctcccgcctccccgccgctgccaacgtcgatctgcgaccgcgactccgcgcgaggtgggattcagaaggtaggaggaggggagacgagttcctgtcggtttcattcttggccgccgacttcacatgccaacaaccccaagaagcagaagccaggctaggaccactaggccttggatcttgtcagggatggactttgctgattcgcgacggaagcctaatttcacggggaagattgccgtggcagctgcactcacggtgatgtgcataatcgtgttgaaacagtcccccagtttcagcggtaccagcgtgttctctcgccgtgaaactggggtgacccatgtgttacgaacagggggagctgggtatattggctcacatgctactcttcgtctccttagtgacaactaccgagttaccattgtggataacttatcaagagggaacatgggagctgttagagttcttcaacggctatttccagaacctggaaggcttcaatttatttatgctgatttgggcgat

SEQ ID NO: 2315 - DNA, 647 bp, Sorghum bicolor
  Clone ID: SORBI-28MAY03-CLUS38790_1
gcacgaggaaaagtaatgccagcacagagccaaatatattaccttccataacagcgtcaaaaacttctcagagtccactgtctgtgaaaactactggggaatctggagatttgcctacattaactatgaagaacagacaggatagtcagtcaatgaaatctttggggaacataaaaggaccgggtgcttctctgcagaacaagggtggcatatttagagatcttggcaaatcgtcttttacttctgaacattccaagccggctgtattacatgagaagactggccagcttagtggggttggcgatgctgtgcagaacactgtgaaagatacccccaagatggcacctcaaccttctgcattctcgtcagctcctgttactcagactgattcatactccttaaggtcgactgtttactcttcagccacatcagcctcgtcaggtgcgaaaacttcggaagttttatctagctcagtgcagaaagtttctccaatagtagccaggggtactgtgtctagctcaatccctactcctgctaaggattcgtcaactggcttgagtcaaaatgcttccaaaccagaaatgctaatatcggaggtaactagtaccatactttctgcaagttcgacttcagtcatatcaaccact

SEQ ID NO: 2316 - DNA, 895 bp, Sorghum bicolor
  unsure (1)..(895): unsure at all n locations
  Clone ID: SORBI-28MAY03-CLUS38792_1
gtgtagtgtacaactggagcatattccttcctgccatgatcggagaccttgatgacacgaaaaagatttgttgcaaaagctgaagacacacctgtggtgcttttcttctttgatgacgccggagacgggaggacacgcttcagcggaggaggagccaccgccgcggcccaagggcatcctggaacggatgcacaagtacctcctcctgcttgccatcctcgccgccacggtcacctacaacgccggcctcagcccccccggcggagtctgggctgacgacgccgatggccacctcgccggcgaccccgtcctgcaggcacactacgcggcgcggtacaacgtgttcttctactgcaacgcgacggcgttcgtggcgtcgctggtgatcatcatgctgctgctgagcagcaccttcagcttccacgggtaccgcgtccgcgcgctgcaggcggccatggtgctggacctgctggggctcatgggcgccttcacggcggggagctgccggaaggtcaggacgtcggcgtacatcgtggcgctcgcctgcgcctgcgtcgcctacctcgtcgcgcacctgctgctgcacttctgggtccggagcagccgctgcccgtccacccgccgggaggtcaccgagctgctcaacctgcatcgcctctgcccctgttgctgctgctgctgtggccggagtgacgacggcggcgctgccgcgcaagatgctcccagagggacgacacgcgcacgcgtgtgattgtcaggttattgtgcgagtgaaatatgcctcatgacaagacatttggtccatgctttgactgttaagggtcaaatatatccggctnggagttttataactccgacacatagtgctatgtatgagagtacacatactttattt

SEQ ID NO: 2317 - DNA, 660 bp, Sorghum bicolor
  Clone ID: SORBI-28MAY03-CLUS39003_1
atgcagccgatgcagcatcagcagccgcagccacagcagatgcaatcgatgcagcaccagcagcagatgcagcaccagcagcagcagcagcagcagatgcaaccaatgcagcaacagcagcagatgcaacacatgcagcatcaacagcaacagatgcagcaaatgcaacagcagcagcaacagatgcagcaaatgcagcctcaacagcagcagcaaccccagatggtgggtacaggaatggggcagcagttcatgcaggggcagaatcgggcagtgcagatgatgcaagggaagattatgccacagggcccgggcagcatgcctgggggaggcttcctaccttaaaacagctcttgtcagcaggcatcagatgaattgaatgtttacactgacccgagtataaagatggttgtgatgtcaactttatttaacagttttagataaatagtcacttgtgtagtgggaagtgatgtttagtagtgtaaatcaatagcactcatgtagctaatagtaccgtactgaactgaccccaatgggagtggtgctaaaacttttttttaaactgcatccgattttattggtagccatataaattctgtagtaaaactgccttgtcaaaacagaacctttcatcaagaagaccggtccatgtttttactc

SEQ ID NO: 2318 - DNA, 664 bp, Sorghum bicolor
  unsure (1)..(664): unsure at all n locations
  Clone ID: SORBI-28MAY03-CLUS39037_1
ttttggtcttttgggagctttcagagctgcctgttgttgtcctctcgaacctctatcggctgctgcttcgccttgcgctcgttccccgtgccctattgtccgctttattcggtgtccacggaagcatgctccttgtttctcacttgcgccccggctgccccggcttggcttggggtgtgcttctcgccgccgttctccagcctcagcccccggcgttcccagtctgcacctattggttttcttctgtggcggctactccgtttgccctcgtccgctggatccggctccaatgtcttggttcggctgtagcgccatcctggagcgcacgacgatctgataggtggctactggttgtattcctttgataagtggagaaaatttgacaagtgcacaaaatgaccatccatgctttcaataagggaatcgatggataaacaacattggagaaatgcttgacgaaggagcatcattccattgaggcggctgcattgcctatttgcttatttgcggcacggagagacaattgttggttgtatgaattagtcttgtttttaaattgcttcatcatcaatgtgtaaatatttatatatacataaacatatttgaccaaatggttgtaaatctataattggnaaatgtaataaagaaatgtcatcatattttc

SEQ ID NO: 2319 - DNA, 545 bp, Sorghum bicolor
  Clone ID: SORBI-28MAY03-CLUS39061_1
tgagagcattccaccagcaaatgttgtcctcctcaagtggattttacatgactggagcaatgatgagtgtatcaagatattgaagaattgcaagcaagctatcccttctagagatgcaggaggaaagataataatcattgatgttgtggttgggtctgatccatcagacaccaagcttctggagacgcaagtactctgtgatctccatctcatgaaaattggtggggctgaacgagatgagcaagagtggaagaaactattcctcgaagctggatttaaggactacaagattatgccggttttgggcctccggtcgatcattgagctatatccatgaatgcccagcaaacaagaagtctgctagagaaataataaagcatatggcgcgttgggtgtcctggtgccttctgttgttggcgttggtgggattgctgtcagtccggttggacccgttctgattctttctcctttttctcttgcagctccccgtttatgtgcagccccattctgtgctctcatcacaccctggcaccctgctaaaaaga

SEQ ID NO: 2320 - DNA, 643 bp, Sorghum bicolor
  Clone ID: SORBI-28MAY03-CLUS39068_1
gcacgagggcgcagccaaatccgaagggtagcggcgcgcggggacgacgccatgagccgcgcgctcctctcccacgtcctccaccgcccgccgcacttcgcgtacacctgcttaagaaggagtggcgttggtgcccgaggagtgctcgcttctggcatccacccactccgtcgtctcaattgcagcgcggttgaagccgttcccggccccactgaggaggcgtctgctcctccggcaaggaactagctgtgttcactgttgcaggaaaagagtagtttctggtgtacagccaactggattggttcaccttggaaattatctaggtgcgattaagaattgggttgcacttcaggatttatacgagacattctttttcatcgtggatcttcatgcaattactttaccatatgaggcgccactgctttctaaagcaacaagaagcactgctgcaatatatctggcatgtggcgttgacagctcccaggcttctatctgtgtacagtctcatgtccgtgctcatgttgagttgatgtggctatggagttcttctactcctattggctggctgaatagaatgatccagttcaaagagaagtctcgcaaggcgggtgatgaaaatgttggggttgcacttttgacttat

SEQ ID NO: 2321 - DNA, 1031 bp, Sorghum bicolor
  Clone ID: SORBI-28MAY03-CLUS39072_1
gcacgaggcttctggtggcaccttttcttttattgaggatgaaggcgtgatgcaagatgcgtttgctcaatgtattggtgggcttcttagcgttgctgttcaggagatgcgtctcagtatggagtgcgttgatcctggtgttcaactctgttccatcaaatgtggcagctatccaagtaaggtagcaagagatggacgaaatggatctgttgatattgctcacttatatgctgatgaggagaaagacattttgctgtcagtgaccattccaaaatcttgtgaacagacttcactgttgagagttgcttgtgcttacaaagattctgtgaccaatgagacgatcaagattcaaggtgacgaggtaaagatcaagaggccaacatctaccgtatctgtaccagtttctattgaagtcgatcgagagaggaaccgtataccagctgccaattctatggagtctgcatgggctgctgctgagaggggtgctctctctgaggccgtcactattcttgaggactgccggagggcactatcagagtctgttgcaagccagaatggggaccgtctatgcatggcccttgacgcagagctaagagagatgcaggagaggatggcaaaccgccagctttatgaggcttcagggagggcgtatatgctgtctggattgagctctcattcatggcagagagcaacagcccgcggagactctacagatagcaccactcttgttcactcatatcaaacgccatccatggttcagatgctggagcactcccagaatttcagctctctgcctcagggccgaaggccacaagtccagggaaggtaaatcaccatcatctcggcagtgtcatgttcggatgatggtgaaagtttaatcttagctttcatcagtcttagcatgattgctggtgctttagtagtgcctatttattcttttgctgataagtttatttgagtcgtagtgaggtactgaggttataccgcggaaattgaggtgcgggatgtacttcattgtgataactagagct

SEQ ID NO: 2322 - DNA, 573 bp, Sorghum bicolor
  Clone ID: SORBI-28MAY03-CLUS39078_1
gcacgaggggcctcctccacccccgccgcctccgccccgcctccccgctccacggccggcctcctctcccgccccggcgccggcagcagcttcggcgcctccgccaccggcggcagcttcggtgccggccgttcccgcggcgggcggtcgtgggaccgggagccggacccgttcgcggactccgacccggccccggccccctcctccgccaccgacggcaccccgttcgaggagcaccagaacacggggatcaacttcgacgcgtacgaggacatccccgtcgagacctccggccgcgaggtccctgcccccgtctcgacgttcgccgagatcgacctcggcgaggcgctcaacgacaacatccggcggtgcaagtacgtgccccccgcgcccgtgcagcgccacgccatcccgatctcgctggccgggcgggacctcatggcctgcgcgcagaccgggtccgggaagacggccgcgttctgcttccccatcattagtggcatcatgaagggaccgccgtctgctggaggtgggaggcaaaggggtggcgggatggggatgaggaccgcttat

SEQ ID NO: 2323 - DNA, 706 bp, Sorghum bicolor
  unsure (1)..(706): unsure at all n locations
  Clone ID: SORBI-28MAY03-CLUS39114_1
gcacgaggctggtgctttgcaaagtcagttgatgccatgtaacaagctcaatgagccaaaagatcacatgcctactgagcaaaatgccttgccacagcatttacgtggcatgcgtaggcgcagccttttcaacgaaaaggctggggttagtaataaaggtgtagacaaagcttcagatcatcatcctgtaaattcaactacccccaaatgcaaaactatttctggtgacaactcaaagcctctaagaacccctccatgtgcattgcctggtattggcttgcacttgaatgcccttgctgcaatacctaaagagaaactagagattcagtcctcgataaatgaattgagtaacttgataggcccttctggatcttctccagcaccttctgagcaaatcattattaatgatgatttcaatcaaacaactgatgttgcaactgccgaagcttctagtcagggtagtcccaagaagaaaaggcagaagtttgataatggtgatggcacttcatgcaagcgttgtacttgtaagaagtcaaagtgcctgaaactttactgtgagtgttttgccgctggagtctattgttctgagccttgttcgtgtatcggctgtctgnncnacccgagtcttacagaaacagttctatctacacgtcaacagattgaatctcgcaatccattagcatttgctcctaaagtaattcataca

SEQ ID NO: 2324 - DNA, 696 bp, Sorghum bicolor
  Clone ID: SORBI-28MAY03-CLUS39135_1
gcacgagggcgccgcccaccctccaccgcccaccgccactgcctccaccacgtccccgacgccgcgtctcagtctctcactccaccctcgccgcgccgcccaacgcccacgatgcggcacgtcctcctctcccgcttcctcctccgccgccaacagggcggcggcatgcctaccgcccaccgcccccgcctcctccgcgccctctcctccgccccgtccccggtctcctccgacgccgagctccgcaagtacgcgggctacgcgctgctcctcgtcggctgcggcgccgcgacctactactccttcccgctccccgccgacgcgctgcacaagaaggccgtgccgttccgctacgcgccgctgccggaggacctccacgccgtctccaactggagcggtacccacgaggtacacgcccgcgtcttgctccagccggactcgctcccggcactcgagggcgcgctcgccgccgcgcacaaggagcgccgcaagctcaggcccctcggctccggcctgtcccccaatggcatcgcgctctcccgcgccgggatggtcaacctcgcgcttatggacaaggtgctcgacgtcgacgccaagaagaagaccgtcactgtgcaggctgggatacgtgtcgcggagctcgtcgacacgctccgggaacatggcctcacgctgcagaactttgcgtccattcgg

SEQ ID NO: 2325 - DNA, 658 bp, Sorghum bicolor
  Clone ID: SORBI-28MAY03-CLUS41700_1
gcacgagccccgcccccccccgccctccccgtcccgcccgctcccgacacggcggccacggcgacgcacctcctcccgcgacccgtgctcccgccaccccttccttcctctccctctccccgatgtggtggcctagaggttggcccccagcggcaccgcttgaccgccgggcgtccttgcggcatgacggtggcctcaggctgtggcggagcgccgcccgtgtgacctgccggcgcccgtccccggccacggcatggcgtcagcagggctctccgagcagggccctccggtggctggcgacgcgggtgctctccgaggcaggctcctcgaaaccctaggttcctgtgctcgcggacacggccgcccggtgccgggctcgggcccggtagtcccgtcgatggccgcaagagccccagcacaagcaggcctccgccgtggccgtacctgtgagggccgtggttctcgccttcgattttggaacagcggcgtcagccatgtaccctatgctcaggttttcttcgtttctcatctttacattttccttatatgcagatcagtgcttagcttcatcctctgcagtcctatgttattctctagcctctccgatccttttaaccactttagcaaaattgttttgggccgttccatcatagcttgg

SEQ ID NO: 2326 - DNA, 506 bp, Sorghum bicolor
  Clone ID: SORBI-28MAY03-CLUS41707_1
gcacgaggccggaatcgagcaaagcatcccgcgcgtgcgccgcgtcacgcttcccccgcttcataatattccctcccctccgcctgccccccccgaccccgatccctcgcctcggccgtcagctccgcccctcggcttccgaagcgccaccgcggccgccgcctcatcatggcgctgccctacctggaggccgtgctttgctttatgattctcatgtacatatttgagacatatcttgacattcgtcagcatagagccctcaagctgccaactttgccaaaacccctgctgggagtaattagtgatgaaaaatttgaacgctctagagcttatagtcttgacaaaagctacttccattttgttcatgaggctgtgactattttaatggataccacaatactgtactatagagttcttccctggttttggaagaaatctggagagttagttaccaatgttgggctgaatgctgagaatgagataatacacacccttgcattcttagc

SEQ ID NO: 2327 - DNA, 428 bp, Sorghum bicolor
  Clone ID: SORBI-28MAY03-CLUS39228_1
gcacgagggccaggtcttcatcgggcccttcaccggcgacgaagccccgcggcggcgaagccagcatggagcccgtgcgtccctttccaccaggtgtgcccatcccttcgcttcccttactgttgtgcaagaccttaaacccaaaccatatcttaaagctaattggtctaatctaatttggatccctttaaaaggtcaccatgcgtatgcgtgtatgtgcacagccaatgcaagaacaaaattacaggaaggttgttgctcacaaagtcaagtaaaatgggagatactgcctctgattgagagattggaataacgacatcatttttttttttgagcgcaaagatactatgaaattatctaggtttctagatgctctaaaattggatgcaatagatgtctgattgtgcaactcgtgacatcagagacac

SEQ ID NO: 2328 - DNA, 697 bp, Sorghum bicolor
  Clone ID: SORBI-28MAY03-CLUS39236_1
gcacgaggcgccctttggacttccgcacaattgatataaggttggctaagggagcttatcgcggatcttgggaggcttttcttgatgatgtacaagaagtaatccgtaatctgcaaactgcatttgctgatcgacctgaagtggtagtcatggttgctgcactgtctgagagttttgagtcattgtataaggcagaggtacaagaccttgttgagaaatttgacaaatatctaagcaatgaaaatggtaactcagaaatccaccaggagctacaagatgctctcacgacagcaaacaataagctgcccaaagcaccatgggaggagcgcgtcggcaaagtctggggaatcgatcgagatgacgagagcgtccttctttgtgatacttgtgactctgaataccacacttattgcctgaacccgccactggcacgcataccacttggaaactggtattgcccgtcatgtactgcccaaactcatgtttcagtgcaagaacaaaagaagtgccttggggaggaagctcatgtttttatcgagaaactcaacaagttagctgttgcgatggatgagaaagagtactgggagcttagcgtagccgagagaatatatttgctaaaatttctatgtgacgaattgcacaacacagctctcatcagggaacatctagatcagtgttcagacaggtcaaatgatct

SEQ ID NO: 2329 - DNA, 459 bp, Sorghum bicolor
  Clone ID: SORBI-28MAY03-CLUS39258_1
gcacgaggcttcgccgtccccgccgcgaaccagatgccggagctcggcaatgcggtgaaggtctcgctgagcgacgaggaggacgccgacgacggccacctcgaccacggcaaggcggaggcggccgcctccccgtggcaccgggtcaagtggaccagcggcatggtcaagctgctcgtgacggccgtgtcctacatcgacgaggacgtcgacgcggactacgggaccagcagcgggaggaggaagcacgccctgctcaagaggaagggcaagtggaggctggtctcctcggccatggccgagaggggtttcgcggtgtcgccgcagcagtgcgaggacaagttcaacgacctcaacaagaggtacaagaggctgaccgagatcctcggccggggaagggcttgccagatcgtcgagaagcacgagctccttgaccaggtgagcctatctgggaagctc

SEQ ID NO: 2330 - DNA, 748 bp, Sorghum bicolor
  Clone ID: SORBI-28MAY03-CLUS39267_1
gcacgaggggtcgtcgtcgtcgtcgtcgtctcgtggatcgatcgccggcggccgtcggtacgtacgtacggtggtgatggcgcggttcgtggatccgctggtggtggggcgggtgatcggcgaggtggtggacctgttcgtgccctccatctccatgaccgtcgcctatggccccaaggacatcagcaacggctgcctcctcaagccgtccgccaccgccgcgccgccgctcgtccgcatctccggccgccgcaacgacctctacacgctgatcatgacggaccctgatgcgcctagccccagcgacccgaccatgagggagtacctccactggatagtgaccaacataccaggaggaacggatgcaagcaaaggtgaggaggtggtggagtacatgggcccgcggccgccggtgggcatccaccgctacgtgctggtgctgttcgagcagaagacgcgcgtgcacgcggaggcgccccgcgagcgcgccaacttcaacacgcgcgcgttcgcggcggcgcacgagctcggcctccccaccgccgtcgtctacttcaacgcgcagaaggagcccgccaaccgccgccgctagcagcagcgctctccggccggtggtcccaacaagctagcaggcgcgccagctgagcgtgcgtaagtacgtacgtgcaaccacaccacaccgccggcggctacgtacgtagtatgaccggtgaataaaaacgttttactgcaccgtaagcataccctc

SEQ ID NO: 2331 - DNA, 365 bp, Sorghum bicolor
  Clone ID: SORBI-28MAY03-CLUS39290_1
gcacgaggctctgctccaccgtctcagggcccccgtgcgtcccctccaccgtctcagggtccctttgctgctggaccaccgccgactggtccctttgctgctgcaccagcaccttttcgccctccgccgtcctcccttgcgcagccgcaatctcccacgggaggtcctttgcctccgccaccgacatatgcgaggccgccacagacgcaagggtattacaccggtgcaccacccgcgaaccctcagttcccgatgtcaaggccagcatttcaacaaccagtgcagactatgcctcctccaccaatgggacctgctgccacgtttggtaaccaggcagcgtatgctggccctccagtcggaggcac

SEQ ID NO: 2332 - DNA, 501 bp, Sorghum bicolor
  Clone ID: SORBI-28MAY03-CLUS3932_1
cgtccgccgctgcgtcgcgagctcgccgccatggctcttcccctcgcccgcctcgtcctacccgggttccccgcctgccagtgccagccacggccccccctgcgcttcccgaagcaccacgtctccttcgccgcccctgccagttctcgcgccgccttcgctgcctgcgcggcggctagtgcgccggcggccccagctgcccaagcgccggaggcggagacggtcgagcaagtgggcccgaggacacgcctcgtcgcgcagaacatcccgtgggactccacggccgacgaaatgcgcgcgctcttccagacccacggctcagtcgtcggcgtcgagctttcaatgtacagtgccagtaaaaacagaggattggcgtttgtaaccatgggttcagaagaggatgctcttgcagctctcacccatctcaattcaactattttaaatgatagaaaaattaaggtggactttgcaagacctagaaagaagcaacctaagcaacct

SEQ ID NO: 2333 - DNA, 616 bp, Sorghum bicolor
  Clone ID: SORBI-28MAY03-CLUS39312_1
gttcggctttgctaatgattgagtgggctgtgagttagctgcatattggtacaattttaaaaaataatggtaaactctgttaggtcatgattcaccgttacccatagcagtcatacgaggaacttactcgctgacccaatatgcatgcttgttgtccaggtttgaagtttcttagtattctcttctggtgccgtgggagcataagttttcattttttgtaatgtcatgggtatcttcagaggtgcctggatggagtggactatcaaacgcacaagtcacaacattcggtgatgtttaccctttagcagctaaacaacagttttcagtttaacccccttttcttgcttgattttgtaatcaattaggtaattattagttttctcttgactataggcatttttagccatatgagagggttctgactgatttccgaatcctattgtaatttctgaatccatgatccaatagtagctcacacaatagttatcaattaagggacatttgatgttgaaaaatctcaatccagaaaagactacgtaccatatgatgaggattattatgcttactggttcttgttctgtatacctatatatagatgtagttaggtcaacactca

SEQ ID NO: 2334 - DNA, 648 bp, Sorghum bicolor
  Clone ID: SORBI-28MAY03-CLUS38959_1
gcacgagggttctctgcaacaccgcaaaagccgcccccgggaaccccacaacttcgttgccatcgccggcccttgcccacgccaatgtggatttggcctcggaggccagcacacgcatggcgcaggaggcgaccaagggcggcactccatccagccttcaccacggaggaaactgagggcgccgccgcctacctagccctcgccgaatctggaccctcgagcggaggatcttggcgtcggatccgtatcttggagcggaggagctcggtgccgatccagacgctggagcagtcccacccccacgttaagtccagcagcgagcacttcaaggcaaaactggtccacatcgagctgctcaggtgactcatgtgttcccccatgtggttctatatccatctttctgcagggattttactagcatgccggtggtgagggatctgcacggccagggtctgacgctcgacggaacctgatctgaatgaatccaagtgccatgatgccaatactgcagattttgctcatccagtgcaatgaccagagcttgcattcggattcctaaaaatctagtatttcacattccaggagatacttaaatcttagcttcgaccatgtttgtttttttagagtaatttttaatcaaatgctatg

SEQ ID NO: 2335 - DNA, 592 bp, Sorghum bicolor
  Clone ID: SORBI-28MAY03-CLUS38967_1
gtcctcccccgccgctctcttcctcctcctcaaaactctctctccctgacctgaaaattctccacatactctggtgctaagtggtggcggcatctcgcttaggcgagatccccctcctcccccggtttccacccctctgctctgctccacccgagtcgactccttcccttgcaatccgctgctggtcagctcacagcagcagaggaggaggaggaggagtccattggaggagctcagctaggctccacgctgggctcgatcggcaccggctgctgcgagattccgcgagcgcgcgatgtaccgggtgaaaagcgagggcgagggcgactgcgagatgatgctgcaggaccagatggactcgccggtggccgacgacgtgagcagcggaggcgggtcgcctcatcctcacaggggcgccgggccgcccctgaagaaagggccatggacgtccgcggaggacgccatcctggtggactacgtcaagaagcacggcgaagggaactggaacgcggtgcagaagaacaccgggctgttccgctgcggcaagagctgccgcctccgctgggcgaaccacctcagggccaacctcaag

SEQ ID NO: 2336 - DNA, 471 bp, Sorghum bicolor
  Clone ID: SORBI-28MAY03-CLUS3899_1
gcgcgtccggcagcagccagcagagcaaccaaaaaaactaaccaacgcgcgggcgcggcggctgcaacctcccgtcccgtcctcctcccgcaagccaagctctgcttcagcccgatcggagtccatcccatcaaaatccaatcgatttcgatggcgccatccatctccatcggctccgcggcgccgtcctgggcggcgggcgcgaacaagaagaagagcgtcggtgctgtagtggatgatgaggcggagctcctgcggcggaggaacgcggagctggagcgggaggtggaggcgctgcggctagagctgggcgcggcgcggcggcgcgccgagacggcggaggaagccgaggagcggctgtgcgtgcagctcggcgacgccgaggtggaggcgctggagctcgcccgcgcctaccaggcccaagtccaggcgctcgccggggagctcgccggcgcgcgcgggggccgtcgc

SEQ ID NO: 2337 - DNA, 595 bp, Sorghum bicolor
  Clone ID: SORBI-28MAY03-CLUS3941_1
ccgatatccaccctaggagggacaatgatgatgacgatgatcaggagcgcgcgctacaaaaatccaaaaaaaaatccttgtagaaaaaagttgctggctgtgaagcgagtgcggagaggatgcagaaagcagatactaatttgcagctattaaatccggctgaacaatatagacacttgcaaaaacagaaatatccaagactcggagggacaatgaatgaggctctagtgaagttacggaagttctgagcttctttactcagtataaatcttgctaccaatcatgtcaaagaaaagaacccttctactgacaaggtggaaaaggaagatgaagaggatgatgactacaaagggtggcacacaaaccgactgtctttcttacccagttcttccaaggatggaatggcaaggaaagacgatccagatgactatgtagtggtagacccacttctggtagagtgacaccgtctgtacactagtgttttcctttttggcatttgtcatgattgcttaaactgtaaatgcaattgtacaatagatcggttattggaagcagctctctgtatcactatctatgtaatgtctgttttttctga

SEQ ID NO: 2338 - DNA, 496 bp, Sorghum bicolor
  Clone ID: SORBI-28MAY03-CLUS39422_1
gcacgagggaaaaactcgtttcggattcaaaccctccaatcccaaatctgccctcctcatcggcacacctcgccgccggccacacccccggcgatcgtcgccctacccggtagacccttctccctacctcaaaccccgcccaagcccaacacggcaacacctccccaccatgccgcggaacttccgcaagcggggcatcgagccggacactgacgaccgctccgacgacgaggacactcgccgcgtcgccctcgaggagatcaagtacatgcagaagctccgtgagaggaagctgggtatccccgccggcaccgccgccgcatccactaacgggtcctccgcccgtggtggtcgagtgggcagcggggcagcggccgctggcgaggctgagaaggaggacctcgtcctccaggacaccttcgctcaggagaccgccgtcaccatcgaggaccccaacatgttgaggtatgtggagactgagcttgcgaagaaaagg

SEQ ID NO: 2339 - DNA, 663 bp, Sorghum bicolor
  Clone ID: SORBI-28MAY03-CLUS39427_1
acagctcacgccacggccgcgagggccacgtgcatccttcgctgctccgtgctcaccagcgctctcctccagtctccacttcacttcgtccctgatcgccgggcgagcagcggcaacggccatgatgagcttggcgtccggcgttccctccgcgcaggcattccccgcgttaatgactcccgccgctggctcccacacccactgtcgggtccacacgcatgcggcggcctccaagagcggattggcctgccgcgtcgcgcgcagcgggggcggtggcgctcggtggctgccggtctcctgtgcagcggggggcggcgcaggttggtcgcgccttcgtgtctgaggacaatcattcttgccagttgctacagtcaaatctacagaagacctgattcttggtgttcccctgatgactgtcaatctgtcggacttgcacttaagtctcatgtacacatatagcaatgttcagaatatatatcttcaaatttgacatatgaatatgttataagttgtcattggttgattaggagtctttacatttaaaaaaaaattacaaccaatcatctagctgcaaatcttgctatcttcgcttttcaagctttagaaaagaggattgttagataaactgtctgtccaagtttgcttgtcacgatttttttctct

SEQ ID NO: 2340 - DNA, 603 bp, Sorghum bicolor
  Clone ID: SORBI-28MAY03-CLUS39451_1
gcacgagggtcactcagcttcagcttcttcgtcttgccgtggccgtgtgtgtcccgtgtccgtgtggattcaaatccgctgaccggcggccgcctatttatgccctaccccgccggttttctcttctcctttccacgctggtccgcgcggcgccaacacctgcctgcctgcctgcctgttacaccaaccacgcgcgccaagccgaagcagccgtcgtcttccaccgatccgcccgcccgcccgttccccattgcttgccaaattgccatggcgcagcagcagcaggtggtgaggcgggttctgaaggtggcgccgccggggaagggcgacggggagtgctttcccacggtgcaggcggcggtcgacgcggtgccgctgggcaaccgggcgcgcgtcgtcatccgcctcgcgccgggggtctacagggagcccgtctacgtcgccaagaccaagaacttcatcaccatcgcgggggcctcgcccgaggccaccgtcgtgtcgtgggacaacaccgccacgcgcatcaagcactcacagtcatccagggttataggaacaggaacattcggctgtggtacgttcattgttgagggggaggatttc

SEQ ID NO: 2341 - DNA, 638 bp, Sorghum bicolor
  Clone ID: SORBI-28MAY03-CLUS39478_1
gaggcatgcacatgtggcaactatggcagaacattttggtaatcaaggttgaaaggcatgtatagtgatctggttgggcaacttatcttgccacatgttcagggcagtctgtttgtccttggaagaacatctccagggcaatccttgcatcaaaattgcttctgtcatactcggatatgttctgaatggtgccctgaacacttgatgcacctcgaggactcaatcccgtggtggctggttggcacttatgtaatggtcctagcataaattattggtgcagtgggctggtgatcaagctgctagcagccgaaattgcaagacttgtatcatgcatcaatgctattgcttttactgcctaacacggaagggtggtgaatttttgtaggggttgtcatctgaactctagagctccataggggataggttctgatcggaatgtaaaaggcactagaaacttactttactgtatctgcttgtattgtcacacctataaccgaatgaggagcatggcagccttgtctgcaccctgtacactgaaattagagaatgttaagcccccggcaggaatcggctggagttgtaaggtgccagtttgtgttgattgtgtagaaccatgcatattacggctattaaattca

SEQ ID NO: 2342 - DNA, 606 bp, Sorghum bicolor
  Clone ID: SORBI-28MAY03-CLUS39496_1
tatctgacgtgaaacggttccccatcatcgtcgacccacggttggaagggcactacaacctcaagtccatgacgaagctgtctagcgtggcgaaccggtgcctggtccggatgcccaagtcccgcccaaagatgagcgaggtgtacgacatggtccagaagatcgtggacagcatcgggaccgggccgccgcagcccccgctgctgcactaccgtggctcggcctctgacccggccaccaagcgcgccaagaaagggtctctgaggacgaggctccgggagtttgggctcggctgccggaacatcgtgcagcggggctggaaagcctgagatcgtgaagaacctctgagtgagtctgaggaggcgcggcgtggctccggtggtgctgtaagtacagtagctgttcatagagacggtggtaacagttccaccgtgtagtgcttggttggtatagagtgagttgatgcagatgcatgcataccagttgagaaagacaaggtgcacagttgagtggtggcgttcgtgtagagtagtgctgtgtctgtgtaattcacctggttttgactcctgtggttaacacaatgtgtgagctgcgatatggtgagct

SEQ ID NO: 2343 - DNA, 701 bp, Sorghum bicolor
  Clone ID: SORBI-28MAY03-CLUS39513_1
ggagccggtggtgcacatgtcggccatgaagctggtgccgcagcactgcctgacggggctcgccgagggcctgaacctgatcgggcagatcgagttctactactcggagttccccaagaccatgtccagcatcggggtgtcgctgctcgcgctcggcctcgggttcggcgccgtgctgggaagcgccatcgtcggggtcatccacgcggggaccgcctggctgccgagcaacctgaacgaggggcactacgaccgctactacttggtcccggcggtgctgtgcgcagccaacgtggtgtacttcgtggtgtgtggctgggcgtacggcgaggaggggaagaaccgggtggtggccgccgacgccgccgcggcggaggacgaccaggaggaggaggaggagcacaaagcgggcatcatttaggctttaggccacggtggactttgagcagagcactaggaacagcagagcactaggaacagtatggcgttgatccgagatggtctcttgctgcatctagtgtgaatctaggtcgtacctcgtatatatgctgctaacttatatttatatggtgacatctcaagagaaagtaatcttgaaatgttgaaaatggacagtatgtaagtactgttgtgaattgtgatgcgagtctagaatgtcgcatgcattttacggcattcttcttcggaatcagagaggagag

SEQ ID NO: 2344 - DNA, 571 bp, Sorghum bicolor
  Clone ID: SORBI-28MAY03-CLUS39144_1
cctgatgacgcccagaagataacagcttcctgtaaccaggtgcaaacacccactcagcagccccctctacttggtgaacaatcagaagggatgagtgaaatggacatgattgcagcgcagcaagaagaggctgatctgaatgctgctatagctgctagcttgatggacagtgggggtccatttgccagctataatgcagttcaaggatccagcaattcacaagatgctcctgctactgaagcagctccaagtaaagataatacccaggaagaagctgctaaatctgagccgagtgcccctccctgtgaggacactcaggagttggcttcaggaagtgaccccaaaagggaggtttcttctgtagaggagaaaggatcagcgaaagaagaataggctggcacttctgatcagtctgtaactgagttagactatacaaacagaaactgccctccatttcagtggagttatgctttttttagttccaaaccccgtatacaaaatgcatagtctgaattgaatgggttttaaaacttttaactggtgtaactgttatgtgcgaactgcatagaga

SEQ ID NO: 2345 - DNA, 1003 bp, Sorghum bicolor
  Clone ID: SORBI-28MAY03-CLUS3916_1
cgtccggtcatactgtgatgtttttggttgacagatgcacatttttttttattttgagacctgtggactggatctagcacatacaagattatcttacactattctacgttgcatcataggagtactgaagaaatcatttgaacctgctgtgaatgcttcaagagataggactgcaggagaacattttgtaagctgcgctactgagctttctgctactccattttatattagggtcttacttttgtgtatattctctactggtatgcttgtccattttttgttgttatttgtaaatctatattatgattcatggcgacatatagggcattggaggaaacatcagtgatctacagtgtagccaaagagagatggtaatagactgtctttctggttctgatggcaaggagggtattgcaaaagcaggcagtttactttgctcaacttacatcaatggtgatactcatggagatggcaaaaggaaaccagcatttacagaagctgacatggctagtgcactgaaagctgtaggttgtggtggaccagaacctgatcttcttctcatgtatggtcctgctagatgccatttaggatttcctgcatggagattacggtatactgaaattatgtatatggggccactgaagtcaatgaaatatggtgctattgtggaggccttatataacttctcaaagaaacaccaaaattatgggaaatgatagctgatactggtttaaagaaatcatttgatcatggagaaacgacaccttggagttactctacagtctgtacccattctcttctgctgctgcttactggagtacaggagtatttaacgttagacataagcatcgacaccgtcgtgtttgcttgtaataagatcaaaagtgtgttgtcgatagaacatacatacgggatagcatcccactgtaaaagttacacccatagcgattcactgtaaaagaaccacaagaatcttaccatctcatctattatttcctttgct

SEQ ID NO: 2346 - DNA, 571 bp, Sorghum bicolor
  Clone ID: SORBI-28MAY03-CLUS39215_1
gcacgaggattttctagagagcctttacatttataaatacctttgtatactctggcaccatgctggggatgacaacctagtatctaagtggtgttagctagtgtcaacaagcatttctggcaccgttgccggggttcaaaagtgtaattcatagggcccgtggggaaagtcaggaagtcagccaaggttattcacataaaatattagactagactatggagaaataattgcataaaacagctactaagtgagaaatcataacaaggcacctctgctttggcaggttcaccctgttgtttttctatgtttatatttttatacagggtatatcaggattgactttggtacattcaactcttcatcttcagaaccaatgcaatcaagaaagaaagaagaagctacctaccaattgctgaagctatggcacaaaagaccttgcaagaattctctgctccaagtcttgagaacattccaactggtccaagatttgcagtagaagaaggagcacccgagttcgagctcgagtcaagccgctgcaagctgctccatgctacacaatttagtggaaagg

SEQ ID NO: 2347 - DNA, 834 bp, Sorghum bicolor
  Clone ID: SORBI-28MAY03-CLUS39613_1
gcacgaggagagggcatccggccatgagggaaagggggttctcgccggcggggagaccgatcctcttcgtgtccctccacttcctcttcctctttaccgccgccgcggcgtctgcggcggcgcctgaggaggagaaattcacggaggagctgctcctgcggccgctcccggaccgcaaggcgctggcccacttccacttccgctcctctgcgccccccgctgcctccgttggtcggcaccaccacctcttccccaaggccatctcccagctggttaaaaaatagcacgtgggcgagttggagctatctttcacccagggaagatggaactatgagcagtggggtggatttgaacctatgtcaactaataatgcaaagcctcctggtgttgagctgtgggcagtttttgatcttcctttgtctgaaattgatgcaacatggaagaacctgacacatacactctctggcctgttttgtgcatccatcaactttttggagtcttcaactgcattttcttcccctcgttggggatttaaattgaatgaaggcaatttgcgatatggtgcattgcctcgtgaagcagtatgcactgagaatctgacaccttggttgaaacttcttccatgtcgtgacaaatctgggatagctgctttgctgtacaggccttcaatttacaaaggatattaccattcgcaaaaactgaaactgagatcctcccagtcacttggtattattcttgatcaaactctgactgttgtgctgcaaccaaatagtgtaagtggcgaacagctacattccaatcatggtcaacttcagcccaactggtccatgagac

SEQ ID NO: 2348 - DNA, 612 bp, Sorghum bicolor
  Clone ID: SORBI-28MAY03-CLUS39623_1
gcacgaggcgcgggcatcgggggaaacccacacctcaggagccttcagctctccatgaacaacctcgcgcgagcgtttcctccttccctgtacaacctgtcatcgctcaagctactttccatggcggagaacgagctgcacggtcgtctccctcaagatttcggaacaacccttggcagcagcatgcggttctttgcgcttggaggtaaccggttcacgggagccatccccacatctctcactaatctctccaatctccaagtttttgacgtgtccgtcaatgagttcagtggagtcgtcccttctgcgctaggcagactgcagcaacttgaatggttcaacctggacaacaacatgttccaggcatacagtgagcaagattgggcattcgttacttcgctcacaaattgtagcgcgctgcaagtactagaattgggatggaatagtaggtttgcaggggaactaccaaattcattggctaatttgtccacgactctccaggagctactgattttctccaacagtatatctggtgccatcccaactgacattggaaatctggtaggccttcagcagcttatgcttggagagaacttgctcactggggccatt

SEQ ID NO: 2349 - DNA, 574 bp, Sorghum bicolor
  Clone ID: SORBI-28MAY03-CLUS39616_1
gcacgagggacgatcgaactgtgtgctcgtttaatttgcctcctcccttccttccacctaactcccaacgagcgcgagcagccattggtagcccgtgaacgaagctagctaggtttgcaaccaactcctccatcccacaagacaagagcttcgctgacatcgcagccggccgggtctaggggcggaccgtgtgcatggctgcgtggacctctgccaagggcgctcttcttccctgggctcgcagcagcagcggcggccatggcggcctctcgagtgtcctgggcagggccttggcgttggctacggccggaggaggaggaggaggaggcggcggcggctcgcttctcccacgccggtggcagtcgtcgctgccgcagctggaccatgtcgacaggtccgacgaggagagcggcgagatcgactgggacaagctcggcttcggcctcaccccgaccgactacatgtacgtgacgcggtgctcgccggaggaccgcggcgacttcccccgcggcgagctctgccgatacggcaacatcgagctcagcccctcctccggcgttctcaactacgccca

SEQ ID NO: 2350 - DNA, 686 bp, Sorghum bicolor
  Clone ID: SORBI-28MAY03-CLUS39656_1
aaaaaaaataaggtgcggcggcgcgcgcggatcaagcggagcgtgagcgtagcgtacccatggcgatggcgctgcgtcgtcggctgctgctgctgcttcctctcctcttcctcgtcgtcttagttcagcggccgcataactgcgtggccagtggcggaggcggaggggagccggcggagttcgagatccctcgggacgggagcgtgctggagcttgacgagagcaacttcgaggcggcggtgcgcgccgccgaattcctcttcgtcgacttctacgctccctggtgcggtcactgcaagcgcctcgccccgcagttggatgaggctgctgtagtcctagctggactgagcacgcctgtcgttgtggctaaagtaaatgccgacaagtacaggaagctcggctctaagtacggggtagatgggttccctactttgatgctgtttgaccatggagtaccctcggagtacacgggttcaaggaaggctgatttgcttgttgagaaccttaagaagcttgttgcacctgatgtttctgtgcttgagtcagactcgtcaatcaaaggctttgttgaagccgctggcatcaattttccattgtttattgggtttggaatggatgagtcattgattgttgaatatggagcaaagtataagaagaaggcatgggttttcacagcaaaggatttc

SEQ ID NO: 2351 - DNA, 682 bp, Sorghum bicolor
  unsure (1)..(682): unsure at all n locations
  Clone ID: SORBI-28MAY03-CLUS39660_1
gagagagagagagagagagagagagagagagagagagagagagagagagagagagagagagagcgaagcagcccaaccaaaatcccctcgccgcctcgtcccgttcccgttcgcgtaccgtcccttctcgacttctcccgtaccgtcgccgcctcaatctcgaagcctctccggcgcagccgcctcaatctcgactcgaagcgcctctccaaccagaaatcctctcgggttttcgcatcgtccgtcgcgatgggctccaagaagcggtcgccgcagcatcccgcctccccagccggcggcgagggcggcgcccagacggcggggaaggccgtgccggtgacggcggcgccggagtcggcgcccgtgtcggtggtgccgaagcctccggacgtggcgcccttcctgaccaaggtctacgacatggtctccgacccggccaccgacgcggncatctcctgaatcgccnccggcggcaacttcatgatctgggactcacacgttttcgagcgagacctgctggcgcggcacttcaagcacaatcacttcaccagcttcatacgccagctcaatacctacggatttcctaaagttgatccagatagatgggaatgggccaatgaaggttttgttaagggccaaaaacatcttctgaagaccatcaagagaaagaagaaatcctctc

SEQ ID NO: 2352 - DNA, 931 bp, Sorghum bicolor
  Clone ID: SORBI-28MAY03-CLUS39664_1
gcacgaggggcacacttcgccagcactagtctagtcgtcttcctcccctcgacgaagagggccgccgccgccgctggagcttgtccgggaaaactcgccccgtccgacccgtcatcgtgggtgtagaggccatggaaaaggcgagcgccaagcgtcgggggcaacggcgaatgtccgaacggcggtaattgtagtcggctgcccaagtttgatgctgggggcgcctgccaatctccatgcgtcttcattcagatctgcagttttggtggtgagtggtgacggattattgactgacctgtgctcacggaacggatggattcctccgagaagagggccagagccgcaactgccgccgcccgcctcgccgatgacctcatcgtcgacatactgtctcgcctgccggtcaaatcggtctgccgattcaagtgcgtctcccgtcactggcacggcctcatctctcacccggagcaccgcaagaacattccccagacagtatctggcttcttctaccctcactacctgttgaaccaagaggacgagataacagctattcccgaattcatccgcatcagggggaccgaagaacctccatttctggacccttcgttgcccttcttgcctggctacaggtggatccgtcctagggactgctgcggtggccttctcctcaacatgtgctggaaggtgaatcccagagatgaattcaattacgtggtgtgcaaccccgctgctgatacatgggtagtcctgcctgagccccttaacaacagcccagtgtctacagtgcgtttgggtttcgacccggctgtctcctcccacttccatgtgttccagctcctagaggaagatcagtacggatatatcactggcctggaaatttactcatcggaaactggagcgtggagtcacaaggaaaatggttggagtgatg

SEQ ID NO: 2353 - DNA, 816 bp, Sorghum bicolor
  Clone ID: SORBI-28MAY03-CLUS39670_1
cttcaatccactgcagtgcaactgcaactgcaagctctcgctctctctctctgctcgaacggcttgcttcgaacccacttgatcgctgcgtgcgtcgccggctccctcagctcagctctccccgtaccgtacgtgcgcagttctcggcacgctaccccatatataccccccgccggtccccgcccggcagtgacgccccgcccgcaccgacgacggacggactagggtagctgctcctcagctatccagatcgttcgttgccttcagccttgcttccttccgtgtcgggcggaggcggacgcggacgcgcgcagcagcagcgggaatgggacgccacgcggcctccggcggcggcggcggcgtgcagcagaagctgcgcaagggactctggtcgcccgaggaagacgagaagctctacaaccacatcatccgctacggcgtcgggtgctggagctccgtgcccaagctcgcagggctgcagaggtgcggcaagagctgccgacttcggtggatcaactacctgcgccccgacctgaagcggggcagcttctcgcagcaggaggaggacgccatcgtcggcctccacgagatcctggggaacaggtggtcgcagatcgcgtcgcacttgccgggccggacggacaacgagatcaagaacttctggaacagctgcctcaagaagaagctgcgccagcgcggcatcgaccccagcacccacaagcccatctccgccaacgcggcctcggcattggaacagccggcggcgtcgcaagagcgcaagccgttgtccacagccgccgctgatggcggcttcga

SEQ ID NO: 2354 - DNA, 653 bp, Sorghum bicolor
  unsure (1)..(653): unsure at all n locations
  Clone ID: SORBI-28MAY03-CLUS39341_1
aggggtcnagatgaacagggaaagaagtgcttgtttggctatgatgatgacgatgatcagatgttgctttctgatgatgatgattattatgaggatgatgagttgcatgacaatctggaggccagtgctgaggatcatggtgttcacagagttcatgccaccaagaaactgaagcatgatcatggggaaggacattgtgggtctcatctgtctgaagttgcagccattgacatgaacagaatgttctctgaaggatctggtggtccatctgctgagaagaatttaagtgctgtgcgtgctcaaatcgagagagaacgtctggatataaaatctcagatgctgagaattgaacagaggcatttcaaatggctcaagttcagcagggagaaggacagggagttggagaaaatgaagctggagaatgaaaagatgaagctggaaaatgagcgattggagctggagctgaagcttaaggaaaattgagatgggcatcaaaccaacaaggatttagtgattgcaggatgtaagtggtagagctagagaactcctagagtttctggtaatccttttgtctattgcagtagcttacaaattaggatatgtcacattacatagtttcatctttgctaactgcatatcagttaagttaatga

SEQ ID NO: 2355 - DNA, 655 bp, Sorghum bicolor
  Clone ID: SORBI-28MAY03-CLUS39381_1
atctcctctacgcctactttggataagcccattcggaacttggaaggttgagcctctgagcccctcgctctcctgctttttaatttcgccgacggccgcctggcagatacgaggacacggctcggcgggtttcctagcagcgttcagggagctcctccttccttctgctctggccacgggggctgggacgtagagaaaattggcttcggtccattgattggattcctcaacgtcttggagtccaattctctgctagccatggtggatcattgactggcaccataggatattttcatgaaggggcatttgcattatctgttggttatactactacagaagagcagactacaaatggaacatctgaaggcacaattttcagaaaaggactttccagtatttatgaaagatcatatgtcaggtcttcctatcttttacatggcttcaggctggtacgaagattggcattcagtgtgcgagatcagtggaatctgttttcaagtgaagtacatggcaaactaaccaggatcttacatcgtttctggacaacactacagggatcttgtgaagatataggatggctgcaaagaactcgggcatcactttgttcagttgatgggacaggtcgcttcaaggagattttgcatgacatcagaaa

SEQ ID NO: 2356 - DNA, 496 bp, Sorghum bicolor
  unsure (1)..(496): unsure at all n locations
  Clone ID: SORBI-28MAY03-CLUS39384_1
gcacgaggcagcgccgctggctcggtcctcagcgcagatcttctgctcctccccccacntcgcgctcaggctcgatcccagggatcggatcttccgcgcgtcggcggctccccctcggcggcgtccagcgacggaggggcagtcccaggctcggcggcggcgtcggcggctccacctccagcctctcgccagtcgcctcgcgccctcgcctccgtcctccgcgcaccggccggcgaccctgcatatgagcgtctgacaagtcgattttgaggccattatttgataccccaggagaagtgcaccgattgcatgcccattttagcctgttgagatggctacacaattgccgtgcttcacacagctcagcccaccgtcttctagttgggtaaaagatgtcgggaactgcaaggcagctacgcctggtagggtagtcagaagtgctcgagctttgggccactctcacttccggtgctgtgcaagcccccgcagtgccaac

SEQ ID NO: 2357 - DNA, 444 bp, Sorghum bicolor
  Clone ID: SORBI-28MAY03-CLUS39727_1
gcacgaggcacctcctctcctctcctctcctctcctctcctcctggcacacactggcagccagcgccaagatccaatccaaatttagcgcaaccgcatctctatttctatctgacaaatccaacctcccctcctcccacgcacacggaggatcggaagcggagaattcgcccttataaaccaatcaaagcatccaagaaagcaaagcaaaagcaatttgtttgttcgtccgatcgagagagacagcaggaatcggaggatcgcatccatggcggcggtgatggttgctcgtcaaggtcgggagctgcagcggtacagcgcgagcacgggcggccgcgtcgtggtgggctgcgtgccctaccgcgtgcgcaacgacggcggcggcgaggtggaggtgctggtgatcagctcgcagaagaaaggccccgcggggggcgtgctgatc

SEQ ID NO: 2358 - DNA, 580 bp, Sorghum bicolor
  Clone ID: SORBI-28MAY03-CLUS39763_1
gcacgagggactggggcacgagcgccgccggaagaggttgccgggcggctgtagaccctcatcgaccacggcgatgcacgtcgcggaggtgacggtggtacaccacgcggcgctcgtgctggcggcgctctgggccgccgcggctgccggctgggcgcacccagcgctcttcctcgtcgcgctcctctacatatttgcggtgaatcaacggtacacaatgaggttgtggaggcggatacagtatgaggaaaggaaatgtgcgaatcagagaaagcttctctctgatgcagagactgtcaggtggcttaattatgctgtggaaaagatttggccagtttgcatggagagggttgcatcccagcagttccttttgcccatattcccgtggttcctagagaagttcaaaccatggacagcaaggaaagcagtaatccaaagtctttacttgggtaggaacccaccgatgtttacagatattagggttgttaaccaatcaactggtgatgaccacttggttctagagatagggatgaattttctttcagctgatgatatggatgcaagaatggctgtgcaacta

SEQ ID NO: 2359 - DNA, 540 bp, Sorghum bicolor
  Clone ID: SORBI-28MAY03-CLUS39743_1
gcacgaggctgcagccgccagtcactgcctctcgcagcgtcttgcatccatttggttccgtgcgggctggtgcgcgcctcagcgccccccgtctcctccggtgtcttccggtgggcgtccgaggccgctcactgcgcctcccttgtcctccagttctcccttgttcacccttgaacccgcagttgccgacagctggcccgtgccatgccctggcgtgggcacgggtgggaaggcgttcctgcactttcctcccgggagttgtttctctgcagccgggtgctggccgtgtctggtcgggtgcatgcgtgccccgtctcttgcctcctacatcttgatcgcttgacctgggtgctggctcgtatgcctacgctctttggtgctcccccgtcccctgagccaaacgctctgcagccctttctgttgaggcgtgtgctggactatattggtagtgtggatgtaagtccggagtcatgctacctacatcatgaactcttgaacttgatgctagttcttatgtcaactcagttatgttctggacca

SEQ ID NO: 2360 - DNA, 751 bp, Sorghum bicolor
  unsure (1)..(751): unsure at all n locations
  Clone ID: SORBI-28MAY03-CLUS39790_1
cggaggcttatacagctggatgaggtgaagcaagctgcaaagcagcagcataacttgaaggctgggagcatcatgactaatgctgaacttcgtgtcaataagaacaagcggattggagaggttcctggtgttgaggttggtgacatgttctacttcagaattgagatgtgcctggtggggctgaatagtcagagcatggcagggattgattacatgtctgccaagtttggtaatgaggaggaccctgtggctattagtgttgtgtcagctggtgtgtatgataacaccgaagatgatccagatgttctagtttacactggacagggcatgtctggtaaggatgaccaaaaacttgagaggggtaatcttgcactggagaggagtttgcatagaggcaatccaatcagagtcattcgcagcgtaagggatttgacgtgtccaactggcaagatttacatatatgacggcctttacaagatcaaagaagcctgggtagagaaagggaaatctggtttcaatgtgtttaaacacaagttgcttagggaacctggccaacctgatggcattgcagtatggaagaagactgaaaaatggagggaaaacccatcatctagagaccatgttatattgcttgacatatcatatggtgtggaaagtaaccctgtctgccttgtaaatgaggttgatgatgagcagggccctagccacttcacctatacnactaaattgacatatgggaattctctgaact

SEQ ID NO: 2361 - DNA, 712 bp, Sorghum bicolor
  Clone ID: SORBI-28MAY03-CLUS3982_1
ggctctaaacatgagcgcaagcagacttctgcaaatgatcaagcatatggggtttatgattttagacccgatggcgaaggctacatgcaagatcatcatgcagagttgagatccagagatttccatcatgccgatgatgcctttgcagactcagttagcacagacttctcggaagctacctcaagtgagtggtcgttgtttaccagctctgacgagtcctcatttaccactgaaagcacaagagattcattcagtgttgtggattatggagacaacgctggcctgcgtccgatttcctctatatttgggccaagttatgctccggagcaccctcctggcaatttcgtctcatgtacaaggttctcaccttccaatccacaaacaaggtacttctcagagagcacaggcttcgtctcggactcttccatgccggcccaccctagcggcattgtacatagaggaaggtatccagatagggcatgtgcctcttcagccgaaccgctcgcttcggcgcatcagcggagtgggtacggtcggtatccccttagtcgagatggttttgttcaaacatctgggttttgccaaatgtaatcggcttacatttcatttcatagttgtagctggtgctcggcagctgcggttagcactgccactaatgctgcctcatgtccttttatttctgatgaggcatattaaattttagctgcatacc

SEQ ID NO: 2362 - DNA, 545 bp, Sorghum bicolor
  unsure (1)..(545): unsure at all n locations
  Clone ID: SORBI-28MAY03-CLUS39870_1
ttcttcctcgcagacaaccgatccatcacattagcaagtctcgtaatctgcgaaacaagactgagccacgtctccggcacgccgtagatctgcatgtacatattctcatgatcctgcgacgtatccgcaagatgaatgtcttttatatccctccgtgtcttcttgcgaggttcgagatggaggaagttgtcgagtgttatgtcggggttgatagactgtacagggacggtagcggacttgtttgttgtgttgggcagggtgaagggtgtttctatagcgtgngttttcgtcgcggtagacgtttagtctttcggagacgatgcgcatccaggcgtagatgttgtggagaagacgggcgcgtcgggagatgctgggttttgtagaggccgcgccagctgattaggcgttccatttctgtgagacaccagcgggtatctgtttcgttgcctgaaaggagctacacagcgttagcccgtggctgcgatgtgatgaagtggtgtttacttactgctgttgataagacggcgcttatacccatcaattgc

SEQ ID NO: 2363 - DNA, 641 bp, Sorghum bicolor
  unsure (1)..(641): unsure at all n locations
  Clone ID: SORBI-28MAY03-CLUS39929_1
ttggagatatcattgaagcttttcgtgtatgtgatgagcttttttgctatacattgcatgtgaggaatcaggcatcagtctgtcgggtcgtccgctggttccctgcatcatgcgtgtgcgcgctcatggaggcgcgttccccttgcggctgccccctgggagtcttccctggggctttccggtgcgcaggtgtccctacatggcaccatgatgtttgaatcaccatggcgcctacatattgagacagatcagtctgaacttggcatgtggacaggaataacgcccagatcaggtggatctagacagtgcagcacctgcaaccgaagagaccaaaccggcaatgtttcgtttcgctgaaatttatttatgcttatacttatgttgaaatggtgtgggctgttatttcgctgaaaagtattgttgaaatagagcagcggaacaggacgggcttacccctccgctctttttttctttccatatatacctagcctaggggaacccaattctgtatttttctaagctatacatacatacgtaagtcaacaatcgaggtgagttctgccaattctggctggcttacccttcccttcttgtggaacagcaatagctgatgctaatgtacatgttggaattagncaagc

SEQ ID NO: 2364 - DNA, 698 bp, Sorghum bicolor
  Clone ID: SORBI-28MAY03-CLUS39527_1
tgatgttaagaatcctcccaagaagagagggcgtccaaaaggctctgtgactccagtcagactgaagggaaaaagtgctgagaaggatagtcaagaaacacctaagactggcattaactctaagaaggaaggtgcaaggccctctcgatctactggaaaggctaaggatgctgttgtcaaggcaagcagaaaggatgaggctgatagcaccgacaactcaaaggatgatgctggcagtgaagacaatacttcacacgatgaagtgaaatccggtgaagctattgatggatccaagaccaatggtctttcaagcaaaaggaagccagaggagaatgaaggtgagtcatcggaggaggagaaggggtctgctaaaaccactagcaggaagaagcgcagaagaaagagccgcaactaggcagctcatcaagctatgcatgccatgtatgcttttatttatattccctggaccggttaccagcttagcgctctggtaattggccatcatgatttagctcgtagttgtagcagtcttaaactctcaataggagctgtaatgtttggttttactttattttgtttctccttgccagcggctgtgcctctggcaaaaacggatttcatgcttgctttggttcaagcttttgtgttaaaatcgtaatgcagtttgagttatctattggcaaacaaaaatatgctcc

SEQ ID NO: 2365 - DNA, 720 bp, Sorghum bicolor
  Clone ID: SORBI-28MAY03-CLUS39530_1
ccgtatcattcaatacttgttggcgaaagttatcttgcaagaaaacgtcctgtttacgaatgcacagatgcccaggtggaagcggccaaaggtttcttggcagtgcttagagactaccttgacacactatgctcgaacttgagatctcatacaattaccaatgtgcaatctaacaatgacaaggtttccttacttttaaaagagagctttatcggttctttcccaatccgggataggccttttatgaagctttttgtggacacgcagttgttctcagtacagacagacctagttctctccttttatcagaaggactaagtgtctgacagacttgaatgtctgtctcatgttgccaagcctttagatgttgagctaaactgtacatatcggcttagaaagaatgagctgccttcgtcattttggcagctgagtgtgttaagagctggggtattgaagaagaatgcctatagctgttgtaagttagtctggtgcggtgatccgccatctaaggttttgtaggtctgttgtaggctgatgcttctatggattgttcctgcaatacctgtgctgtaatggaaccatatctgcggcagaatctccgcacttgaatgtgttatgtcaagaatccaaaagttataccgtgccaaagcgtggttcttatctccagctgtaatttaacgtgtggtatttttataaagcatgtgtcaaagtgcatcttgt

SEQ ID NO: 2366 - DNA, 788 bp, Sorghum bicolor
  Clone ID: SORBI-28MAY03-CLUS39573_1
cttcgccggcgacggcgacgaataggtttctgaagggaccaaagattctgttctggatacaatactcccttgattcagaatgactccagtgagtcattgctccgttggcagtatcagcctgtttcacattggaagcttcaggaccagccgagaaatccaagtaagaagattccagggcacagcaaggtattcaagagtagcatcaccatcgcctcggagactgctgcagccacaggcagcgttccacctgattagtatctacaagagaagaagctggtcctcggccgagaggccaacaaccttgtctgcggcgaccgtgggaactgatgtcacggtggaggatcaaaatccggaaacttcagatgagaactctgaggctgcacctgacgccgttgaagcgagtgagcaggccgaggctagcacgggacaagcttcttctcctcgcaagttgggccccagcattcggaagagcgagatgcctccgctgaatgaggaggatctagttcctggcgcgtcttttactgggaaggtgatgtccatcaagccatttggagttttcgttgacattggagcatacacagaaggccttgttcatatctctagagtaagtgatgggtttgtaaaagatatatcttacctcttcactgttggacaagaggtgtcagtcaggttgcttgaagcaaataaggaaacaaagcgtatctctctgacgatgacggaaggtgatgactatgtcaagcctaaaaaggaaacacctaaagctgcaaacggagggcgcagtgccaccg

SEQ ID NO: 2367 - DNA, 663 bp, Sorghum bicolor
  unsure (1)..(663): unsure at all n locations
  Clone ID: SORBI-28MAY03-CLUS39989_1
cgacgcggcagctggcgccgcattgtatggccacatgggcggcggcggcggcaagcaggacgcgggcgcgttcgtggactacagcagcgtgctggacgtgtccgagaacctgggctacggcgagagctccagcaacagcagcaactggaactgcgcgccggaggcgaacaatgcgctcgacggcggcgacgcgccgctgcactgggcctccgagagcaaggccacgccccacttcgccggctacggcggcggcgaggagcagtcgctggaggagcacaagttcttgctgccctgccacgggcagcaggagcagagcctgccgcatttcgacttcgacatcagccggggcgccgtggtcggcgacttcaaccccgagttcttctgaaggttcagtttgtgaatttcatcagcaatatatatatatataattcccgtatatatatacactgtattattaaaggcatttcacacggaacaattgggagcttagagaccgtgctttgttaatttcctctangtcgtccttactcctccttagcaatgtttttgcgcttctttgttttatatgttttctctatgtctaaaataaaggcatatatacatatatatacaaatgtatgtaaacacagtgtagtagctactcctatattaaggttttggaaa

SEQ ID NO: 2368 - DNA, 578 bp, Sorghum bicolor
  Clone ID: SORBI-28MAY03-CLUS4002_1
ctcgtccgctctctctccatccacgtccgcccgtccccgcgatcgccgagctagctcgatctccactctccagcagagtctagaagcacacgtccgtccggcggcttccgtcgtcacggaagctagctagctagacagcgcgcgccggggcccggacggccggtttctctctcggcggcggccatgaacgacgacgcctcctcgtctccggcttcgtacatcagactggtgcagcatctgatcgagaagtgcatctgctacaaattgaacaaggaggagtgcatggagacgttggagaagcacgccaaaatcatgcccgtcatcacatccaccgtgtggaaggaactggagaaggagaacaaggagttcttcgagacgtacaagaaggatcggggagtaggcccgaacacgaaccaggaagcggctactactactggtcatcatccttcgcgcgtccaacagagctgctgctcacaagagtcgacgacgacgatgctgcagcagaagaatctatctggcgaacaggaacagcgcgtcgtggagaaggagaagagggagttgttcgagacgtacaagaa

SEQ ID NO: 2369 - DNA, 626 bp, Sorghum bicolor
  Clone ID: SORBI-28MAY03-CLUS40029_1
cgggatgccgatcagcgccaagcccgacgtgtacagcttcgggatggtgctgttcgagctcatctccgggcggcgcaacaccgcccaccggcgagggccggcggcggcggcggcacggcgcctcatcggacgccgacgacgacgacgaagacagggaggctacgacgacgttcttcccggtgtgggcggcggtgagagtggcggagggggacacggccgccgtggcggacgcgcggctgcgcggcgacgtgagcgaggacgagctggagcgcgcgtgccgggtggcgtgctggtgcatccaggacgaggaggcgcaccggccgaccatggcgcaggtcgtgcaggcgctggagggcgtcgtcgacgtcgacatgccgccggtgccccgggcgctgcagcacctcgccacgaccacgctgacataatcaatcgtggcgtgtcgtgtgtgcgcgctcactggtggtacggtggtggaatgtgaatgtgtaactcatctttttttttgaaaaaatatgtgtaactcatctccatcggcaggcgtagtgatgtgatgataaccttgtgtaattatggaacctctttcatgttttccatgtgtacattttataatgccagcgctctccttc

SEQ ID NO: 2370 - DNA, 704 bp, Sorghum bicolor
  Clone ID: SORBI-28MAY03-CLUS40060_1
ctgtattgcatcgacaagaggttttcgagccatttaaaaatcatccacgttttaatgaactgcttgagaacatatacactgtattggatttcttcaatagtcgaatggacatgcaacaattagatggggaatggtctgtggataaggtgcttgaagtcatcaacaaaacttgccgttcatggcgtggcgaagggatgaagatgtttacccagttacggtttacatatgagcaagaaagccaccctgaggaattcttcattccatatgcatggcgccttgtcctatcacggggattctccttcaatcccggcgccataaatctcttccctgtggagattcaccttgaagatgcaccggccggcgaacaaaaggtttaggaagaatggtccgaaccagagttctgacaagaacataaagtcatatttttgtttcattgtggcaaagagcacgatgtaaataggcggcatataccatataccaggtagtcgaatgtactcattcttttgtattaaaatagttctgttgtttcataatatgtgtaagaggggagaggatggacggattgcgcaagggttcagatattgtgctagtatagaggttagattactatgtagagggtatacacaattctttcataaattatgcgttgtattgtacccttaagctgaaaggccttgtaaccacgctggccactctttattgta

SEQ ID NO: 2371 - DNA, 726 bp, Sorghum bicolor
  Clone ID: SORBI-28MAY03-CLUS40062_1
ctgggggctgtgtatgagcgaggattgatcggcatatatcatgactggtgtgaagctttctctacttatccaaggacatatgatcttatccatgctagcggtcttttcaccttgtataaaaacaagtgcagcatggaagatattctcctggagatggaccgcatcttgaggcctgaaggtgctgtcataatacgggatgatgttgacatcctgactaaggtgaacagcctcgctctgggtatgaggtggaacacgaagatggttgatcacgaggatggccccctcgtgcgtgagaagatcttatatgctgtgaagcagtactgggttggtgggaatcagacagctgtagcttgaagcaagcacgtttccgaggttctaacatgaggaattctgcaacccaaccttacccgacgatcaagaattaccttaggagtcatcctgtggcaaggaaaatggtcagcccttgtaggggtagcactgaagcagccaggataccgtacttggtggtgatcgctgcaaagcctgcaaccacataatgtcggtgacaaatttttggaattcttcgttggttgtgtactctattcaaaagcttgtatcttagaaaatttctctacggtccgtactgattcgagtgtaatttattaagtagagtagctttctgtaagcaagaaatacaaggttttttggacaaccccaggtatatttatctacccctgaatgatcctg

SEQ ID NO: 2372 - DNA, 630 bp, Sorghum bicolor
  Clone ID: SORBI-28MAY03-CLUS40097_1
tcattgttgaaatgctggaaaatactatggatatgtctagtggaggagagtattcagattttactgaagataagaagtatcaacataccaacttcctgtttgactgcattatagaatcactggattcaaaattctgcaactttggcaaatgtggatacaaggcttggctgaagctgccgctcagtttgagcaaagatctgatgaagcgccaggtattggaagatatcaccaaatggagggagtcaagtgggactgctcttagacaaatttctgaaaaagaagtggaccaagtgactgacaggtgggatgcaagccaggttgaagcatttgatataagcattgcaattgagaacgacattcttgaggcgcttgttggtgagttcactgttgacctgtggtggtattgactgctctatgtgagatattgacatgtttggacttctgctcgcatgattatggataaataagatactgcggatatgtttgcttttttctctgcagtaatttttgtacagagtcatgtaaggttgaaggacctcccggttgttttaccctttgtatgttgtaatggacacgtgctaaagcctaaaagtgtctcctaatctttgtggccttttcgtcggtcctctg

SEQ ID NO: 2373 - DNA, 672 bp, Sorghum bicolor
  Clone ID: SORBI-28MAY03-CLUS40110_1
agcctggccagggaggtggaaggcatcagaacccactgctgaatgcattggcttgtatttcttctcagataatatgagggaactagatcaactagtgcattatctcgctgatcatagcttagtactaaaatatgtcgttgggtttgccaagctgctgatcttcccttctgttttcctaccagagcaatgtcaaacgttccaagggaaacactatctgtggggagtgttcaagcgcaggatgggtaagtgacaccctggtccaagaaatgcctgttttgaagggtatcacaatccaagctgtttggccttgtcatcgtgcagacgatgaggtcggagcacttcatttgggagctggaagatgaaggtgcattggtggtttctctgaacttgtgaaagggttaggcccgtcctgtaatgatcccgccctgaagcaatgatgtagtagcaagtaggatcagaattcagaactaaccagcgacaatcacgccccagcttctgaagcgtagctgtacccttgatgttcaggactgagctagattgtcttctgaagactttcctgttcctgcaaccctaacctaagatgtatcatgcatcgagttgtgttgctaaagaattatgtttggacaactaagtctactatgaaaggcctagctaaaaaattatgtttgtgtg

SEQ ID NO: 2374 - DNA, 614 bp, Sorghum bicolor
  Clone ID: SORBI-28MAY03-CLUS39669_1
gcacgaggccactgcggccgaagtcgcccctcccgagccccgaccaactctcctctcctctcctctcctctccacctcagggccgccgcctccttccttccttccttccgccgcctcgacaagcgtcggccaagatggtgaagagaagcaagaagagcaagagcaagcgcgtgacgctgaagcagaagcacaaggtgctgcgcaaggtgaaggagcaccaccgcaagaagcgcaaggaggccaagaaggagggaaaggccggccagcggaagaaggtcgagaaggaccccgggatccccaacgagtggcccttcaaggagcaggagctcaaggcgctagaggcccggcgagcgcaggcgctccaggagctcgagctcaagaaggaggcgcgcaaggagagggctcggaagaggaagctaggattgcttgaggatgaggacattgctaatttggcatctgcagcttccgcgcagggcagtgagtttgcagcaaaggatgcagctaaggagaatgctcctttagcagtggcaaagagcaatgatcattcagagaggtctttctacaaggagcttgttaaagtaattgaagcttctgatgtgattcttgaggttctt

SEQ ID NO: 2375 - DNA, 571 bp, Sorghum bicolor
  Clone ID: SORBI-28MAY03-CLUS39709_1
gcacgaggcaattttccatacgatcctcaagattccagcagcagcggcggcggcgccccatcctccgtcctttccgccgtctcagctgccattcccacagagcgccgccagccgcttggtgatccaggaaagaagtcgctcactcactcacttgtgacacagatggcccgcctcgccgccctactcgttgccttgctcgtcgccctcttcgccgtcgcggccacggcgcaggccccggccgcctcgcccaagcgcgcgccggcgccggcgccacccaagatggcccctctcccgccgccgccgaccagggctcccaccgcctccccgccctcgcctcccacgatggcgccggtgtccgcgccctttgccgacgcgccagcctcgagccccatcgctgcgggcgttggcgacgcgacggccccggcgggagcttccgctctgactccggcggccgcgcctgtcacggagaagagcgccgccgtatctgcctccgccgccaccttcttagtcatcgccggagctgtggcatccgccgttgtgttatagacatatgccgggcggatccgtgaag

SEQ ID NO: 2376 - DNA, 525 bp, Sorghum bicolor
  Clone ID: SORBI-28MAY03-CLUS39710_1
cggattccgcaaccttcagcaactgtttccaggcgatgccgggggcgggggttcatcgtcgtcggcgtcgtcgagcctgtacctccggctgtcggaatctgaactgcggcatctgcgcggcgccaaggggaggagcaagaacaggcggtggctcgccattggcatcgttttggcttgcgttgccgcactgggcgtatcggcagtagcagcgtggatcctcgtgtccaggagacgacgacgagctgaaatggcgaagcagcagaagggctcctcgtcccttgtagtgtacagctacggcgacctccggtcggcgacgagcaacttctcggagcggctgggcggcggaagcttcggctcggtgtaccgcggcgtgctgaacggagacggacacacccaagtggaagtggccgtcaagaagatggaaggtctccggcagggcgacaagcagttcagggcggaggtgaacacgctaggcctcatccagcacgtcaacctcgtccggctcctcggcttctgctgctccgg

SEQ ID NO: 2377 - DNA, 556 bp, Sorghum bicolor
  unsure (1)..(556): unsure at all n locations
  Clone ID: SORBI-28MAY03-CLUS40190_1
atgaagttgtttgcgtggatcaagattgcaaagggcttacggccaggggcacttactatgtcaatgttgaaaagctagggaatggagcgcattggcgacgtacatgtggccaacatgtctattcaccctttctccttgcttttactcatgaggatgagacaagctcgaagtcctacaatgtggccaaagctggtatgatggatgcaaattacagtcttcctgataatgttgcaattattactttgcagaacctagatgatggtaccacactactccgcttggcccatctttttcaagctgctgaggacccaaaatattcggagatagcaaagattgatctgaaaaaggtgttcggaaagagaactatcacagaattgacggagactaacctttccgcaaatcaaaagaagtcagagatgaagaagctcaactggagggtcattggagacactgaaagtgngtcctgccccagtaaaaggtgngcccacttgatagtagggctctagtcgttgaactaggacccatggagatacgcaccttcttgctaaagttttta

SEQ ID NO: 2378 - DNA, 609 bp, Sorghum bicolor
  Clone ID: SORBI-28MAY03-CLUS40191_1
ttctgacttctcccccacaccgaaggagatttcaatggacgatttgctaggacggatagatgagattcctgtttgtgactctgtcaggccagctgatgatcttccacttgacaatttcaaaaggctgcaagatgcattccccaccggtgattttattggtccaggagatgatcatctgtatgatcactatattggtctagcagacattagccacctgcctcttccaatgaatgagccagctttcaatctggatgcagagcttgattggagtgggttcgactttgctgcaattgaacgtgaacttgatgtcctttaaggctgcatcagagattgtgttatactgaaacctgcacttgattatgttggattcagctgaaagctcctctctatgttttcatatttgtcagaatgcaacaatgaatatggattcaggtttcagtctatggcagcctggctgtatgtggccgggatcaggaggcaattgacctctaaatttggaggcaattggcctctaaattttgtcggggattgtacagttcctagagtagcttgccagtgtgtgctattgatgtaacaagtttcatcatgtaatatgttctaatctatttc

SEQ ID NO: 2379 - DNA, 173 bp, Sorghum bicolor
  Clone ID: SORBI-28MAY03-CLUS40206_1
ggcagcaggttggaggatggactcaggtgtatgagaggcggcgctctgtcgttcgccaccatcaggggcgcctcccatgaggcgcccttctcgcagcccgggcggtcgctcgtgctcttcagagcgtttctgcagggccagcccctgcctgaaaccttctcatgatgatgagc

SEQ ID NO: 2380 - DNA, 626 bp, Sorghum bicolor
  unsure (1)..(626): unsure at all n locations
  Clone ID: SORBI-28MAY03-CLUS40211_1
gcctgcgcgccacgctcgacgcgctgctcctccgcgccggcgccggtggcggttgcgtcacggcgcagcacgcagctgaggaggaggggttcggcgagtccggcggcggcggcgcggacgacgacgcgcagtcgtgctgcttcgtcgaggccggcgcgccgtcgtcgtggaagccccccgcggcgaagtgggcgtgcagggcgtgcggcgagggggaggcgtcggtgctgctgctgccgtgccggcacctgtgcctgtgcaaangcgtgcgagcccagggcggacgtgtgccccgtctgctccggcgacaagaacngcggccatccacatcgcgccgcccaactgatcccgtcggttgcgatccggcgttctcgccggccaacaacagccgccaagtaaccgcatcgcatcgatcagttggagttactacttgagtaattattactaggagtagttggttagattgttactgtaggtaacagtaggttgttgggacgattaaccccgttcgtcgtctggtgcggcgtcgtgttggcccgttttgatgacgctgttgaaagtgaaattaccgccgggtgaaagtctgttttggttaacaatggaacatgtgagtgaggtcagttagt

SEQ ID NO: 2381 - DNA, 649 bp, Sorghum bicolor
  Clone ID: SORBI-28MAY03-CLUS40215_1
cgttgcagcagctgatgaatgatgctctgattgttgccaagcagaagaattatgatgtgttcaatgctctcgatgtcatggagaatgagtcattcctcaaggaactcaagtttggttctggagatgggcagctccactattatctctacaactaccgtattcgcaacggcatcaagcccctctgagcttggtcttgtgctgctatagggcagtctaatcaggacagtcctgagtttacaccttcccttctgcagcaggtctcactgtgcaatcccagtggtttcctcattttgtctattgtggtagtagttctccttgatatgattgccatggccattgatgggagtccgagatgatttgcaaacaaggagactggaattagaaatcctttccttaatttaaggttattattcccattagtgacattttgtgtgtgtggtccacaacatgtatgctggcacggattttaccgagaaattttgatagaacttgtcttatcgaagttgtttgtgtgctgctgtgttatgtttgcacatgtatggccgtatggatgtcttgatgctagaacatttgccacggctctgtcagcactacccaaattttgatggtttctttttattatgagcaggttctattagtcttttttgtc

SEQ ID NO: 2382 - DNA, 668 bp, Sorghum bicolor
  unsure (1)..(668): unsure at all n locations
  Clone ID: SORBI-28MAY03-CLUS40262_1
cggtcctggcaagtggctgcctggtttgcctgagaatgtgttggtggatgagagcttgccgttgccggtgaaattaaaatgaaaggacagcctcgctacgttgggccacaccgtacgtcgaccagctcacacagccaccggagctgaattccgcccctgagctaagctgcgccacatggttggccttggccaggcctgtagaatgaacagatgcatatactctcgtcgtggtctcatcagagtcacgagcctgcatgcgcgcgagtgggaaccccctggactcgatcgtcagttcatcacaaagagagtgaatgtgatgaagacacgtcagtgagatcaagcagggacggtgagcggaatacagtgacagcaaagctctcatgttgtcatgtggccatggtcgcatctgcctcaagtcaaggtcgtcaccgtcgtcgtcggtggcttggttggaaccacgaccagggtcgtccttggctcggtgcctaaanttggttcattttctatacaagtctggctagcaaaattaagtcagcctagcttaagcatgttctaattaggtcaatttatagttgtttggttgtgtacattacactagcctggctgacattgggtgtgtttggttgtctatcatgttttgtatagaattacctcttctctcttctggt

SEQ ID NO: 2383 - DNA, 677 bp, Sorghum bicolor
  unsure (1)..(677): unsure at all n locations
  Clone ID: SORBI-28MAY03-CLUS40306_1
tatctgacagcaatgatgcccaacaaccagctacatcagcacaacatacgggagaaccaagggctgctgccacaccagttcctgaaaatgtctccaaccatactaaaatctggtcagaactttcaggtagtactcccaaaagctttgaagctaacagagaaaangcgtgcccagacgcacagaaatgcaagcaccaatgtgctgaatgccacgtcaatgctgcccaacgttgcaaatgctccaagcaggccaccagttgcagataatgcaaacaatgcaatgcagccttcacaaantggatcacatggaagaacatcctgaagttatcagtgctattcctcgatcgcagcatcacccgagcaactgggtaggtgctgatgacaacgatgatgacaatgaagatgacgaggagcttttagtccaaacaacaccgcactatatggactgaggataaattctgattctgaaatatgtaggcgtatttcagcctagtgtacagtggatcaacgaattaggaactagctgaaggcttttcgtttacttttagtagttctagtagggcaggagttggtgactttaactgaatttccccagacacacagtaatgactctcttaactctgtatccattgtgacttgcatttctttttgtaatgtaaagaaacgttaaggttgatt

SEQ ID NO: 2384 - DNA, 658 bp, Sorghum bicolor
  Clone ID: SORBI-28MAY03-CLUS39957_1
ccagagctgtaagctatgctcataccataacattttgatgggcactatttgcttacaaatgacgaatgaccatcaataatagctgaaaaaaaatactctggaagagaaatagtcaaagttttacgagcagcagaaggcatcctaaaagcatgaagtgcataagtgcacatacaaagcccggtgaaggtggtacaagtgaaacagccacctacgttagagcttgttcgcttgagcttatctgccaaatttgatagccattcaacagtgtttttctctcacaatagtgttgatgttcagcttggcgggtgaatagcagcatccagcttgagagttgagatggtggctcctacatacggagtatgtatatgcgcttgacagaagctgagctgttggatgttcttttagcaggtgaggattaggaaggacagaggaaggaatgcagccactaatcctcttctttttgtgaatcattatcaatatttgttgaagttttgaatattccatgtcaattgtggtggtaaatgctgctaaaaatgttggtagctccagctagtaattcttagtggattgtcttgcagtgttaactatatgccaaaaaaaatgatcaggctgtaggcatgtggcatcagattggaggggcagtgccctagcatttttc

SEQ ID NO: 2385 - DNA, 772 bp, Sorghum bicolor
  Clone ID: SORBI-28MAY03-CLUS39963_1
gccgatttgctggatgtgatattgaaaggtctgtgtagccatgaaaaggttgaagaggcttactctttgtttgttgagatggtggataaggctgagttgaggccttttcaaggcacttgccagcgtctaattggtgacttgctgagggtaaacaaacttgaggaggcactggcccttctgaagacaatgaaaacctgcaagttcccagctttcgtggacccattccatccttacattgccaagcatgggacggttgaagatgcaaggaactttttcaaggccttgacagtgaaaacttctccagcacctgctgtctacgtggatgttctcaagttgttctttgcggagggaagatactctgaagctcaagagttactgtacaaatgccctaaccacatccgcaagcacccccatgtcaccaaactgtttgaatcaataaaagttgagagtgcctctgcctcttgattgggttcaagcaagcaatgattggtgagattatggtgaacccttagctttgcatgctagctagctttctgtttttaagtagccttggtattgggtatttttatcaaatactccatcttctaatgatatatggttcagctaagtcgaattttagtatataggaaggtgccactgccaactggcatgtacttgaaactgtttttgtttgttctagtcattgttgctacttgctagtatcattgcagctatgcagatggattttccttcaaaatgactaaaatgaatcaaagcacctgctcagttgaac

SEQ ID NO: 2386 - DNA, 747 bp, Sorghum bicolor
  Clone ID: SORBI-28MAY03-CLUS39974_1
aggatgagtccgatgaaaattctccacagctaataaaagtgttgaggtctgcagccaatgcaaaccatgatttagtgttcggatatgtgggagtcaagcagtgggaggaattctctgagacttttgatgtgaaggttccgcagctgccaaagattattgtctgggatacaaaagaggagtacgaagtggttgagggttcagagagtctcagagaaggtgactatggatcccaagttagtcgttttctagagggatatagggaaggaagaacaataaagaagaaagtgggtcgtggttccccaacactgctcggccttaatgccatatacattctcatcttcctggtcgccgttcttgttgttttgatgtatttttctgcgcaaggcgaggaggatcatcagccaagaagaggaagagcccatgaggactgagactgacagtatagcagcaatctgagacaactttatattcaaggcattgataccgaggctgcgagttatttttgaggagataacatctgatgagaaaaatttcctgatcttcatttcacgttccctagggtcagagttttagtttttgttgcagagctatgtatgacctccccacatttctcttgaatccttgaaatttttggacttgcacttgagaatcgggtttcctcaagtttgtaccattgtaattattcggcactttggtaatataacattcatgtgtcatatctgagacctttggagcaacgagttctac

SEQ ID NO: 2387 - DNA, 607 bp, Sorghum bicolor
  Clone ID: SORBI-28MAY03-CLUS39979_1
tgcatgtagaaatgacttcaaacaatgttgatacctttgattcaactgggaatgattttactgacacctctgctctatgtgaatgggatgacatggatatatttggtgatgaactagagtacattcttcaacagccagagcagaactttcaagtggaccctcctctaacagttgaagattatggttatgatcgtccacggctagagcaggactgtcagatggaagcacaacaggattgcaaaaatcctcaatatgctgatgtcacaactgaagcatgagcggtggtcccagagaatgttgtcagtaacattagtggatagagatttgtgatgaacagaatcttgagactggcaggttagccaccattgggaacctgaagcccgtcgggattactcagaatccagatactaaacaaaatccagcaacccatgttgactataaaggatttcgttttccttgttcactcatttaaggcagtaggacaaggtttctgtttttgtcccaggtctcattgtcctagctacacccataacgcaaggtggtaaacattgatcaggttgtatatactgttgtattggatgaacatggagcagttttgaacttcttt

SEQ ID NO: 2388 - DNA, 501 bp, Sorghum bicolor
  Clone ID: SORBI-28MAY03-CLUS40363_1
tacaaagaagcacttcaagatttcaggcatgctttggcttggaaccacagaacaaaacagcccttgcagcagagaggaggctgcagaaactcctgaagtgatatggggagcaggaccacctccgacttgtaaattttttgaagactcgcctggttgaaggcaattttgattcggctgcttgtaaaagaaagaagtgttctgcgccatcttccggataaactatccaagagtcattaaactcttctccctttgaggcattcaaaaatttgtatctcacgacgattgtgaggggattttgatataatacgacagcagaagtgtcacattgagtatataggcctggcagcttcttgcgatgagaatccgacaaatttgtactgtgtccagtatggaaagcgtcaatatatgcactgtagaactgaaggtcgagaacacatttgtgagttgtgacttgtgagcgcttggcactgctggagtgcatgattgtgcagtgcagtgtct

SEQ ID NO: 2389 - DNA, 498 bp, Sorghum bicolor
  unsure (1)..(498): unsure at all n locations
  Clone ID: SORBI-28MAY03-CLUS40393_1
cctgtgacgaaggctgcagctgatgccattgcacggcgactccatgaattacgtcaaaagcaatcagaaggcccaaagcgccgacgggggaaggcagccttgaaggcatccttggatgaagccatggaggctaagagaaaggctgaagacgaggccagctgcattgagggagaagttgattgctantggaagaaagtcaganaaaagctgcaggaggctaccagccaacaaaaagaccgcaggtaccctgaggaacaagacttcacggacccgaaggaattagaaggtgaacagtcgtcacctccaggttttgtacagatccaaaaccaagctctgatgaaataatggagccccgtgtgaagcaatgttttcaaatcatctaatcgaccctagtcgctatggcaccgatcacactgactaatattagtggtcatgactagctgtgattagtttgtgataacattgctgagaagccaagtacatgtgtaatgctgactg

SEQ ID NO: 2390 - DNA, 637 bp, Sorghum bicolor
  unsure (1)..(637): unsure at all n locations
  Clone ID: SORBI-28MAY03-CLUS40429_1
ctactggatggcgcacatctcgcaatcctaaccaaacccagcgaggcagcgacctagcgccgtcgtcgctcgatcccgccccgtcgtgccggggcccccagagggtcgcaggccatcgcgagcagctgggggttccgctccgacccgaatccgagcctcccgcaggacgctgcggggtctcctttccggactcgtagcaggaagtttcgcgcgagggattgattgattccggagctagagatgtacgggcagggagggggcttcaatccacactatcgccctggcgcgccgccgccgccccagcagcaagttggggtgcctgggtcctttccccagcaacctgtgccaccgccgcctgcaccatacccacagcaccctggattgcggcctccgcctccgcctgggccggaccagcatggcgtgctgccaccgcagaaccaaccattcccantttgggcagcatggtcagatgcaccagatgccaatgctgccacagcagagaggttatgcgccggtgccaatgccagggatgctgcctccgcaacaagctatgcatcaggcccctccacagtatccgcccctccctccaccgccacctcgacctgctgcccctccgccgtcgcctcctcctccccca

SEQ ID NO: 2391 - DNA, 700 bp, Sorghum bicolor
  unsure (1)..(700): unsure at all n locations
  Clone ID: SORBI-28MAY03-CLUS40437_1
acacgtttcgcctccctgcaccgcaccgctcctcctcatcttccacttccaccacaccagaccagaccagacccccgcccctgctcttccgcccgaagcaaagacccccatttaacccccnctctcgcccccctctcctttcggctctccccatcccaaccggacctccaacagtctcctgcccgcgcagggaccctcccgatccgcttcccctgggattccgggtggttcccattccacctagtagtggggggcgcgggcagtgcttcggcctccgtagatcgttgcagagccgtggcacccaagctgtggatcgggggatcaggagtggagtagcccgcacgcagcgcgccagctgttgatttatgtcgtctgctctgctgccgctccatggttctgagctcccgacgtcagcagcctcttcttgctcccttctccagcctgggcagaggggcgccagacactgcggcttttgcttcaggatctcaggatttggatttggggtgaagtactctgggtttctgcatttagacccttgcttcctactttgctgcacctggaggcagtaagagttgaagaatcccccaaatcacagtcagtcttgggtctggtttgggtggattgcattacgtctcctccaagttcaaacagtcagtcggattcccgagttgagtctgaaggaaccagatcttcccttttc

SEQ ID NO: 2392 - DNA, 563 bp, Sorghum bicolor
  Clone ID: SORBI-28MAY03-CLUS40457_1
gcacgaggaccaccgtctgtgtctcctctcctcgcttccccgatccgatctccactgagagagcatctctaccatccgtgtgccttcctaggaagaagacttggcgcgcggtgacagacagacatggccgtgcaagcgcagttcggcggcctcgccgggtgcctattcccctacggcggcggcggcggcgggtgggccgaagatcagctgcaggcgctcctgtcagccgccgctgcgggcaacaacaagcaggcgcagcagcaggaccactgcgccgccggtggcgtggccagcgccgcgcagagcgagctgacctgcaacggcgggggcggtttgggtggcgtggtggcgtcgcggaagcgcggcagggacggcgacctcgagccgcagtaccaccaccacgtgccgtcctcgtcggccgcgctgctcccgatcccgccggcggtgaacatcgcgagcagtagccgcatggcggactccgcggcggcgtccaccagcgggcggcgcctgctgctaccgacggcggacgcgctgttggcggacgaactgcgccggcagggcgc

SEQ ID NO: 2393 - DNA, 587 bp, Sorghum bicolor
  unsure (1)..(587): unsure at all n locations
  Clone ID: SORBI-28MAY03-CLUS40462_1
gcacgaggaggacgtgtacgagtacgaggaaggggtgcccgaggaggaggccggcaagaacggccgctacgacgccgtggccaagtacgagtacaatttcgacagcgacgcctccgatgcggatgaggatgtgccttcggacgaaggcgaggatatggaagaagatgacaatgcccgcggtgatgatgaggacaggcagantaagaatacttcaggagacgaccggaatgcccagagaagccttcgatggaaagaagaggaaacagccattggagctgcctctgcagcatggtgatggagatggacctgtcacaattcatgatctcttggataatgtccaggggaaacctgggtatagcaagatccgtaagaggctgcagcagcaggagaaaaagccgatggtcgtggtagccccacttccgaaagtagagagggacaagaattgagcgcagtgtggacgtttcagaaatccaagaatgagctaacaaagtgggaaggagttgtgaagagtaacagggaggctcctgtactatactttgagaatgataccaacttgggtgtgaacactgttgcagcaattgctagcg

SEQ ID NO: 2394 - DNA, 553 bp, Sorghum bicolor
  Clone ID: SORBI-28MAY03-CLUS40484_1
gcacgaggaagcagctcgctgtagccttttgtttgttcttttgttgccttccttttccttttctccgcactcatcacttgttgcgggctcgccgccggtgccccgggacacccacccaggactctccacaaggatccggcgtgcgcggagggcaccgtgcaatggcgcggcggtgcccgtgcaggctgctgctagccgtcgtcgtgctcgtgctcgtgtccgctgcagcgcaggcgcaggcgcaggagacgtgctcgggggccgtgccggcgccgccgcggcgcggggcgcgggtgtccgtggccagcttcggcggcgcgggcgacgggcggacgcgcaacacggcggcgttcgcgcgcgccgtcgccaccatcgagcgccgcgccgtgcccggcggggcggagctctacgtgccgccaggggtgtggctcacggggcccttcaaccttacctcgcgcatgacgctcttcctcgcgcgcggcgccgtcgtccgcgccacgcaggacacatcaagctggcctctgatcgaaccactgccctcatatgggagagg

SEQ ID NO: 2395 - DNA, 837 bp, Sorghum bicolor
  Clone ID: SORBI-28MAY03-CLUS4044_1
cgtccggagtatctctggtgcattgaccctttagatggaacaacaaactttgcacatggggacgcccagcttttctgtgtccattggtgttctcttccgtgggaagcctgctgcttctactgtggtggaattttgtggtgggcctatgtgctggagcacccgtacaatttctgcatctgctggtggaggagcttattgtaatgggcaaaagattcatgtcagtcagacaaacaaggtggaacaatctcttctcgtcacaggttttggatatgaacatgatgatgcctggacgacaatataaatttgttcaaggaatttactgacattagcagggtaagtgtttgccgaactgcaattgttttgcagatttgcagatctgagttttctatcatccttgaaatatactctttttttcagggagtgcgaaggctggggtctgccgctgctgacatgtcccacgttggacttggtattacagaagcttactgggaataccgacttaagccatgggatatggctgctggcgtcctgatagttgaagaagctggtggggtggtaactcgcatggatggtggagagtttacagtctttgatcgttctgttcttgtttccaatggacttgttcatggacaggtttgttctaattaatttgggatattgtttgtgtggataagtttcctacggttgttgttgatgcacccttttattgaactgcagcttttggatcggattggccctcctactgaagatcttaagaagaaaggaactgatctctctttgggggtccagcctgaacactacgtaactgacttccgagctgccccaaaaaagcaccac

SEQ ID NO: 2396 - DNA, 658 bp, Sorghum bicolor
  Clone ID: SORBI-28MAY03-CLUS40149_1
gccttcaagaagaatcaccaatggatcgtggaataagacaaacataggttttgatgggccagagcaagcagaagcatcaacgagctggcaatcttggatggtttcagcaagtggagctcctctgcagtcaaatgatgatgcaacaagggaacagctgaggatgccactgctgagcagcagcggagatgagagagcaggccttgtggaggagcagacatcaccttctgctggtgaggagggagatgcgaagaagaggaaacgcggtgttcggcgtgcacgggtgatggatctggggaggaggatggggggcaagctggaagagaagggcaaacatttcatcggaaagatgcgggagaatgcaaggaacaaccgcctgctattgccggacttggagcaggccagcacccctcctgctcctgctcctagttattaggcatttaggatgtttaattaactgttactctgttactcaacaaaatgaaaatacctcagttacagcgcctagcaacagctcctaacaagtgcaatgatatgggagactgtttgcagttgtatgtaaaaagagcttatgaacataccacacaactgaagctagatagatgtatccatctcttaaatctcttgatctcccaactgaattaacataacaagcaagtca

SEQ ID NO: 2397 - DNA, 646 bp, Sorghum bicolor
  unsure (1)..(646): unsure at all n locations
  Clone ID: SORBI-28MAY03-CLUS4011_1
cgtccgcgagcagacaggccccgcggctgcggcaggtggtggtgacgacgacgctgttcgtggggtcagcctcgccgccctgcggacgacccggtacgggtgccggccgaacttcgaagcggagttcgcggcgttcgcggagcgcgccggggacgcggcggacgtgggcgtgctggtgtgcggaccgccggggctgcagacgagcgtggcgagggagtgcagggcgcggaacctccgccgccgcggcggcggcggggcggagaagagcaggagcagtgcggtcttccatttcaacagccacagcttcgacctctaaacacgtctccggtcggtgggttcaacgagcggaattaaattgggtggaccctgggtcaccatcaactgtatgttgcacagcacacacacacacggtagttggatatacatgttggtcctgtatgatatcgtgtatatatatatctatgtatatagctgataattactacatttgtaagttatacaagagatgtataaatctgtatgcgtgttagcgcatatgcatgcatggtaaaagcaaaaaaaaannnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2398 - DNA, 701 bp, Sorghum bicolor
  Clone ID: SORBI-28MAY03-CLUS40167_1
gtaccggattcaggtggtgtatactttgtgccagcattcaatgggttgtttgcaccatggtggagggatgatgcaagggggatctgcattggaatcacaaggttcacgaataagggtcacattgctcgagcagtacttgagagtatgtcctttcaggtgaatgatgtccttagctccatgcacaaggatgctggagaggcgggagaagtaaagagtgcagaaggggaattcttgttgcgtgttgatggtggcgctactgttaataatcttctaatgcagattcaggctgatctattgggtagccctgttgtcagaccagctgacatagagacgacagcccttggagctgcatatgcagctggtttggccgctggagtctggacgaaggagcaagtgttcgcaggtttgcacaaggagaacacgacggtcttccgcccaaaactggatgaggcccacaggaagaagcgagcagattcatggtacaaggcggtgtcaagatcatttgacttggctgatctttccctttaaattggcacacctcgtcgccagtcagttgtgacctgcgtatgtagcacattatgaataagcaggcagccctgtagtgtgcattgcttcggtggggtgttcctgtatttatttccatgcagtaagcaggagaggatgacagttgtatttatttacggacataagtacagaaacat

SEQ ID NO: 2399 - DNA, 589 bp, Sorghum bicolor
  Clone ID: SORBI-28MAY03-CLUS40563_1
ttcggcacgaggcggcggcggcggcgccgattgcggccatggagctgtcgatgagcggcggctcgctgcggacgttcggccggtgcgtgaccttcctcgcgcgcgtcgcctccgagctcgtgctccaggcgcaccccgccaagctgggagatgcacacgctcaacagctcgcggtcggcgtacgcttcggtctccctagcgcgcgacttcttcgaccagtacaccctcgccgccgcggcgtcggcaccgtcttccacgccgctgcagtgcagcgtcctcctcaagtccctgctcgccgtcctccgcaccccgcacgccgcgctcgaccggctcgccgtctccctcccagaacccgacgcacccaagctccaggtcaccctccactgcctcaacggtgtgaggaagacgtactggatcgtgtgcagcgcggagcctgaggtgcagtcgctgtcgctagaccggggacgtttcccgagccgcctcgccatccggccacgggagctcgcgcgcctgctgtccaacttccagtcctcgctgcaggagctcactatcatcgccacagatcctgcttcagggctacctgatgccg

SEQ ID NO: 2400 - DNA, 431 bp, Sorghum bicolor
  Clone ID: SORBI-28MAY03-CLUS4056_1
cgtccggctcgcgcgacatggcgcccaccgcccgatggtccccgctgctcttcctcctcctgctcgcggcggcgacggcgacggcgacgaacacgacggcagagcatccgtccggctccgacccgcccccgtcgccgacgccgacgccgtggccggagcgtttccacgcggtgctgttcacgaacctgaccaactactcggacgcgtcgacgggcccgccgctgcgcatcacggacctctactacgactggccgcggcggcggaacctgaacctggtgcgccaccagctgtcgcccgacccgctctacgacgtggagtggaacaacggcaccaccttctacttcgacttcagggcctgccgcgtcgagcggttccccgtcggcgtgctcccgccatggtggctctccggcggcggcgcccagtacctgggc

SEQ ID NO: 2401 - DNA, 738 bp, Sorghum bicolor
  unsure (1)..(738): unsure at all n locations
  Clone ID: SORBI-28MAY03-CLUS40570_1
caggtgctcaggtgtttgcacgactggncctctcagccccgcctccagctgaattgcgacccggtctgccagctcctacccgatccggggccatgtcgctggcccgcgggtgcatccgtacggtgctcactgcgctgccagcacatgatgccgcggtccgccttgccattgggaaagccaaggagttcattgccgctgatgatgatcccaacctgaggtaccttggacttctggctgttggtatgcttggcccagcatatgcatccacggtgcatgattgtcaggatgctattgcgaagtcactgggtgatgccgacacaaacattcgccaggaggcgttgcatctcattatggggatggttaatgaaaacaacgtcatggacattgctggtatgctgatcggacatgttgctaagtcagacccagagttcgcaaatgacattcttggggctgttctagcagcttgtgggcataatgtgtatgagatggtggtggactttgattggtatgtttcgctccttgcggatatggcaaggaccctgcattgtgcccaaggggatgagattggtcggcagcttgttgatgtaggactgagagtgcaggatacccggccagagcttgtccgttcagctcgaactctcctgattgatcctgctttgcttggaaatcacttcctcttccctgttctttcagcggctgcatgggtttctggtgagtatgtggacttaacgaaggatc

SEQ ID NO: 2402 - DNA, 419 bp, Sorghum bicolor
  Clone ID: SORBI-28MAY03-CLUS40590_1
gcacgaggctgcccccggaggtgggcgacctcaccgcgctcacccgcctcgaggttttcgagaacaagctctccggcccgctgccctcgctcccggggctctcctcgcttcagattttacttgcccacaacaacagcttcgcctccatccccgccgacttcttcaaaggcctcaccgggctcaccgccgtctccatcgactacaacccgttcgcgtcatggacgctccccgccgacctcgccgcctggcgcttccctcgccaacttctccgccaacggcgccaacgtctctggcacgctcccggacttcttgggtgcgatgccggggctccagcggctgtcgttggccttaaaccagctgtcaagacccgtaccggcctcgctggccggcgcgcagctggtgcagctctggctcaatca

SEQ ID NO: 2403 - DNA, 470 bp, Sorghum bicolor
  unsure (1)..(470): unsure at all n locations
  Clone ID: SORBI-28MAY03-CLUS40597_1
gcacgaggctcatttgctgcagatttcaggaaagggaataggtaaatgtcctaatgtcacatatgaaatgctgagtgcaatgggaaaggaaattgaaaggtgcaagaatctggtggaaaaatccaggtccagaatggtttcactacctactgctccttcctcgagcaataccgatgacaccaacaagaggtctaagagggggcctacttctgcattggaaaaagcttggagagcggaagaccgtaatcacttggatgctttgatcagtagagcaatttattctggaggggtttctttcaattttttgagaaatccatatcttcgagaagcttttgcctttgctagcagcagaaacatgcaaggttatgtgatgcctggttacaacagagttagagagggactgttgaggtgtcaaaaatgaggatggtttgcttcaagaagttctttcccaatccagaagacttagcana

SEQ ID NO: 2404 - DNA, 701 bp, Sorghum bicolor
  unsure (1)..(701): unsure at all n locations
  Clone ID: SORBI-28MAY03-CLUS40622_1
gaggcctcacactctcgcgtgcggcagagggactctcgatcggaaagcagagcggagaccggcggccggtgcggncaacacgacgcccgcagccgcaggcatcatcaggcgcatggggtgcgacgacaagtgcgggtgcgcggtgccgtgccccggcggcaaggactgcaggtgcacgtcggggagcggcgccggcgggcagcgggagcacacgacgtgcggctgcggggagcactgcgagtgcagcccgtgcacgtgcggcagggccacgatgccgtccggacgccagaacaggaaggctaactgctcctgcgggccggcctgcaactgcgcatcctgcgcctccgcctccgcctcggcctgatcgtcgtcgtcatcgacgcgcgcagccggcagcagcccacccagggtcgtcttcgtctcgtcgtggatgcaccgcgtgtgctacttctacctagctagtggagttgtctagtgggctgggctgggctggaagctcctagtactagtagtacgtccatactcctacacgataataaagggctcgtgtataggtcgagcctatgtcaccatgcactcatgctcgccagatgcgtcatcacgcgctgcaacttggtatggagtatgtaaacctactttactataagttggtgatatatatatgtatatgaaatgtacgaataaacggttcatgagtgccc

SEQ ID NO: 2405 - DNA, 579 bp, Sorghum bicolor
  unsure (1)..(579): unsure at all n locations
  Clone ID: SORBI-28MAY03-CLUS40603_1
gcngcnggaattcggcacgagggcccgtgccagtgggctcccgtcttcctcttctcctcgcggacggacggggaaggaggaggaggagggcgcgggggttcgctggagttggcctggcctcggatccagagcgcggaaactcgtgcggcggcgttcggatcgacccgctcgaaggccgcgggagcgcgaggtaggtagggatcaggaccggcgaggcgatggggaaggccgtggtggttggcacggcggtggtggcgtgcgcggcggtcggggtggccttggcgctggcgcaccgcaggcggaagcgggatgccgagctcctgggatccgcggaggccgagaggaagaggcgcgcggccgccgtgatcgaggacgtggagagcagcctcgccacgcccacggcgctgctgcggagcatcgcggacgccatggtcaccgagatggagcgcggcctgcgcggggacatccactcgcagctcaagatgctcattagctacgtcgacaacctccccactggagatgaacatgggctgttttatgcactggatcttggaggcaccaacttccgtgtgctgcgag

SEQ ID NO: 2406 - DNA, 502 bp, Sorghum bicolor
  Clone ID: SORBI-28MAY03-CLUS43353_1
gcgctgcgcaacccttctgccccccccttccgtctgtgtgtttccgccgcgctcgaggccgccgcctccgtgaccgtgcctgccggcctacgcgctcggctccgccgccgcctccgtgcccgccggcctacgcgctcggcgcagccgcgcactcggtgaagcctagggtttagcggtccgagcagacctccggtgaagcctagggtttagcggctacacctctcctctcgccggctgtcgaccagcgtttccgctaaaccaccgcgccgccgatggacgttgactcggacccggccgcctcgagcaagcccacgcagatggacctcgaggaacagacggacacgaaggggaaggggaaggcagaggaggggagcgggaagggcgaggagctcgcggactccatcagtagcctctcaatcggtcaggggcgcaccaatttcaagaagaagcctgtgatcatcatcgtcatcggcatggccgggacggggaagacgactttgat

SEQ ID NO: 2407 - DNA, 590 bp, Sorghum bicolor
  Clone ID: SORBI-28MAY03-CLUS43356_1
gcacgaggcttattcttttgagatattgaggtttcctggtggcataacgattatacctccacaaactgcttttgttcctcagaagcctgatggcttatttaatttctcgttgaactttcccattgatgtggtacaagacaagctgagtgaattgaaggcccagatgaaatctggattatttcttaacgaacatgagatcctatatgttacactgacaaatctgtatggttcaacagttgcgcctcctactgttgttcaagcgtctgttctccttgctgttggggcagataacaaaccaccatcattgcaaagactaaaacagttagcccaaacattaagaaattcttcttctggaaacttgggcttgaaccacactgtgtttggacgagttaagcacattagtctgtcctcctaccttcaacattcactgaacaactcaggcaatgctcactccccaagtccagctcctcaacctaataatcaatctccctcagtccatcaggataacaattctgaccatggtcaccaccaccatcatcaccacgtccaccatcgccatcatcaccgctatgatcatagtcatcagagtt

SEQ ID NO: 2408 - DNA, 634 bp, Sorghum bicolor
  unsure (1)..(634): unsure at all n locations
  Clone ID: SORBI-28MAY03-CLUS43362_1
cggcacgaggcaacaaacacaaaatccactgcanttgaaagggggaaaaatcaacacgactgacagattacgatgatacagatgcactagaagtagcacgtctggtagctattgaggtggagcgggaagttattgactacagaggacccttctgtagttctcctgatactaattccaggaatgctgacagtcctgacctggaagcaccgcggcagcctgtagctgttgccagtgaactgaatgataataaatcttctagtacagaggctaagtcaggaagttcctcgtctcataaggaggatggatcaggcatcacagatggcagtggtccgttgagtagaaaacatacacggagtgtggatctggggaacttagaccttaatgaaaatcagtgtgccgaggaaactgactgtaatccaaagtccgtccttagtaattctgtcaatttgtcaatgcctatagctgtggctgcttcaagaggctcatctgggtttccagctcggctccactttgaaggtggacttggctggaaaggctctgctgcaaccagtgcctttagacctgcttcaccttggaggactcctgatgcagagaagtcactttcagcttcttcacataagacaagcaacatgct

SEQ ID NO: 2409 - DNA, 734 bp, Sorghum bicolor
  unsure (1)..(734): unsure at all n locations
  Clone ID: SORBI-28MAY03-CLUS40693_1
gagcagctacgggacatcgccgttggccttgataggtctgggcagcggttcctgtgggcggtgcggacgccgccggccggcaccgacgacggcggcggtttggagagtctcgacgacacgctgtttccagaggggttcttggagcggaccaaggaccggggcctcgtcgtgcggtcatgggcgccgcaggttgaggtgctgcgccacccgtcgacgggcgcgttcgtgacgcactgcggatggaactcgacgctggaagccatcaccggaggggtgccgatgctgtgctggccgttctacgcggagcagcagatgaacaaggtgttcgtgaccgagggcatgggcgttggggtggagatggaagggtacagcacgggcttcgtcaaatccgaggaggtggaggccaaggtgaggctggtgatggaatctgaggagggcagccggatcagggtccgagcggcagcactcaagaatgaagcaatagcagcgatgcaggacgacggctcatcacaggcctcgttcgccacgttcttgtttgatgccaagaatcttcatgaacagcttggctagctagtgatctcggcatcacattgattttcanagtagttgttggcctaggacgtccgccttttaaaatatatctatttctagaggcatttgtcttaaacggtcgcctctgcaaatattatttaagagacaaataattagtctgtttcaagagtttggatatatat

SEQ ID NO: 2410 - DNA, 605 bp, Sorghum bicolor
  Clone ID: SORBI-28MAY03-CLUS40717_1
gaaaggtcgcaatgcatggtacgggcagaagttagctaagggagaactgactctagaaatgggggacagcatcaaaggcaaagggactatccagggtgtttctgcagtcaatgcattttatgaactgctgagccagggaagcctaagcgtgatgcatccagaaaccaagaaggctgttgctcctgttgagctatgcccaatactcaaaacactttacaaaattttgatcaagagggagcttacgaccaattccatcctccaggcaatacgtgatgaatcaatgtatgatccacgggaaagaattgaaatggcgcagaggcagtctcttttccggccatctcttcttggcctagctaaaggtgatgccaaggcctaagatatggtgtttgtttcttcctgaaatacgtatttccatgtgagtttgcaggaggcgcgtactggccttcaagatccttacttacgtgcctcagatgtgtgttgggtgcacgctatagagttcgatgatgtgcatgccaggataaactttatggcccgtgtctgtacataacgtgttgtgattcaaatttatttgtcatgaagtaaagatgtgcattcctttttatttt

SEQ ID NO: 2411 - DNA, 904 bp, Sorghum bicolor
  Clone ID: SORBI-28MAY03-CLUS40760_1
ccccccgtgctccccccataagctattgcaggagaattatgcttctgacccctggaaggtcattgtaatatgcatgctcctcaacttaacacagggaaaacaggtcgagaagaaagtgaatggcttcttcgagcgctatcctgatcctcagactgcatatagagctgatcccaaaaagatggcagagtatctagcacctcttggatttcagcgtgtgaaaacaaagagaatccagaaattctctaaggcttatgttggagaagaatggacctatatcactgagctttgtggtgttggcaagtatgcggctgatgcttacgctatcttttgtgctggaagggctaatgaagtggttccaaaagatcacaagttagttgattattggaattatgtctgttttgagttaccgtcaattcaggtagcggtctccctccaggggcctgccgtgacggggctgcgacaccttgccccttgcgttgctggctcttgctgtgagctcttgtctggcagtaacacttgcgcggcgcttgcacttttggtgtttctctttgcaacttaatgttataatatatggagtatttatctaattactggggaagcctgtaagtaaagcttgaatgctggttacggtggccttgcattgatttgctccagaaattaatcaggcaggccgtaatttctagtgatcaagtggtaatcatggccaaatatatagtttctatttgtgggaattgtatgtgatgtgggatggttgcatgctgttcgattccctggggctaggattgtagcgttgacattggggaagcctgtaagtaaaaactaaacgacgtggctatgagctccacgttttctggacatcggtcacaaaaaggagagttgacactacgaaacagaatgtgttctc

SEQ ID NO: 2412 - DNA, 509 bp, Sorghum bicolor
  Clone ID: SORBI-28MAY03-CLUS40767_1
accgcccaagccaagaccaaagacatctgcaagaacagctcaaaggctaattgctcatggaatgggattgaagcagtttacaaactttggaacagatgagctgaagaaacaggaggaagagaggaagaacagaattgctgctcgacagtctatgcgtgatgaggcttggggttcggactaatccagagcatgtcaaagtggctggttgcatcaaatcgcggctgccagtttgtcacaccggtgttttagatgcttgtactctttacattgtttgatgtcaattggttccgagagatctgagacacaacaagagtggcatgaagtcatgaagacatagagatgtaaccagatcgcttgtcagagtgatgctgagtgcacagaatgttgtattggaatagtgatcggtacccgggatgggctttttgcccgaactgaatgcaaagtgcggtattcagtgaatagttcatagttgtacctgtagtggcagagctgcgaatgttagttctggt

SEQ ID NO: 2413 - DNA, 651 bp, Sorghum bicolor
  Clone ID: SORBI-28MAY03-CLUS40802_1
gaaaggtcaagcccttggatgaagtggtgaggaatggctttaccgatgcaatgcatgaaaagcaggttgcaggcttcaggaaggcagtgaagaatgtggggaaacacggttccaggttgaaattgatggatatcactgagccctttgccttcagggctgatgggcatcctggcccgtatagaagtcctgacccaaacaagaagacacagagagggccagatggaaaacctccacctcaggattgtttgcattggtgcatgccaggaccagtagacacctggaatgagatgttgctagagaccatacagagagaatttgagagagatagaacctgaggatagaaattgctggctacttttccaccacgtgaaatattctgcgctgcaacatcataggcatgtatcgcatcaattagcatgttgtgtttaccatagatagggacgaacatagtttcagatacgtaagattcactgtattttttctgacacattcttgaacatcattttcttgccaaattttgtggaccctgaagcccaaatagtggcaactgatattacttgctgtctttgtaccagtcagcctggtttggtgtaatagaatgaaactgtaacaggtggaaaggagagaatcattagctgaaaaattgcttta

SEQ ID NO: 2414 - DNA, 487 bp, Sorghum bicolor
  Clone ID: SORBI-28MAY03-CLUS40797_1
cttctaagagtgcactgtcatttctttctttcatggtcgttaacaccaactgcgaaggagcactatgcattgaggtcttatgcccaaagtctgaacaaaggacggggactccgagtaggattcaaggcctgataaacattgatttctgtttgatcggttctatttaggtgttcgtccatgtctccatgattctgaataaattggttactggtttcgctaaatattgcccattggtaacaacaccatgatggccttagctccttgtggtgttgtttcaattctgttcctgggtgcttacacagatgtggagtatttgctgaactagctcgagttcattccttttgcctagtttatcctgcattccttgacgtgtagaaacggacgtatctagatcttgttcctcgtttctttccttttttttttgttattaccgatcacatctgaaccttaatgtggttactgctactattaagaaatacagtagttc

SEQ ID NO: 2415 - DNA, 593 bp, Sorghum bicolor
  unsure (1)..(593): unsure at all n locations
  Clone ID: SORBI-28MAY03-CLUS40492_1
tgttcatcctccgccgccatcgcaacaagtctggacccggccggaaggatggggcgtagctggggcagatgctcgaggcccgagcctgccgcatggggagtccatggctaaccggcaggaggaagaaattcgtctacaaatgtttacctgcaccactgtatgcaatccccagtagcgtcctcaccccgccgtcacccgacccaagaaagtcaacacccgccgctgccgtcgcttccctgcggatccatgcagggtttatgaatttgacaggcgacgcccaggaataggttgaaagttgtctaaaaantttgggaacatgcgacgcatttccggattaatggagaaccagtcagctcaccctcggcatggtatggtcgatcaagggtttcgcccgttcactactactccactgagttcttctgtcaacgcagcaccggttatgatgccaatctggtcagcagacgatgggtacatctggaagaattcgtgtctgcaggagattccgggttcaggttcaggccgattgatctgctacgaatgttcgcaggcaaacggcatggtcaagaaatcggtggttctatctgcagatggtc

SEQ ID NO: 2416 - DNA, 605 bp, Sorghum bicolor
  Clone ID: SORBI-28MAY03-CLUS40532_1
aagctaaaaccagttgttacatttgactgcgctgagatacgtgcacgtgactggtgtaatgttgtcacatgccacatggatactccgcacgcggttggatggcgtcttcagaactttgttatcggtgaacatgttttgacaccatcgtcaagcactgtgacaccgattaaggcttgtgtaataagtgcatgtggtaattttactatcttgggcactgaaggtggttggatcgaaaaatttaaccttcaatcagggtttagtcgtggtagttacattgacacttcgttggcaatgcaatgtgcacatgatggtgaagttgttgggttagcttgcgatgccacaaatggctctctgattagtgctggataccatggtgatattaaggtatgggattttaaaacttgcaagctgaaatccagattggatgttggtaaatctgtcactaaaattgcatttcaccggccaaatggtcttcttgctaccatagcaggtgacatggtacttatattgtttgatacggtgtccatgaaaatggttcgtagatttgaaggacatacagaccgtatcactgatttgtgcttcagtgaggatggaaaatggctcat

SEQ ID NO: 2417 - DNA, 567 bp, Sorghum bicolor
  Clone ID: SORBI-28MAY03-CLUS40544_1
gcacgaggctcaccccccgcgtcgccttctccccttgcccagccctctgcgcgcgttggcgttgggcgggcagccagctgcttcccgcggctccccctcccctccaccaaaccctaatcattccggcgccgcccgcgcggccggccggcctcgatccgctccagcggccggccgccgaggccgggctgcggtggttgcgcgtgcgctttcgcgcgggtcccgtggggctcggcgctgcgcggcgcgggacccgtccgcggcggcgcggcgaggcgaggcgcgggcttcagggcggagggcgcaggcggacgggtggatttgcgcgggcgatgacacggtggctcgcggccgcggcgtcgcgggcgaggccctgaatgggagtggctgagcgctgcgggcggctgcgtacatggaggccggggtaccgccccgcggctggcgcgggagggtgctttggctcgtcagcgtcgagattgtgttggttctagtctggactcgaggagctggtgcggattctggtgaaagcaaagcattgtttccacagatgtcgaagtgggagaaaaggat

SEQ ID NO: 2418 - DNA, 762 bp, Sorghum bicolor
  Clone ID: SORBI-28MAY03-CLUS40899_1
gcacgagggttggatacttttggtaaaaaagatagggaaattcttgattatttaacgccagatcgaatcgtgtccaacggtcattggaattgtttctatccttctattcttcaagataattcggatttgttggcgaaaaagcgaagaaataggtttgccgttccattacaatatcatcaagaacaagaaaaagagcgaatatcctgtttgggtatttcaatggaaataccctttatgggtgttttacgtagaaatactatttttgcttattttgacgatccacgatacagaaaagataaaaggggttcaggaattgttaaatttagatataggaccctagaggaagaatatcggacccgagaggaagagtataggactcgagaggaagactcagaagacgaatatgagagcccagagaacaaatataggacccgagagggagagggcgaatatgaaatcctagaagacgaatataggactctagaggacgaatatgaaaccctagaagatgagtatgggatcctagaggacgaatataggactctagagaaagactcagaggaagaatatgggagcctagagaacaaatataggacccgagagggagagggcgaatatgaaatcctagaggaagactcagaagaagaatatgggagctctgaagatggctcagagaaggaatatgggactttagaagaagactcagaggaagactcagaggaagactcagaagacgaatatgggagcccggaggaagattct

SEQ ID NO: 2419 - DNA, 951 bp, Sorghum bicolor
  Clone ID: SORBI-28MAY03-CLUS40896_1
gcacgaggcctggaacaagttttggctctctctcgatgctgagaccgagtccatgatgtcaggagagggcagccaagctcagcacaccaatcttggctctcgtcttacatcccctgatatgcaccgggatcgtatcaacgacagtgttgctccaggagattcagcctcccatgttggcatggagtcccctccccgctccatcctccccgatgttctcgagcatcaactccccgaagaactccccttccccttcaagttcaaggccccctccggtcgggtacaccgcatgaagatcactgctacagaaggcatcgaggctttcgttgatgccattgcctctaaacttggtgctgaggcagacagcattggcggagtacctgatgtagaggacggcaagatcgtgggcgctggctttgccatgagcttcttggacgatgaaggagactcgatttctatcacggctgatcacgatctgctcgaggcggtcatccttgcccgccaagcccatcatgataaggttgatctctttgtgcacgatcccgagaagcctcctgtatctgcagctgaccctagacatcctgctacgccctcggtctctaccggggctggccttcgggagcgccgcaagtggtggcccgaagagaacgaggaggatgaggacgattcggaggaggagcatcccgtacgaagacgtaagagtcgtgcggcgcatgctcatgcgcacgaagagcagatcattgccggtgtacccaatgagctgatccttcctggcgccattgttacattggcgattactattgtaggtgtctttaccattgcaaggctcaccagccggtaaagacacttttgactttcctcataacgacctgatgaagacggggcgctgtttagtgtagatatgcagaaagagaaagaagtgcttcatagtagacattacccttaccccttgca

SEQ ID NO: 2420 - DNA, 751 bp, Sorghum bicolor
  Clone ID: SORBI-28MAY03-CLUS40904_1
gcacgagggcggaacccgcgagggatctcgagacgctgaaacagatactggaggcgctgcagctcaaaggcctcctccaccacacccctccgccggcgcctgcgcaggcacaacgcacccctccgccacctatcgtcgtcatgcgcccgtccaatcgcgcgccgccgccgcagatgtcgccgccctcgcgggggctgactcccgctcggcggctacgcgtggacgtcgaccgcgcgcgccgccctcgctcgccggaccttgccgcgtcccccgcacgtagcccggcctccccggctcgccgtggctcgctgtccccccagcggcgcgtctcgccggcgcagtcccccacgcggcagcagcagactccattcaggaagccaagcggattcgactccgccggcgcccgctcccgcattgcccgccgcgcggcgcacaacgccgcggccctgtcccccgacgacgaggcctcaaccactttctccgacggcggcagcagcagctccttgagcgcctcctcccgctgggacttcgagccgccggactcgaggacggaccgcggcctgctagagcggtgcgggaagctgctgagcagcatccaggctttcaccggcggcgacgctgggggttccgaccagcagcctagccccgtgtccgtgctggacgcggcagccttcctcgcagacgaggactcgccgtcatcgtcttcggggttgtcaaaacgagccatcgacttccgcagcagcgtcgggct

SEQ ID NO: 2421 - DNA, 486 bp, Sorghum bicolor
  Clone ID: SORBI-28MAY03-CLUS40947_1
gcacgaggcctaggtcccaatcagctcaagatgaactattggaatatacagatgaggaagtgctggagaagttccaaccaaatgagaccctggaacattttgtgctagttaaatatacaggctatgtgtttcctacatggatgatgaacaaactgacttcactcccataccttgtcaacctttgtttgttccacctgcataactgcagtgcactccctccaattggccatctaagaaatctccgctacttgcatattaaagatatgcccaacctcagagatctagagatgggtctttctggggggcctgtgtccttggggaaattgactcacctcaaactggaagcactgaatttagaagagctgtctatactgttgtcagccaacaatgagagtccctgtttcatgtttcccaatcttgaggagttatccgttctatcttgttctaagcttgtcttcaaccatctctgccaaagtgtgcgaaata

SEQ ID NO: 2422 - DNA, 568 bp, Sorghum bicolor
  Clone ID: SORBI-28MAY03-CLUS40995_1
gcacgaggcagtcttctgcatgcacatgtctttggtcacaaaggctccgttgtcgctcgctcgcgccaccatctccagccttgctactcccttagagcctcaagccggcccaggcaaaatgtcgtcgagcggccgccagaatgttacttgggtagagggtgttcgtggtgtagcttccttctgggtcgtcgtaacccacttgtgccgggcatgggactacagcctctggtcgccgcgcgacaacgagaacgcagccccccaattgcttcagctgccctttatccgcttgcctttccaaggccgtattggtgtaaccatgtttgccttccttactggctacgtttgcgccatcaagcctctccgacaggcaaagtccggaaacataccggctgcgctcgagacactgggcaagtcggccttccgccgcccacctcgattgatcatgcccgccacaatcgccctcgtcattgcctggttcttcgcccagctgggtgcttttgaaatcgcccacctcagcgactcgcactggttccgccgctccgttcctcacaacattggcagcctcgac

SEQ ID NO: 2423 - DNA, 586 bp, Sorghum bicolor
  unsure (1)..(586): unsure at all n locations
  Clone ID: SORBI-28MAY03-CLUS40997_1
tgcacgaggcaggagcaggaatcacagcagcagcaatgtgtgcaaacaccacaggatcaacaaatgcaacaacagaagcatctgcacaactttcactccttgccagatgcattatcggctttttctcagctttcctcagccactcactccccatcttccacactgcagacagttccggcattctcgcatcaacaaaactttccagatacaaacattagctctctctcaccatccagtggctcttccatgcatggcatgttggggcaattaccttctgaagcagcttcgagcctcccatgtgtggcaataaacactcctgtatcagtatctgacccatggtcatctaagagagttgcagtggagtctgttaacccttctcgacctcatgttgtttcaccacagatagaacaattggatatggcatcatgtaacatgccacaaagctctgcattagcaccgttacctgngagagaatgcttagtggatcaagatgggaactctgatcctcanaatcacctcttatttggtgttaacatagactcacagtcacttttgatgcaaggtggcattccaagccttcagaatg

SEQ ID NO: 2424 - DNA, 691 bp, Sorghum bicolor
  Clone ID: SORBI-28MAY03-CLUS41015_1
caacatcgaagctgagcttagagctgacactgcatcgccgcctctctctctcatctaccacagctagatcgattgccgggccaggctacgcctaggaagaaggatggtgatgatgtcgggactagctgctgcctacagcgtaacaccgaccgggaccgcgccagctccaggctggaagacacgggcaccacagccacgagtcgctttccagcggcggcggcgtacgacgagtctgaccacggccacggccacggccacggccatgccccgcgaggcgatgacggcgccggagaaggccgacgtgctgcggtcgcttgacgggtgggccgagtcgaaccttctgccgctgctgaagccggtggaccggtcgtggcagccgcacgacctgcttccggactcggcgtcgccgggtttccacgaggaggtggacgagctgcgggcgcgcgcgcgcgagatccccgacgactactacgtgtgcctggtgggcaacatggtgacggaggaggccctcccgacgtaccacgccgccctcaacagcttcgtcggctacgacagcccctccagcgccgacgcctggtcgcgctggtcccgcggctggaccgccgaggagaaccggcacggcgacctcctgaaccgctacctctacctgtccgggcgcgtggacatgcggcgcgtggagcagaccatccac

SEQ ID NO: 2425 - DNA, 533 bp, Sorghum bicolor
  Clone ID: SORBI-28MAY03-CLUS40669_1
aagattttgtggcagcatggtacagaatgcatcaaccatagtaatcagctggagtcctcaagctgcggtaaacaatcaatagccttgcaaaacacaaacaggaaatctgcaagcagagaactctaacttggaagaccaagtgcactacggaggtcaaatgcaacatatatctttttgaatgtcgctgattatgcctttgcacacttgcagaatcaacaatgactgactactttcagttttcaaagataaaaacacattacaaaattcgggtcttgacagaatgcaggcaaagaaaacaacacgagctgacacctcctaacagaagccaatagcaaatgaattagcctcacactcttttctttgaaacagggaagttgaatttgcttaaggagaacccacagcatgacttccccaggagcagctttagactagtcttagactattggcatttgattgatttctgaaaaaaaaacatattgatttactatttgcaggtatgattattgtgagttataccctccatgcacatataa

SEQ ID NO: 2426 - DNA, 681 bp, Sorghum bicolor
  Clone ID: SORBI-28MAY03-CLUS40683_1
catgggggagccgccgtcaccagcaagtccgacgtgtacagctacggaatgatggtgctggagatggtcggcgccaccagaggcggtggcggaacgggagcgacgaccggcggggcgagcactgccaccagcaccaggtacttccctgagtggctgtatgaagatctggaccggttctgcgcggaagcagccgccgccgcctgtggtcgtggtcgtggaccggatgcggaggaagccacggaggaggtggtgaggaagctggtgatcgttggcctctggtgcatccgcctctcgccgcaggatcggccgacgatgagcagggtcgtcgagatgctcgacaagacaaccacggcggacctgcagctgccctcctcaaggtcaggtctccatgtcgatgccctcacaagcccacaagatggcccacgctctggtgcccggcccacaaaactttcctgcatcggacatatattactcatgtcagcgagcttgaggtccgtcccattgagtgaacttggactattgaattaacaactagcctataattaatggattaacaattagtctgatttaattagttacgtacttcttctattttaaattataagccattttgctttttttttacataaaaattgctatgtatcaaaatagatgtatcaaaaaaagaatcaaaatgacttt

SEQ ID NO: 2427 - DNA, 712 bp, Sorghum bicolor
  Clone ID: SORBI-28MAY03-CLUS40688_1
ggaccctactggcgccggagacagctttctcgcgggttttgcaaccggactgctgtgggggttgtcggcgaccgacgccgcgctgctggggaacttcttcggcgccgctgcggtatcgcaggtcggcgtgcccaccttccatcccaagatgttgcaggcagttaaagaaatacttgaagagaagacaacaaaacgatatagtccgtgtataaacggcaccagttttaccttcgagaagtcaaatttgcacaatgagttacacgcagctctccaagaagcggcgatgctgatgtctgaacagcagcaggctgataaggccaacggcaatggtggtgatatttgctcgccataggaactttacttcacagtgaagcagtcagacgccaaactgaaagttcgtggcaaaataacccagcactgcaatacagatctcacattgaggtctgtaaacacgttgccaacaagtggagaaagtttgtacattagtacatacgttctatcggcttatactagtgtactgctggtgaggccgtgagggttcgtttctacctgctattgctgaggagaaagtgaaaagcagttgagctgtgacgcttgtacgcatccggttttattgagctttctggcatcgtgcggttaacgttttaccattatatgtcgacttttatcaagatctagcgtttttaccctgccgacaaggggatttatgacg

SEQ ID NO: 2428 - DNA, 744 bp, Sorghum bicolor
  Clone ID: SORBI-28MAY03-CLUS41064_1
gcggatgcgccagcgtggcggcggcggcggcgacccagacgacacgtggcggcaccaccgtaagctgctgtgcggcgcggtggccgaggccctggagcggcagcggtcggcgtgcccctgggagcctgcggcgtggctccgcggcgccgagctcgtcgcccacgtctgggccgaggtccgacgcgccggcgagcccgtggtggtggtggcccgtggcgccgccgccgcgggggaccccgcggacctcaacgacgtcacctgcagcgccatccggcgcgacctggccgcggacggcagcggcccgtggggttgccagcagaagcagcggcacggcgcggaggtcgccgacgcggtgctgcagatcgagcggctggtgttcaaggacctcgtcgccgacaccatccgcgagctcgccgacgcggaccggccccccgtgctgccgcgccggaagctggtgttctgaattctgatcacgcggtagggcatcggtgtgacgtgcagagccgaggagaattttaagagaagcgatgaaggaagattaataatcgagttttgaacttttggtttgcgtctctttgtactaccggcgccgtcttcaattagcgagtgatgtaaaattatgacctctagcttactatttctttttttcttaaccacgtctttataatgttgttattagttaccagtctaatctgtaccgctgttaattagaagccatgtaacggtggatgatgatgattacgg

SEQ ID NO: 2429 - DNA, 629 bp, Sorghum bicolor
  Clone ID: SORBI-28MAY03-CLUS41051_1
tgccgcagagctttccacagtgcgaatcgaccgagaaaaggagaggggtcagctgaaagaacagaacagaaggctccgcattcagctgcgagacaccgctgaagctgttcatgctgctggagaactgctcgtcagattgagagaagctgaggaagcatctacactagaaaaggaaaggactgctgcgttgttgcaagagaacgagaagctgaagaagcagctggagaagcttaggaagaagcacgagatggagctggagacgatgaaggtgcaccttgcggagagccggctgccagagtcggctttgggtgccttctaccaccacgagaatgagaggacaccggagtactcgtgcgatgctccattgacgcacgacgacgatcagtcttggcgggcagcctttgcatctgcctacgagtgaatggagtttcttgattggattgcttgggagttgagactcgtcaactgagcctggttgacaatggggaaatggggatttcttggacctttctcttttttttttcccctttctacatgacgtttaattataatatggacaagaacatgtaactgattcatctgccatctgtctgggcaaaatttcggtttatactgtagtaaaatgtatt

SEQ ID NO: 2430 - DNA, 605 bp, Sorghum bicolor
  Clone ID: SORBI-28MAY03-CLUS41113_1
acttctccaggcagcaggctgcccaaatcctcgacgaggagatggccaaacagtggcgctgacaggtgcaaatacaacttctaatctcttgttgacatgggattttctttgacgggaacaagcagttttcaacactgagagagctgttccttggcgttgcccccgtgcccattctttgtattgttgtgtccatgctccttgccataagattttgcccccatttgggtgttcttatgcgatcggatgactgacacctcatccactgaccagcgtacataccgctctgttcttcttcaatgttaagggaaataaatactgtctgtcgggaaactcttgtggtgtttctttttctaaaacgaaatattttaccatcttctttagtgagccggcaagtgcaggcacatgggacctgagatttacttgaaaggtacatcagaaatgtgcagtgccagttaacactaggatataggagtaatttaggccttgtttggtttcataggtgaaaagttttggagtgctgtagcattttcgtttgtatttggtaattattgtctaactatggactaactaggctcaaaagattcgtctcgccaaattatagacaa

SEQ ID NO: 2431 - DNA, 501 bp, Sorghum bicolor
  Clone ID: SORBI-28MAY03-CLUS41148_1
gcacgaggctccccgcgccccacgacgactcaccgagccggcgcccagtgacccttccagaagcttccagaaggtcaccgccatggccgcgcccttcttttccactcccttccagccctacgtctaccagagccagcaaggatctgtgacggcgtttcagatatccggtggagatgtgcaggtcctgcaggtgatgctgaagtctcaggagaagctgactgccaaaccaggtacaatgtgctacatgtctgggaacatgcagatggacaacaattacttgcctgaaaatgatggaggcgtgtggcagtggatttttgggaaaagtgtaagcagcaccgttttctttaattctggatctgatgatggatatgttgggattgctgcaccatttcctgggaggatactgccggtagatctagcaaactttggtggagaacttctttgccaggcagatgcttttctatgttcagtcaatgaagtttcagtctctagtacagttga

SEQ ID NO: 2432 - DNA, 564 bp, Sorghum bicolor
  Clone ID: SORBI-28MAY03-CLUS4115_1
cgctggcaagcaactacctggggctcaaggaccacaagcgtccgccgcaggtggaggaggggttccacgccggcgcccgcctcagccccgccgagcttggcgagatcatgctcgctaaccgcgggtccccaagccgcgcactccgcaccgtcatcagcgcgctgcagcacgtggcgccgtcaccgtcgtcagcgcagccgcagcggaccagcacggcggcgcggccaccgaggctgacctcgagatggtccgggcacctcgatgtggccagcgccgcggcgtcggatgaggccagcgcggcggaacagtcaccgcgaagcggaggcgggggaggtttcgccaaggacacgccgatcagggagatcaagaagctctacggtatgatcaagtacaggagtcgaaaggacgccggcgtcgtgccggtggacgacagcgcggcgtcgctgaacgggcggggcagcgacgtttgctccgagaaggaccggtgattagttaattgggctttcttgttctttttctttttcggttttcacttttgataatgatgatttctaagtacaaatt

SEQ ID NO: 2433 - DNA, 1015 bp, Sorghum bicolor
  Clone ID: SORBI-28MAY03-CLUS41190_1
tatctgggaatagcaaatcatctgacacatctgcttctgtggacaaggccaatgctgatacagatgatgaggataacctaccttttgatttgagcattgattctggttcattgacctgtgttgcttgtggaattcttggctatccattcatgacaattctgcagcctaccagagaagcattggaagggatttcccttgctcgtatgagtagatacaagatgagttctgaaaaagataattgttcaaatacaattccatgctatcctgctgacagtaattttggatgttcatttgttcccactacaccttcctggcctgcggaacagcaatgtctggctactcctttggggcaggctaacatcagtcatcagaatgtaaattcacatgaagatgtttgtttaagggagaatgaacctaatgggcctgtgctacaacataatgtcatttcacattcttgcagaagtgaaaagcccctgcattcatgtagtgaaagggacaagtctgagaataagattcctgagaacagtcttggcccagaagtaagtgaacaagcaggcaaatatgacggtgatgcgcaaactgcagaaagttctgatggcactattaactggaatgcaagttgtacatttgcacggccccggatcttttgcctgcagcatgctcttgagattgagaagttacttgagggcaaagggggtgtccatgctctcattatttgccactcagattttgtcaaactaaaagcgctcgcaatatcaatagcagaggaaattgagtttcaatttgattgtacagacattccacttgcaaatgcatccaagtctgatttacatctaatcaacatttcaattgatgacgagggccatgaggaagatggaagagactggacgtcacagatgggtctaaacctgaaatattctgccaaactcaggaaagagaaatcagaaaatcaagaacaatctcctttgtcatttgggggactgttttgctgcccttcgcctgtttcggttgttcc

SEQ ID NO: 2434 - DNA, 569 bp, Sorghum bicolor
  Clone ID: SORBI-28MAY03-CLUS41197_1
gcacgagggtctcctcctcgacgcaggggaggacggccggctgctttgtatccagcgccttgttcgccccacccaccgacaacccggactgcgcgtccacgaacacactcgcccaacaacagaccaacggacttcgcttccaatgtcatcgtctgatttcttctgttcggagtgaatcacataagttgagaggtttcttcttcatccagtaagctcagtctgtacccagtactgcaacaatggtgcttggcctccgaaccaagacaaggaaggattctgccttccatgtggatttcaatattctcatccaagaaatcagcccatggcccccttctgaatccctgaagtctttgcgctctgtagtactcttctgggaaaatggcgagcgcaattcagggaagacgagcactgttgcgccttcaattgggtcaggttccgcagcagggaagattgaattcaatgagttcataaatctacaggctgttttccagaaggaggggtcatccaagagtggaaagtggcagaagaacctgcttgaattgaacttgtatgagccgagaagggataag

SEQ ID NO: 2435 - DNA, 589 bp, Sorghum bicolor
  Clone ID: SORBI-28MAY03-CLUS40834_1
caagaagagctcacaccaccaggtcaacgtttgcccggtgcaccgtggaatgtgttccccagcaacgacattctgcctcctcgaggccggcgccgtggagggactcctgggctgcctggagaatgacaacattcgagtggtggaggctgcgctcggagcactgtccactctcctcgacgagagggtggacgtcgtgaagagcgtagtggcccttgccgagctcgatgctgctcggtgcgtgcttgctgcgctgaggcagcaccgtcaaaacttgctgtggcagaagtgcttctgcgtggtggagaagctcctggagcatggcgatgaccgatgcgtgagggaggtgacaggcgatcggatgctgcccacggcgctggtgagcgccttccacaggggggacgagagcactaagcaggccgccgagagcatcctccggcgactacacaggatgcctgattactctgcaacctacgtatccatggagttctagtcgttgggatctagtaaatagtatcaaagtttgtgcatacgctgcttgcttgttcgaacagacttacagttacagttacagaatcacgtgaccggaaaa

SEQ ID NO: 2436 - DNA, 733 bp, Sorghum bicolor
  Clone ID: SORBI-28MAY03-CLUS40861_1
gttggtacgtacatgctaaaaaggaagatatgtcatcaattttacagggttccctcatcgaaatgactggccctaagagaggcatccaactggattatgatgttgtatttgagtttgacatgagaatcaagaacggggagcaacaggaaaatgatcttcagctaattgacggagtaacagaatttgatgaaactactctgccggggaaaccattcactactcgcattaatggtgatgctggtgcggtggacatgtgtttaacaaatgtttttggagttgaggctacagtagaaatcttcatatccgaagtggaaaatggttttgatttatctatctgctgtgctgtttcggtactggaggaacataaagaatttcagatttttggtgctcctattggtgaatcgtgtggcttaagaaggtttgtgattgctgtcgagagggatactatgatgcatttgaagttcgaggtacaccaacacggctcaaatgttgagcactgctgttcctttgaagctaaggtccatggatgtgccagccatgacataaagcttgaggtcgcttctctctcagtgaaggtgacttggtcgacgttaacggaatatactccttgcttgtagtatttagtttaagctgttttatgttctcttgcactggatggatgtgcgtgatcacatatttgcttttgtactggatttacatatgctttaacctacctttactatatatatatggt

SEQ ID NO: 2437 - DNA, 733 bp, Sorghum bicolor
  Clone ID: SORBI-28MAY03-CLUS40881_1
ttggtcaagagattgcagcagattttgcaatccggagagctttaaaacacgaatgcatgaaatagcattggattcaaatggcaagaggctgctggttacctccggtttggttcgggccccaatatatcaggtacaaggccatgaaagtggattgaggacactaccccacagttcatctatcacaagtgtggattggcatccaacactgccaatgtacatcactgggtctgcagaccactctgtccgggtcacatctattttatgatctataaaacaaggtactggcaacaatctttcctagcatgcattgatccttatcgacagtcttatccatgtgtgaggctcggtgtcatgatattttgtcccatggaagatgaactgtgtttttgttttgtcgctgcgctgtgtctagttctataccctttggtgggttgttccaacagttttgttgttgtaaacaggcctagaattagaattatgtgatcgtgtacacactagggaagactgaaatgtttcaggcctcttccgttattcgaacattgtctcatcaaaagcatgtgaaagatgaatgcatgatttccagtctccgtagtggctgttggtaagtaggaacaccttatggcctctgtccactgtaacatcgaggcctttcatgtttctcggaaaccatgttttgcacgaatacattgatgtgctacagtttgaggttgaaatttactgtaccaatgaaaca

SEQ ID NO: 2438 - DNA, 534 bp, Sorghum bicolor
  Clone ID: SORBI-28MAY03-CLUS40892_1
tggagatgaaaacactccttgttctatgggaagaagtggagaagatgatcaagttatcatagatgattttgatggtccacaacaggaagagcacaaagaagtatctaacaatacaaatgctaatgaagagctcggttctgacagaaaatctagtctatcaattagtgcctccccacggttgtcacctattcaggatcctacattgtgctcttctccaaagatccacaacaaggcaagaaaaagcatcacttcaccgggattatcaccaagcaagcttagagtatctgacagcccaggtgatagaaatgttgaagtgtgcagaaatagtgcagttcgttcctctctacaatcaagcaagcttagtcctactgactcactggctgcaagtctccaacgtggtttgcacattatagagtatcatcaacagaatccagccccacgaaaatcatttattggcctttcatttgaccattttgcggtgaatcctcgtcagtcaacagcaaaattcagtacagttgctcaggctctacctga

SEQ ID NO: 2439 - DNA, 516 bp, Sorghum bicolor
  Clone ID: SORBI-28MAY03-CLUS40699_1
acaaacctcttgacataattgctacaccataaaccccagaagcagccattctgctgagctccggcaagcaaaggaaccatatctgttctagggtgctacctctttgtctcgcgaatgaagtcgtcttaaatctcagcaaaaaatctacatgtgctagcagatttatctctgaacttcctgtgaatgtagaaatttatagaggtactagctttgactcactgccgcaatggcccaaaatgggttagaacataatttggccattctcattgttttggccttgttctgttctccagtagtccagtttggtccgttactttctcagtttatagccatgaatgaaactccttaagttttaggggcaagtaaactggtcttgtatcatagtgttctcctcatgtaatttcatgtaatcttgatttaatagacgatcccttcgagataaactgtcatgtaccataggtttgatcttgagacaatttaatgccgatgtatcatagtctatctttaagctgtttt

SEQ ID NO: 2440 - DNA, 652 bp, Sorghum bicolor
  Clone ID: SORBI-28MAY03-CLUS41272_1
gcacgagggccgaacaaccccggacttggctacccgcgtccgcgtgtgctgtctctctctgcaacgactgggtacagccgccgccgccgccgccgccgccctacgccaggtaccgaggccttcgccgccgacgagcacccaccaccagggatggcgacaacagcgccgctccgggctctccggcggccctcgtccgaagccgcgctgcgattggctacaagggcaaatgtgcaaacaactaatggatatagacatctgaataacaggaatctaagtgttttcaatgagttttctaagcaactaaagggtgaggccaagagtaatcctgaattccagaaatccatgaaggagttcggtgagaaacttggtgtggtgaaggaagatctcaaagtaagaactaagaaaacgactgagacaatatacaagagtgttgatgatgtttggagtgaagctgaggagacatctaaaaaggttactgcaaatatcaaagaaaaaatgtttgctgctaaagaagaggtaaaggaaagttttggagtcggaaaagaagagagtacaagttgcagggatggttcgcctgaagcttcaaacctgagaaaactgggacatcctcgcattcagatggcacgtctgaagatgccacaaacagccatac

SEQ ID NO: 2441 - DNA, 643 bp, Sorghum bicolor
  Clone ID: SORBI-28MAY03-CLUS41278_1
agaggacaaggatgagtgcaatgaggaaaagacatcaaatggcagtgcaaaagatgtctctacagatggttaggctcgcccagtggctcttgctggaacaatagtctggaaatggcaagataaggccaacctcctccttccatgaactttgcagcttgaagttctcatggggtgatcaaacccaaatggatgctacgaaaataccctcttgagccaagttaagacaactagatcaactgcaaacgcctggaaggtttaatgatatggcatggcgtggccgttttgtcagatttgacttaagcgaattttgtctgtttggagcttgggtttggcatcctggaaagacacaagttgtgctgcagcatttgcctcaatggaccctattccaatggcagcacgggagatttatgttaacttgctgttgtgcaagagtagagttcacgccaatgaacaacctgtcgtaggccaataagtcaaccacagttaaattagtttttgtctgtgctagtacattagatttgtggtatacgacagttttcattgaaatatttcccaggatgtttgtggttctttagtgaccctccatgcttcttatgctgtaacatttggagagcacaataatcttatatgccttgcaggttcc

SEQ ID NO: 2442 - DNA, 603 bp, Sorghum bicolor
  Clone ID: SORBI-28MAY03-CLUS41290_1
gaccaacatggcgcttcttcgttctcacttcagtatgtgcagcgcatgcttgaagaatctcttgggtctgtccagaagaccatccatgagcatgtgagaaatctccacattgaacttttaagacagtttcacatgcaggagcagatggaaatgtcaggcgtgctgaacttggtcatggaaaaggtggaaggcctgacaaaagaagtgcagcaactaagaagggagaaccaacaactccggcagcagcttctctaatatgcttgggggcctctatttggtatttttatgctttgcagaagagtgcaatttgctccggagtcctagttaggcccggcgatggttgattctcatattgattgtctacgcatgacatataggaagctcgtgtttgagacggttgtacatagaatcctcttagtttagaagcatattgattcaattattgttctctgtttgtcgtgttgtgttggactggttccatgtatcttggtggaccttgggcagccttattttggatggcatatgtgaaaggattcaatgtaacttttgttaataggattccttgacgaggctaaaaatactcgtccttaacaatgccatatg

SEQ ID NO: 2443 - DNA, 612 bp, Sorghum bicolor
  unsure (1)..(612): unsure at all n locations
  Clone ID: SORBI-28MAY03-CLUS41302_1
gcgctggaccgccatcggatgggatctcatggtcacgggcatttggctgtcgccttctctccagagcatcttctctaacaagcttttcatgtgggttggccgcaacagctttgccgtctaccttacacacggaaccgtcatgaaagttggccttgcacgattgatttacggattcagcaccgcaccctactacgtggagcagccagaggacggacaaggcgaggctattcaacactatatccccaggaccaccaactggctcgtctggacagttgccattcctctctttttcgtcgtcgagtacaccatcgcccatctctggaccacttatgtcgactcacagtgcgctaaagctaccaagtggctcgaagataccatgtttgagaagattgaggacgagaagcatggcgccgcaaacatggcctaagcagccatgcacgatttttcaaacagtcatcatcgaccaagcaaccacggaaccacccgccggagaaacaaatgagaacctccggcagcggtccggtcccattgccaaaatacttctttcntgttgttgttgttttttccttttgttcagggtaacgatttcttttgttgggagttttcattatn

SEQ ID NO: 2444 - DNA, 618 bp, Sorghum bicolor
  Clone ID: SORBI-28MAY03-CLUS41373_1
gaaaatagacaaggtaatgagaggaccattttacatggattccttgaaggcaaaggagtttggggtcatcgacaagatcctttggcgtggtcaggagaagtacatggcggacatgctctccccagatgagtgggacaaagttgctggagtcagacgtcctgatccaatgtgatgttatacatgaaagatcaacatttagttaggctcaaagcttgcaggggacagaaacagctggcgctgaacaataatgcttgattatcaatgataatggttggtaagagccaagggatacttgtttaactaggtaaacttaacttagagctcagtgacgggggctgggccatcaagatgttgttaatggtctctggatgagagcaagcacgtgtttctcatgaattattgttgttccccacatcaattctagcccagattttggtatttattagtatatagtccacatattttgatcgacccagtggttgaactagccaagttcatagtattatcactttatcagcacgtgacgcgatgagcatatggtagttgaaattaacatggcccttgcgcggttgccctttgtccttgtgttctggacgttggaaatcctagtatggatca

SEQ ID NO: 2445 - DNA, 626 bp, Sorghum bicolor
  Clone ID: SORBI-28MAY03-CLUS41321_1
tcccccggcgtcgcggccgcgcgcgccgcgccgccgcccgacgccgccctgcccgcgctcggcggcgccatcgcccggggcgtcctgcggcccgccgccgccttctcccgcggcgtgcacgcgctcctcgcccgcacccccgccgccgccgcgcgcgcgctcggcgtcttcaccacgccgggcttccccgtccccgccgacttcttcgtcgacggctggggcgccgccctgctccgccccggccccgccggcgcgcggaggctcgccctcgactcccccgcccgcttccccgaccgcgtccgcttcttcgccgaccggggcgcccgcccggggctcgggccccggctcgccggcccgcggcggctgccgccgggctgcctctgccggtcgcccccggggcggcgcgccctcgcccagctccacccgcgtccgccgcggccgccccggcccccgcagcctcggcaggcccccttctcctgggtgtttgacaggcaggtggagctgcaggcctagccgcagctactgctaccatgttgtgttattattacttccctgtgcgctgcgccctcaaccagaaccagctacttcctcctcgtacggctgggtcgactcttctgttcccgtat

SEQ ID NO: 2446 - DNA, 804 bp, Sorghum bicolor
  Clone ID: SORBI-28MAY03-CLUS41020_1
gcacgaggatgttggactgcagcaacaaatcctcacaatatttaaaaagtatgagagttatattgatgttgaaatacaacagagagcagttgaatattttgaactaagcaggaaaggccctgctttggcagatgtgttggctgaaatgccaaaattccctgaacgtgagtctgcgctgttgaagaaggctgaagatgctgaaattgacacagcagagcaaagtgctataaagctacggcgccagcaacaaacttccagtgctcttgttgtagctgatcacccccctgcaaatggatctgcaccaccagctaatcatctcactcttgtgaagatgccaagccaaactgtttctgacactcaggagagtggagtaatttatgaagaggctcccaagcctcccgttgaagctcccaaagaaaatgggactcccgtcgaagtggagagcagggacacaaacattactgaaatcaacaatgagattaaagctgaacctccctctacatctcattctacttctcccgcagacctcctggcagatcttttgggtcctcttgcgatagagggccctcctgctgtagagcaaaatcctgcccaaggattgaatgctaatcaaagtccagttgatgacttggcacttgctacccttgaggatcagtccaactcagttcagccaactgtcaacgtcgaggaaaagtttcacatattgtgcacaaaagatagcggagtgctgtatgaggatcctcacattcagattggtttgaaagcggagtggcgtgcccatcatggccgtcttattcttttcct

SEQ ID NO: 2447 - DNA, 1035 bp, Sorghum bicolor
  Clone ID: SORBI-28MAY03-CLUS41033_1
gcacgaggcactcctctcacaactcacgctccgatctttctacagagatattgaatctcgcccttcgctcactttaccaatacccatttaaacttcgtttacttcgaaaaggccgagtttatgtccatcgaaaacctcaagtccttcgaccccttcgccgaagccgacgaagataccggcgagactaaacaggctcagagctacattcacattcgaattcagcagcgcaatggccgtaagactctgactaccgttcagggtctgcccaagaagtttgaccagaagaagattctcaaggtcatcaagaagcagttcgcttgcaatggcaccatcgtccctgactctgagatgggtgaggtgattcagttgcagggtgaccagagaaaggatctccaggagttcctgacctccaaggacggtctcgagctcaaggccgataccatcaaggttcacggtttctaagcccatcaccaacgttctgccttgttccggtcccctcttcccagttcactttgccctgtgagcggtgggataggaagcttgcccatgcatccctcatccgccggccgtacgctgtaccggcgttctcgtcgatcaggtgtcttgctttctccacctacccctcagtgcctggcgtgttagacctgggcctttgtcgaaacccctccttacccctatgtgtcccctgccgaccgttcccgcatggtcagttgggtgagcgggattcgaccgatatttttgaagtacgggattatgatggaacgaggcgttggtagatacccaatttctgcatagacagacaacactatttcttttttcgtttttcacgattgtgttctccatccttatccttattcacaagcggaaacttttctgcctgccttgctgattgccattgcatccccatggttattttatcaacttggcttctcggggagaaccaggctgaactgagggcatgctttgctgaactttgttatcggtctctaccgtcttgcatttttcccctgtgctgccttattcacttgctacccc

SEQ ID NO: 2448 - DNA, 643 bp, Sorghum bicolor
  Clone ID: SORBI-28MAY03-CLUS41042_1
aatgcgcggggtgtgcatcgactgacgagtgggtggtggtactgggtactgagcggttcttgcaagaaagggggtcatggcgcgagcgccgagcgtgccggcagcgacggccgtggggatcgtggtgctgctgaccgccgccgccgccgccgccttccgcggcgcggaagggaaatcgtgcacgaacgcgttcccgggattgacctcgtcgcacacggagcgcgcggcggcgcagctgcagcgggggccaccggcgacggcgctccagcccgtcgttcaccgccacggccacgaccacgaccacgggcacgagcagcacctcaccccgaccgacgagtccacctggatgtcgctcatgccgcggcgagcgctgcggcgcgaggaggcgttcgactggctcatgctctaccgcaagctccggggagccaccgccggcggcgcgccgcgccggcccggggttgcggcggggacgttcctctccgatgcgtccctgcacgacgtgcggctggagccgggcagcctgtactggcgagcccagcagaccaacctggagtacctgctcctcctggacgtcgaccgcctcgtctggagcttccgcaagcaggccggcctgacggcgccggggactccctatggcgggtgg

SEQ ID NO: 2449 - DNA, 1110 bp, Sorghum bicolor
  Clone ID: SORBI-28MAY03-CLUS41430_1
gcacgaggcgttagaggaacaactccagttagtgaactcggaagctgcaaaactgcgtgacatagtgactgcacttgagcacgatgtggaaaaggagaaggtattttctgcagagctccagatgcagctagaagctctagaggctataaagaaggtgttggagtcggaagctgagtcagcacatcaggatgccaaaattctcagccagaaggtggagtcattggaagcaaaactcaaggagcagatgtcgttaaccgacgaattcactgccaatgtagagactttgcagtcagataggatggctatggagcataaacttaaaacagcagacagggaactcataaaattgacaaacaaggtgagcatgctccatagggagatcgagcaggagagattactgtcagaagagtatgaacagaaatgccgaaagctggaggcccagttatcaagagatagccgggatgcaaagctctggcggctcgcaaactcgaatggagatctgaaggttaagaaggagaaggagctcgctaacgcagctgggaagctcgcagagtgccagaagacaattgcttctctggagcgtcaaatcaaatcactgacagacctcgacagtgtggtgctggagcctgaaaggcttgaatccagcagggacatgccattgccgctggacttcagaaacaatgatgctgaatttgctatgtttacggatgacttgtacgactttgaccttccaaacaacaacgcgagcttcttttctccactcccgtcgatccagtcctcgtccccaccctcggagatgtcagtattcgcaggagggctctcgactcttagcagttacaggagcaaaagagcaagcagaaggtgatgaaaaaaaaggctgctcagatgccatactaacaaacagttcatggatgccgccatatgtaggtaggtcgatgtacattacagaaactgattgctagatttgtgtgatgaacatccattccagcaagcgcagttttttatagcctgcttgatgaggtcttgtgtcggtgacggttagtgtgtgctgcaaaatgtaaaatcggttatctgtgtgtgattccagttacaggaaagtgcagaggaagg

SEQ ID NO: 2450 - DNA, 981 bp, Sorghum bicolor
  Clone ID: SORBI-28MAY03-CLUS41447_1
acttcaagagtagcaatattctcctggacaaagatttccatgcaagagtttcagactttggtctagccaaacttggatctgatagagctggtggtcatgtctcaactcgagttttgggcacacaaggctatgttgcaccagaatacgcgttgactgggcatttgactaccaaatcagatgtgtacagttacggtgttgtgcttttggaattgcttactggcagagtaccagttgatatgaagaggccacccggagaaggcgttttagtcaactgggcattgcctatgctcactgaccgagaaaaagttgtgcggatcttggatccagcattggaaggtcagtattccttgaaagatgctgtccaagtggctgctattgctgccatgtgtgttcaaccagaggctgactataggccattaatggctgatgttgtccaatcgctggttccacttgtcaagaaccgttctaatcagaaagcttccaaccccaacgtgcaatcatcgaagccacttgactaggaaagcatgtgtttgatctgcagtctttgcccgtctttctggaaccctttgtcatctataactaactactgccgaggcagatatccccatcttaacaatgattttgtctgctggtgcgctcctgattttgtagggtgtgttgtaagcaggtagccaggtaggttgcaaatttaaagggaatctggttgaacggtcctgagagcttatttgagtttgaagggaagtttctgtcatgtacaattagctgccatggtgatggtgggtagctgcctagttgggattagtacttgttgtggggagttcgtcattagatggtaggtttggtatgagctggcagaactgtttgtagagtactgcactaatttccttttggcttatttatgttagggaagtagcttagaagatcgttgtgcacttgtacagggtcttaacttttaagctgctaagtgttgtgtatcctgtc

SEQ ID NO: 2451 - DNA, 406 bp, Sorghum bicolor
  Clone ID: SORBI-28MAY03-CLUS41524_1
atctttggagagatcgcaggcatgtcattcagcccggacgcggaggccctgtttgtcggggtcgctgaccggacgtatggcagcctgatcgagttcaccaggaggcatcggtacgactacttcgactcctatctatgaagctgcaaggcgcgtctgtggtgtcagtgtgtacatatagtggcgtgtcgcgtgtttgtacatgaacattcgggtgtctgcaactgggagctggcaccgcgaaatgtgcctgagctagatggtctgtatgctcggtaagtttgccaaaggcagatcatataaattagagcaagtattatagcaggctgtaagccagctaaaagctgaggtggaggagagagaagaggagagagagtaaaagtgggcctgtaagcttacagccagcttg

SEQ ID NO: 2452 - DNA, 855 bp, Sorghum bicolor
  Clone ID: SORBI-28MAY03-CLUS41529_1
cgccgcgccgccgcgccctcctcccgcccgctcgtcgacgacttcttccctttcccctcgtcgccgtcttcctcgccctcccgcccccgccagcgggggccgtcgctggagccgtccagctccgactccggcgccgacggtggcgccgccggctcctcggcttccgacaggcgccggcggaagctcaagctcgtagtcaagctctcccagctgcccccggaccagcaccaccgccgggccccacctcccccaccctactctgacggctccgacggggcggaggacctggccggggacggaagcggcgacgaggagcaggtcaaaccgcccaagaagcgccggatcgagccgcgcgctgacagatctcgccatcgcgaggttggtggtggtgggaggagcgaccccgccagcgcgccgcggacgaagcggccttcggtgccagggaccgcgaggacgacgccgctgccggaccggaaggcgctggagatgattctcgagaagcttcaaaagaaggatacgtacggagtgtttgcggagccagtggatccagaggagctgcctgattaccacgatgtgattgagcacccaatggactttggcaccgtcaggaagaagctggccaggaatgcatatcgctcgttcgagcaatttgaggtgagattgctaggctttggttgtatatttaggcagcgaatggacaatgaaataccgtattgcggtttgttggccgttgaagtgttacttttcagttcatttttcttttgtcgtaagcgaatttgatgtgtaacggtctcccaaagcagcaacctgtgatatgttagatttgataaagagagtcaggtttgtcatgcagcc

SEQ ID NO: 2453 - DNA, 356 bp, Sorghum bicolor
  Clone ID: SORBI-28MAY03-CLUS41532_1
gaagtgcaagctatgaggtcttgttgactttggacaaaaagaagcacaattttgatggtcctatatactattatgtgttcaattcccttctattttcactacttgttctccacatatattggtgggttttaatatatcggatgcttgtgagacaaatcatgacaagaaatgttggagatgatgtgcgatctgattcagaaggagaagacgcccatgaagattgattggcggcaccattttagcttgtgtgttataacggtgctagaaacatcaccccccaataccctgagcttatacattcttttgctggattccaagatttcgtgcagattatgagaggacgagcattgttctca

SEQ ID NO: 2454 - DNA, 556 bp, Sorghum bicolor
  Clone ID: SORBI-28MAY03-CLUS41550_1
tgatgaaaaatttatacccattgctaaaggctatgatctgacgtccattcgcttgtcctaagcatgtcttcaggctccaagttgattaacaaatgatgaatggtgtgtttctgaggcttcaaaaaaatcatatcttcaatgataattaaaatataatttttgcgctgcaatttacatacatatacttttactaaatgcatctacatggtgttcaagtggaaggcaaagtattttgatgtcaataattcggttgcaggctcaaattgactaaaccaaatatcaggtatgaaaggtgacaatgcatccccatcttgctatttattattgcgcagggtgaaccgacatgtagaaatcgatatgttcttacagttcttattagtgtgcagctaatatctctaaaataaattgcctttattttttctcgaatacgcaggacgactgcgtatcattgtattaatagaaggaaaaaaacggagccgtacagaaactcaaggaaaccacacacgcagactcacgcgcgcacgcgcacacacacaaattaaacttctattaacag

SEQ ID NO: 2455 - DNA, 760 bp, Sorghum bicolor
  Clone ID: SORBI-28MAY03-CLUS41234_1
gcacgagggtcctccgggtgctattcttgtttttcttcctggagttgcagagattgacttgttgattgatagattatctgcttcagttagatttggaggggcatcatctgattggatccttcctttacattcactacttggaccctctgatcaaaggaaagtgttccagtctccaccagataacttccgcaaggttattattgccacagacatagcagagaccagcattacaattgatgatgtaatatatgtagttgatactggaaagcacaaggagaaccggcacgagccacgcaagaaaatgtcaagcatagttgaagattggatttctcgtgcaaatgcaaaacagaggcggggtagggctggtcgtgtgaagcctggtttatgtttctgtttatatacaaggcatcggttcgaaaacatcatgcggccatttcaggtacctgagatgctacggatgcctttgactgagctgtgcttgcaaataaaatcacttcatcttggtgacatcaaatccttcctgctaaaggcagtagagccccctaatgaagaagctatttcctctgcagttgacttgttatacaaggtcggagcatttgaaggacatgaagagttgtcacctcttgggtatcatctggcaaaactgcctgttgatgttttgattggaaagatgatgctttatggtgctatcttcggttgtttatcaccagttctgtctgttgctgcttttctgagttataaatctccatttctctcacca

SEQ ID NO: 2456 - DNA, 884 bp, Sorghum bicolor
  Clone ID: SORBI-28MAY03-CLUS41221_1
tgttaattttggattgtcagccctctgaggtccctttacagcaggattctacaactgagaaaattgacaagggtgagaatgcacataaaccttgtgatatcagtcctcagaccaatccccagaggcccattgccaataatgtctctccagcaaagcttgcacaaattgagcgtgagagctcaacaggaagtgaagattcctctgagtccagtgatgaaggcgaggccattgttgaaaggagccgacctcttgtaagatctgcttcacctagaagatcagcttctccaatgcggagggttcaaatcgggagatcaggatcacgtcgatcaacagcaattgccatcaagagcctcagttacttccctcctagtcagaggattcctttggataaagatgatgaaaatagtacctgcaatggtgaaactgaccagccaccaaggaaatctgacaataacgtaagaaggatgagtgtgcaggatgcgattaaccttttcgagagcaagcagaaggatcagaatccggattcacaaaataagaaagctggcttgtttgctactaaatctgtcttaagaaggtggagtgcaggaatgggtgattctttgaatgaaaaatcagaaggaaaagtctcagagtcgacatctgaaagtaaatcaaacatggcttctgaaacagagaaggttggagctgaaatgaaggctgaactagataacacaccaaagaattttgttacacctgaggttgaagattcaactttccatcctaattctcatgatattggagtaccagaaacagggagcactgtttgtagtaatatttgtgcagaacaagcaaagtttggactggaggaaagtagtgatcgggcaatggcctctgcagagtggaac

SEQ ID NO: 2457 - DNA, 651 bp, Sorghum bicolor
  Clone ID: SORBI-28MAY03-CLUS41256_1
gcacgagcgtcccaagtccaaaacccacccagagccagagccaccatcgccgccgcctcggtcgcgattcccaggcggcaatggccatggcccggcgttctgcctcccatctcctatcctccttccgccccttttccctcctcctccagccgcacctcgctgactccccctcgccggcggccgcggccgcggcggcgtcagctcggcgggcgatgtcggcggcgtcggccctacgtgcacgggacgagaaggatgtggcgcggtggcgggagtcgatggcccggatgcggaatatcggcatctccgcgcacatcgactctgggaagacgacgctcacagagcgggtcctctactacaccggcaggatccacgagatccacgaggtgcgcggccgtgacggcgtcggcgctaagatggactccatggacctcgagcgcgaaaaggggattaccattcagtctgctgccacctactgcacctggaaggattaccagattaatattattgatactccaggtcacgtggatttcaccattgaggttgaaagggcactccgtgttcttgatggtgctatacttgtgctatgtagtgttggtggtgtacaaagtcagtcgatcactgttgatcggcaaatgagaagatatgacatcc

SEQ ID NO: 2458 - DNA, 580 bp, Sorghum bicolor
  Clone ID: SORBI-28MAY03-CLUS41270_1
gcacgagggcgtgtccctctctgggggtgcccgtcgtgcccccgggttgggggttgtacgggtgatgccccgagctccccaggtgcctgcagtgatggtacttctgctctctgtgacgggttaccccctgtgctgggcttgcgtcgttccggctctggtggccgcccttttgaccttctgcagcgggttctacccgttctccggcgtcctggccccgagcctcatgctatagtcccccaggtctctggcaccgggggttgtcttggccgtcctcggcgatggtctttcggagcgctccggtggttcttgtgagcttgtgcttctcccccctcgggaagtcccgggggcctgccaatcttgcctgtgtctgcggtatccggtgggcaaggctttcctcgtgcctgaggtgggggcggcccacattcctttcgtcatctcgcccaacccattctctgggttccaaaatcctatgtacattctaaagtcaccaagatctctattacctgagaaaatcaagtccgtacttggtgatgatcatatggaaagcaacgaagaaacttatgatatatatctacttcca

SEQ ID NO: 2459 - DNA, 675 bp, Sorghum bicolor
  Clone ID: SORBI-28MAY03-CLUS41605_1
ccttccagctgaaccaagagaagcttgtccggatgctcggtaacatccaatcgatgctccttgttggctggcgcctctgcaagctttacgagtcggggaaaatgacgccaggccacgctagcctagggaaggcttggaactccaggatggcccgcgaggtggtttcccttggccgagagctgctgggtgggaacggaattttggctgatttccttgtggcaaaggcattctgtgacctggagccaatttactcgtacgaaggcacatacgacatcaacagcctggtgaccggcagagagatcaccgggatcgcgagcttcaagcccgccgccgcgctagccaaagcccggttgtaatgtactgtatactgtacaacgtaaaccacctttgcagttgcagcagggatattttgatgaaaggtaccgtccccactcccccaatccgcatgttgcaaagtaaagcactggaagcgaatataaatcagggatggggtcgccgtcgtcactgttgcggtggcgctagaacaaaccgaggacgttccctgaacgtgcctggaaaccgccggtcagtgctggctgcttcatgatgtactacgtactattgtaccgagtgaagtttggatgggaacaaattcctgtatatgtaaattttactcctctggggaggcaaaagagc

SEQ ID NO: 2460 - DNA, 499 bp, Sorghum bicolor
  Clone ID: SORBI-28MAY03-CLUS41644_1
gttatgcccgggctgctggacttcggcacgcggcagagcttcaaggatattcagtgaggtcattgtataaggccttacgatcatttggtaaacagggaagtttagtaagagtagctgtttggtgcattggtgaatatggcgaaatgctggtgaacaatgttggcatgctggacggggaggagccagttaaggtaacagaatctgatgctgtgggtatcgtagaggtcgctcttaaccgctactcagcagatgtgacaactggagctatgtgtctggttgctcttctgaagctctcctcacgatttccttcgatgtcagagagggtaaaacaaatagttgcccagaataaagagaatgttgtgcttgaactacagcaaagatcaattgaattcacttccattatacaaagacatcagtctatcagatcatccttgcttgaacgcatgcctgtattggatgaagctagttatctggtgaagcgggctactgctacacaagc

SEQ ID NO: 2461 - DNA, 573 bp, Sorghum bicolor
  Clone ID: SORBI-28MAY03-CLUS41609_1
ccaatgccctcccatggccctgctccaatgccctcccgtgccccgcttcctgatagatatggagctcccgatcggtaccaccacacaccaccagccccagtatatgaagctggtccgttttcttcttatggtgaaccgtttagcgccccaaaaccattccagtacaccccagggtcagtagcagcatcatacaattcaagcccctataaagttgcttatggtggcccaggagcaccagccgcaagcacctatgcaggctatggaggcgcatccgggccagctggttccagcagctatgcaaactatctggtctatcgccctccgcaaccatagattcaactcatctccctcaaaaatgctgtgctggtatgcacaacgtggaaaccagtccctcccaactcccatgagacggagctgtaactttagtcattttcttttttcctagtctccacaccagtgggttttggaggtgtaacgggtggagtcgcgttttaggctgtgtgaggcgccggtcaaattataattgccctcatatcctgctacatgtaccttgcacttttatttgcttttagc

SEQ ID NO: 2462 - DNA, 542 bp, Sorghum bicolor
  Clone ID: SORBI-28MAY03-CLUS41645_1
gcacgaggagaggtaccgccttagggtttttccaatcacaacaactgtcaaaattggtatagtacacgatttttgggtgcgctctaccataaccttcttatgaaaattccttttttcatagtcatacatgtttacagttgttttagcttaatgaaataatacattgtacattgctggtgcatatagatgtacgcctgtatcatggattgagtatgagtgcagggctatatttattaacagctgacctaaggtgtagtgagccacaggatcacgttgtttgaccttttatttgaatgttctttacaagttgtttgctgttgcgtaaaatcagaggcattgtagtttttttagattcaggcattttgctgactgtaataccttagtatttcttaaacttaatgttgtactaaattccaaaccatagtgcatgcatgcctgaatgcaggggtgacagacctagcaaaagaaacaccagatatgttacagtcagaaagcttttgtcattcattctacatatattgtaaaaaaactccattttagtt

SEQ ID NO: 2463 - DNA, 427 bp, Sorghum bicolor
  Clone ID: SORBI-28MAY03-CLUS41666_1
gcacgaggcgaccatggcgattgctcggcggcgccggcgccggccgtggttcatgggtgccgcaatggcatgcctggcagcccagagcacggcgtagcagcacaagaagccttctttcgcagcgaggcgaatcctgcaccaaagtcaacggcaagacagcaacttggaggagcaggagattgttactattacagaaaaaggcgcgatcccaagtgcagagctgcacgttccagcaaagctgtcggctcttccaagaggagttcgagcagggacctctccgatcagtcggaagcgcacgcgcgccggctgctcatggacgccggctggcgcatcaggccacggataaggaaggaccgccccagggtggcatattacttcaccgcgccgcagagggaggcggtgctggcctcgctgtcgcaggcctgga

SEQ ID NO: 2464 - DNA, 551 bp, Sorghum bicolor
  Clone ID: SORBI-28MAY03-CLUS41687_1
gcacgaggcaccatagaagcattgcagcttctggctaaaggcgcgggcgccgtattaggtccacaatcttccgctgttgctcatgtcatttcccatgctgtcaatgaactccatgtcccacttatctctttcgcagccaccgatcctgccctttcttcccttgaatacccatattttgtgagggctacacatagtgattactaccaaatgggtgctatcgctgccatcattagtcaatatcaatggaaacaagtcattgccatatatgttgatgatgattatggtagaggtggcatctcagtactaggtgatgcccttgcaaaaaggaagtgcaagatatcctacaaagctaagttgccacctggtgctgcaaagacttctatcaaggatatcttgatgcaggtaaatgacatggagtctcgtgtctatgttatccacgttaaccctgactctggtcttaacgtgttcttagctgcaaaatctttgggcatgatgagcagtggctatgtatggatagcgacagactggctttctgcagtgatagattcttc

SEQ ID NO: 2465 - DNA, 563 bp, Sorghum bicolor
  Clone ID: SORBI-28MAY03-CLUS41683_1
attccttcctccctcccccaccctcccgccacacgcaccgccgcgtccgtccccccacgccgtcgcttcccggccggtcggctccgatggggtacgtgctgtcggcggtggcgagggtgctggagcagcccacggcgtggggggcggcctgggagatggcgctcctcgcggggcccctctgggcggcggccctcctcggcctcctgctcggctgggcctggcgcccgcgctgggcagccggcctcgtcgtcgccaccgccgacggcggcagcgccgccgctgctgcgcaggcgctggcgcagccgcccttcgccacgctcgacttctggaaggcccagctccccgcccgtctccgcgccccgcttggctacgccggcgccgccgtgcagcagagggaggaggacgaggacgccgtgcaagggtcgtcggagatggcgaacgaggagctggccgtggggaaggatgacctggtgaacctctgggggctggtggagggcagggacggcggcccggcttggatcaagatgatggagaagtcgctgcccaccatgacctaccaggcg

SEQ ID NO: 2466 - DNA, 573 bp, Sorghum bicolor
  unsure (1)..(573): unsure at all n locations
  Clone ID: SORBI-28MAY03-CLUS41388_1
catggtaatccaacatcagacaggagtggttgttatagatggatggttgaggctgtctgctgctgcacagactgctgttttattcaagcaacttcggataactcttgatgctgttttaaaagaactgacaagaaaaccagagatggcaacttttgttgacaatgaagtggtcaggtccatcattcatttattgttagaagaaggcaaggctcgataagcatgaattcatggtcattgaattatattgtagacaaaggtggaaatgtagcagaatcaaccgaaggacttcgggagaacattaaggacccagatttaagttgcatactaccaggccttggatcaatatcggttctcgccgttgtgcacgttccacagtctgcacagcattcttattgcacaatgtggctgactgctaatgtggaaactgcaaagcggaaatggaggtttgctatatattgatgcgttgcttgtttttatatggaagaagtttgcgtcaatctagtaattgtgtaataccctggccccaaatttggagcttgagcttgcatgttcnaaaatacagagcagataaca

SEQ ID NO: 2467 - DNA, 648 bp, Sorghum bicolor
  Clone ID: SORBI-28MAY03-CLUS41398_1
ggaagcgagccaagaccctagagaaagcattcagcagcatggagggcgtgagctgcaacaagttagagggtgcactgtacttgttcccacggctccaccttccctctgccgcgatcagggccgctgaatccaagggagtttcacctgacacattctacgctcaccgcctgcttgacgccactgggatcgccgttgtgccgggctctgggttccaccaggaatctgggtcgatccatatccggtgcacgatccttcctgacgaaggcaaaatcgcatcaatgatcccacgcctctgtgcgttccataaggcgttcatgaatgagttccggggttctcagcagcgcatgcacgatctccgccgttgacgatgtcgatgcatatgcaatggtacggttagaccgagtgatgtgaatggtgaatctgaagctatggcatgtgtgtgctgtgtacatgcatgggtaatcagggtgcctgggctctggcagagttatttgtacctactattatgtgtttagtgttcttgctttctagttgagagaggtgcccctttatcctcacttttgttgtatgacttgctgcagtgacctgcctatatatactggttaaagttaacctgagtgttcagggataatatatctactgtggtat

SEQ ID NO: 2468 - DNA, 667 bp, Sorghum bicolor
  Clone ID: SORBI-28MAY03-CLUS41413_1
ccatcctcgtcttgtgttagtcctttagttacagcacagaactctgtccagcgaaagcattatgctagctccatccagcatgagcctatacatagaaggaatcctcctcatactaacccacctgcattgcctgatctgtggtcttcccactcgcaagctctacccagatttggatctgcacctcctgtaaactcaagttcagttttccagcagcgacctccttggttggctgcactggtcacagttcgtacagctgttcctgtctgctcagccaggccaaatgtgggaacagctccagcaagacctgcttcccagaaccgctctgcaccagctagggctgagcccgaatctcgtacccataatggggagagagatctgaacagtgcggcaatatcgagttctgaattcaataaactccacatttgagctgcggttttgtttctgctgaactttttagttagggctgagacttgcagcatctcagttttgtttgcttctttatttagttagataggttcagcccttgaaagagttgtgcgagtgcgggccagtgcttgcacccttagattttcattttacatataccagctgtccagttccttatgaagataaatgggagaattgtaatatagaaaatacagagttctttatacatgtgatcaatatc

SEQ ID NO: 2469 - DNA, 604 bp, Sorghum bicolor
  Clone ID: SORBI-28MAY03-CLUS41437_1
ggagggtgaaggtatgatccaagcaaggttttgcagagctgttactgagatgcaaatcactggccttcttcggatgccaagcaagagaaggcccgatcttgtgcagagaatcacgttcggtccttgatggttccgtgattacatgcatgttatacaggctcatgataatcccaccatgagttgaacagctgtggaaagaaggttcgatcacttcaatcgatgcattgcccaccaggaatctttgcaagagagccgtgaaatggagcagctgccacttcagatatgctgtgctgataattgcatggaacggctaagctatgtcattgtttttccttaagagcagtattaaacatgttttgcagtattggacatgttttagttattgattcgtgctctgtagagctgacatcggatcatgtagcccaaggttatctattttgagtgttcatatccatagatcctcctctaactcaagggcacaaccgcacaactattttgatgtgcacttgggaacatgcagagaagatggtcttggcagtgtttggtggtaaatcccatttatttgccaacaattttctaccttatttctgtcatcatttattct

SEQ ID NO: 2470 - DNA, 730 bp, Sorghum bicolor
  Clone ID: SORBI-28MAY03-CLUS41777_1
atatatgggaaatatatattagcgccatgttcagtcatggttcaagaataccaattccttgattttcttcaaagaggggttactatgttttgccattctatgcaatacttatcagccggaacaagagtttctctctcacaacaaaccaacatcagccggactccgcatagtaaagtgattgaagcgcaaactagataagatcacaattccatttccaaactgtaattttcaatcccctgtctatgatgtgaagattttgtggaatctattaggtcagggaaatcttgcactcgacactaaaggagactttcaacggccaaatgatcatcagcgtgtatgtccgtctgtttggggggcaatgttgtacggagtacctctgctcgttggtctgctgggattttcaggtcgatcattgctgtgtgtgtggtgggccccctacgacggatccgctgtcttgtgcagcacccaaaaccctaggtccatttccattggttgttggatgacaacatcatggcttttttttttttttgttgggacgtccctctcgtgcttcatcattggggaggaaatattgttctttggtagacgtacgtacacttttgtctacctgtatgagtgtatggtgtaccaacagctgatcagctcccgtctgcgtctcgcagggaatcttttccagacttattaaatacacggtattgaaaatattaatattgtgctgtttttttgagct

SEQ ID NO: 2471 - DNA, 681 bp, Sorghum bicolor
  Clone ID: SORBI-28MAY03-CLUS41793_1
gcacgagggctattaccagcctaattatgattcactggctggtgcatgggagtgggctagaaagacgttaatggatcacgctggtgataaaagagagcatatctatacgagggagcagctcgaaaatgccaaaacatctgaccctctatggaatgcatctcaattggagatggtgcaccatgggaaaatgcatggatttatgcgaatgtattgggccaaaaagattctagaatggactagtggacctgaagaagcactttcgatagcaatatatttgaacgacaagtatcatatcgatggcagggatcccaatggctatgttggttgcatgtggtctatttgtggcctccatgatcagttccataattaaaggcctgggcaaatacctgataccctttacccgtaccttgacccgaattacccgaacccgagggttggaaggagcgtccggtatttggaaagatacgttatatgaattatgctggttgcaagagaaaatttgatgttgatgcttatatttcgtatgttaaaagtttggttgctcgggcaaagaagaggaaaactgaggaatatctgaatccacggtcaaagaatccaaagtctgagttgggtcagcagttgaacatgtctaaagcattgatataatttgaatttggtgcagtggagtgatgtacttttctt

SEQ ID NO: 2472 - DNA, 640 bp, Sorghum bicolor
  Clone ID: SORBI-28MAY03-CLUS41802_1
ctactgggacctaactcttgccctcagcctacgagttacgctcagactctccctcttcgcagttcgcacacgcacggccgccgccgccgccgcttcgcacaccccatgccgtgaggacgaggaggtcgagggagcggtcggggaggagggagagcagtgggtcgagcgccgtctccgtgctccgcggccgcatccgcatccgtcgccgcagcacgtccatcggccgcatccgtatctggtattggcttcctaagggatcaatgtcgactatctctgatcagaaaaaacgcacgttggaagcccttcagcaacagtatactgctgcaaaagctaagaaattgcaagatgaacaggttaagagtcagaagaagagcaatttcaatacccctaagcctaaatttgatgcaccaaggaaaggcaaaggtccagaaatcactcctcgtcaaacatatgcccagccttctcctcataaaggggtagcattttccagttctaatcgccaacaaaagccttctgcatcctcaggtgaccgacccacccctctctctcgcgctctttctgggcccttgcatcacgtgttggcctgtgttcctgtcccgcatttgcttggcactgtggtggttcacagtgttatatatga

SEQ ID NO: 2473 - DNA, 570 bp, Sorghum bicolor
  unsure (1)..(570): unsure at all n locations
  Clone ID: SORBI-28MAY03-CLUS41826_1
ccccgccgccccgccccccgccgcctccgcccccccgccccgccggcgcccccccgcggcgcccggcccgccgccgcggggcgccgggccctccccccggccgccgcgccggcgcccccccgccggcgcgcgccgcccccggcccccgccgccccgtgccgccgcgccagctcgcccccccggtcctcccggccgcgcacgcgggcgttgcggcggccgggcggctccggccgctcccccccggggcgccgccccgccgccgcgcgctcggcgccgccccccgcggggctcctggcgctcggcgccggcccgcgcggcgcctggcggcgggcggcgtcgcccctgcggaggcgcatgcggtgcgagctgccggaccggccggcgccgcggcccggccccgcgctgcgtgcgccccgccgccccctcgcgctcaggaagatgcgcttcacggagggcgactagctccccgtcggcctgcgcggagtctttggaggtgttgttncaaacatgcatatgcactggaaattccacgagacagtgcaagtttgttgtgacaacttcccaaaggaa

SEQ ID NO: 2474 - DNA, 760 bp, Sorghum bicolor
  Clone ID: SORBI-28MAY03-CLUS41833_1
ttttgatgcatttggattttgcaagaatctataaaggagcactttcaatacagtctgtacaaggctacaagcttattattttgtttcagtttattcattttgtctcttggcacaccctggtataagatatagatttggggacagctaggacattttgttcattctaatttagatggtatttgtgtttactgttcatttcctgcgcttcgcagtaaaagtaaagagcagggttatatacaactacaagattacttggatagttgtattaaatagtttttgcattgaaccctagagccactgctcttgacatcatccatgcacctggctgcggctgtagtgccgcgggtacacgcctgccgtcccacagcttttctggcgcactcctctctgccgatgctgcccatacccctctgtggccctgaggccctggagcgcacgcactggccgccccccgctcggctttcttccgttcgcggtcgggctttgactgtcccgcactagcggtgggatgcccgcgctgtgtgggcttctccgggccaggcacctggtgggtggcacatagatggtcaaaaacgctggatcggtaacagtacgttcgccgatgtgctcgtggtattagctaggaatgcagatacacaacaactaaatgggttcattgtgaggaaaggagctcctggtctgaaagctacaaagattgagaacaaaatcggtctcaggatggttcaaaacggtgatatagtatttaataaggtgtttgtcc

SEQ ID NO: 2475 - DNA, 946 bp, Sorghum bicolor
  unsure (1)..(946): unsure at all n locations
  Clone ID: SORBI-28MAY03-CLUS41874_1
gcacgaggagcaaatccatgtccaaatggccccgaaacaagcgaagtattgtcttccaacaatgggagtacctatagtgaaaggaaggctgatggacctaaaaacccaggaccggaaaatgattcattgccctctacatcgaagcatgatcctgatgggaaagattacagaagtgaagtcggacaaaaacaaaggacatactcaggtccagttctgcaatctggtccgcatgatagttcgatgactgaaaggggccacattattgaaagggatgctggagttcgatctgtatctgataaacaaaagaatggtacaagaagagcccgtggtcttagtggtcctttgtcactttcaactcgtgcttctgcaaatagtctttctctttcaagaacgaataatcttagtggtcctctgtcactttcaactcgcgcttctgcaaatagtctttctgctcctattcgatcatctgcaggctatgtaggctctttgggtgataagcctaagcgcactatggtggaaattaaaggccgcttctcagtgacatctgagaatgtggatcttgcaaaggttcaagaaattccagggagcagtaccccacgtaaattgcaagaggggccttcactgagaaaatcagccagtgttggtgattggtcagtgaatgataagacaacgtctactaatcatcaacggaaggaactctgcaatagctctgtatctacatcaattctgattccccatcttcaaaaccttgtgaagcagactgcattccagcaagatctgattacgaacctactaagtagcttgcagcanaatgagagagtcgatgctcagtcaagagttcagagcacagggagtgatacagtggttgaagctgctactgctgagagagaacactcgttacttgttaaaattttgagttacaatctaggatgatttctttaaccga

SEQ ID NO: 2476 - DNA, 813 bp, Sorghum bicolor
  Clone ID: SORBI-28MAY03-CLUS41839_1
gctgctgtgtcttctctagcagaggttcggcaaaaatataaggtggagcttgctgagatacttgatgcaagtggaagcaaagacaaaaaggtaagtacctcaataaatgacaacaatgcatctcgtgcttcagaggagaatacccctgctagtgggttgggcgaggcatctgaagcttcacctgttgagactaagccgcctcctggattgaagcaactatgtgagcagatggacaccaaaggccttctgaaatttctttcagaaaattctagaaaacttgctagccttcgtgatgaactttctgttgcactaaaatgtgcaactgaccctgcccgctttgtacttaattccctggagggtttcttcccaccaccagaacaaactaattcacctgggagtaaacataacgctcttgaggttcagcgcaagagctgcattgttttaatggaagctatagcacctgcactagggacgacggagcctggtggcaacgacccttggagctctgaaattaaggagcaagccaaggcaattgccgaagagtggaagagtaagttagctgaggttgacctggatgcttctaatggctattcattggaggcacaggctttcctgcagcttcttacaacttttaatgttgattcggtgcttgacgaagatgaactatgcaagatcgtagttgccgtctctcgtcgcaagcagactgccgtgtgctgtcgctctcttggtcttaatgagaaaataccaggtatcattgaggagttggttaagcggcacaggcaaattgatgcagttcattttgtacaggctttc

SEQ ID NO: 2477 - DNA, 568 bp, Sorghum bicolor
  Clone ID: SORBI-28MAY03-CLUS41568_1
atccggaaggtgttgggactgtcaaatatggggtttgtagtttcaccaaaggtaagcgatgaggatgaatcaaaaaggtatgagcaagaaatcatggaatttggaacgccgtcgtcggaatatgtgatcatcgcaaccattgcactattgaaccttgtgtgtctggtgggaggactatatcaaataatcctggcaagtggcgagaataaaatggcattgaatgtatttttcctccaagtcattctctgcggggtgctagtgatcatcaatgtcccaatctatgaagccatgttcctcaggaaagacagagggagaataccattctcagtcacactggcctccattggctttgtaatgctggccctctttgtaccattcttttgattttgaggtcaaaaaggcaccgagggtataacaaacactttactatccatatttgattgtaaaattttctgcctcgattaatatcgtgcaatttatactatacaaaaaatacacgatgcacaatgtattgtatgcaaggagtgcgttcagctgtctaatgtaaaagtaaaaaggtcctcgaaat

SEQ ID NO: 2478 - DNA, 477 bp, Sorghum bicolor
  Clone ID: LIB3481-035-P1-K1-D7
gcacgcgtccgtgccggacctgccggcgttcgcgacgggggcggtcacggggcccgtggtgcgccgggggggtccatagcgggcgggtgcgagtacaacctctcggagctgcggatggagtgccacatgggcacccacgtcgacgcgccgggacacatcaaccaggcccacttctccgccggcctcgacgtcgacacgctcgacctcgaagtcctcaacggacctgcattgctagttgatgttccgagggacacaaatataacagctaaagcaatggaattcctaaaaatcccgagaggagttcgccgagttttattcaggacactgaacactgacaggaagttgatgtggaggaagggaggtgacatgagctatgttggatttacagaggatggcgcacagtggttagttgacaacactgacataaagctaactggagttgacggtctatcagttgcagcatttgattacttgatc

SEQ ID NO: 2479 - DNA, 543 bp, Sorghum bicolor
  Clone ID: LIB3478-004-P1-K1-B9
gaattcctaaaaatcccgagaggagttcgccgagttttattcaggacactgaacactgacaggaagttgatgtggaggaagggaggtgacatgagctatgttggatttacagaggatggcgcacagtggttagttgacaacactgacataaagctaattggtaagaaattatgttcctgactgcatacagatgagggaaacctggtttttcttcctctcttttatccctgacactgctttgttttccttacatgttggttgccatctattcataacatttcgttttcatgaacctgacacacacttgccaggaatccataattggggacaaactttcagtgtgttctgagatatttcttggtgggtcaattgaaacttacaaaatactgctactgtcaattatgcaggagttgacggtctatcagttgcagcatttgattacttgatctctgcccatgtggtcttcttcaaaaccccggatataatccctgttgaggccctgaaactagacgacattgaggccggaatatacatgctggattg

SEQ ID NO: 2480 - DNA, 641 bp, Sorghum bicolor
  Clone ID: SORBI-28MAY03-CLUS41591_1
tactcgcagaggaggtatttttttgttctcttgcttcgacagtgaccaagtgctgccgttgcctccccagactggggtgtcccgttccttctcttcgtttttgtggccgtgcagtatgatctcgagctggttctgacgaagaacttccacgaatttgtgcacgagtacctgcaaaagccagagtttaccgagctgatgcggaggctgggtgcccttggtgatggaaggcaggaccaaagtacactgtcacaggatgagtgggaggtttcctatctctatctcgcatttgtcctgcggaagcgagggcaaccgcctgcccaacggagagccaacaacgcaaacagagggaagatgttcctcaccgagggtgacatcgaggttctcgggatataagcatgagtgtaccctaggagaatcataagtgtaccctaggagatttcaccctaggagagcctgctaacagcttaccgattgtatgctcaacagaccacagtccacaaagcacgaaagaaagttgtaacattagtggctctcatattgtttgtttctccaatttgtatcttctgtataacatcccatgtgtactttccagactctttttttctattgacaatgtcaatattaaggaccagtagactggc

SEQ ID NO: 2481 - DNA, 738 bp, Sorghum bicolor
  unsure (1)..(738): unsure at all n locations
  Clone ID: SORBI-28MAY03-CLUS41598_1
aggcagcaacagtgacgagttagacaccgaagatgatgatctgtgggactcggattacaaggggggagaaacgaactcaggagccccaaaggtgaatttcccaaatttccacagcagtagtgaggacagtgatgacaacaggaaaagcgatggcaagattggtaaaatgaagaaaaatactgatgaaagttgggatagtgactgagaactcaagaaagagtaatgttgatgtgatgcatgaaggtgagctccaatgattgtcaattctttcattggccgtatcactcatgtatttgtccaatggaaatcttgaggagctagaagaataaacatgattttccatgagaactactgtctgaacgtttgatcgttttcagacgtcttttgttccagttgtcatagtataacctgaaaaattggcagaaatcaaagttcaaagccagaatactgcatgactcgcacaagccgatcgaggacaaagtggcggatgtagtcggagttcattgttgagaaaattagcagatcgaggttcctgaaggtctcangatatgtaactcttcgatcacatttgttaattgtcatattcatgaaattttgatgtgaaccacaaaacatgcacatagatttatctgaaagagtgaaaggtcatgtgtatcttgcgtgacagagttaagactcattttcggtaaattgtccgagatgcacgttcttctctactgtgaaacttttactttattt

SEQ ID NO: 2482 - DNA, 729 bp, Sorghum bicolor
  Clone ID: SORBI-28MAY03-CLUS41949_1
gcacgaggccgcgctcgtccgcaacgtcaccctcgtcggccacctccagcacgggaagacggtgttcatggacatgctcgtagagcagacacacgaagtggacaccttcgactctgagggggagcgccatgtgcggttcactgacacaagggtggacgagcaggagaggcaggcccccggcaaggctgtgccaatgtcgcttgttctcgaggggggaaacggcaagtcatacctgtgcaacatcatggacacgcccgggcatgtcaacttctctgatgagatgactgcagcactgagacttgcggatggcgctgtgctcgttgttgatgctgccgagggagtaatggttaatactgagagggcaattcgtcatgcaattcaagaaaggcttcccatcgttgttgtgattaacaacgttgacagattgataacagaactaaagctgcccccaaatgatgcatatttcaagctgaggcatactctagaggcaattaatgatcttatctcatcatgttctactacagtaggtggcactcagctggtggatcctgctgctggaaatgtatgttttgcaagtggtgctgctggctggtcttttaccttacagtcttttgcccatctctacttaaagattcatgggattcaatttgaccatgagaaatttgcatctcgcctatggggagacctgtattttcaccctgattctagaacctttagaaagaagccgcc

SEQ ID NO: 2483 - DNA, 884 bp, Sorghum bicolor
  Clone ID: SORBI-28MAY03-CLUS41937_1
gcacgaggggaagcaggagcttgtcacattttctcagttcctggatagaatgtggtcaactgtctgcccatcaaagttgacatatctagctcagcatccattgtttgagcagataaaagagctcagtgaagacatagttgttcccgaatactgttatgctggcggaggtgaactccaatcacttaatgcttggtttggtccacaggggacagtgacaccattgcatcatgacccacatcacaacatcttagctcaggtcttgggcaggaagtatattagactctatcctgcttttatatctgaggacttgtatccacacacagagactatgctatgcaataccagtcaggtagatcttgacaacattgatttcaaggagtttccaagggctgaaaacctggaattcatggactgtatattggaggaaggtgacctgctttacatccctccaaaatggtggcactacgtcagatctctctccaccagtttctcggttagcttttggtggcgtgcagcagttcagccctcaggcggctcatagcttcaattcttatatatctcccatattatcagaatcagtttgcagacaaccaaagtaacctgacaggacccttcgtttcaggtgacgtccgcttttcaatggatgtcatcaccgatggccattgttagttttacttttaccacagtgattaaaatattgaaattgcctacatgccgtttgtaacgatgcgttgttcgaccatcatgctatcatctgattcttcaaagttgagaggttggagccttggagggtgtcgtcctcactgccacaatgtcatattaaaactgtaaaggtagacgtactgttgtggccacgggctaccaaccacataccgtttactgaa

SEQ ID NO: 2484 - DNA, 992 bp, Sorghum bicolor
  Clone ID: SORBI-28MAY03-CLUS41950_1
gcacgaggattttgtcaagtattgaggcttatggagtcacggatggatcagtacgaaatcatggagcagattggccgtggggccttcggtgccgccatcctagtcaatcacaagattgaaaagaagaagtatgtgttgaagaaaatccggcttgcaaggcagacggagcgctgtcggaagtctgcccatcaagagatggctctgattgctcggctgcagcacccttacattgttgaattcaaggaggcttgggttgagaagggttgttatgtctgcattgtcacgggttattgtgaaggtggagacatggatgagctgatgaagaaatcaaatggtacctacttttctgaggaggtattgcttaaatggtttgctcaattggtgttggctgtagattatttgcactcgaactatgtcttgcaccgtgacctgaagtgctccaacatatttctcaccaaagaacaggacatacgccttggagactttggcctgcccgaggcgggcacgcacctgcatggccctccttcggttgtagggacaccaaattacatgtgcccagagctgctagccgatattccctatggtttcaagtcagacatctggtctctcggatgttgtatgtatgagatggcagctcatcgacctgccttcaaggcatttgatatggctggattaataagtaagataaatcggtcttccatgggtcctttgcctgcctgttactcggtgtctatgaaaaccctaatcaaaagtatgttgaggaagagtccagagcatcgacctactgcatctgagatcctgaagaacccgtacctgcaaccttatgttaatcaatacctccccctttatgattcttcaaacccaatgcggatgccagagaaaccattacccacttcacggaacagtcagagaagcatgtctgacagccaaagcagtagcatttccagtagtgacattgacagtgcccaatcaagtgacagaagcacatcagg

SEQ ID NO: 2485 - DNA, 576 bp, Sorghum bicolor
  Clone ID: SORBI-28MAY03-CLUS41956_1
gcacgaggggagattgacgcatcgttagtacaacctggtgatgccttaaaagtgcttcctggttcaaaggttcctgcagacggtatcgtcatttggggtacaagtcatgtcaatgagagtatggtaaccggtgaatctgtaccaatctccaaggaagtatccagtctagtaattggaggcacaatgaacttgcatggtattcttcatatacaagcgactaaagtaggatctgggacagttctgagccagataatttctcttgttgaaactgcccagatgtctaaggcccctattcagaagtttgctgattatgtagctagcattttcgttcctattgtcatcaccctgtccttcttgacatttcttgcatggtttctatgtggatggttgggagcatatccaaactcatggtctgctgaaagtagcaattgctttgttttctccctcatgttctccatatctgttgtggtgattgcttgtccatgtgctcttggtctggcaacaccaactgctgttatggtagcaactggagttggggctagtcatggagtacttgtaaagggcggagatgccctg

SEQ ID NO: 2486 - DNA, 578 bp, Sorghum bicolor
  Clone ID: SORBI-28MAY03-CLUS4199_1
gaatccccgggttttcccacgcgtccagaagtttcctatccagtcatacatggggcgagataagaatttatggcgccgtaaacatcataatcttatcaaatgccttgacatccgtctcaagaccgttgtgttgactaattatcgaggtataaggtcacaagttaactttgcaacattctttgtactgaacgcaaagatgctggagtcaatgacatttcggtgtcgaaggtaccttgtgactgatggaattcttgcagagcagcaacggctgctacagctgcagaaaaaggcttcaagatgtgctcggttttattttactactaaaatatgtgagcgcaactttatgcatattaatcatgcccatgatttgtctaaaaccgacccctttgaatgtgaagaaacaaaggttggtgtatgtgcatcctttgagtagttactgcttgattcctttttccagtgttgaagtaggggggttgctaaaagaactatgtgtattgaaagatttgtgtaattgtggtagtctgacagtgtcccagtttgatttgctaatctatataatccacggaatcttcatgctc

SEQ ID NO: 2487 - DNA, 672 bp, Sorghum bicolor
  Clone ID: SORBI-28MAY03-CLUS42003_1
gcacgaggccgagatctactgctcttcccccactcccaggctcggctgcggcggtggcggctccccctcccgcctctcgccagtcgcctcgcgccctcgcctccgtcctccgcgctccggccagcgaccctgtggctttgaagtagttaaggaactgactgtttggatgatttgaaagtggcatctattcacgtttgtgtaagcaaaatggacaggaaagttgctagcaacacggagcttgattctgctgtcttccaagtatcctcgcctgacaacaggtatgaggcaattgcttgcagtaagggaaaaacagaactgatagcttctggtccttttgaccagttagttctgcacctggaagatgccaaagcattccaatcttgttcacaaagtggtacttttaaactgttattgactggggatgaaaagggctcttcctggtttaccaaatccaccttgcagagattcttgcatatcataaattcatgtgatacatcaaaatcggtcaatggagttttagacgagatgtcacagctggaggaaacgagaaagtttcatcagtcactctatgttaaggaggaacaaaatgttactagtggtgctttaacaggaggtttgtttggtactggtgccatagcacagcagggaaatgatgggcataattcatcggag

SEQ ID NO: 2488 - DNA, 579 bp, Sorghum bicolor
  Clone ID: SORBI-28MAY03-CLUS44901_1
gcacctcgtgttggcgttgctcgcctgggtttggatccgagcgggggggctcgggccggcggatgctgtagaggaatggcggaggctgtcgcgtccgcgggcaggctcgccatggagccctcgacctccgtcacgcccggccaggtttctgctattctgggctttctatgggttttcgcagcatgggcgtatgctgaggttctcttccataggaagaatactgcttctattaaaactagacattcagatgtcaatctagcagtaatggataacatttcagtcaaagcagaagaccagacaatgttgttggaggagggcggccaagcagtggttgcaaagccagcttacacttccctcacatcacaaatactcagacttatcttcatggaccagatgcttcttctggagaaccgtttaacactgagggcaatatctgagtttggagggtatctactttatttttacatatgtgatcgtacaaacttgctcggagagtctgccaagaattacagccgagatctgttccttttcctctactttcttcttatcatcgtagcagctatgacttcctttaaggtc

SEQ ID NO: 2489 - DNA, 476 bp, Sorghum bicolor
  unsure (1)..(476): unsure at all n locations
  Clone ID: SORBI-28MAY03-CLUS4490_1
cgtccgattttcccaacatagggcgttgaggcaaacaacctcttctactagtacaattcacgctgtggttcctcctgagaagttgtatcactcanattttgaaagttgcacatttcagcctgatgcttttcatttttttcttctttcaggacaattctgcacgttgttggatctctcatgaaaaccaccttgaagaaatttttgtgaattcaaattttccagagctaagggagtcagcagatctatcagaagtctctgatcgatgctatggtcttacactagcacctggagaacagatgattgctgtggtccgcagtttggatctgaaccttttgaaccagatgtatcaagtcaggacacaaaaggcggtggttgagttcatctggatcggtggccaatttgttggcattccactagacaggagcattgatatttgcagtccagagtctgcagacttatcctcaagtaaccttatg

SEQ ID NO: 2490 - DNA, 565 bp, Sorghum bicolor
  Clone ID: SORBI-28MAY03-CLUS44910_1
cgacgtcgccctggggtgcctctgcctcgacgccggtccaaccgaggcggagctcatgcgaagaagccgctagatctgccggcctctccacacctgcctcgacgcaagtccgggagggtagcgagcggatcgatgctcgcggagagagcaggggcgaggatataaggctgagcggtgcagagtagcggcatggcgcgcccgaagaagaccgcggtggctggcctacccgacgacctcctggtggagatcctctcctgcctccccatcaacgagatccaccgatgcaagtgcgtctccaaaggctggcgcgacctcatcgcggatcccctccaccacaagaagctcccccaaaccctccatggttttttcccttcctacgtgggggagttgggatctttcatcaatctgtctgggggatccgcgtcaaccttcgacccttccttcgccttcctcaagaagctgcctggcattcacaacatctggctcagggcgtcctgcaacgggctcctcctctttaggcacagcaccaggcttcgcgagcttggctatattgtgttcaaccccg

SEQ ID NO: 2491 - DNA, 554 bp, Sorghum bicolor
  Clone ID: SORBI-28MAY03-CLUS42121_1
attgttatttggcacttcgggggagtatgctggatttgatcccacagagcccacttcacgcagtgggggtaaagcaaaagcagtgcagaaaataaaacaggaccatggctacaagacagttgttatgattggtgatggtgcaactgatctggaggctcggcaacctggtggagcggacttgttcatctgttacgctggtgttcagatgagagagccagtcgcagcattagctgactgggtggtctttgattttcaagagctgatcactaagttgccataaattgattacttaccgcaatttatgacccttgcattcttggtgctgagcggctgaataattgcggccacatttcaagttgtagatttcactagtaattgttggagttcactgaattatcttgttgtaaagtatgtttttttctcaactttatttgcatgatcctgaaccacagatgtggttgttgtgttccgaagttgtcagtgaagttgaagtatcctctaagcaattgttgagtagtatatgttacatcacagtttaaatgctgaatgcatga

SEQ ID NO: 2492 - DNA, 608 bp, Sorghum bicolor
  Clone ID: SORBI-28MAY03-CLUS42113_1
acaattccaagacccatgtgcctcattcaccctgccaaatgtgatctgcagctattgcaatgattgccgggacctggatctctgccgcgactcaacactccagggtcaggagtggagatgcgcggtgccgcagtgtgggcagccataccaccgtgagcagatggagaacgcacttctacaggtggtccgccagcgagagcggctgtaccacctgcaggatctggtgtgcgtgcgctgcaggcaagtgaaagccgcccatttgtcggagcagtgttcctgtgggggctccttccggtgcaagcaagagtcttcatattttctcagcaaaatgcgggtgttcctgaaagtggcggtcaaccaaaagttccagctcctgcaagattgcgtgcaatggattcttgaagtcagatgatgcagtcagctactagtagaacacagttttagctgaagctaggatttacaactttgcataggctatagctccgaagaatgtatataaacaggtgtatacggtgccacgtatcaagttgatctttggtagagtaaaactgttcggacttcagaagataccagtttatcagtgatgataacgatgtgtggtacccagt

SEQ ID NO: 2493 - DNA, 457 bp, Sorghum bicolor
  Clone ID: SORBI-28MAY03-CLUS42129_1
tccgttgtgatagcaatgaatgatgcattgagccatccactggctagcagggtgtgggcactgctattgaacctctgcagcttcggagttcaggtttctcagcaagtcatcagcatatttgtgatccatcttccatcacgcgtcgtaatcttcagaagctttcatgtccagaaaagagtttggttctgcttcagcatggaatcaacatggatggtaattctgttcagcgcttcacacatgttttcgccatgcattctttgtgggtgaagtctgaagtgtgatatggtcactcaaattggcaaactgggccacaaatgcattaccaggtcagagacagttcagatctggggtagtagtgttactgctccttgaatgaccaggaacagggaaacacccagatttcatggtgtccaaggttacaggtcggaacctttgctaatcattattaataacaaaa

SEQ ID NO: 2494 - DNA, 485 bp, Sorghum bicolor
  Clone ID: SORBI-28MAY03-CLUS42160_1
gcctccagaagaatccggtgaaccggccgtccgcgatgcggctgctgcagcacccgttcgtggcccagccgcagacgcagcaggcgcagccgcagcccgtggccgcaccgccgtcatgatggcccgctgcgccgcagaaatccacaattccgaccgattcgattgattgattgcttcccgtcgtgatccaactggggcggcgggtggattgatctctcacctttggattgattgcctgattggttggatggccatgagatgtgggacctagggacgttcttcctagccattttgggaattcaggccctccgccacagcaatcatcaccgcatcatcatccattgttgttgctgttgctccaccaggaattaagttatcgtcttagcatttcttttttttcttcttcttcttctttcctcaccccaccttcatcctttcaatgttcatgttcttccaaatgataatcatatataatatgggttgtt

SEQ ID NO: 2495 - DNA, 547 bp, Sorghum bicolor
  Clone ID: SORBI-28MAY03-CLUS42165_1
tcggagctaggaatatatggagcctacttgcggaacaaagataaggtgatcttgaataatcagtctggctacttgatgcgcaccaaagtttcttcttcaaatgagggtggcgttgctgcagggtttgctgtgttggacagtgttctcctcactgatgagtgagacagcaaggtggcagagttatgagtaacacacctgacctgaattgttgacagtacccacagtcaaacgatcgtgatgtcagattggacatcaattgatctcggctgcaattgtagggaaaactgtgaatagcttacagaataacagacaatggctgacggagaagacggctgtgtcatgttgtgataatagtttcatgtattttttttatggtggttaaaaatgtaggggaaaaaaccccatgttgtcagagaaaaccctggaagagaaagaggacgcagtgtcgtcacagtggcatgcatgcattcataattcatataggaatagcagagccacgttgtgctaccaccagtgcagcagagcctgacgtttgttttgaactggt

SEQ ID NO: 2496 - DNA, 559 bp, Sorghum bicolor
  Clone ID: SORBI-28MAY03-CLUS42202_1
gatctcttcctttgcagccaagttgatgtcaaagggccaaggcgtcctgtgaagtaccttgtgctgcgagatgataacaacttcacggcagatgaactgcaggctctcacaaataacctgtgctacacttatacaagcggcactcggtcagtgtcgatcgctcctcccgcattctacgcccaaaagctcgcacatcgtgccctcgcctacctcgccaaaggctctgacacggcgtcagcatcaagctccggcagtgcaggtgcagatgcagctgctcctggtgatggtccgaagcaacttccagagataaagaaggagctgaaggggtccatgttctactgctagtcctttgccccctgaatagacgatgcattgctctagtgaaatatttctgagtctctggctgacatctggcgaaggatggcatctgcaagagaatagttgtcgtgttcttttcaagtactggaatggatggatgttttttgtttggtggtgtgatgtttcccttgaacagagccgtgtgtgtgaacacctatgttgaatcagttttttttgcagt

SEQ ID NO: 2497 - DNA, 739 bp, Sorghum bicolor
  Clone ID: SORBI-28MAY03-CLUS42223_1
atgggagagtcatagaagacatccggtgcatttattaagatgatgcatcacacttacacatatttagcaaggtgaagatgaggtgccttcgtgattggtatcgtggttctagctttttatcatagcggaggtactacatggaggttttgactgaatatttattctgctgccttgcttttctgccccatattcggactgttgggaaatgaggatatgtgaagcttgtttggcagtacatctttgaactttgaagatcaagcaatcagcactctcctttggaatctctatagtggtgctagagggcaagtaatgaccaaattgatagcctgcaaagcactttatggtttcacagaagctcaagtggtgggtgatacatgcggaatgtacatgtacatggaacgaaaggaaccaaacagtaggagataatagggctactgatctgcatagattttctttagggtcattatagtggtgccgccgaggcacttccaggttctctcattttcaggctaaaaggcatgacatataatgttacgccttttcccgctaataattgacatttgcaccagtttttaacgtgcgtgcaatcattcttttgccaatcatacaagctgtactcaggagaactgtagttgtcgagcgtgtctgatagtttttgtcttcgttccatgtatcgtgtggcctctcctttagcagctgccaataattgtaggccctgtcttattgcttcagattggaa

SEQ ID NO: 2498 - DNA, 697 bp, Sorghum bicolor
  Clone ID: SORBI-28MAY03-CLUS41880_1
ttccactagcgcgagcgaacacgcacacgcgccgccgccggccgctgtctcccgcggtcccgcccaacatccacatctcgtggcgacgagccacagctccccgccggcgcctcccgcccaacttccctcaccgctggacatctatagacacgctttttttttccttccctatttcttcgacgagggtttaggcgcggcgagaccaccgtcggccaccgcatctcgcacccaaaaccagcgcctccctcgcccccgccggcgcgccgccatggtgtcgcagcacggcatcctcctcgctgttaacatcatctccgaccacttcggccccatcgtatccaaagtgtgtggctgccttctgcgccacggcgcgctgtccctgctggagatcgggcgccgcctcgagctctcgcccgcgcaggtgaagaactccctcctcatcctcattcagcacaactgcgtccaggcctacacaagccccagagggggtggcgataagacggtgacgctctacttggccatctttgacaatgtcctgcaccggctgcgcttctcaaagttcctttctgtcgtccgtgtggatattccagagtcagaagttcttctcgaaggattacttcagaatggtaggctaacatttgagcaacttgtggagcgaacaatatttaaagtaccagaaggcagccccttaccaacaagg

SEQ ID NO: 2499 - DNA, 641 bp, Sorghum bicolor
  unsure (1)..(641): unsure at all n locations
  Clone ID: SORBI-28MAY03-CLUS4191_1
cgtccgcggacgcgtgggtcttgatacttgaagaaaagcatagccggggtctcacagagatcacagacgacttctgcccagcgctgancatgcggcaactgtaccggatcagtacgatgtactgcgacgacaagtatggaaccctgggcattccatcagaagtcatctcgagcatgcgaatcaagatgatcgagggctcgagcactccatcggcgcacgacgacatcaactcgttcctgctagacgatgacttcagcataccgttctccgtcgatgacttcacgaagcttatagtgcacgtcgacgtagcggacatggacctgccaccactgattcaggagagcaacggctccaaactgggacactgaactgatcgacaaacttggcagggacaaatatgcacgcccttttttgtgttgcggtgatgtacatagtgcgtgatatattacgacatataccacagttttgatatctgggtttccaacttttgattgcatatatatacggttttggtttttcttttttgactgatcttcagttctctcccaccttgagtgcctgattgggtttacgtgtgtaaggttgtacagaactgaactggcatataaagtaactatgtaaacaaagaaagcctttggttg

SEQ ID NO: 2500 - DNA, 823 bp, Sorghum bicolor
  Clone ID: SORBI-28MAY03-CLUS41912_1
cttttttcctttgccgtgccgcgccgtcccgtccattctgcttccgagccttccttctccccccctttcgccgccgccgccgcgtggttgggtgggtgtgtgctgtgctgtttgttccaacatcaccggagcgcagcgcagcgcagcgagcagccgaggagcggagccggagatgaggtgggcggcgttcctgtgggaaggcgcgtcccgggcgtccggcggccgccgcccgggggtctccaacctcctcctcgtcgtcgcagctgccagtagcggtggcctcgttgcctatgccgacgcccgagcagatgctgctgttgagaagccgcaacttcctccaaggaaaaaagttgtggtgcttgggactggttggggcggcaccacattcctgaggaatctcgatagcaggttgtacgatgtgcaggttatatctcctcggaactactttgcgtttacgccactgctcccgagtgtcacttctggaacagttgagcctaggagcattgttgagccaatccgtaggatcttggagaagaaaggtggagaaatcaaattttgggaagcagagtgcttcaagattgatccacaaagcaagaaaatccattgtcgctcgaatgttgggacaaatcttgaggggaatggcgagttctcggttgactatgactatctcgtggtagcagttggagctaggacaaatacattcaatactcctggcgtggtagagaattgccacttcttgaaggaagtagaggatgctcaaaagatcagacggagtgtgatggactgctttgagagagcaagcctccccttcctgaatgaagaa

SEQ ID NO: 2501 - DNA, 680 bp, Sorghum bicolor
  Clone ID: SORBI-28MAY03-CLUS41932_1
ttggcttgccgaggaccagcacaaggcattggtgaggccggaggagacacccaagcagaagaagcgcagtctcagcaaaatgatgggcaagccggatgcagccgaggatgaggccaagattgacagtgctgagcagctcgccgcaggaaagcgagagcggaagaagagtaagtacctgtcgccaccatacaccaacttggttgtgtttgacaagattgcccgtgaacccgttgatctgccaaaggcattggtgcccaaagctgctgaagatggcagaaatgtgtcgctattgccaggcagcattgttgtggaagatgtcttgctgctggtgcgaggcttaggggaggttcccaaccatatgggcgattttccaaaggatgctgatgaatttctacgtttgtttagaagcatgacattcattcatggtgctgactataagtcttctaaggcacatgaaagtccactcatgcgtggctctagaaatgttggcatgaacattgctgtggatctagtctctgattcacatgctgttctgaaacaaggcagttgtgtgtcaaagaggggcaggaaaaaggatgaagctgggagtggtggctcttccatcaagaggaagaagcgggagaagacctctcctgctgctacaattggcgctggtataccaaccactcctgctattccta

SEQ ID NO: 2502 - DNA, 843 bp, Sorghum bicolor
  Clone ID: SORBI-28MAY03-CLUS4229_1
attgactgtgcgacaggacggccagaagagcccatccggacggtagattgggaaggaaaagttgctctaatacagtgtgcaaaggctatgggaattcaaaagtatgtgttctattccatccacaactgtgacaagcatcctgaggttcccttgatggaaatcaagtattgcactgagaagttcattcaggacagtggtctggattatatcatcatccgtttgtgtggtttcatgcagggccttattgggcaatatgctgtgcctatactagaagagaagtctcgcccgggaactgatgctccaactcggattgcttacatggatactcaggacgtagctcgactaacgtttatagctatgcggaacgagaaggccaacaggaaactcatgacttttgctggcccacgagcttggacaactcaagagtgattactttgtgagagattagctgggcaagatgccaatgtaaccactgtccctgttgcagtcttgagatttactcgtcagttgacacggttcttccaatggacaaatgatgtggctgacagactggcattttcagaggtgctctcaagtgacacagttttctctgctccaatgaatgagacctaccagcttctcggggtggatggaaatgacatcctcagcttagagaaatatttacaagattattttaccaacatattgaagaagttaaaggatctgaaggcacaatccaagcaaaccgacatattcttttgataagaagtatttctgtgacctggggacatattttacagatctgtgcctcaaatgacagatgagtgagcacaatttttttctggatatttgcatttttgcatg

SEQ ID NO: 2503 - DNA, 616 bp, Sorghum bicolor
  Clone ID: SORBI-28MAY03-CLUS42304_1
tcttttatttcaactcagaaattcggtgtgcagaaagcacttcaaaagaatttccggaaatacatgacattcaagaaggattacaacgagctgcttctgctccttctgcgtacactggtcaaggatgccctgcactttgaagaaatcatggcaggatcaacctcgcgccttactcacgtcgaggtcaaagtggaggacctgaagaacaaggcccaagagtatgagatctatgatctgaagccgttcttctccagcgcgcacttcagggacaacagcttccttctggatgaagggcgtgggatcatcaggcatccactggcagaataataactgactttcctcctgtttagaaccggcctttgtcgttgtggccctgggatgaagttaacagccacagaggcctcctggatgaagagcgatgatcagatctgacatcatttcttataagctagcatacaaatgacgctggcagtcggcttctcaggatttagtgtctgttgtgttatattgaagagatcctatatttgaacgtctatgcactttgctgccatttaggtgtaactatacggtatgtcaaatcatttgttagataaatgatatgggtgtgactgcgtgc

SEQ ID NO: 2504 - DNA, 510 bp, Sorghum bicolor
  unsure (1)..(510): unsure at all n locations
  Clone ID: SORBI-28MAY03-CLUS42331_1
gcacgaggcaccgctcccacccacgcgccgtgccggcctccatcgctccacacaccgctcgcagccgccgccggcgagccgactgacctcctcctcttcctcctcctcctcctcctccccactgctgcgcgcgccacaggctcctcggatcctctccactcaggaccgcaacaggaacagagacgccacctggggtctccgacgctgcctgagcctagagggttgtcacatatttttggagagtctgcgctcctccctgccacaaccatcccatctccatccctgtgaacaagatggcacgtcagtcggcgctctcgctcgcgagagaccaggcgaaggtgggagcactgaagcgtctgaccctgggctcatccaagacggcggggcggaactcgtccgggcgcatcacctcttaccaccgtggcggaggggccaagaggctgcagaggaaagtcgatgtgaagcgggacacctcttccctgngcattgtggagcggatagagtatgacc

SEQ ID NO: 2505 - DNA, 539 bp, Sorghum bicolor
  unsure (1)..(539): unsure at all n locations
  Clone ID: SORBI-28MAY03-CLUS42335_1
gcacgagggcgcccggcgcaggcgaggacctgataacctaggctatgaaagtcgctgccttctcgctgatggcacggttgttgttagtgatggctacaatgatggagtagagggtaaagtcggtgtgagtgactctggtgttgctgatttgttcttcatcggggcaacactgcatcttaggggagctaagctggtttcacagcctctggtggcccccactggaagtgtccttgtgtataatggtgagatatatggaggaattcaggttgcagatgatgaaaacgacacacaagctctttttacctctctggaatcttgttgttcatgtgattgccatgctcttggtagagataaaacatgtccttgttgtgggagtggtgccacatcagttttgcaactcctttccacaatcaaaggtccatgggctttgatatactggcaggcagatgaagtcaaatacaatttggtttggccgggatgcatttggaagaagaagcctcttggtacattggcccacagctgatgattctcngttcata

SEQ ID NO: 2506 - DNA, 554 bp, Sorghum bicolor
  Clone ID: SORBI-28MAY03-CLUS4236_1
gcgcgtccggtgttttaggtctgtccaattctctagatagccaatgttatctgttacaatagtctgattagtttgatgtctttaaaatctcgtgcattttaaattttatacaaggttaccagcaatactatctgttcccctactctgatgcacacttacctggctagccagtgtttgtatgtgtaatcctttagttgatttttagttactttaagttgatgctgagtggctgtagtttgattattatcgagctgctatcagttgatctctgtgctagctaatctgcatattcttttctaaatgttgactgtagtctgtatgcataccacttctccacacctgccctgtcaacctatttgtgaagattttgtatgtctgccaattgccttactgatagattcaaattaggcttcatctttgtgttatgactagtctttgcagttgtggataacagttggcacaagcgctctataatagtgatattactcatatctttatggtgctgttcagttatcatttggtctgccaatttgtaaaggatatacctgttgatc

SEQ ID NO: 2507 - DNA, 428 bp, Sorghum bicolor
  Clone ID: SORBI-28MAY03-CLUS42418_1
gcacgaggatttccttttcttctcttccaagtacgtaacaaactcctgagtgagcgcgaggggatcgagttgcgcccatggcgaggcatcgccgtggcagagggcgccgcggtggccaccaggcctacccgccggtcgatgaggcgcgggtctccggcgacaacgggcgagacgaggcaaacccgagcggcgctgaggcggggaaccgcaacgagaaccgcgatgaccacccgtcgcgcgtcggccagagcctgccccgccatcgctgccgatatccgccaagccgggaaagccgtcgtggaggaggccgccgcgccgctgtggaaggagttcgaggcgctaggcatccacgtccaccgcgccgagcccgtattcccgccgcgaccagggtacggcgccgaggggacgccgtgcgtcgtcagggccaa

SEQ ID NO: 2508 - DNA, 963 bp, Sorghum bicolor
  Clone ID: SORBI-28MAY03-CLUS42382_1
gcacgagggccacatccatgaaccttggccgccgcgaggcacgacgaagccggagcacgacggcataacaataaaatcgcgggagcgcccggccgccttcgaatcgattccttccccccaacgccatgtcctccccctgcgtctcgcaccaccaccaggtccgcctccgcgccggcggccgcctcccagccccagccgcggcctcgttcgcgccgcccgccgcgctacgcgggcggcgccgggtggcacgcgccgcgatgagcgccgaggcgcgcccgggcgtcgcgccggcggaggagggggccgcgacgccggggcagcagcaggccctgctggcggagatggtggagaatgccgccgtgtggtgcgccgtccacgggcttgtcgtcggagatcgcgccaatcagagatcaggaacggtccctggggttggcctggttcacgctccattctcactgcttccagcgcgttttccagcatcgttctggaagcaagcatgcgagctggctcctatcttcaatgagctcgtggatcgtgtcagcttggatggggagttcctgcaagctgctttgtctagaacaaagcaggttgatgaatttaccgcaaggctgctacaaattcatgagaagatgatgccaataaataagaaagaggatatacgcttaggattgcaccgatcggattatatgctggattctgaaaccaattcactacttcaaattgagctcaacactatttcatcatcctttcctggccttggctcccttgtcagtgaacttcacaggaccttactgaaccagtatggaaaaatattaggcctagatcctaaaaggattccacagaattgggcagccactcaatttgctgaagcactgggcaaagcatgggctgagtataacaatgacagtgctgttgttttgatggttgttcaacctgaagaaaggaatatgtacgaccagtact

SEQ ID NO: 2509 - DNA, 797 bp, Sorghum bicolor
  Clone ID: SORBI-28MAY03-CLUS41997_1
gctgcctctgcttgcgtttccctcgtgtgcggcacgccaagccagccagccagcgatccttccagaatgctcctccgctgcggccgccgcgccgcgctcctcctcgccgcagccgccgcactctcgcgcggccgcgaccccgacacggccgtctacgcctcggtctccccgccacagacgctccgccaggccctcccaaccgccgcccccgccgccgaggggctccgctccgccacccgcctcttctccccgtggctgctcccgtatccgtaccaagggttcccaatactaaataccttcgcgtctgcgtcggtttcacctgctaacgacagagaccaaggttctgacggaagctcgggtgattcaagatgctgcccagggtgtctaggcaggaattcgattgccaaggcggcatctgcagttggtcctgctgttgtaaacatttcttctatgcatgatatgcatggatgggtgcaagagcagagcatcggatctggaactataatagatccagatgggacgatattgacatgtgcgcatgttgttgcagattttcaaagcacaaaagcaattgtgaggagaaaggttagtgtgactttacaagatggtcgtgaatttgaaggtgttgtccttaatgctgaccgtgtgtccgacatcgccgttgtgaagattaaatctgcgacccctttaccggctgccaggcttggatcgtcatctcgacttcagccaggtgattgggttgttgctgtgggctgtccactttctcttcagaacacagttaccgctggtattgtcag

SEQ ID NO: 2510 - DNA, 666 bp, Sorghum bicolor
  Clone ID: SORBI-28MAY03-CLUS42032_1
aagggtccccgtgtgctcgagattattcaagcaattgacagcaacaccgatgggcttgtggacttcaaagagttcgttgcagcaactctccatatacaccagatggcggagcttgactctgaaagatggggtatacgctgccaagctgctttcagtaaattcgatctggatggtgatggatatatcacaccggaggaacttagaatggtgcagcacactggcttgaagggatctatcgagccgctgctggaggaggccgacatcgataaagacgggaagataagcctgtccgaattccgcaaactccttcgaaccgcaagcatgagcaacgttcccagcccaaggggggttccaaatcctcaagctctgtgaattgcagcgccagtcattagggaggagcaaatttaggaagataccacacagtagtcacgttcttttttggtttctttagcgtgccatgtgatgtttctgattttagcatccaggttgtgtgcagcaatgagtaagtttcaagtaaatatttagtgtttattttacggaaaagtatgtgaggtcgaggtcaaaatggtaaacaagactcaccttctttcctgtacactgtacagtatactaaatacgtatgattttactgtactgttggtcacaataaagttgtctgaagcagtg

SEQ ID NO: 2511 - DNA, 605 bp, Sorghum bicolor
  Clone ID: SORBI-28MAY03-CLUS42107_1
cgaattggaacatgggtgcacgacattgaatgtcgtcctggtcagggtgggaatatggtacgagcagctggtacatatgctaaagtagtccaggagccaggtgtacagtgtgttctgcgtcttccttcaggtgctgagaagattgtcgattcaaaatgccgtgctacaattggtatagtctccaatccaagccatggaacacgcaagctaaggaaagcagggcatagccggtggttgggcagacgccctgttgtccgtggtgttgcgatgaatcctgtggatcatccccatggtggaggcgaggggcgtaccaaaggaggcaggccttcagtttctccttggggaaagcccaccaaagctgggtaccggtcaccaaatgtggccagccgtaaaacttcttagtttgatgtaacgagctcatatggaatggccctttttgtttcggatctttgtagttgagaaaataacgaacagatgttggtggtagagggaactgtgatgcatcatcttggttgtgatgtagaaagcagacaacagagaagtaatgttttcattcctatatttgtcagtgtttcattttgcagaaatacataacatggccttcc

SEQ ID NO: 2512 - DNA, 558 bp, Sorghum bicolor
  Clone ID: SORBI-28MAY03-CLUS42112_1
tgcgatccagtttggttcaaggatagcgagggagtcgaaccggaagaacttcggcagtaacagagctgcgaaccaggcatcagcaggcagcgtgcagattcaccagcatatgcaatgacagcacgccgtggggtatcaatatattacatccatattaacagtttacagccgctgagaggaagctgatgaacccgcttccccaatggcggcgtgtgttcaccagagtccaagcttctccaatggcgccgaagctctgcccggccacacgccaaccgtttctcaccaaatcagccatgaacacgttttagctacacctgggtttggctctgtagagcttattagtagttggatggagcatcattgtctgtctgttgtctcagaccatcgcagttcacacatgtgacttgctactatctgttgtccctgtctgtctcagtcttaagactttttgagtcatatatgatccttgttcttttttttgagaatcatatgatccttgttctgatcatgtaacgactggacgtggttaaaacctaaaagtggccggctgcttttctc

SEQ ID NO: 2513 - DNA, 515 bp, Sorghum bicolor
  Clone ID: SORBI-28MAY03-CLUS42543_1
gcacgagggtgagatctaactgttgtttagatgaacgtgatggacaagacttgataatgagggtcgtatttatagcaacttatactatgaaggaattttggcctttgctaaactgaaagttgattccagataaggtagtcatgatgtggaattttgttgatttggacatcaattctttctttgaaacgttgtccaaggtgacatgatgaggttgtatgatgtggccaatgccacatcagacctagtcatctctttctaaaagtaggcttgcattgtattgttgaaggctgaggtggactaacaactttctctaacggaatttgtctaaggccttaatatatcttctgttatatatgctattcatagatacacataaattttcgttgcttggatttttccttgagatgtcagttggatgttaacttggataacttgacatgtcaccatgttttgaatgtttatactataaatacactttaataaacttgtacactaatttgtgttgagttctgttt

SEQ ID NO: 2514 - DNA, 957 bp, Sorghum bicolor
  unsure (1)..(957): unsure at all n locations
  Clone ID: SORBI-28MAY03-CLUS42565_1
gcacgagggccggcttccgccgttccgcggcggagggaagccatgggcgccgccgtcgcagggtggaccgtggcggcggtgctgcttcaggtcgccggcctctccctcttcctctacgggttcttccccgtgaagcccacgctgcgtggcttcagtggagaggagagctaccaggtgccgtcgtgcggttccgttagtgctgggcagcaggagccggcgcttcccccggatcagctcagatctctgtacagggtaaggcgttgctactgtctccgttcttcgtgcaggaactctctgggatccctcctgtgtacgatcgcttagtgttgatggtaatagatggactacctgctgaatttgtacttgggagaggcaggaaacctccaagcaaagaaatgatggcgcctgggccatacactcagtctttgttagctggttgcaaagcagcagcttaccatgccaaggctgcacctcccactgtcacaatgccccgactaaaagctatggtatctggggcaattggcggttttctagacgtagcatttaatttcaatactcaagccttcttagaggacaatcttcttgatcagcttcatatgattggtttgaagttagtgatgctgggagatgagacatggatcaaattgttcccaacactattcactagacaagatggagtgagcagtttttatgtgaaagatacagttgaggttgatttcaacgtttcacgccacttagaatttgagcttgctgcaaaagactggagtgtcttggttcttcactatctaggcttagaccatgttggacatataggtggccgccggagtgttttgatgacccaaaagatgaaggagatggatgatgtcattagacgggtgcatgctgcgagccttctggataatatgaacagaacacttttcgttgtggttagcgatcatggcatgactgaanggggta

SEQ ID NO: 2515 - DNA, 678 bp, Sorghum bicolor
  Clone ID: SORBI-28MAY03-CLUS42579_1
aagattccggcgagctacggagtactacgaggccggcgtgacgttccggcggtggtgctcgtcggaagcgggatcgcagcgccgccgccggcggcccgtgctcgacgtggcgttcaacaacggagtcctgtcagtagcgctgcaggacatccacgagaataccggctacatcctccggaacgtcctggcgtacgagcagaagtacaaccggacggcgatgagccccgacaccagctacgtcacggcgtacgtggtgttcatgtcgcagctcctgggcagcgccgaggacgtggcgctgctgtcgaggcacggggtcatggagcacctgctcggcgacgacggcgaggtgtgcgcgctcttccggggcctcgctgacggcctcgccttcgaccccgtcagcgaccactacctgagtccggtcgaggtggcgctgcaggatcactgccgccaccgccgctacaggtggcgcgcctggatcgtcaggcaccgcttcagcaacccgtggctggtggcggcgtggctcttcggtggctctgctgtgctgtgcaccatcgtccagacagtctttactgtactctcttacctgcagcaaccacactaggagcctgttttcatgtcgttttagccaacagtattttcctttataaaaaatcagcgaaccaatactttttgtttgtc

SEQ ID NO: 2516 - DNA, 969 bp, Sorghum bicolor
  Clone ID: SORBI-28MAY03-CLUS42599_1
gcacgagggctggctacatacctagaaacattgggagcggacatcagcggcgcactatggtctgccgaaattctcattgagaacccctcactcatcaagcaagcacatctggactattaccgggcaggcgcaaatgtcgccattactgcatcctaccaagcatctattgccggcctcgtcaaacacctggcattgagcgaaaaggaggccaaagacgtggtgcagaagagtgtgcagctcgctcaggaggcgagggatcaacatgcgagtgaagcagatgcaaatgtccgagaccaactgtttatcgcgggaagtgtagggccgtacggggcgttccttgctgatggatccgaatatcgaggcgattacgtgatacctaaggaagagatgaagagcttccaccggggacgcattcaggcacttgttgaagccggggtcgacattctagcatgtgagacaataccatcaaaggccgagaccgaagctctcatcgacctgcttacctccgagtttccttcttcagaagcctggttcagttttacactccgagatagcagccacatcagtgacggcacgcccttgtccgagattgccgcgcttttcaagggggtagagcaagtggtttccttggggttcaactgtgtccctgacgatgttgcactcgctgcgctacaaacactagagccattggtgaagaagggaaccatggtagtttatcccaactctggagagcagtggaatgcaaaggcaagggaatgggaggggacgcggaccgaaggttcgacgctggctaagaaaacagaagattggaggactgctggcgcagggttgattggaggatgttgtcgaactacgcccgaggacatatcggtcatgaagaaggctttggctttgtgagttgcacctgaggagcaaaaaaaaaaagtttcagatcgatggttagttattatgtttgtaaattatatgtca

SEQ ID NO: 2517 - DNA, 778 bp, Sorghum bicolor
  Clone ID: SORBI-28MAY03-CLUS42665_1
tggataaaacattacataaacaatgggtacaggttgtggcaatgcagttcttgggaatggctggtcactttggtcttgggaatacaaatagccttgccagcattgatgttgctggagcattcattggcatttcaagttactccacagttctttctggtatactgatgtttatgataacatatgcatcacctctgatgttataccttgggttggtccttcatgtatcggtgaaagatattgatgatatctctactctacggcacttgaaatggagctatattctagacaaaatggtcacattgccatgtttgtttcctttgctcattaattctcttgcgttgacttcatacaccattgttttgctactcatgaggaatcacttatttgtttggagcgtattttcaccaaagtacctctatgtctgcgcagcaacagtgtgcacgtatgtcggagtattcgtcatagctatgactgcagtctacaattgcgctgtttttaagttcagggcgcgaagctacagggataaatcccagtgatcagactaatgattagttgttctgatttacaagtagacatttgtaagaactcagaaaggggagtatcttggcctattctctcatcgtacaacattgaactcccatgtttccagaccatgcagtccctgcaagggcctatacaacatttctcgttctctttactaattgtattcttcttctgcgagtacattgtagcctgagttgcactgtttcgattgcgagatccatgttgagccattttc

SEQ ID NO: 2518 - DNA, 638 bp, Sorghum bicolor
  Clone ID: SORBI-28MAY03-CLUS4272_1
cgtccgcactccataaacaatattattggaggtttactttggcgctatacaaagaactcacagaagtaaatatgcattatacctttaatagtcatccctgtaagatgttgtactagtttacactttttagtccttagtccttactagtcctgttgccagtattagggttcgatattgcttcatccatatttttcagtagcttatagtatttttttctctcatttttcctacaaccatatggcaaatgaagttaaagatgactacttggctgtggaacacaaaatgtggagccatggactcatggtctatagaatattataagttgcaatgagcttgaaactattctttacttaatggttacagcttacaaccattgtagctctgagactgtcagattcagaccctgggcagacaaaataagcaagtgccatgaaaatcaggccctgcttcattgtgggcagacaaaaacaaggtaactgagaatatattgtccatgccatgttcttcatggagttcaaattatccacagcacctttctcaaactggtggagacctctgaatgttgcagtagcagcaggtcgctgcagttgttgcaacctgtcgatgttatccagagctgtaagctatgctcataccat

SEQ ID NO: 2519 - DNA, 714 bp, Sorghum bicolor
  Clone ID: SORBI-28MAY03-CLUS42666_1
cagagtttgcagcaactagcagtgggtacacgaaggaggttgaagacatgctcaaagtgctatcaccgatgatggtgtcctttattaagaatttgcctgctattgaaggaccatcaccggatattgatgtggtgctcagcgtgctgctgcagagcacattgccagttgcacagagtgctgggaaagcaggtggcgtgagtgagctctcaggcattggaaaagcaggactaaaccagaatggatctgttcatagacctccaagggagagaaggaaggacgtggaaaggcaaggggtgcaggaggaagaggatgcgtcaacggtgcagagtagggcagctgtgccacgagacatcttcaggcttcgacagattcagaggagccgtggcctgggggtgggcgctgctgccgccgcttcacagtctgggtcctcggcattttccttctcgggcggtggaagcgccttctctggggatcactcagccagcacagattagtagtttatctatggtggaatatatcagctgtatcattatttagcatctgcatttcagaatttacattattgtagggtgaaactgttggtgctaagctttgtgatagaatggacacctgtgagtagatcgtaaagtctgatgtgctgtttcttctaactgttggttctggggcggtgctgatgatgccgaggatgatgaatgaatgaaagcacattcaaag

SEQ ID NO: 2520 - DNA, 823 bp, Sorghum bicolor
  Clone ID: SORBI-28MAY03-CLUS4331_1
gcacgagggcccaatggtgtttttccccaaaacgacgaaccctcacagagtcaatccagtcatgcctcagttagctactgggaacaagatcgtttgtcggagctggtgtcgatgatggtgcaaagcgcagacaccgcacgccacaacagggatccgtgccagcagctggctcgtcaagccctcatcgtcagcaaccagctccaggggccgctgggggcaccacagaggctgcggctggagcagctggaagacctgctcttccgtggatacatgctcatatgcttctgcagccagtacagcagaagccaactccagctcatgttcacaggagcgtccgtctgaccaatggcggttagtaaaatgtttgaattcattaattagcagctttacctcaccagccgtttgtgagttgccaatctcattcgatgcttcataacaaaataaaataaaatatgcaggacaacattaagcatatatggggaactgccgtcaacaggtgctgcgcatcaatccatgtccaggctggcacctcatggctatcgaattccttttgttgtgctacaagaggcaacaaataacttcgatgagaagatggtcattggagttggagggtttggaaaggtctacagaggagtgatgcaggatggcaccaaaatcgcagtaaagcagggcaaggctaaccagatgtctggacaagggttgagtgagttccggacagagatcgatgtgctatcgaagttgcgacaccgccatcttgtagcgctcctgggttactgcaacgagcacaacgagatgatcttggtgtatgagtacatggagaacg

SEQ ID NO: 2521 - DNA, 560 bp, Sorghum bicolor
  Clone ID: SORBI-28MAY03-CLUS42250_1
gctcaatagcagggtccgtgttatccatcagtatctggttgccatgcaaaaaggtgacattccagtggataattcactgcttaggcaagtctcaagcctcgtaagaaggctaccagctatggagtcacagaaattccaagatgacttcttaatggaatacagcgccactctcctcatgacttacttggcaatgttcactaactgttcaagcacaatgaacgagttggtcgagaagatcaacccaagctatgaaagtccgactgccaggagaggaggccgaggtgctttcatgtagctcacctgccgtgatcctgctgcggctttcatctgtggagatttttggaaatagcttatgttcctgaggcatttttttggcatgcaatctattatgcgcaatcgtctatacggcagctctgagtcacttaaaactttctaggcaaaaaatgatgatttgctcgaactgtatcacatccccacttgtgctgaagttgatctgtaaagtttctcccccaagttattctatttgactggcaaatggatattgatcctggtttgcgtcc

SEQ ID NO: 2522 - DNA, 579 bp, Sorghum bicolor
  Clone ID: SORBI-28MAY03-CLUS42264_1
gtgatgatggcaacactactagctcgtagcaatcgttatgctgaaatagcattgtttgtgtcaaacaagattcttgaaccgcgtaggctgcgcgcaaggctcctcacggccctggggcggcggcgcccgccctcctggctcctggccatcgtcatgctgagggagcgaggcctgcatcacgactacgtgactgcgatgctgcaagaagggtactacttggaggccttgcgctatgccagaaaatacaaggtgatcaccgtgcagcctgccctgttcctggagaaagccgtggcgaagaacagcgcccacaacctggctgcagtgctgagcttcttctgcgagttcactccgagcttcaagaccacatcggacttcggcagataccggcatatcctgtctgaaatggtttgagcagctttgttttgtgtaatcttgttgccccgaaatgcattagcacgttctctgtagcaagcaacgtcgcctcggaggatagttttatttgtaattcttttggttgctcttgcagaaattaaaaaaactagtactgttgtataaataaaaagcgttttttccgggggg

SEQ ID NO: 2523 - DNA, 680 bp, Sorghum bicolor
  Clone ID: SORBI-28MAY03-CLUS42267_1
gatcacttgactatcccaagcatgttcgaaaggagattgtaaagcagctcaaggaatgtaactccttatatgaaggttacgttccaatgaaatataaacattattgcaagaagatgaagaaatctggtgaatggggtgaccatgtcaccctacaagcagctgcagacaagtttgctgcaaagatatgtcttcttacatcattcagagatacctgttttgttgaaatcgttcctcaatatcaatctccacagagagagatttggctgagtttctggtcagaagttcactataactcactctacgatgctcgagatctccctagcaaatacaagcctagaaagaagcactggttgttgttttaatatcatatcaatgcggaggtttgcttcatactggtggaatcatattgcttgaccgtttcgaccaccgaccaccgtccgctggtggcagcctgggcatagctccttgtggctttatctcccatatagctctacatgaatgattcattgtgttgctcggtgcagctactgcaagatccagactcgcagcgctagatacagttacaatgttgaacctgagccttgtaaatagatactcctttactgacatacaggttgattgtataccctggcctattcgttcattgttacatctttgtttatacttctacatattagtgc

SEQ ID NO: 2524 - DNA, 590 bp, Sorghum bicolor
  Clone ID: SORBI-28MAY03-CLUS42886_1
cggcacgaggaaactttgcaccccccgcgccccgtacccgtccgaaaccctagcctgcctcgtcggcggcgggccctccggcgatggaggtggaggaaccgctcccaacgtccaagaacccgcgccgtgcccggcgccgggacctcaacgcactggatcccagcatggaggagtccgatggggaggatattggtgttccggaagttggcatggtgttcaataatcacacagaagtgaaccgattctaccgcaagtatgcccgccgtgttggctttggtgtctcagtaaggaggtcctcattctcacaagaagggacctgcttatatctcgagcttatgtgctgcaaaggagggcggccacgttatgagccaaagtttcggaaacgggcttcatcgaccactaactgcccagccaagatccgagtgaagttgtggggagataaattgttgcatgtagagttggcgatcctcgaccataatcatccagtgagcccagcaatggcaaggtttttgaactcttataagcaactctctggccctgcgaagaagaggatgcgtatgggtggccctggggctatgcctattgaagag

SEQ ID NO: 2525 - DNA, 653 bp, Sorghum bicolor
  unsure (1)..(653): unsure at all n locations
  Clone ID: SORBI-28MAY03-CLUS42818_1
tctaggagtgtcgttgcatacatcttcatcagggctggacctaccaatgaaggtggttgatatgtttggatgtggattgcctgtttgtgctgcttcattttcctgcattgaggagcttgtaaaagtaaacaaaagcgcgcggcttttctcaacatcttcggagcttgctgatgaacttatgatgctctttaaggggtttccagaagaatgcaatgccttgaaatccctcaaagaaggtgccatgaagtcagcatcatcttcaaaatggtcaacagaatgggaaaccaatgccttacctttggtgaaccaagtcattggatgagatgtgtgctaacacatatcaaatagaattgttctattccagagaatcagagacaggtgtgctagagagaccagatgtacatcaaaagggtacggattgctttcaccagccgctgccaaaatcagttgctagtttatgccatgtgctgatgtgcgccacttcagcaaaacttgggcaattttatagatacgaaggtctttcctttttaggctgggaaacatactctgctgaacacatgtataagttgtttcaggcaatgtatactactgtaggccnaagccactttgtttgataatctggtctatattggaaatgcttagtggtcacagac

SEQ ID NO: 2526 - DNA, 545 bp, Sorghum bicolor
  Clone ID: SORBI-28MAY03-CLUS42938_1
cgtgggcgccgtgttgtgaccttccataatcagcgagactacatatttttccgtcatcacaggtacatcttcgatacaaaagaaaagaaggttgcttcaaaggacaagaaagctaagacatctgaaagcaaaagcgaatctgagaagcaagtgatttgtcgccttcaggaatgtgggcctcgctttgttctaaagctgctcaccttgcaacatgggaccttcgacacgaaaagcggggagtacgagtgggttcacaagccggatatggatacgagcaggaggagattcttcttgtgatggagatcttggctggaggagacctggtgtccaagcccaacctggtgaaaatgcgccgatcgtttttttaaaaaaagaaattgctgtagagaggatgctttgcacgtagaattgacagtcgatgcacttagaggatgctgttgaagaaattttgtggatccatccaatgagcaagtaatacaaacttctgtttcgcgtcgaaaatttctgtggtgaaaatgttggcaaaggcacgtctcgtttgttct

SEQ ID NO: 2527 - DNA, 512 bp, Sorghum bicolor
  Clone ID: SORBI-28MAY03-CLUS42942_1
gaaggtccaatccgcatcaggggagaaggccgccatcgcttccgccctttcaggtaccggcatctgggccaattcgccccactaggaggggagcaaactgctgcacagcttcccggggactggatctccattggccacagcacccagtggctctggtactccgtgtatgcaaccaaacaaatcagttggcgcacgaggatgctggtggtatctgactggacgcgcagattcatcttcggaagagactcgagttgcatatagtcaagagaaggaaaagattttgctgtgacatataatatatatatattcagatgaacggggccagtagagcctcttcccacttttttttagtctgatttcacataaatgttctttttttgttaagggaagaatgcgagttcccttgcactttgtatagtgcaccacgaagaaattcctttgtacctacctttttctggagagagttgtactgcacttttgcggcctgagtaactcagattcttttaatagct

SEQ ID NO: 2528 - DNA, 571 bp, Sorghum bicolor
  unsure (1)..(571): unsure at all n locations
  Clone ID: SORBI-28MAY03-CLUS42998_1
caaaattggacatttctgggactgccaaggctgttatctcttgctttcagaagttgggtgtatcatttgacatgaatgaggtaaagcaagttagggatcctgaggagcaggtagctttggtgggtgtcccagaagaacatctcgggggtcatgccttccacatgtatcatctcacttcacctgatgggacagtttcgtttgagtttcagcacaatgtatgtggccgttcaatatatgcagaaggaactgttgatgctgctatgtttctctacacaaagataaaatctggggcgagcaagaaattgtatgacatgattgatgtcttgagagaagggaacatgagatgagatccatgctgacttcatgagtgcttatgtaccaatttgcaagctcaattccaatgtgaattaggctacttttccaantgtaccagccttcccaatgtaccaatttttgtgttagtcacttgcagttttggattggcagcttcgatggcagaaaatgtacccgctcaagttccaaactgttagtgcataggtttttactatgcactgagtcacatctagcgaaa

SEQ ID NO: 2529 - DNA, 681 bp, Sorghum bicolor
  Clone ID: SORBI-28MAY03-CLUS43001_1
ccatgggtacacatcaggcttaaagcttgaacaatttatatttgatgtgttcaactattctccttcgacagctctttttgaggttttgcgtgaggaggaatttgcgccagtgaagaatgctaatggtgcaacttatgacactcctgatagtgccaggttaatgctgcttcggcttcatagccgatgggtggttgctgcaggtggcttcttgactcattctgtgcccttgtatatgacaggagttgaagtttctccgctttgttcttatgctggagagaatctagaagccatatgcagaggaagaacattccatgcaccaagtgagatttcattctaggcatagtagttggaagcaatctgaatacaggaagatgagatctgctcaattttgattacaacatgacaactcttgcaaataggatgttgatattagtcaactattgtatgttatgcaaggatcaaatattgtaatgcaacgcctgaagttgcctcctttctcccctagcattaatgcatattgcattctcatgtgctgttcgaatgtagatgatgacatgcttttgtgtaatatttgttgaaaacagccatatgtaccataatatttattatctttgcacaattgtaattcttgattctatgactatgatggagaaaaatcaaagcatgagatgttctattttc

SEQ ID NO: 2530 - DNA, 690 bp, Sorghum bicolor
  Clone ID: SORBI-28MAY03-CLUS43008_1
accttcactaaaggttcacctggaattgaaggtttttaatacccatgtccgtgtgtgcaatgtggcagctagttggaagttgaggaagggtgtgtaccatccaaagttgcccagcgaaaggaaccaatgatttctcaacctcagttgcttcgtagactcaattatcagtctcattactgtggaaaatcagtatccatcttgagatgatatgcatcacagtttgcatgatttgactttggtccgtatctaccatgtgtctgcagattctctgtgctgaattgttttctgaatccaactgcacagttgtttgttgtctggaccattgttggtaaaagtgagattgagaatgtaaggctttgtacaacaacgtgccccataaggcaatgacagtttattctccattccatggtggttgaaggagattaggaaggatcagttggattttgacttgctaggcatttcagtaaggactgacccaagaaacagcattgaccttaacatttcagaggactggctcaaggaacaaacagcattgacctgtaattgagcccaatacaaaatgatagtggttttcaggggcatggcctcctgaatcatcctctgttcaggatggccatgtgcaatggtttcatgtggacctactggatttacatcctacatgctggcacatgaactttggaaaattgggcg

SEQ ID NO: 2531 - DNA, 862 bp, Sorghum bicolor
  Clone ID: SORBI-28MAY03-CLUS42472_1
gcacgaggtttacacacatgaaagtaggctgattcttcttgcttctggaatgcaatgcacgatgtttactggctatcagttttctgctggtgggattgtcaaaataccgaagtttgagatgatgatgtctaaaagtgaagcaaacaacaagcctgttctagctgcagatgatgttcacattgtaacagtctacggtaggatttattgcttgcagcttgacagagttagtatgtcattgaatctataccgcttttaccgtgatgctgttgtacagcagtgtactctgccgacatactcaagcagaattgcagttagtgccgttgacaacataattatggttcaccaaatagatgcaaaagtagtcatactttatgatgtgtccctggattcttatgccccagtttctgcgccacttccactactagtgagagggctgcccatcaatagtagacaagtatctcagactgcagatagccagtctagtgcatatggtggaaccatctatggagaaggttggaactttctcattccggacctcatctgtgatgctgagaatgggctcttatggaagctccatttagacctggaggctattgctgctagtagctctgatgctccttcaattttggaattccttcagagacgaaagtctgacccaagcatggttaagactctatgccttgctattgttcggacaatcatcctggaaaggaggtcagtgcccacagttgctaaggcaatggatattgttcttgattcctacacacgtttgatgaaaatgggaggagcttttcctggggttaggcggacacatgagcaaaatcagcagtcaggtagtcaacctaatgagggctcccatgtg

SEQ ID NO: 2532 - DNA, 517 bp, Sorghum bicolor
  Clone ID: SORBI-28MAY03-CLUS42475_1
gcacggcgccgcgctcttcccaagtcacccccagccccaacccagaggtgaaagcgtcgtccagtccccatttcgccgccgacccccgcacccaaagcagaaggcttttgctttgcgcgtcctcccaatccgcggctagccggcgttctatctttcctgccgagctcgccggcgttcctcttctgctgctgccggtggtggttggagatgacacatatgtttccaagggaaggtgcctcatctagctcaacctcaatgagcagccagaggagtgaaactgatgatgataggatgattgcgatggttctctctgaagaatatgccaagctagatggtgctatggccaaacgtcttactaatttaacatcgattcctcatgttccccggattaacacatacttcccgacatatagtgatgccactatggaccattatcgccttcttgataggctaaatgcatacggcttgtttgaggtgagagtatctggtgatggaaattgtcagtttcgtgcactct

SEQ ID NO: 2533 - DNA, 483 bp, Sorghum bicolor
  Clone ID: SORBI-28MAY03-CLUS42531_1
gcacgaggggaataactgcattagaactagcacatggtcatgctccattttcaaagtaccctccaatgaaggtgttgcttatgaccttgcaaaatgcaccaccaggtctagattatgagagggacaagcggttttcaaagtctttcaaggatttggttgctacatgtttagtcaaggatccacgcaaacgtcctccttctgaaaagcttctgaagcattctttctttaagcatgctcgctcagctgaatatctggcacggagtattcttgatggcctccctccattgggtgaacgctttagggaactgaagtgcaaagaggctgagttgcttctcaataacaagcttggtcaagagagcaaggagcagctatcacagaaagagtacataagaggcatcagtggctggaacttcaatctagaggacttaaaaaatgcagctgcccttatagacaatttaaatggcacttgtcatttagatgtca

SEQ ID NO: 2534 - DNA, 586 bp, Sorghum bicolor
  Clone ID: SORBI-28MAY03-CLUS42540_1
gcacgaggctgaagagctcgccaagtttgaaggaatctgacatgaacactaagtctgggcatcctaatgtcggtttcagagacatagtgaaggactccatcaaccgggaccctggaggcctgactgtaaaaacctcggtgcaggaggcaaggagaaacggacagtacaaggactcaccgaggccactgctgctgtccaaatcaatggatggaacctgtatcattgggatcgataggaccacaaaggttcctgcaaatgtcactgaatctagaaggtgtttgcaggagcagtcacgcttctcatgtgatgaccgaagactcctgcggccagctgaaacccaggaaagcaagaggcctccctcgaggccaaaagagcttcctagattgtccttggacagtaggaaggagtctctgagtccaggctcacgtcagaagaacctcagttacaggagaactgatgatattcttctggatactttgaggcctcaagattcgcccagccatagaagagctaacagtgttattgcaaagctgatggggttggaagaagcacaaatgctacaggggtgctgactgctgaaaactgt

SEQ ID NO: 2535 - DNA, 746 bp, Sorghum bicolor
  Clone ID: SORBI-28MAY03-CLUS46190_1
ccaaggagacgcggcggcggctgctcgacgtgtggctgcagccgctgatggacgactaccggtggctgcagcacgggtgccggtggttcgaccgcgccgtggtggaggacggcatcgggcaggccatcctgacgctgcccctggaggaccagcaggccgtgctgctcgcatggctgggtcggttcctcaaggccggagatgggtgccccaacctgcagagggcgttcgaggtctggtggaggcgcaccttcgtcaggccgtatgccgagcagcagcagcagcagctcgggggcgggagctcgtcgtcgcggtcggggcggcactgatcgtcctgcaattgcttagaataacagtccatggtgctggttgcggttttgcaactcacagtgttggaacaagtcagcaatgatggttttcttgcaagtttcagtggtaggagacttggcttcaattagaagatgctggagaagggagagtagagtgtaggtttactagtggcgatttgtaactgacgttagttttaatgttggttgtgtgcttctgttgtaatgctttgggatatgaaaacctgtctgatttcttggtacagaaatcaatctcctgtaggtttactagtggcaatttgtaagtgaggttaattttgttgttggttgtgcttgtgcttatgttattgtaatgctttgggatgtgaaaacctgtctgatttcttggtacagagaaatcaacctcctgtgaatttagatttt

SEQ ID NO: 2536 - DNA, 926 bp, Sorghum bicolor
  Clone ID: SORBI-28MAY03-CLUS43116_1
gcacgaggcccttgaggtcaagctcaaggcccctaacggtgtcaacttcaccgccaagggaacctctgcccacgatgggcccgtcacctcttctcttgagggcaagaagtcgctttccaacggcatcagcatcacccagtcatggaatactgccaacatgctggcgaccaaggtcgagctcaacgacaccttcgccagcggcttgaagaccgaggttctctccaacttcagccccgctgctggcaacaagggccagaaggtcaaccttcacttcaagcagcccgctttccacggccgtgctttcgtcgactactcggccgccggcgcaattggcaccactgccgatgctgttgttagccacgagggcatggtcgtcggtggtgaggtcggttacgatgtgcagaaggctgccatcaccaagtactccgccgctgtcggatacaccacccctctctacaacgctgccgtcactgccaccaactccctgagcgtcttcaccgcctcttactaccagcgcgtcaatcccgctgttgaggccggtgctcgcgctgtctgggactcaaagtctggcaacaacgttggcctcgagctcgctgccaagtacaagcttgaccctgcgtctttcgctaaggccaagatcaacaaccttggaattgcttccctcgcctacaacaccaaggtcaacagcggtttgaccttcggtattggtggctctttcgatacccagaagctgaacgaggccggccacaagctcggcaccagcttcaccttcgagggttaagcacctcaaaaatgacatttgtggacaggagaagggggaaattgccttagattcctttggttctcgcgaagcgatatcatatcaatctagtgctcaagagcgagcgtagtatagttttctgacacgtacgacgactgtcccaagc

SEQ ID NO: 2537 - DNA, 738 bp, Sorghum bicolor
  Clone ID: SORBI-28MAY03-CLUS43126_1
gaagagctgctgaggagattttgatcgggaagatctctactggtgctcaaaatgacctggagaaagttacccagatgacttatgctcaagttgcagtatatggctttagtgaaaaggttgggcttctttccttcccacaaaagggttttgaaatgagcaaaccatatagcagtcatactgcatccatcattgacaccgaggtgagagaatgggtggccaaggcgtaccaaagaaccgtggacctgatcaagacgcacaaggagcaggttgcacagattgcagaattgctgcttgagaaggaggttctccaccatgatgatctagttcgggtactaggggaacgcccatttaagacggctgagccaacaaactatgatcgtttcaaacaaggtttccaggctgaagttgttgacaagagttctgaagtcgcagatgctaatccgtcccccctgggggttgtgccaacatgaatactgagagctcatatgtgttaacgtgtatatagcattgcctctgcccccgacttctatgcttatttggcatatgaagcctgtgttaattttttatgtcgagattttagttccagcccccgaatcaaaatgctgttaacttttcccagatggggcatctattttgcggactacccggacagaattagataccccatttatcttggctatctacagatgtgccttgtcgctctgtgtacggtttaaggaatattgtagtttatcattt

SEQ ID NO: 2538 - DNA, 636 bp, Sorghum bicolor
  Clone ID: SORBI-28MAY03-CLUS43153_1
aaaaccctcctccggcccttcccgccgccgccaccccgccgggcaccaccacctcctcgttctccttccgtccgccgtcgccgtcgccgtcgccgcgatggacggccaccccgcgcgccaggtgcgcgtgcgcttcgtcacgaagctgccgcctccgctgcgggcgccgcccgctgccatcgccgtccctgcggacctcacccgcatgggcctctccgagatcgtcaacagcctcctcgccgccgccgagccggaccaccagacacagcccttcgacttcattgtggacggcgagctcgtgcggctgccactccaggagttcctcctcgccaagggcatctcggcggagagggtgcttgagctcgagtatgtgaaagcagtggcgccacggatgctggagggacccgccccccctgttgcctcggccagtgccgtggatggatcgtccgcagctgtgggctgtccgcgtggcgtggctggctctgcgggttggtcgctacggctatacaagtgtgacacatcagtcagtatggactacccaaagcgggttggggcttacaaaattcttcgtggccacacggcatctgttaaaagtatctccgtagacccttctggcgatatgctatgttctggatc

SEQ ID NO: 2539 - DNA, 821 bp, Sorghum bicolor
  Clone ID: SORBI-28MAY03-CLUS43163_1
ccagccggagcaggccaccatgtgcggcatcctcgccgtcctcggcgtcgccgatgtctccctcgccaagcgctcccgcatcattgagctctcgcgcaggttacggcaccgagggcctgattggagcggtttgcactgtcatcaggattgctaccttgcacaccagcggttggctattattgatcctacatctggagaccagccattgtacaatgaggacaaaacagttgttgtaacggtgaatggagaaatctataaccatgaagaactgaaagctaagttgaaaactcatgaatttcaaactggcagtgactgtgaagttatagctcatctttacgaagaatatggggaagaatttgtggatatgtttggatggagcgcgcgccttcgttcttcttgatacacgtgataaaagcttcatggcagctcgtgatgctattggcatctgccctttatacatgggatggggccttgatggatcagtctggtttgcttcagagatgaaggcattgagcgatgattgtgaacgcttcataaccttcccccctgggcatctctactccagcaaaacaggtggtctaaggagatggtacaacccaccatggttttcagagacgatcccttcaaccccttacaatgctctcttcctccgggagatgtttgagaaggctgttattaagaggctgatgactgatgtgccatttggtgtgcttttatctggtggacttgactcttctttggttgcatctgttgcttcacggcacttaaacgaaacaaaggttgccaggcagtggggaaataaattgcatacattctgtata

SEQ ID NO: 2540 - DNA, 554 bp, Sorghum bicolor
  Clone ID: SORBI-28MAY03-CLUS43160_1
aaaaaacgcaacccggcaaaaccctctcaccgtcaccgccctcgcccgagcacgcatccccgtacggcgcgtctccccgccgtcaatgggcgtctcggcgaatcggttttgctcccaaccgctcttttttctactctagggtgcgcctgtgtgcgcctttgccgctttgcgcccctcccccccgccccccccgcccccccgcccccgccccgcctgcctggccgcacgcgctcggctcgccgcgtcgggccgccgcaggggcgaacgaaacccttggatcagggaggctccgggcatcgctgctcgacccccatgacgtcctgcgggtgcctggtgctcgagaaggtggagggcgacgcggcggcgaaggcgagggtgaaggccgcgccgggcgccggcgccggcgctgggtgcggctcgtgcgccggggactggcggggccggtccgaggccatcttccccatctacgtgatggggagctcgcgggggagcaccgtggcggcggcgcgcggcatcgtcgactcccccgaggaccccatatggggggcccgtca

SEQ ID NO: 2541 - DNA, 708 bp, Sorghum bicolor
  Clone ID: SORBI-28MAY03-CLUS42763_1
cccattcgccacaccgatcgctttcaatgggtcctatgaaagctccatgacggcggcaggcccctttggatactcctacccaaatgtggcagcctttcagacgccgatctatggaatggaatgattcggtgtcgtggctactggccctgttggcgtttcgcatgtgcaaaagggtagaagccatgagaccaaagattcaagcacaaaaaacataaagggtctgaaagagagattcccagtagagacagtagtatgatggagacataggaagcagcgagcagtgtgctgcagccatacatcactgacgatcgagccagagacggagaaggaacaagactcgatcttgctaacaacaaaatggtcgttgcagctagctatagcatatctgcgcttttccctttcgtagctttggtcttttttcagctttgtttgccccctagcgccgtgcatggtgcatgcctttgaagctttctctttctactgacatgattctgcaagtgccatcatagctttagtcagccctgtacaatggaaacaggaacgtcgtctttgatctgtagctttctttcaactttgttgtttttttttctttttgtgctttactttcatggtcactttagtttggcccccctgttctaccactatgcttcagaggggataaatgttcaaagctcctgtcttgtactaaacaagttacagcaaacagaa

SEQ ID NO: 2542 - DNA, 245 bp, Sorghum bicolor
  Clone ID: SORBI-28MAY03-CLUS4279_1
caggagtatcaacaacgagtaatcatagaagcatatgatgcaaacactcaacagctcaatcctaacacaaatgcctaccatatgtccaaaagaatgaatccagaaaaaaacccatatataaattaaacacgggggaagcttcctaagctgaaccctgtgctttgacatggtcaggagcacgtcgattctcaccacaacagcatcaggacacctgagacagcaagccccaggtaatgggcaacgac

SEQ ID NO: 2543 - DNA, 779 bp, Sorghum bicolor
  Clone ID: SORBI-28MAY03-CLUS428_1
cgacccacgccgtccgggcgaagcgaactccagtgagaaggggggagagcggcttatagtctagtaggatggctgggatgggcggcgcgtgggggcgctcatggcgtcgctctccgtctccgcgcccggcgcggcgagcaccagcagcttctggggcaaccggctcgccacctactccgcgccgcagcctggggtaagatttatggtcaagatatgcccaattgaaatgaaacttaagagatgggagcgaaagaagtgtaaaccaaacagccttcctgtgctgcacaagatgcatgttaggattggggacacggtacaagtcattgcaggccgtgagaaaggaaaggttggagaagtaacacgccttttcaagcacaacagcacagtgattgtgaaggacctgaacttgaagtcgaagcacaagaaaggcacagatgatgaacccggagaaatcgtcatgattgaaggccccattcatagctcaaatgtgatgctctactccaaggagaagagtgtggcaagcagggttggccacaaattcctcgaggacgggaccaaggtccgatacctggtcaagaccggtgaagtaatcgacagtgttgagaagtgggtaaaggtgttcaaggaaggaaattctgagtaaccattttagcatgaaaaacctgcagaatgctttgaaacctgactgcatcttgcatgctgaattgagtctgtttatccctctgtgttgtttatgccagctttgtaaattatacagttattaccaaattttgcaacgc

SEQ ID NO: 2544 - DNA, 815 bp, Sorghum bicolor
  Clone ID: SORBI-28MAY03-CLUS43199_1
ctcgagagccctcgtggtcgcttgcaaatccaacccaggttccccgtccgctagggttcccgcgacccccctccgccgctccggtgatgtcgtcggagtctccgcccacggagtcacccgacgcgcccgcctccggctccagatccggatccggctccccttcgaaggacgccgtgggcactgagggcggcgccgctgcggggggcccggagacgaacacgctccgcgtgggcaacctgcccttgcacgtgaccgagggcgatttgttggcgctgttcgggccgcacggcgcgctcgattgcgccctcgcacgagccggatctcgcagctacgcgttcctcctcttccgttccccagccgaggcccgcgctgccgtcgaggccacccggggtgaaaaggtcaagggggccgccatgcgcaccgagttcgcgcggccggctaaagctgttaggaatctgtgggttggtagcattagcccatcggtttcaaaggaggagcttgaggaggagtttcaaaagtttggaaaagttgaaggtgttgcattctcccaagatcagacttcggcgtacattgattttgagaagcttgaagatgcaatttctgctcacagatccttgaatggaaaaactttaggtggcaaggaattgtgtgttgatttccagaggtccaagggaagagcggaatggtcagacgctagcagcttcaatggtagagtatcagggccagtgggtgataagaggggcagtggccctccaaagggttctgctggaatacggatgcgagaagcacagcctaccaatgttctctgggttggt

SEQ ID NO: 2545 - DNA, 989 bp, Sorghum bicolor
  Clone ID: SORBI-28MAY03-CLUS43235_1
ttgcatttggctatcttggctgtttttgattcatgggatagtgctagggcaaaaaagtacagaagcattaatcggattactggattgaagggcactgctgtaaatgttcagtgcatggtatttggcaacatgggtatcagatcaggcaccggtgttctctttactaggaaccctagtactggagagaaaaaactttatggagaattccttgtcaatgctcagggtgaggatgtggttgctggaattagaactccacaagagcttgatgcgatgaaggagtgcatgccagagccttatgcggaacttgttgcgaactgcaaaatcttggaaagccattataaagagatgatggacattgagttcactgttcaagaaaacagactttggatgcttcagtgcagaacagggaaacgtactggcaaaggtgcagtgaagattgctgtagacatggtcaatgagggcctgattgaccatcactcagcaattaagatggtggaaccacgacacttggaccagcttcttcatccgcagtttgaggacacattgtcatatgaagataaagtcatcgctacaggcttacctgcatcaccaggcgctgctgtgggtcagattgtcttcacagccgttgatgctgaaacatggcattcacaaggaaaatctgtcgttttggtgaggactgagaccagcccggaggatgttggtggcatgcatgcagctgctggaattctcacagccagaggtggtatgacttctcatgcagcagttgtagcccgtggctggggaaaatgttgtgtggcaggatgctcaagtatccatgtcaatgatgcagagaaggtggtagtggttggagaccaggtgctttgtgaaggtgactggttgtcactgaatggatcaaccggagatgttattttgggcaagctacctctctccccaccatcacttagtgctgatctagagatattcttgtcttgggtggatgaagttaaaca

SEQ ID NO: 2546 - DNA, 700 bp, Sorghum bicolor
  Clone ID: SORBI-28MAY03-CLUS43241_1
gcacgaggcgaactgccaactcggtccgtctccgtcggtcgacgaggcatcggccatcggccatcgacgcatcacgcttctccgcttcccttcccatccgtccccccggcttctccccccttgcccacctggcgggaacgcgtctaacagcttcacgcgacagcaccgcgccactcgaggctcgcccctgctgagccagcggagcgcgccgccatggcttccacatcctcttccaggtacgcgaagcaccgtcggatcggagaggacgaagagttggaggaggccgaggaggaggaggaggaggccgaagaggagcttgagcggttcgatgatttcaccattgcttcatcatgggaaaggcttatatctgagatagaggctatttgccgtcaatggcttgcagatggcgtgaagatcttaatgcaaaaaggtgcagagggtgttcctccctttgaaaacttatatatgatcaagcgtgaactgaagcatgggaaaagagtctattctatggaatatcatttcatgaaatctgcaaaaggccaaaactcatattgggacgatgatacacatagcatgcagctctcatttggagtcgatgagttattgataattgctccgctgagtgccagtggtgtgattctcgatgatccggagtcgacaaagcttttaagttctgtagcaattgctctttctaattgag

SEQ ID NO: 2547 - DNA, 575 bp, Sorghum bicolor
  Clone ID: SORBI-28MAY03-CLUS43290_1
gcacgaggagcagccttcggtcctgccccgccgcggctcgtcgcctcgccgctcggagatcaggagagcacacctctccccccccccccccctccctcctccgcgcgcgcgtgcgagctatggcgatggacgacgtcgcgggctcctcctcgatggccgcggcggccgcctccgacccctcgcacggctggcagacggtttcctaccccaagcgcaaccgcaagcaggcgccccgcgccgcggcgcccgatctggcgctgcaggccaacggcaagggcgccgccggcggcgtcttcgacgccgtcgagaagcgctcccaggagcgccaccgcgcgctgcagcagcagctcgcctccagggcggccgacctcgacgacgcgcggatcgccgcggccacgggcgccggcgcctactccgacgacgaggactccgacgaggccgccgccccgcgccaggaaggggaggtgaagaagcctaagaagcccaaggtgaagaagcccaaggtgacggtcgccgaggccgccgccctgatcgacgccgagaacctcgctgcgcacctcatcgagatctcggca

SEQ ID NO: 2548 - DNA, 702 bp, Sorghum bicolor
  Clone ID: SORBI-28MAY03-CLUS43295_1
gcacgaggctcctcctggctggtggctgctacccttgccggttctcggttctcaccgcgctgccattaaaaacccccttccttgttaccacggcgatcttgagcaagcgtactcttcatgttgccgcctcgccgcagtagcagcttacatggatacgctgtttaggttggttagccttcaagcctccgagcagcagcagcagcagcagcagcagtcggcatcctacaactcgaggagcaccacgtcgagcggctccaggtcatcgtcgcaccagaccaacgcatcctacaactactactaccacagcaccagcagcggcggcggcggcggcggcggcgggcagtactactacggccagcagcaccagcaccagcaccagcagtactacctggagccgtaccagcaagaagaatgcggcaacgcccaccacctttacatggatgaagacttctcctcttcgtcctcgtcgaggcagcacttccactcgcacggcgccgcggtgcagccgccgacgtcgtccgcggccacgcccacggcgccgacgcccccgctgtccacgtcgtccactgccgcgggggcagcgcacgcgctgttcgaggcggccgacctgtcgttcccgcctgacctcaacctcgacttctcgtccccggcgtcgtcgtccggtgggggcgcggcctcgtccgccgcggtcggggtcggggg

SEQ ID NO: 2549 - DNA, 710 bp, Sorghum bicolor
  Clone ID: SORBI-28MAY03-CLUS43298_1
gcacgaggccccgctctcgtggttctcccgagtcccgtgctggtcgagtgtgctgtctccgtctctctagtggcgacgactgggcgaccgccgccgccgctctacgcgaggtgcccagatctctattttcgggcccttcgccggcaacgagcatccgccaggataatatgttgttcacgcatgaggcaaatgctgaccagtttgatcttctttcttatggtaatctaaggggagtagaggctagtagaaattctgaggaatccaattttggaaatgacttaaaggatggttcttcagttttttctgagaacttcagctcctcttgtctgccttgtgagaactatcaatctgccacaatagatcatgaaaaacgacctttttctgatgtcaggccatgccaagttgcttgcaaacgtccaaagcaaacagatcacaatacctggttatattcctttgaggaagaccctttgaccagtgaagtggggatatcttctccagcttttgctcccgccttgcctgcggtgttcagtgctctaaataataataattaatccagaagatatctagctgcaatttttttttgtttcagctttagctgatggattggttgagaccaaacaaccaaatgacattcatgcaattaatggtgccacaacctgcagtggtagttcagacatcccttgccttaatcatgatcaatcagttttagt

SEQ ID NO: 2550 - DNA, 559 bp, Sorghum bicolor
  Clone ID: SORBI-28MAY03-CLUS43035_1
gaacattagctcctgtttttcagttctcctcccattctggctggatcactgcttgtaaatggcatccaagttcatgtttccatttggtatcatcttcatttgatgggagagtgatgttgtgggatctaagaacagcatggccgctggcgtctgtggattcacacgaagataaggttttatgtgccgactggtggaaagggaacagcgtgataagcggcggagctgattccaagctatgtatctcatctggtattcatattgtgtgatgaagttcttatgcttcttgagtccatgctatcgagatgatatggcttgacaggccattcccagaagccaaacaatgtcatctatgtttgtgggaagatctgcaacccttcagtcaagatcaagatacggcacagggcttgccagatgtgtatgcagaagtacatttcatgcattagtaagttccatagcaattgataactgcattttgctcatcaagttttgtgttcgttggtgaatttgataccaacattactaccccaagatcatgaattgatagttgaagttttggctg

SEQ ID NO: 2551 - DNA, 706 bp, Sorghum bicolor
  Clone ID: SORBI-28MAY03-CLUS43045_1
ttggctatgggatcatgcttcttgaacttgtgacgggtcagcgggctactgacgcctctcggttcgctgtggaacgagtggcgctcttgctcggtcctggtggggagcctccctgcgtgcgggagcttgaccccattggggtcgcggtccttcgccagctctttggttgtgtgggcctcggcacgacactaccggtgcccctgctcggctcgccggcttcgccggaggtccgtcctgcctgccccgtaggggtttggatgccgggaggtcccggcctggccgggccgtcgggggagcggctgcctgtgggggcggctcgggggctggagtatgagcggatgcagcggaggttcgactggggagaggattctgtctacaatcaggaagcgatggagttgtctgcaggtagatgacaatcagtggaaaacggatgggtgtaaatgcaatgatgcggtgcctgctgtgctgtatgtaactgttatttgtagagtagcctattagatacttgttgagcaattgcatgaacgtggatggaattagatggataaatggcagtacatagattgaggtaactgtacttaatttgattatttgtagtgtagctattagatagatatgttcataagattattcaaacgaacttgttgaacaatagcatgaacgtgaatggaattagatggataaatggcagtacatagattgaggt

SEQ ID NO: 2552 - DNA, 485 bp, Sorghum bicolor
  Clone ID: SORBI-28MAY03-CLUS43064_1
aactacgaatcttgatggtccaaatgcagagagccttgctgctgcactgttgagaataatggaagcctggaaagggcaggagaacttccagttgattgtaatcactcatgacgagagatttgcccatcttattggccaaaggcagcttgctgagaagtactatcgagtctccaaggatgaaaaccagcacagcataattgaatcccaagagatattcgtctgaaggtggttcctggaggctgtatcacacattttccggtcgaatgcagttaatttgtgccaagtgttattggtgccaaagcaatgttaaggatagagaattaacaaggtttaggtgtgacagagaactatgttatccttcgtcgcggtatataattaattactaatgtagccagaggatgcaatgtatgcactgagtgctgctgctttacatgttccacgatatcaagcatccgtttttccttaacatgtcaagatacacaatc

SEQ ID NO: 2553 - DNA, 492 bp, Sorghum bicolor
  Clone ID: SORBI-28MAY03-CLUS43094_1
tgggcaagcgcgtggaggccatgatcgagatcgaacttggagctcgtcgacgcaaattcaagctcggtgagtactcgtacgtggaacacagcatgagccacaggagaagcaaggcgccatccgccatgcctagccggcgttgatgcatcgatccatgcattggatcgcgcgcacgtgcatgtgtatggcggtctctctatggctcctccttgctcgtcttgaaagctgaatggctcacgcatgtagggttttggagcagcgtaagcgtagtaggggattgctagctcacgtacccattggttgcagcaaggtgatcgaggaggaggtatggtcgatagttttaggttttagacttgcatctatttcaaatttggatcatcgatcgtcacaagttcttggcgtgatgattccgatttgcttgcttcctttttttttttccccctcacattcctctgtgtttcttcgtgtaatttaaggttaacaacttcttcc

SEQ ID NO: 2554 - DNA, 999 bp, Sorghum bicolor
  Clone ID: SORBI-28MAY03-CLUS43105_1
tgctatcaagctgattgattttgggagtacgactttcgagagccaagaccacaattatgtggtgtcgacaagacattaccgagcaccagaagttattcttggtcttgggtggaactatccatgtgacttgtggagtgtgggttgcattttagttgagctctgttcgggcgaagctctctttcagacacatgaaaatttggagcatttggctatgatggagagggtcttagggcccctcccgaagcatatgattgtcagagctgatcgacgtgctgaaaaatacttcaagcgcggagtaaggttggactggccagagggggcggcttcacgagagagcatgaaggcagtctggaagttgcctcgtctgcagaaccttgtaatgcaacatgttgatcattctgctggagatcttattgatcttcttcaaggacttcttcggtatgatcctaatgagcgccttaaagcacgtgaagctctacgacaccctttctttaccagatgcatcagaagatgtggtttctgaggctactgacattgaaaatgtcaatgctgtatttcttcgttttgatgtgtaagaactacaaaaaaagtggagatgttctacgaaaaatgaaatatgctaacttgcaattctgttcaatgatttgaaaggtcttgcaggtagcatgcagaaatctctaaccaggtggtgtcatttgaggataaatgggattaagtgttttcatagaagactggaacactatatttaatgatggcatacggtgatctctggtcaacaggtaatcattttgcatgcatttagaatttgagtatttcttttgcaagttggcaaatatattttcgacatggcacttttggtttgttcgtgttcttttcctctggaatttgtggttttttccagaaataaaacaattgcacccaacctgttttgtatggtgaatactgcttgagattggtctttatattttacaataagtctcatggtcaagcttgattttc

SEQ ID NO: 2555 - DNA, 922 bp, Sorghum bicolor
  Clone ID: SORBI-28MAY03-CLUS4338_1
caaaacgtagtcgcaatattggttccaaaagcaggaggttcttaatcgatgctgaagatgccatggaactaaagcttacctgggaagaggctcaagagttgttgcgccctgctcccactgcaaagccaactgttgtgatgattgaggactatgaatttgaagaatatgatgaaccccctgtctttgcaaagaggtcaattttcaccatccgtgcaacaggggaacaagatcagtggattcaatgtgatgagtgctcaaaatggcgtcggttgcctcttaatgttattgttgcatccaaatggacatgcaccgacaactcatgggacccaaaaagctgctcctgctctgcgcctgaagagttgaccccgaaagagttgcaaagtgttatgcagcagtatgaagaaatgaggaggcgaaagggcagctatggtctgaagctgaatgtcgctgaaatgcgtgcggccacgcgtgaggccttggccactgctgcagtatttggtgaagtcgggaaccaaggcaccgcttcagtcgcgacaaccacaaagcacccccggcatcgccctggctgcacatgcattgtgtgcatccagccggccagtggcaagggcccgaagcacaacccttcgtgcacctgcaacgtgtgcatgacagtcaggcgtcggttcaagacactgatgatgaggaagaagcagcggcagtcggagcgagaggaggcagaggccagcaagaagatcacatgggtgaacagagaagagcctgaggggagcaacctgtcaagatccccgcagacgctggacaccacccgagacaacagtgatgtgaccatgtttgacaaggtggccgacatgaacaaggggcacatcgaccttaactttcaccctgcccctgacgaccgtggcgatcatggacagcatggcgtgca

SEQ ID NO: 2556 - DNA, 552 bp, Sorghum bicolor
  Clone ID: SORBI-28MAY03-CLUS4339_1
cccggtcgacccacgcgtgcggaaccctattcttgcagtactgctttcttcttgttggtgaagtggtaatctggtggtgatagagtaagaatttgttcaagttgccatagaagcgagaaatggtgtaatgcttgctggatgttgctgaattgctatgctgccatgattgactaggatgctgctctgctcttatcggggataccttttagatgccatgcttcattgtttggattaattcaatgaatataacctttgacactaaaaattacgcctgcattatctttggttttgttgagtccctgatccagtgatccttgagtttctgtgcaacatagatctatgtatgcgatgcctgaattggaacaacgcaaaacttttaatttcagagcctctgtcatcatattctgcatctgtaccgctacttttgtctgtttattactggtcatgggagatgaatttggttactatatataactgggagatgaatttggttattactggtcaagatatgcaattgcatgttttttttgtttgcttccacctaggcattga

SEQ ID NO: 2557 - DNA, 663 bp, Sorghum bicolor
  Clone ID: SORBI-28MAY03-CLUS43461_1
tggatctgatgaccagtgggaatttgttggcgagacaagtacttccagaagctttgagagatcaagtgaggttgatggtacgcaggatcacacacatcaagttgtgaaggccggtactgactcttcagcatccaactctctcccgagtaacatgcctacagaaactgctgaagagaatcctgtaactcggagcaacaaaactgacaatagcgatcatgtggtcacgaccacagcatatagtgctgaggataatcaaagtgatcttccagaggctaaccatctttttgaggatgagcattatggtctggatgacctggagaaaatcatgtcggaaattggtaatgtgcgatccaacctaaggctcatgcctgacttccaaaggagggagatggctgcaaagctagccatgaaaatggcagccatgtttggcggtgatgaagaagaggcatttgaggatatctaaagcgattcatgtaattccattgattcccagaacaggtttgcttgctggaaagaatggggcacctagggcctttctcatgataatgtctttttctttagcgaaaattttgtgcctattaggcgttctaagccatataggatgtattattatgaactttaactcccttgaatcctccagtggaaaactttctgaactatgtt

SEQ ID NO: 2558 - DNA, 771 bp, Sorghum bicolor
  Clone ID: SORBI-28MAY03-CLUS43498_1
gcacgagggtcgccggacttcaaggtgcggttcaccctggaggtgaagcagggcggcgggcgcaacagccagttctacctcatggacatgggcagctgctggaagaacgacgggcgcgcctgcgacggcgacacggcgacggacgtgacccggtacagcgagatgatcatcaacccgtccacgccggcgtggtgcacgccgtcgcggatcgaccagtgcccgccgtggcacaccttccggaacggcagccgcgtgcaccgcaccgacggagcccgcttcccctacggcgcctaccacgtgtactgctcccccgggaacgcggcgagcgcggagcagcccaccagctactgcgacgcctacagcaacccgcaggcgcaggagatcctgcagctgctgccgcaccccgtgtggggcgagttcggctacccgacggcgaaagggcagggggtgggtcggcgaccccagggcgtgggagctcgacgtcggagccatgtcgcaggcgctctacttctaccaggaccccggcacgccgccggcaaggaggcggtggacgtcgctcgacgtcggcaccgagatttacatcagcgacagggccgaggaggcggagtggacgctcagtggcttcgacgtccttgtgccggacatcaagtcacagcaacgggccagcaacagctgctggtagtacgttacgttgcgtagcaggccaaagtgtctgttttttttcctttattttattcatcatatctacaataataatacgtacaaagaaag

SEQ ID NO: 2559 - DNA, 725 bp, Sorghum bicolor
  Clone ID: SORBI-28MAY03-CLUS4351_1
tgctcttagatgctggttggggtcctgatggggtgctgaaggatgaagaagctttatgcctggatgcgacattttgtgggaatgttgggaggttcatcaaccacagatgctacgatgcaaatttagttgagatccctgttgaagtggagacgccagatcatcactattatcattttgcatttttcacaaccaacgtccgcccacgcgtccgggagctcacatgggattatggtattgattttgatggtgataagcatcctgtcaaatcatttgaatgcttgtgtggaagcagatactgccgcggtagaaagcattcgaggaggctaggcaaagctgcttcgaaatgaagcgttggctgaaagcggcagtgcatgttctgggaaagcgaacggactaatcagttttagagtttgttactgttagggtggtggctaagatgtcttgttaacctatgctatgcagctatcaggaggagacctgagcttatgcattgatgaagtggcagtctggtgttgaaggggccggcttgcattatggaatgcataccatgcccgctgtgcttgactgcggaacgtgaaattcaatgagactgatgcataccatgctcgctgtgcttgactgcggaacgtgaaattcaatgagactgactgtagtaggctcccagataatagcggcatctttgcttgtatctatgaaaagattgtcaggttacttgattgtttcgt

SEQ ID NO: 2560 - DNA, 645 bp, Sorghum bicolor
  unsure (1)..(645): unsure at all n locations
  Clone ID: SORBI-28MAY03-CLUS43560_1
acaggaaaatcgagttccctcttcctgatcggcggcagaagaggcttgtgttccaagtctgcactgccaagatgaatttgagtgatgaggttgatttggaagattatgtttgtagaccggataagatcagtgctgctgatattgctgcaatatgccaagaagctggcatgcatgccgtcaggaaaaaccggtacgtgatcctgcccaaggactttgagaagggctaccggaccaatgtaaagaagcccgagacagacttcgacttctacaagtgaagaaagcttgttgatgttaaaataaaatgcatgcgctcttgtcgatatactaacaaactgggacacatgccatgttggatgttaagcgacaatgactacaattcaaacggcatcataccttgtgctgtttgctagtgtgacaaatgcacctaaccgtaggttgcatggatgtcatctgtactaaatttgtactaacgattttcttgtaattgagcctgcaacacttccctctcattattctgtctgacaaccgacacaagccttcggcgtgtacgtgcgtgcatttttgtattttgattggaaacaaatgatgtttcggatgcgtcttggtagtttttgcttccanaaataatgtaattctttttcaggt

SEQ ID NO: 2561 - DNA, 855 bp, Sorghum bicolor
  Clone ID: SORBI-28MAY03-CLUS43510_1
ctagccgcattgccaccataattgatggaactaacctatctgatcaaagaggttttgacttgccgcctaaggagaggctcaagactctgatgaaaagcatcatctgtgagtctgtgtttgatatatttggtatgtttgatatattacatcaacttgaagtctctctactgagtgacaaggtaaaaagtggtggtaagaaaatttgcttacttatcattgactcgatatcatccttacttgctcccatcattggaggcaagtatccacaagggcggtcaatgatgatatcagtggcgatgatccttaagaagttagcctatgagcataatctatctgttctggtaaccaatcatatggtttctgctggcaatggagctgtcaagcctgctcttggtgagagctggaaagctgttccacatgtccgcctggtgatatctcgtgaacacgatagtaatatctgcacagcaactgtgctgaagcacacacaactggcttctggccgtactacaaaatttgtgatacccagctaacctttcggacgaggtgagatagatttggcgttaaggactgagacgattggtggttcatgccctacccacagtgaatatttctcttttctttttggttgtacatacatggacatggtgtatattgtatatttgtatgccccatgaggcagagcaggatatgtgtatatgtactaggttgttggagacttgggattgagatatcttattttgtcggagttttgcatggttaccatcacttgggaattttctctcttttcctctcgtcaccattgtgtagtgggactagaggctcatgttgagtttcaattgtaggctacctcaactt

SEQ ID NO: 2562 - DNA, 662 bp, Sorghum bicolor
  Clone ID: SORBI-28MAY03-CLUS43169_1
aacagtgctcgagctcctggctccgctctcacactttctttctgcctgctcatcccaacccgtccaccgtaactcacgaatccgcggccgccccctccgcaatcccgacctccacccgccttgcccgaactcgacgctctcttctcctgaacgcggtgcctagcccccgggggcgcggccaccgggggcccatctactgcggctgggctgatggggtggagtgtaatggaggtccggccggagtgggatctaggcaagatgagggagctgcgcttcgttgtgttggttctggtgatatccttgccgtgcttctctgcatccgatcgccaaggagatgctttatatgatatgaaacaaaaactgaacgttactggcggtcagctttcagattggaaccaaaatcaagttaacccttgcacatggaattctgttatttgtgacaacaacaacaatgttgttcaagtaactttggctgcacgaggattcacgggtgttctgtcaccaagaattggagaactccaatatttgagtgtcctgtcattggctggtaacaggattaccggtactgtaccagaggagtttggtaatctatctagcttgacaagcttagatttagaggacaatcttttagttggagaagtaccagcttctcttggcaacct

SEQ ID NO: 2563 - DNA, 474 bp, Sorghum bicolor
  Clone ID: SORBI-28MAY03-CLUS43170_1
cggagtccactacctcatcggcgcgcgtgccccgttcccccacccacgcacccccatcccatggcgaacgcagcggccgcggccgcgtgcgccgcctccgacgacttgtacctgcaggagctcatccgcggctccgtgccgggcccgtcgtcatcgcgcgcgcgtgtggcgccgctgaccgatgacgagatcggctggttctgctgcggcatctgcacggagaggcggctggtgctcgatcggttccgcgccggcggctccgtcctagacgcgcgctgcgcgcacgacttctgcatcgagtgcgtcgtccggtacatcgagggccgcgtcgcgaacggcgcggtgcccgtgccctgcccggcgcccgagtgccgcgacggcgtcatgcacccggaggcgtgcaagaagctgggggacatcgacgtgttcgacgcctggtgcgtcgcgctctgcgagcgcgccgtggggcccgcc

SEQ ID NO: 2564 - DNA, 549 bp, Sorghum bicolor
  Clone ID: SORBI-28MAY03-CLUS43178_1
tgaatggagcagtttcaatgatcaaagatgtatcagagagctgtccagataactggagttcacattcatcttctgctggcaacccagacctaccatatgtggtggtctccaaatcatcaatactgactgctgtatgcaaggagattcttggctgctacaggaagttacttgccattcctgatctgttgaatcaaccaaacatgtcaattctgaagcaacttttgcagactttgcagccaactaaaaattttgatgatgttctttccgagttccaaccatctcttgctccttgcaatgttgattacctatattgtggagcatgtaaaatgttggaggatattatggatccagtgtcctcgttctcataccttttgtcttctgatgtgttaattactttacaatcaattgcaaattctgttgttgtattgttggaaaaatctggggaaccaaatgggaaaaatatccacatgggatgctccaaagcgatcattccctttctgcgaaagcgtcttggatactcagctcataagctgctaagcgctgatttcc

SEQ ID NO: 2565 - DNA, 1055 bp, Sorghum bicolor
  unsure (1)..(1055): unsure at all n locations
  Clone ID: SORBI-28MAY03-CLUS43197_1
gcgtgatccaattctggtccaactgagaggcgtagaggtgcccgccgcagaacacgagcgcatgcttggtgcttgctaagatagaagcatctgcaatcatcattcctggtttgcgagcaaactcatttactttaatcatgtcggatttacttgggagtagatatgataagcaagaagattttcaagttctgttgagcaagaaagatcctggagaaccacctcggcacaagcattacctgtggatggcacactggaccaaagcaagcagcagtgcagaagcccgaaacaacaatggcagcaatcctttggaggatatcaacaagggcactactacgaaagatggtgagaccttgccttatgaattcatgaaatctacagttgctgaaaggctcatggtaggagtaagccgtggaagtgcctccatgcagcatgcccggcagttcaattctagtatgtggggtatggcacgccatgtttccaatgaattggcaccagggaatagcgaacaggttgatgagtcttttgaaaaatctatgaagcacgatgctgtgaacttgagagctagagcagttgtgtcagaaacatattctattcaccagctttcagagttaccgttggattttcaagaccttgggagctcagatgatccaagtccagattggagccactttccaatgttcgaaattaatcgaaagattgacagtattctcaaccgtaaacgaaagtctgcagcacttggtcctgcacctctgaatctaaatgtgtctgcatcccatgtgatggccctatcgtcacaggaatacatgatgcactcacatcaaatagctgacaagaacatggatacgtgcaaacctgcagaaggctttgcatctcacatagaagatcctgctggcctcaactcagatccttcagggccaaagttaaagggacaattattggataccatgtcatgttcttgcagcaaggacgacaacaactcagcagattgtccaatagatgagcagcatacaagccactattttgcaaactcanagcatgaactaccctatgtatct

SEQ ID NO: 2566 - DNA, 789 bp, Sorghum bicolor
  Clone ID: SORBI-28MAY03-CLUS43671_1
gcacgaggcaataagccatatgggttgcttcttgatactaaaaatgaagtgtttggtttaataagaaagggttcattttctctattccgttgtttggagggtgtggaaatgcttatttatggttcatctgaagaatttcccaatattgatgaccttggaatgaacttattggatgatatatctgattttgaactcctcaaagaggtcctcagatgcatgggccatatacaccatttgctggggagatcttccacagcagtatattatgaatgcctaattagttctattatatcatctgatgaaattgcttcacatatagtaaagattctagagactggttttagtcctcaatcatcctcatccctcattacattacttggaacggatacttatgtagaaagaaggcaggcagctcacagaagtcaaaggaagttttctgttgagatgttactatcttttcataagttgcaatcaagatccgcgtcctggtcggcagtattcgatgtgattgagaagtttatgaagtgtttgaacacaaacatgagtatacaagagcatggatcaaagagagtttgtaatgtaaattatgtgttactagttcaagctacttcacaggttgcaagaacaatgtttgagtgtgcatttgatctgtttctgttccttagttatctggttggtgttggtggccaggtctccttattgcaaagtgatgttgccagaataaaattgaagttgttcccaacgattcaagacatattgggacagtggattgttctccactttgtagga

SEQ ID NO: 2567 - DNA, 770 bp, Sorghum bicolor
  Clone ID: SORBI-28MAY03-CLUS43674_1
aagctattacctgctttaatcacaatcgctccgcccctcctgttgcttgacttcgcgggtcactgtagtgtagttgttgcaatgcttgggattcaccttgcggttatcgttgggcatcgattccgatgactggatcgtagatcctgttgagaaatcgccttatcgttgtgtaataaattagaacctgtggtggtggaccgcgggggccgccgttcctgccggtggccgcggcccgggccgtcgccccggccgcgcgctcgcaggcatggttcctggaccagtttggcgttcttcacgacgggaagaagccgtacccgggcgccattctggcattggagaagcttgcggggaatggggcaaagatggtgataatcagcaattcctctaggcggtcgtctgtgacaatggagaagctcaagagcctggggttcgacacgtcctgtttcctcgcgaccatcaccagtggggagctcacacatcaacaccttcagaagagaaacgacccatggtttgcagcccttggaaggaagtgtatccatatcacttggggtgacagaggagcaatctctctggagggacttggtttgcaagttgtgaacaatgttgatgatgcagagtttatattagcccacggtactgaagcccttggatcaccttctggtgatcctcttcccaaaagtcttgaggagcttgagcaggttctaatgcttggcctagaaaagcaacttccaatggtggtggctaatccagattatgtcactgtcgaagct

SEQ ID NO: 2568 - DNA, 742 bp, Sorghum bicolor
  Clone ID: SORBI-28MAY03-CLUS43696_1
gcacgaggggaagccgggaagcacgcggtgatggcgcgtacggggctccccgcgcgcgatctcagggtgctcgacccgttgctctcgtacccgtccacgatcctgggccgcgagcgcgccatcgtcgtcaacctggagcgcgtcaaagccctgatcacagccacggaggtgctgcttccaaacaccaaggatcctgccctcgcgcgcttcgtccgcgatctccagacccgcgtcctcgcatcttcgtcggaccaggcagctgagctcactgacatggaaggtgaatcatctatggttgcttcaccatttcctgtaccaagttcatccaaaggacatgaagtggaaatgactaagaagactactgctattgtgcctgaaatgactagcagcagcagtatgcccaatttagctgttgcaaaagatggaaataccaaggttttgcctttcgaatttcgagctcttgaagtgtgccttgagtcagcctgcagatctttggaagaggaaacttctactctggagcaagaggcatatccagcgttagatgagctgacatcaaagatcagcacattaaaccttgaacgagttaggcaaatcaagagtcgtctggttgcgatatctggtcgggtacagaaggtgagggatgagcttgagcatttactggatgatgaaatggatatggctgaaatgtacttgacagagaagcttactcaacaagaaatcagtgaggcttcatctagagctg

SEQ ID NO: 2569 - DNA, 698 bp, Sorghum bicolor
  unsure (1)..(698): unsure at all n locations
  Clone ID: SORBI-28MAY03-CLUS4370_1
cgtgcgcccacgcgtccgcccacgcgtccggctccgncgnggctgncccgngtcccgccgcgcctgggcgngccaggggngcgccgcgnccggagnatngnnngctcttcgattgcaagcaaacaaattttagatctaggttgaggtggagaggggccaggctccgctgcttgatatcaagggcaaggatgaagaggagattggtgcgtttcgtattagaggccagtcaagaacatcaacctacttgtcctcgtccgctgagcatgggggtgtgttccggcgcggcgggccaacgacaacatggaagctgcagctggctccgccatagcagcttcagcttagatgtcctccccgtgccacactgagctcatcttgtcgaagaaggaagagtctgtgaagaaagagatatttggttgtatatctctttgtgcctgattatttgagtcaaagcaagggattctagatcgctaccaggaaggcttagagtagggggtcatcttttgtgattggttgagtgaaacttttgactgattatttgttgtctcatatacctaaatgttgtttgcaagtgctttgtcactttgaacttaactgcacatataattcaccagtcttaagatttgtctgtggtttttttcatttaaaaaaaaaaaaaaaaaaaaaaaaaaaaaaaaaaaaaaaaaaaaaaaaaaaaanag

SEQ ID NO: 2570 - DNA, 606 bp, Sorghum bicolor
  Clone ID: SORBI-28MAY03-CLUS43722_1
gcacgaggcaccctcgcctcgctctctgcactcccggtacgaaatccgtagataccaccggcggcgatcgcacgggcggcgtcgggaactcgggatacagcagaaaccctaacccgcctcatcctcgtgcgatgtcggcaaccgccgtggccccgacccctcccgccgcggccttcgcggtggcggccccgccgtcgtacccggcggccttctccgccgccgcggcgcccaccgagggccacgacggcgacttctactgtcactacaagtcgctccggcgccaccacgagttcctggagatccaggaggactacgtcaaggacgagctcaggaacctcaggcgcgaggagctccgcggggccgaggaggtgaagcggtgccgggcgacgccgctcgagatcggccagttcatggagatggtcgacgccgaccacggcatcgtggcgccgaccaccaccggcggcagcttctacgtgcggggcctcagcaccatcggccgcgagctgctcaagccctcggcgtccgtcgcgctgcaccgccactcccacgcgctcgtcgacgtgttgccgcccgaggccgactccagcatctcgctgctcggctcgt

SEQ ID NO: 2571 - DNA, 626 bp, Sorghum bicolor
  Clone ID: SORBI-28MAY03-CLUS43727_1
acgcccacgccccgtcctcgcttccgtctcccacaatccaaggagaccgagcagcaggcggcggaagcaacccgctgggggcggcggcgtggagtccagttttgctcggctcgccgctgtgatccgccggccggcgaagcggggtagagaaggggggcggcggggattggagagtaggagcagggagagatgtcagacgcgctgatcaacggcctcgccggcgccggcggcgggatcatcgcccagctccttacctacccgctgcagaccgtgaacgcgcggcagcagacggagcgcgacccctccaagccggcgttcaaggacggtgccgctcgccagttgtacctggttgtgaagaatgaggggtgggagcgcctgtacggcgggcttatgccctcgcttgtcggcaccgctgcctcccagggtgtctactactacttctaccaaatattcaggaacagagccgaggcaaaggcccttgagcgatcccggagaggactaggcgatgggtctgtcgggatgctgcagtctctcactgtcgctgcgttgtctggctgtgtcaatgtactgctcacaaacccgatttgggttgttgttacacgaatgcaaactcacagaaaggcaaa

SEQ ID NO: 2572 - DNA, 707 bp, Sorghum bicolor
  Clone ID: SORBI-28MAY03-CLUS46158_1
ccccagaatacttcatgcatgggatcataaatgagaagaccgatgtgtttgcatatggagttctacttcttgaactagttaccgggcggaaagcggtggactcatccagacagagcctagtgatatgggcaaaaccgctgcttgatgcgaacaacatcaaagagctggtggatccttccctcggcaacgagtatgaccctgaagagatggtgtacaccctagcagtggcatccttgtgcattcaccacagctcaacctcgagacctagtatgaaatcggtagtctgtttcttgaagggagaccgggagtcacttgagctggtgagaaggcccaaaattgtgaagcccctgatgtttgactcgtgcgattcagaagattacacacgctcgagttacctcaacgatctcaaccggcacaagcagcttgcattagagcagtgaactttgaattgagtttggacagattcactgtaattttgtacatcagtcacgctctagccacactttgatcctcccgctttccacataggttttaaaaattgtatggattgatgtgagggatcagttatcattcaatcccgggttactgatcttgctgtaattttccccagagtttagcacatgttaaggccctgtgatctactatatcacttcgattgtaatgccaggtgatgcagccatcagtgacattcctgagatggtgatgtt

SEQ ID NO: 2573 - DNA, 633 bp, Sorghum bicolor
  Clone ID: SORBI-28MAY03-CLUS46159_1
gggaatgacgacacgctacaaaaccagcgcagcacttctgctaaggaagactcaaaaatcctatcagaagttctggaaacctataggtcgaggtttggcaagctggaaatttccttgttaagctctgagaagatgatgacattacatgatatggcatcagagctgcaggacttggagcggtggtatattgtctatcaacttgcgaagtgtcatggatacgcaaaaaattctggactggaaccctgcacagcgactgtcaagaaacatgatggagctgctgcagcaccagtagactcgctgagtagtatcaagtgtcgcttactgaactagggcagttcagggactactaacaagtctacccctgtttgtcacaatttccagcagtcgtgcatcaccgcaatgctggctgagtaggaatacatagaaccatagaatatactactgctttcacgttgcccgattggcttattttgttaggaaattagaagcaacttctcggtgctggctgagtaggaaattagacgtaggaacaggtgatgtgacttatcctgtgttatgtgatcagatgtaggagcacggtgctaccattttgcaagtatagctaatgctagttgtctgtaattttcagatgtt

SEQ ID NO: 2574 - DNA, 596 bp, Sorghum bicolor
  Clone ID: SORBI-28MAY03-CLUS46187_1
tgctccgaactaagaaaagatgctatgtgaatcatgtaaattattgctttagccatatgcatgtacaggcttctgaatttctttattctttgttagactagtcactgtccaggggagtcactgtgattaacaggataatctggtgatcatcctgtgttatggacaaagtgcgctgtggtttaccaacctggatgaattgacaaaggcttaagacaagatggcgtagatgtgactccctacaattttgtattgctgaaccattgggatctgaggcatccccctttttctctttttttttctcctttttttttctttttggtgaggcatgctcggttcaataaattgatagtcccttgtatgtttgctctcctttccctttgcatatatggtaactgacctgatgcgtgtagatttgtattgcggagtaacaatgtaaatgtgtaggtttgaatatattgatttggagatgatgtaatccttctgtactgcttagcttccatgttggcagtttacttggttttcctttcggtaaaaggttgtttacttggttaattgtaactagcagcactgctaatagactattggttctgactgtc

SEQ ID NO: 2575 - DNA, 558 bp, Sorghum bicolor
  Clone ID: SORBI-28MAY03-CLUS43781_1
ctccattccaactggtccccgccgccgccgctgccatctccctcctccctctcctccgtaccacccgtcttcgtctagccgccggacggccgcccaccgccagtccgccaccatggcacccggcctctacaccgacatcggcaagaagaccagagatctgctgtacaaggactacaacacgcaccagaagttctccctcaccacctgctcgccccatggcgtcgcaatcacagccgcaggaacaaggaaaaatgagtccatctttggcgagcttcacacacagattaagaacaagaaattgacggttgatatcaaagcgaactcagaatcagatctgttgacaacaatcactgttgatgagcttggcactccagggctcaaatcaattctcagtttggttgttccggaccagaggtcagggaagtttgaactccaatacctacatgaatacgctggtgtgaatgcaagcatcgggcttaatcccaaccctatggttaacatttctggtgtctttggaagcaaagcactctcagttggcgttgatgtttcatttgatac

SEQ ID NO: 2576 - DNA, 513 bp, Sorghum bicolor
  Clone ID: SORBI-28MAY03-CLUS43795_1
gcacgagggatgaacaagatttttcagttttgggaagacacttttcagacattgtacaacttcagggctgaacttgtttccttgtctccaggctcgctcgtggagatttgcactaagatatgtggagatgatgtccacttcgacaaacttttctttgctctggagcaatgcatagatggcttcaaaacaggctgcagacctgacattgcactcaactacacagacttggatggcatctactcagggaaattagcgtgtgcttgtgcgcttgatggtcacaattggatgtaccctgttgcatgggccatttttgactctgcttcaaatgagaactggacttggttcatggagcaattgaagaaggctatagggaatctaccaggattagcaatttctgctgatgttggtgataataatctaactggaagtttctacgaatggactatgaacataaagggcatgcctttggttgacttgattgacaagatgaggcagatgacaatggggggtttg

SEQ ID NO: 2577 - DNA, 745 bp, Sorghum bicolor
  Clone ID: SORBI-28MAY03-CLUS43811_1
cgaagccatatggaacagtcaaggaataccttgttgtttgcaagttgtgcaaaggaagtggtgacaaatgcccaggttaatgtggttatgtctgataaagcactagttaagcaattacaaaaagaacttgcaaggttggagagtgaattgcgatgcccaacttcatattctggtcttgaagcattagtgaaggaaaaagataatcaaatccggaagatggagaaagaaattaaggaactgaagttacaacgtgatctcgctcaatctaggctccaggatttgctcaaggttgttggagatagccacagttcgaagcatcccctggcttcttctggaagaaactttacttttgatgttcctcagccatgtgaggatgagcgatcgacgacatcagaagttgtcagcagtggccaaaattttaggcttcaaggacgccagacaatacaaagagattataggtcccagcaatctgaaaatgatgtgcagtttgctacccctcttagctattcagtcagtagtcccccattcagtgggatgcccccaactaatggcagagatgataactctcaaatatctaatgaagattcagaggatctttgcaaagaagtacggtgcatagagaccaatgaaacagaagaaaatgaatgtttagagtcatcagctgtgggaagcaatagtctgcaagattcaaatgtagcttccagcatgcaagggggtaatcatccaaatcgatctgtgaattcta

SEQ ID NO: 2578 - DNA, 555 bp, Sorghum bicolor
  Clone ID: SORBI-28MAY03-CLUS43812_1
ctctcgctctcacttcttcactctacccttttttttacacttatggaagctctaggagcgcgctcctccgtgctctcgtcgccggggaccgccggagacgcgtcgccgtccctgtccctgccgctccgcagagcctccgccgcgttccccgggctccgcaggagcccctccgctctcgccatctccacgcgctggctgcgcgctccaccccgaatcggcggccgcctgctcgccggggcaggggaagacgggtccctggaccctgccgatgacacgactgatcaggcgggagattttcaattactcgagagtaatgtaactctacgcggaagcaatgacatggataccactaaacatgatgatgctggcacttctggaagtggtgggactaacactggtggctctagggctggtctattcagaacacctatttcaggtggtgtgcacagtgcaaccgctgttcatgatttaccaccaccagctttggctgttcgcaacctcatggaacaggcaaggtttgctcatctgtgcactgtaatgtctcggatgcatcac

SEQ ID NO: 2579 - DNA, 198 bp, Sorghum bicolor
  Clone ID: SORBI-28MAY03-CLUS4383_1
gccgacacgtaacaatgtttgcagaaaaaataatagaaacatagtatacttgcttccattgagattattgcaatggtccaacacaacattcggaatcatccaatttctacaaaatgtccaacctaaacaattctgatgaaatacttgtatcgaaatggttgcattttttgtggcagtttttctcccaggatacagtgg

SEQ ID NO: 2580 - DNA, 885 bp, Sorghum bicolor
  Clone ID: SORBI-28MAY03-CLUS43830_1
gaccctcttccccccgctttcctactggggcggcgccgctgttggcgcagaggagcagaggtggcgtatcggcatggactccgccgccgccgctctcctcgactcctccgcctccgcctcttcctccgccgccgccaacggcaacgccaaggagatgcccgcccgactcctcgcccaccgcaccgcccacaacatgtcctcctcctcgctccgcaagaagtccgacctcgcgctcctccgcaaggtcccctgcgccacgctccgccgcctcctcgacaacttccaggaggtcctgctcgccaccaagctcgccctcctcttccccgccgtcctcctcgcccccgccgcgcgaatcttccaattcggccaggaatgggtctttgtgcttagcttgatcggtctcgttcctcttgctgagcgacttagctttctgactgagcaggttgcgttttacacagggcctactgtgggtggactgttgaatgcaacatttggaaatgtaacagaggtcatcattgcaatctttgcgctgtatgaaggcaaggtagtggtggtgaaatgctccctactcggctcagtcttgtccaacttgttgcttgtgcttggaacctcccttttccttggtggcctggctaaccttggaactgagcagctatacgacagaatgcaagtagatgtcagcacaggacttctgattcttggtgtgctatgccactctctgccactgatgctgaggtatgctgtgagctccggggagcacgcggtatcttcttgggattcagaactggagctatcccgagcatgcagcattgtcatgctccttgcctatgtagcctaccttttcttccaactgaaaacccaccgccaactctttgagccccaaga

SEQ ID NO: 2581 - DNA, 510 bp, Sorghum bicolor
  Clone ID: SORBI-28MAY03-CLUS43833_1
gcacgaggccactatgtcgcagactctgatagattaattcctgctggtgaaaccgaatttgccaaggatgcagcttttggctataaatcttccaatctcagacagtgggttgcacgggggactagaggacgggtttcggagaaccaagtttcaacaatttccataactctcttgcgtaaacaaggaccaactgctgtctgtgagcatctctgtagcttggcgaagggctctgtgtgcatcgtcaatgctgctagtgacagggacatggccgtctttgcttctggaatgatccaggctgaattgaaaggaaagcggtttctctgccgcacagctgcaagttttgtgagtgcaaggattgggatcaagccaaagccacctatctgtccaaatgaccttggcttaaaaagagctttaactggaggcctcataattgttggttcatatgtgccaaaaactacaaagcaggttgatgagctgcgatcacagtgcgggcaatctcttcgagtaata

SEQ ID NO: 2582 - DNA, 637 bp, Sorghum bicolor
  Clone ID: SORBI-28MAY03-CLUS43592_1
ttccaggcatactaccttagagtacagtatccagttgaaaaggcaaccacggagaagctcacgagcctagggaatggcgtgagcatttttcacctactggattatccagtcagtggatttttgttcaaaggtggtgcgagcctggaagatttgtcggatgtggtctccaaagtgtgcatcttcttgcaagagaacaacagacctttcaatgtcctcatctctgaatccggcaagagagttttcctcctaccacagtgctatgcggagaagcagatcctcggaaaggcgagccaagagttcctcgacatgagaatcaatccagcaatctgggagctcagtggccatttggtgctgaagaggaggaaggattacgacgaagcctccgaggcaaacatatgcagatttttggttgaagcagctctttctgaaaccgaatttcaggagttgaaccgatgcctgctcgactttgtgacctcttggttgtaactcggacataggttcctagagagtaacaatcctgaagtttcagtaaacagttgtattggtaactgttactttatgatggtatatcgtgtagtagtatttctgatttgactcatcacttctgcgatgaaagtaatatgttttctccgacttc

SEQ ID NO: 2583 - DNA, 643 bp, Sorghum bicolor
  Clone ID: SORBI-28MAY03-CLUS43626_1
gaacttctcatgcgccggcgaggaaaccaaggtcggggaacttctgatccggtgttagggtacagtggtttggcgccaagccatggagggatccctggaggcgcggcccggtgtcctcctcgtcggcgccccgggtgtcggcaagcgaaccatcctctcccggttgcttgcagcagaaatacctgacgtacatgacttatcctccggtgtgctgtgtcaggggtggacaattcaaacaaagtattattcagctgatctttccatctggacagcgaatcttggtgaagaattttctcttggttccctacctcatctagaccggctggctgccctcgttatggtctttgatatgaatgatgaatccaccttgcttactctgcaaagctgggctgccaatgttgatatccagaggtttgaggtcttgttatgcattggaaataaagcagatcttgtacctggtcatagtgcacatatacaatataggaggcgtatgcaaaagcttggggagtctagttctgatctacaccctgattatttcgattttgggataaatgaaagtgagggttgtagcttgttatctgaggaagagccatgcatagagatcagaaactctactgcacagtggtgcattgagcagaacata

SEQ ID NO: 2584 - DNA, 568 bp, Sorghum bicolor
  Clone ID: SORBI-28MAY03-CLUS43647_1
gcacgaggctcaaagcatatgtctcagccatttgagcatctagtactagaggagaatacttgtttgccgctgctatgatcgataatgcagcatgtcccttgtgccagacaagcagtgaagatattaagcatatgatgtttacatgtggccgagcaaagtctatttggaatttcctaggaatagggagccaaattgatccctttaatattatgttacacttttcctgctggaggttctcactgaggtacacaacagatacaaaggaattgaacacagaggccatggtgctgagcaaagggaggggctgttcttgtttatggtgcactgctgaggtttgagggatggattaattttcctcattttgatcctaagctttcgtagggatcatggggcctcaggtcctgcaacggatttctctttcttattgacgaaaagagaaggaggaatcacattgttcgttctttggcatctcttcagaatggatttcgttgagcgtgtgcttgagaatgctttgttgtcgacaaatacaaagtttgtcagtgttttggtgcttgcagttacaggcttt

SEQ ID NO: 2585 - DNA, 615 bp, Sorghum bicolor
  Clone ID: SORBI-28MAY03-CLUS43649_1
gcacgaggctcagagctgcctctccccgctccgccgtccgaacgcttcccagaacggttccatggcgcaccgcgagccggaggccagagcccctccgccgccacccttgtggaggcagcagcggctgcggccaagcggaagggcaaggagaccgtgggtctttcccgccgaggctcctccggtggcaggccccctctctctccgcgcgctgcttccgtctcgaggtctagggagctgagctccgcgggcggcaaggcccccctctcgccccgcccgatgtcccacgcggaggtggtggcgagggctaagtggacgaggagtaggagaaccatcgatatggccgtggaccagacagccgaggcggatgagttgccgagtcaatcgatgaagcaggtgaagtctccaacaacatggcctgggaaagtttacaagaaatcactttggagaaaggttttggacaggataggaaaatccagtggaaattacacaagagtggatcctcatgtgagctatcagactgtcaatatgtctgggatcatcaggcattacaacctcatcgaaatggttgctcgacaagtggaatgtggttcaaatgcactgaacttttgccgtggc

SEQ ID NO: 2586 - DNA, 504 bp, Sorghum bicolor
  Clone ID: SORBI-28MAY03-CLUS43876_1
gcacgaggctctcctccccggttttcgctcccctcgagaccccaaaagcaccgaaagggggaggaagagaaagcggcggggttcaactgttcaagaacgccaagaccctcctccaggattatcccaaaccacccccccccccccccctcatttccagcctcttcagtggcggcgccgatttggaattccggcgacggcgatgggctccggatctttgctcaaggtcgtcgccaacaacttcgacgtccttgcagggcctttggtggcactggcttatcctttgtatgcctccgttaaggcaatagagaccaaatctcctgtggatgatcaacaatggctcacatattgggtcctgtactcattaataacattgtttgaactcacatttgcatcaattattcagtggcttcctttctggccttctatgaaattgatctttatttgctggcttgtcttgccgtacttcaatggcgcgacctatgtgtaccaaaattatgtgagacc

SEQ ID NO: 2587 - DNA, 827 bp, Sorghum bicolor
  Clone ID: SORBI-28MAY03-CLUS43888_1
gcacctcaccgtcggccggcaaaagacctggcctcacgccctcaccgtcactgggaatggtggcacggggagccgaaggcctggccagctcgtagaacgacggcgaacaagtacggaggagagaattattggttaaagactatgaagtttgactgttgacgcacatgaaatgctctataaactcgaccggaggaagtatttgcattcaaggatgacatgggcatagtgaattatttatatgatgagactaactcatcctttccaaaggaaaaggtacaggagttgaagcaattcagtcaactcggaagcaagacaccgggccccccggaaaactttgtaaccccaggagttgaagttaccactggacctcttggtcagggtatcaccaatgcagttgggttggcactcgccgagaagcacctggctggccgcttcaacaagcccgacagtgaagttgtcaaccactacacatacgttatcctgggagatggttgtcaaatggagggtatctccagtgaagcttgctcgttggctggacactggggtcttggcaagctcattgctttctatgatgacaaccacatatccgttgatggagatacagagatagcattcacagaagatgtgatcgcccgctttgaagcctacgggtggcacacactctgggttaagaatggaaacactggctatgatgacatccgtgaagccattaaggaagcaaaagcagtaaccgacaagcctacattggtcaaagtgaccacaacaatcggttacggatctcccaacaaggccaactcatacagtgtgcacggaggtgcattgggcac

SEQ ID NO: 2588 - DNA, 670 bp, Sorghum bicolor
  Clone ID: SORBI-28MAY03-CLUS439_1
cttccgctccggccatttcgccttcattgcggggggggggcgtccccttcccctccgcctggtccggccgcctccacttttcgcaccccagaagcgtacgtcactgtgtagctgctggccgccatggccactacagtcatggccgcggccgtctccttcccgtcctcctcggccgcctctgcgggggggggaggcgtcgccgacgtccccatgtgccgccccgcacttcctctcttaccgccctaggcccgcgcgggccgccatccgggcgcaggcgtcggctacggacaccgccgtcgaggcgcccgccaagtccaaggagtccaagaagcaggaggagggcgtcgtcaccaacttgtacaagcccaaggaaccgtacgtcggcaagtgcctcctcaacaccaagatcaccggcgacgacgcgccgggggagacgtggcacatggtcttcagcaccgaaggcaagatcccgtacaaggagggccagtccatcggcatcatcgccgacggcgtcgacaagaatggcaagccgcacaagctcaggctctactccatcgccagcagcgctctcggcgactttggcgactccaagacagtctcgctctgtgtcaagaggctcgtttacaccaacgaggcccgagagatcgtcaaaggagtctgctccaacttc

SEQ ID NO: 2589 - DNA, 1083 bp, Sorghum bicolor
  Clone ID: SORBI-28MAY03-CLUS43913_1
gcacgagggagagcaaggaggacggtaagatgcacgcctgtggccatgatgctcacgtggcaatgctactcggagctgctaggctgcttcagtctaggagggaccttttcaagggtacagtaaagctcgtgttccagccggccgaggagggccacgccggcgggtactatgtcctcaaggaaggcgtcctggacgacgtgcacaccatcttcgccgtgcacgtggacactgccctaccggtgggcaccgtcggctctaggccgggcccgttcctcgccgggtcagctcggttcacggcgaccatcaccgggaaaggcggccacgcggcggggccccagctcgtcgtcgacccgatcgtcgcggcctcctccgccgtgctgagcctccagcagctcgtcgcccgcgagatcgaccccctgcagggcgctgtggtgtccgtgaccttcatcagaggaggcgaagctttcaacgtcattccagagtctgtgaccctgggtggcacctgccggagcatgacaactgaaggcctgtcctacctcatgaagagaatccgagaggtggtacaagggcaggccgccgtggggcggtgcacggcggtcgtcgacttcatggaggagaagatgaagccatatccagccaccgtgaatgacgaggcagtgtacggccacgccaaggcggtggccgagagcatgatcggggaggccaacgtgaggttgtgcccccagttcatggcggccgaagacttcggcttctactcgcagcggatcccagcggcattcttcagcgtcggcgtccgcaacgccgagacggggaagatccaccacgtgcactcgccgcacctcgacatcgacgaggccgcgctccccatcggagccgcgctccacgccgccgtggcgatcgagtacctgaacaaataggcgtctgcgccaaggccaaaagctgcagctagctattgacaatgcataccgttctgccattttgttcatcgcaggggccgaccattacatgcatttgtggatggctcgtataatattgctcatctttataagcagtaagtactgaacatataaaaaaaaataccaa

SEQ ID NO: 2590 - DNA, 550 bp, Sorghum bicolor
  Clone ID: SORBI-28MAY03-CLUS43982_1
gcacgaggctgatagccatgtcggagactgaatcggcggcagtggccgcggcgctggacccggcggctacagcggagccgaagcctcggcggctgcgggggcacaagaagggcgccggcgccccctccgtcgcccccgccgcccgcccgggcggcggcgcggcccccggcgaggatggatgtctttgctggtttgatctgcgcaccaaagatgtacttttgaccatggaagcagcaaataaaccaatttcttcaatttgctttaaaccaggaaatgaagattgtgtgtatatctctgctggaaatgaaatattgtcctttgatgttcgtatgtggctttcttatagggagctcaatcaaagccattagagacgtataactacaatagagatgaaatcaatcagattgctgtcagctctaaaggttttctcgctgctgcagatgatagtggggatgttaagattgtcaataccattcagaagcgcctgtataaaagattaagggaagcccacacgagtgtatccttatctggtgtaactggatgctgttga

SEQ ID NO: 2591 - DNA, 591 bp, Sorghum bicolor
  Clone ID: SORBI-28MAY03-CLUS43975_1
ctactggaaacctaaacctcacctcgcctccgctcgcccgcggccccggcggcccaaagtcgaagcaccgaaccagcggcggcggcgggcggcgggcggcgcggcaagtggtgaccatggcggagctcaagcggctgtcggagagccgtgacctgacgcggattgagcgcataggcgcgcactcccacatccgggggctagggttggactcctccatggaggcgcgcgatgcctcggagggcatggtcgggcagctcccggcgcgccgcgccgcggggctcatactccagctcatccgccagggcaagaccgcccgccccgcgggcctccccgcggccctgcccgccgccgccccctccgcccccgccgcggcctccgccctctccccgcgcgccctctccccctccgccgccctcgcgcccgccgtccgccgcgccctcggcctccccatcaaggaggaggcggagatcattgagggtgaggtcgtggagatctcaatcgaccgccctttgtcggcctctggcgctggcggcagctcggctgccccttctggtgctactgcggctggtaagtcagggcggctcacgctga

SEQ ID NO: 2592 - DNA, 404 bp, Sorghum bicolor
  Clone ID: SORBI-28MAY03-CLUS44200_1
gcacgaggccggcgccggcggccacctcccgccggggccaccgggcctgccgatcctcggcgcgctgccactcgtcggccctgccccgcatgccggcctggccgcgctggcgcgcaagtacggtcccatcatgtacctgaagatgggcacgacgggcgtcgtggtggcgtcgtccccgtgcgcggcgaagacgttcctcaaggcgctggacgcgaagtacgccaaccggccggcggtggcgagcgccgccgacatcacgtaccggcgccagaacatggtgttcgcggactacgggcccaagtggaagctgatgcggaagctcgccagcgtgcacctgctcggggcgcgcgcgctcgccgactgggcgtgcgtgcggcgcgacgaggccggccacctgctccgcg

SEQ ID NO: 2593 - DNA, 434 bp, Sorghum bicolor
  Clone ID: SORBI-28MAY03-CLUS43741_1
gcacgagggagaactagtctcgagttttgtattcttctcgcccgccgttcgtcttccccttcgcctctttctctctctccgtgttctcgcgtcgccgtcgccgctggtgcgagatggtcgagacgaggcggagcgccgcggcgaagcgcccggcggcgggggaggagcaggaggacaagggcgcgccggcatcgccggcgccggcgcccacggaggacccggcggcgggtccgggagcggctgacgatgtcgcgtcgtcgcagcccccgaagcgcgccaaggttgggtgcgcggaggcggataccgtgaagccatcggtggcgccggcagcagccggcgccgttgtgggtctgcccaacacggctgggctgcaggcgctgaccggcgccatggacaagctggaggccctcttgaggtccaaggaggctcagtcc

SEQ ID NO: 2594 - DNA, 830 bp, Sorghum bicolor
  Clone ID: SORBI-28MAY03-CLUS43743_1
gcacgagggccggctgtgactgtgagtgcctcctccggctctctcggtgcagtcgtcgtccgggagtggggcgcgaggtggccggagtggagctaggcaactcgagctagtcgtcaagaagaaggctgctggagatggggaaggcggcggcggcggtggtgctggccgtgaacggcaagcggtacgaggccgccggcgcggacccgtcgacgacgctgctggagttcctgcgcacacagacgcccgtcaggggccccaagctcggctgcggcgaaggtggctgtggtgcatgtgttgtcctcgtctccaagtacgacccgttcaccgacgaggtgaccgagttctcagcgagctcctgcctgacgctgctccatagcgtggaccgctgctcggtgaccaccagtgagggcattggcaacaccaaggatggttaccaccctgtgcagcagcgcctctccggcttccatgcctcccagtgcggcttctgcacgcctggcatgtgcatgtccatcttctctgcgcttgtcaaagccgataaggcagctgatcgaccagccccgcctgacggcttctccaagctcacttcctcggaggcggagaaggctgtctccggcaacctgtgccggtgcactgggtacaggcccatcgtcgacgcttgcaagagcttcgcagccgatgttgatcttgaggacctgggcctcaactgcttctggaagaagggtgatgagcctgcagatgtcagcaaactgccaggttacaacagtggtgccgtctgcactttccctgagtttctcaaatctgagatagagtcctcgattgagcaggataac

SEQ ID NO: 2595 - DNA, 556 bp, Sorghum bicolor
  unsure (1)..(556): unsure at all n locations
  Clone ID: SORBI-28MAY03-CLUS43754_1
gcacgaggcccgcctccgtccgggatctcgctgggagcctctgtccgggccctggcgcgccgtggccgcccgctccctgggccgccattgccgcctcctttctgtccttggatggctctagctttgccctccctgggcgccacgggtcttgtccggccccagctcgacgctgcctttttgtcgcctgggctgctcgcacgtcgtggggcgtgggtcgtccgcacgtcggggcccgtgtttcatcggggcttccgggcctgcgcaactttggggctacctggagtgcacgacggggtcgcaacattcggccaacggcgggctcaatggacccggccctccgacctctcgtcggtccgaggcctccttccacttgtctgtgcccagtggaggtgctctttagtttccccgttgctggggaggcctctgcgctactgcctggccctgttcccgcccctgttccagctccgtctaccgccatcgtgtgttctggggggccttttggctgccgccttgcccgcttgactcccaaaatccaggactgtttaccgcanaggat

SEQ ID NO: 2596 - DNA, 676 bp, Sorghum bicolor
  Clone ID: SORBI-28MAY03-CLUS43759_1
gcacgaggcaaaggtccaaccccggtggtggaccagtccctcttcctcagctgctgctcctcacggctcaccacaccaccacgagcgtccgtcaaccgccccgccgacgcgatctcctcccgctcccgccctcgcccgcccgcccgccggcgcgatgcaattcctcagcgcctccgcctcagtctcagtctcctcgccggtgccgccgtcggcgcatctcctccgcctctcgcgccccccgcccttcccgcacctccgccgccgctgctctccgcccaaacccctcgccctgacgccccgaccgccgctcctcctcgcctcgcgcccgtcccttctcttcaccccacgcgctcacggcggccacggtcacggtcacggccaccaccatcaccacggccatgaccaccaccaccaccaccacggccacggccacggccacggccacggtcaccacgaggtggacgtgcacgggggaggcgggggcgcggcggtcatgcgggtggcgcgggcgatcggctgggccagcgtcgccgacgcgctgcgggagcacctccaggcctgctgcatctccctcggcctcctccttatcgccgctgcctgcccgcacgtcgcgctgctcaactcagtcggccgcctgcaggccgcgctcatcgccgtcgccttccctctcgtcggg

SEQ ID NO: 2597 - DNA, 1110 bp, Sorghum bicolor
  Clone ID: SORBI-28MAY03-CLUS44081_1
gcacgaggctagaccgccgctcgccgacgccgctcctccctctgctcccagcgccgcacgcccccgccgctccctcacccgccggccgccgcgcaagagccgcaaccccgtcacgtctgcccgcgtgggagccgcggccccgtcaacatccacccgcgcgagagctgcagccccgtggacgtccgcccgcacggggactctccgtcttcgtctctctccgagtgtgggactgtgccggctttaaccgcctcgtatctcacactccgggtgtcgactgccgaattgatccctgattcaatggaggcgtccgaggcagcaccggcggtggcgacggccgccgtcatggaagcagaggatgtgagcggcgggaagggcagctggtacgtgcttggggagcgggcgctgatggtgccgtacatgcgggagcacgtgccgcggtaccacgactggatgcaggacccggcgctgctggaggccaccgcgtcggagcctctctccctctcgcaggagtttgaggtccaccgctcatggaccctcgatcctctaaagcacactttcatatttttggataaggagttgatagagggagagttcgtgcccggcaacccgcacactgaagctatggttggtgatgtgaacatatatatgaatgactctgatgatatgcagatcgcggagatagagatcatgatagctgaacataagagccgtgggaagggaattggtcaagaagcaatcttgctgatgatggcatttgcagtcgagaaatatggaattcacacattcagggcaaaaattagtgaatcaaatacggcatcccttaagctcttcaggaagttgggcttcaaggatgcttcatacagtgcggtgttcaaggaggtgactctggaggcacctactgactcactcccgttgaggtttcctctaaccattggagactggtgacgtctgacatgccccaagctaattccatgcggacgacacaagaagctgatgctgtttgtctgtactatctgaccaaaatttactcgggatgatgatgtatgaaaaaaattgaataaaacagttgcacagttgtgattcaattgcattacggcaacaggaacaagt

SEQ ID NO: 2598 - DNA, 670 bp, Sorghum bicolor
  Clone ID: SORBI-28MAY03-CLUS44107_1
ccatcatcttcattcaccatgatcccgacatttggggaaaagacgcaagtgagttcaatccagagaggtttgccaatggcatctccaacgccaccaggcatcaggcggctttctttccgtttggaggggggcccaggatctgcatcggccagagctttgcgttgctggaagccaagatggcgctatgcaccatcctccagcgcttctcctttgagctctcgccatcctacacccacgcgccctacaccgtgataacactgcaccctcagcacggtgctcagataaggctgaaaaagctctgactgtgatgctcatatgctcgctggcagtggcagcagcagcagctcctacgctgctaccgaatactcccggatccaactatgtcagaacgtcttacaacttggatcgggggaagtagttgttttgtattaatacgtaggttagaatatgaataataaaaagagggtgtgtattaatagggaataggttactgttactgcgatgcaattttgtgaagatttggcaaagaacttaattatacaatatgtagttcttttttatagggtgcactagtactcgaaagtagtctttgcatgtaggagtatatacatttggcttttcatttttcttccctgtatatatatattaccaatcgctgaaaggtcaatat

SEQ ID NO: 2599 - DNA, 825 bp, Sorghum bicolor
  unsure (1)..(825): unsure at all n locations
  Clone ID: SORBI-28MAY03-CLUS44112_1
gcacgagggttcggtcgtgagcaacatgtcggctactactanccgaaaaccagcagaacggcgacatcatgtcgattcccggcgccgaggaccagatcgaccctgccacctttgagcaaatcctcgagatggacgaggatgaggacgagcgcgagttcagcaaaagcatcgtctacgacttcttcggccaggcagaccagaccttcaagaagatggacaaggagctggaaaagaaggagggaaagtacctcaaggagcttagtgagctcggccatttcctcaagggctcatccgccacgctcggccttaccaaagtcaaagactcgtgcgagaagatccaaaattacggccagttgaaggacgatgcaggcctcaaggacatcacagaagagcaggcacaagaaaatctggcaaagatcatctagcaggccaagaaggagtttgcagacgtcaaggatatcctcaaggagttttacaaggacgaagatgcttgagggcatgccaccgccagagtaatggcgcgagttcccgtctcgcactcaccatgctcctctggaggacatgggtcatttgcagcaagaggggctccggacggtccgcctctacaagcgacgcgcgacactggtcttcctaccaaccctactgccacgccctaattgttacgatttccttttcttctgttcgcatccttgtctttgagttctagggttgtttcgctgtacatgtcgttgggtagccagcactctatgtagccagctccaatcccgacttatggatatgtttcttgcggcgcattgcgttgaccttgaaggcgttcgaagaata

SEQ ID NO: 2600 - DNA, 801 bp, Sorghum bicolor
  Clone ID: SORBI-28MAY03-CLUS44116_1
gcacgaggctagttagtggctctcagacatctagcacaccggagatgggcctggtgcataggaaaaggtgcgctggtagggaggatgggggtggtcggtgcactaccgggagccggtgccattgttcaaagaaaaggaagcttaggataaggaggtccatcaaggtccctgcaataagcaacaaggttgcagacatcccagctgatgagttctcgtggaggaagtatgggcagaagccaattaagggatccccacatcctaggggttattacaagtgtagcagcgtgagagggtgccccgcgaggaagcatgtcgagaggtgcgtggacgacccctcgatgctgattgttacctatgaaggtgaccacaaccacaaccgagttctagcccaaccagcctgatctttcaggctatcaattcaagatcgcttctatagtcaccctccttcccctagaggaagggaggacaacaacaacaagaagaagagcctagtgtctgtacatattttctgcttctaacagttggggggagagagagtcagttagctagctctttcagaagaatcaaatcaatggtgacagaaggaaacttatcgcgtcgatggagaaagggagagtgcctcatcaaatcaaatactctagttttgtagtttcgatttctcttttgtgttcatcatcctgtgttagggccccatcctgtggttgcagtgtagtaacattgagctgcagttgtatgtctgagaaatgggttagggggattgatcggagaagaaggcataaggcaggaaagtgccgtaaaagt

SEQ ID NO: 2601 - DNA, 523 bp, Sorghum bicolor
  Clone ID: SORBI-28MAY03-CLUS44122_1
gcgccgacgtggagctcagccaggtcctgcgccagttctctgtgcgctccaccggcgttggtgtgtcggctcgccgtgacgccacggcggtgcttcgtcgcctcaacagcacgacgcagcatgcggattattattcacagtcacccgccccaggtgtcgtcgtcgtcacaacagatcgatgaggaaatcatgcatcattgttgttgttatacatacacacatacatacatacatagatgtaaatacagtacaggaggaggaaggaaaaacatgcgcacacagtacctagcagctagtgtactagcagtgtagatgatgagggccaggtttttggaagtagctagctagaagtggtgtacatttggaaggaaagctaggatggatggagcatggaggggtataaagttagtttcattctttagttttcccctagctcgttaatgaattttgggataatgttttttccctttaatttgttcttaataatcttatctagtaccttaagaaacggtaggaaataaag

SEQ ID NO: 2602 - DNA, 615 bp, Sorghum bicolor
  Clone ID: SORBI-28MAY03-CLUS44192_1
gcacgaggagatcgtggtttccttcctggaatgtccaaggaagaacgagaaaaagttgccaggagtgaaacattagccatacggctgtctaacattgcaaatatggttctctttgctgcaaaagtgtatgcttcagtaaggagtggctcacttgctatcatcgcatctactttggattctcttctagacttgttgtcaggatttatcttgtggtttactgccttttcaatgcaaacaccaaatccctacagatacccaattggaaaaaagcgtatgcagccgctgggaatacttgtttttgcttctgttatggcaacccttggccttcagataattctagaatcaatacgctcattggcgtctgatggagacgaattcagcttaacaggggatcaagaaaagtggcttgtggacatcatgctttctgtgacattggtaaaacttgccctggttatatattgccgctcattcaccaacgaaattgtcaaagcatatgcacaggatcacttttttgatgtcatcacaaatataattggcctggttgctgcactacttgccaattatattgagggctggatcgacccacttggtgcaattgttctggcaatctacacg

SEQ ID NO: 2603 - DNA, 476 bp, Sorghum bicolor
  Clone ID: LIB3481-039-P1-K1-A3
cgtgcgcttatctaaggaaggcgattgtttttggctatggccctatcaggccatggatgtctattgcgcactgtttgatttgacacttggatctaaaaaaatttacaccaaatgaagttccaagggttaagataagcttagcatgcgtgtttgcattcatggcgattggatagcctttgatcatcctcaaatcaggactagctggatggtttaagttctggttcatgcctcggatggtttatcatttttggatgagcacttttacaatggtacatcacacagctcctcatataccattcaagtcatctcaagaatggaatgctgcacaagctcaattaaatggcacagttcattgtaactatcctcaatggatagagatcctttgccatgacataaatgtgcatgtcccacaccatatttctccaagaatcccaagttataaccttcgtgctgcttatgactccatcaaacagaac

SEQ ID NO: 2604 - DNA, 328 bp, Sorghum bicolor
  Clone ID: LIB3478-029-P1-K1-F5
atcatttttggatgagcacttttacaatggtacatcacacagctcctcatataccattcaagtcatctgaagaatggaatgctgcacaagctcaattaaatggcacagttcattgtaactatcctcaatggtatgtttttatgttacattgcactcacactaagaacaaagtttatctgctggacatatgtgactcttattaagataacaaagtagtgctcaaaagttccttataatctgtgccagagcactgagtgactgtgcaacaaagcctgcatatgcgcattacccaataaaactaaatatacaatgaggaggccaaaacatg

SEQ ID NO: 2605 - DNA, 442 bp, Sorghum bicolor
  Clone ID: SORBI-28MAY03-CLUS43844_1
aaaaaaaaaaaaaaaaaaaaaaaaaaaggttgttcccgttccgtcaccgcctgctcaccgtctccgtcgtcctcgtcttcgtcctccccgcgccgggcgtgcaccctcaggcgcccaacctctgcgggaccaaggccaatggcaggtacgcctgcgcagactgctccacctctgctgccacctccgatcgagggcccaccttcaaggccaatctcctccgtttccgggactccctcaaggacatgctcgccagcaacgcgagcttcctgaacgccaccttcgcgggcgacagcgacacgccggaggaaacggtgtacggcctcgccacgtgcctcgcggacgccgaggcgtccgattgcgtcgcctgcctcgccgcggcggccggcgagttgcccgggacgcggtgcgcgagccgcagggacatggtgctctggtacccgca

SEQ ID NO: 2606 - DNA, 735 bp, Sorghum bicolor
  Clone ID: SORBI-28MAY03-CLUS43856_1
gcacgaggcattcgcctcctcctcctcttctccacctccgcaaaaccctagccgccgacccctcgaatcccctaccagcgcccgaatcccggcctcagtcgagctagggctcgccgatttctggccgggcccgttgaaatttcggccggtcttttcgggtgaatccttcggtttactctgaggggatttttttgatttctgcggcgcacgaggggggagcagaagggaggaggagaggaacgagaagatcatccgcggcctcatgaagctgccgcccaaccgcaagtgcatcaattgcaacagtgtggggccacaatatgtgtgtaccaatttctggaccttcatttgcctgtcatgtagtggaatccaccgtgaattcactcaccgtgttaagtcggtgtcaatgtccaaatttactacccaagaagtgcaggcccttgaacagggaggtaaccagcgagcacgtgacatctacctaaaggattgggattggcaacgaatgaggttgcctgccaataccaatccagataggataagggagtttatcaggtctgtttatgtggataagaagtatgctggtggatcctctaacaaaccagccacagatagtgagagtatcaagggcaacggcaatgacatgagaagacctagctcttatcattcgtattcccagagcccgccctatgattttcagtatgaagatagacgatatggtaagcaagtcgacacacttgc

SEQ ID NO: 2607 - DNA, 812 bp, Sorghum bicolor
  Clone ID: SORBI-28MAY03-CLUS43857_1
ttatgttcacaaaagaggatggcaaggctacttcaaatcctactgtattccagaagacttggtaccacgcattctatctccagcttactttcaccactacaatgcccaaacacctgaagcatcttttataaataaaactggtgtgaaatctgaagaaactatggaggcaagtgcggaaagacccaaagggaacaatggagaacaactcgttctaggcgttggtccagcgcgagggtcactttggaggctttcaaaacttgttcccttggaaggggtgcggaaaagcttaagtgtaattcaaaaacaaacaaatatttttgggaaagcaccatcacaattggatagttatttgcagtcaaaggttgatgaatcagaagaaccacctcaatctcttgagattcaggaaagttcacaaggaattgctcttacccctttatctgataaagatggagggaacactgaagataataataggactgagaaaataaatgcatctgaagcagggaattctaaacgctggagcagggtaccttctttgccatcatatgtgccatttggtgagctttacctattgggagattcatctgtcaatacactttcagattcagaatactccaagatgacatcggtgcagtctgttatatcggagttaagagagcgtttgcagtcacactcaatgaagtcctatagggcaagatttcaaaaaatatatgattcatgcatgtgtgtaaatgcccccgtttttactggcattgagcaattgccacaattttcacatctacaagaattaattggtctaacagctacggatt

SEQ ID NO: 2608 - DNA, 496 bp, Sorghum bicolor
  Clone ID: SORBI-28MAY03-CLUS44299_1
gctttcctgcgtttgcagattgagatttttgaggctagcaaagatgataacagagaagcatcatcagaatgttctatttgccttgatggattttatgatggagatgagctgataaggttgcgctgtggccacaggttccactcaacatgcttggagccatgggtgcggaaatgtgcagactgcccatactgtcgaacaaatatacggtcacgatcctgatggcaaacccttagctggaaataagattataaccacaatggagttaaactgttgcaaaattcgctgctgtgggcatcccagttaatccggtgctcctatggcaacatgtcatttctaatatcctgaatatgtgtgttgtgtcgctcaatgaggtttatggactatggtgttgtgtgttgtgtggaggctgatagcagtatagcttagaaaccacccttttctgtgtatgtaagcgagggattgagcaaatgatcctgttctacttatgataattttc

SEQ ID NO: 2609 - DNA, 412 bp, Sorghum bicolor
  Clone ID: SORBI-28MAY03-CLUS44296_1
gcacgaggcaacgacctcagcatcatgaccaatgtcatcatgctcaacatcactgagaattggtccgatgaagaggagcagtgggagatgtgcactagtaaaaccaagacttgtgctgacaagtacgccatggagagcgcacagctggcgtgtgacgtggcgtacgcgggcgtcaagcaaggctctgtcttgggagatgaatacttcttctctgcgctgccggttgttcggaagagaatagcgcaaggaggggtcaggctcgctgcaatcctcaacaggatcttcagtgagagcggcagcagcagcaggctgcagagcagttgatccaccaggacaggacaggattagttattgacgataagaagtgcatggaacgagttgtttcttgcttgcctgtaactttagacgtaat

SEQ ID NO: 2610 - DNA, 994 bp, Sorghum bicolor
  Clone ID: SORBI-28MAY03-CLUS44327_1
gcacgaggaatatcttgaagttgcagaaaatgcggctaactttataaaggaaaaactttatgatgcaagctcaaagaggctgcatcatagctatcgcaatgggccatccaaagcaccaggatttttagatgattatgctttcctaatcagtggcttgctggatctatacgagtttggtggaaagacagagtggcttctgtgggctgtccaactgcaagtcactcaggatgatttgtttttggataaacaaggaggtggctattttaatactcctggagaagacccttctgttctcttgcgtgttaaagaggattatgatggtgcagaaccttctggtaactcagttgcagcaatcaacttgatcagattatccagtatatttgatgtggcaaaatctactggttacaagagcagtgttgaacatctattggcggtctttgagaccaggctacgacaacttagcatagcgttgcctttgatgtgttgcgcagcagatatgctctctgttccttcaaggaagcaggttgtgctagtggggcagaaaggatctgaagaatttcaggacatggtagcagctacgttttcgttatatgatccgaatagaaccgtgatccaaatcgatcctaggaacacagaagaaatggaattctgggattgcaacaatgcagacattgcgcaaatggcacggagcagccctctgggggaaccagcggtggcgcatgtgtgtcaggacttcaagtgcagcccgccggtaacctctcctggggcgcttcgcgagctgctgaacaagacactggttgctgcaagttcagcctgaggcattttgccgcctctgctatgttcgtagatgttacgataccaatgtagtaatagtaacaaacctgtgtagatatttacatatgtgagaagttcaaatatgtttgtcagttaagttgtagagcccgttaaagccttcccagctgtagacatgttcacaataaagcacggagcaaaa

SEQ ID NO: 2611 - DNA, 693 bp, Sorghum bicolor
  Clone ID: SORBI-28MAY03-CLUS44337_1
tcaccgccggcggctagtcccaagtcgccggtggagatcaagatcgaggagctgacggaggagcggaaggcgctgatcaagggctcgttccgcgaccggcatttcaacgcggggtccatcctgctgggcctcggcgtgctcgagtccgtcggcggcgcgctcaacacctggttccgcaccggcaagctgttcccgggcccgcacctcttcgcgggcgccgctatcaccgtcctgtgggcggccgcggcggcgctcgtcccggcgatgcagaagggggacgagaccgcacgcagcctccacatcgcgctcaacgccgtcaacgtgctgctcttcgtctggcagatccccactgggctcgagatcgtcggcaaggtcttcgagttcaccacatggccatgagtgaatcaccaccatatatatgcttgctttgcttgccatgcgcatcctgttcctgcgtgctcagctcacccctcgatcgctctgcatgtctcttctcatctcttccgttccgtcccattgctaattacgtactactggtgtataggttgttgatgaccttttgctagccgcgcccgtgtttgttgagttctcgaaatcaattcattctccatgtattaggttgtttccttggcctgtccaagtcgatccatgttccttctttatacactacacgagaaataagagctcgtttgc

SEQ ID NO: 2612 - DNA, 688 bp, Sorghum bicolor
  Clone ID: SORBI-28MAY03-CLUS44349_1
aatggctaaagtttgcgacgagcttgccacagtcattggcccaagaaaaaacatcgaagaatctgacattggccggttgccctaccttcaagctgtggtaaaagagactttcagactacaccctcctgctccactgttgctaccacggcatgctcagaccgacgtgaaaataatggggtacacgattccagaaggttctagagtgttcataaatgtgtgggcaatgggtcgagacgaagagacatggcctgaacctgagaggtttatgccagagagatttctggggaagacggtggatctcagaggcggcgactttgatctgattccgttcggtggaggacgccggatctgccccggaatgccgttggcgatcaggatggtgcatctgctgcttgcgtcgctgttgaatcagtttccatggaggctcccggatgaggttgagagaaatggagttgacatggctgaaaattttggcttgacattgaccaaggctgtgcctctttgtgctatagctacagcaatttgatgagtcagtaaggcattctctgtggtaaacagctgttttgtggttattggttcctctgttggtcgatgtatcaatatatcttacattttagtttttgttttcttctttgtgtgctgttggctggtatagctttggtaaccttggtgaataggtaatcttttg

SEQ ID NO: 2613 - DNA, 852 bp, Sorghum bicolor
  Clone ID: SORBI-28MAY03-CLUS44363_1
gcacgaggctcttcttcccctcccatcccacacaggtcatctgcctcgtctgtgacaccgagcagccgatcgcgcaggtgtgctgcaactgcggcgtctgcatgggggagtacttctgcagaaagtgcaacttcttggacgatgacgttgacaaggagcagttccattgcgacgattgcggcatctgcagagtcggtggaaaggacaacttcttccactgccaaaagtgtggatcctgctactcgacgaccctgcgcgacaagcactgctgcatcgagaactcgatgaagaacaactgccccatctgctacgagtacatgtttgattcgctgagggagacgtcggtgctccggtgtggccacaccatgcacctccactgcttccacgagatgttgaagcacgacaagttctcgtgtcccatatgcgcgacgtccatctttgacatggacaagttcttcaaggccctggacgcagagatggaggcaagctacttctacatgggaaagggctggatcgtgtgcaacgattgcagggacacgacgcaggtcttctccggcgtggcgggccacaagtgctgccactgccagtcccacaacacctgccgtgtggctccgcctgtcctcccgtagccacatctcccatctcttgttggagttggatacaaggctcatccgtccatggtatcagcagccaagatacccagctacactacacatatattgctatttataccggtagcatttttatacaccagtccattccagtccgagatgaactgcatataatttcgtgatatgcagagttagcgtatgtatatgtacctacactgttatgcagatcggaagatttccg

SEQ ID NO: 2614 - DNA, 731 bp, Sorghum bicolor
  Clone ID: SORBI-28MAY03-CLUS44529_1
tgcatcaacaacgactgaatcacctacctccagctccactacgtctgtaacaactccgacagtgaggcccagctcttcatcatcaaagaaaaaactcaacagagaagctcctactccatctaaagatcaggactcagcttacagaatggataagaagtccagctatacacctctgaccaataggcagcacaattcaattcctgcagcgcccacaacagctactactactgcagccaccaaagcatccaagaaaacttctggcaacaaatctcagccatcaaaggaagccaagaatgtggcaagactggacaaggcaccaaagaacgttacagcaaccgcaacgaaacctcggttgaatgctggtgcaaaggatcagaaggtggatgctgtcatcaccaggagactgtcatgcccagctgctgcaacaacagacaacgtgcaggttacagcaacactgaaagggaggagcagagctgccaccggcgttgtgcctactgcccgtaagggtgccagtgccaccgatgcggtgctaaagggaaggagagcaggagagaagcagcagagaccaaagcttggaagccatgctaagaagtgaacacggtggtttcagctgatcagtagatgggacgctctcttcaggaaggaatgcagaaagagtaacatccaatttccacccaatgtatgcaaatacacctattgagttattggaataaacttagttgccttaagtt

SEQ ID NO: 2615 - DNA, 668 bp, Sorghum bicolor
  Clone ID: SORBI-28MAY03-CLUS43993_1
gagattggtcaatctgaatgtggaagaatttaaggaagaataatgagtataacaggttttccaatacaaatgtacaagagacaaataaaagtttgagattatcaaaacaaaattttcttctaaaataaattttgaaaccagaataaatgtacttctaatatttttaaccacttgaaaaactcattggtttatcaactgttttttagtctatcggagatgctcggacatggcaattcgcatcctgccatgagctacctgacagccataaacgtcgtctccctccatgccttagctcgcactcatccctttgtttcattccaccaccgcgagggttgaaacacgttgatcagttgcatctccggcgaggcagagcgtcgcagagccacttgcgcaccaccgcgccaccacaacaagatttcctctttgttcccctgacaatggagcagcagaccgtcatcctgtacccgagccccggcgtcggccacatcgtccccatggtgcagctcgccaaggtcatcctcacgcacggctacgacgtgaccatggtgatcgccgagccggccgtcagctcgcccgacttccgcatcgtcgacgtcggccgcgtcgctgcctccaaccccgccatcaccttccacgtcctccctccggtcccgtacgccgacctcgcc

SEQ ID NO: 2616 - DNA, 659 bp, Sorghum bicolor
  Clone ID: SORBI-28MAY03-CLUS44043_1
gcaaatcccacccgcccgcggaaccctcttccccttctctccgccgccgccatggccgccgccgccgcacgctcccgcgccgccgcggcgtgggcacgcctcctctccctgcgtccgcacagcctcgcggaatccaccgcactcccacgccactgccatcacctaggctcgcggatcacgccgccgcgccgccacctggcattctccgcctcctccgggggcgccaggcccaaccagaacatccagagcgagcgggtcgtgcacgagctgctcgctcaggtcgagcgcgagcgccaggaccgccgcgcaaaggacgccaaggaccaggaggaggaagagccaaaggaggaggaggaggaggactacatgggcgtcaagccgctcatcgagaagctcgagcgacgcaaggccaaggaggcggccgccgacgaaggcttctgggagcccaccgactccgacagcgacgaggacgacgagcgctacacgcccgacgccatcaagcgacgcgtcgacgagttcgagcgcaagtgcaagcgccatgaggagtacctgcaatcattcgcagaggccgacaccctcgacgaggctcacaaatggatgaccaaaatcaacaagttcgaggagcgccatctcaagctgccactggagtacagggtcat

SEQ ID NO: 2617 - DNA, 607 bp, Sorghum bicolor
  Clone ID: SORBI-28MAY03-CLUS44021_1
gcacgagggacaggcgccgccgcccgtcgcagtgccgcaccccgcacccgcacaggagccgccggggctgcggctctccgccctctctgtctgcgacgactgggtggactaccgccgccgccctacctcaggtgatccgcccctgctcggatgcccgggggctgaaccggggaatcaaggacatcgtcaggagcatctgctacgtgaacggagggaaaatgtcaacgaatcctgatgagcctaagagtcgtgcccggacagactttttgctcaacaatgaatcagaggttcagaagttttgggatgagaacaaggtttttgaggctgatcctggcaatgagcctccaagccctggggaaaaattctttgggaactttccatacccttacatgaatggcttgctgcatctgggccatgccttctcgttgtccaagcttgagttcggtgctgcataccacaggcttcgtggctccaatgtgcttttgccctttggtttccactgcactggaatgcccatcaaggcctcagctgataagcttgctagggaaatccaacaatatggatatcctccggtgtttcctgtggcagaggattctggtgctgcagt

SEQ ID NO: 2618 - DNA, 950 bp, Sorghum bicolor
  Clone ID: SORBI-28MAY03-CLUS44092_1
tgagtatctgatcaaatggctgacactgcttcggccgaccagagaggtggtaggggttctggcgaacgtggcttcggcggtaggggccgtggtcgcggacgtggtcgtgagggcgccgagggtggtgctggtggacgtggtaggggccgtggtggtccccgtcgcgacaagggtgataaggaggaaccctgggtccccgccaccaagctcggccgtctcgttaaggccggtaaggtgaccaagctcgagcaggtctacctgtactcgctgcccgtcaaggagtaccagatcatcgaccagttcgtcagcggccttaaggacgaggtgctcaagatcatgcccgtgcagaagcagacccgtgccggtcagaggactcgcttcaaggccttcgtcgtcgttggtgacttcaacggccacgtcggtctcggtgtgaagtgctctaaggaggtggccactgccatccgtgccgccatcatccttgccaagctggctgtcgtgcccgtcaggcgtggttactggggtaacttcatcggcaagccccacaccgtccccgtcaaggtcaccggcaagtgcggttccatccgcgtgcgcctcatccccgcccccaggggtaccggcctcgtcgcctcgcaggtccccaagaagatgctgcagttcgccggtattgaggacgtcttcacctcgtcgtctggtcacaccgccaccctcggcaacttcgccaaggccaccttcgtcgccatcacccgcacctaccagttcctcacgcccgacttgtggaagtctggtcgtttccagaaggatctctaccacgccaacactgacttcatcgcctcgtacggcgagaagcacgccgcggaggagaagcaggctcgccccgacagggactagagcccccaaacgcacaaacgaaaaccacaaatccaaaaacacagctgctcctttggttaata

SEQ ID NO: 2619 - DNA, 882 bp, Sorghum bicolor
  unsure (1)..(882): unsure at all n locations
  Clone ID: SORBI-28MAY03-CLUS4457_1
gccgcacgcgtccgcaaagctctacaagacctatgagaaaatcaaaaaggaaagctttgctggactcatgggatgagctcttgacacagatgccctctcttcttgatatagatcatccatgtgctcagaagcagatcatggaggcacggaaagttgttgagtcactggaagaagaccctgatgatcctgccccgcagtctaacgcattgggagagagcgaggtttcacagtggaatgtactgcagttcaacacgggaacgactgcgcctttcatcataaagtgtggagcaaattcgagcagtgagctggtgattaaggctgatctgcgagtccaggagcctaaaggtggcgaggtgatccgtgttgttccaagaccaacagttcttgcggacttgagttttgaggaaataaaaggtgtgtttgagcaattgccagaggcagtcagcttgcttgccttagcacgaacagcagatggtacaagggccagatattcaagattgtacagaaccttagccagcaaagtgacggccttgaaagagattgtcgcagagatggaaaaaggtggtgttttcaaagatgtacggtcgtcgtagtgttattgtagagttatagatgatgttgatgttgtatatggatgccatttgacggcatcccctgtaactgtctttgtttttactatgaggaaacctatgttgtaacactattctttggcaagaaatggcccttgcctgcctcaacccgtaatgctatggttgtgcaaggcgtcaatgtaaattgtagctgcagctgataaatgtctgcagtgctgcaagtttgatgaactttaccatgttaagaanagtactcatgcatttcactgttcgttgtatatttgtattaaga

SEQ ID NO: 2620 - DNA, 362 bp, Sorghum bicolor
  Clone ID: SORBI-28MAY03-CLUS44588_1
aaacgcccgcagccgcagtcagcctctctctcccttcgcgcgccgcaaatccatccaactcaaacccaatccgaccgatcccgcaaaaccctagcgccgtcgcctccctctcggctccacaccgtcctctccgtccctcgcccacgcgccgcagatcgcggggccgtacatcgcccgccgggagatcggaattcttgtctttcttttccccccttgcgcgctgcgggtggcgatggcgggcggcgggggtagccggcgcggcggcggcgcggcggaggagccgaagatcggcagcggcaacgtgttcgcggcgctcgagacgctcaagaagaagaagaagaagccggcggcggcggggacca

SEQ ID NO: 2621 - DNA, 1068 bp, Sorghum bicolor
  Clone ID: SORBI-28MAY03-CLUS44593_1
gcacgagggcacagtggccggcaacagaagggaaagacaaagggtaaagacagagaaagatcagcaagaaaggaggcagcgagctgggaggccatggcgccggctgatctcccaccaggctttaggttccatccaactgatgaggagcttgtgaactattacctcaagaggaaggtccatgggctaagcatcgagctcgacataatccctgaagtagacctctacaaatgtgagccttgggagctagcagagaaatcattcctgcctagtagagactccgagtggtatttctttgggccaagggataggaagtatccaaatggatgccgcacaaatcgcgcaacccaagcaggatactggaaatcaacaggcaaagatcggcgaatcaactaccagaacagatcaatcggcatgaagaagacattggtctactacaagggtcgagctcctcaggggctgaggaccaactgggtgatgcatgagtaccgcattgaggaaagcgaatgcgagaacaccatggggattcaggactcatatgcattgtgtcgtgtcttcaagaaaaatgtggcactcggagagttccagaagcaaaagcaaggcgagtgcagctcatcacaagctaatgaaaaacaagaacagtttacaagtgtcagggatgctggacagtcatctggttcaaatgagcatggtaaagacaacacatggatgcagttcatagctgatgatctatggtgcaacaaaacaaagtgatggaagtatggaactgataaggcagttgtttaacttcatctaactagaaacctctcagttgcacattgactttgtatatgtttgataacatcagttctcggttctcactttggagtttggacaggatgaccactaagtttgggggctctgactcttcatgtagagttatagttttctcttttggtactgtaatagaaaaaacatcctactttggtacttcaaggttcggtcttcctgtatctgtcattaaacacagtgatttataggagggagtacagtacaaagacataaatttaatttgacacatatcatttattt

SEQ ID NO: 2622 - DNA, 593 bp, Sorghum bicolor
  Clone ID: SORBI-28MAY03-CLUS4462_1
cgtgcgggaattgaagagctggaccttattctcacagtgtatggaaactacaacttcccatgcccacgtttatgtggtggaactagaggcacacttcgctatctctctcttgcaagctgtcaatttcatcccacagtcagaattggctgcttgacaagcttaacaacactaaacctaacttttgttcatattgaggctgatgagctatggtgccttctttccagttctcctaacttggagcggttcgaactcaggcattgtgacagcatagtttttcttaagataccatgcctgcagcaactcaattacctggaggtggtatgtagctccaatcgtcttcgagcaatagagagcaaagctccaaatctctccagtgttaagtttgtaggtgacctccgaattccgctctcacttgaaaacacaaatcgtattaagatattagacacacactactattgcagtctcgccttttatgcccgtgctgatcttccatccaccatgcccaatcttgaagctcttaccatacgctctgacggtgaggtggatacagtaccgatggtgcctagcaagttcctctacctcaagtacttgag

SEQ ID NO: 2623 - DNA, 708 bp, Sorghum bicolor
  unsure (1)..(708): unsure at all n locations
  Clone ID: SORBI-28MAY03-CLUS44640_1
tggttggggacggcatcaacgactccccagccctggcagcagccgacgtcgggatggccattggcgggggaacagacattgccatcgaggctgcggactacgtgctggtgcggaacaacctggaagacgtgatcaccgcgatcgacctgtccaggaagacgttcagccggatccggtggaactacttcttcgcgatggcctacaacgtcgtggccatccccatcgccgctggcgcgctgttcccgttcaccgggctgcagatgccgccgtggctcgccggcgcctgcatggccttctcgtccgtaagtgttgtgtgctcgtcgctattgttgaggaggtacagaaaacccaggctgacgactgtgctgcagataactgtagagtgattgtgaatactatatagctcccttaaccgtttttttgcagaaatgaaatggaaattgcgtcggaaatggtgccttctgtaaattgtagatttttttgtggggttttccatagccttctcatttctcaagttttctttttttacgatggtaccatggtatattcaacctcgtaattgtaaatctctctcgcgcgctgtaatacggaactcgggaaaaatgattggtacagatttattgggctggaaatgatatgtgaaacgaaatgttagttttgggcttttagcaaacgnattatgcacttcttgtgggtgttggcgagttt

SEQ ID NO: 2624 - DNA, 464 bp, Sorghum bicolor
  Clone ID: SORBI-28MAY03-CLUS4471_1
ggcaaggagctttctaaactcgtcgcttttgtcaaggggactcaatttgatcttgtggaatatctacaacgagaaaggcaagggtctgctcgtctggagaattttgcttctgcacttgaactgattggacaaaagctccaaatggatacactgcaaagccgacttgatgcagagttccttctagctcatatgtgttcagtcaagtttaaggaatggatcgtggtgctagctactttattgcggcgggcagaggttttggtggatctctttcggcatgatttgcgattgtggaaagcatatagcattactctacagtcacatgatgtattcagagaataccttgaccttcttaatatcttggaggagcagctttcgtcggtctctgatcttacattgcaaaatggaccattgtcatgaatgctggatgacgacactgattgaaaaaccgactgaatgcggcgttt

SEQ ID NO: 2625 - DNA, 731 bp, Sorghum bicolor
  Clone ID: SORBI-28MAY03-CLUS44213_1
gcacgaggctccaagccatggttgctggtctcgcagtgactgcgccatccattgaggagagtattcggtcaggtgttaggcccaggtgtctctgtgctggtgttggaggtggatcactcctcatgtcaatcagaatggggcttcagtttgatgttctcggagtagaggccgatggtgttgtcctggatgtcgcaaggaatcattttgggctggtggaggatgagtttctccatgtccatgtcggtgatgctatacaaatgatagaggattttgctcagcaaggagagcctgatatgaatttcagtgcaattatggtagatcttgactcctctgatgctatgtgtggtgtcagcgcgccgccattggagatgactcatggaaatgtccttctctgggtgcgcacaatcctacatcgtcacggagttttgattctgaatgtgattccacctcctgcagataggtccttctacaaagggatgattgatgttcttcaccaagttttctcagaactgttcgaaatagatgttggtaatggcgagaattttgttgttattgctacagtatcgccgattgaaaccacagtcactggtgattctggacattttctgacagaattgaggaaattaactggggactttttggagcatataagaaaaatttgacattcctagtcattatgcggtgttgtttgtgttagcctccacaaagacagttcacatatatttgctgtt

SEQ ID NO: 2626 - DNA, 624 bp, Sorghum bicolor
  Clone ID: SORBI-28MAY03-CLUS4426_1
cgtgcgcccacacgactccccatggcaaccgaagaaattccattgagagcttgagagatcataatactgcactgtcgactagctagacccgtgcaatggagagggcaccggctctgtgtcttctgaccaccttgttggcattatatttcttggttccctccagtgctgtacctctctcaagagtgcaaaggatgtccatgcaagaggatgatcagataccatcggttgaaagcagcactctagagccaaagataaaaatggagaggtttgtgcaagaggatgatgaatccatggtcaccgcaaggatggccttcgagacacaggactactctcccccggggcccaacaaccaccacaaaccaccgggctggaggtgaacgaggatcactttgatggatgtcgtgctcttggctgaaggcatgatgctcacaaacctcggagagccagcattgcaatgtttcttctcctagctatactagaatcatgtcacgaagaacaaacaaattaaatgatatgtttcgtatggttaattattgttataattactactacaaatggccatgtggttacaccgtgtgatatgtaagtttctttaaaagattgagcttaaaaagaattatcacc

SEQ ID NO: 2627 - DNA, 528 bp, Sorghum bicolor
  Clone ID: SORBI-28MAY03-CLUS44288_1
gcacgaggcacacttcatccttcaaaagacagcaagaacaactgcactgtagcgctacagcgtggccgagagatagagaaagagatcgagagcaactatggcgtatctgctcaccctgtatggcagcggcggcggccagaggaggacgagccgcgacagtggcacggcggcgccggtgaggcggctgttgaggaggctgaggtccagcttcggccggagcgcggcgcggccgaggcgaagcgcggtgaggttcgggtacgacctgcacagctactcccagaacttcgacgactgcggtgcctcgtcatctccggcggcggccatggcttgttcgtagctaggattctagaaccaggattctgcttcttctgtgtaaataactgtagtcatgatattagtgtggcttagtgtatggttcctcactgagagatttgagtccagggctaattttcgatgattagctatctagctgtaggttcgtcagttcttgtatatgtacaagttatttcgaaaaaaaaaaaaaaaaaa

SEQ ID NO: 2628 - DNA, 962 bp, Sorghum bicolor
  unsure (1)..(962): unsure at all n locations
  Clone ID: SORBI-28MAY03-CLUS44798_1
aatgtatgcatacgctgttgctagcgcattgcatggggttcagcatatccttcgtaaagatttcatgatccagccaccctntgatacaaagctcgggaatacatttataatccacttcacttatggatgtgactattcactaaagggtgaactgacctatgggaaagttggtgaatggcgatttgacaaaagatcattcccagatgggccaccaccaagaaattttacattgccccctcctggagtcccagaaagtgtggttactctagtaaaaatggtcaatgaagctagtgcaaacctacctcggtgggatgatggaatataaactttggctgatgtcaattataccttaggttcctttgatttgccccttgtatatggggaatatcaaagtatcaggtgcagtcggctgtttggtttatgcccaaaatagctgcttgcactcgcacaccatacctgatagaagacgatacagaattatctcattgtactttgcacgaggagaaaagtaagttggcacccacagttttccatttaattatcttgtaactgttgctcaccgctgaaaatctcaatacaagtttttttatcctaataaagtttaagtcattttaaccttctcatttttttttgaaaaatctttgttttagatgttctaccttctatgtgtttcttacactttgttccttccctgctcctacttaataaatactatcaccctcatgaatgaaaaatcgtcttcccaataatacataaaaacaaaggtcactaagggcatgtacagcgcaaacggtttattttgcaaaaaaaacaccctcaccgccgcgagttcaatgaggagagagagtgaacccgtcgtctcgcgactcgcgaggccacgggctcagctcatgctccgagagtcccaggtctcgtcgtcagccgagggcagcgctgtacgggatgtgccgtctccaagcttt

SEQ ID NO: 2629 - DNA, 459 bp, Sorghum bicolor
  Clone ID: SORBI-28MAY03-CLUS44836_1
gcgaggtgccacatcctggcgtacgagtccgccggcgcccacgggaggtacatctgcaacgcggcggtgctgtgctgcggtgacctcgtcgccctgctcgcgcggcggttcccggcgtatccgatcccgaggagcctgcccagcgtgtacggcgagcagacgtacggcttcgacacgtccaaggcccgcgcattggggctggtggacctcaagggcgtcgaggagatgttcgacgacgccgtcgactcgctcagaggccatggccatctccccgccgccgaggacgtcggcaagcatggatagcctcttgatctgaaaagtttcaccccatcgctggtggaaagcttttgattccaaatagcctgctctgaaaagtctgtcttggactgtctgactgcaaaaggtcatttaaccactagaaaattttaaataagaaaagggagaggttcaattcagctc

SEQ ID NO: 2630 - DNA, 679 bp, Sorghum bicolor
  Clone ID: SORBI-28MAY03-CLUS44872_1
gcacgaggagtgactgctggagatatgttttggatagactaatgcatttgcctgatgtacaagaggacgctggaattgggacatgcatccgcgatgctcttctctatggttgtgctgaatttggcacagcacctggcaaagtggaaatggatcgtgataaaacagtgaatgcgaacactgccaggtgccagaatattcttatggacgttttaagatcggagaactttgctttgttgtgcagtgtactctgcagaactgtacatcaagatggggaaagaactagatattttgattttggtgtgattgactcaaggatgaaaaatggaaattatgggcatgaacctgaattattcatgcatgatctgaaactgttatgggaagatcttaaagtagctggtcaagatattattcacctagcagataatctatcaagcctcacagaggactcctacgaaaagctggttggaagagagagaggatcagatgatggtgagctcaatggagctgtggtggccaggtctgaacccaaaaacctagttcaatcaaatgcattggtacccttgacctcacaaggctttaaccaattggatcaacctggaccttcttatctttctgatgtatataaagacagtatctgcaaccaatgtggaaaagaagcaagagtcggtagcgttctcaa

SEQ ID NO: 2631 - DNA, 489 bp, Sorghum bicolor
  Clone ID: SORBI-28MAY03-CLUS44865_1
gcacgaggatcctacaatgatgagcttatctatttgttccaacaaaatatgggtcttggtccaaatcctgtgtcagtagagccagagtttatcaacatgcttgatcagccacaagtatactcaggtcacaggaattttcgaactgttaagggagtcagtttctttggaccacatgatgaatatgttgtgagtggatcagattgtgggaatgtattcatatggaggaagaagggaggtgaattgatgaggatgatgaatggtgacacaagtgtagttaactgcattgaaccccacccgcatttcccgttcatggctaccagtgggattgataaaactgttaagctttggactcctgcatcgaacaaattgatgtcactgcctaaaaatgcaaaccaaataatagcctccaatgaacgtgggagagaaattgatgcttctcgagcaggagtgacactttcatctgatgtcgtcatgcatgtgttgaggtta

SEQ ID NO: 2632 - DNA, 921 bp, Sorghum bicolor
  unsure (1)..(921): unsure at all n locations
  Clone ID: SORBI-28MAY03-CLUS44889_1
gcacgaggcaagctgcagcaaaggcacaggcagcctttcgtggttacctggcacgaaggtcattccgtacattaaaaggtatcataagacttcaggcactgattcgagggcatcttgtaaggaggcaggctgtatcaacccttcgtacaacatggttgattgtgaagtttcaggctcttgttcgtggaacaaatgttagactctctggtggtcacacacaattcaatgtgaagcttgggcagcataactttgggggtgttggatcatctgatgcatggaaagagaagctgtcttcaagcgcgtgggttcggaagcttctgtcttcaccaattgtgctagaacctcttcacttccaatatgacaagagggatcccaattcaacctacaactggtttgagagatggaccataggatgcatctggaaacctgcttttcaacccaaaagagttgctgatgggaaaccactggtaaagaaggctagttatgcaatggaaactgaatcagccaagttaaagcgcaacattcggaagggttctgctgctgtcgctgggagtttccatacatctggtgaatctgataaagtaaagcggaatccaaagaaaatctctagcttccctgctgattcagtaccagatagccagttatctgaacttgaaaaggttaaaaggaacctcaggaaggtaactgattcgatggctgaagcctcaaagatatctagttccagggttgattcctcgaaggtatgtgattctacagctgatgtcccaaaggaatctaatcctgtggtagaaatctcanagacacctagtctcatgaatgggatctctgaccatcaaggtattcaatgtgagaatacacgtgaggcttcatttcctcttgaaactcaagaatactctgacagtgatcatctgttacgatatt

SEQ ID NO: 2633 - DNA, 991 bp, Sorghum bicolor
  Clone ID: SORBI-28MAY03-CLUS44892_1
gcacgaggctgtatgttctaagtaatgactggctgtatacttggttgcatttagttctgcggacgtgcttgaatagttcattcttagcactatacttcatgctagctgctctgtgtatccaggcactgcgccaccttaggcaaattgctcaagaaacaagtggagaagtagtgtacgccttgggaaggcaacctgcagtactacggacctttagtcaaagactaagcaggggttttaatgatgccattagtggtttcaatgatgatggctggtctgtaatggggggagatggcattgaagacgttgttgttgcttgcaactcaaccaagaaaattaggaataacagcaatgctgggattacatttggagcccctggaggcattatttgtgcgaaggcatccatgttactgcagagtgtcccaccggcagtactggtccgatttctgagggagcatagatctgaatgggccgattacaatatggatgcgtatttggcttcatcactgaagaccagtgcgtgctcacttcccgggttgcgacctatgagattttctggggggcagatgatcatgccacttgctcacacagtggagaacgaggagattcttgaagttgtccgccttgaaggacaacctcttactcatgatgaagctcttctttcaagagacatccaccttctccagctttgcactggaatagatgagaaatctgtgggttcctccttccagcttgtgtttgcaccaattgatgaacattttccagatgatgctccattgatttcttctggctttcgtgtcataccacttgatatgaaaacagatggtgtagcctctggcaggacgctagatttggcatctagtcttgatgtgggttctgctgcaccccaagcctcaggggatgcatctccagatgactgtaatttgagatctgtgctgacaatcgcctttcaattcccttatgagatgcaccttcaagacagtgttgcaactat

SEQ ID NO: 2634 - DNA, 651 bp, Sorghum bicolor
  Clone ID: SORBI-28MAY03-CLUS449_1
gcacgaggcgcggccgaccgagctttctgggcggcgaaatctccatccgatccacccatccaggctttcgtttgttctagaacatgctgtggccgatcctggatctccggcctcctctcttctcgcccatccacccaacaaatgctttataagaaggccgttgtggccgccatgtaactcctcgtcagtcggcactcgagctcgagcgccatctttttccgagtaatcatcatcgatctatggccatggcttcctctgcgtcagctctccttctggcggtctccctggccgctctgcacttgtgctgccgccatggccaggctgccgacgccggcagcggcaacggtatcacggccatctacagcctcggcgactccatcactgacaccgggaacctcgtcaaggaggcgcctccgggcatgttcgagaccatcaagcatctcccctacggcgtcacgttcgggcacccgactgggcggtgctctgacggcctcctcatgatcgacttcctggctcaggacctgagtctcccgttcctgaacccgtacctgggcaagaacaagagcttcgaccacggcgtcaacttcgccgtcgccggagccaccggcgtggacccaaccgaccagtacaacgttaccgtccccgtgccgg

SEQ ID NO: 2635 - DNA, 608 bp, Sorghum bicolor
  Clone ID: SORBI-28MAY03-CLUS44555_1
gcacgagggttggagtctcgatgggtgtatctggttccgctgttgcaatggagacgagccacataactttgatgtcgaacgacatccgcaggatcccaaaggctatccagctggcacggaggactcaccggactatcatcgtgaacatcatcttctcggtgatcaccaagcttgcaatcgttggacttgcactctctggacatccgcttatctgggcagccgtcctcgcagatgttggcacatgcatgctggtgatcatgtacagcatgttgctattgagatcaaagggcggtcggaaggcgaagaaatgttgtgcctcttcacagcatgggtcacacgcaaagaagcactgtgtttcccgccactgctcagatggaccgtgcaagtcgacaggctgttccaaagagtcgtctgctggtaaacatggttgtcatgatcatggccatgcccacacccactgcaaagagccgagcagccagcaccctacagaaaagcacgcttgtcatgatcacggccacagccataaccactgcaaagagcccagcagccatgtggtcacggaaaagcatgtttgccatgaccatggaaacacccataaccactgcaag

SEQ ID NO: 2636 - DNA, 478 bp, Sorghum bicolor
  Clone ID: SORBI-28MAY03-CLUS44537_1
agcagcaatctcttccgtctccagcagtgctccaccaaaccgcgtgatccgtccgactccgacctcgctacgcttcgctcgctctcgccggaggcccggagcggagctctccacctctccacccccgcgggcagcgctcgcggcgccgatggagtacgacttccgggggagccgttcgggctcgggcccgggcccctacggcgcgcctccgggggccgcgcccgggggaggctcctcgctctacccgcgcgtcgggcagccctcccacggcgggggcggggcttccacggcgtcgccgcgggccgcgccgtaccaccacggctccgggtccgggtcctcggctcccgtcgtaacgccgctcgctccaatctcctcctcctcctcctcgaaggtgggcatacaagttacgataaagcctgaattccgcattgacccacctcctcaattgccaccacagatggtagaaattcctcgcagc

SEQ ID NO: 2637 - DNA, 598 bp, Sorghum bicolor
  Clone ID: SORBI-28MAY03-CLUS44564_1
gcacgaggctgtccacggcgctgggccgccccgtcgccgccgtcacctactcgctctccaggctctccgagttcctgtcgcccatccggacggtgcgcctgtcgcgggaccgcgccacggacgccgccatgatcagggacctgctggcggagggagacctggtcatctgccccgaggggaccacgtgccgggagcccttcctgctgcgcttctcggcgctcttcgccgagctcaccagcgaggtggtgcccgtcgccatggagaacaggatgagcatgttccacggcaccaccgccagggggtggaaagggatggaccccttctacttcttcatgaacccgagcccggcctacgtcgtcaccttcctcaacaagctcccgccggagctcacctgcgccggcggcaggaccagccacgaggtggccaactacatccagaggctcatcgccgccacgctctcctacgagtgcacaagcctcaccaggaaggacaagtaccgggcgcttgcaggcaacgacggagtcgtcgccaccccaaaaccgccgccaacgggttgctagctagctagctaaaggttattattattattatttttttt

SEQ ID NO: 2638 - DNA, 883 bp, Sorghum bicolor
  Clone ID: SORBI-28MAY03-CLUS44568_1
gttgagtgatgtagatgacatacacggcgtttgtatgtgcttatgtaacatagttacgtagcggtgttagtagtaatgtagtgatatacatccaccaaagtatgtatagcaagcttatgatcagttgacccattaacggcaagatctgctacagttaactctcaacaacaataatgatcactggacatgtatttggaactcggggtttacagtggcaaaagcttacaagcacttaagtggacacagaaccatacattggagcttcaaatagatttggaattgctcgtgtcaaaacaagcataaagtcttgcttggctgattttagtggagagactaagcacaagagaacttctcagaagagagaacatggcacttgaagaccataattgtgtactttgcacctcatcaacagaggaatcacttgtccatctactaatagattgccctttttgggcctacagattaacccacaagcgaacatctttcagaatctggaaagcttcagaagacagttacaggtcccattcttcactgaaatcatcctcatgtgttggtccatctgggaaactagaaatgggattatcttcaacaacaaacagccttcaaaccaagatgccaaaagaactttcaatactgaatttgcgctgcttctgctgcgcgcaaaaagaagctacttcccttcggttggtttttggttaaacattcttgttcctcgcaaaaaaaaaaggttaaacattcttgtttaatctacttagtgtggctcattttttccatttctttctttgtctcttactctttttactctccctcaccctactcccttttgtaatcacttccaaactctttctaataaatctagggtgcgcccatcctgattaacgtc

SEQ ID NO: 2639 - DNA, 607 bp, Sorghum bicolor
  unsure (1)..(607): unsure at all n locations
  Clone ID: SORBI-28MAY03-CLUS44931_1
catngtcatcgcccgtgatgaagtcgccgagagggggctcgttgctgtcaagtaccttggcgccaagtccatggccatctttaccatctccctagcattgtgcatgcacattttgatgggaacacggtttctattgccagcgtagccatctggctggttgggagctggaattccatgacaggtgattgattactacttgtcctgattgtaggtgcagagtaaattatgtagatttgaaattgatcctataatacaagttgtccttctcttttgtgtgttggtgaaaagtgtgaaaatttaagctagaaccctgtggggtttgtagttgatttttgtttttttggttgatggaagtatatatgcatctgaaatgccactggccaatttggcaatgtgattttgaggttagacccctctattgttgtgcccttatagctgtcactagcttgctactgctggttgtttttgttgttataagctgttgatcaatgtaaaacatccaggcagagcaacaggtatcttaactgcttgctcttgaaactctcttttgtacactttttagttgtaagaaagggagaagtgaagtgaataagtggggttgattttc

SEQ ID NO: 2640 - DNA, 540 bp, Sorghum bicolor
  Clone ID: SORBI-28MAY03-CLUS44972_1
tccaggtgcatgggttcccggacgccaccgcctatggccagcctgctgggttcccttacggatatggccacggccatggccatgcgttccatggcgggcatgctggaggacatgcccacgccgccgcagctcctcggcatgggcagcagcagcagcaggcggatgtgtacctcaaggcgctgctcatcctggttggctttctggtgattgcgagcctcatcacgttctaggctttgcctgctggttggttggtgtcatattgctgttgccttgctggtaataaggagtagtataagagagacggagacagttgcagatacgctgcgatgtattgtgtgcatttatcttgccctctccatatacaacacgaccgaaactgaattattcagagcggcgcgtttacatggggaagtgttgatagcagaattgttgtacatactgtttggatgtggtcctgtggtctgtggatcacctacatgtatactgtggttttgaacatacattataatgaataataatttggaagaatctgttcgaatg

SEQ ID NO: 2641 - DNA, 604 bp, Sorghum bicolor
  Clone ID: SORBI-28MAY03-CLUS44989_1
ctggaacacctagcaatgatggagagggttttgggacctctaccagagcatatgacacggaaagcaagttcttctgctcagaaatattttaggagagcaacacgcttaaattggcctgaaggtgctgtttcaagagaaagcatcagagcggtgcggaaactggatcgactaaaggacttggtatcgaggaacgctgtccattcaaaggcagcgctggtggacttgctatatagtctcctacgatttgagccatcggaacgtctgtcagcgcaagaagctctggaccatccattcttcaggaacccaacatgacttgttgagcaggcttgactcatgttgaagaaggtggtagggaggaagcaggcagagccatccattgcaaagctgaaaaggcatcatgctcctctgtaataccagaaaaagtttgtgtaacgcctgtcaatacaggcttctttgtggtgataaatgcttatggcttacagtcaccacaatgtaatgtgacactggcatttttcctagggagattagcgcgccagatggcgcttgtatgttgttaaccgggacgcgcaatgagctgcgtcccaatgccctggtgcccataatc

SEQ ID NO: 2642 - DNA, 762 bp, Sorghum bicolor
  Clone ID: SORBI-28MAY03-CLUS44994_1
ctaatgcaaaagacaggatttgacatggatgatgtagtaaggaagtacatccgttacacactgaatgaaaaacagttcaatcctgatgtggtcgtggatctcatacatcttaggaaggcatcaatgctggaagatgcggaagttgctgaaattttgaatgagatttcaagacgaattgtccgggaaaaagggccagtagttatggacttatctggttttacagaacaaggttttaagcggaagcttgctgtacaagcactgtttggaaaaatcctatacttatcagaacttccggagttctgttcacgggacagctcacttgtagtcaaagaaatctttggagttacagatgaggatgcagacagcctgcggattcacaccctctcagcaacaggtgatatcgaatctatacagaagatggttgacgatctagacatagaacaaggtccctcatcatcgtcttgagttatggtgatgaaataatgctaaacatcttcgttgatagtgttgcaattttagcttgatgtgagtttctccaaccttttcgtttagtttttcatgagcacaggatactccggctcgagcctggaggttttgtaaattgcctctctattaggctagtaacgtctggcagcagtgagtttatagaacacgggaataatatttatatctactctgttttctcatgattcatttaacgatgtacttctacaaaatgcgtttgtgtgaaattctctactaattaaaggatgaagattcaac

SEQ ID NO: 2643 - DNA, 440 bp, Sorghum bicolor
  Clone ID: SORBI-28MAY03-CLUS45044_1
gcacgaggagacggtttcgtctccgctgatgctgccggcaacggaggccaggggaggaggggtgtccgtggttgagatggtgacgggggcgctccggaggtcgctcatactgtgcagcagcagcgccggcgccggtgtgcgcgagccagaggagctggaggaggacggggctgcgcccccgccgggtatgcagatagggggaccaacggatgtgcggcacgtctcgcacgtcaccttcgaccgcttcgtcggcttcctcggcctccccgccgacctcgagcccgacgtacctcgccccgtgccgagcgccagtgtaagcgtatttggagtttcaccaacttccatgcagtgctcgtatgatagaagaggaaacagtgtgccgactatactgttgactatgcaaaggaagttatattcacttgggggtcttcacgctgaag

SEQ ID NO: 2644 - DNA, 630 bp, Sorghum bicolor
  Clone ID: SORBI-28MAY03-CLUS45050_1
gtcttttctcccgtccccatctgcctgcctcggcttgtcgcacgcttcgaagcttctcgcatctactacttggtgctccgtctccctccccggcgccccctcccccgccaccgccgccccggccgccggtaggtaatatcagttccaagggcactcaacatggcggccaatgttggggaatcaacaagcggcagcagcagtggcgctgatgctgggggtagctttgagtgcaacatatgcttcgagctgccacaggagccgatcgtgacgctgtgcgggcacctcttctgctggccgtgcctctacaaatggttgcgcatccactcgcactcccccgagtgcccagtgtgcaaggccatcgtcgaggaggacaagctcgtccccctgtacggccgtggcaaggaccgtgtggacccaaggtcaaagaacgtccccggggcggcagacatccccaaccgtccggctggacagaggcctgccacggctccgcaggtcgaccccaacacccacttccccaacgccaacccgaacccgtggttcatgggcgggggcatcccgctggcgaacgcgcggtgggggaactacaccttctcggcggcattcgggggcctgttcccgctgctcagcttc

SEQ ID NO: 2645 - DNA, 640 bp, Sorghum bicolor
  Clone ID: SORBI-28MAY03-CLUS45054_1
gcacgagggcccgcggaagttcactcactgacatgcgacagtattcgtggaaatccatccctccaaccttgtggactgtcgacgctctccagtccattagtgaatgcccgagcactaagtgagggagacaataattcaccacctgacaatacagcccctgatggcaatggtagcggtggcggattcagcaaaatagagattgcctccataacttcagcatcagcaattgttgcagttctcctggctctggtcatcctttatatttacacacgaaaatgtgcatcaagaccatcaagacgttctctaaggagaagggaagtcactgtttttgttgatatcggtgctcccttgacatatgagactgttttacgtgccagtggaagcttcaatgcaagtaattgcattggaagtggtggctttggagcaacgtacaaagctgaggtcgcaccaggaaaattggtggcaataaagaggcttgctattggaagattccaaggcattcagcagttccaagcagaggtcaaaacacttgggaggtgtcgccatcccaatcttgtaacactcataggataccatctcagcgattcagagatgtttctaatatataattttctgcctggtggcaatttggaaaggttca

SEQ ID NO: 2646 - DNA, 728 bp, Sorghum bicolor
  Clone ID: SORBI-28MAY03-CLUS44741_1
gccgccggccgccccgaggaggctggccgctggggccccgcctcctcccccgaggaggctcgccgctgagacacactagatctggtggtggcgcatgtctccggtcgggatctcgcgccatctggttcgtcaccatgacctgcagtgcctgatataaaccaccttcaaggaaatgcctcgtttgcttttgtccttggtataggatatcagtcagcaagcacaaaagtcgattgtggaagagtgcactagtcatcttttggggcggtgctggtgctccggcctgctcgggcgtcgggggcatctagtctgtgtgctggcatgcggagcttgagtgggggtggatctggttcctggtcctcgctgtctgggcaccgactttcgtgaggtcctggcccggcttcacaggtccccggccatcagtgtgcacctccccccgtcgtgcattccgatggtcgctctggcgtgcaacgacaatgacccctatgatttgatgacaaggacgagcatgcagccacagcaagcgccccttgagaactacatggtatgggtttgcattgatctatggcttattccaccttcagtttgaattatgcagtcatgataattatgcatctgttgtaggcaagtcaacttggtcacctttccaatgaggccggagaaagactagttacaagttttggacagagattaaaaacagagttatttaacaattttcaaattttaatttc

SEQ ID NO: 2647 - DNA, 893 bp, Sorghum bicolor
  Clone ID: SORBI-28MAY03-CLUS44755_1
gtccagcccccttccgtgtgtggcttgattcccgttcgatccaaacatgtcgtccgacaagaagaccggaactgcggtgcccgtgcccgagaccctccttaagaagagacacaacaaggagcagacccttgctcgcctcgagaagcgcaaggctgaagccgctaaggcccgccgcgccaagaggaagctcatcttcaagaaggccgagaagtacgtcaaggagtaccgcagccaggagcgttctctcatccgctctcgccgcacggccaaggccgctggccacttcttcgtggagcccgaggccaagcttgctctcgttgtccgcatccgcggtatcatgggtgttgaccccaccacccggaagatcctccagctcttccgtctccgtcagctcaacaacgccaccttcgtcaggctgaacaaggccaccatcaacatgcttcaccgtgttgagccttacattgcctacggttaccccaacctgaagaccgtgaaggagatgatctacaagcgtggttttgccaaggtcaacaagcagcgcatcccgatcgtcgacaactcgattgtggagaagtcgctcggcaagtacggcatcatctgcgtggaggatcttatccacgagatctacaccgtgggccccaacttcaagaaggccaacgctttcctctggccgttcaagctctccaacccgcgtggcggtttcaccaagaagggcactcacttcgtcgagggcggcgatgctggcaaccgcgagacccacatcaacactctcatccgcaggatgaactagaaactttatcttgtgtgagtggcaaagggctggtgtgcggagtaaatactcaagaagagacccccgcgccagttcggagcgaaagggaaaaatcaaaacatca

SEQ ID NO: 2648 - DNA, 221 bp, Sorghum bicolor
  Clone ID: SORBI-28MAY03-CLUS44756_1
gcacgaggatccgatggcatattgcttggctgttatgaagagcgaaggtgttaacttaataggggagaatttcatgtctgggcttaaggttgtgtttgatcgagagaggaaggtcttgggttggaaaaaatttaattgttacagcgtggacaactcaagcaaccttccagtgaacccaaatccttctggtgttcccccgaaacctgccttgggaccgaaca

SEQ ID NO: 2649 - DNA, 330 bp, Sorghum bicolor
  Clone ID: SORBI-28MAY03-CLUS44796_1
ggtggacaccaaggcaattgagaagagctccaaggttgggctttccctggtcctcaagccctgaggcctgagggtcaccagcttttgcttttgggatgttaggtttattttttttattatcagcagctggagtccagcaaactgaacttgtcaactttggtgctgatcccgcaaacccaatttgttgcttgttaccgtcccctaaactacctgagaggtttctgttacaatttacgttgtgcttctgactatttttgccattcacgggctcttggtggaaaaactatgcaatttgtctactattgggtgatgttgtttggtcaccccttg

SEQ ID NO: 2650 - DNA, 661 bp, Sorghum bicolor
  Clone ID: SORBI-28MAY03-CLUS45103_1
attaccgtgacatattaaaccttactagagtgttggtacatgggcccaagagcaaagaagaggttgacaccgttattgacaggtgttctggtgctggtcattggcgggaagatattatgcattacaggaaagtactgcaagattgttcacatgacgacgacgacgacgatgatgaggaacactcttatctcactgatatgggtacaaaagctttgaggcgttacttctttctgatcacctttaggtcctacctatacagcaaaagatcatgtgaagcaacatttacatcatggatgaaggcaaggcctgagcttggccacctttgtgacaatctaaagctggacaaataggttatcttcatgtggtgtgattatgtagttttgtctcttccttggacaaattcacccagagcttcaaaaaggaaggagactaaaagagcgagtagagaggaagcagtggttatgggagttgtggacaatgaaagagcggcttagactgtctgaaagtagggcattgtactatacttgtcggtgttaattgataccgacaagcatgtatatattgtcaggcttattgtagatgaacatattagatatttttgttgtattttctctctcatctttttttataaaagatcattttatgaagttcattctcatgt

SEQ ID NO: 2651 - DNA, 631 bp, Sorghum bicolor
  Clone ID: SORBI-28MAY03-CLUS45118_1
tttattctgacatctcagtttcagggacgatgcacaaagtaagaatgacagtagagaacaactcaaagaagtcagtagcagaaagcacacgttcattatcagcaatggatctaggtgatgtaagtggttcccacagcactggcaaagaaactactcggaagggaaacgagagtgatggactgtggaggaaaataagcaatggccttgggttcgcaagaccaagtgacaaccaaagaacactggaggtcaacgggaccgattcaggggtcgcattcttcctccatttctcagtgcatacctctgaatcatcaacagctaaggaggaatacaatgacacaagaatccttccggtccactactcagacaactacttctcgctgacgccgggggagaagatggccatcgacatctcgttcgaggctccccagggatccaatcccaaagtcgtcctcagaggctggaaccatcatctggaccacgccgtgatgatctgagatccgtgtaaccaaaaaaaaaagtgcatacggaataaagggcagacatcagagttcatgcctgttgttggattttaattaggcttgtcctaatctatacctattgataaagattaatataaagacaaaatttcagc

SEQ ID NO: 2652 - DNA, 903 bp, Sorghum bicolor
  Clone ID: SORBI-28MAY03-CLUS45125_1
gcacgagggccataagaaatcctgggtctctccatctgatgcccttctggattctgttcgagaatgttatgtccatgcaccgcatgcgtgctgctgtaactggtttacttgagactgcacgtgcaaatgattgggtagtcactgagaaggtaggagatcttgtgaaggatgacctggatgttccactccttgaaccagtgaagccaacagaatgtgtcgagaggatttattttcctgagctcttgcttgcactactcctcctaatatgtgcttcatatgacttcgtacttggaagccacaaatactatctttacctatacctccaggcctttgcatatgttgtaatggggtttggtttcgttggaacaaaaactccatgttcatagctgctgacataatgttactatttcccatttgacagttagttcctatgaatactgccactatgcgcagaggtgaattttatctgatggtagtgttattcaggttgcagggccatggttagtctagtggggttggggttgggggctgggtgggggttgggcctttggttcttagattcctaacaagttcctcaactaccaccggtaaactcagttttatgatttgccactggtaaacgcgttttcactgacatacatgtgttttctcaataatcaccttgtgctagatgtattcatctgtaacaggtcccatctcagaactgagagtgtattattggcatggatttcagattatggattcatggttgtaatagggagagaggcaaggttgtatcctagctggatttggaacttattgtagcatattcttatgattgccatttgtagattggcactcaaaaggatgtatgggcataacgagaagatgtgaaagatgaaattaattcttgtattgtgacat

SEQ ID NO: 2653 - DNA, 657 bp, Sorghum bicolor
  Clone ID: SORBI-28MAY03-CLUS45131_1
tcagcggcgacgtacatgtacagcctctacgaggcactgagctccggggtcacgctgagagggtggtggaacgggcagaggatgtggatcatcagacggacgacgtcctacctcttcgccatggtcgacaccgtctcgaggctgctcggactatcggccatggcgttcgcagtcaccccaaaagtaagtgatgatgaagaccagtcgaggagatacgagcaagagctcatggagtttggggcctcgtcgacttcgtcccccgagctcgtgatcgtcgcggcgaccgcgttgctcagcctcgtgtgcctggccggcgggctgagccgcgtcctggcgagtggctgcggcagcgcgagctgcctgagcgagttttgccttcagattgtgctctgtggagcgctggcggccgtcaacgtcccagtatacgaagcgatgctgctgaggaaggacagagggagagtggcgttcagaatcagcgtagctgcttgctttgggctcgtgctgccagcctgtctgatttgggtgaacgtattttgagaggccacgcatatatgtataatataaataaaataactctccccaaagaaaaaaaacaaagggaaatagataattacattatgcttccttttgctttttagataaaaaagtacatttttg

SEQ ID NO: 2654 - DNA, 824 bp, Sorghum bicolor
  Clone ID: SORBI-28MAY03-CLUS45128_1
gcacgaggccgacgacgacgacaacagcagcagctgcagcaactctggcgccaccgccacctcgcctcggtcctgcaacgcgttccagctcatctcctccatgtcctccgggttcgacctgtcggggctgttcgagaacgagcagaaggccgcgaccgtgttcacggcccgcgcggcggcggccaccgtggtggagaagctggagtccgtagcgcgcaccctggggttcgagatcaccagggggaaggagagcgggaaggtgaggatggaggccaaggccgagggcacaaacgggcggctcgcggtcaccgccgaggtgctcgaggtggccgtggacgtggccgtcgtcgagttcgcgcacgacgccggggacgcgctggacttcaacaagttctgcgcggtggacgtccgcccggggctcgcggagatcgtctgggcgtggcagggcgacagcccgcccgcgccggccgccgccgtcgggaccgcgtgaacaagaacaaacggccccttcgtcctgtccgtgatgtaaaaattgtagcgactttgcgtaggagttacaccagcttcatatagcatgtaagtcaagttttcgttgttgcttcgagacagccatggctagttttgttatgcgtcatgtgttgtacaggaagagaacaggtgcacaaaattaaagagaggtgttttgtcgacacgagtgtccaatcgaggcgctgagtgctccatcggcttgcaaagttttgtagtgaatgtaatctgtattttgtggagaggtgtacatacatacaaaattttggtcatgatcaaatttagttttggtccccact

SEQ ID NO: 2655 - DNA, 374 bp, Sorghum bicolor
  Clone ID: SORBI-28MAY03-CLUS4514_1
gcgtccggcatgagctgcacaaaattcagacttgattggctaggattgacttgttggatcctagacaggtttttaaaggttctggtctgttatggtcaataaacctgccggttggtcaaattcgtccgagcgtagactgcatctccttttccagcccttgagctggagaagccttcagcttgccctgtaatcttgagtactctttcacttatagtttatgctgcttctggagttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgggcggttttaggggatccagttttacgtacgctcgcttgcta

SEQ ID NO: 2656 - DNA, 675 bp, Sorghum bicolor
  Clone ID: SORBI-28MAY03-CLUS47595_1
gcgtccgattcatcttggggattgttcctagtgagcctcttgttcatatgcactctcaccgagcttgtttcaatgtggaatttgaccaaggtggaaattcaactgtgcaatatgctgtctcctgaaggaccgaaagtatctcttgattcatacaattgggggcttgtgttcattgctgtgttggtagacaatttcctctatccagtatctgcattcagatcacatttctcccaatcaatcaattggtctggtatccgatactacttgagagatgggaaaataagcaagatcgaaagagagaacagttcaaagtacactgatcttggagggaagcatctatatggcaagaggacatacccttctaataaatcattgcttggttacctgtcaagaactctagtgcaatggcatcagccaaagaaatatgacgtataggaaggccaaccagggattcagccctcgatttggcggggcttcttgttgtacaccctcttttgtttttatcttgcctgcctgcctccccccttctctgattgtttattggttattaggttcattcatattaaattttgtggtgtccaatcggcgccactgcaaagggttgcacctcatagttcttgtaacagtatagatatgtaatggtctcgctgaagaagtgaaatgttccatattggg

SEQ ID NO: 2657 - DNA, 677 bp, Sorghum bicolor
  Clone ID: SORBI-28MAY03-CLUS4761_1
cgtccgaggaaactttatgatgcctatgaatatgaatcagcctttgatccccaatgcacctttcaattaccctctccagcaagatggaaaccctcagtacttttctgcccctttccagatgcagctaccagatactggatcggaccaaggttccatgccaagtgtccagcctccagctggtcctatgagcttccctgaggggcttcagcgcccgtgggctatggggctgatgccatttcagtcgatggcccttggtcagggaatggctgatggtgcgggtgatcctcagggtggtggtggccttgccttcatgcaagctggttttgggggcatgcctgatggctccatgaatacaggcatgcctgatagaggtgatggaaggggtattctagcacagatgccaatccaaatgcaaatgcagatgtcacttcccccacctccgccaacacaacctccatcaggttcacagcaaacgtttaacaggagttgatattatttttttgcacgaattgatggttcctctcaaaattgcatgtcgattcattgggcaatttgtaactttatggttcttggcatgtaacctgtgagaactagatggctcagttttattccctggttgcataggagcctgtattatgcataactgtcctgtggaatgaaatttcccaaatccgaaa

SEQ ID NO: 2658 - DNA, 963 bp, Sorghum bicolor
  unsure (1)..(963): unsure at all n locations
  Clone ID: SORBI-28MAY03-CLUS47613_1
aatgtgaatactgcatcggaagaatgtcccttaagagaaacagtgtggaagaatcttcctcgtaaagtcgaaaagaaaagaattgaggtgccgcagcaggaaaatgattacgattgtggcctatttgtgctgtactatatgcagcggtttattcaggaggcgcctgaaaggtttaagaagaaagactattctatgtttggcaaacggtggtttcgacctgaagagccatctcagcttagagaccaaattcgccatttactccacttgtgtagagaaactgaagtgaagaagggtgtaacagggtcatgtggggaaagtcaacctaagattgagaatgatggaaccgatccgagtgatgcctccgagccaacaacacccaagcatctgagtgagtaatgctgacagaactgggtaactgctgattttggatgttgctgtagaccaacatagtagtctctaggtcgtgtgggtttgcgcccaatatggggaaacttgagggtgcatctatataaaaatacctgtacccctagtgtcgggaaaatgccgtgtaaagtagcgaaactggtagtcaggttgctttgcgagacttccacaacgctgttggcttgacattcttcaccttcattagctcancgagccctggcttctcgaactacatccttattatgctagcagtgtgcacctgttgagactctgaccaatgccatcctccccccgtttactgggctacctgtcatagcttgggctgtgcccaattgagggtgggtcgtcacacggtttttttgtatggccgaaagcatgacactacatgataattttttggcctgtatcagcacgttaggatctccgcgtgttggtggcatggcaatggcaagacctgtctagtttggaccatgcaccgacgtgacataaaaatagcatgtaattacgtaataatttcacaatacaattttgaagtattta

SEQ ID NO: 2659 - DNA, 474 bp, Sorghum bicolor
  Clone ID: SORBI-28MAY03-CLUS47653_1
accgcatcctgcaggtggcgcgcccgcccttcatcccgacgccgtcgccgcaggacgagagcggcgacgaggcgcttgacgtcgagaaggtcgtccacgaggtgttcgcgtccaatgaagccgaggccgcaacaaaggcgggcgagggcgggaaggcttcccctgtggcggacggagcccgtgtcggcggcgacggcgacgggaggagagatcagtccaaagatggtgatttctccgtgtttttctgagctatttattttatttggatttgttctttcttttccctttttttttaaaaaaaagctactgctagtagttgtttatggggtatttcttaaggatttgtagtatgaagatgatgggatttagcagctgcgattaggagtgagtacggcccaatgcccggtggagtacataaattaaagaggtgctcctgttcaatgggggtatacccactatagtttttttctctcc

SEQ ID NO: 2660 - DNA, 516 bp, Sorghum bicolor
  Clone ID: SORBI-28MAY03-CLUS47668_1
ctgttggtgagacgatatgctcattgaggtttgcttcaagggtgaatgcttgtgagattggaataccaagacgtcagacacaagcccgctcctttgattctaggctcagttatgggtgaagatagttgtaggcgtcattgtaatgtgatatataatgagttggtttgtgccacatttggccacaacaatgatgcccaacagaattcttgtaacttgtacagtgtaggcgatggtggtttgctgagagcagcatatgtacgagtgcttacatcttatcacgctttcctttttggtgtagctaatatagttatgacggcgggttcgaatgtgggttcaaatgtggaactacgaatttttttgccttctaccaagcagaactcatctgctggtttatggcaacactgcagcaatgattctgcgatatgctaaaatgccacaaagaaattagttttataccttgtacgttatgacttaccataatatatgtgtagccatggaagtttgcattgagttgtg

SEQ ID NO: 2661 - DNA, 671 bp, Sorghum bicolor
  Clone ID: SORBI-28MAY03-CLUS45243_1
aagctgttgtggctgccacaccgcgccatcacatacacatacctcctcctcctccatcctctgcccgcgccaaaagcagaaggaagggagagatctgggaggggtgagagagcaggaggagaaggccattgccctcttgaaggctcgagaccttctccgtccatcctcttccctctttgctttgcctctcctagactctctagtcgtccggtccggccatggccaccatcctggagaacatccagaaggcgaggttcctgccgaccaggccgctcaaggacgagctgcccaccttccagggcggcggtggtggcaaggaggagagccacctcatgggcctgaggaagcggctgtcctccctctcgggcaagatccagcccatctcctccgcgtcggccgagtgggcgttccggcgctccaagtcggcgccctccctcggcgccgcgttcgccgcggggggcggctccctgaggcagtggtggcagtggggcgtcggctggcccccctccgcggggcccgcgggcgcgggcgacctcgagatgaacgaggaggaggtcgccgcgctgggccgccagagcaggggcagctggggccacatcctctacaagatgcgctccggtgtccggcggctcgtcatgtccacgcactcgctccctacacgcacaagcagt

SEQ ID NO: 2662 - DNA, 477 bp, Sorghum bicolor
  Clone ID: SORBI-28MAY03-CLUS45246_1
gcacgaggagaacccaagcagaacccacgatgtcaccggcggcgaggcgcctcctgctcgccggagccgcccgtcgccgccgcttctccacggacgcagcggcgtcggacccgtcccggccgtcgcagcagctgcccaaggataagcggtgggacgcggtggtgatcggcggcggccacaacggcctcgtcgcggccgcctacctcgcccgcgcgggccgctccgtcgccgtgctggagcgccggggcatcctgggtggcgctgcggtctcagagtcggaccttgtccccggatttcgcttctcccgctgcagttacctcctcagcctcctccgccccgccatcctccgtgacctggagctggagaggcacggactgaagctgctgccacggagcccttcgtcgttcacgccatgccttgacggcagatacctgcttcttgggccggatgcggagctaaacttctcagagatcagca

SEQ ID NO: 2663 - DNA, 509 bp, Sorghum bicolor
  unsure (1)..(509): unsure at all n locations
  Clone ID: SORBI-28MAY03-CLUS45249_1
gcacgagggtaccacacctgcttggcgtgttcttggataaccgtggaatacaccatcagaatgcccatgtgagccgtcgtgcaggatacttattcatgagggcagtcaagtcattgaaggcaaagctagtgccttatctggataccatattgcagagcctgcaagatgtactaagtcaattcacttctatggattgggcaaataaagatactaagtttcccagctcagaggatggcagccaaatttttgaggctgttggattattgattggcattgaagaggtatcaccagagaagcaggctcagtgcttgactgcttttctaaatcctctctgtcatcagattgagtcacttgttttggatgccaaagcacgagggcttgaggaatcatcaccaagagctattagtcttcaacaaattattgttgcattgaatatggtcagcaagggctttaatgagcgccttgtgatggtaaataggccagctattggggtcatgttcaagagnacc

SEQ ID NO: 2664 - DNA, 678 bp, Sorghum bicolor
  Clone ID: SORBI-28MAY03-CLUS45269_1
ctcagggaaaatatgtctatgttgatggtgacgggtctgttcccacagaatcagcaaaggcagacggatttgatgcagtagcaagagttggtgttgctgctgaccaccggggaatcgtctgcagtcaccatgtgttccggatcgtccagcactggctgcacgcaggagaacctgacccgttctatgacccgctgaccgactacgttatactcccagcactctatgacatagagtagcattgtgagaaacatggggatgtcatgtcagttacggaggactgggagatcatctcccagagtgacggcaggaccacgaggccaggtgagcttcctcctatgatcagcacactgaccactagtcgggaaggcaaggagggcacactggaagaggcacaggccaccgtggtcgttcacccagagaaacaagggcggcagcatgtggaagttagggctgtgggtgtcagccatggtggctaagctggaggaaccacgttggttgtatatctagcagctaaaacctctgggcacgcactgtaaaattggatgtacatatggctgtgaccctaggaaatctgtgtttagaactataaatgttcatgaaaaacttgtaaaaatgtaaagaacaaaaaaacacaggtcctatttttttcttttaaaatagaaaatggtaaagtatttc

SEQ ID NO: 2665 - DNA, 793 bp, Sorghum bicolor
  Clone ID: SORBI-28MAY03-CLUS45283_1
gcagcgtctggtacgtgctcagctacatggaggctcagggacgcctgcgcaagggcgaccgcgtgctcatggtcaccttcggcgccggcttcaagtgcaacagctgcatctggaccgtcgagaaccccgccaccgacgccggcgtctggaaggaccgcatccacctctacccgctcaaggacgtctccaacccattcatggagaagtatggcttcctcaaggacctgaccatcgatggaccgatgatgtgatctacttccattccaccgcgctatagctgcccggccactcatcttcgtctcaattcccaccaaagcacatacacatcgcgattcattcttcgattcgacaggctaaggcaaggacgatgaaactagcttgcttcttcagcttcaagattatataattctcaatgtcgccagtactcgatctgttgaacaagtacttagttaattgcattgtgagcacaacaatgagactaagctgaggattcataggtataataagtagcttatgattcttttggtggtggtggcagcgggaagacgacttacgtagcaacgctactcctttttctttcttgatcgagttctatcatttcctgttttttagtttggattggatgccccatgtcgtcggtcagtcagtgtcgtcttgttcttgtttattataaactgaggatggtggattaaagtgcaacattttttaattaagtttatttatttattgtgtaaggataatataatggttctgtaataaatatcatactctcacaatgtagagatatttcatg

SEQ ID NO: 2666 - DNA, 587 bp, Sorghum bicolor
  Clone ID: SORBI-28MAY03-CLUS45278_1
cccttacgtcgatgaatctgttataattgacatcaatccagacaacaaggatatgtcccctgattttttgagatggctaagggagagaaacctttcaagcgatgatcggacaatgcgcctaaaagaaggatacatcaaggaaggtagcactgtgagtgtgatgggggttgtccaaaggaacgacaatgttctgatgattgttcctccatcagagcccatctcaactggttgtcagtggaccaagtgtgttctcccaaccaaccttgacgggcttgttttaagatgcgaagatacttcgaacattgatgtgataccagtttaactggcggtggaagagtcgttgccaaagaaagtgcctgttaaatatttgaatctgtattgtttcatggaatgctagttgagagaaatgtgcaaatgttgggtgtgattatggcaggttgagggtggttggttaagcaggccgttggatgtatagttcttttttcttttaattgtgttttgtcatttctttttctttttaattttcagctgagatctgaaacttgtgtaaccagatgcctcttaatctaaatctgcgtggcccttag

SEQ ID NO: 2667 - DNA, 686 bp, Sorghum bicolor
  Clone ID: SORBI-28MAY03-CLUS45286_1
cactgctctatgcaattatcttcccaaagtacttactttgtttttgctggtacttagcatttggttaacactcagcatatatgtgtcatatctgtttgattacttcccaatgacttgccttgatgcttccccttctggacttcaatataaatgctgtccgggcgcgctgttgttgctttttgctgggtccacctacgtggcccactcccctatgccttctgacgcatcctgtccagcttttggccactgtcgaatctaggcggcgccgatggcgtgcgtggtctcctgtgctgtttgtgggtactgtcgtcggccgcttggcttattgcacctctctggcccggtgcagagtattatttcaagtgtcttcgctaatctgattgagatcaatgcaacaaggtgtgattttttttgttgtgcataccctattcgacaaggatcgaccccctcatgtcgtcgaggccattaaccatatgccattcaatcaatctgctactctcaaatatctccttgtaaataatctctcatttaactccacttctcatgaactataagtagacgggttgcctaccgttattcctgtgtgttatattgttacttctgctttcgtatgtgtttaggtgtgaaaataacatttttttatataatctttgatgcaatgaaccatgtcatgaaatttgtctttg

SEQ ID NO: 2668 - DNA, 749 bp, Sorghum bicolor
  unsure (1)..(749): unsure at all n locations
  Clone ID: SORBI-28MAY03-CLUS45059_1
gcacgaggccgagctgctggtttgaaggttataagttgcattgttcaaagagatgaagctcgcatgccaatgcgccacacattcctctggttggatgaaaagagttgttatgaagaagagcaaattctccggcatgtggagcctcccctctctgcacttcttgaattggataagttgaaagtgaaaggatacaatgaaatgaaggctcctccgtcacgtgatcgtcaatggcatatctacacactaagaaatactgaaaaccccaaaatgttgcatagggtatttttccgaactattgtcaggcaacccaatgcaggcaacaagtttacatcagctcaggtcagtgatactgaagtaggaggtcctgaagattctctgtcattcacatcgaatagcatcctaagatcattgatgactgctatagaagaattagagcttcatgcgattaggacaggtcattctcacatgtatttgtgcatactgaaagagcaaaagcttcttgatctcattccattttcagggagtacaattgttgatgttggccaagatgaagctactgcttgttcacttttaaaatcaatggctttgaagatacatgaccttgttggtgcaaggatgcatcatctgtctgtatgccagtgggaggtgaaactcaagttggattgtgatgggcctgcaagtggtacctggagagttgtgactacnaatgttactagtcacacctgcaccattgatatctaccgagaagt

SEQ ID NO: 2669 - DNA, 650 bp, Sorghum bicolor
  Clone ID: SORBI-28MAY03-CLUS45063_1
gcacgagggttgaagggtcccttttaattgctgtgtgacattatgtactacaacttcttgcagtgcatgaccactgggtgttgatgggcattgcataaacaactgcaagctttgtgcttcaacctaagctcaagcatcaggcacctaccttgaaatcgactcagatttgctactaactcaaattcaacgcattgttaattaccaagttcatttagattttgactcttgtcctttttgtttctttaggcaacatttcctctaaatggcttcactaactgtggtgaagtatatatatctttccacttaataagggcatctatgtaaagaacttgccacccagtgctattgtagattggaaatagctactgatgtgtcctgaaaacttttaaatatcacattgccttctataattaattaaagtaaatttcagaaagctacattacacttcttgtaaccaattttgcaatacagttctattcgcatgcatatcagagaactgaacttataaattagaatttatttagcagctgtgtacttattttttcattacatattacagaactcacatctattgtcattccatgtcgtgaaactgcattttcatttgggcttgaaactttaaatgtgtgatctgcaacatgaaacaagta

SEQ ID NO: 2670 - DNA, 589 bp, Sorghum bicolor
  Clone ID: SORBI-28MAY03-CLUS45072_1
gcacgaggcgtcctcttcctccgaacctttccggcgccggggaacttcttccacctgaaccgcgtaccacgataagccctaatcccagcgccacctccatggcgaccacctctttcttccatccgctcgccgcctcgatggccagcggcggcgttcgcctccatcgctgcccgttcagcctaaccacccccgcccgtacagcgccccggcgaccggtgccgcttctcgtcgtctgcgccaagcgcgccggcagccgggcccctgttgccgccgcctcgcatcagcccgcgaatcccagcgcggtcccgaagcgggaagtggaggaagaggtggaggaggtcgaggaggagatgccgtggatccaggacaaggcgctggacctcgtggagttcaccggcaccgtcacacaggccatccctgggccccgcgtcggctctagccctgttccgtggcttctcgcggttccgctcgcctacgtcggggtttcctttgtgctcgcggtcgtccgcaccgtgcgcaggttcacctccccgcgcactaagaagaagcgaagggtgggtaagaatatattcttattgaagtcactaga

SEQ ID NO: 2671 - DNA, 648 bp, Sorghum bicolor
  Clone ID: SORBI-28MAY03-CLUS45098_1
gaaccagtacctgaatctaatgatggggatgtcaaaatggttgttgggaagaatctggatctaatagttttggatgaatcaaaagatgtacttctggagatatatgcaccatggtgtgggcactgtcaatcactggagcctacttacaacaaactagccaggcatctacgtggcgttgactcccttgtgatagctaaaatggatggtactgccaatgagcatccacgtgcaaagtctgatggatacccaactattctcttctatccagctgggaagaaaagctttgagcctatcacttttgagggggagcggacagtggtagatatgtacaagttcatcaagaaacatgctagcatccctttcaaattgaagcgccaggagtcgagcactcagatggaggagggtgtaaagagctctgatacgaacctgaaggacgaactgtagggcatcgaagtatcatacatatagctgagggctggtggttagttttgaggtggatgtggatcctcctctgcaatcttcccttcccttggtggatgatgagggaggaggagaaatcagtactagtagactactagtagaagaagagtggtcagcttgagaacagatcggcatatagtcaaataaaattaaatgtttttttttgcc

SEQ ID NO: 2672 - DNA, 601 bp, Sorghum bicolor
  Clone ID: SORBI-28MAY03-CLUS45416_1
atcttgtagaagtatagggtttttttttcccctttcaccattagctccacgctccactgtcccccgccgaccggctcgggcgccagcgcctgaaggcctcgctcgtccccgtgctcgaccaggtggaccgtcggtacaaccactactgcgaccagatgcagatggtggtgaacttcttcgactcggtgatggggttcggcgcggcgacgccgtacacggcgctggcgcagaaggccatgtcgcggcacttccggtgcctcaaggacgccatcgcggcgcagctgcggaccacgtgcgagctgctcggggagaaggacgccggcaccagctccgggctcaccaagggcgagaccccgcggctgcgcgccatcgaccagagcctccggcagcagcgcgccttccaccacatgggaatgatggagcaggaggcctggaggccccagcgcggcctccccgaacgctccgtcaacatcctccgatcctggctcttcgagcacttcctgcacccgtacccgagccccgccgcgacccccccggcgccgacgccgcgcactctccgaccaccaccggcgcagcgcagctcccgcaacagcaacagcag

SEQ ID NO: 2673 - DNA, 666 bp, Sorghum bicolor
  Clone ID: SORBI-28MAY03-CLUS45422_1
tggaccgaaacactccggacgcgtcgtcgcttcccaaaagccagtcagtctccatctccacacttcgctctcactccacgccgcgtaccgctacttaagtactaccaccgccgccgcctgacgaccccctggccacctccgccaccatcgtgctccgtacacgctccggccatggccgccgccgcggcctccttctcggcccttccgttccttctgctgttgctgctggtgccgtcgctagacgccgcctccaatgtgacgtacgaccaccgctccctcatcatctccggccgccgccgcctcatcatctccacctccatccactacccccgcagcgtccccgagatgtggcccaagctggtggctgaagccaaggacggcggcgccgactgcatcgagacctacgtcttctggaacggccatgagatcgccccaggccagtactacttcgaggaccggttcgacctggtgcggttcgtgaaggtcgttaaagacgctgggctgctcttgatcctgcgcatcggtccctttgtcgccgccgagtggaattttggaggtgtgccggtgtggttgcactacgtgccaggaacggttttcaggacggacaatgaaccattcaagagccatatgaagagtttcacgacatacatcgtgaatatgatgaag

SEQ ID NO: 2674 - DNA, 570 bp, Sorghum bicolor
  unsure (1)..(570): unsure at all n locations
  Clone ID: SORBI-28MAY03-CLUS45445_1
catggagatgctgacaggcaaagccccccttcagtcacagggtcaggatgatgtcgccattgatctaccaagatgggtgcactcagtggtccgcgaggagtggactgctgaagtgtttgatgtccagctgatgaagtatcccaacatagaagacgaactggtccagatgctccatatcgccatggcatgcacggcgtggtctccagaccgacgtccaacaatggcagaggtcatcaggatgatggaggagctccggcggcctgcttctgagagccgcactccctccattggcaatcccaaggagtcgagtcctctgtcagcctgaattgttagatctttcagtctaatccgtgattctgattcagaattcgtgtatccatatcattgatgatgtcctgtatgtggtgctgaggaggcactgggaccatacagcgttgtatcgttatatatagctgtagcgttattcccggtgcacacattgtctgcctactcatcctaccatgctaccgtaactttggttcaatggaatgttcaaganaacaatggcggaaatagctattttcgtctctc

SEQ ID NO: 2675 - DNA, 577 bp, Sorghum bicolor
  Clone ID: SORBI-28MAY03-CLUS45495_1
gaatgtaagccatatgtagaatatgagggctaaccatcttgtgctgtttcttgtaatttgtctaagttcatggctgaccctctctcactttgtattttgtgaaaaaaaaggcattcaccaggaagttaaatggagcccttgtgctttctaaggtccaaaaggattttagactacttataataggcatgaaggtggctctcgttgcacatgtagataacctagtgcaagcaaagtgcacataatctacttatttctgaaaagagttatacagatgcatgataggtttgtcatgtcttatggtatctttcacagagaatgcaaataaccaatgtagtaatgtgcattttctattctgagcaaatgatatgctgaaacatggatttgccctactttttagggtatggcaaagatgcaaataatgtgactgaagctaggtgcacaattaaaattataaagcatttggtttgtcattgttttatacttttatgtgttggaaacttcacccatttcctgaatggcatgttgacaacttgataaactgagcagagtcactctgaaaaacgtgctgcatttgtgc

SEQ ID NO: 2676 - DNA, 592 bp, Sorghum bicolor
  Clone ID: SORBI-28MAY03-CLUS45531_1
tacggcaataccagtgcggcatccatcccattagcattggatgaggctgttcgcagtggcaaggtgaagaatggtgatattattgcggcatcaggttttggcgctggacttacctggggttcagctattgtcaaatggggctaattattctacgtgaaccataacaacatcaatgagatagcttcaaagtctttgaaggcttcgggggcctacatctattggttattttccccatttttctgtgcaacatttttcttccgtatgtgtcggtcttccttgcacatgaaaatctagtggcattttaccctttgcatctattcctttggctcattacacagctgagagagattgtaatgtagttgcagtagtttgagtggtggatggaaatgtttgaattttgcatcgaggatggcaatggtgacactaaagatgagattacactgtaaagttaatgggcctttttgtctgagaaatttactgagcggttgtcgatcttgtgggttgtggccccaagcaataagcatgtacaaggagaggtggaccgtggacatgtgctgtaggacaattcttagtaattatgttcttttttact

SEQ ID NO: 2677 - DNA, 469 bp, Sorghum bicolor
  Clone ID: SORBI-28MAY03-CLUS45525_1
gaatcaaccccggacaatcctatgccaagtcttcccactgcccatcattccatcattcccaaggtaaaccctgccatgttccgcacatcatctgaaccatgttctgcagtaaagcttccacctgccagccccttcgataacttcctgaaggcagcctatcgcacccagccggagctgtgaactgtgatcgactgacctaagcaccctcttcacgagtgctagactgcgtaccaaagcatagggtactaggttatctaatggaacacttatctattatgacgtggttttagttgtagtagcgtaagtatgtgtatctatctactaaatgtctgtagcatatgcgtatctgtctcttatgactgtgcctctagtctgtagttgtaagccgtgagctctgtgtcgcctgtgcagactgagttgtatgagaatactactccggtatatgtttggcactccctgtatgcttgcc

SEQ ID NO: 2678 - DNA, 683 bp, Sorghum bicolor
  Clone ID: SORBI-28MAY03-CLUS45144_1
caggttccgcttcggcctctacggcgtcgacttcgccgccgacgaccggaccaggtacgctcggagctccgcgcgatggtacgccggcttcctccgccgcggcggcggcgacctcacgccgccggcgccgcctctgggacacggacacggctccacctattcggagtgaaaatcggcggtacgtgtgtgcgtgcgtgccacacggaacatccggagtcgtaataccccgtacaatatatacatagattcgtcgccggaaaagaagcacaggaaggatggatgtttcttcactgatcatcgtcatccgtgtcgtcctgtgcggccttcgccatcggttctgtacttctttgcattggaggaataaaaattcagttttgttgcacgtaaataagcaggaggctgtgatcacctcagctagatattagtggcaagtttaaacgagcctgctagattttgcacgtgacagtgcacacttacttttttttccaccatgatgtctaagagagtatataacccaattgattgtgtggaaagtgcattcgtgtactcagccatgtaggttttgcttgtctggaaagtgtattcgtgtactcagccagcttgctggttcgatttttccaggtgttcttattgaaaaccatctcaaaatcgaacaaatttcttgaggggcgaaaatgaaccct

SEQ ID NO: 2679 - DNA, 550 bp, Sorghum bicolor
  Clone ID: SORBI-28MAY03-CLUS45175_1
gcacgaggccaccaaaagcagacgctgctgcgtttcacgagcgcccaggcgcgagcgagatgcagaacgtggtggaggtcgagccgggccgcccggctgccgatggccggccgtccgtggggcccacctaccggagcgcctacgcccgcgacggattcccgccgcccgtccccgggatggactgctgctacgacatcttccgcatggccgtggagaagtatccaaacaacagaatgcttggccaccgcgagattgttgatgggaaggctggtgcatatgtctggaagacatataacgaggtatttgacattgcaaacaaaattggtaactctattaggagctgcggacttgcaaagggtagtcgttgtggtatctatggtgctaactgtcctgaatggattatcacaatggaggcttgcaacgcccatggaatctactgtgttccattatacgacacacttggagctggtgcgatagagtttattctgtgccatgcagaagttgagattgcttttgctgaggaaaagaaaattgagctgctcgtgaagac

SEQ ID NO: 2680 - DNA, 602 bp, Sorghum bicolor
  unsure (1)..(602): unsure at all n locations
  Clone ID: SORBI-28MAY03-CLUS45235_1
gcacgaggtgagatctctgcaaaaatgaaggctgagatgaaggaaaagactatgagagcatttctgctctcacaaaaacatattgtgtatactgagccacttgaagtacgtgcaggaaccactgtagacgttctttataatccttctaacacagtgctgaatggaaagccagaggtttggtttagaggttcctttaaccgttggacccatccaagtggtcccttaccaccacagaaaatggtaaagactgagaacggttcacacttacgaacaacagtcagggttcccctggatgcatatatgatggactttgttttctctgagtcggaagaaggtggaatatatgacaataggaatgggatagactatcatattcctgtttctgattcagttgcaagggaacctccaatgcatattgtgcacattgcagtggaaatggctcctatcgcaaaggttggaggccttggtgatgttgttacaagcctttcacgagctgttcaagatttaggccataaagttgaggttatactgccgaagtatgattgtttaaacctaagcagtgtgaaggatttacattaccaacaaagttttacttgnggtgg

SEQ ID NO: 2681 - DNA, 582 bp, Sorghum bicolor
  Clone ID: SORBI-28MAY03-CLUS4522_1
ttctgcctaaatcagagcacactgttaggcataagcttgtaccgcttggttccggctctcagcagttgccaaagatcacagtgacttcggtgcggtattctgctgcattgactccttcagcctcagcagcgactgtcttgtgggcacccagtgagcctaaattcaacttggaaactaaccattcaacatccgatgagatcgtgagttgagacctgagcaacctgaagtcaacccactcctgagtcctgacacttagctcggccggggtgcatgcgaggtaaggttttctactggaaataccatcagtttgaccttcatgttgatgttttagaaacttgaatcagattcctgtcggcgaaaagggattgtcgctgtgcaaaagttttggcattgtttttcgaggtttcgattttgtagtgcttctggattaaccacatatctgtaacttatgattacttcattgtttttggcccaagggtacaacatacacatgaggataggcagattgtaaatcaccgtcccaccagtcaagtggggaataaaccagctccatgtctcagtttttattttcgatgctgccaa

SEQ ID NO: 2682 - DNA, 548 bp, Sorghum bicolor
  Clone ID: SORBI-28MAY03-CLUS45649_1
cgccgcgctcgcgcaggacaagatcttcaaagatgctcatcaggaggcactgaggaaggagatcgagaggctgaggcaaatctaccagcagcagagcctgaagagcggcgggggggaggccccagcgcccgacgcggccccggtctgcggcgacaaggacgacatgatcggcagcagcgaggggaccgccgcgcccgcgctcggcccgccctcgtgatgaggaggaggaggaggaggggcgactcgtccatccgagtcggtcgctgtagtggggatggccctgtcgcccgcccatcacagcgaggcgctgctgctgctgctgctgctgctgctgctgctaggattggtgcattgcttgggtgtgcgtgtgtgtgtgtgcattctttggggtgtaacgtgattgtgatgtaaagaagaggaactggattggtttggtttgttcattcttgcatgcatcctctcctgctgctgctgggggtggctgccgctgctagctccttccacctcccctgatttataactttttgtttgagcatttgggcgaaggt

SEQ ID NO: 2683 - DNA, 604 bp, Sorghum bicolor
  Clone ID: SORBI-28MAY03-CLUS45686_1
attctggtgccagtagctagaaaattcactggaagggagaagggtttttctgagctccagcggatgggaattggattagccctgtcaattcttgcgatggtatctgcagctcttgttgagttgaagcgtttagagattgccaggtctgaaggtcttattcatgagaaggctgctgttccaatgagcattctttggcaaataccacaatatttcttggtgggtgctgctgaggtgtttacttgtataggtcaagtcgagttcttttacgatgaggccccagatgccatgaggagtttatgtagtgcatttgcacttattacagtctcactgggaagctatataagctccatcatactgacgttggtgtcgtgcattacaactcagggaggagatcctggatggatccctgacaatctgaatgaaggccatctcgaccggttcttttggttaattgctgggataagctttgtgaatttgatagtttacatgggctgtgctgtgagatacagatataagaaagcctcttgattatatttatgtgaactcttgtaatgtgattccaggtgccatacttatcaaatacattgcattgtccagacttctg

SEQ ID NO: 2684 - DNA, 612 bp, Sorghum bicolor
  Clone ID: SORBI-28MAY03-CLUS45732_1
gcacgaggatcacatctactgcgagtctctctcggcacacgcgtgagtccgcctccgccgcggctccggcgccgcatccgtctcaggaatccccttctccgcgtgctagaggcagcttgattatttctcaatcttaaactgatgatgctggtgctcgtttaatcaacttgattcagcgatatatcagctatgggtgatctgaatcatggaagctctctccctctacttctctgtttacatctgttgttgccactacttccgtttgctatggcagatatagcctccgagaagcaagcgctccttgcttttgcctctgcagtctaccgtggcaacaagctgaattggagtcaaaatatcccactgtgctcgtggcatggtgtgatatgctcaccggatcgatcgcgtatattggctcttagggtgccaggtgctggtttgattggtactattcctgctaatactcttggcaggcttgtgttcctccaagttttaagcctgaggtctaaccgtttgagtgggagccttccatacgatgttgcctcacttccttctttacaagccatatttcttcagcacaacgaactgtcaggagacttgccaccatttctctcc

SEQ ID NO: 2685 - DNA, 421 bp, Sorghum bicolor
  Clone ID: SORBI-28MAY03-CLUS45750_1
gcacgagggcaaccccaattcggcccgtccgctttcagtagtcgccgccgccgccgctgaactgaaagttgaaaccagctcgccgggggtccgatttccccaattttgtttctgctaggaggccgcggccgcgaccatgggaaactgctgtgccgcgccgttgacggaggagagcggcaagaaccgccccaagaagcacaaggcgaacccctacaacgtcgcgtacaaccgcggggcggcgccgccgcccgcgcgcccgggcctgctggtgctgcgggacccgacggggcgggacctcggcgcgcagtacgagctcggcggcgagctgggccgcggcgagttcggcatcacgtacctgtgcacggagtccgccacgggggcgcgctacgcgtgcaagtccatctccaagcgcaagctgcgg

SEQ ID NO: 2686 - DNA, 551 bp, Sorghum bicolor
  Clone ID: SORBI-28MAY03-CLUS45753_1
gcacgaggcacaaatctagacaacttcctgccacgccttcctctcgcagatctgctaaaacgcccaccaaggatgacactgcaattgctacccccaaatccacatcctcgccaaacaacccaaaagactcgacagaaaagccctccagagttaggaacacaagcgtttcaccttctccttcaaaacatgattctaatggaacctcaacgaccgcctccaccaaacggaaaatccaagatgatgctcagaccgcctctacgccgtccaagaagcagaaaaggctcatgcacacaaagagctacgttgcgctcttcagtacaggacaaggacaacctgagtcgcaagtgcttgctcccctcaggcaggataaggaaaaagcttctgatgtgcaaccggaaggagatggtgctgttttggcgcatgaagaaagcaatgcactggaacaacccaaccaggaaccttcaaatgtgtctgctggcaaggttttgggaggtcactcttctgacttgcatgaaactgaggtgatattggagggagatggattgaagatc

SEQ ID NO: 2687 - DNA, 624 bp, Sorghum bicolor
  Clone ID: SORBI-28MAY03-CLUS45298_1
ggagacttggtgcctgcagctaccccaggcagatacggggcatgaattggtaggttcttcttcgcatttgaggcagctgcctgtacgacgccacaaccgcctcaagattatggagattgaaggattcaactgtacaaagagcttggttgagctaacatgtagcattgtcaagagcgcagtctcacttgcttgccttaaactgtacacccttcgttatggtaaatctccatgttgttgggatggattttgcattccttatggcaaatctgaggtcgaggaagcttctagagcagcggcagctataagaaggtacattgaggataaagttgcacctacaaccaagctgaccattatggagccttgcccacggtgtattgccaccgcaatggacgatggtttggcctaggcagagaagttaagatggagggtgaaagttgtcaaaggttatcttaattaagtgtgctgtcatttataatacttttttaatttagttttatcacttagtttctttcaatgttgtggcttaaaagttgtcaaactagtggcatgtgcacgcgaggcatggacatggttatgtttatgacttttttatttatatatcatcatatatataaggttagtctc

SEQ ID NO: 2688 - DNA, 649 bp, Sorghum bicolor
  Clone ID: SORBI-28MAY03-CLUS45335_1
ccctcagggaacatccttgtgatctttgaggaaaagggtggggatcccacgaagatcacattctcaagaagagctgtgacaagcgtgtgctcctttgtgtcagagcactttccttccatagacttggagtcctgggatggaagtgccacaaacgaaggcacatccccagccaaagcacagctgtcttgccccattggtaaaaatatatcttccgtgaagtttgcgagcttgggaacccctagtggaacttgtagatcataccaaaaggggagctgccaccacccgaactccttatctgttgttgagaaggcctgtctgaacaccaatagctgtacagtctccctatcagacgagagcttcgggaaggatttatgccctggagtcaccaaaacactcgccatcgaagcggactgttcttagtggcctgctaagtatctgtgtccataccaggctccactacaactgtgcccatcaaaattctcaaaattgtagtgcttgttgcgtgacatattattgtaacctggatttgaatatctacctgagctaggttccacgagctttcgcttttctgaaacttgaaagttgttgctgaacagtgacccaaagctgagtcctgaaaggcgacagttaaagatagcgattgtctctg

SEQ ID NO: 2689 - DNA, 721 bp, Sorghum bicolor
  Clone ID: SORBI-28MAY03-CLUS45329_1
cggcggcgacgcgcacgtgggcggtggcgcggacgacctgtacgggcggttcgagcccggggtgagggtgcggtacgggcccgctgcggcaggcgcggccgccggcgacgtgtctctgacgctaggcctgcagcacgccggcgccggcaacgccgggcccgacagcaccgggcggttctccttgagagactacagcggttgttgatgcttacatacatgcatcgctacatcacctttcatggctcatgcatgcatgcgcgcaatcatgcatttggaagagtacggatcgaggaaagagagagagaaacagtaaaaacagagaagagagagagagggtgctagacagagagagatgagcatctagaaagagaaaatttgcatggtgcctggaggtgatgaatgggatgggatatatgaaaatgagatcatcaaaaccgcctcctgcttctcgtcgtccttcttcccagatgattcttaatttacttagctagcacattaattccttttgttaggcattattgttggggggttaaggaataattaatttgtatacagcaaaggaagactaggaacgtgtataattgtttagtcacacttttttgcttctctgttttgcatttgcccgtttttgttctagtgtaccaattttccttgtactcattttccattccctctctgtaaactaaacataagagacacatacatacatgcatacgtaaat

SEQ ID NO: 2690 - DNA, 497 bp, Sorghum bicolor
  Clone ID: SORBI-28MAY03-CLUS45344_1
gcacgaggggctgtttgcccacccgtccatcgtttgcgtgaccaagaaatcaagaactcaggcagggctcgccctcttcctcctcctcctcctcctcctcccgccgcgaattccaccctggttcagggatgtcgaccgagctcctgaccaaattcctcacgttgctgttcgggtatgccatgccagcgctggagtgcttcaaggcgatcgagcagcggccacgccgggcagatcagctccgcttctggtgccagtattggatcatcttggtcctccttgtcatgttccacgaaattgctggggttctcatttccaagattccaatgtactacgagctcaagctagccttcctcgtctacttgtggtacccaaagacaaggggaacggacatcgtgtacgagaccttcctccagccgctggtgatgcagtaccagcccaacatcgaggccaggctacagtaccttcgcgccaacgccggtgacatcctcgtcttctac

SEQ ID NO: 2691 - DNA, 607 bp, Sorghum bicolor
  Clone ID: SORBI-28MAY03-CLUS45813_1
gcacgaggccgggttggaggacgagctctgggcccatttccaaggcctacctgccagatatgctttggatgtcaacgtagagcgggttgaagatgtcttactgcacaagaaattgctcgagcaagcccatgaacccatgaatggtctggtctttgatgttcgtccttcacaggttgttactctggaagaaagcactggatttgagtccgcaacttcctttaagcaagaagaacaagatccccagtgctcagtattcacatcaagaggtcaaaggcctctgcatgaaattatatttgcgtgtgacgataagccaaagcttctgagtcagttaacctctcttcttggggagcttggtcttaatatccaagaagcacatgcatattcgacgagtgacggctattccttggacatctttgttgttgatggctggaagtatgaggctgatattctccgaagtgcattgagggaaggcgttgataaaataaagtacaaagcatggccgttggttccgtcgatgtctgctaggatggatcaccaaccattggaggtttctccttcatctgactttgtccagataccagctgatgcagctgatgtttgggaagtc

SEQ ID NO: 2692 - DNA, 552 bp, Sorghum bicolor
  unsure (1)..(552): unsure at all n locations
  Clone ID: SORBI-28MAY03-CLUS45836_1
gcacgaggcatccgtactgtctcactctcacccactgcagaggaactgaagaagaatgtctcgatgaacttgaaaccaccatcaaaaatagagcttcacaagtcctttgacgaaaatgatcccactaacaagcgctgccacatgagaaagtaaacgtctcttccatcagggcaactgcatatacagtggcagacctgcaggtagcaacaaagagcttcagtgctgacaatctagtcagtgaaggccgttttggctgcatttacagagcacaactttgtgatcagaagattctggctgtgaagaaaatcaatttctctgccctaccaggccacccatctgatttcttcatcgagctggttggcaacattgcaaagctaaatcatccaaacctctcagagctagatggctactgctcggagcatggacagtgcttgctggcatatgaattctacaagaatggatctctttatgacctccttcacctgtcagatgggtacagcaaaccattatcttggaataatcgtgtaaagattgctctangatcagcgaggg

SEQ ID NO: 2693 - DNA, 636 bp, Sorghum bicolor
  unsure (1)..(636): unsure at all n locations
  Clone ID: SORBI-28MAY03-CLUS45848_1
gcacgaggctgatgttcttcctctggtcagcgtacctgctggccgattccacagcgatctacaccctgggccacctatctgtggacagcaggtcagatgagcaccagctggtggcgttctgggcaccgttcctactgttgcacctgggtggcccagacaacatcacagcctatgcactcgaggacaacgcgctctggctccgacacctgcaaactctcgctgtgcaggttctaggagctgcttatgtgatatacgagtacatcgtcaacaggggggcattgcttttgctggcctccatgtccatgttcgttgccggccttctcaagtatggtgagaggatatgggctctcaagtgtggcaacatcagcagcatccgtagcagcatcagcatccggaaggtcaagactgacccatatcagttattggctttgagtactagcgaagaggatttgctgcttggagcccactcccagttcgatatctgcaaaggtgtcttcgctgatatcataatgctaccaaatccctcacttcgttcgcaatccaaaccgcgttccgtgatatcttacctgngagatgatctgtacaagctggtcgagatggagctgtctctgatgtatgacttcctatacaccaaag

SEQ ID NO: 2694 - DNA, 540 bp, Sorghum bicolor
  Clone ID: SORBI-28MAY03-CLUS45850_1
gcacgaggcatattcctcgaccgcagagcgatcttaggtatagcaagcagacagatgttggtgtaacacattttagaagtggtatgagccatgaagaggaccagcttattccaaacttgtaccgctacatccagccatgggagagtgagttcattgattcacagcgtgtttgggctgagtatgctttgaagaggcaggaagcgcaatcacagaacagacgattaactcttgaggatcttgaggattcatgggatcgaggtatacctcgtatcaacactcttttccaaaaagaccgccatacgctggcctatgacaaaggattggagagtgagaacggactttaagcaatatcaagtgctgaaacagaacccattctggtggacacatcagcggcatgatgggaagctttggaatctaaataactacagaactgatgtcattcaagcacttggtggtgtagaaggcatcctggagcatacattgtttaaagggacttatttccctacttgggagggtctgttttgggagaaggcatcaggt

SEQ ID NO: 2695 - DNA, 588 bp, Sorghum bicolor
  Clone ID: SORBI-28MAY03-CLUS45859_1
gcacgaggcctgaccttttcacttttaatattttcttacacacttactgtaatttgggtaaggtggaacagatccttcacctgctggatcagatgaaaagtgagggccttaaaccagatattgtgacatatggcactataatagacggttactgcaaagcaaaggatatgcacaaggcgaatgaatatttgacacaattgatgaaaaatgggttaagaccgaatgcagtcgtctataatgctcttattggtggttatggtacgaatggtaacatttctgatgcaattggtattcttgacactatgaagtataatggcatacaaccaacacctgtaacttacaatagccttatgtattggatgtgtcatgctggtcttgttgaagaggtgaaggcagtttttgcacaatgtatagtaaaggacattgagcttggagtaattggctacacaattataattcaaggtttttgcaaaataggaaaaattgatgaagctgtgatgtacttcaaggaaatgcattccaggggtatacctccaaataagatgacctacaccactctgatgtttgcctattccaaatctggcaaca

SEQ ID NO: 2696 - DNA, 515 bp, Sorghum bicolor
  unsure (1)..(515): unsure at all n locations
  Clone ID: SORBI-28MAY03-CLUS45871_1
gcacgaggagttgttcaggccgttggcaatgcaggacccgatgcaaacacagtcgtctcattcagcccatggatattaagtgttgctgcttcaacgacagaccggaagtatagaaaatcaatcataattggcaatgggaaagtattttcttgcggtgccctttcagcaccaacaccagagtgaaacaatgtacccactagcatgggctgatgatgtggtcaatgagaattcatctgatgggtctgttaattgccaagatccaaggatgttcatcagacctcttgtccagggaaaggtgattatttgcatgttcgactcatcacactactatgaagacgaccccgaccttgctagtgtcattgatacgattgagagaattggagctgctggggtcatcatcactgaccgttcttcgggtgacatcgacattgattttgagcctacatttcccacgacagtcccttccgccatagttctgaggggttccgacatgcgagctctgtttaggtactann

SEQ ID NO: 2697 - DNA, 431 bp, Sorghum bicolor
  Clone ID: SORBI-28MAY03-CLUS45851_1
gcacgaggcttagttcacttgacccgccactggtgtttgaggttgggatcgatatgctggcacttgcagatgtccctggaggcaagccagagtgggcttcagctgccattattgcaatcctgacactatgggaccggcaagaattctcgtcgatgagggagaccattgtcagggctgttgtgaccaatcttcatttgctggatcttggaatgcaggtctctctgttcaaaagactgcttcagatggtgagaaacctgagagccgaatcacatcgtatgcatgctttggcatgtatttgtcggactgctctttgtgttgatctttttgcaaaggagagtgttcgaagaggtcagaagcctgttccaggaacagatgtgatatcgctctttgaggatgtgagggtgaaggaagatctaaacagtgtaacaagc

SEQ ID NO: 2698 - DNA, 470 bp, Sorghum bicolor
  unsure (1)..(470): unsure at all n locations
  Clone ID: SORBI-28MAY03-CLUS45538_1
aggagtagagaaatatgaaatgagtttagctattgaggtcttttgtccatgactcaaaaatgacagctaactgttggtttggatctgtaaataaaagaatacatataactattgatgctattattatttctagattttattcagcaactgactagtgacagcatggaagttttaaatatacttgagctggttagtgacagcaaacttcagttagctctatttcttgctgaagatgaggcatgggtacgttgttttgcaggttataaggtgatgctatcgtccttcagattcagttaaattattatcagatgaagctctggactagtcatcagtggaccaacttggaagttgtggacaacacatgttagtttgtttttgttcatcagtctatatatgttgagacccaggttagncttgatgttaagtgacaatgattaatatatgtactccagtgttgataaatgaagtga

SEQ ID NO: 2699 - DNA, 646 bp, Sorghum bicolor
  Clone ID: SORBI-28MAY03-CLUS45554_1
aaagagtcttgcagaaacatttcctgagataagaaaagcgctgaaagagaacgagcccaccaaaatgcttatttaatgattgtgtgcacctgggtgagcatggatgtgttgtgaaaggggagtgggaaaggtatccatactatctccagatgcttgatgagatcaaaattagagaggaaatccagctacggacatttggaacaaaaagagaaggtgatgtcaggtacaaaacaggtgtcatggggctgaagcaagcagagcctcgtcttgagctcaagaagcataggagggtgtctagaaagaagattaaccaatctattattgacgaaattgaagatgacattgatgacctcgatgatgactaccagttcgacgtgaagcaacgtactaggaaacgatagttgtttcttgtctgatgatctaacgactacacgagtctaatcattggcaggaaggaacctttgggtgctgtacatagttggttttgtagtgcgaccatgcccttaagcagttatgctgatcgctgattcgctgtaactgtaaggagtgcactggccgggacccgggaggccgtggacgcttgcacctaacatttgacgtttaacttgcggcagaacagtaagaagtaagatggaagtttttagtt

SEQ ID NO: 2700 - DNA, 588 bp, Sorghum bicolor
  Clone ID: SORBI-28MAY03-CLUS4562_1
caagcttcctagcgtgatgttgggattgatgagaagttctgggagcaagattttgaaattcctagctgccatcaatgtggtggagtgctaaagcctgatgttgtgatgtttggtgataatgttcctcaagagagagctgatagcgctaaggaggctgcaagaacctgcgatgcacttctggtggttggttcagcactaatgacaatgtctgcttttcggctggcaaggctggcacacgaagcacatgctccgatagctgcagttagcatcggggagaccagggctgatagcattttatcactgaaaatcaatgcgagatgtggggagatattacccagaatacttcagatgggaagtctggtggtaccaaacataagctgagcataatcttgctatcagctattaatgcagcattatgcggtgcctaccatcacccatagttaagatttggaggactcggtggtgaagaataaaagaagaaacatgtacaattagttgtagataattcaacatggtcaatggccatctgtggttgttatatccgaattgttcatacttcatagggaataactaatagtgattcctgca

SEQ ID NO: 2701 - DNA, 455 bp, Sorghum bicolor
  Clone ID: SORBI-28MAY03-CLUS45631_1
aaatcaccgagtacttccatggtgattccgcgaaggaggaggctcaccctttcaggatcttcatggtcgtaagggatttcctaacggttcttgatcaggtctgcaaggaagtgggcaggatcaacgaccgaaccatcgccagctcagtgcgccatttcccggtgcccgtgaacccaatgatgccgcaattgttcccacggcttcatgctttgagagctggattctccgacgatgagagttcagctgcttcagtgtcatcgccatgatcactggtagtctgccaatataatttttcgcggaccgtcagtagaacagcaccaggaggcagagggattcaaatggtagcgggctgtcctaatttttttcaccttttgtacctgtagattatagaatgtacaatatttttgcaaatatttatttctatatataagaagggataaagtctagatcagaag

SEQ ID NO: 2702 - DNA, 516 bp, Sorghum bicolor
  Clone ID: SORBI-28MAY03-CLUS45625_1
gctatgattaggaaatggctgctgatgcacttaatgttgatgacagtccctaccacaagagttcaatgtctccaagcagaccacttctcagcaatcatttctaagtgttggccagagatggaagctgcaacgaacttgaccagacagactgaagcttcgccccctgcccttgtgggtttcacgtgtgcctcttctgtcacaacaacagggtcaagctacaagatggatgctgctcaggtcgcaggaagcaatataacatagtttttgcatcattgtggccatggcgtaaaagcaaccattggtactggacgagagatgaaaaatattagaggatcatatctccattgcaatctaaactgcttaagtattaatggtagacttttctatcattggcttcaaaggaggcgtttagctaaagtgaattgcaagttgggcttacaatatgtttgaccattttgttttggttgcctatgtctaaactcgaatggataccataatgcatgcaaagtgttttcc

SEQ ID NO: 2703 - DNA, 608 bp, Sorghum bicolor
  Clone ID: SORBI-28MAY03-CLUS45926_1
gcacgaggggccgccgcagcggaggaggcagggatgggtcccggcgccgggcgaccgcctctacctggcggcagagggtttacacacacacagagccaccatgttgctgcaaggaaggagaaacagcttgagactctgagggctgctttagggctggacgttgaggatgctaagaagaagggggatgtagaaagtgatgtagaatctggggagcttgttcctggtaagtattatgaggaactggatactgcttggcaaaaggatagcaaggattcaaaggatgcaaagaagagcaagaagaaaaaagagagtgacaaaaggagccgacacaaaagttcaagaaagagcaagtatgactcggactcagatgatgatcatgacacaaaaacaaaaaggaagagttctcgccatgattcagaagatggttcagagactgattatgatgagaagaaggaaaagaaacacaagaagaaacctcgtcttggttcagatgatgattctgaaaatgatcggaagaatgccaagcgtgtaaagaactctcgtcatgattctgagtctgatacagatagtggctatggcaagaataaagccaaacatgcaaagaatga

SEQ ID NO: 2704 - DNA, 501 bp, Sorghum bicolor
  Clone ID: SORBI-28MAY03-CLUS45917_1
gcactagggcgagagagaaaagaggtcgtggacgaatccaaaatactccacctccatgtaagctgtatccacactacaacacctcacctccctttcctcgctcctctctctctctctctcctcagtctccctctctctcctccaagatctgtcgatcacacaccccacaccatacacacgcagcagctgctgcttgctcttctacttgcttcttcttcttcttcttccatctcgcaatgccatctcccaggcaattcttgcagctgctgttacccatcttgctcgccacttgctgcgtcgatggaggcaacggccccgacgacgctctcgccaccgcgaggaggcagcttcaccagcccttcttcgtcccggatcagcccgggcagccgtcggcgccgccgccgttcttttcagcgatgccggtgacgccgccgcctccgatgccgacggggcagaaccagccgacgtaccctgctctggtgctcccaacaccggctccag

SEQ ID NO: 2705 - DNA, 699 bp, Sorghum bicolor
  Clone ID: SORBI-28MAY03-CLUS45960_1
gcacgagggaacaaccccgtcctcatcggtgagcccggcgtcggcaagacggccgtcgtggaggggctcgcgcagcgcatcgttcgcggcgacgtgcccagcaacctcctcgacgtgcgcctcatcgcgctcgacatgggcgcgctcgtcgcgggcgccaagtaccgcggcgagttcgaggagcggctcaagtccgtgctcaaggaggtggaggaggccggcgcgagggtcattctcttcatcgacgagatacacctcgtcctgggcgcgggcaggacggagggttccatggacgcggccaacctgttcaagccgatgcttgcgaggggacagctccggtgcatcggcgccaccacgctggaggagtaccgcaagtacgtggagaaggacgcggcgttcgagcggcggttccagcaggtgttcgtcgcagagccgagcgtgcccgacaccatcagcattctcagggggctcaaggagaagtacgagggccaccatggtgtcaggatccaggaccgcgccctcgtcgtcgccgcgcagctctccgcgaggtacatcatgggtcggcacctgcctgataaagccattgacttggtggacgaggcctgcgccaatgtgagggtgcagctcgacagccagccggaggagattgataacctggagaggaagagaattcagcttgaagtcgagctccacgcgctc

SEQ ID NO: 2706 - DNA, 599 bp, Sorghum bicolor
  unsure (1)..(599): unsure at all n locations
  Clone ID: SORBI-28MAY03-CLUS4597_1
gcgttcttgaatcctaaacttggatccttgggtgagtgattgaaagcgaggaaaactgttctagaccctccctgggaaggcacaaatctgatccctggtgatgtgctctggtctgacccttccttgcagatgggtctttctccaaataaagaacgaggcattggtttgctttggggtcctgatgtcactcaacagtttctgcagacaaatcatttgaagctaatcatcaggtcacatgaaggtccagacgcaagagacaagcgacatgatctcttagaaatggataatggatatacaattgatcatgaagtagaatgtggaaaactaatcactctcttcagtgcaccggactaccctcaatttcaggcttcagaggagcgacataacaatcgtggagcatatattgtccttaatccacctgattttgcgacccctgttttccacagctttgaagctgtaaagcctcgacctgcggcgcatccgttctatgattttgaagaagtgatcgactcagatgaagagttgaatttggacgccatggacagtggcacgtcgagcctgtcatgatgacttctcatataccttttgtatntatcact

SEQ ID NO: 2707 - DNA, 573 bp, Sorghum bicolor
  Clone ID: SORBI-28MAY03-CLUS45974_1
gcacgagggttgagcccataattccaattatatttcagagaacaaaagcaacatgttttgcttatggccaaacaggcagtggcaagacatacaccatgcaacctttgcctctcagagctgcacaagacatggttcgtctattgcaccaacctgtctatcggaatcagaattttaagttgtggcttagctatttcgaaatatatggtgggaaactctttgatcttctatctgacagaaggcaattactgatgagggaagatggcaagaaacaagtttgcattgttggtctacaggaatttgaggtttctgatgttcaaattgtcaaggaatatattgaaagagggaatgcagccaggagcacagggtcaacaggggccaatgaggaatcatcaaggtcacatgctattctgcaactggctgtgaagaagcatataattgtaaaagataccaggagacagagagatcgtgatgctaatgaagctaagaatacaaaggctgtggggagaatatcatttattgatcttgctggaagcgagcgtggtgctgatactactgataatgatagacagacca

SEQ ID NO: 2708 - DNA, 635 bp, Sorghum bicolor
  Clone ID: SORBI-28MAY03-CLUS45989_1
gcacgaggatccactcgaggactctgcagcagcaacagctcagcgggccagacgactccgtggctccgtccgccgatcaacacgccggcacgcctcccgtttcctcattcccaggctgcactgcgccgcgtccagacgccgggccccccgccgcccccccccggcctctcccccccctcctccccggcctccctcccccgctccgggtctgcgaggtagtgccggcgacgaggcctctccatcccctctggcgagctccccttccaaagtggtgagacagtgctttggatattaccttttgcattttagtggatcagtcctcccaggggttatgcatgacagcccctgtggctcttccaaatgatctagaaacagtctcccattctgcaagggttgacttattccgagacactagttgcaacatagaaaaggaggtgttggccagtttgggaaatggccaaaattcaactgctgctggaacaaatcctggtttcagagttggggagatcaggtttgctaatggagatatttattccggcacattgttggggaacacaccagagggttcaggccagtatcgctggtcacatggttgcacctatgagggtgagtggaggagacggatgaggcatggg

SEQ ID NO: 2709 - DNA, 554 bp, Sorghum bicolor
  Clone ID: SORBI-28MAY03-CLUS46011_1
tgaatcagaaaatggagatggacctgctggaggattcaccagagcactgagggagcgcatcgagcctcaagacaaatctacagaggctggagctttgatttccaagttgactgaagaaaagaattccgcgattcaacagaatcatagacttagacaggaacttgatttggtgagacaggagatcagcaagaggcgtggagggggcttctcctttatcattgtcataattgttgctttgatcggcatcatcctaggctatctgatgaagtcataattctttcaggctgtcctctggccatatcaaagacagtcatgcaagttgtgtttgggaactcaaaaaagtctattcaaaccagatgtcttgaagttctcctgcctattttgtcgatataggagtgcatgctgagccagcttaagcttttctttttcttcttttgttattttttgttggattggatgggttgtgcttgtgcgcattgctgacactgtaacttggaaaatgcatcatttgcttttattcacagtttatcttgctgacgaaatctgttttcccc

SEQ ID NO: 2710 - DNA, 532 bp, Sorghum bicolor
  Clone ID: SORBI-28MAY03-CLUS45758_1
gcacgaggcatttgctgcttacggaagtgatattgcagttttcaaaaggactgatcaggtggctacttggagtagacatgaagaaaaggtcaacatgctatacctgtttggagaatatgttctaagtgcagatgctaaaggtaatgtattcatgtgggccttcagaggagcacaaccaaacactgaaccagttggaagcatatcattgggagacaagttcaccccaacatgtatcatgcatcctgatacttacctaaataaggtaattgttggtagtgaagaaggccccttgcagctgtggaatatcagcacaaaaaagaaattgtatgatttcaatggttggaactcgccggttcggtgttgtgtctcttcgcctgccctggatgtagttgctgttggatgttctgatggatcagttcatgttcataatgtaagatatgatgaagaattgatgtctttcaaccatcagattcgtggtgctgtgactgcactgtcatttcgaacagatgggcaaccccttctggcatctgga

SEQ ID NO: 2711 - DNA, 574 bp, Sorghum bicolor
  Clone ID: SORBI-28MAY03-CLUS45791_1
gcacgagggtatgactgtgattgccgaaggaggaagagttaatggtacatcagggggaaaagtttagatctgcagtaagtgcaagaaaagctaatgtcttgagggagatcttccaacttgacacccgtggtcttcttcttgagaaagccaaagcagaagttcgtgaaaaattacaaggctggaatatttcgacatctagccagcttgccaagaaagggaaatcagaaagaagagagaagcaagtcgaaaacaatataaaggttaatggcatcctctctgacaatccaatcaatagatgcaagaaatacagttcaaaagatgcagatgtcgagatccctgtgactgatgtagtgaatccagaacagatgcgtgtacccatgtccattgatgtccctgacccagatttccatgactttgataaagatcgaacagaaagagcctttggcaatgatcagatctgggctacatatgatagtgaagatggcatgcctcgcctatatgcaatggtacagaaagttatttccatgaaacctttcaggatacggatgagctttcctcattctaagtccaacaa

SEQ ID NO: 2712 - DNA, 541 bp, Sorghum bicolor
  Clone ID: SORBI-28MAY03-CLUS45809_1
gcacgaggcaaagtcagcccggaatatcatgcttttggagctcaaaaagctcattgaagcgaaccccctgttccgggacaagctgaatttcccaccattcaaagcttccaggcttcgcacattgatcaatcaaagtctgaactggcaacatcagctctgcaagaaccccagaccaaaccctgacatccagacactctttactgatcactcttgtgctgctcctaccaatggagcaagagcacctccacctgccaatggtccgcttgttggatccatccctaagtcagctggatttccaccaatgggtgctcatgctccatttcaacctgtggtgtcgccatctccaaacgccattgcaggttggatgacaaatgcaaacccctctttgcctcatgctgctgttgcacaaggaccacctggtcttgttcaggctcctaacacagcggcatttctaaagcatcctagaacccctacaagcgcacctggtattgattaccaatctgcagattcagaacatctcatgaaaagaatgcgtgttgga

SEQ ID NO: 2713 - DNA, 558 bp, Sorghum bicolor
  unsure (1)..(558): unsure at all n locations
  Clone ID: SORBI-28MAY03-CLUS45810_1
gcacgaggataagaatggaaatccaccaggcatcatacggaccattgtttctgatccaatgcctgacctgtttaagactatgattaagagattggtacgatggcaagttctgcctacaacttgtgtaccagacagctgcattgtaaatatatatgaacctggagattgcatcccaccacatatagatagccatgattttgttaggccattttgcactgtttctttcctcagcgaatgcaatattctttttggatctaacctgaaagcttctgcccctggagaattcaccggttcaattgcgacccctctccctgtcgggtacatattctgtcatattctttccgcctgctaatagatttcttatgctagtcgcacttttttattgttatatactctatatggatagtttgaaaaatgttttgtttcttgacatttcaaagttgtgaatatatatatgaatatcaaggctgtttagtgggtcatttgaattctttagatgattgcttgttgcatcgtacagtgatttgcttaaattgtctcctttgccctgtnatttac

SEQ ID NO: 2714 - DNA, 558 bp, Sorghum bicolor
  Clone ID: SORBI-28MAY03-CLUS46103_1
cgtcgccaccaaggcgtatgtcgaccaattctcgaggtgcctatatgtcgaatacaagagcaaaggcatagacgtacaatgccaggtacccatacaggtggcgacgaagttggcgtccatcaggaaacccaccttcctggcaccgtcgccggagacgtacgcccgcgccgccgtccgctacatcgggtacgagccgcggtgcacgccgtactgggggcatgcactggtgtggctcctcatctcccttgtgcccgagcctatcgccgacaggatgttcctaaacaggtccgtcaccatccgcgccaagggccgcgccaaagaagctaagaagaaggcgcagtgactgtgatgagggttctacgtgttggtcagtggatttgcagtagcctctagcgtgaatggtcacatttcgtacacgtttgtatctcctctcagtatgtacgttgctacactttgcatgtcgatgagtttgtaatacatgcacaattgcatttttcttattatttttggaaaatcagttctcaaagcaagtgattggcataaaaccattaagcactt

SEQ ID NO: 2715 - DNA, 555 bp, Sorghum bicolor
  Clone ID: SORBI-28MAY03-CLUS46105_1
cttcagtgccactgcatgtcgttctgcaagattggatcaggcatacggatgggaaattgagctttctcggttttgtcaagttgttgcatggcatgtccagcaggtccctgtcaaagatgagatagctgttgataatccctgacgacagcgcgtgtttacactgcccttgcccctgtcgacttggttcacaggcaaattaacagggctaaagaaccgtcgattggagcttgcatatctagggcgtacgagttctagcagcacctgatctgtcactaatttgagtatagagttatgtttgttgcctgcctactgatcatttagctgataggagaaaggaaaatctcacccatgtctgcaacatgtgatgtttctaacagtcttagattagcgtcatcttctgttgtgattttgggaactttgtaatgcttctttcctggaactggagcaagttagctgcagtcataaggttggcgtttggagcatggacatatcacttactgtcattgtcactatgtcattgtacctatagatgaaagtgcgtgatcgttatgtggt

SEQ ID NO: 2716 - DNA, 452 bp, Sorghum bicolor
  Clone ID: SORBI-28MAY03-CLUS46115_1
tatcttaacaacgatgactgctacaagtgatcaacggagcaatcaagggaatgaagatagttctagcataggtgaaggtcgcccaataacttcccctaacccagagaaaggccagagctctgatatccctgctgaatgaaggcaacactgataaaatattcttgcatcaatgattccagcccattgctgtgatcattatcgatgtttcgtcataaaattagatttgtacagttgtggtggttgtgctaatgctagtgctatgatgatgttggttcgtgcatgtatatgactgtatatattgtaaccactgctgctgccgcctgtatatttggccagttgcagacttgtcgtcggttttcggttgtggtcgatattaacgttacctccggtaactgataagtggtaattgtatttgtcaccccctagtttggaacgaagaaattaagcggttc

SEQ ID NO: 2717 - DNA, 575 bp, Sorghum bicolor
  Clone ID: SORBI-28MAY03-CLUS46126_1
tccgcgcagacaatccaggggtatggtttatgcattgccacttggaggttcacgtcagctggggcctgaaaatggcatggctggtgctggacggagaccgccccaacgagaagctgctgcctccgccgtctgatctccccaggtgctgaggcagacgacacgaggaattgctgcccggcctgcaggtcgccatcaacggccgtgatcgattgggcccggccggccgtcttggaacagggattgcgtgctctctaatttgcataggatatcttaatcatcttttggttgtgctggggttggtgttatgcgatgctttcattaatagaggtgtgcttttccgggttgagtcgtcgtctggttagctgtgtgagtgagagtcacacgggcaggaaggttcataccacttactcagtataaggcaaacgcccatgtattttttgattgtttatgagttactgtactaccatcttttgtaaatcagattcttgtcgtcggggaactggatagtgtatccaggcgtgcctccctaaataatatgtttacgaactatcagccattgttggaatttatttttg

SEQ ID NO: 2718 - DNA, 379 bp, Sorghum bicolor
  Clone ID: SORBI-28MAY03-CLUS46130_1
ctcaccttccaaactcgcagtacatcgtgaatactgaaaggggaagaaagctcttcactatcaagaagaatgtggcaaaatggtatgacaaactctccaagctcgagacatggaagcaggttgtcaagatgcagaaggaacatcctggcgcatgtgagtaattgcttaacttggggggttaggagtttttcttgaatggcttcatcgttggtgtcggtctggctgtgcagtgttgttagtcatccattgttttgccatcagtgttgtcgtgtcaaccaaaataatgtgaagccctactgtgatgtattatccttttgttctgaaacgcatttgtctccatgtatcgaagggtctgatgaataaaggtgaattattgcct

SEQ ID NO: 2719 - DNA, 564 bp, Sorghum bicolor
  Clone ID: SORBI-28MAY03-CLUS46145_1
ctaccgtccatttggcactatttttgccttcacagatgaggagagagttaggcaacgattggctttgtaccaaggtgtatgtccaattcaaatggaattttctgatgatgctgagaagacatttggcaacgctttgtcttatttgctgaaacatggtatggttaaggatggtgaggaggtcgcactccttcaaagtggtaatcagcccatctggagatcccaatcaacacccaacattcaggtgaggaagatctgatgcggaacgcacatagtattcagattgttgaggacatcatttcttctagcaaaccagaaggtcttgttacaataataccgcactggtagtactggcattggtgagatagatagtactgagctagtattgtgattcttttcttatttgtgcactaatgcagttttccttccatgtaaaaaggccaatcaatttgccacccggttttagctgtagcttgggaacgctgtaggcttcttgttgtaatacagttcgttcagtttgtcaatgttataaggactttcgcctcgacagggacgctttgtcatttg

SEQ ID NO: 2720 - DNA, 640 bp, Sorghum bicolor
  Clone ID: SORBI-28MAY03-CLUS45874_1
gcacgaggcgagaggcttcttcatccgacgatccggcgtggcggcgcctccgtcctctcggcgcatcccgtacggccgaggccggccgggctcttcgtgtatagccaaagctttaagcttggtctgatgctagagagcgctacttccacgggattaatgaacaaccaagtcttggaaaagatatacagttttattggggatgagtcagccaatcagcttggtgtgcatacacagctacggttcctccatcatgagcctcagcagcatgcgaggtgccctggaagatgttgccgatatggaagaccttgacaacgggaccaaggcgtggaggaacgaagtgtcgggattgtactatgacgctgaggattgcatcgacgattttagacaccgggttgacagcggtccatcacatggcggacaagggttcatgcgtagggctggtcatcttcttgagacgctgatggctcgctaccagatatctagaaaaatcaaagagctcaggactcgcgcgcaagaggcaaatgatcggcgcacaagatacaagcttgatgaatgcgtgtcgagatcggctcgggtttctgtcgatccacggatcactgcactttacgctgaaacatcgagccttgttggcattgatgcc

SEQ ID NO: 2721 - DNA, 613 bp, Sorghum bicolor
  unsure (1)..(613): unsure at all n locations
  Clone ID: SORBI-28MAY03-CLUS4588_1
gtcgacccagcgtcctggagctggnaggcgcgctgaagctctccgccgccgcctccaggaagcggaggcggcccatcggcaccgcgccggccctgctggacggcggcgtgcaggaggaggaggaggaggagcaggcggccgacgacgatcccaccgccacgcaggcgctgttcgcggagctggacgagcgggggaccacgtcggagctggagaacctggcgctcaacatccagggtctcggcagcagcaagcgcaggcagggcgggggcggcgcgcggagccagcagcgggccgccgcggtcggtggtggcgagacggcggagctgaccgacgacttctgggaggagctgctgaacgaagggatgagaggcggtgcggcggctgagctgttgccgccggagaggagacggccgggctggtacgtcgacgcgctggcgcagaagctgagctccatgagcaacaccacggcgaagtagagctggcgttcgtgtcgtagtcgcagtttactcctatatgactatagtaatactagattgattaaccctccgattcgtccggtacgcgttagtgaatactcctagtcatagctccattgttgtactagtatttagga

SEQ ID NO: 2722 - DNA, 652 bp, Sorghum bicolor
  Clone ID: SORBI-28MAY03-CLUS45898_1
gcacgaggccaaagttgctcacctggaaagcagagcaggccaccatttgctaagcgggttcatcctgctggtgatggcaatgattcaggaggtaaagttgctcagcaagagggcctggcattgacatcaaaattggatagttcttctaatgatttaattggcaaagtgggagataatggtgcgtttgatgttgcccttgggcagcattgtcacagtgacaatttaatttctgagcattcacaaccagtggctgcttctgctggtactcataagatgcaagaatctcgatcggacttaaatgtgtcttcatcagcaggtgacccaattcttatgagccaacctgcatcaggtgtctcgtatatgtctgtacaaactaccaagagctccatggcatctgatcctctccagtctcatcctcagagtttgtgtcctcctgaacacatgtcatcctcaaatatgattcagccaccaggacaaccaacatttacaacatcagaattccctcaaatgcagttccagcataaagttattgcaccagcaaatgagttcctgcagaaccagatgagaagctaccctccacaagatgtgtctcatcccagaccattcaatttccatcatcatactctcccaccagcaattccttctaaccagc

SEQ ID NO: 2723 - DNA, 819 bp, Sorghum bicolor
  Clone ID: SORBI-28MAY03-CLUS46211_1
gcacgagggcgcgggctggcgcccggggccgacaccctgctcggcctgccagccaacgtccggcaccgcctgcggcccccgctaccgcgcaccttcttcgggaacgccgtcgtgcgcgacctcgtcaccgcccccgtcagcaccgtcctcgacagctcgctcgggtccgtggcggagaccatcaagaaggcggtggaccgcgtcgacgacgccttcgcgcggtcggtgctggactacctggagctgcagcagaataatgcaggcggcggcggccagcaggcccaggcggcgcaggcgcccagcagggagcagctcgtgccggcgacggatctgtgggcggtgagctggctggggatggccatgtacgacgccgacttcggcacgggcgcgccccggttcgtcgcgccggcgcagatgttcggcgtcggcacggcgtatatgacgccgcgcggtccggacagggacgacggcatcgccgtgctcatctcgctggagcccgagtacttgccgagctttgagaaggtcttcttctataacgagtgagattcacacatcattactgcatgtctcaagtctggagcttgaggatctgcgaatgtgaagctactcctacggtcgagtagtatttttttttccttttcgtacgcgtgtgttccttagcgagttgttctcgtatatttctgtatatcttttgatacccaacttcggatcgggtgtctcctcctttttcttgccattattgttggatcaagccgtctagattacagtatcatcttcatgtgtagttacaattgtcttttctggaagtcattttaaaag

SEQ ID NO: 2724 - DNA, 784 bp, Sorghum bicolor
  unsure (1)..(784): unsure at all n locations
  Clone ID: SORBI-28MAY03-CLUS46194_1
cccccacagacatcgatgttaccaagcgagagacatatctgtctttgtcggagttcagagagaagtttgggatgacaaaggaggcatttgggaagctaccaaagtggaagcagaacaggctcaagattgccctccagctattctgaaaaccttctactgtcaaatagactgcgcttttctttgctaagtcaaagcacaatgacactgttttcaaaggtaaaaccattttttcaggcacaggcattcacaatctctcatagtcaattcagaagtggtaagagtcattgtaagtgttagcctaccagggtcaagggaccctcggtgggttttggaggagcaagtccagtgagtttttagctgctcgtgctcctgagttgtgttcgtcactgacaatttgcatgtgcgatgactagtgtcagatcactgcattggtgatccggtcactccaattctttcctacccaaggtcacaggtttgtttgtgcttgcaaacccttttttcccctgtgaagccatatttgttctatttttttaagtagagtcccgagataataagggatatatatatgatgtaatttagacaacagagcatgctgtacaaaagagtttgtaaaatgttatttctgggggctgttgttttgtacttcctgtgtttgtttccgtaataacagaccatgcttgtaaatttttccangatacgtattgtctggcatttttccatgcttgtaaatttttccagaatacttccctgtgtttgtttccgtaataacagaccttgcttattt

SEQ ID NO: 2725 - DNA, 559 bp, Sorghum bicolor
  Clone ID: SORBI-28MAY03-CLUS46214_1
ggaccggaatcgcaccgccatttctgctgcagatcttgacgctgaacttgacaagtaccatgcagcagcagtgaaagaggaatgaggctctggcgttctatctcttacacaggtggaaaggcgtcgggacagtgtggcttttgctttagaaacatgaagtttactatcttagccctagggttttatgctagatttttcttttggcccatggtacaaccattcaggcgtctctgcaccaagattctagtgttttatgtgtagcatgaagttgtggtcctactttgcaggatctatcaatcattcagaacaactggaaaccaacattgttgtgtctgccctgatcctgggtcggttctgttgtattttaagtagttttggcttgcctaccgaagacatcaggcaaacatgttccagagtccaagagttggtattgaatcgagtctgtgttctgttctgattttttacaattgtcttgaatctttctgctgtgttctagatacatggtatgtattacttatgtccgaaaaatacttgttcttatttgattcaagttttggct

SEQ ID NO: 2726 - DNA, 629 bp, Sorghum bicolor
  Clone ID: SORBI-28MAY03-CLUS46289_1
cacggctgccgtcggcgggaatgagacagaacttgaccgcctgcgattccagccgcatcgctggcacatgcctgctgctgctggaactggaagccacaccgccacagtggtgggagcaagcggctccgttttctcaagccgtgtcttgcaccgttgcacggccgtagactcgatcttcgggaaccactgaccgcagggtttttttttttgacatactgcatcgttgaacacatgcaggagaataggagaaagcataataccagtagtaaaccacctgcaccaaccaccaagataatactagtagtaaaaaaaaggctttttagacgaccaatagcttttccttttgacgccaagctctggagtccgccacgagacagggacatgcgggcgtgtctgatcaggtaccgcggcgactctggcagtgtgccgcggtaggctggcaacgtcgcgcctcgcgagtcctctactactccaggcaggcagaggcaaggcacggcccttcatcaaagccatcgtgtgtcgttcttgccctcgtcagtgtcagccacccaaccttcgccagtactgcacggctcgctgcacttgccacttgccagtgccaaagcgaggcttaaaacatcgcttgaccc

SEQ ID NO: 2727 - DNA, 675 bp, Sorghum bicolor
  Clone ID: SORBI-28MAY03-CLUS46298_1
tacctctgttggaagatcatggttcctcaggaacaaggccaagaatgggctaggatcgccgactgccgctgccggaacaaagcagagcaaaagcaaccagactgggataattgcatatgcagagactgaagagtacctgaactctgaaagcaccgttgttgcctatgacaaccaatcagtggcagagtatttctacaacggtgacctctgggtcagtttcgatggcgcacaggtagtgcagcagaagctagagttcgcggcgagatctcagttgcttggctacttcctctggaccgtcggcttcgatgattcaaacagcacaatatccaagaaagcatcggaatcatggcaccaatatactcaaggtggatttggaatcatgcacgcaggaggttcaaaccaatatgttgcatttaattcatcttcagtatcacttggtagctggtattcaaaatctctcagctgtttgctgtcttcagtacttctgttggtgattctgtttcattaagaatatcagtaaacaggccagaaatgtaaaagtagttcagatgatatattcatcaaagcgaatgtctaatatatgttctgttgtatttattaagttttctcacagtcgttctttgccaaaaacaagtgtcgcatcatgttcaatgactaatagccacattgtgttcc

SEQ ID NO: 2728 - DNA, 545 bp, Sorghum bicolor
  Clone ID: SORBI-28MAY03-CLUS46301_1
gggctacccagaaccagaagaccacgaggaaggtgtccccttgtctaggaatccaccttggatatggtgttgcttgaaatcatactatagggacaaaagcgatatctggggcagcagagcgtaccaaatctttgccacagagatcaaggattgagtggggatgctgcttgaatttgcaggaacaactatgcaagcgaatcaaacaaatgttgtgtagtatctctatgtgctgccagtgctctcattggcattttgcttggagggggcgttttgcaaggaagcacgggcgcagggcgacacacttagtggtaaacgctactattgtcagtgctattccctttatgtaatgtagttgcagtgctgtcgctggccatctggttatgtacaatcagtgaatactgtccagaacactggtggcattccgtagtagtctgtatgtgccaattgtgcgcctgcactctatcttatgaaatgttagtgcacacatcacctcttttggcttggaacgtggcaagaacccctgttcggcgccttacattctgcaa

SEQ ID NO: 2729 - DNA, 633 bp, Sorghum bicolor
  Clone ID: SORBI-28MAY03-CLUS46026_1
agggcatctccagtgattgacctcaacgaggcctgtgagctgggttatgaggagatggaaatcgatgagcaccatggttacagggcccctctaggcatcaacaagtcaaagaggtatccgatggaaggtgatgctgctgccggaccaagccaggttagaatgcctgtgttctgggatgtccagaacccagcagggcgatctgggaagaggaagatctcatggcaggatcagttggccctgagagtataggtaaatgataatgtttagctctagtacagtagtactattctagtaggatcagtatgtgccattgctagcctggtaaatgtaaagggatggttgggacaatttcaatggttatctgctcatgtttagtgctgatgaaaacataggctgttggctgttgcatgataaagtagtcgggtgtgtgtgatgaatcaccgaaatcttatggttaatattggtatggaaggctaatgcttcaatgagagatgtagcttccaaggatgtaatctgttcatgtagagttgcaaaaatgagggtgcctgctctcttgacatagtaaacataaagttcaagaaaaagacagttttggcaacagtttattgtacatataatgtggcagtgtttgtc

SEQ ID NO: 2730 - DNA, 699 bp, Sorghum bicolor
  Clone ID: SORBI-28MAY03-CLUS46056_1
gctggaacgatgaagaacagtactgcatgttgcaaggctatgttaacttatgtagcccattgcaaaagcaaagcttcataacaaacttgcaagctctaaattgtgcttctttcctcggggcaaagttgcaaaagacgaatgttagctcgaatgtctatagctcttgtcaaataacactaaaagatttttcacttcaagttggatctcaagaatctggatgcctccttccaagtatgccctctgatgcatctttcgacagcacttctgggattagcttcacatgtgatctgaatgacaacattgctgctccatggccatcttccatgcaagcaccatcttcatcatgcaacaagtctgtcaatatcccagagcgacccgctgcgacatcggcacaaaatggtgtgaaccacaagaacctgaagctaaggctgcttgcttctttggtctcccttcttctggtgctcttggtacaagtttagcaagatccagttgccctatcatggagatgattcattcaggagagctaactggaagtgtcagtgaagcgctgagtttttgcgatcttgtggtcgcatcaaagtgttgtaggttcacatgtgttttattttttgaatctcctggtagcagttagtgtaatctgttgtaaggcatatatatatataatataatataatgatagtaataatttatattcattgt

SEQ ID NO: 2731 - DNA, 626 bp, Sorghum bicolor
  Clone ID: SORBI-28MAY03-CLUS4607_1
ctagagggagggaggggttctgcaagcgatataaagtacaaccctgatgatttggagaaccaggtctcagatttttttgaagggagaaagccgaatgcttgatggtcaagggatgtccatatcaactatgcaacctcaagacccatgcaaattttgatgatgctagttccaagtccccctccaaatttcttggcactatactgtacagggaacttgaccttcaaacatcttttgacggtctgaagatggaaatataagcttctcctgaactgacagaaactgtgtgaactgcaaagcaacctgaattgaatactttagcttagcttgtcatccttgatcctgtcagggtgaatggtgacatcattgaggcttgcacatggaattatgacaactgcatctgccatgagctgtgtaattgcaattcttacattttacccttcttttgtcgattgtaacatctcatggctattgtttgacttcaaaatgttgatgcttggcacttctatgtacaatcctaccagcagttatgttcacatttaccttataatgtgttgtagccttctgttatattcattcgttaatgataaacaaaacatatagtttatgtgaatgctattggtcctgtt

SEQ ID NO: 2732 - DNA, 586 bp, Sorghum bicolor
  unsure (1)..(586): unsure at all n locations
  Clone ID: SORBI-28MAY03-CLUS46073_1
cctcctgtcggacgccaagcaggggcagtacgcgccgcggaacgtgctgccgcggctcgtgtcgcgcacggtggccgtcgcgctggccacaaccgtcgcggccatgctgcccttcttcggggacatgaactcgctcatcggcgccttcggcttcctgccgctcgacttcgccgtgccagcgctgttctacaatgtcaccttcaagccgtccaagaaggggttcctgttctggctcaacacgacgatcgccgtcgtcttctcggggctcgccgtgatcgcgtccgtcgcggcggtgcggcagattgccttggacgccaaaacttacaagcttttcgccaacgtgtgaggagagccaaaactgacgcagctgtaaacgccctagatgttttgtcgcgactcgtgagcgttttgtcgtgaaaaaatatcaggtacggaccatcccgattcccgacggtgtttctgtgcggacgactggctgatatgtggtccgtaaatcatggagatgacggtggtactgttccttttgtagtggtgtacgatctatggtagtataaacacgctnaaaaatgtgttttcctgcttggct

SEQ ID NO: 2733 - DNA, 644 bp, Sorghum bicolor
  Clone ID: SORBI-28MAY03-CLUS4635_1
cgccgccggaacgcggtgctgtccgtcgagtcggacaagaccgacgaggtggagctgcagcgcgcggtggaccgcgcgtccgccgcgctgctccgcccgctcggcgccgccgtggcggactacaccgcccggacgtgcgccgagaccgtgccgggtcactacgtcgtgtactgggagctgcagctgccgctcggcgccgcggacgtcgtggtcgacggcggcgacgtgctggaccggtgctgcctggagatggaggaggccctgagctcggtgtacaggcagagccgggtggcgtccggcaccgtcggcccgctggagatccgggtggtgcggccgggaaccttcgaggagctcgcggaccatgccgtggcacgtggagtctccgtcggccagtacaaggtgccccggtgcgtcaccgcgccgccggacgtcgagcttctcgactcgcgcgtcgtctccaaccacttcagccccgcgttgccgaagtgggtacctggttagcggttccattaatcggacagggggacaacagggagaaatgctaatgaggctctgctacgtatatgtaaatccactttttttttttacgtatttttataattttttgatagttctataaatatatattaaattttaaagttcca

SEQ ID NO: 2734 - DNA, 567 bp, Sorghum bicolor
  Clone ID: SORBI-28MAY03-CLUS46354_1
ggcacgaggacttctcctgccctgtccaccctcgactgcctgcgcgtgacctcagcccccgccgcctacatccgctcatctccgcgcccgcctcaaccgcgccgccaccgaccacctctaatcccgcctcaccctccgtgcggttcccgaggctcgtttcctttgggggtcgtccgtctgccccgaccgcgtcggcgcttcttcttcttcgggatctcgctgggccgagcggcgcagggctagggattcgggcccatggcgtggcggcgcgtcctcacccagattgcaaggcatcgaccaacaaaagcaatctacaatgaactaggtgcttcctcccctttgggcactcttcgaagtgacatcactgcaggtgccagaattaaaaatttacaagagaggaaccagtcaagttacattggtagccttgcacgccgggtgcgagatctagaatcaccaagtgaaacttctctacttaaagagatttacagaagtgacccagagcgtgtcatacaaatatttgaaagccgaccttctttacattctaatccagcagcactttcagagtat

SEQ ID NO: 2735 - DNA, 521 bp, Sorghum bicolor
  Clone ID: SORBI-28MAY03-CLUS46363_1
gcacgaggaaagctttggacaaagaattatgggcaatatgatggataatcttttggtcagaagtcttacatccaaatcaaaaggtcgaacagatgatattgctccaccctcacctgtgaaggcccctgatgatgaggctgacaaggctgaagaggaagagagccctatgatggaaactgtcaggagcaaatgtatcacacagttactactgcttggggcaattgacagcatacagaagaggtattggagcaggctaaaagctacacaacagatagcaataatggatatcttgctctcacttctagagtttgcttcttcgtataactcaccttcaaatcttcgcacaaggatgcaccatatacctccagaaagacctccactgaatcttctccggcaagaactagctggaacaacaatttatttagatatccttcataaatcaacagtggagcaggatgaaaaggactccactgaggaaacaaatggtttaaatgtggaatctggtgaccaggagaagatca

SEQ ID NO: 2736 - DNA, 793 bp, Sorghum bicolor
  Clone ID: SORBI-28MAY03-CLUS46366_1
gcacgaggagctcacgcagacagcgccgccgtcgccccctccccttcttccccttccgcttcgccgccgctcactactgctgccgactaccgcgccaccctatggcgcctgccgggcggctcctcgcggtagccgccctctccttcctctgtttgcaggggctgtggggcgattcaggcagcgcattgccccagggccagccgccgcttcaccggatcgttcgcgcagaggcaaatgacggcggcggcggcggcctcatgccggagctcccgcccagtggcttcatgcccatgccggacctctcaccctcacccagcggctccccgaggccatttgttcccttcctggctcccgcaccactcgcgcccttctttaacaacagcacgccaaagctctcagggaaatgcacactcaactttaccgctgtcgacaaactcatgaccaccacggctgtcgactgcttcacctcgtttgcacctttcttggccaatgtcatctgctgcccgcagcttcaggcaacactgaccatcctcatagggcagtctagcaagcagacagggtctctcgcattggatcccacggtggccaactactgcctgtcggatgtccaggagctgttgttgagccaaggcgccagtgataatctccatagcctttgctcggttcacctctcgaatgtaactgaggggtcctgccctgttagcactgtggattcgtttgagagcgtcgatgattcggccaagctccttgaggcctgtcggaagatcgactctgttaatgagtgctgcagcca

SEQ ID NO: 2737 - DNA, 515 bp, Sorghum bicolor
  Clone ID: SORBI-28MAY03-CLUS4643_1
cctctgaatccaagaaattgttgcaatatgagagacaacgcctggtacaggctgcggagggcgtcttccaatcccttcctccacggatttttttttttttggttgctatatctgttgaagcagggggggggctttttccaggaattcaggcactgtagggtaactcctgtttcctcggtgagaagtatgaaaattattatccattagttggattacaaatgttcatagacgtcggacgtgtttggttttcttactcccttgccgcgcttaaccctagctggtcaaggataccctcgccagctgaggcaggccgaatcggctcacctgagcaagcaaggaaaaagcttgacagcacggaaacgaggcagatggtaaagaatccaaaattccaaacagtctggattttgtctagacaggctgaggcaagcgctggcgaggaaaccaaacgtgcctgttgcccttccactaattgcaagttttcatatggagctggacaaaaaatgtctcgacctgta

SEQ ID NO: 2738 - DNA, 859 bp, Sorghum bicolor
  Clone ID: SORBI-28MAY03-CLUS46468_1
ctcctccacctccaccacctggtggacgtgcaccaggtgcgccagctccacctagagcaccaggtgtaccgccaccaccaggaagtaatccatccttaggcagaggacgtggggctgtacgccctctgggatcagcttatggggctgctgcctcacgcaagtcaacgttgaagccattgcactgggtcaaagtgacaagggcccttcaaggtagtctgtgggaagaattgcagcgcaacgatgactcgcagagtgtttcagagttcgatatatcagaacttgagagcctttttcctgcagctgttccaaagtctgacgacagctcaaaatctgaacgtagaagatcgcttggatcaaaaccagaaaaagtgcacctaattgagttgaggagggcaaacaacacagaggcccggcggacaaaagttaagatgccactctcggatttggtgagtgcagctcttgccttggatcaatccaccttggatgttgatcaagtggagaatctcataaagttctgtcctacgaaagaagaaatggaacttctcaagaattacacaggagacaaacaaaatcttgggaaatgtgaacagttcttcctagaattgatgaaagtgcctagaatggagtcgaaactgcgggtattttctttcaaaattcagtttggttcacaagtagctgatcttagaagaagtttaaatattatagactcttcttgtaatgagatccgaacttctctcaagttgaaagaaataatgaagaaaatccttctccttgggaatactctgaatcagggaactgctagaggtgctgcggttggcttccggttggacagtcttctaaaacttacagatacccgggc

SEQ ID NO: 2739 - DNA, 930 bp, Sorghum bicolor
  Clone ID: SORBI-28MAY03-CLUS48920_1
gcacgagggaggaggcggcgtacgtcgcaggccgcgcctcagcgaccgaggacgccaggcggggcctcggcctgccgctcatccgcatgctccccgtcgtcaagttcacggctgcggcctgtgatgacgccggcggcctggcgccgaggatatccgtgtcggagtgcgccgtgtgcctgagcgagttcgtggagcgggagcgcgtccgcctgctgcccaactgctcccacgccttccacatcgactgcatcgacacctggctgcagggcagcgcgcgatgccccttctgccggagcgacgtctcgctgccggcgctcccgtcggcgcggcgcgccctggcggcggcgacggctgccctccccaggcgccgcgacgacgggctcgccagcgacagcattgtgatcgaggtgcgaggggagcacgagaggtggttcagcagccacgggacgacgacgacgacgggcgctcgtccggccggtggcggcggcagagggccccggcacccaaagcagccgccacggcggagcaaggcggagagcgtcggcgacgaggccatcgacacgaggaagacgacggacgtggagttcgcggtggagcagcccttgcggcggtccctctccctggactcctcctgcggcaagcacctctacgtgtccatccaggagctcctcgccacgcaaaggcaagtgcgcgagcgcgatccgtccgtgcattcatgatccgcggatgccatgccatggccgtgcagtcagaacaccctgctggctgctacctcatagcactgtagatggctgattggctgtggtcaattctttttttattattaattcttttttcactactactaggcgctactacgtacggagtactacgtagctgtgactgcaagaaaaaaaaaacgacgcgcgcgcgcgcgtggctttttgtgcc

SEQ ID NO: 2740 - DNA, 545 bp, Sorghum bicolor
  Clone ID: SORBI-28MAY03-CLUS48939_1
atttggcaaataaaaaatattttgattgataattgcactgttcaaattcagaagggtgatttcagtatttggtctacaccttggtgctccatctggaaagaaattcacagccacctaagactacctgtaactgtaccaaacttgccacacaatatttctgaattgtggactgctaattcacatgactgggatattaatttcatctctcaggtttttgatactgctgctacaactgcaataagtaatgttatcaccgttccttcaaatgacaaagatgagatcaaatggaaacctgctcccaaaggcaattgcacttcaagagaagcttttaagcttcttaactctcaaatgcaggtacatcttccaacacagggttccaggagtgttaccactcaatccatggagattctaaggagggtgtgggctcacaaaagtttatcccctaacatgaaaacctttacttggagattgataagaagagctattgccacgggggtcagagctgggagtctttccacaaagattaacaagaattgtgaaattgc

SEQ ID NO: 2741 - DNA, 655 bp, Sorghum bicolor
  Clone ID: SORBI-28MAY03-CLUS48951_1
ccgtcaaagtccccactgttgatggaatggttgaccttaagataccctcagggactcagccaggcacaactctggtgatgtccaagaaaggtgttccgcttcttggaaagtcaaatgctcgcggagaccagctggtgcgtgtccaggttgagattccgaaacgtctgagcagtgacgagaagaagctaattgaggagcttgcaaatctgaacaaggctcaaacagccaatagcaggagatgattattgcacaaggctttgtaggacacaccgtgcttgtgcgataggcaattttgatgcaaactgcagtgatgaaaagagttggtagtggtaaacaaacacttctacgaactacatacggcaaggggtacactggagcaaaatgtgtcatgctatatctgtaacctcgtttctaagctattgaaagtcaagttagtgaactggacgttttgcaatagcttaacatatgggctaggcgactttattagccattttttattatacggcttttctattcttgaaagccttaggcaaaatcaggcttagacttcacatttcttgcagaaatgctgcaccattcatggaatctgtaagctggaaatgtaactgtagttttatggtttgtgatgcattggggggtttattggtttgctctt

SEQ ID NO: 2742 - DNA, 490 bp, Sorghum bicolor
  Clone ID: SORBI-28MAY03-CLUS46616_1
gcacgaggcacttcaccacctcccagcaatggagctagcatggttcatcagatcctcaataatctcccttgctggattcttgtcagtggtttccgcatcgacatcgcagcagcaatgcggcggcattggaggacctgctggagtgagagctggctactggtcgccgtcctcaagccgctactccccggtcagtagcatcgacgcctccttgtacactcacctctactacagctcagtgtccatcgacgaggcaagctatgctgtcgcgccacagccgaccgaagaggagggctcgctgctcgctgccttctccggtaccgtcaagtccgggagcccgtctaccaagaccatgctgtccatcggcacaaatgagtacagggtggatgcgtcgaatgccgccttctccacaatggcttcggacaaggacctccggggagtgttcatcaactcctccgtggaactggctcgagccaaccgcttcgacggcctg

SEQ ID NO: 2743 - DNA, 689 bp, Sorghum bicolor
  Clone ID: SORBI-28MAY03-CLUS46622_1
gcacgagggggagctcgattctgaggccctcatcgctctcgctgcggggttccccgcggactccctctccgaggacgagatcgtggccgccgtgctcccacgcattggcggcgctgagcaggccaactaccttgtcgtccgcaatcacattgtggcgctctggcgttctaatcccctctcccccgttgccgccaacgccgcgctcgcatccattcgagccgagcacgctccccttgttgctgcggcgcattccttcctgtctgagcacgcatacatcaatttcggtctcgcccccgccggcctctcgcttcccccacagcctcctccctcttctcctaccccatccatcctcattgctggcgccggacttgctggtctggctgccgcaagacacctgattgcgtttggattcaaggtggccgtcattgaaggccggttccgacctggtggccgtgtgtttaccaagacaatgcgttcttctgctgtagagtatcccgacactgttgctgctgctgaccttggaggcagcgttctcaccggtatcaatggtaatccccttggtgtcattgctcgacagcttggattcccgctccacaaggtgcgggataaatgcccgctgtatcttccagatggccgcccagttgaccctgacatggatgctcgtgttgaagctgcctttaaccagcttc

SEQ ID NO: 2744 - DNA, 429 bp, Sorghum bicolor
  Clone ID: SORBI-28MAY03-CLUS46619_1
gcacgagggcgccgcgccgccccagccccctcccctcccccccccccccccctcccccgcgcgccgctccactctcccgcgacccctctccgccggtcctctccggctccgggcccggcttcgccgtgaaaaagggaagctgtgctacagggggcatggggagaggacgacctgtaccaattggatcagggaggatcatgtaaaggtagcgccgggaagttcctgtcccttgtggtgaaccaaacagcaccttcaggtccaggatttgcttgcagcacgctacagtcaatcacacccaggctatggaggaggcaacagcgggagagcggaagaggctgcgcgagggcgacgcggttacttccgccgcggcggcggcggccagggaccctcagtacacatacctgtctatcgccgacgccctcaaggttc

SEQ ID NO: 2745 - DNA, 494 bp, Sorghum bicolor
  Clone ID: SORBI-28MAY03-CLUS46629_1
gcacgagggttcagtctgtatcaacgcaacgtcctggctgttcaacatcttacactggccaaactgtcacggtggctgttattctagtatcacactcagctccgacgcacacacatagagcaacattacactgcattatcctccgtatatcagcgaggagtcagagtctcgcctcatttctccctaacctgaaacatttaccagactctctccatcgtcatggacatattcgataaccacgaaaacagctctgaatcttgtatatcccttgcctcttcaatctttactcaggacctggagcggttcagcacctacggttttgattctgatgtccctgatgatgcggacggggatatagatgatgaccatcaaccttacggtcctcctacctattcatcattgatgcttgagaatgccaccgtccgctccgatgccgatttcttctccgtgaccggctggacaacagctacagtcgggtcttcgaccggttccac

SEQ ID NO: 2746 - DNA, 651 bp, Sorghum bicolor
  Clone ID: SORBI-28MAY03-CLUS46656_1
gcacgagggcacgccatcgtcgcacagctcattcgccaccgccgtacgcgccacgccgtcaccgcaccgcaggccgagccgcgcctgatggccgcgctggcccacttcgtacgcgtactggagatggcggcgccgggcatgtacgaggggaaggcggccggcgggcggtggcggctgctgcaccatccctacctctacctgcgcgccgtcgtcgagcagtggcgcaaacacacagcggcgcgccacaagcagcagaggcgacgcgacgaggacaggaaggaggaggaggccatacggcgcgagggcggcctgacgccggacgacatccggcgccgtatcgacgaggtaaggaagcggcgagcagagcggcaggcagccgaggccgagggagcgagcggcagaacgggtgacagagtggtggacgcgctgcgcgggctgccgacagcggaagaagaggaagtgctggctacgatgagcgcggaggagaagctgcgcatgcaggtgcaagcgatgttgcagcacgagaagaatcgaaagcaacaagacgagcagtcggaggaggaagtggaggagcccaagctgtcgtggcgcgagaggcggaaaggcaaagttcccgtctttttcacatctccgcgatagagatcacatgcc

SEQ ID NO: 2747 - DNA, 644 bp, Sorghum bicolor
  Clone ID: SORBI-28MAY03-CLUS46692_1
gttctttacactctcgtcattaccgacatcatcgctgggtcgtctgtctaaccgccaaaagtgcacgtggctcccccctcccctctccccgcaacccacgttctccctcccacccaacctccaccatcagcaaccatgggtgccccagacgtcctctcccgcaagtccggtgtcatcgtcggcgacgatgtcctccggctcttcgagtacgcccgcgagcacggcttcgccatccccgccatcaacgtcacctcctcctccaccgtcgtcgctgccctcgaggccgcccgcgacagcaagagctcccgtcatcctccagtcctctcagggtggtgccgcctacttcgccggcaagggcgtgagacaacaccgaccaggccgcctccatcgccggcgccatcgccgccgcgcactacgtccgcgccctcgcccccgcctacggcatccccgtcgtccttcacaccgaccactgcgccaagaagctcctcccttggctcgatggcatgctcgatgccgacgaggctcacttcaaggccaccggcgagcccctcttctcctcccacatgatcgatctctctgaggagcccgtcgagtgcaacattgagaccaccgccaagtacctcaagcgcgctgctcctatgaag

SEQ ID NO: 2748 - DNA, 456 bp, Sorghum bicolor
  Clone ID: SORBI-28MAY03-CLUS46321_1
gcacgagggaaattaatactacttcttttcccacccttcatctctctcctcgcccgccgggccacaccaccccccgagatctcccccgtctctctcctcgcgccgtgtctctctctacctcttttgatccggcaatggccacccccgcccctgccaccgccggcgagctcctacgcgtggaacccctcgagctacgcttccccttcgagttgaataagcagatctcgtgctccatgcagctgtcgaatcacaccaacgactacatcgccttcaaggtgaaaactacaagtccaaagaagtattcagtgcggcccaacactggggttgtcttgccacggtctacctgtgatgttgttgttacgatgcaagcacagcggctagctccgccagacatgcagtgcaaagataagttcctagtccaaagcatcgttgccccttctggtataactgtgaagg

SEQ ID NO: 2749 - DNA, 967 bp, Sorghum bicolor
  Clone ID: SORBI-28MAY03-CLUS46343_1
gcacgaggctgaatatgttcatgatcagagtcacctggaggctcttacatattctgcaatatatctaaagtggatatatactggtcaaataccatgctttgaggatggtggtcaccatcgacccaataaacatgctgagatatccaggcaaatttttcgtgaaattgaaaggatatactatggggaaaacacatcagctcaggatttgcttgtgatacgcaagattcatccttgtctaccttcatttaaatcagaatttactgcctctgttcctctaacacgaattcgtgatattgctcatcgtaatgacataccacatgatctcaagcaagaaatcaagcatgctcgacgaaacaagcttcaccggaatgccggccctgaggatcttattgctactgaagccatgcttgctaggattactaagactcctggagagtacagtgaagcttttgttgaacaattcaagacgttttatagtgaattaaaagatttcttcaatgctggcagcctactggagcaagtgcaatccatcgagcaatctttggatgagtctggcttagaagctctctcatcctttctgaaaaccaaaaagaatttagaccaactggaagatgcaaaagatttggatgaaaatggtggcgttcaagttttgttgaaagccttgctgtcgttatcttatctaagatcaattctaatgaagggtctggaaagtggccttagaaatgatgctccagatagtgctattgcaatgcgacaaaagtggcgtctttgtgagatcgggcttgaagattattcgtttgtattgttaagtagatacatcaatgctcttgaagctttgggtggatcagcttcacttgcagagggtcttcctacaaatacaagtctatgggatgatgcccttgatgcccttgtcattggcataaatcaagttagcttttcaggatggaaaccaaatgagtgtactgca

SEQ ID NO: 2750 - DNA, 662 bp, Sorghum bicolor
  Clone ID: SORBI-28MAY03-CLUS46348_1
gcacgaggggcttctaagaggaatttctcccgtgttgtagagggaactaatcgagggcaccagggtcagtcagaagttgaatctggattgttgtctactgcaaacattaacatgttggagcaatttctggttttttgcaaatccaagaaaatgaatgagcataatgtagctccaaaaggaatcaatggaggtcccaatgatggtgctaaggttcatggagaatcaaattcattcagggacaagcttaacatgtattttggcgagtttttgcctgcaaatgtggttgatgatttatgcaagcttgttcatgagaattcttatgggaagtgtagtttttgtctaatgcctactgagagtctagtcctaagtgttcttcaaattttattggatgctgcaaagactgccgatcagatgaaagagaagaatggtgctgctcctgttgttgagaacaatcacgcagtttgtaatgataattctgttccatctattctaagagataatcgtcgcagttcatcagtcaaggagcaatctaacaggcgcattgttgaaggaaattttgaagtcaggaaacccataggagatccaaagaatgacggcaccactgttgctcacgctcagaactctattgcatctagaggaccttcactttttgcagatgacga

SEQ ID NO: 2751 - DNA, 497 bp, Sorghum bicolor
  Clone ID: SORBI-28MAY03-CLUS46349_1
gcacgagggccaagcgaagatcaaaacaccacaaagatggtgaaggacatggaactgcagaaactccacggaaccatcaaggcacttcagaaggtggtgtcagataccggggtggtcctggagcaagagaggctccacttcaacagcaacctccaggacgcaaggaagcagatcgagatgctgaagctgaaggagatcctggacagcgacgccagcgacgtgaactacgagcggatgatgaaggacatccagctggacctcgtccagacacctagccggcgagctgccgtctcacacgggcgccacaggaagaagaactcagtggcggcggcggcggcgcagtctgacgacaagatgctcgcactgtggagcgtggacagggtgagcagcggcagccggcggtacgatgtggacctccgaccgccacaaagcgaggcagctgagaacgacaaggcaaagaagcgatcgtcctccgagccagtggtgaccgtgaagga

SEQ ID NO: 2752 - DNA, 665 bp, Sorghum bicolor
  Clone ID: SORBI-28MAY03-CLUS46749_1
gcacgaggaaccccgatttgaggcccacgagaatgaggactccttcgttctctatggcgagctccccggtatgaacaaggagcacgtcactgtcgagttccccgagcctcgcaagcttgtcgtcagcggcagggttgagcgattcacagaggagcctaaggcagttgaaacaaccccaacaaccactgaggaagctgctcccgccccagtcaccgattcagacaatgaagacacccgaagcagaagctcttaccaggccactgtggaggatgacgtcgatgacgacgagtttgaggtattgagccacacatcagagaagtcaaagaccgtcagccagccagagcccgagactatcagcgagaaggcacaggagaagcagcccgagcagcccgagcagccaaaacgctctggctatagcaaggagttctcgcgctacttcactttccctacctacatcaaccacgacgcggtcactgccgacctcaaggatggtcttttgaccatagtcatccccaaggctactcccaagtctcagcgcatcatcattaactaaagggtcggatattaatgtatggatttcacggaagggctttggttagatgtattaaaggatttctcatatgttcagatctggttgctagctaattaatctattcttaccactc

SEQ ID NO: 2753 - DNA, 597 bp, Sorghum bicolor
  Clone ID: SORBI-28MAY03-CLUS46770_1
gcacgaggcccggggacctcacttacgctcagcatatagctagacagcgacgacggggtccagggccatggctgctaaggaaagcaagctgacgacgacggccggagtggcccagcggctggccgtcgtcgccgcgtgcgtactatgcctgctgccggcgatggcccacgcgcagctccgggtgggattctacgacaccagctgccctaacgccgaggcgctcgtccgccaggccgtcgcggctgccttcgccaaggacgccggcatcgccgccggcctcatccgcctccatttccacgactgctttgtcaggggctgtgatgcctccgtcctcctcaccgtgaaccctggcggcggccagaccgagcgtgacgccgtgccaaacaacccgagcctccgcggcttcgacgtgatcgacgccgccaaggccgccgttgagcagagctgcccgggcaccgtgtcgtgcgccgacatcgtggccttcgccgcccgcgacagcatcagcctcaccgggagcgtctcgtaccaggtccccgccggccggcgcgacggccgcgtgtccaactcgtcggacaccgtcgacctgcccgcgcccag

SEQ ID NO: 2754 - DNA, 719 bp, Sorghum bicolor
  Clone ID: SORBI-28MAY03-CLUS46807_1
cgcgaccgcggcgccgggcacgtggacggcgagggccgcgtgcgctacgccccgagccgggaagacgtggaggagctccgcaacgggctgcgccaggcgctgcgcatcctggtggccgccggagcggccgaggtcggcacccaccgcagcgacgggctccggctgcggtgcgacggcggcctccgcgacgaggacctcgaggcgttcctcgacgaggtgaccgtcggggagggccccatgctcccggggcccgacaagtgggcgctccattgctcggcgcaccagatgggcagctgccggatggggtccagcccgaaggacggcgccgtggacggccgcggcgagagctgggaggcggaggggctgtacgtgtgcgacggcagcctgctgcccacggcggtgggcgtcaaccccatgatcaccattcagtccaccgccttctgcctctccaagggcatcgccgagtccctggcgcggggcaagggacagtaggcccctgctcctggcgccccgcgccgggtcgtgctccctgtgtgctgcttgtgtgcggtctctcgttaatcgagtgtggcgatagcgtctatatactagtacattgtgcaaatggttcgtgaatcacaatacagcctgtttcctggtgaagattgtctattattatgcgtacgattgtccaatgtaacgtgtatcacctaattcgaaaaaaacggtgtatcactttt

SEQ ID NO: 2755 - DNA, 799 bp, Sorghum bicolor
  Clone ID: SORBI-28MAY03-CLUS46832_1
gcacgaggattcagttcgccgccagcactgataccgatgcagtcaaccattcagcggtacccaagtggtgacaacattcagcggtacccaagcggtgacaacattccacagcacccaagcagtgacagcattcagcggtacccaagcggtgacaacattccacagcacccaagcagtgacagcattcagtggtacccaagcggtgacaacattccacggcactcaagtagtgacaacattcagcggtacccaagtatggacaacattgtgtctcccctcaggtagcgttaacagctcaatgtcaaggtcaagagcgtcgtcatggagcggaacattaccagagcagttgagcagcactgctgctaccaggtcacctgatggacagatcatgcagtcaccatcgatgcctggaaaaaggcctccgcacagccgttccagcagcacttcttctgcccagttcaatggtttgggtgaagaacttcacgaggtggagctctgacacttggccgcagatttcacctttttgaccatcatgtgatttattactagctggatgtgtgtctagaaagcaaaggaaaggaaattgaaggagaaaaaaaagagtggtatcccttttcaatttttacatgagaagcctgtggatgctgctgcattgtacagatagttcacaagttcgccagatgaaaaatgtataagaagagacgtaggttcaagataggaagttgtagaaaggctgacaatacctcttttgttttgtgcttaacactttaagattaaaaccatgatgattcatcattgt

SEQ ID NO: 2756 - DNA, 650 bp, Sorghum bicolor
  Clone ID: SORBI-28MAY03-CLUS46867_1
gtgcatccgatgaatccatcacgagagagatcgaatccgatctccagggctggcttgacgatatcaccgacggtgctgtggaatacatgcccgaggatgaggtgaagagtgcggccgcggagcggctgaagatctccatggagaggatcgccctgctcaaggcggccaagccaaaggtcccacccgcgaagaccgagcaagaggaggaagaggagcggaagcagagcgaggaactagatgggtttggaaaccccaagggcccctcgacgctctccaagctcaccgccgaggaagcggagcaccgcgctctccaggctgccgtgctgcaggagtggcaccagctgtgcaaggagaaagccatgaaagcgcagtgaggtcgatttggaccgtgtggatcttacacccctgtataattttgtattttttttccgccttccattttttttttttttgcgtacctatgctgctgatttcactcgctgtataccgtcgccgatttgttcattgtattcgcagatatttgttgtgtcccgaacaaaagtgttttgtaacatagtagcacttttcaagttttggtgcgaagatcaattgtacggagtacaagagaatccagatagccattgttgtcctcccgattttctaatgaaaga

SEQ ID NO: 2757 - DNA, 646 bp, Sorghum bicolor
  Clone ID: SORBI-28MAY03-CLUS46849_1
atatcaattatgctctctttaaacccaacaagggaatagttgacccgaatactagcttgcactatgacaacatgtgtgatgctcagatagatgcagcttatgctgctctacatgctgctggttatgatgacatggaggttcgggtggcagagactggctgggcttctagtggggatcaaaatgaagcaggagcttcatctgagaatgcaaggacatataatttcaatcttcgtaaacggctatttctgaggacgggaactcctctgaagccaaagagcccagtcaaagcatatatatttcccttgtttaatgagaatcagaaacctggagctggctctgagaggcattatgggctgttccttcctgatggaaggatttcatatgacattggtgtctcaggtttactacctttttttgcatcctcatccatgctgttcattaagaaggttcgagctgggggttggattttacactattgggctacagttcttttaggtattttctttctttgggggccatagtgacttgaggacggcataacccatccgtagtaaaggtacaactgagcaagttagaatgttgggaacgggaagctcccaatgaaaatccaaataatagtatcatgcatatgagttccgtttctcgc

SEQ ID NO: 2758 - DNA, 830 bp, Sorghum bicolor
  unsure (1)..(830): unsure at all n locations
  Clone ID: SORBI-28MAY03-CLUS46545_1
gcacgaggcccaccttcctcccccgccccgccaccgccaccgccagccggccggccgtgatccctcctccctcccccgacgccgctgcccgccccgcccgccgccgcattctccggtccagatccagggccctcgtagagtctcctccgctcgacctgcccttcccccctcggatcagattggttgccgcacatcctcatgggtgaagaggctgtccacttcagcgtcgtcgacgccaaggactgcaaacagagtgccgttgacgtcggcgataagacgtatgttatctgtagatcagatgatgactcgaaaacatccgttgttaaaattcacgacaagctcactcatacttgggttgtacccacaatacttgggaaacagccacttctaaccaagtcgcagtctgcgattcctgtcggtgatgagaagatattggttatcgagaagggtgttcccttgaatgagtccatctggttccttgagatagacaccccctttgttaagcagcaacggaaaatcaagggaacagaagttgtttcttggagcaagggagtaatcggcgtcggccaaaaaccagttgtgattagtggtccttctggtgttggtaaagggacattgattgcaaagttgatgaaagactatccatcgaagtttggattttctgttagccacactacaagatctccaagggagaaggaaatagatggtgttcactaccacttcacagaacgcagcangatcgagaaagatataagcgagggaaaatttcttgagtttgctcatgttcatggaaatgtatatggcacaagtattgaagcagttgaatctgt

SEQ ID NO: 2759 - DNA, 545 bp, Sorghum bicolor
  Clone ID: SORBI-28MAY03-CLUS46556_1
gcacgagggtttcttctgcgccgagactgaaaacggcatcagtagcagacggagcgacggggccagcgacgcttgacaccggcacggcatgggcgccgacgacgacgccgccgccgcctccggcggcgtggcggcgcgagagagggaggcggagatcgagaaggccatgcgcgcccgcgtcgcggcacttcaagaagcaggccgactccttgacccttgaaggcgttaggagagcactggaaaaagacctgggtttggatatttattcacttgatgcacataaaaagttcataaagcaatgtgtagacaagatttttgctgaatctgatgatgaaaatgcaaatgataatgcatcagacgatcctgaagctaaaaatgatcatttatccaaagaagggacagatattgctaaaccaatgcctgtttcaaacaaaacatcctccaatgctgatgttgtaacatccagcaagacaggaaaggatcttgaaggagaaaaggatcaaacttctagcggtgatattagtgaagacatgataaaagaagcc

SEQ ID NO: 2760 - DNA, 635 bp, Sorghum bicolor
  Clone ID: SORBI-28MAY03-CLUS46469_1
gcacgaggagccaatgtgctgaatctgatggtgcttgcaatcaattgcctgaaacgggctccgagagcagcaatgttgagtgcgctgatgaagtgcctcaaatcagatccaagagcagtgctcgtggagataatgggtgcgctgatgaaatgccaggaaccctctccaagagctgtagcaatgatagcagtgagtgtgctgatcggagctctccgcgagctgtgctagatatctcagtatctggtagcatggactcggatgacagtgtttcagtcgagcagtcagcagagtcaaaccataatgtgcagtggaggaacctgatcagcagtctaatacttaggagaaagaagtccatgggcagagcagtgacgttccctcagagatccaagagcagagggattagagggtacctggagagaatgaggagtggtaagaaccaaatggactgcagtgccattgctcctgagatcctccctgagattgggaaatggaggccatcatggcgtagctttgactacaacgagctttgtgctgctactgacagttttagttcagagaaaatgattgggaagggagggcatgccgaggtatacaaagggcagcttgctgatggacaatttgtggcagtgaagaga

SEQ ID NO: 2761 - DNA, 528 bp, Sorghum bicolor
  Clone ID: SORBI-28MAY03-CLUS46570_1
gcacgagggagaaaatcacggaccaattctcttgcgcagcttttgtgtccgtgtcgcaaaagcccaatatgattagccttctgtgggagttgctatctcaaattgggagccacggtggagatttaggattgatggcaataggatcttgcagcgaaaaacaactaatcgacagactaagatcagatcttgaaaatcagaggtatctcgttgtgatagatgatgtttggacaaagtcaccatgggaaatcatacaatgtgctcttcctaataatggtcatacaagtaaagtaattatgacaacacgcatcaacagtgtaggtcagttctccagcacttcagatgagggtttcatctatcaaatgagacctcttagcagaaatgattctgaaaatttatttttgaaaaggacattatgtgctgaagataagtttcctgttcagctgacggggattaaaaatgacataattgaaaaatgtgatggtttgccgctggctattgttactctagctagcatgttagctactaaac

SEQ ID NO: 2762 - DNA, 961 bp, Sorghum bicolor
  Clone ID: SORBI-28MAY03-CLUS46605_1
tatattagcttttgtaactgctcatctatccaaattaacatgctcctctccgatgtccaaagaatatccaaggataggtaggccaatcaaataggcgactaggaagtgggcagcttcatgcctagctattctctcctgatagtcaggaaagaccgtagaaaatgctccaattgctgcttgcagaagacctggagcaacgcttccgacagccaatacgatcaatgaaatgcttccaatcaagtagggaacaaagaagccccaatccccagggagctggcctgcaaggacggctaagaatccagtggtacccacaactgtaaacaaaaatgccgcatcatttctaacacttggaattgctagattctcagcattcttgattccaagggtagtgagctcccgcagagatgtcgtgcggcgcgacacgtagggctgcgagctccaccgcttggcccatccgagctctctgagctggtccgcccccgccgtgccgccaccgccgctctccttgtcgatggcggcctgcagacctttaaggtccaccccggaggccgccgaagacgaggctgccgcggcgcgccaccggcggcgcggcccgacggagctcgcggtgggcgcgacgagcacggccacgatcgccattggctccccctgcgcgcgcgcctctgcggccgaccgccaacgcttcgggcggctcagctcaggaggatactgttagagcttggcccggcatttgtgaagatcgcgcaagcagtttcgtcgcggccggatgttgttccacctgcataccttgatcagctctcactacttcaggaccgcatagcaccattttcaaacgatgttgcttttaacattatagagaaagagcttgggctgccactggatatgattttctctgagataacaccagagcctgttgctgctgcatctcttggacaggtttaccaggctaggctccgctcca

SEQ ID NO: 2763 - DNA, 579 bp, Sorghum bicolor
  Clone ID: SORBI-28MAY03-CLUS46937_1
actctacaaatactgatgattctgatgatattgacatggcaactagtgattcctcagaatcagatgctctatggcagctcaatgtccaaagcatgaataactcaattagtgacagcggctcaaaggttaagaagccacaaataaagcttagagatggttcagatgccaggacaccaattcattctcaaataccatcagcgtcgagaaaagtcgcaagcggttcaaacagatctgttaggcagcctttaagcagaagcgatagcagaaggctttcatcaaatggaagacaaaccggtgcaaagtagggacttacaatgatcgcgtgcagtttttgcctttttttttctacggtgtttgtcacgagagattgtgaggttgttctcgagtacagcaatgagtgacaataaacccaattgattgtgtcagtgtggtgagttgtgatctcaacaactggtgtgtgaggccattaacctttttttttgttggcctatcaagctatgttgagttcttgctaattctttgtatcttgttcataatataaatatataatgaaaagaaaggaaatgattgataatacct

SEQ ID NO: 2764 - DNA, 621 bp, Sorghum bicolor
  Clone ID: SORBI-28MAY03-CLUS46963_1
gacactgcctgtcacaccctagagggagggacaacatgactgtcgtactggttcggttcaagacgccaggcgcttgccaagttaggctgccacggccgatcaaccaagctgctgccgcccgagctgctgcggaacaggaacgagctgctgcggaacaggaacgagctgctgcggaacaagaccaagctgctgaggaacaagaacgagctgcttcggaacaggctgctgccactcgagctgctagtacttccgcaccatccagccccagcttccgcagacccaagtccgaggagagccccaagagctccaagagctcagagctttgagttcgttttctcatgatgaaaacatgaacctgcttaccctggttctttcatgtggtgcatcttatcccccacagagtttggattcgttttgtcaggacaagatgaacttgattttgttttgcgtagtatgatttcctatgagaatagcttgtcggtctaggcactgacgatggaatttttgcctgtgagccatatatgtttaggttatcacagcaatattctagttttctacggcctggaggatgcttaatgtcctagtattgttttttgaatggatattgcgatcagaatttct

SEQ ID NO: 2765 - DNA, 730 bp, Sorghum bicolor
  unsure (1)..(730): unsure at all n locations
  Clone ID: SORBI-28MAY03-CLUS46976_1
cgttctcagagaagggcaaagtattcattactatctgttgttacaaagcncaggatctcatctttggacactggttctataaaagggacttcctcaacaaaagaggcagtgttagcgctgaattcacgaccactagaattggctcaatgccctcctgcctctttagcagaagaggcagggaatggtgcactgttcgtgcttgccaatgttgttggttcacggcctaaggttgtcgaggactccatgtcgaatgtactccttaatcaacctgttacagatttttctcgcaaagaggttgatcctgcacaatctatctctgagatagtcagagaacaggaggccattgaggtatcacctgccattccagtgcataataggaaggaaataaacagtgaggcgatatgggaacagatgcagaaagttcagagtgaatgtggggcactctgggcggcacccgccgcggggcgcttggggcgcgcagcggtcctggtcagggtgagtcgtcgcctgaacgattggctcagttggctcgtgcgccgggcgacagccctcgttgcccccacgcggcgcgcgagcttcgtcgccgcgcagggggcctgcacatcgtcaatcgtggaagcgccgtccaccttcctcacacgactatgctctcagatccttaggctgtaccaaatcaacaccttgctctgagatacttgctaattaatttcccgtctacccaccagttttc

SEQ ID NO: 2766 - DNA, 613 bp, Sorghum bicolor
  Clone ID: SORBI-28MAY03-CLUS4704_1
gtcgacccagcgttcttccagcgtccggctgattggtgctctgaggggatggattactgcatatgttcagtttcctagtgaaaatcattaagtaattgtatgctgaagtagtgttctacaagcacccatagtgctctgctctgcaatatttgtttgggagcaacaaaaggctcaacagctttcgactggcatgaaactttgcttcatgccatacataaaaactttgcttcatgcacctagacagacaagactcaaacaaatagttttaagccataggaatgacttgcttcatgtaccaacttctatcttcaattcttcatgtacaatggcaacttgcacgtgaaggtgtatctttgtgctttttaaatgcctgttgaagtaagtagaagtttcctctctagttactttccaaatagttactaattaattattgttttgatatatgctagctgatttattggaccatatatggttttgcaggattcaagaacagcctatatatactcaaatgtagttacaacttatgtactgtaagaaatcttcaatgttgctgctcagcatgtattagtagcaatcttctaagcttgtagctccttgagcacagatgatttgt

SEQ ID NO: 2767 - DNA, 649 bp, Sorghum bicolor
  Clone ID: SORBI-28MAY03-CLUS47039_1
gcacgaggcagggagaagcctcagcctccacgtccacaacaccaggagcaggagcacgtccggcaggcaacaacaatggcggcgctagaggcggccaccaccagcaccgtcccgcgcgcgctcctcgccgcgtgcctcgtcctgctggtcctcggcggcggcccgtcgtcgtcggtgcaggcgcagggcggcggcgggctgtgcctgccgcagctgaacggcctcctggcgtgccgcgcgtacctggtgcccggcgcgccggacccaagcgccgactgctgcagcgcgctgagcgccgtgtcgcacgagtgcgcctgcagcaccatgggcatcatcaacagcctccccggccgctgcaacctcgcccaagtcaactgctccgcttgaaagcaggagcgagctgccacggatgctgctgcaatgcgtgcagggaagaggaataagaagggttttccatttcacagttgagagtagcagccgagctccactgctccagcttttgtcttgaccaccgccggcatcgcccaacgttgttgtcgttgttttctttcgatattcagagactgtcttccgggtctatatcatcaccataaataaaataagtaaaaccaaaccatgcatgaccatcatgcaacctcttctatcgtaa

SEQ ID NO: 2768 - DNA, 731 bp, Sorghum bicolor
  Clone ID: SORBI-28MAY03-CLUS47059_1
cagtgcaaagatcagatgggagattttccgagggaagagtggtgtggtggtcctatggatcgaaggggaaggtctcttcacgttcagccttggcgatcggtcaatgaggaagattgacaacgagcatgtcacaaagaagtaccggttctgcccatatgagatcgattggctatcctgccttgcagtcacaaacctcgtcagcgatggcttgctgtcgcttgacacagaaagggaaaaagctcaatgcagatggacgtctttggtggcagacaatattccgaaaagcagatgaccatataatgtcaaggtatgagttacatatggtctgtcagtggcatgtcaatgatggcttctgaattacatttctagttccaagacaagagtctcctgattggaggacaagatggggttaaaccatatgatttgtgaaaaagagatcactgcaatggttgatgtatttgcgggtattggtgggtgtggtcactttgttctagtattgggcttagttttgtgctattccttttagttttatacctttatgccagctcgaagctttgtaaaataaaaggcagttaaagttgatagctggaggttgggttggtttgttctgctcatgcactaagacctagtgctttgtgactaccagtttggaactgaattaaaacagggtggtgacttctgtaattttgtttcaattaagtaatgatgaaatccgttttacctgtccaggc

SEQ ID NO: 2769 - DNA, 931 bp, Sorghum bicolor
  unsure (1)..(931): unsure at all n locations
  Clone ID: SORBI-28MAY03-CLUS4671_1
gcgtcctgctaatggaacanaaaagaagttcaactctggcaagaaaagaaccgggaactctgtggagttgttgggtctcttcaggttgcgattgaaggtgctaaagtggtgaaaggagaactggagaagaaaacacaagactgattgaacagtgttctagcaaggatgacgaaattttacttgttgaggcagacaatgaggcattgcaatcagaggttgagcagcgtgagagggaatttgttgttctgatggatgatgcaattacctcttctgtgaattctgcggtttatgaagaaaaagcattcgagcttatgatgaatggtaaagctacagagaatagagcaatatccctaaaggagttgctaatgaaggagatctcttcccgagatgctcatgttgaggagttgcagaaaaagttggctggcattcaggaagaacatgcagaactaaaagctgagttgaacacacatctagctctcatagcatcattgtctgatcatgtcagtgtgctggaagaagatacccgttctctgtcaaaaccatgtagtacagaaggcaaagaggaaactgcatgggtacatcatgtgcaagagggcaacgacgggctggaatctcattgcttacccaaaggaactccaaagttgcaagggttgattgcaagaatagaagcacttcaagtggttgtattaaatgctaaagatcgtcaagatcaggagtcagccaagtctgcagctaaattggcagcagcaagtacagaaattcaagagcttaaagcaagaggcagctcacgcatggaggcaaaagaaatatattctgaccttgagaaacaagatgttgaggtctccaaagggaagcaagtccagatcatgaaggatattgagctggacaaaatatctacttgtccaccatatggtgctggagctgccctcta

SEQ ID NO: 2770 - DNA, 459 bp, Sorghum bicolor
  Clone ID: SORBI-28MAY03-CLUS46721_1
gcacgagggtgcagctaaacccccccctcttcctcgcaccaacccccgacgcaaagccgccggctttcccccccgatggcgacggcgatgtcggtttcggcggtgacaccggccgccgcggcggtcgcgcggccgcggacgatggtctgcgtgccggcgacggcgcgggcgccgcgggagatggcggaggagctggccgccgccgcggcgctcggcgccgacgtggcggagctccgcctcgactgcctcgccgggttcgcgccgcgcagggacctgcccgtcatcctcgccaagccccgcccgctccccgccctcgtcacctacaggcccaagtgggaagggggcgaatacgaaggcgatgacgaatcacgcttcgaggctctgctattggcaatggagctgggagctgaatatgtggatgttgagtttaaggtggctgacaaatttatgaaacttatt

SEQ ID NO: 2771 - DNA, 537 bp, Sorghum bicolor
  Clone ID: SORBI-28MAY03-CLUS46724_1
gcacgaggccacagaaaaaatgtaccttttgtgaaggtaccatataagctttgccaatcatttcagagtggcacgaggccgacttccccagttgagattgtgtatcactgtcctgaagaagagattgcatttggacctagttgttggctatgggattatttgaggaggagtcaagcatcaggatttttgcttcccctttctggtggtgcggatagttcatctgttgcagcaatagtcgggtgcatgtgccaacttgttataaaagatatagagaaaggagatgagcaagttaaggcggatgctcttcggattgggcattataaagatggggagatccccacagatagcagggaattggctaaacgtttgttttacaccgtttacatgggaactgaaaatagttctgaagataccagatcgcgtgccaaaaggctagctgaggagattggttcattccacctgaatgtacccattgatagtatagtatctgcttttctttccttgtttgagacattgactgggaagcgacacgctaca

SEQ ID NO: 2772 - DNA, 502 bp, Sorghum bicolor
  Clone ID: SORBI-28MAY03-CLUS46761_1
gcacgaggcttattcatcactttcgttatactttaattttcttcaatatgaagcttttccgatctattggcgccgtcgcggcggctttgatgctgcttcctggtcacgctttggctgggcagtacaagggcttcagtatgggtgccaacagggctgatggcgcttgcaagtacactgcggattggaagaaggatttccagacgatcaagagctggaacaagggtttcaacgctgtgcgcctttactccgccgatgactgcaacacactggtcaaggctgtccccgccgccaagcagaccggcatgaagatccttgtcggcgtctgggccaccgacgacgctcacttccggcgcgacaaggccgctcttctcaaagtaatcaagcagtacggcactgactggatcgccgccatctccgtcggttccgaggacctgtaccgcaaggacatctcccccgacaagctcgcccagcagatctacgacgtgcgcggcatggtgcgcca

SEQ ID NO: 2773 - DNA, 518 bp, Sorghum bicolor
  Clone ID: SORBI-28MAY03-CLUS47170_1
gcacgagggtgaccatcgccatggccgtgtagaggagctagcactgaagccggaagagatttttcagatacagatacagggagagaagggaagtgggcagggcgggatgaggtcaagaagaactgcgacgccggcggccggcatcctcctcctcgtcgcgcttgtggcggtggcggaagccgacaccgacgccgccgatgttgcggccttggggaatctctacagctcctggaacagcccggcgcagctcaccgggtggtccgccagcggcggcgacccttgcggcgccgcgtggacgggtgtctcctgctctggctccgccgtcacctcaatcaaactttctggtatggagctgaatggtactcttggttatcaattgtcaagtctacaggctctgaaaacaatggacttaagtaacaactacttgcatgatgcaattccttaccagttgccatcagaccttacctatctgaatctggcgaaaaataacttctcggggaatcttccgtactctatat

SEQ ID NO: 2774 - DNA, 667 bp, Sorghum bicolor
  Clone ID: SORBI-28MAY03-CLUS47164_1
gcacgaggcacatccaaccatcaccaaaaggacgcccctttttttcctagtcacttgacttgcagccaccccaccacgctttcgcatctccatcttcttcctcctccgctgcgcccgccgcgccgatccaacccaacccggaggccggagtccccagactccctccaatcgcagctgctgctgctgtaggcctgtagcagagcttggccgttggttcaagtcaacacccggggtattgcctcgatttgcggcgaaagcacgccgtttttttggtggtttctggcgccgagcggttcttgattccgacgctgaggaggaggaggaggttttctttcgattggaggggagaaagttgccgcctttcttgcattccactctgttttccttctccctgcacgaactcgagctcgagctcgaactcgggcttctccaacgcgtagtccagtctgctttttcttgtacaggtggcattttggtggttgcctgtttcaagaactgcagtatctcgattactgctttacctctttacagatggatggatgcgattgtattgagccactttggcaggccgatgatctgctaatgaagtaccagtacatatctgacttcttcatcgcacttgcatacttctcaatccctttggagctgatatactttgttcagaagt

SEQ ID NO: 2775 - DNA, 558 bp, Sorghum bicolor
  Clone ID: SORBI-28MAY03-CLUS47179_1
gcacgagggagagaactagtctcgagttttttggttgacgaacaccatatggcaaagttgagcgactatggactatccataatcacagaggagatatacaaacatgaggtaataggacaaaagaaaaaatacttccaaaatgatcctacagaaatgtaagtacctgctaaacaaattgtatctttgtttaatttgagatgcatagtccaagggcagtttgatttcacatgcatgtgaatgagcctctagctgagttggtcaggtggttctagtagcactcaggctcctcgtttgtgtcatgccaaagcacaggtctaaggctcggcccaggttggtcgagttttagaggagttcagcacaccaagtgcattgaaataggaaaaaaaaggaaatcttgttcttaaattcaagtgtcataattagttatgaccatataacatatgtgttatttatagggaaaatttggaggatgatgtatgctctttcggttttattctactggaagtacttatgggcccaaaattacatgagagaggtgaccctttcattttgaaagat

SEQ ID NO: 2776 - DNA, 674 bp, Sorghum bicolor
  Clone ID: SORBI-28MAY03-CLUS47232_1
accccctcgctcgcgcacacggcacaccaccagtccagttcccagtacactgctctacgcctcactcagtacagcagcggccagcggctgcctaatctctccagccctttcgccccctccctcgccacgccgcccaccgctgccgcgtcatcatccgcccgttgcccggccgtcgtcgcctggcccgcggcttccgttccgcccccattcgccgccgcactgcaccgcagcgcgccgagccccgtcccagatcgccgcggcgcttcctgctggcgtcggcgcggcgcagggttggaaatctatttgaccactcagtgagtggcctcatgttaaatccatctctggtttgaagatgcttcaccaatgacatctggaaactgtaatagtatgtgctgatcttctatgcttcaccacctgattatcaatgggctctttcctgaggaaacagcccagctacctctttgttttgatagttctgcaccttgttgctcatgaggcaagaacgctgagttcagatggcgaagcacttcttgccttcaagaaggcagttacaaattcagatgggatctttctaaattggcgtgagcaagatgcagacccctgcaattggaagggtgttagatgtgatagtcatagcaagagagtgattaatctgattcttgcataccacagat

SEQ ID NO: 2777 - DNA, 538 bp, Sorghum bicolor
  Clone ID: SORBI-28MAY03-CLUS47182_1
gcacgaggaaaagatattcacactgaagcagaagtgactggaaggaaggatcagcgttcacgatcatttggaaaggtatctggtggtgttaatcctaaaccaaaagcgtcatccaattcccgagctaatgttaaaggctcatctggtagggatgagattacctctacagaaactgagttccgtgatgttagtttgcagcggaatcgtctagtgcggaaggcagaggatgtagggagaaaggttacagctggttctgattcagattgttctggtcgtcagggaacaaatttgagcaggcaatcatccattaccgatcaggaactaaacttgcaggctagagtgatgagaccaggaaaagggaaccaagatcggcatggtgaattgcaaatgaaggcaaatgagttggagaaattatttgctgaacacaagttaacatcctcccgacgaggcaaacctacagatgtgcaggctgatagcacacctacggtgagtgaggtaaagcagacaatggttcttcatgagacaattcatacaaaac

SEQ ID NO: 2778 - DNA, 552 bp, Sorghum bicolor
  Clone ID: SORBI-28MAY03-CLUS47244_1
gcacgaggctctcttttccccatctgcaggctgcaggcgctgctgctctcgtcctccgcccgcgaccgaatcgctggctcgacgccgcggcgggaggttggtatctcgcctttcgatcaggttcacggccaaattcgttgctgcgtgaggctttggagtctggagccaatcttgcgccttagagggcggtggcagcgcctggtgggcaccatgagcttcgtcttccgagggagcagggccgacatcgaggccggtggcttcccggggttcgcccccgagcgccgcgccatgcgaattcatgcagggagcaggccggtgaatagcaattccttggcttttcttctaactgttcttgttttgttcatgggactgaactcacaccagatgtctcccaatcttttgctttggcttgtcttgggagtcttcctaatggccacaagccttagaatgtatgccacgtgccagcagcttgctcatgctgcagctgccaacaattttcttggacacactgagctgcgtgtgcatgtaccgccgaccattgcccttgctacg

SEQ ID NO: 2779 - DNA, 842 bp, Sorghum bicolor
  Clone ID: SORBI-28MAY03-CLUS46869_1
gcacgaggctccctcaccggcacgttcctgccgggccccgcgccgccgggatccacggggctcaccgtgtacctcgcgggcgggcaggggcaggtcgtcggcggcagcgtcgtcggcacgctcacggcggcggggcccgtcatggtgatggcgtccacgttcgccaacgccacctacgagaggctcccgctggacgacgccgaggaggagcccgccgggcaggcgccgccgccgcagctgcctcctggcccgggcggagggccgcctctgataatgggcgggatggccgatccctcggcggcgatgccaatgttcggcggtagcgtcggcggcgtgccgccaagcctcatgccagggggcggcgccgcctccggtgcgggcctgcagctcgggcacgaggggcttgcatgggctcatgcacggccaccgccgtactaggagggggatctccatgccatgaccgaggaatggaagtagaaatggaggatcgttcatcgctgcaccgacagctcaaggacgacgacgacgactgcgactcatcatcatatagttacttctagctagaactgaagatcgaattaagcatgcttccaggagctaataaaaggctcttcgattgatcaattctagctaatacagtaatctgcgaagaaggtaaactacactagtactatatatattatactgctactgcaaactgcatgcatgtgactgtgtggatgtgccaaatgtcagcgcaagatacgatcgagcttcttgctgcttgcatatattgtttcctcattgtgatgtttgatttaattagaagatgcagcatgataaatagatggtggatgcttatt

SEQ ID NO: 2780 - DNA, 938 bp, Sorghum bicolor
  Clone ID: SORBI-28MAY03-CLUS469_1
ctgttggcctctggctcctagctctctcttgtctgcgcaccactcgagtcgagagacgaaaccacctgatccttccttccccgtcttcctcctcccacacgtccccatcgccattgctgcgccgagagtgagcgggagagggtaggtgtcgaggcggcggagatggggcgcggaccggtgcagctgcgccggatcgagaacaagatcaaccgccaggtgaccttctccaagcgccggaacgggctgctgaagaaggcccacgagatctccgttctctgcgatgcggaggtcgcgctcatcgtcttctccactaaggggaagctctacgagtactctagcccacgcggcagggaaggcattcttgagcgttaccagcgttactcatttgaagaaagagcagtacttgacccaactattgaagaccaggcaaattggggagatgaatatgtccggttaaaatccaaacttgatgcacttcagaagagtcaaaggcaactgttaggagaacaattggattcactaaccataaaagaactccagcaactggagcaacaattggacagttctttgaagcatattaggtcaagaaagaatcagctcatgttcgattcaatttccgagcttcagaaaaaggagaaagcacttacagaccaaaatggtgtcctgcaaaagctcatggaggcagagaaggagaaaaacaatgctttaatgaacgcacaccttcgggagcagccaaatggagcatcaacaagctccccatcactgtcaccaccagtagttccagattccatgccaactctaaatattgggccatgtcaacctagaggagcaggaaaatctgagcctggtccgtctcctgctcctgcacaagcaaacagcggcaacctgccaccatggatgctccgcactgtcagtaacaggtgagctcttcccaatgc

SEQ ID NO: 2781 - DNA, 433 bp, Sorghum bicolor
  Clone ID: SORBI-28MAY03-CLUS46874_1
catagctcgaaactgtaatatagcccggatctaagatgatagggagcaagaatcatgtttatctgatcttgattgggcgacaggggatgcccggatgagtgagctcggctaactgtttgttgcctcatggctatcctgcatttgatctgtccattgcaactggttgctgctacatccaaatcaggttcttaataacataaataccactgggaatccctcgcacgacggggatccttggcctagttcagatatagtcagttcggatttgaactagagagcatcccttgcaagttcgatcactggccaactccactctgtatagttcatggcctctgcctctgtatttctctgagtcgcgaatgcttgtatttgtcattcttaccctaatgttcgcactatatcatcattaatcgtattgtggactttgcagtgc

SEQ ID NO: 2782 - DNA, 627 bp, Sorghum bicolor
  Clone ID: SORBI-28MAY03-CLUS46918_1
cgtccagtacttgacactgttgctatggtcagttatgagctggatgatgctgaatatggggaaaatgaagtgaatgacccatgggtgcagaagcttatacttgcagttaacacaaatgttgcttggctccagccagtgatgacatcgaacaactatgattcctttgtgcacttgatcattgacttcattgtcaagaggctcgaggtgattatgatgcagaagaggtttagccagctcggtgggctccagctcgacaaggaggtccgttctctgatcaaccatttctcagaaatgtcccagagaccagtcagagacaagttctctaggctttcgcagatgtcgaccattctgaactttgagcgggtatcagagattttggatttctggggtgacaatgctggccatctcacatggttgttgacacctgcagaggtgcggagagtgttaggacttaggattgacttcaggcctgaagctattgctgctttgaggctctgaatcttgcatttatatgtacttgttaattctttatatgtgatataccaacgagatgccttacaaatttttgttgcaatgacaaacacctgcattgtaaaagaaatctgcgaaccataccttttgtctgtt

SEQ ID NO: 2783 - DNA, 650 bp, Sorghum bicolor
  Clone ID: SORBI-28MAY03-CLUS46935_1
tattcaaatataaagttcaggcgcagcaggggaatgcccctgcccagaaaagtgatgggccatctcagctatcggtttcctcaactggatctggcaatgagaagaagcaggatggtttaaaatcagatggaaccagcaaaactccagaggatgaactaacatgtagtgtttgcttagagcaagtcgccgtgggtgatctgttgagaagcctaccatgcttgcatcagtttcacgtaaactgcatcgacccatggctgcgccaacagggtacatgcccaatctgcaagcaccaggtgagtgatgggtggcatgccacaggcaacggtgaagaggatgcctcttacatggtgtaagtagctgcctaggagtaggccataggtaactagtagtagctgctaacagaatccgtggaacgctgttttggaggtgacggttttggagtgatttcatgcaatctagggatgtggtctaagcctgtctatcctaacaaaaccaagtgtggaaccagctgtctagtgcgctgagttcttgtacaactaatgtttctctcattctatgtgatgctgatgcataaaaaggttgatgataatctttgtaacatcatggcccagggcttaataggattaacaaagttataacttttttttttg

SEQ ID NO: 2784 - DNA, 939 bp, Sorghum bicolor
  unsure (1)..(939): unsure at all n locations
  Clone ID: SORBI-28MAY03-CLUS47365_1
gcacgaggttaaattaagacagcagagtggtgcagttcgatttcccaataaaatgtccggttccaagagaagcctcccgtcttggatgggttcttctaaagatggagaggacgattcatgcaagaagaaacatgcaggcacctcccagaaggctcagaaagggcctgatttctccaaacttttggtacctatctattggccacagctacaatcagatatatgtatgtatactgtcctgtattggtgatttcatacatctgtgtaggatggggtggtgtttgtgctgtcagggttcgtgaacccggagaggagcacgcttcgttcacaagcattggacatgggggctgagtatcgagccgattggacatcggactgcacccttcttgtttgtgcatttgtcaacgcccccgggtttcgacaagttcaggcggataatggaaccattatctcaaaggactggatctttgagtcctacaagcaaaaaaagcttgtggacattgaacctttccttatgcatgctggaaagccatggcggaaaaataaggagcctgtcgaaactgatcaaggtgatagatactttcaccagaaatatcttttatgggcacacaatcttgtttttgggtgctgttatgcatgtccataagttatatctgatatacactcagtatgcacacacttttgtcgttacaattcatgatcttgtcagcttaccaataacatagcacttattatgtggtcaaaaagctcttcattattccctttatgtattttcatcatatagttctttctgtgcttattttctctttctgtgaaccttgtactagaggtataactgtatcatgttgttgcactaataatatgatgcccaacaaattaagcttaatagcttactctctcaataagtattccaaatgttanaacaatccttcatttcttctg

SEQ ID NO: 2785 - DNA, 701 bp, Sorghum bicolor
  Clone ID: SORBI-28MAY03-CLUS47372_1
gcacgagggcgaagctggagtcagacttcccactctccttcctcaaatggacgcagcagggctttaagcccccaaagcctcgacgccgagcacagctccgccgccaccgccccccttctcatccgcggtcttctccgcctgctgcttctctatcgatctagcgaggccggatccaccaccatctagacgacggctggttccttctcgcgttgggttcgtcttcgccagcgcgcaagatcggtacctgtgaacatatgagctgttcccggtgctaattcaggcgagggcggtgttggggtttcgataattttgggggttcacctgaaccctcatgacccaggtgaagcccgcccctgggggaaggatgctgaccgtgctgcgggtgcacctcccgtcggagatcccgatcgtcggctgtgagatcacgccgtacgtgctcctgcggcgccccgacggcggcgtcttcactgacgacgtgtctgaggcggcgcccgtggatgggtacttcatgcgctacaagtggtaccgcatacaaagtgatcgcagagctgctatctgcagtgtacacccaacggaacaagcaacgcttcagtgcatagggtgtctgaagtcaaaaatacctgttgctaagagctaccattgttctgctaagtgcttctctgatgcttggcaacaccacagggttttgcatgagcgtgcta

SEQ ID NO: 2786 - DNA, 766 bp, Sorghum bicolor
  Clone ID: SORBI-28MAY03-CLUS47370_1
gcacgaggcttcagaccccaatctctccgcctcgcacacctttcctctccgtgcgcagccggagctggtggagcgccgactggcggacggccagccctctcctactgcggcgacgaatcgctcttataagcaagcagtaatggaggaagaagaggaaccacatcttccactagacatcatctacaagatcccagaatacatatccgatccagtctcactagcgcgtgttgcttcatcctccaagttatggcgctctatcataaaagagactgcctttcttgatggcctcatgacacggcacctcgaccatgatttcacctcgtccctcctccttggcttcttctaccaggacaatgccgaggctcctgaccacttgtggcagcatcacagggacaaaaatcgctgtttggcaccgagcttcatgcccacgtctgaattgttaccatttgctggctgtaaagagggttacagtccaaccagcccactgtcccttggcaacttcattcagggtattaattcaaccctcaatttttatgagcctgttgcatcccaagacagcttcctggtcctctgccatcactcgaaagacgccgaaggtgatcccaagccagatgtggtatgcgtatgcaatcctctcaccggtaaagtgtttcatcttcctggccttccatacaagccaccacaccactatgctttgcttgtcactgatgatatcaacctcgacgggcggatgacacaatccttccgactggtggccctttggaac

SEQ ID NO: 2787 - DNA, 561 bp, Sorghum bicolor
  Clone ID: SORBI-28MAY03-CLUS47395_1
gcccttgactgggctgtcaatgaaaaactgaaatcaggtgaggatggagaagtaactgccaatcatttgctactggggatatggtcagataaagagtcagctggtcataaaatcctggaatctcttggatttgacgatgagaaagccagtttactggccaaaacggctaatgaagaggctgcaatgagtcctagatagcaaagagagcacccaatttattcttcggcttaagttggtgttgtgcactagctgtatgcacttcttggcgcctcaagacgttgacctgaagacgctgcttgcttctacaaaatttaggacttatccagatgtgttaggtcaaatacaatatttgtactctcacgattgccgatggctgttaaaacattgcgatttgtttgtcacggtgaatgcttctcagcttctgttccttgctcgtagggaaaaaaagtttgtagggtccagtgggcttgacgagtccttcaatttttttttttttttgttcattttgctgcctgaatcctgacaagcaagaatttcacctgaagtcaccgatatgttctg

SEQ ID NO: 2788 - DNA, 633 bp, Sorghum bicolor
  Clone ID: SORBI-28MAY03-CLUS47399_1
ttgggtgcatacactggttaaggaatctccaccagagaagcaagttactacagctgaatcaattaattctgttggaccctcacccctaatgcctcccggcatgaacagcggcgaaggttctggtctgaacacccagctggatgcacatgaccaagccgcagttataggagcattgcttgaacagatgcagcttgatcagcagattggtagtctagcaacataggtgcacaatgagcctggaaggtgtgaggatactatattcttatctaatgaattccaagttctttttccctgtcaattaaggtattcaacaaagatggattgctgaaggtggtgattcagagattggttttctttaattttggaggtaaatcatatacattattgaggttccagtaggttaaagagtgaagttcctcaggttggggttgttccatggccaacccaggtagaatcgcaccccggcagcatcagttcatcgattggagttctctattttgttaattaaccctgttaagaaaagaaggcttgttcgccgtgtcggaattctttccttttccctagtgttgtttattttgttcattattatgatatcgatacttgatgtactgatggtgtaagtggttactggga

SEQ ID NO: 2789 - DNA, 596 bp, Sorghum bicolor
  Clone ID: SORBI-28MAY03-CLUS4741_1
gccggtggtgttcggcgccggcacgccgccgctggtcgtcacgcgggagaggaactacacggcgggcgacatgtcggagtttttgacggcgatcggggtgcccccgctcggggtgacgctgtacgagacgcgggcgctcccggtgcagctcggcttccgagcgccggtggtgccgacgacttgcatcaacggcatcggcgtgtccacgatgaggcaactggtgtactgggacggcaacttcagcgagacgccggaggtggtgtacggcgacggcgacggcttgttaccgtcggcgagcatactggccctcgacacggtgatcggcggtgacccgaggcaggagtactacaagtctatcaagcttgccgcgtctcacgccggcgttgtctcagatgctgcggccttgaagcgtgtcgtcgatgagattctttggagcaatccgatgtgagaaagtgtatcagagatcaactctgtcacccgtttgacagtcaattgactcgtaagaacttcgctttagatagtactaaatcatacctccaccctgtttgtttttttttatctattggattggatgaaacttgagatttatatggact

SEQ ID NO: 2790 - DNA, 753 bp, Sorghum bicolor
  Clone ID: SORBI-28MAY03-CLUS47060_1
ctcaaacacatatattgcatttcaagcatcatgtcaatttcccaccccaaaatgtatcatttcatctactactaccgtctgtggatctcaggttgtattattccccaagacaagaatcttttgctttcgcagcaggttctgcctcaagtatgcaaggcatggagtcgtgctgtcaagttctgtgtgtctgggtgggactacggactagtagtgagcagctgcaaggacttggcaggcccattcgaccatatccacacagtgagccttaacttgcccccatcaaagtgccgctgcccacagaggcacaacacactgtggctcacaataaagcatgttcgcatccttcctcccccgctttgtcacccagacgacaccccgttcgccatggttccggttccggcatgatattgatagcggagaagatgacggtggcatccattgcccgttgcggtgggaggatgagtcccactgccataccgacactgcaaactgcagcccaatggcagagttttatgattttatcatggggtggagtgacgggtgtcacggtgtgggtctgtcgtctttgctgaaagacgaagggagaaacttcgttcaaagacagacaagggggaataaaagggtgtagcgaaccctcgtgctccactgtcctgtgcaattgtagtgtcgtctttaaataaaatgttgtaagttccgaagtgctggtgtcgatactcgatagtcacggagaggtatatatggctagttgtggtc

SEQ ID NO: 2791 - DNA, 512 bp, Sorghum bicolor
  Clone ID: SORBI-28MAY03-CLUS47067_1
agaaccaccaggaaatgtttgccctgatgcatcatgttgtcatgggtgatgatccagaggtgaaggctggtaaaccatcccctgatatttttcttgctgcaatgaggaggtttgagggtgacatagaacccagtaagtgcttagtttttgaagatgctcctgctggtgtagctgcagcgaaaaatgctggaatgtctgcagtgatggtcccagatccaaggctggatgtttcatatcaaaaaggagctgaccaagttctcagttcattgttggacttcaaacctaccgaatggggcttaccggcatttagcatttaaagagtagacaaattccatacaaagattggaaaactccagtgaagaagaatgtgagatacttgaatactaactgcgtggataatacaaattccattagatgttgctcaagacaaatttcataagatgttgatcaagcattcttgtcgcctcttaactatgtggccccaaattactttatatgacttagttccttcc

SEQ ID NO: 2792 - DNA, 664 bp, Sorghum bicolor
  Clone ID: SORBI-28MAY03-CLUS47131_1
aaaaaaaaaaaaaaccctcggcgcctggctttactcctccctgcatctcctcaccttccccggcgcgccgtcgtttgccagttcaccgccgccgacgccgacgccgacagccatcttcgggagtctaggtcacgcgcttaatgccgccgctgcgtcgattctgtcagttcttgccgcggtccacgccgtcgatggctcgccatgttccgacgccgacgacggcgtcgacgtgcaccccggagacggcggaaggcaggcacttgtttgaggtcactggttacagcaagcacagggggatgggccacgacaagttcatcaggtccggcaacttctccgtcggaggccaccagtggtccatccgcttctacccggatgggttcgtcaaaggcaaagattacatctcagtttatctcgagctcatgggaggctccaaggtaagggcgtcctgtgacctgaagctggtcgacctgacaacagggttgtcggcttcagtgcataggacagagcctagaatgtttaactccggtgatgtcagtaggtatgctcctcagaatagctcgttcatggaacgaagcggatttgaggcatcggtgtaccttcgagatgatcgccttgtgatagaatgcattgtcactgttatggcagaacctaaggtatctgcaac

SEQ ID NO: 2793 - DNA, 865 bp, Sorghum bicolor
  Clone ID: SORBI-28MAY03-CLUS47158_1
actcccctctgcgttttcaaaatcaaaccccagccggaacggcgaaaccccttccaccatagcccagaggagagagagtgtgtgtgagagacggagcagcagttgcggtttccctctccgtcgctctcgccgcccgccgccggctccgtgcccggagcgcaaggcgggcccggcggcaaggtcctccgctccgtccccttcactcccgaccggcgtccccgcttcgttggttcgccaatctacttcgtccgcccacccctttttcccccgatcgatctctcgttcttgctaagcaaaccatcttaacccctctccctcgtgcgagatgcgccaggagaaagttccccgcttttccaccaggcatgcttccaccgccttgctttgctgcttgactgcttgctgctgttgtgcggagtgttaaagaaggcggcgccggagtcaagattccttcttcgcccttcttgttgccgttgttagtggttttgtttgtgattgcggctgccctggagtcgcggtgtgtgtgaagcgagggatccgagattcttgtggattctgttctcctttttccatcgctgccgattctctcccgtgcgacagcacaagcggcggcggcgtggggagagcagccgccgtgcccggccttggaggggcccagtccgtctatggaacttgctgcctcggtgccacgccccggcccggaaccgaagtgctcagcaaggcgctgcttgcctgcccctctcacgctgctggtgtccattgtggcagtctcctgtttgattcctgctcctcgctgatcgatttctggactgcgatgatggtgccgcgaacggtgctgctcctttgctgctgcctcctggcgttcttg

SEQ ID NO: 2794 - DNA, 599 bp, Sorghum bicolor
  Clone ID: SORBI-28MAY03-CLUS475_1
ccacgcgtccgggagcccctcggcgcgccactgataataatatatatatatatatgatcggcggatgatggagtcggcggagctgcccgcggcgcggaagctggacgccgcgtgcagccgccattgaccggccgccgatcgacgtgctagcagcagcagctcagtcatctacaccatggattgatcgtcgatggttcagaggagaagaagcgacgacaatggagaggagacggcggacggctcctctcccatccgattcttgcttacgtgtacatagctgaggcgcagcacgtacgtacccattgtttagtgatgttctcgatctcttactgattccttgcctctacgttctagaacattctagatgaggggaagaagagggccgggtgatttcatccacctactacgcattcgcattcaagggttaccgctgtgcgtagctacttgcttaatttctcaactagtactacgtattttggttggacatacatggctgatggatctcaagagcggttctccagaagaggagacactttgagctctggagtatatatgtatcaaactttgcagagaaaagaaaaacaaacgtgtattctttg

SEQ ID NO: 2795 - DNA, 604 bp, Sorghum bicolor
  Clone ID: SORBI-28MAY03-CLUS47541_1
accatcaattatgaagaatttatcgctgcaactgtgcctcttaataaaatagaacgtgaggagcacttgatggcagcttttacttacttcgacaaagatggaagtggttatatcacagttgacaagcttcaacgagcttgtggagaacataacatggaggacacattccttgaagagataattttagaagttgaccaaaacaatgatggtcagattgactacgctgaattcgtagccatgatgcaaggcgacaaagttggacttgggtggcaaccaatggaaaccactttgaatgtaaccttgagagatgcacctcaagtacactgtcactgatgcaatcgccatgtacagattttgttctcttctcttatttcattgtttctccacaacccgaattctggttgttgtgacatgtacgagaagagagcaaatcaatcaattcatttagtagtatttatcccaaataagtgtgggctggcaagtagtatatagtttgtcatgagagacactagtatatatatatatatagtagtggtatatattggtttatgtagcttgtgatcctgtcaagcgattcaatcaaaatactaaaagaagtgcattc

SEQ ID NO: 2796 - DNA, 426 bp, Sorghum bicolor
  unsure (1)..(426): unsure at all n locations
  Clone ID: SORBI-28MAY03-CLUS47560_1
tcaaccaagttatgggccttcacatttccaaattctaattgattggtttctgcaagaggggcctggctggnctggtgtatttggattttaaaatatagagtatagttgcattaacttcggaaaatatagcccggtgtccaagctgccaatctgaatgtaaaatagagtgctgtaccagttgctgctcgggtatgttaggtacttaggtttttgagtcctaagtttcttgagccgttttttgttttgaattgagatggctatactcttcacagtttcttttttatgtgtctatttatatgtgagaaatctgtgaagctggattgggtctattagtctacactacaccattcccaagtccccagtcaaagcagcacccagagcagganaattgtaactcgaagcaaataaactcttgctttgactcgc

SEQ ID NO: 2797 - DNA, 645 bp, Sorghum bicolor
  Clone ID: SORBI-28MAY03-CLUS47594_1
cgtacggtttctggcaagagaggcagatgaatctcgtttacgtgaggtttgtgagaacttcctaggtcctccgatgggtatgcttggatctgcatcatctatggattccaaaaatccatcgtgggatcctgatgttctcgggatgaagaagcacaaacttctcatggaagacatacttccatcgatggcatcgaaccggaaagtccagcggctgctcaacgagtttatggatctcctatcagagtatgaagctgctaagagcaaagttgacccaatggatgtcacacgggcgccacaaccagcagcaagtcaatgacaacgtggtcacctcgtagctgctccagtctggttgctggggacttactgacctctcggtaagtatgataggatagcaatcttgataagtccttatatgaaccaatcaattagttgtgcttgtaactggtagattgtttagcgagggaggcgacctcaggcaaacactgattttgaacccattagctgtaacgctgtgtaacagtagaaaaaggaagctgaggtcgcctggctggtgattattttgtaacagtaaaaaatgtagaaggtcggataaactcatgccctttttgttcccaagcaatgttggtctttgaggtcaaaaaaaaa

SEQ ID NO: 2798 - DNA, 705 bp, Sorghum bicolor
  Clone ID: SORBI-28MAY03-CLUS47564_1
caagggcaaggcggaggacttcgagatcgtgtacgtgcccatggacaaggaggaggacgggtacctgcgctcctgcagagacatgccgtggctcgcgctgccctacgacggcgtgccgtcgcgcgcgctggcgaggtacttcgacgtgcgggagatcccgacgctggtggtggtcgggcccgacggcaagacggtgacgcgggacggccgcaacctggtgaacctctacttcgacatggcgttcccgttcacggacgcgcagatcaggctgctgcaggaggccgaggacgaggcggccaaggagtacccgcagtcgctgcgccaccggggacacagacacgagctcagcatcgtgtcggacaagtccgggggaggaccctacatctgctgcgagtgcgaggagcaggggctcggctgggcgtaccagtgcatcgcctgcggctacgagatacacctcaggtgcggccagaatgcggagggcggcggcgcaggaactgcttagcgacgacgagttaacagcgtcaacactaatatctatctagactgctgcatgcatactggacatggttctatgtttgttcccaacaaaccgtcagcttgctctatcaaggctgatgctaaagtagtaaaatagatgagaaatggccttccttgtaaggtttaggtggttagcagagtgcacatgaaaagaaatgaagctgcatc

SEQ ID NO: 2799 - DNA, 416 bp, Sorghum bicolor
  Clone ID: SORBI-28MAY03-CLUS47575_1
agtaaaagccgaatttggggatccagaaatctagtattaggtggtaaatctggccagagttaccgttactaggcaatcgagtttgctcacttccgcttagccaccattttgtatgccatttggtagggcacaatttggtgtttacaacctgcttgctagggacctgggagtggcgtggttttggggaactctattcgtttgcagtctgcaggagcgagcacatcatgatcaacctgctgtcttctttgtaattagtagttattaggatccagggatcttttctcttgagttgtagtcaattgtaggaaggatttctgtaaaagcatggttctagaatgcttgcgtcttgaatcataactagctgggaccccgtccactggagcgggctagaaatgcaagtctgaatttgagcatgt

SEQ ID NO: 2800 - DNA, 513 bp, Sorghum bicolor
  Clone ID: SORBI-28MAY03-CLUS47271_1
gcacgaggctgattctttctctcgcccagtctctctctctctctctctctctctctcctacgaggacagcccgggaaggatatcaagcttcgctatggcacttgctgtacctgtgacactaaagactactgaggagggtgggaatgaaagatttgattacgcggtgtcagctatgcaaggataccgtcaaaatatggaggatgctcatgcaattgtcttaaatcttgatgctgcaactggcacatcattctttggtgtttatgatggccatggaggacctgctgtttcaaagtattgtgcgagacacttacacacagagcttctcagacacgaaagtttccgtgataatctccaaactgcaattgagggaacgttcttaaggatggatgagatgatgaaagacaggagtgcagggtgggaactatctgggtatggtggtaatgacaattggaaagcatacaaaaaggctctgcgctggagtctacttctacccttcttctgtcagagacctga

SEQ ID NO: 2801 - DNA, 842 bp, Sorghum bicolor
  Clone ID: SORBI-28MAY03-CLUS47300_1
gcacgaggcgccccaacaaccttcgttccccacctaaagtacaggggcctgatacctctgggcaagcagggggggcctccatggcggcggtgctggactccttcgtcaagcgatgcacggcgtcattggaagacttcgctagccaggaggcctgtgtcgccctcggcatcggggatgacgtgaggggcctcctcgccacgctgtcgcgcatcgatgccatcatctcccatgaggagcggaggagggtccttagcgccaaagctgatgcgtgggtggtgcaggtgaaggatgccatgtatgagattgacaacatctttgatgtctgcatgattgagggcgcaaaggttcttgccgatgaccgcccacccacgcccaaggtccgatgcttctcctgcttcaagccttcgggcccccggaagttcccccgtgggatcggcttcaccattagggacattgatctcaggctcagggaggtggaggaggagatgcctaggcttcctgctggatcagttcactctgatgcaaaaagggactcattcagccataatgtctgtaagaactgttctgatgccatgaagccccaagcagttgggtcgcaggtccagaaggctgtgggtggccttgtgccaaggatgcttagagagggcaagaagaaggtggatgtcttcgccattgttggtgcggtggggattggcaagactacgcttgctagggagatctacaatgatgacaggatgactgaaaatttccccatttgtgtgtgggtcgacatgtcaaaggatttatcggagttagatttcctcaaaatgatcatcaggggtactggtgccaatgttggggat

SEQ ID NO: 2802 - DNA, 278 bp, Sorghum bicolor
  Clone ID: SORBI-28MAY03-CLUS47320_1
gcacgaggcggggaggaggtggcaccgcgcgcgacgccgcccagggcgttcccgccgccgctgccgtcgctggcgcgccgcaaggcggagtccaccatggagatgcggcaggaacgccaggacggccgcctgctcgtcagggtcgtccccgtggcgtcgtccacgctgttccgcgcgcagcgccgcggcgggcgcctgctcctgtcgttcgcggacacggccgcgccccccgcccccgcctcggacgagggggacaggagccgcgcccatccggagac

SEQ ID NO: 2803 - DNA, 608 bp, Sorghum bicolor
  Clone ID: SORBI-28MAY03-CLUS47347_1
gcacgagggaaccttttcccttcgtccccatctctcgtctctcccctcctccagcccgacccggcgacctccattccgaaccctagccccctaccaccactgcggcctgcctcctctgggcgggtcctgcccagatccagcacaggaggttaagcaggagcccggcgggcgggcgggcggtggatggacgggccgaagcggtcgcagctgcgggtgcgcctccgcgtcacggcgcgccggcgtggcgccgacggcgacggcgccgggggcgcggccgggcccggagggcggaagcgccggatggaggcccccgtcctcaactccgccgccaagctgcagcgccgcgagatcgggggccgccagctcgccgcgcgcggcggtggccccgccgccgccgtgcccgagcgcttccggaacatgcagctccaggaggagttcgatacatatgatgccaatgctcacctatttgtgaagctgcagtttcttaaaagaagatccaaaattattgagatcgttgcagcaaaggatatcatatttgcccttgctcattccgggctttgtgctgcttttaaccgagtaacgaacaagcgcatagccttcttggattt

SEQ ID NO: 2804 - DNA, 584 bp, Sorghum bicolor
  Clone ID: SORBI-28MAY03-CLUS4767_1
cgttctctccccttcttcacccactgccagtctgccgctggcctctccctccccttggcggctcggccatccatagccatggcgaccaccacctcctcctcttcacctcggcacatctcactcccagctgccgcaagtaggagtacgtagtaaatagccgtacataggttcagtcgatcgttcagagagcagagagagggtagctagctatatatataggagtatacaagaacggtggagacaggccggccgtgcagggcaggggagatgatgctggggaagcagagatccgggcgcccgtcgccggcgtcgcggcagcagcaccacatgcggcggacgacgagcctgacggagttcgcggcgccggacgtgctggcggacgtggcggaggaggaggaggaggacgaggagctgcagctgctgccagcgcacgcggcggcggcggacgaggtggaggcggtggagccggtggagtgggccgtcggcggcgcggcggcggccgggcgcgcggactggctggcggcgtaccgcgcccgcgccgcgccggcgctggcggggctccgccggaactccgccgacttctc

SEQ ID NO: 2805 - DNA, 694 bp, Sorghum bicolor
  Clone ID: SORBI-28MAY03-CLUS47684_1
gcacgaggcctcgctgccgccactcttctccccggtgccgccgtcgctgagggcgtcacgccctccgaggcgcgccggctccgcgatgaggtggcgcgtgggttctatcatgcgtttgacgggcacatgaagtatgctttcccactcgatgagctgcgacccttaagttgccaaggtgaagactcccttggtggttacccgctcactcttatcgattctttggataccttggctttactgggtgataaggagaaatttggtgctgctgtggagtgggttggtaagaatgtccgctttgatattaataaaaccgtctctgtttttgaaaccaacatacgtatccttgggggtctgctatcagctcacctgattgccagtgattatgccactggtatgagaatccaatcttatgatgaccagttacttcatttagctgctgacttggctcagaggttgttgcccgcatttgacactcctacaggttcattaccttttctattattataatcttcctggaatgactggcttatatcttgcatcagacatttgattccaattttttttcatgttctttgttgtaaaatgattgtttccactggtcgggaattgtcacttggcgatactggaattacaaacacacaactgcatttgatgctttactctaatgaaaacataaataaaaacattgcttagt

SEQ ID NO: 2806 - DNA, 599 bp, Sorghum bicolor
  Clone ID: SORBI-28MAY03-CLUS477_1
gtttcgacaaggaccggatcgaggcctccgtcgtcatctggcacaggaagatctgtcacaagctatcgtgggcccccgctggcgtcagcttggagaagcgagaggagttcgaggagcgggcacagaccgccctgctcatcctcaagcacaggttccccggcatccctcagtcgtcgctcgacatcagcaagatccagtacaacacggatgttgggtatgccctcttggagagctactccaggacactggagagcctagctttcgcggttttgtctcggatcgaagacgttctccacgccgacgccgtcgcctgcgatcccaacaagcggaccaagtctaggagacggcctagtctagagtttccggttcctgatgccgccgccgccgccgccgaagcggaagccgaagccgagacagcggcggcgcatcacagcagttgcgtgcattggcaagaagaggacggcgagaagcatccgggggccgccccggatggtaacaacggtagaaagctgaggaagattcacagggtggtgacgaagaagttccttcacacacagcagatcgacagtgtgacgagtgggtttaagagcttcacacac

SEQ ID NO: 2807 - DNA, 709 bp, Sorghum bicolor
  Clone ID: SORBI-28MAY03-CLUS47721_1
gcacgaggcttctcagaagtctggcaggagatctggtatgccggttcggaaagaacctcaggcacttttggaatacagtatgaattcttcagagcttggtccatcgactcagggtattcttatgtctgggcaaaacagaggatttccagtgagtatgaccaaggtggatggttttaagctgccggctgaccaagaaactcctgttgctggaaacatgtatactaattgtgtaggcgcggcggctttattcatgggtagatcatttcgtgttggttggggaccaaatggtttacttgtacattcaggtagtctggtcaataatcctggaacaggcttatcttctgttattcacatagagaaagttgcaagtgacaaacttgtgcgtgatgataagagcaagattaaggatgacctaacagaactatgtttttctgatccaatgggcctccataagagtcttgatcatgagattctggagacggagtctgactcgttcagattaaagcttcagaaagtcatggcaaatcgtttggttttgcctgacatctgcaggtcatatattgacatcattgaaaagcagcttggagtcagtgatttatctatgtctacgcgtgtgctgttgatgcaccaagtaacagtgtgggagttaatcagggtcttgttctcagaaagagcaactggtaaccagttggagcctgttggagatgat

SEQ ID NO: 2808 - DNA, 629 bp, Sorghum bicolor
  Clone ID: SORBI-28MAY03-CLUS47740_1
gcacgaggcccccccgtcctccgccctccgccggcggcggcggccggcctccgccgccgccgccccccccgccgccgccgcctcctccttccccctctcctcccgccgccccgccggccccccccccccccgccgccgccgctccccgccccccccgccccccccgcgccgccgcgcctcctccaccgccgtcgctcccctccaccgccgccccccccggcgcctctacgccgccccccgccgcctctcctcggggggggccgccgggctgcggcgggtggtggtgccccccgccggcgacgtctgctggctcctcccccctatcgtcctcctcatccgccgcgccgccggcggggtcccccctgccgccgccgtctcctccgtcggcggcctccggagcaacgatgcttctgtgcgccgccgccgccggctgggcggcggtggcgcctcgccgcccagcttcccgggccgctcatgtcgtgttggcgctacctgctcctccgacgaatatgacttgcagagcatagtacccatctgcatcatgtaccatgttcttatactcatgctgaagtatgcagcctctcagcatcctgtgccgctcattacgtgatatcgatacctacacaaca

SEQ ID NO: 2809 - DNA, 558 bp, Sorghum bicolor
  unsure (1)..(558): unsure at all n locations
  Clone ID: SORBI-28MAY03-CLUS47746_1
gcacgaggctgacttgcgtcgcggtgaccgcgccccccaaacccccataaaccccagagcagagagcaccgcggatgccctcccgcttcccgtctgatggcctcggcggcgcgaggtaaagagggctccgcccgtcccctcttttcccactcagatgtggcggctccctctggcggcggcgctcctccgacgctcgctcgccgccaccgcgcgcctctccgcctcggggtatttgatgcgtgcctggctcgcagaacagcccactggacgcactaattcacccatcactgtgcattgcctccaacagtgtggttcagataacaccgttgatgatagggtcagtcaggcatttaagcggtgctgctcaaccagtgcaagtagtggtgtttcagatgcatcaccttgtgcttcttacatcgagaacctctgcagatctggcaatcttgttgatgctgttcgtgttcttcgacaactgcatgacgagcaggtccatgtcagcctgcacacctttaatatgttgctgcaacacacagctgaagcanacatctttaccctttt

SEQ ID NO: 2810 - DNA, 660 bp, Sorghum bicolor
  Clone ID: SORBI-28MAY03-CLUS47423_1
taccacaatggtttccatggagagaaattgcagttatgcccgttcagtggcatgccttagctcttggcttgtttgcttcaataatagcaccctttggtggcttttttgcaagtggcttcaagagggcattcaaatttaaggattttggggacagcatacctggtcatggtggatttacagataggatggactgccaaatggtcatggctgtcttcgcatacatctattaccaatcatttgtgatggtacaggacttatctgttgagacaatcctagagcagatactacggaatctgacctttgaggagcagcatgagctgtatgaacagctaggcaagttacttgtgagagcgaactgatgctaacagcatatataatccaaaaggataatgtgcagtggttttgaggccttgcttttgttaatcttcttgtatagccctaacacccctaagaacgaaacaaagaatcacaacgctgacagggattgcatggttgtatgatgttttggaggatacagctccggtgtttttcagagatttgtgtcatctttttttcatttgcttcgggtgttagcttgttgccgcatcaaaaccacgctaatgctgtttttttcatgtcaaaggttcttggtatttgacaatgtgtaggaggtttcctcct

SEQ ID NO: 2811 - DNA, 889 bp, Sorghum bicolor
  Clone ID: SORBI-28MAY03-CLUS47440_1
gcaaccggtggcaccgcgcgccggacatgctccgccgccggcagtgcttcgacgtgtgcgtcatgggcaaccgcctgtacgtcgcgggcggcgagagcggcagcggcggcgggctcaggtccgccgaggtgttcgatccggtcaagaaccggtggtccttcgtggctgagatggccgcgccgatggcgccgttcgtcagcgcggtgcacggcgggcggtggtacgtgaagggtataggcgcgcagcagcaggtgctgagccaggcgtactccccggaggccgacgcgtggtccgtcgtcctcgacggcatggtcaccgggtggcggagccccagcgcgtgcgtcgacggccggctctacgctgccgactgcaaggacggatgccggttgagggcctacgacgaggccgcggacgcgtggaccacctgcgtcgacagcaagcagcaccgagggagctcccaggcggcggaggcggccgccattgtcgccctccacggaaggctctgcatcgtccgcgacgacatgagcgtctcggccgtcgacgtcgcgcccggggcaggaaaccagcggtggcagaccctcgccggcaaagcacataccaagagcttcgtcacgggcctgttggccaacctcgctggccgcaggcgcgccaagaacaacatcctccattgccaagttcttgaggcctagctgatgacttgctggttgctgctctatgagttatgcttagaagttactagaatcatacactgaaaagtatgtgagaaaaattgagaaatctccatgtttgctcaagagtactcctaaaaaagcgagaattataggcatctgaaggatgtgatcgttgtacaaatacagtttatatgatatacagtatacagattggtatg

SEQ ID NO: 2812 - DNA, 652 bp, Sorghum bicolor
  unsure (1)..(652): unsure at all n locations
  Clone ID: SORBI-28MAY03-CLUS47450_1
agctcactgaagatatgagttcaagtgcttcagaattaataggcccagaagatttcaagccaaagaataagggaagaaggtttagaaaaaatggctaagaggccattgattgatatntgaggcctgaatcctttttatttgtgctatgtgcacatctctagtcccatactgctagagtttctggaaatggttgaaatgttttgtagaatgaagctcacagtattatagagaaatacaaagctttaagatgacagaagcatgatggttaggtaaacatgcaatgatacagggtcaagaggacctgctgacctgaatgggtcattttggctgcatgattttaagcagcctcatgggtcacgggaaatattaagattcaccaaattagaataccttgaagctgcatctgttactcattaatcagctttatgtaacatggacacactgctggatttggcttgagacataggcgagtatcatgtgaggcagaaacatgtagaattacagcttctgcaattagttttttctgtgaatcttaggcatgaatagagacaagattccttgttttctccatttcttttcccttgtaatcagaaangtgctataatgtactaatgttagttgattgaattcagtttattatcttagctatttg

SEQ ID NO: 2813 - DNA, 610 bp, Sorghum bicolor
  Clone ID: SORBI-28MAY03-CLUS47473_1
ctgactggagccgcagccgcagcagcagcagcaaggtctggctcgtcggcgacaagctgacggacgaggagcagaggagggcgcggggcggcgtccacttcgtgccctactcgcagttccctcccgacgccgtccgcggcgactgcgtctaccacagcacgccggcgctggttgtcccggacgccttcgagaacctccacgcctgcgagaactggctgccgcggagggtgatgagcgcgtggcgcgcggcgggcatcgtgcacgcgctccagggctgggacgaccacgagtgcggcgccagggtcaccggcgtcgacaaggcatggcgcgccgcgctcgcgcacggcttccgcccctacgaccgccatcacaccgcgggtggcgccagcaagtgaccatcaaggaatattgaattgggtggacggactacgattctcgtgtgcatggcttggcttgtctgtgacgctcatctactactggtggcataatgcgtgcgtggttgttctgtgttgctttcttctgctggaaatgcgtaacattcctattcctattattatgaggaggaaacaaaaaatactctggcagacgcattgaaaatgccttttttttc

SEQ ID NO: 2814 - DNA, 533 bp, Sorghum bicolor
  Clone ID: SORBI-28MAY03-CLUS47802_1
gcacgaggcccgtctcactgacggtggccccccacccgcccggccccgctcgtcggcgagccccttcccttccttccccctccccccggcggaccaccgctgtcccgggcaagagatccggccaactcaggttgctcggaaggccggcgagccgcgcgtgctgggcgccgggatgcaggcggccggcgccagccggtggcccggatctcgccggcggcgcgtctcggcgagtgtgggcctctgaactttctgaccttgagtcctcgattttgtcatagatcagacaaataatggaagagttacaagattgcaactcgaaatgcctggttgccctcccgggctctttggctctgcatctctttaggctgtttggccagcaggatcagagttcatggcagaagtacatactagcttactgtctgttggtcaggaatgactacttctctggggagtcgaagaaacactcagatttgttctgtgatatttcagaattagatttctttccatatgctacagatttggatagtgaagaa

SEQ ID NO: 2815 - DNA, 963 bp, Sorghum bicolor
  unsure (1)..(963): unsure at all n locations
  Clone ID: SORBI-28MAY03-CLUS47820_1
gcacgaggagcctgataatgggaatataccacataaggaccagaaaacaaatccatctgcagtcaaaggaagcaagcagcagccatccttaaacaatgcatcaaatggtgatgcctcttacaaggcaaagcaaatagaaaaggctgttatcgaaaatttggaaactaggaagcaagtaactcttaatggtgatgcttcaaatctaacgagcgcatctgttctactgaaggaagctcgagatttgaagcacttgtctaaacgccttaaggaaaaaggggatgactttgagagtacaagcatgtgctttgaggcgggtctgaaatttctccacgtggcttcgctgtgtgaggctccaaacgttgatagctccaaacaaggggattctgtacaagctatgaaactatattctgaaacaggaaacctttgtggattctgcgctcatgaatttgagcgactcaagaaaatggcgaatgctgctttggcatataaatgtgtggaagtggcatatatgaaggctgctttctttaaaagtcctggtgtaattaaagataggcatgcgttgcaggcagcgtccttgatggttgctccagcggagtctccatcatcttctgcttcagacatcgataatttgaataaccagagcacagttactaaggctgtttctgcaaggggtgtatactctcctcagattgctagcaaccccatatctcggaacaatcatcatttgatgggattgctttcttatacagaggatataaataatgcattcgagggtaccagaaaatcgcaaagttcattttcagcttatctttctggtattggaaagactcaggntggatggagttgttcttgtaagggaagtacttgatttcagttttcataatgtcaagggattgctgcaactgattcgtcattcgttggagtctatcaaccatgaaagtggtaaataatctaacaggtata

SEQ ID NO: 2816 - DNA, 439 bp, Sorghum bicolor
  Clone ID: SORBI-28MAY03-CLUS47824_1
gcacgagggcggatggcggcggcgccgccggtggcgcggcagaggcggcgcccgtgatcgagttcagtgggagggaggatgtggagcgcctgctcgccgagaaaatgaagggcaaaagcaagaacgatttcaaggggagagttgatcagatgagtgactacatcaagaagctcagggcgtgcatccggtggtacatagagctggaggatgcctatttggtggagcaggagaagctccgaggtgctatggactctgagaacgctcgtcatactgaattggagacccagctcagcaatgctattgaagagctaaaagctgcaaacttggacttgacaaggcgttgtgagtctctagaggagagcttcaacaaggagaagtctgaaaaactgatcgctatggagtcttacgagaaagaaaagcacgaaagagaatcagctga

SEQ ID NO: 2817 - DNA, 507 bp, Sorghum bicolor
  Clone ID: SORBI-28MAY03-CLUS47826_1
gcacgaggcaattcgaaagccgcttcgggcgcgggtggaatcggcccgtggccggcggagatgtccggattcgtcggggtcgtcgtgtccgacccctcgctgcaggggcagttcacgcaggtcgagctccgatcgctcaaggccaagttcgtgtctctgaagagagattccggccatgtcaccactaagaatctgccggggctgatgaagaagctgagggggctcaatgaggtggtctctgaggaggagatcgcggccttcctgtcggagtcgtaccccgacagcgatcaggagattgaattcgagtccttcctccgggcgtatctgaatctgcaggctcgggtgagtgccaagcaaggtggtgccggcggtggcgggggtggcaagtcgtcgttcctcaagtccaccatcactacgctgctgcacaacctcaatcaggcagagaaatcgtcttatgtggcgcacatcaacacttacctccgtgaagaccattcctgaagaagtact

SEQ ID NO: 2818 - DNA, 462 bp, Sorghum bicolor
  Clone ID: SORBI-28MAY03-CLUS47847_1
gccgcggtcgctagggtttaaaccgtttcccccgcccgtccgcctcgccgccgacgccgtccgtcccccgccgccagaccgccgcccccgcgccccagccggagacgacgatggtggggctcggctccatggcgggctacgggatccagtcgatgctcaaggagggccaccgccacctctccgggctcgaggaggccgtgctcaagaacatcgacgcctgccgcgagctctccgccattacgcgcacctccctcggccccaacggaatgaacaagatggttatcaaccacttggacaagctgtttgtcacaaacgatgctgctaccatcgtgaatgagctcgaggttcagcacccggctgctaagatcctggtactggctggcagggctcagcaggaggagattggggatggggccaatctcaccatatcgtttgccggtgaactgcttgagaaggctgagg

SEQ ID NO: 2819 - DNA, 809 bp, Sorghum bicolor
  Clone ID: SORBI-28MAY03-CLUS47872_1
gcacgagggtcagcaaccaagggttcaggtgaaaggagtgatctttcttcatcaaagcaaaaaagtatctcacggcataaccgtttggaaaattccaagaaagcaaggcaagatgatgtagttgttcccgaagacgagagcaaggaatattttcaccagtcagatgtacaaagatcagatttgtctagtaagaagaggatagtgaaggaatgggaggagagtcagtacaatccaatagctcctcgaggcaaaggagctatcaaggaaacctatagggatcagaacttaaaggaagcaaagttgaagtcattgaattctgaagaactgttttctatgacgagctccaaaccaccaaaaggtcaacatgctgatcaggttttgtctcatgatggggggcgtatgaacagcgagttagttgaggataacacactctttagtgccaaaagaggtctgcctgaacaagaaaagagcctttctgatcaggctttggactttggtgaacctgctagtgatgtcgcctatattcagacttcagctgtaacttcaagttcttcaaaggcttcagtctcacaaaaaaagaagcagaccactcaagctatgaagacttcgccaattgagtctctttcttcatcaccacagagaaactccaacattgacaaggtctctgtctctcataatagaatttcaggcaatgatcaacggtctagtgaacctgttttggttggttcttcccgaagaaaatctgatagagataatggacaggttcagttaactcaaggtcatgcctctgatggtattcatcttgaaag

SEQ ID NO: 2820 - DNA, 700 bp, Sorghum bicolor
  Clone ID: SORBI-28MAY03-CLUS50053_1
gcacgagggtttctacctcactatgcagcgtcaaacaacctattgattggcctatgtgatgctgggcgcatagcagatgctacgatggcattgtatgggttagctgatgcaggcttcatgccagaggctagatgttgggagaggcttgtggagactatgtgccgggagagaaagcaaaggagatccactgagctactagatgtcttggttggtgtaggttgaggtcttgaggaaaggaactggaactcacagcagtgtatctgaacccatttgcactaaggattgaattgatgtttatcacaatgaagagaagactgccaggccctactggagacagcaaccaacaggggcacagggcctgacacaaacttctctttcagaacaagagttgtcattggagatgtagtccaggatgaggtgccgccgtaggatctggcaaacagacttctgctggggaaggtgatcttcagcagaaccatttttgctacaaaaaagcttcatcagggctggcgatcgagccggtttggactgaaaccacaactaccaaaagagtcctattttaataggaagtgagcgtgacttctttgacagttaaaatatttcccggttttttttctactactatctggccctagtgctaattgtaattggatccttttttgaggtaacacaggcatggtccatgattgcttcttggttt

SEQ ID NO: 2821 - DNA, 773 bp, Sorghum bicolor
  Clone ID: SORBI-28MAY03-CLUS50068_1
agctaccaaagtgaataatgaacaaaaggaacttcaaaagcaactcttgagcaagcagctgaacaaggattcactgagaatccgacagcttaatgaccggcttatgcagaccgagagagcattcactagcagggaaggcatcttcaagctagaatggtttaagcatctggtgtatggaccttcagatcagaatgactgggatactgcagtctatcccggtatagccaatgcaatagccagcgctcggagcagcaatacctcggaatcttggaagtttgtacagcatgaggtctacagagtggccagggccgtgacacaagcatctgctatactgagtggtcgtctgacatgataggattgaaaccatcttcgttaagaaaaggagattggaactaaccatggtggccgaatggattgaggcctcaacacatgccaaacaacatcatctcttcatagctctattatccaatgggtatggataagattggggagggtgagaaatgaataatgatggtatggatttgaacataaataagcatggatatatccataccctcccaagtggcaggtataatttcccattagcatccctagagagtgttttcgaaaaattgctgaaaagagagcttataatatcgcagcaatacacagggaattcaactagtttcccattccttgtctccagcctaggagaaggtttatctaaattttgtttttacttattttaataaagggatatagtataatataagcacttaatgtgcaagcagaaa

SEQ ID NO: 2822 - DNA, 658 bp, Sorghum bicolor
  Clone ID: SORBI-28MAY03-CLUS50083_1
gccacaggtggagagctgcccacatcattgttatcgcccttgtccagagcactgccaatggcatattgtacgcatttggccgcattctgctccttgatgcctcaccaccagggaaggagggtgcattctcggtctggtatgcatttgtccgtgttactggtgccatgattggcttcgctgcttcttctgctggccctgggcgtgccggaggatcatttgctgctgcattccttgggagcttcctgggcatcattgtgctgatcttcggcaatgtcagcaacattggagcgctgaaggctgctgggcacctcaagggaatggacgatgagaagaggatgggcggacttggggagaaaggtgaaggcatgggtagcgccgtcgctgattcgggtgaaagcagggggagggtatgatgacaattcgtgaaggtgtatttctgggaggggaaaaaagattgcattctgtggaggttgtgtttgtgagaaggatttgttctctttttttttctggtttcttcatgtttcagtgacactgttaatctcagtgctttgcccgtttgatgcatgatgatggatgacatagtggtagagtgtgctagttgttaatgtgttattcttttgctgccaagacaattgtaactgatgatcatatggttatc

SEQ ID NO: 2823 - DNA, 843 bp, Sorghum bicolor
  Clone ID: SORBI-28MAY03-CLUS47904_1
gcacgaggcctcactcctacgcctcgccggcgagccgccttccgccctttcgcttccgccatcttctgcgcgctttggatcatcgtcctctcctctcgcttgagatccaggcccctaaaccctagagctcgccgtttcggctcgctcgctccgcgctggcggcggcaatggaggacgaggagatggagaagaaggtgcagcagtacctgcagcgcaaggggttccgcctcaccgagcttgcgctgcaggaggagcgcaaccgcctctccacctccgccatctctgacgttgcgcttgcaccgcctggcaatgatccagcaaggtaccatgatggatatagcagattaagaacatgggcatatagttctcttgatcaatataagcacgaattacttcgcgtcctttacccagtttttatccatagcttcatggatctagtggcggagggacatatgcaagaagctcggtcatttttccatacatttcgggaagatcatgaggtgatgcattcaagggatcttcagaagctagaaggcgtcctctctccttcacacttggaggaaatggaactggcccgatcttttaggaaaaataaatttaaaattaaattatgcgagtattcgtatgaattgcttctccagtatctccagaaaacacaagctcttgttgtgcttggagtaatcaatgagcacataacttttgaagtatctcctgggcagccctcattaatctctgatgatgctgatgttgttgctctgattgggacaagtaaggacttggcaaaacagataaatcagaaggaagtacattgggggttgcttgaagattctgttgaagagcgaa

SEQ ID NO: 2824 - DNA, 709 bp, Sorghum bicolor
  Clone ID: SORBI-28MAY03-CLUS47913_1
ggaagtgcaggacaccggggcggcactactgatgcgggcacggaaacaacttgcataaagttttactgacttattattcctttcttacacggaaacaacaacattctaagcacttgtttatttctgcaggtatgccttaggaaagatcgcccgcggcttctatgagaatctgtaattattgtgatggattttgcacatgatctgttatgcattgcattgtatgttttgttttgatttagcagtttgtagctttttttaatacatgtatgatgtcttctcttaatttatgtacctattttgtagtatgttgggttaaaggtttaattaattgtatcatagcaatgtcctattgtataataaatttatgagactagataggtgtgtgtgcaggattgttattttttccatgtctctataaacacttaataacatttgaacttgtacaacaaaaaaacttttctgaaattcttcaattttcctacaagtgctcttatggatgtgtcaaatattcaaaccatcaagttattttactgccttctatgattactcatgaatccttgttctgatagctataatttttattcttctggtctgaatcctatggatccttactactagtctaacctttttattcttctaatagctacgatttttatcgtacagaattgggtgagcatactcattggtccttctttcatgcactaaaacc

SEQ ID NO: 2825 - DNA, 759 bp, Sorghum bicolor
  Clone ID: SORBI-28MAY03-CLUS47916_1
atcggccagactctactcaccgcccaggtcaggtcaggccaggcccggcggtagagagatccggcgagagacgcggcctcttgctcccccacccctctccagaagcgcctagaagcttcggaaggtgcctcgccgcggctcgaaggaggggaggggacgccgcgggcaatggcggcgatggaagccgccgccgacgctatgctcgccgccgcaagccgcgccttcacgagcaccttcgccatcgccattcagatccaggggtgccgcgtcggtttagttcttgctcttgggtgggcggctgcttcaatcgtcagaaaaagggttataaagaacatgaggcggaacattgtagatggaaatagttttgcttttctttgtgacaacatagatgagcttgagcactctgttcaggagaatttacctagagtctctgtaattatgcctttgaagggctttggcgaacataatttgcaaaattggcgaactcagattacatcactttatggggggccactagaattcctgtttatcgtagagagcaaagacgatccagcttatcatgctgtttcccgtttgatcgcagagtacaaggaccatctagaggcgaaggtggttgtggctgggttgtcaacaacctgtagccagaaaattcacaatcaattgattggtgttaaaaagatgcacaaggataccaagtatgtcttgtttcttgacgatgatgtgaggctgcatcctgggactatcagagctctcacaaaa

SEQ ID NO: 2826 - DNA, 652 bp, Sorghum bicolor
  Clone ID: SORBI-28MAY03-CLUS47944_1
tgattggccatttatatctgcggcgccgggcgagggcgcgtagcccgcctggaccctggctagctgttgccctgttgccgtctactagcggactgctcgcggcagcagagtgcacggcagcatcaggcatcggcgacggcgagagcgttggcagcaaagcctatttgcctgtctggctgtctgtctccaagcttgaagcccacccagttggtgttgtccgggacatcatcacgcacgcgcagagctgacactggaacgactgaacatggctggagatccgggggacgcgccggaggtgggggaaggtggcatacgctctgtgctcaccatgggctcgctcgtcgatccctccgggaacgaggttcagtttccagagatcgacggcaagatgatcggcctctacttcgcggcgaactggtacccgaaatgcgaggctttcaccccggtgctggccgcggcctacgagcagctcaaggagcgcggcgccggcttcgaggtcgtgctggtgtcgtgcgacgaggaccggccgtcgttcgagcggttccaccgaaccatgccgtggcccgccgtgccgttcggcgacctccgctgcaagaagcgcctcagcgagaggttccaggtggagggcatcccgcgcctggtggtgctcgct

SEQ ID NO: 2827 - DNA, 866 bp, Sorghum bicolor
  Clone ID: SORBI-28MAY03-CLUS47971_1
gcacgaggcccattgattttgcattttagcccctcaggaagctccgatttcgcgcccggtccgacggcccggttcctagcgtgctctgctccgatcgagcgcgccgtcccgtgggggaccgctgcgaggcctctcgtccggcgggtgtggttctcggctcggttccgtttcttcccgcacaaatctcgtcttttttggttcagatttggattctaggcgcccgtctgggtgtttctcgtgtgtttcggcttcggtttcgccgatttggtgccggattcggtgggttcgggccgcatagcctggatctcgggcgcaggtctagcgctaagagccctcagattggggatttcctgccggaggaagcttttcaagcgcgcgggctgcagcagctcttctagtctctgaaggtttcaccgttcgcggtggagagggattagcttgaggagtagtttggcaggctcgtttattgcgtggggttttgggtagatttcgtgtagtggtgagcaaagtttggtgtcaagtctggtggtggaagccctcaagctggagatttcctccctcacgacgcccaaggagcacaccggctttggaaggaatttcctgacatcccagaggctgccgatttcctccctcccaagaagcaaagcaagggctttcttctagaggagctcttccagttctttaagtttgtgggccgtggctatttaatctccatctgcatcccaagttattcacaattctgtgagactgggaactccggatttggtttcgataaggtgttctgggaatggggaaccaatgcccaaacgggacccttgggagtgactactacaaccgccccgcgtctaggttcgctgatggatgcc

SEQ ID NO: 2828 - DNA, 658 bp, Sorghum bicolor
  unsure (1)..(658): unsure at all n locations
  Clone ID: SORBI-28MAY03-CLUS47952_1
gtccccagcaccgcagccccccgccaccagagccgccttgatcagcgcgatggcgggagatccggccgccggtggcggcggtgacgcccaccccgcgtcggggagcaagagttcccgctcgtcgacgcggcaccggcagttccgcgaccgagccaaggtccgcgtggacgacctacaggagatgttctgcggcctccagtccgctcgcaaggagagccgctccgccgacgccgccgtcctcgaggagcaggtccaccagatgctccgtgagtggcgtgccgagctcagcgtcccatccccggcttcctctctccagaactcgcaggggaacaaccgggaggcttcggatccaccgtcggatacgctgcgactgctgcagctggtggtgcccgaggaggaggacgacgccaccagtaagctcctggtgccccaatcggcgcagcaggcgccgcctcctcatcagagccacgaccacgggcaggacagcaggatggccaatactgatcagcagtgtgaagctatggatgggggcactgctcctgcacagcactctctaggtcagggagtggaggcaggctgtggagaagtggctgctgttgctaatgcaatgttncatgatcagatgtactatatagaccaggaacttagtattgatgat

SEQ ID NO: 2829 - DNA, 657 bp, Sorghum bicolor
  Clone ID: SORBI-28MAY03-CLUS47977_1
atctttggcgcccgggcctctttcccccggccggccggcgagccagaaaacctttggcggtggcctccatgaagaagatcgtagttctctaccccggcctcgccgtcagccacttcatccccatgatgcagctcgctgacgtcctcctggaggaaggctacgacgtcgtggtcgcgctcatcgacatcaccatggaacacaacatcgccttggccgccgccgtcgaccgcgtcatcgcatcctccaagccggcggtcaccttccacacgctccctcgaatccacgatcctcccaccgtcaccaacgacgtgaacctcctcctcggatacttggagatcatacggcgctacaacgagcacctccgcgagttcctctgctccatcccgccgccaagcatccacgcggtgatcgtggactcgtggtccgacgcggcgctcgacgtcaccggccatctcggcatcccagcctacagcttcttcgcctccaacgcctccgccctcgctgtatgcctccaactcccttattgggcccgacgtcgtgcggagggccagccgagcttcaaggagctagcaggagacgccactgtcaacttccatggcgtcccaccgataccggcttctcacctcattcgcgaggtgctcgaggaccccaacactg

SEQ ID NO: 2830 - DNA, 790 bp, Sorghum bicolor
  Clone ID: SORBI-28MAY03-CLUS47767_1
acgccagctttgtgaaagaaggcccttgtagccagctacacgcaggaagccaggaagagaaaccagcagcacaatatggcctcaaagcctggccctctcagtcgctggccatggcaagatctcggaaactacaagtacgcgctggtggctccatgggcagtgcgcagcacgtacaggttcgtgacgagcggggagcgggacctgctcgccttcgccgtgctgccggtgctcctcctccgcctcctctacagccagctctggatcaccgtgtcccgccaccagacggcccggagcaggcaccggatcgtcgacaagagcctcgacttcgaccaggtcgacagggagaggaaccgcgacgaccagatcctgctgacggcgcttctcttctacgtggtgaacgcggcgttgccggcggcgcagtctttgccgtggtggaactccaagggtctggtaatggtctccctcctccacgccggccccgtggagttcctctactactggctccaccccgccctccaccaccactacctctactcccgctaccactcgcaccaccacgcctccttcgtcaccgagcccatcacatcggcgctccccccgttcccggcgggctgcgtccacgtccccctgttcgccgtcccgctgctctccatgctggcctcccgctctgccgccgtggctgtagcaaacggctacctcatctacatcgacttcatgaactacctcggccactgcaacttcgaggtcgtgcccaagctgctcttcgacgtcttccctccgctcaatacct

SEQ ID NO: 2831 - DNA, 454 bp, Sorghum bicolor
  Clone ID: SORBI-28MAY03-CLUS47768_1
gcacgaggcttcccctccccagtctccacccccctgccccctttgcttgccccaccaaatcgtaaaccctagccgcgcctgagcgtgaggccaaccccgtcgcagccatgggcgccagccggaagctgcagggcgagatcgaccgcgtcctcaagaaggtccaggagggcgtcgacgtcttcgacagcatctggaacaaggtctacgacactgagaatgccaaccagaaggagaagttcgaggcggacctcaagaaggagatcaagaagctgcagcggtacagggaccagatcaagacatggatccagtccagcgagatcaaggacaagaaggctctgatggatgcccgaaagcagattgaacgagagatggaacgatttaaagtttgtgagaaggaaacaaaaactaaggccttctcaaaagaagggttaggtcagcaaccaaaaacagatcc

SEQ ID NO: 2832 - DNA, 545 bp, Sorghum bicolor
  Clone ID: SORBI-28MAY03-CLUS47787_1
gcacgaggcccctccggcgctcctctgcgtccctcccccgtgccccccgcccccgccctgctccttcccgccggcgcggccgccgctcggccccgccgccatcgccgcatgttcacccatcgcctcccacgacccctcctgcgctcctctgctccccccccccgggctcgccgccccctctccccgccacgccggggcgcccgcctccccccgcgcgcgctccctccgcggctgctcatggtcggtccctggtccctccccctgagggtgttgtgcctctgcagctccatggtcgcgctgctactcgcgggctggctgttgctgcggtgctgcgcgagccggtcccgctctcgcttcctcccactgaggcgagtgctgcagccttctctgcggcgctgttattcggggtgttgccggtgcgggggtggcgggtgagcctctctgtcgcacgggacccgccactgtcgccacagctgctgctgtttccgcttgcccgtggaatcacttctgctgggcatgatatcgtacagtttggattggcttca

SEQ ID NO: 2833 - DNA, 518 bp, Sorghum bicolor
  Clone ID: SORBI-28MAY03-CLUS47786_1
gcacgaggcttaaattcagtgtggaaagtcggctgcagtttttgcatgtgccaaggaacaaggcttcaatgtgatagaggtaaatacatctgacatgagaaatggggcttatgtaaggcagaagtttgaggaagctacactaaatcacatggccttgaaaaatggtcacatgaggaggttatgaatccactaagggatgattccttggatccagattcacgaactcctgataggactgaataccaacatttgatgtcctgtactacaagagtaatgattgactgtgatcaaccgaaatcacctgtacgatgctactcacgtttgaaggcctgtgatgaacctcctaaacaagttgctaacaagacactcatactatttgaggatgtggatactgtctttgatgaggatcgtgggtttatttcaaccatacttaagatggcagagactacaaaatggccaatcatactgactagcaacaggaaggatccgtctttgccgaatcttttggatcaacttgt

SEQ ID NO: 2834 - DNA, 371 bp, Sorghum bicolor
  Clone ID: SORBI-28MAY03-CLUS4803_1
tgctcgtggcgggaagcttagtaggaggaggacgacgactacgagcaggcgggcgcgtgcgggttgctgcgtgcatggaggccaagccggtggaagcgagtgccgcgcctgctcctgcgcctccgcctacggcggcgccaccagaggcgacggtgagcttccagcaggcggcgccggcggcggagatgggtagctcgagcgccgtcctggtgccgcctctggctacggcggcggcggtggcgggaggaggaggcggcgccatggcgctggggccggtgctgatgaaggtgccgaagaagcgcgggaggccgcgcaagtacgggccggacgggagcctgattccgccgctcaacgccacgccgatctcggcg

SEQ ID NO: 2835 - DNA, 540 bp, Sorghum bicolor
  Clone ID: SORBI-28MAY03-CLUS48043_1
agggcacacataacacaaatcaccaccatgtggcggagcagaaaggttgtactaactaagaaacggatggcggatacactcttgtgctattttattccatatacttattaggtagctgaaagtagatttcagccccagttgattctgtacaatgctggaactgatatcctagatggcgatcctttaggcagcctaaaggttagtccagacggtgtgattactagagatgaaaaggttttcaggtttgcaaaggatcagagtattcctctcctcatgctgacatcaggaggctatatgaagtcaagtgctcgggtcatagcagattcaattatcaccctctcgaacaaaaacttgatagatattgatacccactgtatagaaattgaataatggtgtctcgaagcaaaactcgatagatattggtgcccactgtatagaaattgaataatggatgccccttgtgtaaagaaattttatgctaactgtgtacttgcacatgtatcaacatgagaaagggaaatcagcccttgttcagttccc

SEQ ID NO: 2836 - DNA, 586 bp, Sorghum bicolor
  unsure (1)..(586): unsure at all n locations
  Clone ID: SORBI-28MAY03-CLUS48047_1
acaggctggagtcgtggagcaaatcctggacctgggtgtgcttggctaccgtgccccagagctggcagcctccaagaaaccgtctccctcgttcaagtccgacgtgtacgcctttggcgttgtgcttctggagctcctgacaggcaggtgcgctggggacgtcgtctcggggtctgaaggtggcgtcgacctcactgactgggtcaggctgcgggtggcagaaggacggggatctgactgcttcgatgtcgctatggcctcggattcagagaacccacaggctgtgaagggcatgaaggaggccctgggcattgcactgaggtgcatccggccggtctctgagaggccggggatcaaatctgtgtatgaggatctttcatcaatctagttagctagcctcattgcgtagctttagattaacactgcgtgttaaaatgtgtgcgtgctgtgtcttggactcatagaacttcgtagcgaatccaagtgttattatggcctcaccttgatgccagcaatttgaaatgaagtgcctcattggttgccnaaagtgtttgctgtttcagtgttgggccaatatccttgttgc

SEQ ID NO: 2837 - DNA, 671 bp, Sorghum bicolor
  Clone ID: SORBI-28MAY03-CLUS48065_1
tcagtttctagagcatattcacgtgattcaacagcagctgactattgctggaataatatatgcgggaacgtatagtccgatgcctctagccagtaagagaagtgcactaatgaagtttcaggaggccccaacgtgtatggctttagtcatggatggaactgctgcactggggcttgatttgagttttgtgactcatgtttttctcatggaaccaatatgggataggagtatggaggaacaggttattagtcgggcacatcgaatgggggctacgcgtccaatacatgtcgaaactttggctatgcgtggtaccgttgaagagcaaatgcttaggcttctgcaggattctagcgcctgcagaaaaatagtgaataaaggaacaggcagcactgacaatgaaggaggccggtctcatcggagcctccatgattttgctgaaagcagctatctgttgcaactcagctctgtgtagacaggatctaaagcagcagcccattttggttgttggtagcactaactaaattcttgaattttttgtgtttcttctttgatcattccctttgcaatagtaataaaaattgcttctaagtcagttcttgattccaatcaagtgttgatgggattctttcgtgtaaataactcgaattccttttgttaaacgacgtgtttcc

SEQ ID NO: 2838 - DNA, 566 bp, Sorghum bicolor
  Clone ID: SORBI-28MAY03-CLUS48076_1
gcacgagggccgcccgtgagtccgtgacgcgcgcccggcgccggatcccgtgcgtgctgtgctgggtgccggcttcacgtcacgtcgcgtcacgtggtgcggtgccatcccatccgtgcgctagctggttggttcgccgccgctcggtgcgtcctgattcatcgcttcctccgttggcatctcatcttgctttgctttgcttgcttctccgtgacccgcgcggcaccgcccgtcggcgtcggcgcagggtacgcaggcacacacacacacacacacagtgcagcttcagtgattggttacgttacacggtgacggtacaggaagtagtacgagatacgatcatgtgttgtgtgtgtttttttatttgaaatcttatgttgtgttgtggtggttattagagttagcagagagtgaatcagagagatatggtttatttcattttcaatatactgtgcgaaaacctacgtagactagttttgtcgtcgtcactgctattagtattatgtagattaatcatagtatcataatgttactgtacgatgtggtgaatattggtagttcgttgg

SEQ ID NO: 2839 - DNA, 511 bp, Sorghum bicolor
  unsure (1)..(511): unsure at all n locations
  Clone ID: SORBI-28MAY03-CLUS4808_1
atgaatattaaatggatgttttttagtattttctctatctaatttcaaatccacatttcataatatttgacagtattcatacccacaaacaaaacaaggtatcgccaacctattcaaattttttctctctgtaatgaattaattttagtattttggtaaatatgataaaagttttaactctatttgtgtactaatttagttgttccaaaaatattgatacaacaaaataactatttgttttctactacttttatttgaatttcttcacttgacctattattttagtaaatacattaaaatttataatttagtttagatattggagattattagaagtgtaccttcatttagttcactttggttaacgatgaacttagtagtaaaattttattcatgtatgttgaatttaacaatatacactntgagagcagctaagtaaatatccgaatagaaataaatatctagcattagtgtggacattattcatttatatttatataanttgtatgca

SEQ ID NO: 2840 - DNA, 736 bp, Sorghum bicolor
  Clone ID: SORBI-28MAY03-CLUS48128_1
gcacgaggccgccgcctcgcccccggcccccgcccccgcctcccctcccaccaagcccgccgaggtccccgcgcccgcaccgtccaagaagaagaagtcctcctccaagaacaagaagaagaagtccaaggcccccgcccccgcccccgtcgtcgccgaggcacccaccagcaccaagaagtccaaggctaaggcgcctgcggccagcgaagccgatgcacccggcccggtcggcgatggcgccgccgccgacaccgcgggtgctggaaggaccgtggcaggcggaatcatggcgttggcgctgggcctcgtggccctgctcgcctaggcacggagcgcacgccgacggcgcgcgtgagcgggtggcgcctgcaccggctgcaccagcaccgcacggccagccagctgggtccccccgggacgacgacgagcagagttctgacgcagatgcatgcagccggtgcgccgtgcctttcggagtcggaccccgctggcgctcacgtccattgacggccacccgtctccggcgcggctgtgttcaattcttgtccgttgtttaaccgggccggtcgtgtagtcgtgtgtgtagtagtgcagtgccactcacattcggtgacggtgatacgtttggtgtggtgcggacgtaccaccgtcgcctcggattctttctccttctctttttctgtactactattgcgaccccattgagatgatttatttatatctttattatgcc

SEQ ID NO: 2841 - DNA, 601 bp, Sorghum bicolor
  unsure (1)..(601): unsure at all n locations
  Clone ID: LIB3481-048-Q6-K1-H3
tcgtcatcggcgagaacggccgtcggggggggaacgacgtctccatcctgcacggcgtcacgcctcggaggcacgggngaaggagtccggcgaccggcaccccaaggtcggggatggggtgctgatcggcgccggcgccagcgtgctctgcattgtgcggattggagccggggcgaagatcggagctggggcggtcgttctacgggacgtgccggagggaaccacggccgtcgggaaccccgcgaaggcggtcgggaagaaggcggtgccgcagcggcggccggaagagcagcccggggtgaccatggagcaagggtggtcggactacgtgatttgaaaattttcagagggtccgggtgcaaatatttttagtgcaggagaaggagagtttccctccaaaagatattcgtggtcgatggccatttccgctattctgtaatagtgctgctattgcagtattgcctacactagagactacagagagagctgcattcccatatgccattgcataagagggagagggagctcaattaggcattgagccctagagcaagtccatgttttttctgttcttttttcctctgtttctcgggacttaata

SEQ ID NO: 2842 - DNA, 575 bp, Sorghum bicolor
  unsure (1)..(575): unsure at all n locations
  Clone ID: LIB3481-060-Q6-K1-A10
ctcggnggcacggggnaaggatccggggacggggggggggggcgcgcattggctcgggcatcctgttcgaccacgccacgggcatcgtcatcggcgagacggccgtcgtcgggagccggggcgaagatcggagctggggcggtcgttctacgggacgtgccggagggaaccacgggggggggggaccccgcgaaggcggtcgggaagaaggcggtgccgcagcggcggccggaagagcagcccggggtgaccatggagcaagggtggtcggactacgtgatttgaaaattttcagagggtccgggtgcaaatatttttagtgcaggagaaggagagtttccctccaaaagatattcgtggtcgatggccatttccgctattctgtaatagtgctgctattgcagtattgcctacactagagactacagagagagctgcattcccatatgccattgcataagagggagagggagctcaattaggcattgagccctagagcaagtccatgttttttctgttcttttttcctctggttntcgggacttaataacaatactatatgcatctcattagtt

SEQ ID NO: 2843 - DNA, 602 bp, Sorghum bicolor
  Clone ID: SORBI-28MAY03-CLUS47885_1
gcacgaggctcgccccccgaagaggcgaagcggcgccccgggtgaatgccgatggccgcggcttcgccggagaagctccactgcggcgaggtggggaccggtgacgaagaaaaggaggacgcggagagggctgatgccgaggtgatagcgcagcaactgtcgaatcaatcgctgcgggagaaggcacagcgcctccagggcctgctcaccgaaggcacgtccgaacgcctccctgaccgcggtaggaagctgcgcgccacactcgttgccatctaccgggagcaagaccgccgccaggcccgaggcgacagggcacgagcgccgggcaatgaagcatgtgaaaggagagtccgatcgaggtgtattgaatcatcgggtttgcgtagtgacctcagtagagttgaagtatcagtggctgatttcatgtcttcatttggagcggataaagaggcaggcatcaacatatctagtttgggaataaaaagttggagcccaaaccagcctagcactttgataggagacaaggggaagttatgtgaagagaaagactcttgtgaagcctctttacaaccaatgaattcagttcatgaagagtggcatct

SEQ ID NO: 2844 - DNA, 719 bp, Sorghum bicolor
  Clone ID: SORBI-28MAY03-CLUS479_1
gcacgagggcgcctccaaagcgctgaaatatatgctcaatcaagtccgcctttagacgacgatgcatatctcgatcacgtatgccttcttgtatctctagagccctagcaaatccatgaatgggcccatgtccatataacaatggtgcagatgagctactctcgtggttctcatgctcgtagttgtcatcatatcgaactctaaaagaatccctttcatcctccacaatcatgttatgcaatataacatgcataaataatttcagcgagtgatcgcacttgccacatacgtgctgggcttcgttgaatggcaaatcgagcttgcaaaacaccaaaagcacgttccacatcttttcttgctccctcttggtgttctgcaaataatttgtcttttccacactgaggcaaatgaattgttttcacaaatggtgcccactctggataaataccatctgctaggtagtatcccatgttgtactcgttgccattgactgtgaaatgaacctctggagctcttccttgtactacatcagtgaacaaaggtgatcgattaaggacattgatatcattgtttgacccagcaaccccaaaaaatgcatgccatatccacaggtcatgtgaggcaactgcttctaacatgacagttggtccacattgatctccacgagtatattgtcccttccatgcccaccgacagttcctccattgccaatgcatgca

SEQ ID NO: 2845 - DNA, 596 bp, Sorghum bicolor
  Clone ID: SORBI-28MAY03-CLUS47903_1
gcacgagggtctacctccacttgtaacacggcgacttcttgaactctgcacgtggcttgcttctaaccatccttctgttgcggatcttttgatccatttcagtccctcagctagttcgaactgtttgacattacagcacaataaagagacatctcaagaaagtccaacgccgaacaggatgcaaccatcttcagagggttatacacctattctattgtttcttaagcttctaaataaacccttatttctgcggagtcgagtatatcttgagcaggtgatgtgtttgctggaagtagttgttaacaatgctgcatcccaaattgattgtccacctcactctgcacagataactaacagttcagatattgaattagttgatgggacaccatctcaaacacatgtggaaccatctactctggaacaaggtcatatcccggataataaccaaagcagagatgttgaggtcccaccaacttgtgctaaacagaatgataatgtgcatgaaatccttactcagcttcctgatgctgagttacataatctgtgcaatattcttgcacttgagggtcttccagataaagtgtactcacttgctg

SEQ ID NO: 2846 - DNA, 408 bp, Sorghum bicolor
  Clone ID: SORBI-28MAY03-CLUS48246_1
cgcatcagggtcaaacacatcctacggcgcagcagcagtgcgcccctatggctcagctcaggcgcaaccatcatatggacaaacacaggcaccatctgcgtatgggcacacacagctaccatcatcctttagtctagcacagtcacaatctcccttcactgctgcccaggggtcctctccctatgggctggctgcccaccctccagcatatggttctgggcgagcaggccctaatgctggcacctatgaagcttctcatggacgtaaataaatttgcaggcaaatttataatacttggctgctttcaaaagagagttttttgtcccctgagttaaaatcctttccgtagctactgaacccttgttgtttaactgtttggagatcccagaggaatccgttcccttcgtt

SEQ ID NO: 2847 - DNA, 659 bp, Sorghum bicolor
  Clone ID: SORBI-28MAY03-CLUS48260_1
ttaagtgatgaagataggaaggctcagctgaaattacatggtggacaagccgttaaaggaaaagattatgctggtgcttcaaaattctacactgaggcaatcatgttggaccctgctgacgcaacactgtattcaaatcggagcttctgccatctgaaaattggtggagccagggatgctctggttgatgctaatgcttgcataagcctgcagcctgactggccaaagggttactaccgtaaaggatctgccctcatgtcgcttaaggagtacaaagaagcacgtgatgcatttatggatgggttgagactggatccttcaaatttggacatacagaatgcttactgggaggcagacgaggcaatgatcaagaaacattctactggacaaagtgctgattagttacttgagtaggcttgggcgagtcacctgtttgtttcagaagtttctcgtacttcttgtcataaggggaattggatatgctcttatgttaccgtgtctcggaaatgtcttttttctgttggttggacgtactgtactcaccacctacaggtgtttttgaacagtgcctggacctatgtttctgccgcaactttggccagtaggcaattgtgtaaggacctttctccttttgcaacaaagaacctttgcctgtaatg

SEQ ID NO: 2848 - DNA, 549 bp, Sorghum bicolor
  Clone ID: SORBI-28MAY03-CLUS48268_1
tgcaaaacttttcaacatccagctgcatgcgctttgcacaaagttgagaggagaattcgctggagccagcataacttatgtggacatccacacaatcaaatacaacctgatcgccaactactctcgatatgggttcgagcatgccactcaagcatgctgtggatatggaggtccacccctgaactatgatggtaacgtaccatgtggacagacagtgtctgtgaatggtaagctggtaactgcaaaagggtgcagtgacactactgaattcgtcaattgggatggaatacactacacagaagctgcaaacttccatattgcatcgcagatcctgaccgggaaatactctgatcctccgtttgtggataagatgccattcgtcctaaaacctagattctgattagcatacacttacctttttcccctttactcaaccactttaacagcattggttgcagatacgatgtactccgtagttattacttgtcaataaccatatatagcatgatgtcaaaaataaaatcatatatggcttggtttcagttgcct

SEQ ID NO: 2849 - DNA, 773 bp, Sorghum bicolor
  Clone ID: SORBI-28MAY03-CLUS48293_1
gcacgaggcaggggcgggtacccggacctgcagcaggcgcccatggcggcgccgcgcgtcgagaagttctccgcagcggctgagaaagcaagagttaagagcaatgtgctcaccaaggaggcttcggtgccaaaggatgccaacggcaatgccatctcggcgcagactttcaccttccgtgagctcgccaccgctaccaggaacttcaggcctgagtgcttcctgggagagggaggttttggacgtgtttacaagggcccccgggagagcacaggccaggttgttgctataaagcagcttaacagggatgggcttcaaggaaacagagaatttctagtagaagttctcatgctcagcttactacatcatcaaaacctggttaatttgattggttattgtgctgatggagaccagcgacttcttgtttatgaatatatgccctccggatcactggaagatcatttgcatgatctacctcttgataaggaggccttggactggaacaccaggatgaaaattgcagcaggtgctgccaaaggacttgagtaccttcatgacaaagctaatccgccagttatttatagggatttcaagtcatcaaacattctgttggatgaaagtttccacccgaagctgtctgactttggacttgctaagttgggtccagttggcgacaaatcacatgtctcaacacgtgtaatgggtacatatggttattgtgcaccagaatatgctatgacagggcagctaacagtgaagtctgatgtgtatag

SEQ ID NO: 2850 - DNA, 577 bp, Sorghum bicolor
  Clone ID: SORBI-28MAY03-CLUS48294_1
ctctgcaatgactgcccagccggtggtgttggcatttacaacccaggattctggggcatgaacatagaagatgggaaggcatacaatctagttatgtatgttaagtcgccaaaaaatacatgcttgacagtttcactaacaagctcagatgggttgcaaaatctggcttccgttaacataatagttgcagggaagtcgaagtggataaaggtggagaagaagttggttgctaaaggaactaatagaacctcaaggcttcaaataacatctaagaagaaaggagttgtgtggtttgaccaagtatcactcatgcctgcagacacatacaaggtgtattatgtttttgttggatcttgataatgaaactctgtaagacataaaccagaacaaataggaagtgtaaaattttaataataacacatatagatgaatatattgtactaattaaacctgtgattatgatgcagtggccaactacttctgcctggcacaagagaaatatgccccccctgtaacacaaaagggatttgcttcatgctctttttagtactgctaataattcagtcatgtgcccatg

SEQ ID NO: 2851 - DNA, 554 bp, Sorghum bicolor
  Clone ID: SORBI-28MAY03-CLUS48296_1
aaaaaaaaattccttcctctatgctcgcgccatccctttcccctctctttctctctctcctctaccctctctctaaaagactggatacagaacgaggaaaacatatagaaaggaaaggaagaagggaagaagaacaccaaccaagcagggcttggtttttgagaacttcatgggctgtggaattgtccccaggaatccgctctgggtttgacgagattcatacagaaacacagttcttgattttttttcccctttcttttgctcaagaatttacctgtacaggcgaaactgcttgtttgtgctttgtttttcccgttttgttttctggggattttcctctggtccgttcttcttcacctgtgaggtggtgaggagcagagagaatcatggggaagcaaggaccctgccgtcattgcggagtcacaagtactcccctgtggcgaaatgggccaccagataagccggtgctctgcaatgcttgtggctcgagatggagaacgaagggttcattggcaaactacaccccaatgcaccgcaaggacgatattgatgat

SEQ ID NO: 2852 - DNA, 430 bp, Sorghum bicolor
  Clone ID: SORBI-28MAY03-CLUS48303_1
gcacgaggccggcacccaccaccgcctccacgtcgccgtcctccttccccaataccacgccactcccacagaaatcctcacccaaaatctcgcctcccagatcgatcgccacccttatcgccgtgcgtaaaccctagcgggcacggcagccgcgactcccgcgattcaccaccagcggcggcctcgctcccctcgaccgatggcggcgctgcccttctccacttgaggacgatggccctgctcccatggaggcatgccctccgccggccactgctgcctagtcacggtcgcggccagaccgagggatggtgagaagcagcgggttgggctgatccaacgcggtcggcctggatccggcttgtggagggcgagagatgaggactgctgagttattcgatctcggttgatcatcttgccgccgccggagcca

SEQ ID NO: 2853 - DNA, 569 bp, Sorghum bicolor
  Clone ID: SORBI-28MAY03-CLUS47980_1
gcacgaggcttcctctgcctgcccgtcgtcctctggcgtgccggttcctgggtgcccgcggcccgccgtgcctgccgtcgcacctcgccgtcgtttgcggtctctctgtccttacttcctctgtttgcccgccgtcttctgccgcgctgattcctgggtggcggcggctcggcgtgcctgccggcgcgcctcgccgtcgtttgcggcctccgcgggataccgtgccggacaaatcgcgccgccatgtttcgtcgtttcagtttcggggttgccacgacccggcgtgcgtgctgccgttgccgtgtcccggcgtccttcggtttctagagctgttgagttcagcagatcggtcgtgcggccagtgcacagtttcctgttcttccggctggatcgacctgttggtctatattctcggtttgtgctctgctccttcataaattcctgcttcttgtgtgcgattgatttgagatcttgtacaatgcaatgattaaacacaccaagcgtatttgttgtctgtgcctgtgcgtcttcatgtagagtacagttgattgttaggtgattggattgtc

SEQ ID NO: 2854 - DNA, 649 bp, Sorghum bicolor
  Clone ID: SORBI-28MAY03-CLUS48001_1
cttggcatcccagcaatatgatcccaacacagctcttgcttcaaggaagccaggtggcgatcaacgaagcaggcctggtgagaacggcagggtggtttccaggaatgacgagactggaagctcgggccacaaatcacctggcaaggaccgggaggactcacccagggacctcccagcgatcctgaacaaggacctggaacgtgagcgcatggtggcggaggcgaagatgtggggcgaccgggagcgcatggttgccgaggcgaagatgtggggcgaccgggagcgcatggtggccgaggcgaagatgtggggcgagaattggcgtgataagcggcgtgcagagaatgggcaggggagcctggactagccgccgactgggaacagcagctagggggcaagcgaacagaaacgaggctttccacacaccccacccatgcgtatcgtttggtttatttccaggtcgattttcgttcgctctggcggtggctggcaggggccagggcagggaggggttagatgtacattcctagggcaaggaaagggtggggaaaacggcggcgttgtactggatagtgaatgcatgtggttgtacttgtaaattctcagaaaaattttgtgagaatgaaaggacgcatttgagttccacttg

SEQ ID NO: 2855 - DNA, 459 bp, Sorghum bicolor
  Clone ID: SORBI-28MAY03-CLUS48002_1
ttctctagcagcgtctgcaattacctggaaggattcagagaataactcattcctaagagtaaagattgtaaactttgaatctgatgctgctagagtcacaatctccacaactggacttgaatctagcattgatgtgctgcgatcgaccgccactgttctcacatcaaccaatgtgatggatgaaaattctttcagtaacccaaacaaggtcgtgcctgttaagagccagctattcgaagcaggagcgcagatgcaagtcacgctggctcctcactcattcacatccttcgatcttgctctggctccgtccaaatttgccacgttggctgatgtctgaacagtgatacccccatttgtcagtactaattgaggagatgtcagtatagttgtaaagaattgtgtactgtaacgtcgatgataaactgaataaaaatgacactgcaattcaggtttttatct

SEQ ID NO: 2856 - DNA, 542 bp, Sorghum bicolor
  Clone ID: SORBI-28MAY03-CLUS48003_1
ctggaggagcacttaatttattcatgttacccccagaaaagttatcattactggtccctcctgagtatgccgactctgatcaagacttgctgctggagatacctctcaatgcacgacacccagaggcagaacttctctgtcaaccatctcagctgatgagctctataacccgcagctccacctctggtgctgaaggagaagggtgcctgaagctaccatagtctcaggtcacatcaagcaagcagcttaggaacagccagtagtttcagtttactttagcctcctggatcgtggcgcctctatttgctgatcaccaatgggcgttatgcgtccgtcattgccctaatttacataacaatgtgcgtggtctgccaacttggcgaattgtccgttcagctaacattgtagcatgcttttggatcgggtttctgctggttttctgtagcatatggctcatggagaaagtattaacttatctctgtgtggaaaagatataaccttattgcaggaaaatgaaaaaaaagaaagaggatattggagtt

SEQ ID NO: 2857 - DNA, 756 bp, Sorghum bicolor
  unsure (1)..(756): unsure at all n locations
  Clone ID: SORBI-28MAY03-CLUS48379_1
gcacgagggaaaaccgcattgtcaagaactttcagcaggagctcacacaatccaggctgggttcagaagtttctgatgcatcctatggctcaactgccctgggcaagggacgcaaagtccagatcagaaggctcgcagaatgggttggaacctgggatacctgaacccgagtataatgtgaccacgagccttcagtgggctcatggaaaggcaggggaagatagggttcatgttgttctatccgaagagcaaggatggctgttcattggaatctatgatggttttagcggccctgatgcacctgactttctaatgagcaatctatacaaggccattgataaagaactggaaggactgctctgggtttacgaagacagctctgaaaggtgtgaccatgtatctaatcttgaagagggtgaatcagcttctgcttctgtggatgctcctcatgatgataatggccagttccagagtgacaatgggaaacaagaacagcttggtaattttggaaaacaaaatgtctcacctggaaagggttgtgatgaaagtgtcttgcaagttcaaccaaactgtaccagctgtgaagagaaagatttggctgcacaggattcaagtagtcagaagttgggcagggatgagatagttgaggaaatggctggagctgatctgggaaatgatctccanagtagagaatctcacaactcgaacagcggtctttctggtacagatctaaacaccagctgtacctgtgcaaca

SEQ ID NO: 2858 - DNA, 453 bp, Sorghum bicolor
  Clone ID: SORBI-28MAY03-CLUS48385_1
gcacgaggccttttcgcctcgccacatcgcagagctcacagcaagggaagccaccgcagatctcaccaccactccaacacagttggatcaagcgaagccgcgtagtgttttagtccgatagagcggtgaagggagccatgacggagctgttcgacacggccgtgaccagcctcctccacctgccggaggtgctcgaccgcctcgccgccgcggacggcgaccggcgctcgggtggccaccacgctgcgcaccaccacgggcacgcacgcgtccacgggctcggtggcggcggcggcggcggcgcgccggtggacatcgtagagacccctggcgagtacacgttcgtgctcgacgtgcctggcctctccaagtccgacatccaggtgacgctggaggaggaccgtgtgctggtgatgaagggcggcagcgggaagcggaagcgcgaggaggagg

SEQ ID NO: 2859 - DNA, 605 bp, Sorghum bicolor
  Clone ID: SORBI-28MAY03-CLUS48386_1
gcacgagggtctccgcagaatcgagcccaaccttcttcggtggcagagcgccggcgctaggatgtcatccgctacctcaggcgactccttggctccttccttggctgcgaggtgctccctcgcccgttgtgcccttggtcgagcaaagatcccaatgcccctagctcccccgctcaaagatctcgcctccgcagctcaccccacggccttcggcgtaccagcagaggcaacgctgcatcccagcggtggttgcccagctccgcagctcgccgcgccccaactccgccccgtcgttgcccattgctcttgcagcaccgccccaccatgattccaggtgtgaggcaggcatgaaggatccgcacgcgcgacatgatcgagatctgctggtcaccatgcaaaaccctaggccgagatctgtggtgtcctccatgaagcagcagatggtggaggagctgctcctgtgggtggaggagctgctcctatgggtggaggagctagagcaggtgaatgcatgactgctcggcgagaaggaggccgcgaagaaattgagtaattctgcattttagccaacttgtccctattgttcatctccctcccactctcgc

SEQ ID NO: 2860 - DNA, 644 bp, Sorghum bicolor
  Clone ID: SORBI-28MAY03-CLUS48393_1
gcacgaggggcagattggtctcccggttggcccgccctggttctgggccgtgggccgctactccggaacaggaggctcttccccgcgttgtggctcccgcctctgcccggggcgtccgctcctccacccatctcccggctccctcggccggcggcctccgggctcgccgcgccgcaacggaccggggaaccggatcccctgtctccgccctcctccgtgcctcggccacccacctccccgaccccctgcgtgcgccctggctgccgcctccccccctggctgcgggggcttcgccgacctgccgcctgctgcgggcggccaggtccttgcccgcctcggggcgatgcaccgtggatttgctccctggcccccctcccgccggccggcccgtccccctgttcgtctcggctggtcggagtttcactgccggccgcgggggcttccagaccttcccgacgccctgaatgggcccttgttgcctggtgcccccctagatgggaagtcttggaaaacatttttcgtggagcgggagttcaggagtaaatcattcatgggtagattcaatgtggatattctccgtggccacaatgaggatgttcgagccgtcttccttttggtatcagcaaatctgatattcactggcg

SEQ ID NO: 2861 - DNA, 634 bp, Sorghum bicolor
  Clone ID: SORBI-28MAY03-CLUS48398_1
gcacgaggccgggccgcgcaatgccgccctctgtcgacgcgcccccggcccccccaccccgtcccgcccccgccgccccccccgcgcgcgtcgcctcccccgccccccgccgcgcgcacgccgccgccgccggcctcgggcgctccatctccgccgacgtcctccgcgcccccccctcccccccccacctccccggcgccgtcccccccctcgtctccctcgccgcgcccggccccccccacccccccgccgccgacctcccgccctcggcgcgcccgctcctccgccgcttcttcgtcggccgcctctccgactacaccgtctcccccgcgtccgccgactaccgccgcctcctcgcgcagctctcctccgcgggcctcttcgagcgcgtcggccccacccccaaggtccagctcgccctcatggccgtcctcttctacgccgcgctctacctcgtcctcgcctgcgccaccgcctccgcgcacctcctcgcgggggggctcatcggcttcgtctggatccagtccggctggatgggccacgactcgggccaccaccgcatcacgggccacccgctcctcgaccgcgtcgtccaggtgctctccggcaactgcctcaccggcctcagcatcgc

SEQ ID NO: 2862 - DNA, 495 bp, Sorghum bicolor
  Clone ID: SORBI-28MAY03-CLUS4841_1
cgcacaccactccacctggctgcatgggctgggcatgttgatgttgtgagatgcctttgcaagcacaaagctgatgtgggagctgcagcaatggacgacacagcggcgattcattttgcttcccagaaaggccatgtagaagtggcccgtgagcttctggcatctggggcctctgtgagagcaaagaatcggaaaggcttcacagcactgcactttgctgcgcagaattcccacctagatcttgtgaagtaccttgtgaagagaggcattgacgtcacaacaaagactaaaggtggccagacagctctacatgtcgctgaggatgatgaagtgcgtgcgttcctgaaggagtgcgagcagtccatgaagaagggagccgaactaccatcagagaagaaggatgattctgccgagaaagagggtgacagcaagtcttcaggtgaggttatgaaagagggggagggtggcgggcagggccacaagccggaaaatgaa

SEQ ID NO: 2863 - DNA, 1113 bp, Sorghum bicolor
  Clone ID: SORBI-28MAY03-CLUS48539_1
gcacgagggttctcctttcgccggaatctgtccctccccgccctcctcctctcgcctctgcgggtactggaccaccgtggagcgggcatccatccgggcctcgtccattccttcctttgcttccatccatggatggactaggttcgtcttctccatcgcggaagctcaacccaagttgacgccagaagagaatcggtgccctagctgttcgcgcaggtcccttcgcgcagaagatttggggatcgagtcgaaccctatgtcccgctttaagcctgccgccggcctgcccccttaccaccaccgggcgctccccggtcctggacccggccatgggcaaggtccagttcccacggcgcatgggatgatgcaccgggaggtccgtgacccgtacgggccaccggggccggggatgcacctaccgccgccgggtcaggggcctggtccgttcccctacgacatgctgcccccgccggaggtcctggagcagaagcttgtggcgcagcgcggggagatgcagaagctggccgtggagaacgaccggcttgctgcgagccacgcctcgctgaggaaggagctggctgcggcgcagcaggagctgcagaggctgcaggcgcagggggaggctgcgaaagccgccgaggagcaggagatgaggggcctccttgataaggttgggaagatggaggccgacctgaaggcctgtgagaacgtgaaggtggagctgcagcaggcgcacgctgaagcgcagaaccttgtgactgtgaggcagagcatgatggccaatgtgcagaagctgagcaaggacctgcagaggaacctcggtgaggcgcagcagcttcgggcactcgtggctgaacgggatgctgcaaggcaagaaaatcagcacctcaggaatacgtatgattacgaaaggaaactcagggtggatcactctgagtctttgcagacaatgaagaggaattatgagtccatggttacggagcttgaaaaacttcgtgctgagttgagggacacgtctaatcttgacagaagtggttttttctacaataataccacccaaaatgctgatggtatatctagccaactttctgttggacaaatttcttatgatag

SEQ ID NO: 2864 - DNA, 198 bp, Sorghum bicolor
  Clone ID: SORBI-28MAY03-CLUS48154_1
tcgaactgatggaactcatgcttgacaaagtgacccttatcctggaagaggtgaaggattgccccacttcatacggtttgtacaatagtgttccaattttttttcctcaggtgatacacgaactgttagcagtacggattttagttctttttgggttgtaatgctacaaaagaatttgttagtatatatagccaatcc

SEQ ID NO: 2865 - DNA, 469 bp, Sorghum bicolor
  Clone ID: SORBI-28MAY03-CLUS48184_1
ggtcctgcctgcggtgaagcgcaacaaggagggactcgaagaggtgattgctcgcatgcacgaggcgctggagaggaagaagaaggagatccccgagttcgagctcaagtacaagatcaggatccggaaggctgacaatgacgccgaggacgaaggcggcaagaaggaaggcactgctcagggagtccttgtcggtcctccctgccagtaaaacttgattagagagccctgcatgctactagtattttatatggtgcccaggatactcttcgctactcagggagtagatgtgtgtgtgttttggggtgacatgcttctgtagaacccagcgattttgtgtaaaagaatgaggacccgatgtgaactgaaatagtttggcaggttgagtcagggtttgtttctttattgttcttcgggtgctgagtatttctgtttgttgatgactgattgcaaattttccgggccccca

SEQ ID NO: 2866 - DNA, 691 bp, Sorghum bicolor
  unsure (1)..(691): unsure at all n locations
  Clone ID: SORBI-28MAY03-CLUS48225_1
gcagaagctgcaggctgaggactgtttctttgtgtacagaatggtggtagttctcttcaggagagagctcacttttgagcaaactgtgtgcctgtgggaggttatgtgggctgaccaggcagctatacgagctgggattgggaggtccacctggggaaggataagactgcgtgctcctccaactgacgacttgttactttatgccatcgccgcttgtgtcctgcagaggaggaagctaataattgnagaagtatagcagcatggatgagatactgcgagaatgcaacagcatggccgggcaactagatgtctggaggctgctagatgatgcacatgacctggttgttaaccttcatgataaaatctgatctggtggtgagtgctgttctccgctctaatggcagaacaggtgtaagcctcaacctcaacagaagaagaaaaaaaggtggttcctttaccacctactgaaagaattctattatctgctatttgttcccagacagaaccaacttctaggtatagagaatgttgtaacttagagtgaggactcgagtgtcctcgcaaagaaaaggctgaaagattgtttggtgttagtgaggcactgtgaactgttcgttgtttaacttgttataggcaaaaacagagtttcctgggatgccacttcatcaattttatgcatccgcgctcaagt

SEQ ID NO: 2867 - DNA, 505 bp, Sorghum bicolor
  Clone ID: SORBI-28MAY03-CLUS48447_1
gcacgaggccccgacgccctcgtcggggatcccggatctgtcgtcgagggagccgccggggcgccgcgacggccgatgcgatcagcagcatccctgccgcgctgccagaatcggcaacgaatcggctgacgcggtaactagtctccctcccgccgggctcccagccgatgggcgcctgcggattcaccgtggtcgtcgtgctgctactgctcgcctcggcgctactccctgcccctgcttctgcttcaggtagaagccttccggaaggcgatgaacccaactccggcgagcacgctcctgcacctaccggttctgggcagtcttcagctgcggggcagcaggcaccattgcaatcaccatcgaaggataccaagggaaggagtgagccacaggcatctgcatcaacaccgccgccgccgctcacgaaggagactaatttgcagaaggcggccagtcctgcccctggaggtccaggaccgaatggcgggacgaaccctgaggacac

SEQ ID NO: 2868 - DNA, 577 bp, Sorghum bicolor
  Clone ID: SORBI-28MAY03-CLUS48464_1
gcacgaggttagagtgagagttcgtgatattagcttagcaaatttcaaataaaataatatcctacatccttgacctggctataatatcccatgatcagattgtagctgtagtagtttagctggtgtaattcaagtaactagtctttgaactgtgatgcaatagtggatgcttacgtataaattgtatatgttatgagaagacttaacccttctaggctagcactcaagccttcttaatttcaaaattatttgttagcaaagatatttgatctttttatagagtcatagctgattgaatgctctccatatagctaggcacttcaacaataacaatctcagtggatcttttcctcatgaatcgtcacttttaagaaatctgaagtccctgtggatatttgataataacgtcgaagggcttattccagaatttattcagaacttaaccagtctcacagatttgcgtatatatgggacaaaacttcaaggacctatcccaaaaaaaatctcaaatttgaccaatctagaagtcctgatgcttggtgatcttggtggcaaccattcttattttgatgtcata

SEQ ID NO: 2869 - DNA, 401 bp, Sorghum bicolor
  unsure (1)..(401): unsure at all n locations
  Clone ID: SORBI-28MAY03-CLUS4848_1
caacaaccataagagaaaacataatatatgcaaggcacaatgcaactgaatctgagatgaaagaagctgccaggatcgcgaatgcccatcacttcatcagtagcctgcctcatggttatgatacacatgtgggaatgcgtggggtggatttgactcctgggcagaagcagcgcattgccattgctcgtgtggtgttaaagaatgcgcccattttgctgcttgacgaagccagctcagctatcgaatctgagtcgagtagggtggtccaggaagcccttgacactttgatcatggggaacaaaacaacgattttgatcgcgcacagggcagcgatgatgaagcatgtggatagcatcgttgngttaaatggtggtaggattgtngagcagggaagtnatgat

SEQ ID NO: 2870 - DNA, 824 bp, Sorghum bicolor
  Clone ID: SORBI-28MAY03-CLUS48502_1
cgaaaactgagagcacagattcgtgagcttgaagaagaaaaacaacgtctgaactcaaggatccaggttgaggaggctaaggttgaaagcactaagagagacaaggcagcaactgagaagttgcttcaagaaacaatagaaagaaatcagactgaacttgcagctcagaaggagttctacaccaatgctcttaatgcagctaaagaggctgaggcattggctgaagcaagagtcaacagcgaagccaaagttgaactggagaaccttttaagagaagctggtgaaaaagaaaatatgctgattaagacaatcgaggagttgaggcattctctcacccgacaagaacaggaggctgctttcagggaagaaagactaaaaagggaccatgatgatcttcaaaagcggtatcaagccagtgaacttcgttataatgaactagtgacacaagttcccgagtctactagaccgctcctaaggcaaattgaagcaatgcaggagacagctgctcgaagggaagaagcttgggctggtgtggagagaaccttaaactctcgccttcaggaagcagaagctaaagctgctgcttcagaagaaaaggagcggtctataaatgagcgactgtcgcaaactttatcccggataactgttcttgagacccagattacaattcttagaacagagcagacacagctgagccgatctcttgaaaaggagaggcagagagcatctgaaagtagacaggagtacctaacaattaaagaggagttggtgaaaatgacagaacaatgtgaaaagttacggacggaagccgcagctgtgcctgg

SEQ ID NO: 2871 - DNA, 608 bp, Sorghum bicolor
  Clone ID: SORBI-28MAY03-CLUS48509_1
ttcggcacgagggtccccttcgatctcctgctccctttcccctcctctccggctcccgcccctccctccctccctccctccctcctctctcttctgttcttcacctggagctgtgatcctcttcctaagtcccgagcgttggatggatacgtggttggctccacgccatctccttcggtggcgatgagctccggctgctgcttatgagatcttgctgaatgaattttgtggtttttgagccgtcctggtaaaccttggcatggccagtccagagacaagcgcagggaacacccagaggggggatacccttccaaatggtgacatctatgttggcaactttgctggtttagttcctcatggatttggaaagtatatgcggacagatggaactctttattatggcgagtgggatacaagcaagatgagtggtagaggagtaattcagtggccttcaggcgcttcatatgatggagatctctgtggaggtttcattgatggaacaggcactttcaaaggagttgatggatctgtttataaaggttcttggaggatgaacaaaaaacatggaatgggcacaatggtttatgccaatggtgatacttacgaag

SEQ ID NO: 2872 - DNA, 684 bp, Sorghum bicolor
  Clone ID: SORBI-28MAY03-CLUS48532_1
aagtcgcacttgcaaatgtgtcagatgttgcctttcaacagatctcatcaaccaacgttctgtccaaagccggaagccaactgatgattccaggtgctacacaatctgtactaactgaggaaatcccttcttgctcaacatcaccgcccgcggccaacaacggaaatcatttggcacacccaactattggcaggaacgagcattgcaaggtcaacatggagaaggtgcctcaatcgtctgctctgatgtcaattccaacatctagtgaagctgtaacaactccaataatgatgaaggaatcgtcgaagttgaaccataatctgaaggagaatgtaatcacctcaaagtcacccactgttgggactggacatgacaatcttttgaacattgtaccatcaacagaaaacctggaaacagcttcatcagcaacttcgttatggcctacccaaacagatggacttttgcatcaaggattccccacttctaacttgaaccagcaacaaatgttcaaagatgcacttgcagatgtggaaattcaagaagtggatccaactaacaatgctttctttgggatcaacaatgatggtccattgagctttcctatggaaacagaaggcttgttggtaagtgcacttaatcctgtgaagtgtcagactaatttgtcaactgatgttgagaacaatt

SEQ ID NO: 2873 - DNA, 657 bp, Sorghum bicolor
  Clone ID: SORBI-28MAY03-CLUS48304_1
atgccccgaccgctaggagctgcaggcggcgcacccggaggccgcagcagcagccacggatgaggaggcctccaatcgcggcgcgcgtgcgccgctcgctcttcctcctcctcctctgttgctgcctcaccgcctggtcgccgccgccgccggccgtccgcgcactcccgctgtgcaccgacgggcgggcgccggtgccgctgaacaggacgctgggcttctgctccgcttacggcggggccagcagcaggagcagctgctgcgacgctgccgcggacgccgcgctgcggaagaggttcgtcgccatgaacatctccgacgcggcctgcgctggcgtcgtcaagtccgtcctctgcgcggaatgcaatccattttcggctgagttgttcaactcaagctcaaaggttcagatggttcctctcctgtgcaattatacttcctcagcaagttctgctcaatcaaaagattctacacaagactactgtacactcgtttgggagacttgcaaaaatgtgacaatagtgaactctccttttgaacctcccttgcaaggaagtgcaagactgcctagttcatcatcaaagctcacagatgtctggcagtcagaagatgacttctgcacatcatttgggggctcatctggtgaccagtctctat

SEQ ID NO: 2874 - DNA, 326 bp, Sorghum bicolor
  Clone ID: SORBI-28MAY03-CLUS48316_1
gcacgaggcctttatccatgtatggaatatgagatatcctttcaatggatgctgatgaggttcaccgcaaaaagagatttacagagaggatgtcgagactcgaagaggaagaaaaaaatcaggcagatattaggaagaggaagttctttgcagaaattctaaatgcttctagggaacaccaggtgcagttagctaccacattcaagcaaagaaagcagcggaatgatggagttcacgcatggcatgttcgggcacgtcaacgtatctcacggccagagaagagtaggttgaatcttctgaaaattggtgatcaagaatcatatatg

SEQ ID NO: 2875 - DNA, 613 bp, Sorghum bicolor
  Clone ID: SORBI-28MAY03-CLUS48369_1
attaaactctctctgctccctccggcccgccgccgtccggcgagcgccaaccacctgcctccttccaattcctctatttcactcgcctgcctccgcgcccccgcccgcccaccctccctccctccccaatccatccaattcatggcggccacctccacctccggcagcgtcctcccaacacacaccaccccgtccgcccccacctaccctgcttcttcctccaccaccaagcccccgccgcacccacgccgccgctgcctctgcatctgcctcctcataaccctcgccctcctaaccgcgctcgccataaccctcctcgtcctcttcctcaccgtcctcaaagtccgagacccaaccacgcgtctcatctccacccagctctccggcatcgccccacgcctaaccttcccggcggtctcactccagctcaacgtcacgctcctcctcgtcgtgtccgtgcacaacccgaacccggcgtccttcgcgtacgactccggcggccacacggacctcacctaccgcggcgcccacgtcgggtccgcggagatcgacccgggacggatcccgagccgcggcgacgggaacgtcagcctcgccctcacgctccaggccg

SEQ ID NO: 2876 - DNA, 670 bp, Sorghum bicolor
  Clone ID: SORBI-28MAY03-CLUS48329_1
aaaggcacactgtccgtcactgacataagaaggaggagccttggagtctgtccgcgcggccccggcgcgctcccgcacccaccggaccaaccacatcggacttcgccggcggtgagcgcccgaagaggaagggaaccgaagatgggctgctccatgtcggggctcaacgcgctgtacgacgcgaccacgggcggcagcgacgtctggatcaacgaccgccgcttccgcatcctccgccagatcggcgagggcggcttcgccttcgtctacctcgtcagggagcaccagcccgcctccgatgccgcggtcgccaggcgtgacaccgcccacgtctcagaggatggaacgtatgccatgaagaaggtgctgatacagagcaaggagcagttggatctggtgagggaggagatccgtgtgtcgtccttgttcaatcaccccaaccttctgccgcttcttgatcatgccgtattagcggtcaagggagattggagccatgaagcatacctacttttccctgttcatttggatggtactttgttcgacaacgctaacatcatgctctcaagaaaggaattctattccacagctgatgttctgcaaatattccggcagatgtgtgaagggctgaaacacatgcacagctttgatcctccgtacgcccataatgatg

SEQ ID NO: 2877 - DNA, 669 bp, Sorghum bicolor
  Clone ID: SORBI-28MAY03-CLUS48554_1
agccttcttcccctctccttcctcctccagcctgccttcccctggaagcctccgcctcacagcactccaaaaccccaaaaacccccaacaaacccccgagccccaaccgctcctccatggcggcctggagctctcgcgagcacgacaagcagatggcggcgtccttgcgcatgatcgcctccgccatgggggggaccggaattagttcccagacgctggacgagatgaagcgcaccgtagccaaggcggattgcgacgcgagcaacgtcgtggaggtgcttgaaagaatggctgaagactctgacgaggaggagcacctggggccactgcatgatgcggcaggggcgggcaaaatggatgtttgcaaacacctggtggaaaatcttgggtttgatgtcgatgttcgtgctaatgatggctcggggaagactcctttgacttgtgcagtgtcacgtggcaaagtgattgctgtgaggtatcttattgccaagggtgcagatcttaataagcaagatgccatgggctttactcctctgcactatgctgtcaaaaaagggtacagtggaatagcacgtttgttgctctctagaggagctaatgtcgatgtggaatcttctgaagggacaccgctacatgtttctgctgcgcgtgggaagttcggtgtcatgg

SEQ ID NO: 2878 - DNA, 516 bp, Sorghum bicolor
  Clone ID: SORBI-28MAY03-CLUS48573_1
gcacgaggtccttctctgcctccgcgacgaggatggcggcttctacatggtttacaataccaaggccaaggccaactccatcgccgtcgtcccgcggcgagtttgctgctcattgacccacttccccatagcacgggtccgatggcagttccaaggggtcaccatcctacggctctccaccagcgaggagcacgatcaatacctcctcgccgagctcctcttccgcacggaagaccggagcggcctagaccccacaaacaaggccactctcttcttgtggaggtcgatcactgcctccgaccaagcagctcgtggccccatctgcaacccttacatctgcctcacccctgacaaagtcccccccttccctcaatgcttggacatgtacccccagcagtggatccccatggaggtggagctccccctccccactgacagagaccaccacccctccttccgtgcagacatgacgttggcaactggagcagccacgctctactgggttgaccttctgca

SEQ ID NO: 2879 - DNA, 888 bp, Sorghum bicolor
  Clone ID: SORBI-28MAY03-CLUS48605_1
gcacgaggacctggcttggttatacatacttatttataaggatgaagactaatcctctggtgtatgggataacttgcggaagaggttatgggagatccttctatgggtgcgaagcaaagaacatttattattgatgctgcacgtgcactggacaaagctaagatgatgcgctttgatgaaaagagtggtaacttctactgcactgaacttggtcgaattgcaagccacttttaccttcagtactccagtgttgagacttacaatgagatgcttcggcgtcacatgagtgaaagtgagctgattactatggtggcccacgccgctgaatttgagaatatcgtagtaagagaagaagaacaagatgaattagaaacccttgccaggaaagcatgccctttggaaattaagggtgggccgactgacaaacatgggaaaatttcaattctcatacaggtttatatttcccgtgctccaatcgatagttcctctttacattctgatgctcaatacattagtcaaagtttggcacgtattatgagggcactatttgagatttgtctgcgtcggggatggtctgagatgtcatccttattattacaatattgcaaggccgtggaccgcaagatatggccccatctccatccacttaggcagtttgataaggatctttctcctcagatattgtggaaactcgaggaaagaaatgttgatctggatcatctttatgagatggaggaaaatgaaattggagctttgatccggttttctcatcagggaaagttggttaagcaatacgctggatacttcccatatgtcaacctttctgcaaccgtgagcccaatcactaggacagttcttaaagtggacctgcatataactccctgattt

SEQ ID NO: 2880 - DNA, 735 bp, Sorghum bicolor
  unsure (1)..(735): unsure at all n locations
  Clone ID: SORBI-28MAY03-CLUS4870_1
gggcctcaagcggttcaagggggacgaggagaagctggcggatttcgtgcggcggtatgtggccagactgctcaaggcggataagctcgccgtgctcggtgagctggaacgccaggaggaggtcgacctggccgtcaagatgttcaggatcatacaaaaggaggactggtataagccagatatttatatgtacaaagacgtgattattgcactagccaaatgcaagaagatggaggaagcaatggtaatctgggggaacatgagagatgagaacttgtttcctgactcacagacttatgcggaagtaataagaggattcttgagatatggctccccatcagatgcaatgaatatttatgaggacatgaaaaagtcacctgatccaccagaagagttaccttttagggtattgttgaagggtcttttacctcacccattgctaagaaatagagtaaagcaagattttgaagagctgttcccagaaaggcatatctatgatcctccagaagaaatttttggcatgcactgaggtatattcagagacatgaatgcgtttatattgattggatggccatgttgccaaaaagcaataaatgggcgagactgagatgctgattattctgatttctgatagccagattattgtccatatcattgtgcaagtttttgttgttcagccaaccccattaatattgngccatctattcacctcaacaagtacaactttgcatggct

SEQ ID NO: 2881 - DNA, 648 bp, Sorghum bicolor
  Clone ID: SORBI-28MAY03-CLUS48790_1
ggttatagatacatgtactttggtgtaagtagctaatatctgagactttaggtagcttgaactttttaactaagctagaagttttttttggtcgtatcgatttattatatcacaatggcccaaaatttgcgatagagcatgctcatgatcttactgaacgctttgacctgatgcacatgttccaatgctttaacgactaaatgagtattggtgactgaagttctgataatgtacttggcaatttgctatgatggggaaaccatatgccaaagactgaatcgtgtgcatgaggccacagccgcaagtgttttgcaggttcactgttcatttcatgtagatttagaaggttctaagttcaccgggcttgatatgagctttttgaccttcatgtctgggagtcttgttacccaggaatgtgcaggaacatgcaaaagtaagcatgcaggtattgtttctggacgaaaatgaattagcttctggagtcgcacaacattgttaacctcgtctaagtgtagttaataacgtcaaaatgttgttagcggaatgactgtactgtttgtttatttaatgttctgtcaagctgttttatgtaaatgctaactgtatcgggttttcaccagcaaaatttattttagattatgttttggc

SEQ ID NO: 2882 - DNA, 512 bp, Sorghum bicolor
  Clone ID: SORBI-28MAY03-CLUS48915_1
ctgctacatttacttcacccgtgtcgtggtgtatgcgcttcagaccatcacctcgtaccggtacctgtggactagcgtcgtggccggggagctcgcgacgctcgcgttctatgtctttactgggtacaagttccggcctgaggtgcataacccatactttgccattgatgatgaggaagaggaggctgcagctgaggcactaaagttggatgatgaatttgagctatgagggtttagggattggcatctcctccatgccaatggtgatattggcgttgtatgtccccccccaggacaagtggcataggctggtatctttagtccatacccttttgtttcttctttggagttggctacattttgtcttactgtaattgggtattgacaacaactctgtgtgtgtgttaagcaatgcagcttggctttcccttaaattttatacacaatcattgagatgagctgtttccattctagatgttcactttgtttatatagttaaaactgaagttacg

SEQ ID NO: 2883 - DNA, 523 bp, Sorghum bicolor
  Clone ID: SORBI-28MAY03-CLUS4886_1
cttgaggtctcaggtacagaggctgcaaagctaccagaaactatcaagaacctggaagcccagctagaaagagccttagaagagaaatcagtacttgaagaccagatgaagcagctggagcaggttatgtctgaatctttggagaaacattcacatgagcagtcctctcttactgcagatcttttgaagttatctgaggcaaacgcttctcttgaaaacaaattgtccgctgtggcagcagagcttatgcaagtttatgctgacaaggaagaagaatctcttgaaaatgagaagcggatttctgtcctcaatcaagatattgctgatctcaggagaaagcttgaattattgtcatctgagaaagccacagttgatgatgagttggccaaactgctagctgatattacgactcgtgacgaaaagatgaagcagatggatgaccacttaactcagcttcagtttgagcatgccaagctgatggcagagtttgacactgcacacaggtccttgtcagagctgcgga

SEQ ID NO: 2884 - DNA, 717 bp, Sorghum bicolor
  Clone ID: SORBI-28MAY03-CLUS48419_1
gcacgaggctccgccgagcagcaagcactctgcagtctgcactcccagcccagtcctcgtcgcggcgtccccgagcttctctctcgtagtctcatccactcccccgacccgccgcccgctcgatcgcgacctaacggcagcgatgcacccccgcgccgcctcaggcgccaccgggaagtcgaccgcgccgtacgggtcctgggagtcgccgatcagcgccgctgtcgtctccgccgccgggaggaccgccgaggggttcgccatcgccggcgacggccggctcgtctgggtggagacgcgccccgaggatggagggcgcgcggtcctcgtgaaggaagcggcagaaccaggcggcaaggctcttgatgtgactccgcaggggttcgcggtgcggtccttggcgcacgagtacggtggcggggcattcgcggtgcaaggggataccgttgtgttctctaactacactgaccagcgtctgtacaagcaaacaatcggagataattcaccactaccgctgacaccagattatgctggatcagtagtacgctatgctgatggtgtctttgatccccatttccatcgtttcgtaactataatggaagattatcggcacaatagctcagatcccatcactacaatcgttgctgtaagaataagtgatcatgatgtcaaagaatctactatgctggtcagtggcaatgacttttatgccttccc

SEQ ID NO: 2885 - DNA, 429 bp, Sorghum bicolor
  Clone ID: SORBI-28MAY03-CLUS4843_1
cccacgcgtccgcccacgcgtccgggcagctcgtgctgacctacctctacctgctgatctacatctgcctctcgtcgggcgtcatcctgttcaacaaatgggtcctttctccaaagtacttcaaattcccctttcctatcacactcacaatgattcacatggcattttctggaatcgggactttcttccttgtccgagtttttaaggttgttgcacctgtgaagatgactttccatatatatgccacgtgtgtaattccaattagtgccttctttgcttcaagtctgtggtttggcaacacggcgtacttgtatatttccgtggctttcattcagatgctcaaggccttgatgcctgtagcaacatttataatggctgttttgtgtggtactgacaaattaagatgggatctcttcttgaacatgggat

SEQ ID NO: 2886 - DNA, 562 bp, Sorghum bicolor
  Clone ID: SORBI-28MAY03-CLUS48438_1
gcacgaggtgaacttcctcaccagtatatctggaagagttagcaagaagacgaagcttgtgttccgctttcttgacgaacgctctattgagccatcgacaagtcagacttatggctcaatgttgaaaaatctaacgtttgtcaagacttttgcctctggaatacttgttcccaaaagctatatctggcctgttacaccagataattacctgctgccttatacttcagttgttgatgatgctcacaaagcagggctggaaatctatgctgctgattttgcgaatgactttactatcagctataactacagctatgatccattagcagaatatctttccttcattgataatggtgccttctctgtcgatggtgtattgagtgattttccaattactccttcagaggcagttgattgctttagtaacctgaacaacagcaagatcgatcatgctaaacctctagttatctctcataatggtgctagcggtgactacccagactgcaccgaccaagcttatgaaaaggcagttgctgatggtgcagatgtcattgactgtcctgtt

SEQ ID NO: 2887 - DNA, 655 bp, Sorghum bicolor
  Clone ID: SORBI-28MAY03-CLUS48442_1
gcccgggggtccgccgcgtcggctcccctccccccccctcccccgccccccttctctgcccgtccccgccgcgtcctcgctgcgccgccgcccccccgcccgccgcggcccctcctcggcagcgctgcggggtctccgtgccgtccgccgtggcccgcgcttgctccctctgggtggtgggtcagcgtggcccggggacccccgcccgctccctgtggatcgtgcggcaccgagggcccccgtccgctgccctggggccgggatacgtgctggggtctcctgtcttgctctctcccctgctgaacgcggctcctttcccggtgctaccatctcctccctgctgtgtcgcgctatgtgttgttccttcttcgttccaggggttcccgcggcgttcggtcggcccggagtatgtgcttgtgtctgctgccttttcctctcacctgggcagcgctgcaccttccttggtgcgcgccgcggggcccccagattggtcacatcctccccgccggtgtgttttgccctggttgttgttccccgttccggctggtgctgctcaggccagttatactgtttcaacgtgaattccacaaaagcttgtgaaccgtgttgaagtagcagcaagtctacccttgcactgtatttgtaaatatatctg

SEQ ID NO: 2888 - DNA, 593 bp, Sorghum bicolor
  Clone ID: SORBI-28MAY03-CLUS48959_1
aaccaaactggcacattggaatgcgtggaacccagcaccgggctgtgatgtggagagtgtggaaggaaggtgggacaggattcctttattggggtaccaactgctatgagaaggctatgatcccaagtgctgagatctgtttccgacgtggccttcctcctggcgacggtgtcctgttttaccctggtgaagtgttttcttcgtcacatgaaccagttgcttccacccggctagagcgcattctcagtggcatgcaggacatcgaatacctgaagctttattcttcccggtatggaagggaggaaggcctggcccttatggagaagactggcatgtatcttggcccggatcgatatacgctggatcatggaccggtagatgtgatgcggggtgaggtataccgcacctgcaggtcttagtgcaatggctgccaaatgttcatgccctttcagtttagggcctttgttgtatatatagggttgtgtattatgttatctatgtagggatctaatctacccttgatgatcgatccgctcatcaaacctggactaaactagtcctggtgcatcttttgaatctggcttgagagttgc

SEQ ID NO: 2889 - DNA, 565 bp, Sorghum bicolor
  Clone ID: SORBI-28MAY03-CLUS48980_1
ccgaagccgccatcgcctggtcctccgaagccgaggccgccatcgcctggtcctccgaagccgcctgcgccgaagccgaagccgaagccttgcccgcctgccccgaagccgaagccgaagccgaagccaaaaccaccgacgcccaaggcgccgccaccgcccaagaagccgtgtccctgtccccccggcagcgacgaggtgaacaagaactgagaagcggtggatccgcctgtcaataaactcatatatattgtacgcagtgggagtacgccagttagttgctgcgagcaaagaagcaatgctatctccgttttctgtatactgtcatatacaccatatatatgaaccaaactgcccgctagtagttctataaatgaatgcatatgtgctgtactgaaatttatcttctatatcgtgcgcagagccacaacgcgcatatgtataacatacacatgtattcacctttaccctcttgttctttttttccctatcttttgcaaaaaccctcttggtctttgatgaataaaaatcggtgtaacgggaaaagatatagaccctttgtccc

SEQ ID NO: 2890 - DNA, 566 bp, Sorghum bicolor
  Clone ID: SORBI-28MAY03-CLUS49050_1
gaatcatagttgctgatggagcagaggacgtgactattaagattagtgatgaaggtggtggtataccaaggagtggcctctcaagaattttcacgtatctctatagtacagcagaaaaccctcctgatctggatggacataatgaaggagtaactatggctggatatggttatgggatccctattagtcgtctttatgctcgatatttcggtggggacttgcagatcatctctatggaaggatatggaactgatgcttacctccacttatcacggctgggagattcagaggaacccttgccttaaccgattcagaagaagccattcgattcagaagcagccattcctgtaattaggactctattgctttctcaattactgtgctggtattatgcaaatatagttctgatgaccagccacctatagtttcagctgttggtgtcctacttgttgtctttgttgttcattcatcatcttgatggaatgtgattatgattcagaatcgttttgcttctagtttgtactgtcattataattgttcgacctccaaaaatagttgccgtcgat

SEQ ID NO: 2891 - DNA, 826 bp, Sorghum bicolor
  unsure (1)..(826): unsure at all n locations
  Clone ID: SORBI-28MAY03-CLUS4906_1
gccggccgggccgggaaagcgcaggggaagacgacgaacctcgagcagcgcggccatggcgaagcagggggcgaagaagatgaaggacgagaacaagaagcgcttggaattactcttgcgcatcatcctcgtatccaacgctatttacatagtggtgaggatggctataatgcattcatccttcacttggaagcattggattggccttatggtaacatcagccgcatattttcttccatataagcaacttgccagtatggcaaagccagtttactctgataacggagaactactggatggtggcttcgatttgagcactggtggggtttgcgagtatttatatgatgtgatctacattactgtctttgtgcagctgatgtctattatttctgaaaaattttggtggacatatttagtgattccagcttttgctggatacaagattttcggtttgttgagaggaacatttttcagtggtggctcagagggtgaagttgaagatgagaagacccgaaagaaaagggagaagatggagaagaaggcatctagggggaagatgatcaaaactaggactcgctgatatgacagttgtgccctgttgcttaaatgttagggtggtttatcatagctgtccgactgaattccaagctgtttgtcnaatattctattgtgaattcgtgatagtgttcaatgatgacttgtttcaaacagtgagtattacgtaggaaaaatgccagctaatctccaacttgtctgatcaataagaaaatcctgngtattcctgactcttttttgaacacaagtcatacaccaacattgtggcacc

SEQ ID NO: 2892 - DNA, 677 bp, Sorghum bicolor
  Clone ID: SORBI-28MAY03-CLUS49063_1
cccaccatatgcaaatggaccaggctatgtgatttccggtgacatagcaaaattcatcgtgtcacagcatgccaatcagagtttaagactgtttaagatggaagatgtaagtatgggtctatgggttgagaaattcaatgcaacaaagcctgtccaatattcccacagctggaacttctgccagtatggttgcgtgttcaactactacacagcccactatcagtcacctaggcagatgctgtgcttgtgggataagttgatccgtggtcagccatcctgctgtaactacagatagctaagcgaagcgaaggattgctggactttgtcctctcttcatcataccccagccatgtttagtttggttggctggtattctcctttttgatccgatcaccggatcgacatcgatagtgtaggtgttgttgctcctccattgctggctcaatatgagctaaatgaatgggtgtgcgttagaaagatttaggaagctccaaccagttggttagtgtttttacacgatctttattggtccaactgtggcgttggcgtccttgttcttgtaattgatccaattttgatgtagtaggccagattagaatgtccagatcagatgtacgtcttcgttcttctcttatacaagttataactagacaaaatgtttcctgctcttgcagtct

SEQ ID NO: 2893 - DNA, 549 bp, Sorghum bicolor
  Clone ID: SORBI-28MAY03-CLUS49070_1
tggcaatgaggtggtccacctggtgaggtgggtgcagtcggtggtccgtgaggagtggaccgccgaggtgttcgacggtgagctgttgcggtaccccaacatcgaggaggagatggtggagatgctccagatcgcgatggcgtgtgtgtcgaggacccccgagcggcggcccaagatggcggacgtggtgaggacgatcgaggaggtgcggcggagcgacaccgggacgcggccgtccactgaggcctccactccggcagccattgaagcagcccagaactgggcagaaagctcatcggctgcgcaggaacggtgagagttcgtccaccggacgctcgcagccgcagctgctgattcgtagcttcttgtgttttgcttttccacggtaggagcacggatggtcgatcctgtgcttttggcgggtgctgtaccattcattcttttgtgttaagattcggtgttacgaaattgtaacagaatgtcacgtggacacggcggtccgatttggcagcaattgctcactgctgattactatctcttaagcgaagg

SEQ ID NO: 2894 - DNA, 686 bp, Sorghum bicolor
  Clone ID: SORBI-28MAY03-CLUS49073_1
gcagaacctgatgacaatgcagagcctgatgacatcgcggagcccctcatcacagtcgacgacagcatcgaagagagcttatggagcccttgcatggattatgagctagacaccatgtcaaggtctaactttggcagctcgattaatctgagcgagtggttcaatgatgcagacttcgacagcaacattggatgcctgttcgatgggtgttctgcggttgatgaaggcggcaaggatggtgtaggcctggcagatttcagtctgttggaagatttcagtctgtttgaagcaggtgatggtcagctgaaggatgttctttcagatatggaagagggaatccaacctccaacaatgatcagtgtgtgcaattgattctgaaacctatgcgtcgcgtgcgtgcctatgtgagatatccaaggaggttttcactttttaggtgtcctgtcttgggtatacttgatttgtccaatgccacagagccactgctgcaaaagcagctgaactttcttgtagaaagcccatggcagcttggcattagacaagtgtgttgatgttccttaattctttgaatttgttcgaggctgcttgactaaccttaagggtttgtcattgtcgcgcttagcctagattcaactaatcacatcctgaatctgaagtaattgtgcagtatcacaattttacatggc

SEQ ID NO: 2895 - DNA, 771 bp, Sorghum bicolor
  Clone ID: SORBI-28MAY03-CLUS48543_1
gcacgaggggagagccagcagcccagcactgtctccggcggcgacccacctaccaccccaccttccccttcccaagcggagcagtataacccagtagcccaacaacctcgctgaaacgcgccaccagccaacgagcaaagcaagagccgcagccggagctgctccaatggcatctttctcctccctcgctgccacctcctcctccacctccaccccgtctttcaccctccccacaaaaacctcccctggcacagcctccctgtcattccccagggcgagagagtcgctgaagtccagggccaggatggtgacggtgcgggcggaggcggttgacacgaccatcagcccgcgggtgagcgcgctcaggccgtccaagaccatggccatcaccgaccaggccacggcgctgcgacaggccggcgtgccagtcatcggactcgccgccggggagccagacttcgacacgccggccgtgatcgccgaggctgggatgaatgccatcagagatggggctacaagatacacgcctaatgccggaactctggagctgaggaaggctatctgcaaaaagcttgaggaggagaatggtctatcgtacacacccgatcaggtgctagtaagcaatggagccaagcagtgcattacacaagcagtgcttgctgtatgctcacctggtgatgaagttttgatacctgctccatattgggtcagctaccctgagatggctagactggctggtgcaacgccagttattctccctacaagcatatc

SEQ ID NO: 2896 - DNA, 857 bp, Sorghum bicolor
  Clone ID: SORBI-28MAY03-CLUS48545_1
attcacggcctcgccagccagcggcctccacctcctcctccccagaaggcagaagaaatttccccatttccgccgctcgcgatcggcgccgctgagttccccgaatcccgccccggaatcgcgaccgtacgccgtgagccttggggggccgccggtccggggctctgattcgcgggcggcgccgcggccgtggttcgcgcggggaatgctctatctcaagcagccgggcggcgcggacttagggttccggcggtcggcggtggctgctgcggctgcgcggcggtgatctgccgctctggcggatgcgagattgagccagcacgcgccggggattcggccggccatggcggggccggattgctgcctccagagcttcgagctctacgaggccgagtcgaaattttatattcttggaactaacactaacaagacaatatggagattactcaagattgatagaatggaaccatcagagctcaatgtagatgaggattctactgtacactcacagagtgactaccttgatcttctaaaaaatctagatcaagaacacaggtctactggtggagtcaaatttgtcaccaactgttttggaatcatcggtttcattaagttccttgggccctattacatgttaattattactgagcagagaaagattggggatatatttggtcatccggtgtaccaagttactaagactgcgatgattgagttatcaaattccaagacgaggccaaagttaatcaactccaaggacgagaacaggtacaagaagctcttgcagacaattgatcttcgaaaagacttcttttttagccactcatatcagataatgagaagtctccagaagaact

SEQ ID NO: 2897 - DNA, 407 bp, Sorghum bicolor
  Clone ID: SORBI-28MAY03-CLUS48547_1
gcacgaggtgagaaaccaagcaatcagagctctgccataattgtgaaatcctacacatcaaggctccctgttggtaatccggatgggacaatcattataagaactgaccagtacaaccgagatgatctcccaatcgactatacgtatgcaaagctctttgttatcaagtcaattggtgaggcagatgtgcacaaatcaataaagtatggtgtatggtcaagttcctccaatggaaacagcaagctagatagtgcattcagggatgctgacaggatatcaaggaggcattctactaaatgtccagttttcttgttcttctctgtaaatggtagtgggcacttttgtggcatggctgagatggttggtcctgttgattttcacaaggacatggacttctggtgtcagga

SEQ ID NO: 2898 - DNA, 1139 bp, Sorghum bicolor
  Clone ID: SORBI-28MAY03-CLUS49114_1
gcacgagggctactcctagctccctcctccatcattattccggcctgcaagcacacttgctcttgctcgatcattaattagttcgtcgctcgatcgatccctcgccctgcacgcagcaagccccgcccattctgctaccttctgcctgcgcatgcatctccctctcttccttcaattcatcagcaaagccttgccgcgcgccgcgtgcgtaacgtaccagctgctagtagtgcactagtgctacgccgccgccggctctctcgtcgtcgtcgtcgttgacgatcgtcgttcgtccagtatatatatatatatacaccaattaataggatcggataagaagaagaagctactagctagaacagataatggcggcggcgccgaggcccaagtcgccgcctgcctcgccggacccctgcggccgccaccgcctccagctcgccgtcgacgcgctccaccgggagatcagcttcctcgagggcgaaataagttccattgagggggtccacgctgcctccagatgctgcaaagaggttgatgagtttgttggaagtaatccggatccattcctaacgattcagccagagaaaggaagccatgatcaatctcagcagtttctgaagaagttccgagcaaagagctgcctgagctactacctctcgtggatctgctgctgcggcggtggcggtggcggtggcagtggcgggtggtgcccgccgtcgctgcagctcaagaggccagcggcgccgagctgctcctgcgcgccgcggctgaggaagctctgctgctgctgttgctgctgccggtgccgcgtggtgtacgccggcggcgccggcggctgcgggtgctgcgcgccgtgcccgcgctgctcgtgcgactgcacctgcgcctgcccgcgctgctgctcctgccccaggtgcagcgccgcgtgctgctgcgccccgcgctgctgcctgtgcctatgatggccacatgagaaattttgtgtgcatgctactacccggagaaccgtggttttgatgatggatgactggcattttgcagcatgttttttttttgtttagtgtcggcgacacgagtactattgctaacttgctgttctggttcgtgctgcatgctgattgctgaatggtgtcgattcc

SEQ ID NO: 2899 - DNA, 615 bp, Sorghum bicolor
  Clone ID: SORBI-28MAY03-CLUS49121_1
tttctcgcatccaccatcatccggcttcaatctttgcgatcgcgccaagattccaggctcgacactctctgttcttgtcttcttgagtgatgcaatgcaacgcaagccacctttgcttcagagcagctagtgagtgacccgtcaaacaacaagtgatgcaaccgttgtgcatgatgataagaggtttctgttttcatatatggataaatataggcagggttgaataatcggtaccaaggtgtaacaatggagatgaataactcttgaggattattacacctacatgtatgataatcggatctttgtgggagtgaaaccatctgcgagcgtcaaagtggagattcagagcttattctgctgctctgtcagttttcttcctcagcacctcctttgatggagggtaagagttgatgagtatatgatatatagcaagcaagtactagtatcaatgtagcaagggttgcaacacttgatcacattgtgtttgtgcctccctagaacaaacattggagccagcagctcaaattggagtttgttgtagtagcaaattgtagccatcatcagccatttgtaaatctgcgcgacttataaaagagcttctttgtagccctgagg

SEQ ID NO: 2900 - DNA, 707 bp, Sorghum bicolor
  Clone ID: SORBI-28MAY03-CLUS49149_1
tgtgtggtcacgtaagggctgtgttgatctcatttagtcactgtttttggtcgtgtgggatgttttccgtaactgctttggtcatgtgaggtctgtaaggttgcatagggtcattttcttggttatgtaaggttacataaggttgttctgttggtcatgtgtctccccttgtgcccttctttgctctgcctgcttcgccggttgggctcgccctggctcagcggtgcggcccgttcttgctcctagctgcggtctacgccccctctgctctgttccgcaggtgcctagaattttcttctggttgccaagatgcaggaatgccttgtcgcattgttggttaggttcctcatcttgtatgcagtttgcttgtgcattatccatatggatattgattgtgctttgtgtttagttaatgtggcttaacaagatcaacaacctagtataacaggtggttcagcccttctttggcaatgctgatggctggaaacttagaatgacatttgacattagacttagtagctcttcagatgcttgaaggctttgtatgttgaatgcattaatacacattatctgaaggtactttatattgagagagcgcctgttgaggataaactgagtaagaattgttgaattggtgctgtataagacttgcaaaggttcatgaaagtgtttttttttttctaggaaaggaacttcttatgattctc

SEQ ID NO: 2901 - DNA, 862 bp, Sorghum bicolor
  unsure (1)..(862): unsure at all n locations
  Clone ID: SORBI-28MAY03-CLUS49161_1
ccttggcttattgaatntactgtaagctaagttatgctatcaccattcttcacttataaaaatatgttaatgcttctcatatacaattatacactacagattcttcactctgaaaaagacaagacactctctatggatggtgaacatttttaccattttcatctaaaagaacaaaatataaccatttgtagttttcaaatagctaaacaatcttaagcaaatattaggtggagattgctctacaatgtttttaggtaaatagtttatattttatctgctagtatttttgtacttaactaatggtattattaatggttttgatcaaagcaggatgcattcggggttgtctaacctgtgctttccgtagggtggttcgtcctgtttggtgcctactgctgcagtattcttcatatacgggaatgttacaaagatcactatagtacccactagaattgtattaaagttacaaaatttcaagttactttggtaacaaataatgtttgtcaccaacttacttttatgctttgatcctagacaaacatagaaaatgttgcacatactttgatttgacaattttattgttcttcatgaacaaatacttaacaattttatattgaaaactataaaatgttattcttgacagggattaataattgaaaacatagtatgattttgtacttataacagctttacactttaactataaaaattcattgttcttgacagcgatatagtgtaggcactgccaagaaaaatgcaaaaaaaaaattgcaacaaggaacatgaaaagtctacgcaaaagtgatgcaaaaaaagaatgggaaaagtccacgcaaaaaaaagaaattatgaaaaggaatgg

SEQ ID NO: 2902 - DNA, 470 bp, Sorghum bicolor
  Clone ID: SORBI-28MAY03-CLUS49167_1
ggccaatttggtacagaatcagaccagtctgccagagtattgatgcgacacctgaaatatcgcaagatgaagatgccactttagccacaatcctacagagaaatggtagctgtgtcagcccaaatgacatatgtgcccaaatgacatatgtcctattgaccacggagatcatcagggagatacatcgtccacatattttccaggtggcctatccggatgcagtcaccatactgaatgcatgtgcttttacgaatattcagattaatggaccaccactaggaaggcagacctttcagaccgaagctccgaatttaagatcagcgcattcactcaatctatatatccatcaaccagcatgtataatccccccttatataaatcgcaccaaccattatgtacaaatatatgtacctatgatctatgtatgaaggggctctatgtatgtgctatctgatatatttcttccatgc

SEQ ID NO: 2903 - DNA, 984 bp, Sorghum bicolor
  Clone ID: SORBI-28MAY03-CLUS49177_1
tcttccatcttcgggcgtttagctgttgttgtacgcgtggtttgtatatcatgaacaaaatttgagtcagcaatcggcagaagaaaagtttcttttgtaaactgtgcatatataatggccgccaagagtccaagacgcatcactgagtgagactgagacagcaaccgaaaagaaacttggaagatggcgtgtgctcctatgaagataatctacctatataacctcaatcattcccccacttgatttgcaacgccaataaatgtgcaagaggctattccaacttggccgactgggatcaatcgaatacatcgtcttataaaattgaaatacctgtttggattttggaaaaagaagagacgaactaaacattttccaggaatatgaagacagttgtctgctcgatcattaattcaacagtaaacaaattaatttggcaaggtggccaagtacaaatgtatgtactactaatctatgaatctaacctaggtagggacgaagtgtcgtttgcgatcggagtaagagactcaaactaccaagcaagctacaacaatggccaaaagtgcatgaagctgagccatggtggtagcatgttttgcctgtcggcagaggtgggcgtggccttgctagcttcagtcgctgggcgcgtagagggagccgcagtagccctggggcagaggaagaagctcctgccctcaagctccatgagcttctcctccgggtccaagctttccaagctgaactgggagtaatggaggccgaacgcggaggggtcggcggacggcagcagcgggcgccgtccttccctgacgtagagccccaccgcggcggcgaccaggtccgcgacgcgccactcggcgcccgccatcacgtgcagcggccacatgctccgctgcacggcgacggtcaccagcgccttgctcggcgccgccctgatgctgccccacgggacagcagcatcggtggtggtggtggtagcgtggacga

SEQ ID NO: 2904 - DNA, 542 bp, Sorghum bicolor
  Clone ID: SORBI-28MAY03-CLUS51131_1
gcacgaggccgctttccccaccgcgattttcctcaagcgcgcgctcagcccgcgacaatttctccttcgcgccaattcctctccaccaggcgccaaatcctctccaccaggctccaaatcttctcctttcaatgactatttaagtttctctacaatttattctatgattttccatctgtcgtaaccctagcctgaatcagatgtctcgccggtcgaaaagagagatggcgtcgccgcctcagatttcctctccgtccgtccccatgatgcccgcggcacgaccaagagagatggcgccgccgcctcagatttcctctccgtccgcctcagatttcctctccgggcctgggtgttttcctacgccaccagcttccataaacaccacgatggggtctgcagctcccagcccttggtggtgcggcccgccggtgccccagcaaggtatgtcgtggtggcctgcacctagctgtggtggtggtgccactgcgtcgtcttcccaatcggtccagagagacgacatcgactctgatccaaaggaatgt

SEQ ID NO: 2905 - DNA, 331 bp, Sorghum bicolor
  unsure (1)..(331): unsure at all n locations
  Clone ID: SORBI-28MAY03-CLUS5115_1
gcacgttctatcatgaagttgcatggtgctaacagcacagagtttgatccaaccacaaaaacaccatgtgttattttcatgccagagggatccaaaacccatatgggggcaacaatgcgccttggatcaaggaggacctttttccaggtcactaactgcaaattttttaaactgtatgggggggttagctacattgatgaaaggcaccgccacagatacgaggtgaatcctgatatggtcccagaatttgagaaggcagggctttctttttttgggagggatgaaagcgggaaacgcatggagattattgaactaccaactnatagggttt

SEQ ID NO: 2906 - DNA, 478 bp, Sorghum bicolor
  Clone ID: SORBI-28MAY03-CLUS51156_1
gcacgaggatttctacaggggatgttggatatggtatctgttccattgacttctttccctgttccttcggcagtttgcattttgccagagcgttgcagatgtttggccgaaacatccatgatggtgaaactgaagagaaggatggtgagaaagaggatggtgatggagaaaagctcacatcgcacatgttctgcaagacactcacagcttctgatacaagcactcatgggggattctctgttcctcggcgggctgcagaggactgctttccaccattggactatgagcagcttaggccttcccaagagcttattgccaaggatttgcatggcatgaaatggaggttccgtcatatctatagaggtcaacctcgtaggcatcttctgacaactggatggagttcatttattaataagaagaaactagtctcaggggatgcagtcttgtttctgagaggtagtgatggcgagctaagatt

SEQ ID NO: 2907 - DNA, 656 bp, Sorghum bicolor
  Clone ID: SORBI-28MAY03-CLUS49240_1
gcacgaggggacaggaagcacttttcgatcaaggagcaaatacaagaggtgaatttcaatgtagaatcactccaatcacttgctcaagaggtgagggacggaaatgttgagctaaaagagaccataaaaaatcatgagggtgtaaaagccttgtacgttgataatctgatgctgctggagaggacgctggagaaaaatgctcatttggagagatcactttcagctgcaactactgaaattgaagccttgcgggagaagaaggctccattggaagaatcatgcaaacgccttcattccaaggttaatggccatcagtctgagagagccatgtttgttgcacggattgagggaatttctcataccagggagaagatatcagagaagaatgtcttctgggagaatttgttatctgataacaatactgagctggagttgcttagaaggaagctgaaagtttcagaggaatttactcacacattccgcagccagaattctgtatttcgatctgaaaaaagaactttgatgcgtgaggtggatagcatcaatagtgctctactcagtttggaaacccaatatgcagagttagaagggcgatatttggatcttgagcaagacaaagacaaggccctcaatgaagtgatcagattacgagagct

SEQ ID NO: 2908 - DNA, 529 bp, Sorghum bicolor
  Clone ID: SORBI-28MAY03-CLUS49247_1
tgcacgaggccagtctattatcaagagagctaggaaaaacaccatcacccgctttcataatcccgatgggactttctctatgacacaggagcaacttgcccgtactgctaatcaatacttcatggaaattttcagttctcaagattctaacaatgcaggatcagaagaacaagattggcccaatgatctggaacaaaattaggtaatcatagatgactcttttactaattcaactcccgacatgcaagaagtacacagtatcataaataatatgagagccaatgcagcgccgggaccagatggtttaaatgcagctttttataacgcctcttgggattggattgctaatgatgtctatgatcttgttgcatctttttataggtctggttatttgcctgctgaaattaattatactcgtatcactcttattccaaaaattaatgctcctcttactcccaaagactacagacctatcagcctttgtaacgtggcctacaagatcatagctaagtctcttgctgatagaatt

SEQ ID NO: 2909 - DNA, 694 bp, Sorghum bicolor
  Clone ID: SORBI-28MAY03-CLUS49250_1
tctggaactattataacatggctcgtatacggctggtgtgggctagaatagcgcctgggttggcccaacattttattgctgctggaagccaccatgaggagaaagttgcaatgtatgccattgattctctaagacagcttggtatgaagtacttggagcgtgctgaattaaacaacttcacatttcagagtgatatactgaagccttttgtcattttaatgaggaatagccacaactcaaaaatccgaggtttaattgttgattgcattgttcagttgatcaagtcaaaagttggtagcataaagtcggggtggcgttgcgtattcatgatatttactgcagcagctgatgatgaggatgaatcaattgttgagagtgcttttgaaactgtagaacaagttatcttggaacattttgaccaagttgttggcgattgcttcatggattgtgtcaactgtcttattggttttgcaaataacaagtgcactcctcggattagtttgaaggctattgctctcctgcgtatatgtgaagatcgtttggcagagggattcattccaggcggtgctgttaaacctattgatgttgttccagaggccaattctgatgtgactgagcactactggtttcctatgctggctggtttgtctgatttgactttggactccagaccagaagtcagacactgtgcact

SEQ ID NO: 2910 - DNA, 551 bp, Sorghum bicolor
  Clone ID: SORBI-28MAY03-CLUS49259_1
gcacgaggctcttatctcctccttcccttcccccacctgcaccgccccagcacagcctctccgccgccgtccgcctccgcaccatcgacacgcccgaccccgagcgcgtcgctgtccgctggtcgcgctggtacacgcaagtaataaaacattatatggcgctagtacagtttaacggtgccttggttcctcaactcggtgaaaaacctcggctgctatcctcgtcacctgcagttgcaagggctacctatgctgatgcaagattcctgacaccaaaaactggttcaagaggtagaggtaaacacctgctatcacctagttatagtttgcattcacagacctcttctgaacaactaaaccatgtaccatcgtcaagatttcgccagaaaaggggttcacgttttgttgtcagagctgaagctgatttttatagtgtacttggtgtctcaagagatgctagtaaatctgagatcaagagcgcctatcggaagcttgcgaggagctatcatccggatgtaaacaaagatccgggtgcagaacaaaagttcaag

SEQ ID NO: 2911 - DNA, 490 bp, Sorghum bicolor
  Clone ID: SORBI-28MAY03-CLUS4927_1
cccacgcgtccggctgcacctactgagtgcgcactgatcccgctattggtaccaaatggagatcagttggatggcacaacagaagataaaacaagaatccatgatcacataagcaacttaaagttctctatatcaccaacagcttttttccaggttaatactcttgctgcagaaagattgtatacccttgctggtgattgggctaatctcaattcagacacattactttttgatgtgtgctgtgggactggaactattggcctgaccttagcacatcgtgttggaatggttgttgggattgaaatgaatgaatcagcagtttcagatgctcacaaaaatgctcttatcaatggcataaaaaattgtcgctttgtttgtagtaaggctgaagatgtgatggggccccttctgacagaatatcttggttcaccacagcagcaggctgcagcttctgaaagtaattctgaaattgatgatacaaacaaaaatg

SEQ ID NO: 2912 - DNA, 620 bp, Sorghum bicolor
  Clone ID: SORBI-28MAY03-CLUS49287_1
gcacgaggcaggcacgctgcacctgcacgcaacagaggacggcgagaaagcaacacctcgcttcgttctctgatcgacatttttttgccgggaggagaagagaggagagtcggcagcgggaaccccagcggttcgttggatggaaggctgtaatggccacaacagcagcggcagcaggagccttgagagggcgatatccaggaaggcgatgcaggctgggagctctgctccctgtaaaacctggctcatcggcttcttctgcggcgtctgcatcacatgcctctttggtgtagtcgctctacctccgcttcgggtcattcagagccagtcggtctatccgctgccgctgcgccgagcgatcctctcgaattttacattcacccagcctgctgatggggcagcagcagcaacagatgagttgccttctgcaccagagaagatggaacaacaaaaggaaaacgagaacatcactgaagatgctaggataatgtacctgtacaatgaatggagcactttgctcagcactggcagagatgaagtcacgaaaagttcagatgggatctctaataaagattcagacttgccacggccacctcatctggaggactgcaggactaacg

SEQ ID NO: 2913 - DNA, 577 bp, Sorghum bicolor
  Clone ID: SORBI-28MAY03-CLUS49289_1
gcacgaggtatgcaaaatatgttaggtggagaagcagggcatgctgtcatctttgatggagttgacgccatccttgaggtgccgtggtgctctcctagcctaagaaagcttgttttcatggtgtttcccatgtcaagggtgccaagatggatgaagtcacttgtcaacatagaagaattaatgctgagaataaagaatttgggcgaggaaagtcattgcattcttggtgacctaccagctcttgtccatctaacactggagataataaacaacgttgaaggtgtacactggactgacaaacaacgacttgtggtcagcaacaggtatggatacagaagcttgaggcatttcagagtggcaataatagggttacggtttgtccgtcacagtatccccatgctgacgtttgaagctggatccatgccagagctggaagtactccatattgactttgatgcagatatgacaatttctgtgagtaatggccatcttgattttggtctcaagcatctctcccaactcaccgagatcgagttttatatattcggcaccaaacttaatggtttgcgtgtacaag

SEQ ID NO: 2914 - DNA, 713 bp, Sorghum bicolor
  Clone ID: SORBI-28MAY03-CLUS49093_1
gccctcggcctgggcgtgtaggaactttctgtgtcatctttctgctgactgaccacgctgtgcccgcctccgagggccctcggccgtcctggggcggccccttggttgtctacatcctgtgtactgagggctccgggttcgccccgcagtgcgcacagctgacctggggctccctctcaggcggagacggctgccgttgccggggctgcggtttggctcctcattgcgcacgacgaacttttcgccccctctcccgctgaggtgcccgcccttgccggggctgtgcactgggccttccttcgctgcctctttatcaatctctgttgtgctttgcctttccctgttccctttacgttgcgtctcagcctactgcacagcccacgcttctgtatcctcatcgcatcttctctgttcactttcatcctgctttggggccgggtgcccgcccccgggcgccagggacccggtggtagtttttctcttgggttattatgtttctttaagcttgtgttggtcttcacaaagatttgttacttacttttcaaatactgcagggaggaagaactattcaccacctcttcctaaaatgtgctctggcaaaacagatgaatgcacttgacattgcttctcagcctatttaacaatttatgttttacttttattttaattgttaacaaaacattgcttctcaacctatttaacaattcagtttt

SEQ ID NO: 2915 - DNA, 528 bp, Sorghum bicolor
  Clone ID: SORBI-28MAY03-CLUS49079_1
ccagtatgcagaagttatagtggagcagcgtcgtcaaacttgcaggttatatccatggaccagttcgccacctgccatatatgcctaggatctgttcatacccttcatttgttcgtatatgtaatcaaaagttacccgccagtgtgtctacagagtgtggcaatggacgcagcagatgcctattcattcattcataccgttttggtcgagaggtgcgttcaataagttactagtctagtgtccgttataggggagagttcgatattattattcttattttcattttcttcttctctttcaccctttttctctgggtaataattgggttacttggaaactgttggtcagtcggtcaggtcggttggtcagttagaatgtgaactggttgttgctgggtaagtatggtttgtttggtatattacaagtctgggaacagagagtgaggtcctgcttgtaacaagacctgctttggttttgtgattgagttatagtgctatatcctgaaacccaaattccctggtgccattt

SEQ ID NO: 2916 - DNA, 548 bp, Sorghum bicolor
  Clone ID: SORBI-28MAY03-CLUS49098_1
cgcttcctcgcggcggcggccgacatgaaccacggcctgcccgacgacatcggcgacaacagctcctccgacgagcagtggttcgtgcggttcggcgaggtcatatccaagcacacactgtcatgatcctccctaactccccagaaaatttttctcccaagtagagatggaagcaagaaggtagtaaaagcatagtagcacagtgcaggaaataggcggtaggattatgagatcgctgtagatggagacgatcgatgcatgccaccattgttcttgtggacgttggtttagaaagttgtccaaaaatggaaggaggagaggtaattctggtgctgctaggacggatctgcagtggttggttcgttggttgtccttggtgtaatcacacggcacgaggtgtcccgtgaacgccatgaatctcgtctgagccattatgcccggacgtgagtttcttggatcctggaaagaaccgcattgaatcgaaccatgcaacctgcattggacagggtacgttgtaaatgaaatgcatcaccgtttttttggctgct

SEQ ID NO: 2917 - DNA, 989 bp, Sorghum bicolor
  Clone ID: SORBI-28MAY03-CLUS49109_1
gcacgaggatagggagatgccatctggataatgatgaattgagagtgcatcgtccgctgcctcgcttgctatacttgaacgttgcatactgtgcgataagcaagatagaattcatagccatgaatctgcagacttttgtattccaggggagctggattaatttttacctcgggactgctttggcactgaaagatgtgaagctctatcttattggcaagataactcttaacctcgctatgaccgtgcttcccttcttgtttccaagggcacagaatatgattctgcattgttccttgccacttaagatgccatggccacaaggaaacggttctaagttttcacttttaaagtatctacaactcaagtttttggtgttaccggaagatctccttaaccttctatcattggcctctttcctgagtgctgctcctttcattgaaaaattagagatacattttgctattcgtaccctcccacaaggctcagagcttatcaggaggcttccaggttctacatatcgctatctgaagaaccttagtatcactggatttgcagggtgcaccggtcaagttgaattgttgttacacattgtagaaaatgcccctaaccttgaggctttgactattgaccgagctaatcactatggtagtattgaagagcatgtatggcaatcaagatccaaggcactagacattgctaggagacatctggatgggaggttatcagaaaatacaaaggtttctataatgtaggacgatgtgactgaaaaggaagcctgctaatgttgtggatggcccctcagttattgtcccctcatcgttcttcttgttcttgcatcgttcgtcttgttcctcttctctgagttgttaatgaactcttcgtgttcttaccggagtctgtaagcaatgcgcttataacgtgttgaatgtaatgaaaacaagaacaaagaatagaaataatgtactgtgttccgttgattgatcttgttt

SEQ ID NO: 2918 - DNA, 411 bp, Sorghum bicolor
  Clone ID: SORBI-28MAY03-CLUS4936_1
gctattggcatttggcacgccatcagcgggagctgtcctcctcctcctccgaattcctccgatcctctctttggatagaaaagctagctgctcgtgctgctgctccccgtcgaaataggatccatggcgctgttgattggtcgtcgtcgtcgtgggagctcgagatgatgcttggggggggcggcttcttcctgctccgcacgacggagggcttccacgcacaccaatcgctcgtagctagcagccgcagggccggtcgagttgtgcagcacgcaggcagcgccatcgcaatcaggctaggtagtactaggtataggtagctagttggtaggctacgcgctcgcaggtggcgtgtcgtcttacgtcgtcctccactcgtcgtctcctctctctctctctctctctctctct

SEQ ID NO: 2919 - DNA, 656 bp, Sorghum bicolor
  Clone ID: SORBI-28MAY03-CLUS49370_1
gcacgaggccccagtcccccacgcccaaaaccccaagtgcctttctcgccgcttccgactccgccatgccaccatagatccagctagggcggcgtcgttgcgttcaatcctgtgcgagagaacgcgaatcgccgccggcttgatattggccagggctttctccgcccaattgcatcaggtctcgccgtcatttgcagcgaccgtgctctaattggggcgaaaaggaatcttatctgctgaatccccgagctccggcgatggattttgacatggacgactacatagacccctacgaggaggctgaggctgaggctgccgcgggcgaggacgacgactccgacgaccccgacgaggacgactcggatgcggagagcgactacgaggagaagtcgttcggcctcctcaagtccggcaagcaccgggtgcgcaacccggacggcaccttccgctgccccttctgccccggcaagaagaagcaggggtacaagatcaaggacctcctccagcacgccgacggtatcggcgtctccagcaagcaccgccgccacggccgcgagcgcgccaaccaccgcgccttcgcgcgctttgtccgcaccgatccggacttcgcggaagacctcgtcggtatcactggcattcaaggtgccattacaacc

SEQ ID NO: 2920 - DNA, 431 bp, Sorghum bicolor
  Clone ID: SORBI-28MAY03-CLUS4938_1
gtgactcttatcatggtttaggaatggagatacatggctacaaagatgaactgaaggcgttgggtgttactgttgaattaaaacgaggtgctagattcgtcatcacaggcgtcagcattcccagtgacccttccaagttgtccaaaactacaatcttgtcactgcttgggtgcatcaagagctacttcacccttgcagctggacctcctaagggcttccaggaaaatatgtgcaagaagtggttgaggacatccatgggatatcagtgtccgaatgattgtatcctctttgatccaatgcagtcttctgtctgcatagaagatggccctttcatagatgaagcattctatggttcagagatagccttatttaaagatgctcttaccagaatcggagtaactatggatatcaaaccttgaaaagaacttggt

SEQ ID NO: 2921 - DNA, 569 bp, Sorghum bicolor
  Clone ID: SORBI-28MAY03-CLUS49380_1
gcacgaggctcagattcaccgccgcgcgcgtctcctccccctgcaccaccaccagtacaccgttcatcgaggagagggacgggacgggacggagaccaccatggacatggagagatctcagcagcagaagtctccgacggagtctccgccgccgccgtcgccgtcgtcctcctcgtcctctgtctccgcggacaccgtcctgccccctcccgggaagaggcggagggcggcaacgacggccaaggccaaggccggcgccaagcctaagagggcccgtaaggacgccgccgccgcggctgatcctcctcctcctcccgccgccgccgccgccgggaagaggagctccgtctacaggggagtcaccaggcacaggtggacggggaggttcgaggcgcatctctgggacaagcactgcctcgccgcgctccacaacaagaagaaaggcaggcaagtctatctgggggcgtatgacagcgaggaggcagctgctcgtgcctatgaccttgcagctctcaagtactggggtcctgagaccctgctcaacttccctgtggaggattactccagcg

SEQ ID NO: 2922 - DNA, 487 bp, Sorghum bicolor
  Clone ID: SORBI-28MAY03-CLUS49386_1
ccgtcaggtggtggcggcggccctgggtctccggctgggctttcccccacctccactagctcaaatgatgccgcgagatcgaacatcagtggggctggggtggcgcctccgccccttgttgatgtcttcagcaatgctgctcctgctcctgtacaggtgaagccacaggagattgctgctgaagggagggctccccaggcgaatccacatccacatccagaggtagctacacatccccatccagaggcaacgaggtacaggcaaccactgtcgcagctgccaccactgcctcctgtcttcatgaacgatcatagagatgccattcagggtctgaatcagcagccaccaggtcatgggccaagattcgacgattgccacatgtgcttgaaggcattgcctcacgcccactctgatccggtggtgaatgagtatggcaatgaggtgcatggaggggctgctcctgagcctgggcctgtgttcatgagcc

SEQ ID NO: 2923 - DNA, 479 bp, Sorghum bicolor
  Clone ID: SORBI-28MAY03-CLUS49394_1
gcacgagggccggggccgtggaaaacgagagggatcgagggaggggtatccgtcggagccccttgcccgaggttccgggtcgccgcactgtgttggcgacagtgatggtagtgacaacttcgaatgggatagtgacggcgatggggaggaggcagcgagcttcaacgctgctggtgccagttcatcagcaatggcatcaacgaacgctgatgctccaggcccatctacacgggttgctaatggcaatgggaaggctgggccatctgcctctttggttcataagtatatggacatgggtttcccagaagagattgttctgaaggccatgaaggacaatggggataatggagcagattcattagttgagcttcttcttacttaccaggaactaggcaatgacctcaaagtggataatggctttgcttctggttgtgtcccccaaaatgttgacgatagtgatgatgatgacattctagaac

SEQ ID NO: 2924 - DNA, 481 bp, Sorghum bicolor
  Clone ID: SORBI-28MAY03-CLUS49196_1
gcacgaggcgggcgccgccgcgtgcctcgagctctggcacgcctgcgccggccccgtcgcgccgctgccgcggaaagggaccgtcgtcgtctacctcccgcagggacacctggagcacctcggtgacgccgccgcggccgcagccggaggcgcgccggcgcccgccgccctgccgccccacgtcttctgccgcgtcgtcgacgtcactctccatgcggacgcgtccacggacgaggtgtacgcccagctcgccctcgtcgccgagaacgaggatgtcgcgaggcggctgcgcggagggtccgaggacgggagcgctggggacggcgacgacggggaggccgtgaagcagcggttctcgcggatgccgcacatgttctgcaagacgctcacggcctccgacaccagcacgcacggcggcttctccgtgccgcgccgcgccgccgaggactgcttcccgcctctggactacagccagcagcgg

SEQ ID NO: 2925 - DNA, 671 bp, Sorghum bicolor
  Clone ID: SORBI-28MAY03-CLUS49204_1
gcacgaggtccgattttgtccgctccaagttccccgaccagctcgttcctccgccgtcgccccccccatccgaagcaggaagcacccggccccgatcgagaagcgagcgacaggcgaaggttcctcggaccaccgactggctaccctctaacggcccgcgcagcagagcagccggacctcccgccgccgccgacatgggcgggggccgcgcccaggtgaacaaggcccacaagagccgcttcgcgtccaaggcctcccgccacgcgcacaagatagacaaggtcaggagcggcaagtcagagaccagccatcgcgccgccgtcaagggtgcccgtgccgcgcgcatccagcagagcaaggcgatacgtgataaaaaacgtgctgctttgctgaaggagaaacgttcatcaaatggaccttcaagcgcaccacgtgtcattgttcttgttggcctttcttcatcagcaaatgttggatcactagccaaagatcttcttgcactagcggaaggcagtgatgggaaactggaatcatctaccgttgcttctcctacttataagtttcgaaccacggtactgcaagcaccatatggtgatcttaccacatgcatggaactggcaaaggttgctgatttgttagcattcgtactaccagccaattcattctactgt

SEQ ID NO: 2926 - DNA, 643 bp, Sorghum bicolor
  Clone ID: SORBI-28MAY03-CLUS49199_1
aaggtacttgaatgtgcaaaagaagacttaattgctgaattaaaccaggtcttcacaaatacatggataagacgtgggaggcgcgggcgtccccatgtgcctaccccaagtctagttgatgtgcggcctctgaaggttgttccttctgtagtgtcaagctcaagcagccagagaagtgtaacagcattcaagaaaaaggttgaaaatcctaagcttcatgctaatcaggataatcttcgtccgaatcaagataatctcactgaagttggtcacatgtatactgatccttctcaaccagttcacaaaagtgacatacattatcataatctgcctagagcggttaatccttcagttactcatgttcagcaccaaaaaaactatacaccacaaggcaatgctaaggtctctgaacagcttgaaagaaataactcagctggattgatgcaaagtgaaagggataagagagtgccaaatggtctctttgtcaatgacagaaatgggcagaacaggtctagatttgcaagaacccgatcaagtcctgaactcacagactcttctgctgaagggtttcgtggaaggcggaataatgcagttggtatggaaaaatctttgggtgttgatcacagcagcagaagaaacatct

SEQ ID NO: 2927 - DNA, 461 bp, Sorghum bicolor
  unsure (1)..(461): unsure at all n locations
  Clone ID: SORBI-28MAY03-CLUS49208_1
gcacgagggttcctcctcgacgcgctcggccaccgcgtgtccgccctcgaacgcgcgctcgccctcacccccgcccccgcccccgccccgccccgccgcaagtacacctacgccgccgaggcccacggcaggaaggtcaagtggaccgccgaggaccggccctccggcggcaggaacctcaagtgggaggccgagctcaggacgccccaccacgacggattcgaccgcaagtggaagtgggagtccaaggcgtccgccgccggcgctgccaccaaggtcaagtgggaaaaggagatcaagggcaagggcttcctcgagccttggtccaactcttactccgtcgaggagacctacggtgacgatgaccatgatgacgacnaggagaagaagcctactgatgttaatgttaagaggaaagtcaaggaggacaagcagcagcacaagaagggcaatgtggagat

SEQ ID NO: 2928 - DNA, 466 bp, Sorghum bicolor
  Clone ID: SORBI-28MAY03-CLUS49503_1
gcaacaggggtccagagcagctatgtggtgcccagcaacggcgccatggcagatcaagaccttgatgacttctgcaggtctttactggctaaagtgccgaccaactgcgccgtgccggactttggcaacatggccaccagaacgctgggcgctggctgctcattggtctgcaagtagaagattactttctggtcaagaactaactcaggaatcattcggaaccaaagagcatggaacaaccgtttctagtctcaggtcaagaagctgttcggagatatgctggggggctcagcttgtagcaaggagaagctgtgccaggggactgcaccaccaattttttgtagctagaggactaggatgtaagcagcttacactctgcagtgacttaggaagtttattattcagtggtggaaagccacgccactaatgtaaggtcctatatatatgtaatgttatgttattccct

SEQ ID NO: 2929 - DNA, 600 bp, Sorghum bicolor
  Clone ID: SORBI-28MAY03-CLUS49505_1
agttcatccaaagctaaacagggttgcttatcatatagttatccgtggatactgcaagatggaggactttgagaaggccattgagtgcctaaaggagatgaggaaagatgggttgctgccaaatgtggacgagtatgacaaactgattcagtcattgtgtctgaaggctatggactggagaagagctgagaaactcctggaggaaatggaggatagtggtttatgcctaaggggtataagtcacagcctcatagctgcagtcaaggagttggaaggagaggaaatgcagtcaaaggcgagccaagaagcatagtttctctaggacacttgaatccatacgtctgctaattattttttgggtagcacctttctttttgagcttttcatctctgatgagcttgcaagaaacatcatctctgtatggctgtccctgtgtttgtttgttgttatttactacaataattttgcatttatatttaaatgctagactgacagaagaatatttagttttggtctggggcttctgtttatctacaatatgagattttccatatgtcattatacatgtcgagaatttattttcatgtcttgcttaagaac

SEQ ID NO: 2930 - DNA, 574 bp, Sorghum bicolor
  Clone ID: SORBI-28MAY03-CLUS49526_1
gcacgaggcaaccctcatgctccaatggcatctgggccaagccataactacacaaaaccccgaggtacaggagggccaaacagatatccacagggtggaaaccaaggtggaggataccaaaatcgtggtgggcaaggtggcggctacagcagtggctcgtatccgcaacaaggccgagggccaccgccataccctggtggtgggatgggtggaacaggtggcccaaggggtggaaatggcagtggctatggagttggcagaccaaattatcagcaggttggcccttatggcgtgtctggcccaggcagagggtcaaactatccccaacaaggtggttctcgcaatcagcagcagcatggaaactggcagtaacattttaacactacctttttcgtttctttttttttagatttgatcatttcagatggtcctaaatcagatagatttatcgaattgtaggttgatttagtctggtaataaatatccattgactataactccagttagttacgaatgaactatcgacatctagtataacttggtgattgcccataaaaaaaaaaaaaaaaaaaaa

SEQ ID NO: 2931 - DNA, 432 bp, Sorghum bicolor
  Clone ID: SORBI-28MAY03-CLUS49530_1
cttcgatatgtatattggtgacccccctgtttcagtggagaccaaacaagacattgcgcaaaatgtggctggactcataagaagatgctaggaaaaccagaaacctagatcgaagaacgtggaattaattcattcatctattcaaggagaggagatataaatagaaaggaagccaggagaggacctatcgtatttatagtggtagacagtcagtttgtaagctataaacaggcaaaaagtttcaacaaacagaggcctagcatccttggcaaatgcctccatgcttttcatgtggtttggcatcttgccatttcctggccggctggcgcactgtgtcatgtacaaataaatgatacatacagtaacaagttgtacaacaagaggatgtttctctaccccaagtcaaaaatgacggggttcagctttgctcct

SEQ ID NO: 2932 - DNA, 740 bp, Sorghum bicolor
  Clone ID: SORBI-28MAY03-CLUS49542_1
gagccaacatcagcccgatcgatgtcattcgtcgggactcatgaatacttagcccctgaaatcatcaagggtgaagggcatggaagcgccgtcgactggtggaccttcggcatcttcctccacgagctgctgtacggcaaaaccccattcaaggggtcagggaaccgcgccactctgttcaacgtggtcggtcagcaactgaaatttccagagtcgccgtccacgagctactcaagcagagatctcatcagggggctcctggtcaaggaaccgcagagccgcctcggcgtgaagcggggagcgacggagatcaagcagcaccccttctttgagggcgtgaactgggctctcatccggtgcagcacccctcccgaggtccccaggcccgtcgaggccgagctgcctgtgaagtacggcgtggcggaggcgatcgggagcaacagcaagaggatagccggagcagacgtgaagtccggcgggaaatacctcgacttcgagttcttttagagtatatagtgcccagtggcagcctattgtttgcatactgtccgtgtatgtggccagtttgatgttgtgtgattcgatgtggtgctttggtgtctcaccgtcgatgcaaaattctcagatctgaatcgaccaaaaattagatagatctgtcatctgtttgccacttgcctgctttggcgcatttcgagttgtagcagacctgaaagcagtgagtgggcaaaaaaattctcatg

SEQ ID NO: 2933 - DNA, 678 bp, Sorghum bicolor
  Clone ID: SORBI-28MAY03-CLUS49551_1
ccttgataccgagatcgataaattatccatccgttccagccctcttggtaaagacaggcagtacaataggtactggtttttcaagtgtgaaggaaggctttttgttgaaactgcagattccagagaatggggttactacagcactaaggaagagcttgatgcgctcatgggctcattgaatgtgaaaggtataagggagagagctttgaaacggcaactagagaagttctataataagataagtaatgccctagagaaacgatcaaaagatatcgcaaacaagatgttgcttgaagagggtgtgctgcgccgttccacacgcgtccgggctaacccaaaggacaacccgtccatggcattcctcaagtatgtcaacaagtggaaggataactgaggtactctgagatggtgatccgccagcacagtgggaggataactgagccttgggcgtgaccctcttaagttatgtaggctttgcttggttaggtcgtcgcagtggggctgccatactcatgggtggtttattgacccctcattagctagtgaaacctgtatcagaacccacttttcttttttctttttccttttgcttttcaggtgttggacaccggttcacaaatgagaaccctttgctccttaactgaactgtgtcaggctttacatttttttagaacagtt

SEQ ID NO: 2934 - DNA, 594 bp, Sorghum bicolor
  Clone ID: SORBI-28MAY03-CLUS49561_1
ggagctgatcactggcaagaaggcactcaaccttgaagggcccgagagcgagaggagcctttctgtgagctttctgtgcgcgttgaaggaggggaggctgatggacgtgatagatgaccacatcaagggtgaagagaacgttgggatgctggaggaggtcgctgacctcgccaagcaatgcctggagatggctggcgagaaccgaccagccatgagagacgtcactgagaggctcggcaggttgagtagagtgacgcatcacccgtggatgcagcgtgaccccgaggagatggagagcttactcgctgtcagagagccatcggtggacgccgtggagatggtgagcacttcgtttttgaccatggagaggaccgttggtcgtgccctactggagtttggtcgttagagacatctccccgtcatgttttgtagatcatcttgcgtgtacccatgcatgtactatgattccattgctccggtagatctgacctattgtttgtttgggcatctctgatagaggttgctgttactggactgttcatggtctcttttgttactactgaggtattatgtatttatgctctctttttgtcc

SEQ ID NO: 2935 - DNA, 678 bp, Sorghum bicolor
  Clone ID: SORBI-28MAY03-CLUS49292_1
gcctactgtatgtaagggataaaaggcaacatgatgacaagttttctgatgagcgagtggcccggggtcatgaaagtgatagagctgattataagagtgctaaagctcggcgcagaagctcagagagccattacagaaaggatgcagttcaagatgttgatcattatgaggattatggcaataggtataaggaaagtagagggaaaaaacgacctcctgaggaaaatgatgaccagtacgatttaaagcctccaagcacacgtgatcaacgtgtgcatttggaaaaatcttcaggcagtgggcgtctggattctctgattgagagagcaagacctgatcgtagttctagtccaagtaaaatccactcaagaagttcacctagcccaagttcttaccacgacaaagatcaaagccggcatggatctaaagtgatagatcatggaaagagagaaatgacgtatgatgagagaaacagtcggccaagaacatcttctggtagagaaaggacacctggttctagacttcgtgacagggatgcagaaaattggtcttctgaaaggcttaagcagaaggatgatcaccagcctcgtgatgtagcattggaaatttctacatcatcacactatgatcgcacacctaggaaagataagcatacttcaccaaaacaactgtctgaaa

SEQ ID NO: 2936 - DNA, 393 bp, Sorghum bicolor
  Clone ID: SORBI-28MAY03-CLUS4930_1
ggaatggagggagtagctctaagatcattcaatgcgatacttgagtagctttttcagaccagccattattcatgtgttaggctgtacttttctgtcattcattcaagtgaacaaacactagaaggaattgtgccatatggtgaagagcagtttgtagttattcagggttgagactcttgatcagaaactgctcctactccctgcattttgcctgctttatactccatctgtttcaaactataagacgttttggtttttctatatacaatggtagacatagcaaaagctacgtatctagaaaagccaaaatatcttataatttgaaatggaaggagtaacatgacacacgagtccatgaccagagagagagagttgaggccaggttttaggtca

SEQ ID NO: 2937 - DNA, 396 bp, Sorghum bicolor
  Clone ID: SORBI-28MAY03-CLUS49320_1
gcacgaggctgctgtagaatcatccaagggtgtactgggccatggttctcaaaaggagcacggtggtgcaactggtgtcggtgattggaatccccacaaccagcaggttcaaaatctaggcaatggtgccacggacaaagctgtttccagcattggcagattgcgttccgaaggattacttgcaaatgatcagtctacatctgccagggatggtggtgcttcccaaccaaacaagggtcagaaggagcgccacaaaaagaattatgatcctaatgttttctttaaggtgaatgggaaactttatcagaaacttggtaaaatacgatctggaggtagcagtgaagttcataaagtcatatcatcagattgcataatatatgccttgaaaaagatcaa

SEQ ID NO: 2938 - DNA, 676 bp, Sorghum bicolor
  Clone ID: SORBI-28MAY03-CLUS49358_1
gcacgaggctccccctccgtcgctcccccccccccccccccctcctccctcctcctgcggctgcggcccactacatataccatcatcacgtcgatgcgccgctccgctggcatcgccatcgccgtcgcgccgccgtagacggcctgacatttttttgtttatccctttatttatcatcccaatttcccacaaacccccccgcgcgcgcgcgcggcggtagggggtaaaaaacaaagagagggaaggatggcgtcggagccggtggcgcgggcggtggcggaggaggtggcgcgctggggcgcgatgcgccagaccggggtcagcctgcgctacatgatggagttcggggcgcgccccacggagcggaccctcctcctcgccgcgcagttcctgcacaaggagctccccatccgcatcgcgcggcgggcgctcgacctcgactcgctccccttcggcctctccacccagatgatcaaaatgatcagggtgcggcacaccaatgtggtgcccgcaattgcattgggtgtgcagcagatgaagaaggacttgggaggtccaaaggcgttcccccctggaatccaggagatccatcagttccttgatcgcttctacatgtcaaggattgggatccggatgctgatagggcagcacgtcgctttgcatgaccctgatccag

SEQ ID NO: 2939 - DNA, 453 bp, Sorghum bicolor
  Clone ID: SORBI-28MAY03-CLUS49658_1
tttgaaaggttccatgcatataggttgttctaattcacatcagattaggggaggagtgattgcctgtttaattttttctacatgaacattgggcgccttgtctctttaaacggttccatgcatacagtttggtctaattcaacatggctaattgattagtattgtttctcaattttacctaaaataatgtctgagaatgataatccttcaaagactgtagacaaggtggttcaaaaaggactacagacgcttggagtttgaccagaaatatgacaccccattggttgaagtggatgttgtcttccataattctcaagtctatatccaagtctaacaaaggctgcaatccacttactaatgaccctgtataatatctctgtccaacactctataatgcttttgtatacacactatacttcgccatgtagcaaactttagttgttttctgcacct

SEQ ID NO: 2940 - DNA, 561 bp, Sorghum bicolor
  unsure (1)..(561): unsure at all n locations
  Clone ID: SORBI-28MAY03-CLUS49668_1
gatctggttctagctatcccactagtgctgtatgacaaggggtacgcattcgcactcaaggatgggagcacatacagcttccgcttctccttcactgtctccaacaacattgtgtctggtctcatatatacacacaccgtttggaagacaggagtaagagtcgaaaagcagaaggtgatgctggggacattcagtcctcggcaggagccctgcatacacgaggctgaggaagatacgaccccaagtggcatctttgcgaggggttcatattctgcaaagctcaagtttgtggatgatgatgggaatgtctacctggacatgaattactgcttcgagatcaggaaggactggccagccacggcctaagatctggttactttgtgagaaacagcgttcaggtggtaggtaataggcgatggatgtgcacgatcaagtgctgtgtgttttatgtatgattctcgcttttgtgggcgtgggctggcccacgttctagattctggaactgaaanagctgtcaaaactggtgttcanaaatattttttgtttattgtggcatggctc

SEQ ID NO: 2941 - DNA, 705 bp, Sorghum bicolor
  Clone ID: SORBI-28MAY03-CLUS49672_1
agagactttcgcataggatgcttgatgaattcacaagacttactccctatcttagtggatacaatgatagattagctggccagtcttatattgttaagcatggcgaggttaacgccaatgttactattgagcactaccttcaagttgtgaagactgagattgtaacacagaggtcgtcaaaggaactaaaagtgctcgaggaatatgaatacacagcacacagcagcttggtgcacagcttctatgttcctgttgtgaaattccatgttgagccttctcccatgcaggtcttggtaactgaagttccgagatccttctcccatttcatcacaaatgtctgcgctatcattggtggagtcttcacggttgctggaatactggattccatctttcacaacacactcaggatggtgaagaaggttgagctgggaaagaacatttaaattttgacgccgctgcaaggatgcactaagtagccattgttttgttatacctgggtagtgattcatgaaaatcggtaatatgatatgaaagatggtgtgtggcattgacagttcgaattcggggtcatgaactcatcatataactagggatctcactgtgttgctaaaaacacttgcaataagacagtggatcgctgtgtgcccctgtgctaatcgacgtagataatatattcagtattcagtatactctggttgttatgtc

SEQ ID NO: 2942 - DNA, 377 bp, Sorghum bicolor
  Clone ID: SORBI-28MAY03-CLUS49686_1
gcacgaggcgaagaattcagctccgcaccaacagggaaacctacagatgccaccaacccaccagccatgtcaagaaaggattcgtcggggccgcccctggcctccctcccccgcattgcctcgctaccgcagttcctcttcaagatcccagaggatactgagaactgaacatggaagtcaaagacctcgcacccttaccctgaaatagggagtatgctgtaaagattgtatccaagcaataagaaagccccttatcgcctccctcggaggcgagttccccaccctgtaaatgtgacacccggtaggttgctcagttgtatgtttctcgactcagatgggtagtggaaaaattgaaatgttcattggttctttgactc

SEQ ID NO: 2943 - DNA, 487 bp, Sorghum bicolor
  Clone ID: SORBI-28MAY03-CLUS49717_1
acgtcgaagcaggagcatccaggtcccacacaattatggtaggactacttggaagaatatctgacgtggattcaaccatggaagaagtttttgtttaacacaaatcaaaattagtggagcaagtgaactgagctgcatagtagataagtctaactgtgacactgtacctactgatgttgcttctgttgaggcatttattattcccagatactgaaagtctgaaacgacgatacgtggatgacaaattagagggtcgtcagtcttctgctctgtgtgtttgtgcttactcggccaaaatgtacctttcatgatgacaagggcccatgacactaaagattgttgagtgtatgcatttgtctataagctccactcgattagagttcatcccttcttagattaatcgtgtgttgttatcagtacagttattagcaaattaaagttttaactaattatagagtaaatttatccggcactaactgctgtctgt

SEQ ID NO: 2944 - DNA, 536 bp, Sorghum bicolor
  Clone ID: SORBI-28MAY03-CLUS4969_1
gtggaacgccagttagacagtctgcgaggagtgcagggaaaatgttgaaaaggtacacagacttatcttctggaggtgattcgtctgacaatgataatgaaactgctgaggtgcctgaggacttggatgataaggagatggtgagtccagaaattaaggatgagagtgaaagcgaagagcgtgaaacctgcagattcttcaacagtagccctttctagcaaggagcctcttgttcaggctactttgtctagcatgtttaaaaaggcagaagaaaaaaagagatctacaaggagtcctaaagggtcccctgcaaccaaaggtgctgctgctaagaaacagcgagcaagtctaatggcaaaacagtcagcaggggtcaagaaggctagcggaactcggggaaagaaaaaaccaaaggtggaagaagatgaaatcgaagagctctcaagttcctctcaggataatggcacagatgatgatgacgacaccatgatgatagtgacgaggactgggccgagtaatgcccttgtagttgatcg

SEQ ID NO: 2945 - DNA, 495 bp, Sorghum bicolor
  Clone ID: SORBI-28MAY03-CLUS4972_1
gttttccttcccccacaagtccaccagactgcgattccatggagacaggtcaggcagtccaggaaagcgctctgcacgccgggaggcaggcgtggtggcctttggacaccatggcatgcagcttggacgacgcgagcaccatcagcagcagcttcctccttggatgggatccacaggtggtgctactttggtctaggagcaatgggagctgccgccggcgattctgatacccatggccatgcgcgagagcttgagctcttcgtccccaaatgcatggagtctccggtgtccgaggcgtcaacagcagcggccacggaccggacgatgcaaaaggacgcggcagcgatgcccggggagctggatgaactactcatgagcctatgggacgactcggacaaggagctggccgggggcttcaattcctgcggcgctctcaaggagacgagtgccaccatctcttcccaatacgatgatcattccgatctgagctccctt

SEQ ID NO: 2946 - DNA, 973 bp, Sorghum bicolor
  unsure (1)..(973): unsure at all n locations
  Clone ID: SORBI-28MAY03-CLUS49400_1
accggcctactacgatttcctccatgccgactccctaggcgcagcctgccctcgcttcccttcctcaccgggactccctccggccgcttccctccacgcacccggtgcctcccttcggccgccatcctctgcgtcggtgacacggttccgcgcggatgaaagagcgaggcagtcccacatgcggcggcgtggctcccccctcactgcgcctcctggtggcacaacgccgcatccgtctctagcgtcggccagcttggtccctgcgccagtgagctccccagctccggcggccacctctgccacgccggcaatggctggatctggtggatccggttccccactacctttcccaccccatcttcttctcatccatgggaacgttgcaggcgcctggccgctgcaggtgcggaggccgctggctgctggtcgcgggcatggggaccgccagggaggaagcgatctacgaggtcgtattgcgacaggagggcactggtctaggagggcgccggcgtcaacggcgcggtgacaccgcctgcagggtgggtgaacgagaaagaggtggaggaagaagtggacctccagctaactaaggcagccgtacggctccatccggactgatttgtgccatctcaggctcgccccagccacaagcgctgcctctgctgaatcgacatgtttgatttggatttctcatcctctatgcagtcacattcaagctgtatgatcgaaggggacgggttacatcaggaaagaagaggtgatcgtccattcattctcatatgtgtttgtttgcaacgatctcgtttttattctaacatctgtgtgccggtctggttggagtgcggacattcagtctaggggactcanatggagatggcatgatatgtcctgaagaatgggagttgcagggattagtgttgtatttcttatattactattcctatctttttcttttttagtaatgtctagaagc

SEQ ID NO: 2947 - DNA, 479 bp, Sorghum bicolor
  Clone ID: SORBI-28MAY03-CLUS49405_1
gcacgagggtggctatggcaagaagaaaaccgaacatgccaggaatgataggggtgagagaaagaagatgccagtaaagagttctcgtcatgattctgaatctgacacagatagtgaatatggcaagaagaaaatggaacatgcaaagagcgaacgcgatgagagaaagaaggtaccagtgaagagctctcatcatgattctgactctgatacagatagtggctatggcaagaagaaagtggaacatgcaaagaatgaacgtgataagagaaacaagataccggtgaagagctctcgccatgattcggagtctgatacagatagtgactatggcaagaagaaaatggaacatgcaaagaatgaacgcgatgagagacagaaggtacccgtgaagagctctcgtcatgattctgagtctgatacagatagtgactatggcaagaagaaaatggaacatgcaaagaatgaacgtgatgaga

SEQ ID NO: 2948 - DNA, 561 bp, Sorghum bicolor
  Clone ID: SORBI-28MAY03-CLUS49409_1
tgggctagtgccagcaagacgagccctcgaaccttccagttccactccatccatcgccgccctccccctgcgcgcccgaaacaagagcagcggcagccgccaactagcagagacgacggctacggcggcgcccgcgcccgcgcccgcgcgcgccctcccgacgatgcggcgagccacactcccgctcgcgcttgggctctccatcgtcgccctcttcgcggccaggggcgccgatgcctcaatccacgagtacgccgccggcggcttcgcgccgcgggccaactccttcttcttccacggcgggagcgaggggctctacgcgtccgacccctcatccaactcctccgcgtccttcatcagatttgacaccgttgtttttcgtcgcaccctggagtcagcatctaggcatgaggagatgcagcaaaagacaggattggtggaggctataattgttgagatacaggacagggacaaaattggaggtttatacctgcactctggtgcaatatgctgcacgcctgagcttgataaggagaaatcttgtagagtaggtgaggtgat

SEQ ID NO: 2949 - DNA, 661 bp, Sorghum bicolor
  Clone ID: SORBI-28MAY03-CLUS49478_1
gcacgaggctcggcctccgcgctcttcaagcactccgccaccttgtcggcggctgggccgagggccggatcggggacgcgcgtgtacccgctgcgggacttcccgggcggggacgcggccgcgctcggcggcgcgttccgggacaacgtgcggtggctcctgaagcagtggagctgcgcaccgggttccgggtcggcgtggcgcgcgctgctctcggacgagcgtacgggcgccttagtccccatcgtcgccgtggaggagctcgccgcggcgtcgtcatcgccgctctgcgatctctgtcgctgcgccggttggagccaccactgggtgtcaaagcggaagtaccatttcatcattccggccgcgggcgactgggaccagccattcagtgctgatgcgttgcttgggcacaccgatcaccttctacatggtctgatccatagtaatggctttggtcaccttgtcactctccatggtcgtgatggtggctccactttcctctctggctgccagatcatggatatatgggatcagctttgcgcagctctccgtgtaagagccgtctctattgtggacttgactcaaaagcactctgtggacctacgtctcctgcttggattggcacaacgcaagacatggttcactcgctgggggtactgac

SEQ ID NO: 2950 - DNA, 429 bp, Sorghum bicolor
  unsure (1)..(429): unsure at all n locations
  Clone ID: SORBI-28MAY03-CLUS4978_1
gcgccgcgcaatggcggccaagcagcggcagcggcagcggcagctgcgcctcctgcctctcctcgccgcggccgtcgcgtggtcgctgctgcgcgcgtgcggcaccgccgccgaggtcacgggcacgggcacgctcggcctccggcatagcaagcccgcgcggcagcacaacggcacgcggcacgggggagggaaccagcgtggccgtggccgtggcggcgccgcccccggcaccggcatggcgtcgtgcaacctgttccagggcagctgggtgtacgacgacacgctgccgatgtacgacacggcggggtgccccttcgtggagccggagttcgactgccagaagtacggccgccccgacaagctgtaccttaagtaccggtggcgcccgaccttctgcgacctnccgaggttcgacgggcaggagtt

SEQ ID NO: 2951 - DNA, 488 bp, Sorghum bicolor
  Clone ID: SORBI-28MAY03-CLUS49795_1
gtagcaagcagcagcagcagcggcagcgcgtcgaccagacccggccggcctggtagaggagcaggacgggatagcacgcgggaggagaggacgcgcacgccatgtcaggttcaccgccaaagccttgggagcgttctggagctgaaggaacatcaggcccagcacctttcaagcccccatctggtggaagcaccagcgatgttgttgaagcttctggtaccgctaaacctggcgaaaatgttactgcgacagagaggaatgtctctgctaatgtaaatagcactgtttcgaggcctgtgccacagcggccttggcagcagacaggctatggaaacacctatggaggatatggtggatctaacatgtatagttcatatggtggattcggtaacacttatggtagcggcgggctctatggaaatagcatgtactcgagttacggaggaggttatggtggtggcatgtacggtggtgggatgtatggagga

SEQ ID NO: 2952 - DNA, 310 bp, Sorghum bicolor
  unsure (1)..(310): unsure at all n locations
  Clone ID: SORBI-28MAY03-CLUS49800_1
gcacgagggccggtcacacataaagcaagtgacctcatgcttgcagcatttacctggattgcagtttggttcacaattaagagaagagcacgctgtacagatgcttttagcgaggcttgcaagcgcaacctttggacgcctgtggacggaggtggaggagcgacatgcctgcaacatccttatgctggctgctgctactgtaataccaccatttgaaaacatatcgccaaagatgctggctgagtcaatggcactaagaaaagatggtggacacatccnagaacctgctgaacagtcttattcagaggag

SEQ ID NO: 2953 - DNA, 474 bp, Sorghum bicolor
  Clone ID: SORBI-28MAY03-CLUS4981_1
tgctctcctagcatagatggtagaatggctgggggcgctgaccgccatacttaattctcaacacaggaaatcgctttccgaagcacccccagccgtggctcgttaatagaggatcagagcactacgagcatgtccatcctacagctttctggtgccatagtggcagctgaggccttcacgagggggggccttgtatatcagcccgaatgtctacacctctgctcgacaaggctctctggccttgccctgcatgcgaaggctgccaccggcgtcaccacaaagtgcacttcactgaaacctccctgagatagggtgcctctgaagcttgggccacgaggacgcgccacagttggtggcatattgcttccatctaccggccagaccaaacaacaaggaggttacgctgtcgcatgcgctaaggcaaggaccattggatacattacattactttgtgatctaaagactggagtacac

SEQ ID NO: 2954 - DNA, 870 bp, Sorghum bicolor
  unsure (1)..(870): unsure at all n locations
  Clone ID: SORBI-28MAY03-CLUS49821_1
cgcccagctccgcccgcgccctcccattccgccgctgctggggtcactcgcccccgcgccggcgaagtccctcccgcgcggacgccccgccgccccgtggcgcggcgtcgacggtcggttcccggcctcgcggaggctcctccccgtgtcgaatcgaggtatttgtcggcaggatcctaggccaaatgcctctctttgataagaaaccattctccttactggagccccctaaggacctggattcaaaggagaaggtgttccaaattcgattcacaaaggagatattccgagattatgaagaatacctaaagaggctaaacctttatcgccagagagtttggacatgtaagatttctggaaaatctaatttaacttttgaagaagctttggtatctgagcataaagcgatggagaaggctcaaaatttgccaactgagctaatggctcatgttcttcggatgactcaatacagcactattggtttacgcgcgcgggtcaataagatatatgctagtctgctggaagaagtatttgaaggaatagaactacatgctaataaggatggtgctgtggcaccttgcaagatcttgaagattttagattctggttgcacaaagatgtgtgaagttggttggattcgacagggtaaagctgtaaccaacacatcagtaatcaaagctgcagatctgttttaccggagggcacctgttagcaggaataccctgaagatttttattanagatgctacatcacaaagtaatccatgggttatccatgagaatctcgccaaaaaatttggcatatccatggacccccctgacagcataatgaagaaagggagaaaaagacaagaggatggaactattgaag

SEQ ID NO: 2955 - DNA, 575 bp, Sorghum bicolor
  Clone ID: SORBI-28MAY03-CLUS49811_1
ctgggcatagtcttctgctccgcggcgccgagatcttctgctccttccccactcccaggctcggctgcggcgtcggcggctccccctcccgcctctcgccactcgcctccgtcctccgcgcacctgccggcgaccctgtgtacgcacctccctcttccctcccgcctctgctgtaccgtgggagcccggcctgctgcccagtgtggccgggccttggctccgccggtgcttggtggcgcccagaattagcgtggaagcagggtggagtgctgtctgggcagaaatctgctcaccgggtgccaggaaacaggcggttggagagaattgtttgggggattcgtcaagaaaagacccagtaggtggttgcgcacttgttatgctgagactgaatggaggctgtagacaagattgctgagcccaaagaccctttcgtgctcacttctcagaaggttcagagcttagagccaccgataccgataaaggcgtcatggaaagggaaggactcccaggagcaagaagagaaggatctgccagctgatggcgaagagagcttccggagcctggattcctctgat

SEQ ID NO: 2956 - DNA, 327 bp, Sorghum bicolor
  Clone ID: SORBI-28MAY03-CLUS49573_1
ggccatgctagttattatcaatttgctgtcctgtttaactggactattgatggagataagagtgtgcgtccaaacagttggcctgtgcccaaggcattttggtgccctgctgagtatgttgacatggtgggtcaatcgtgtgttcaaaagcgaggcaaacgcagccgccccagaattagagttattaatggaagggagtaccgatatgcgtagagcatttctatttccttctttgttctgtatatattcgtgttaatgaacctgtttgagctggtttcggaatcaaagatcattgttatataatatattagagtttgttcacgtgtc

SEQ ID NO: 2957 - DNA, 412 bp, Sorghum bicolor
  Clone ID: SORBI-28MAY03-CLUS49626_1
atcacataactggcgagtcagtgatttggcaattacggtgggcttcaaagcatgccaagactttaaactggagccttataccttgtttcaacatcgggtaaacacggacagacaacattcaatcaaaaacttcaacggcggaacttagcatggctaccacaccgatccacagggcagtactggcttgggtctagggacgaaacgatgacattcaacatcttcagcctgaacttatggagaagaaaaacaacaagaaaaggagagtgggtacttttgtactcgcaagccacccaaaatgtgattatgcaaactacaacggaaggctggtctgtttagtttatatattctggcgtttgatctatctatatacaagactaaattagacacaatgaatttgcaagtgtttgtttgt

SEQ ID NO: 2958 - DNA, 501 bp, Sorghum bicolor
  Clone ID: SORBI-28MAY03-CLUS49591_1
aagaagcattgtatcaaagaaagcggggccttttgagcagggaatggtccaagggtgcatcactggaataagctcaactgcaagtgtcatatctcctctaatttttactcctctcacagcctggtgtctgtcagaagctacgcctttctacttaaaaggtttcagccttgcctgtgctggatttgcaacgctggtagcgtttgcaacgagcataagtatgaggccaggtgaagtgcagactgataggaaatagatgacctattgacctttttgtattatgggtaaaagaaggtagatacatgcctgtaatagtctttacatcctacacttagtcttctactaccatttactattcaatgtcaaatggagtgatactctataacttccttgctgggccacattattagtggatcaacacactgcacagcggccagcgggtagtattgtaaatatcagaaactcttcagatgcttgagtacattatatttgaaacagaccctc

SEQ ID NO: 2959 - DNA, 446 bp, Sorghum bicolor
  Clone ID: SORBI-28MAY03-CLUS49897_1
agcacgagggtgcgattaggctgggcaagtgataaaccattgctgggatttgttggactatcaaagttggtcggatgatatctcttgggtgaaatactacgccagccagtatagctacagctagtttgccaggagctcatatggagaggcggctcctggaggcagccatggttggcagtgccacatcaatgaaggagatggctgcacaggatccaagcctgctgcttggaacaactcctcaagggaacacctgcctccacatctcctccatccatggccatgaggggttttgcaaggatgtgctgacgctaaacaattctcttctcactgtcacaaacatggatggtgagacaccaatgctcactgccatgacaaatggccacatgtctttggcctctactctacttgaatgctgctgcacactagggttcagtgaagcaatcttg

SEQ ID NO: 2960 - DNA, 520 bp, Sorghum bicolor
  Clone ID: SORBI-28MAY03-CLUS49938_1
gcacgaggccgaccccttcccactcgccccgtccgtgtgaccgtgtccggcgaccggcgcccggcctcccccacgccccccgcgcggctccgcccccgccgccagccgccacctcgccccccgcgcggcggccccccacccgcccggcgcctcgcccccctccgggcgccggccggcccctggtgctccacttctcgctgcccggtccattttgtccccaggccaggctggtggacgactagattgaactgacaataacaaaaggaaagaaactgggacagcgggcagcatggataacgaggagaataaggaaacatcagtgagcatcagcaacaatgacacagacaccaatggtttggatgatgatgactatgatgatgatgatgggaagcacacagtgatgcttggccctcaggttcccctcaaggaccaacttgagctcgacaaggatgatgacagcctaaggaggtggaaagagcagctcctcggagatgttgataccaacaagcttggagagact

SEQ ID NO: 2961 - DNA, 530 bp, Sorghum bicolor
  Clone ID: SORBI-28MAY03-CLUS49953_1
gttccccaacggcgtcggcgagtacgtggacctgatgcagggcctcatcccgggcatgcgcgacggcaccgtccgcaccgcgctcgacaccggctgcggcgtcgccagctggggcggcgacctgctgggcaggggcatcctcaccgtctccctcgccccccgggacaaccacgaggcccaggtgcagttcgcgctggagcgcggcatcccggccatcctcggcatcatctccacgcagcgcctgccgttcccgtccgccgccttcgacatggcgcactgctcccgctgcctcatcccctggaccgagttcggcggcctctacctcctggagatccaccgcgtcctccgcccgggcgggttctgggtgctctccggcccgcccgtcaactacgagaaccggtggcacggctggaacaccacggcgcaggcgcagaaggccgacttcgacaggctcaagaagatgctggccagcatgtgcttcaagctctacaacatgaagggagacatcgccgtgtggcagaagtcctgcg

SEQ ID NO: 2962 - DNA, 501 bp, Sorghum bicolor
  Clone ID: SORBI-28MAY03-CLUS49985_1
gcacgagggctgtatcattcttggatggactggacaaacggcaacaggctcatgctgcagatgcactagttagaaagctcagtgctgttgacaatttggatgctgctagtcttttccttaaaaatgttctggacaagcattatgctgttgaccatgcaacttatacaagcttcatcaattcatgctatgaaagcaatagatatgctctagcttctgaaatttctgaaaagatctcaaagcggatttctggctttaagaaaaaggatgttgcagttattgcttgacttgcaagagcaatccgaatttctcccactcatacagcatagaaatcgctcgatgttcctttttagcacagcttctatgcctatcaatggctgtaaatggttaagatgaccaaatattgattaattgattggataagagctgtttgaggatttgtatggggtctgcttttgcataaaccatgtgagttgaaagaaaggtaacaagtctttcttaaat

SEQ ID NO: 2963 - DNA, 521 bp, Sorghum bicolor
  Clone ID: SORBI-28MAY03-CLUS49988_1
gcacgaggctgcaactgctaaactctcgcacgaccctgcgtataagtcactgtactagtgtcctgtggccaactgaaggtgagaatgattccccattcgagttcccagttgaacagctccagatatcagattgtggtgccactgtgaaggaattggtacagctaatctcttatttccctaacctctcaacgttggacctacggaggtgtggtaacaagcaggcaggagaagcagaggaaatagaagctgcaacaggagaacagctgtccatgcccctccaattgaaggagttgctccaaaatcagagctctctgagatcactggaaatagaagctgcaacaggagaacagctgtccatcccctctttttactgccctttcccgacctccctgcagtccctcgtgcttgagggtgtgaaggatggcatgctgactctggctcctctcacaaatctgaccaaattggacctatatgattgtgggggtctaagatccgaggacctatggcctctccttgcccag

SEQ ID NO: 2964 - DNA, 525 bp, Sorghum bicolor
  Clone ID: SORBI-28MAY03-CLUS50035_1
caggaaagcaagaaccggaagaaacagccaatatacagaacgagccagcacaccgttttctcatacggttggccccggaattaggcgcctcgattgcttgctagccgccggattaatctttccctaagttcctagatcgacaaggcgagttggttgggtacttgggttggtttgcttcaggtgaaactgctgagagcagattcttggattccttgacttcaaagtttgcatgtccgctcaggttttagtgggatatgatgaagctaaaaagtagacgactgctgttctacaaggatgttgagccagaagactgccattcaggctcaggtcatccacatttgaccgctcaagccaagtttgcagccatgaacatgcagactgaagatgtcaagactcgtcgaccagttcaagtcaaacgaagtagatgggttcttggtgatgttaccgaggtgttggatcataattcttggagacttgggaagattacagaagtgctgaagaatgactgttttgtcatcaggctag

SEQ ID NO: 2965 - DNA, 768 bp, Sorghum bicolor
  Clone ID: SORBI-28MAY03-CLUS50000_1
gcacgagggtgattagcaaggcagcaaatcaacacgcctcataaaaaccaggtgtaaagcgggtgttttcgaattcgcaatcttttcctgatcctccgcaagctcacaaatcccccgcttgtcctgttccgcttgcgcccgcaccgccgccgccgctggctgggcaccgagagaggcccagccatataaaggagactgggctgcccccccggctgagagctcggccagtcgagcgcgcgacgctagcggcggcataagcagtccagtcggagaagcggaagttcgcgtgtcgttgctgatccaatgggagagacgaacgagcagccgccgccgccgccgccggtcgccgcgccgccgcccatgatggccatgatggtgccgcccgtcggcgcgggcgccatccacccgccccacgagcagttccaccacctcaactactgcgtccactcgaatccgtcctgggttcaggtggcagcacttgcattccttcactatcttgtgatgttgggttctaccgtcatgcttgcatcagttattgttcctgcaatgggtggtaacgctggtgacaaggctcgagtcattcaatcgttgctctttatgagtggcataaatacactgattcaaacacttattggaacgagacttccaacagttatgaatgcctcttttgcatttgttgtcccagtgctctcaatagcaagagagatcgagtcaaataatgacttgctgaatgatcacgagagatttaaacacacaatgagaacagca

SEQ ID NO: 2966 - DNA, 432 bp, Sorghum bicolor
  Clone ID: SORBI-28MAY03-CLUS49761_1
aatgtccatgagctggagctgcaagcataccaatccactgtcagagctttccatgctgcaggacccctgacatgggagcaagagtcactactgacaaacctgcgcctctcgctcaacatctcaaatgaggagcacttgcttcagttgaggcatctcttatctatttgaaaattttgaaaaactaatatgctattttatactgtggaatacctccaactcatagagatctccacagccttgtagcatccgttttccaccttgatggtgttgtatataaagaagagttcagagaaattcacctatagttgtactccaccaaaactttgttgttaggagtaaacgaggcttttaaatgtaaagctatcgtcgaaacttattagtcatgttgataatcaagtttgaaatatcagtttcttcaaaggaagctgaagt

SEQ ID NO: 2967 - DNA, 529 bp, Sorghum bicolor
  Clone ID: SORBI-28MAY03-CLUS49773_1
tggattcgtcaaatgttgcagcagcttttcaaactgtcgttaaggagatctacagcatactaagcaggaaggtgtttcaatcactagagcagaagaaaagcgagctgcagtcgctaagcaacgggaaagccgtggtgctgcagggtgagaccaaccaaacaagcagtggtgggaggtggtgctgttcttcatgacctcaggaccaccaggactaccattatggagagcgataggattgggaggacacatctgggcatgtaaacctgcaggtccgatttgtgaaaagttgtttttccatgttcttgttctaaaggtaagctggcgaggctggttgtatgaaagttggtgtttcccgtcggaggaaatcaatgtatagttcgattgatccttgtgggaggtattgatatacatgattgtgtaaagagaatgtgcgaccaacttgactgtcgtgtcattctacatcattctagcccgaaaccgttctttcattctgcattactccgaacctagatatctaagtacctgaccc

SEQ ID NO: 2968 - DNA, 266 bp, Sorghum bicolor
  Clone ID: SORBI-28MAY03-CLUS49775_1
gcacgaggggcaaaggcaaggacagcggcagcgtcgggtgggtgatgcacgagtacaccatcgccgagccgccctgcccgtcgcccgtcaagatctgccacatttccttcagcggccacggccggaagcgcatgcgcgtgccggatgggcgacaagtctgccagagtagcgctcacgcgcgcgtcgcctcctccaacgccgcatcagcgcttccttgttcttgggcaatgctcgatcacggctcaagcgtgccatatgattctgga

SEQ ID NO: 2969 - DNA, 414 bp, Sorghum bicolor
  Clone ID: SORBI-28MAY03-CLUS49777_1
ctcgccgccgccgccgccgaggacgacggcgataatgtggcgttcgcgagctcgtgcgcttctcctacttcgctcgaccattccccggtcaccgccgccacctccacccccgtgggccactcgaaccctaacccacctcccaccatccccgccctctctcccgcttcctcgcctcctctccggatcccatccccgatgcctcttcctccgccgccgcggatcccttccctgaagccttctcctccccgaccgaggcctcccaagatgatgctactgaggccggggaggacaacctgagttcgatgtgggaggaagctggggacgccgacgatatcttcgtctcccccagcggcgccgacgccgtagccgacgatgaggaggtcgcccgcgtgtgcgccgccgtcgagtccactc

SEQ ID NO: 2970 - DNA, 624 bp, Sorghum bicolor
  Clone ID: SORBI-28MAY03-CLUS50093_1
gaaagggaaaaagctctagagaccatgcttatggagaaggagcaaaaagaagcagagctccaaaggaaagtggaggagtcaaagcagaaggaagccttcctggaaagtgagcttgccaacatgtgggttctagtagcaaaactgaagaagtcccagggttatgaccatgaggatccggaggccaaaaatgatggctcgtgacctcatcagttaagataaatctgcttggtttgggtgtggccgtgtgggttttctgtatgtaagttcttcgtattgggttttcggtttcttagcatgaattagtgtctcattctgtatattctccgcgtgatcaatatgccagtagtgccttgcctgactgtgcctagagctttctattgatgctagagcggcattttgggttcttcaggcacataatctgggtttgaagaaacaatggacaagtgtttggaaatctgacgggtttctgatgctctcactcaactatctaacatgtattagtctgctcatcctggtcttggatattgaaaggataacaaatgtgaatatgccctgaagtgtgagttctattgtatcagaacactatcgtttcaacatcatcaatagtatatgcttgtttttgtc

SEQ ID NO: 2971 - DNA, 563 bp, Sorghum bicolor
  unsure (1)..(563): unsure at all n locations
  Clone ID: SORBI-28MAY03-CLUS50094_1
agagctgtcaggaagaggcccagagaagacaaggcatcctgagagtgagagttcaccactacacgnaatgcttgctggaatgattgctgaaagtgtcagtaggagcattcccatggtaaatatcatgagggacaccaagattgttcggtgtcttccaagatatgaatctgccaagaaagctccgagaaggggagtcaggtagcacgtgccctgccagaaagcgacgttgctggctgcagcgacattgctttgcttctgcaccttggtcatgtagctcaccaggtttgtcccaactccgtagtatgccatagcgccacaaaattcacccccaagaatcgagtagcaggctctccagtttcccgtatgccttttggacgctcggttgcctctgatatcaacagatccattgcaagtatattgttcatagtcctgtgaaggcgttccatggagaagaggaagaagaggcagcaggctcgactcctccgcctcactcatgatggaatctcctttcattgcgtttgtgtttgattctcggtcagttcagttcagttctagcctcgtgc

SEQ ID NO: 2972 - DNA, 511 bp, Sorghum bicolor
  Clone ID: SORBI-28MAY03-CLUS50099_1
cgccttttacagtaccgaagcataaacttcgcccattttctcgacaccagatttggggagcaagccgcgtccttgatgctcggttgctgtgttgttgtgttactcgaagggcataagcatgtagattccatttctaaggatccttccacaattgccattgtttgctggagagggaaggggactatgaacgttatggtttctccctcggatagaaaggatcttcttgaaaggatggtgtagtggctttggccttaaagactgtgtagaggaagatgagaaaatcttgtcacaaggttagttgattagaccaagactgacagtgacaatcaagaacacgccccttgcgtagtccgagtaaataaaataggctgacgtagcactgcagcatgctgttggcggatgctgacgtcccactgttttttgtttctgaagttctgtgctattcttgcgtgtaaacgagtcatttcaaatacaatacttttgaaaagtaacatggtcagttgaacttgtg

SEQ ID NO: 2973 - DNA, 568 bp, Sorghum bicolor
  Clone ID: SORBI-28MAY03-CLUS5010_1
gcaagtcatgttttcaacccatcctttcatatcaagatactttgagaaacagagtttgaaagctgcatttgcaactgctccagctgatccaacagtagacctaaacatgcaaatgacaaaactaggacatggtttgctctctggtaaatattctgcaccagcaaaggaggggcaggaagggatacgtcctcgcatgtttaagtcagttattgccgcgaaccatcctgaattttctagcatgagacaacaggatgccctcgacttcttcctccaccttattgacagagttgagaaggcaaaccctgggaaccatgagctaaatccttgttccggtttcaagttcattgttgaagagagggtccagtgcccttctgggaaagtttcctacaacaaacggtctgactatattctttctttgagcataccactgcatgaggcaacaaataaagagcagctagaagcttttaatgagaagaaagctgcaatggacttggatggaaaagaagtgtctaatgaggatattgtcaggcctagagtcccattggaggcttgcttagcgagtttttca

SEQ ID NO: 2974 - DNA, 696 bp, Sorghum bicolor
  Clone ID: SORBI-28MAY03-CLUS50101_1
aaggactcaaaagactactatgggctagcccctggcaaatctgtcatgctaaggtatgcattccccataaaatgcacagatgttatctatggtgatagtcctgatgatgttgttgaaattcgagctgaatatgatcctttgaagacttctaaacttaagggtgttctgcactgggtttctgagccagcacctggtgtcgaaccattgaaggtggaagtaagattatttgagaaattgttcatgtcagagaatcctgctgaattggaggattggcttggtgatcttaaccctcactccaaagaggtgataaaggacgcttatgctgtaccatcactcgccactgcagttctgggtgacaagttccagtttgagcggcttggctacttcgccgtggatacggactccactcctgagaagctcgtgttcaacagaactgttaccctccgtgattcgtttgggaaagctggacccaagtgatgactccagtgtaatttagggagggcatggtgttttgatcggttgcagaggcacaccggagctatacactcttaagaagaaaatgatcagtttaaaggccttactctttgtaaaatttacatgtgactgcagcttgtttgctttgaatgaatcagattttgtatgatatagtgttagtgtccaggttcgcaatcaggtttgatgatgtcaagggctaaa

SEQ ID NO: 2975 - DNA, 443 bp, Sorghum bicolor
  Clone ID: SORBI-28MAY03-CLUS50109_1
ctcccctgccggccctacggcgccggccggcggttccgccccgcctccccctcccgcccttcccccccctccggcgcccccccccgctccggttccctctcgtgcacggggtcccctggggcggcccttccggatggtgggcgggcggcgctcgtgggtcctcctgtgtgcgcccccttgccccttctcgtcgtgcgcggtctccccatcctggagggtgggcggggtgctcttgtgcgccctcctgtgaccgccctctggcccccgtccttgtctcgtgttctccctctcctgctctgtgtgtttggagttgctcccctcttgttggtggcccgcctctgggctccgtctgttgctggattcgttcctcctcatctctggcttcttgaattgtctccctttttgatgtaagcacatctaaagtgtcagtctgttgaaggata

SEQ ID NO: 2976 - DNA, 717 bp, Sorghum bicolor
  Clone ID: SORBI-28MAY03-CLUS50117_1
cggtgatccatggtgaagactacatttgtttgggtttcctttttggaagaaaatcaaaagttgcttacatatcagatgtttcgcggtttcccccaagcacagaatatgcaatttcgaagtgtggagggggccaactggatttgctcatctcggatcgcctggtcacgtcggggtcgctctatctgctccttcgttcggtcccgactcttgatcctgcttcgtggtcttcccccatttgtgccttccccatcggcctctccctggacatggatcatcacaaggacaaccaaacattggaagaatggtccaggaggcaaggccttcttccgcggctggcgcgtcttggcctgcgtgccgacattgctccgtcaccgtccgtgcacctggcctttctcagtccgccccgcccgccgtcttgcctctcgtcttcgtccagcccctcctggccagactctgcgatccgcgccggcttttttggcggacgtcctcttccgggcctctttctgcgggcgctacaagtcgatctgtcttagccggcgttctgcctcgctggggcatccgtcttcccccgcatcatggtgggatgttcttgtctattgtatgcttcgctgctctagacgcgtgtcccccaatcgtagtcagcatgcttcttcccgcagctatgttgcactagatgcatgtgcatcaattgaattgagcatgtgaattttccctccg

SEQ ID NO: 2977 - DNA, 252 bp, Sorghum bicolor
  Clone ID: SORBI-28MAY03-CLUS49844_1
gcacgaggcagcagctagcccccgcggcagctgtcgtgcccagccgccttctgcgcctcccctacctcagccggaccctatcctcccgcccggaaaacagtattggacgatgttgattagagcggatggtggtcatgccacaagaaggtcgaagaagaataaaataacttgcaatgacgatagagacacaacagagccattgatttcaggtgatattcatcaggactcagaacaaggtatctggagtgagct

SEQ ID NO: 2978 - DNA, 476 bp, Sorghum bicolor
  unsure (1)..(476): unsure at all n locations
  Clone ID: SORBI-28MAY03-CLUS49875_1
gcacgaggcgcatcccaaagttctcacgcaccaggcttcggccccccggccgcccgctgcccctctccctccctgctgctcccctccgcttcctccggcctgacccatcgccgccggcgtgcgtcggtggcgacgacgttcgtggtcgatagcatggacgcggcgaggatcatagcctacttcaagggcaagtgcatcctcgtcaccggctcaacaggctttcttgggaagattcttgtggagaagatcctccgggtgcagcctgacgcccacaagatctaccttcttgtacgtgcgatcgacgcgccatctgcaaagcagcgcgtccagcaagaggtgattggcaccgagctgttcggcaagctgagagagaagcacggggaagacgggttccagcagttcatgcaggagaagatagttgccttgcctggggacatcatctacgacaacctgngactggatgctcctacgctgga

SEQ ID NO: 2979 - DNA, 378 bp, Sorghum bicolor
  Clone ID: SORBI-28MAY03-CLUS49883_1
gcacgaggcagtcatcacgcccccaaccactccctccctccctccggagcccctcaccgccactagctaccacagcagccgcagcggcggctgtagtactactacctgtaccgtccctcgacttgcaccacacgtccggtgttggtaggcaggccgcaggcaagcgcggcggcggccatggcgctggcggggacgggggtgttcgcggagatcctggacggcgaggtgtacaggtactacgccgacggcgagtggcgcagctccgcctccggcaagtccgtcgccatcgtcaaccccaccacccgcaagacgcagtacagggtgcaagcatgcacccaggaggaggtgaacaaggtgatggacgcggccaaggtcgcg

SEQ ID NO: 2980 - DNA, 726 bp, Sorghum bicolor
  unsure (1)..(726): unsure at all n locations
  Clone ID: SORBI-28MAY03-CLUS49937_1
gaggagacgtagcagcagcgggaggcagggtccccacgctcgccggacctctacgacctctccgacgactccgactacgccgccgctgccgccgctgcccgccgcacggtgatgcggactgatccggcagacagaggctcagaggagacggcgagggtggacgtggtatatgagaaggagcgtgtgaccatccacccatcacagtatggctccggtcgtatcagtgggaagttgcgcttgtttctgcagcagggatcattgttcctgagttgggggccaaacgaaggagctgactctttgtcaaccagttcagtcggtgtggaaatagaaaaatatagaaatctgtacactatcaaggccctgcctttaagtgatgtacgcttcatccgtaggtacaccccaacatttggattggactacataataattgttctctcatcaggtctggcttttcctccattctatttctacaacggtggaattcgtgaattatttgcaacactgaaacagcatgtcttcattatcaggtccgacgatgatcctaatgtttttctcgtcaacgactttcaagatccccttcagaagagcttgtcgtccttggagcttccaggagtagcctctgtagcaaatgccatgtcaagacaaaattcactcagttttactgggtcaaatgatgagtccagacatggggcaacatctagcatgtctcagtatagctcanagcaa

SEQ ID NO: 2981 - DNA, 466 bp, Sorghum bicolor
  Clone ID: SORBI-28MAY03-CLUS51163_1
gcacgagggatctgtctagcaacaggttctccggtccaattccgtctgagttgactaagctggcaggcttgggctatctcaatctctcttccaatgatttccgtggtgcattgccgttgggtttccggaatttgaggaaattgaagtacttggaccttcatggcaatggcttcacaggcaaattggacgacgtgttcgtgcagctgcagagcccagtccatgttgatttaagctgcaaccagttctcggggtccttggcatcgatctctgacaactcatctgtggttagcacgcttcagtacctgaatgttagccacaatgtgctgtcagggacattatttgaaagtgttccgatgcctctgttcgacagccttgaggtttttgatgcgagtttcaatatgctcagtggcaatatcccacagtttaattttgtgatctccctccaggtgctgcgcttgcagaacaa

SEQ ID NO: 2982 - DNA, 380 bp, Sorghum bicolor
  Clone ID: SORBI-28MAY03-CLUS50241_1
cctccccctccctcccctgaaaattcactggtggatgttctgacgagtttttttttatagcgaggtgtttttttattcaattattagtaatgggtagttatattcttccgtcaaaattagcaggagaaaaacttctaaaatgtgcttatccggctggtgtcgcgtgctgcttagaggtatgtctagagaattgagtgttcccggaattggattgtcttttgtatcagatcagatgatataaagtcccaggagtccaatccaaagcgaaaggcatcaatcaagtggattccagggttacccctgagtcctgcccaatgtaaaactattacaactccagtatcaagaaatgcgggtatccttttgaggataactggtcttgt

SEQ ID NO: 2983 - DNA, 416 bp, Sorghum bicolor
  Clone ID: SORBI-28MAY03-CLUS50248_1
gcacgagggccacagccgccgtgggcaaggggtcgtcggacacgtccgggagctcgcagagcccgcggtcgtcggcgaagccactggagtccaagtcgtccagctcgtcgtcgaggaaccggcggtactcggtctcgtaggcagtaggccggggccggcggcgtaggctgtacagaggaaggaggagcctggtccaagcccaatcgtgaaggttggcgagctgctgctaactttcagagtcagtgttgatcacaaagtgcggcagtagggcagggagctagagatctttgttcggtcagtgtcagtctagcggctctgatttggggatataatccctggtttctgtaacagacttggcaactatgcttgactcgaatactcgatgaacagggcaatcctttttggcggctctgttt

SEQ ID NO: 2984 - DNA, 176 bp, Sorghum bicolor
  Clone ID: SORBI-28MAY03-CLUS50260_1
gcacgaggatgttcgccaagaccaagtacgagaagcccgggctggagctcaccaccaaggccgccgtcgccaagggcaagcacggcttcctcccgttgcccaagaagtcgtacggcaagtcggacgcgttcgtcgacaccatcccgagggcgtctcacccgtcgccgttcctgagc

SEQ ID NO: 2985 - DNA, 711 bp, Sorghum bicolor
  Clone ID: SORBI-28MAY03-CLUS50296_1
gcacgagggttctcttccccccccacccaaatcgatcgccatccgccgttgtctgccggcctctaaaccctacatcctccttgcggtgctgccacccccctctccgagtttcggctgctcgctcgtgttccccgatcgggttcctccgtggtcgctcagcaatggaggagatgagggatatggcacaatcaaccctggcggtggcgtccgcggccgtgatctcattggtgctcggcgacgacaacctcctcggcgagatcctcctccgcctagggttcgccaccgacctcgtccgcgccgccgccgtctgtaggcgttggctccgcgccgcgtccgaccccgtcttcctccgccgcttccgcgacctccacccgccccgcctccacggattctacatcgacagctatccgaatccgaccctaaaacggaggttttacgctgaatttgtgccgatgcagcctcagcccccagagctcgccgccgtcctccgccgggggcgcttcagcttggacacctacgacagccaatccacgcgcatcctggactgccggaacggcagagtcatcgtcagcttgttttgcggcggagacttcaaacgcggagtgcacagcccgctccatccagcgagagacttggttatcttcccgcagctcccaaagaaggatgtccctgacagtgacagttacagcagcaaaatccgtatcttctatg

SEQ ID NO: 2986 - DNA, 482 bp, Sorghum bicolor
  unsure (1)..(482): unsure at all n locations
  Clone ID: SORBI-28MAY03-CLUS50313_1
gcacgagggcctgctgtactgttatggggtcaatgctaacttgtgtactgtaggctgtggcgccggcatggtaagaactaagaaggtctagagcctagatggctaggaggtctatctcctgcactacctctgtcccgaagtcatagtcccctatatatagacgccccatgtacccttgcaacttaagaagaaatagatcaaagccttagctcatatgttctgcccctgacttgggcgtcatcctactggtcactgttcctaccctctcacttctccccaaatccccctccctaatccggggtaatctaagcactaacatatatattctcccttcttgtgagactgattaggggatagccaatgatctgaatgtgcgaagatgtgacctccttatccataatacaaagagaatgtgcaccgccagcctaatagtaacaaaccatgaagcagaanacttcccctattgttctcttgcagaggat

SEQ ID NO: 2987 - DNA, 639 bp, Sorghum bicolor
  Clone ID: SORBI-28MAY03-CLUS50315_1
gcacgaggccttgaacagccatctttctccacagctgctacaacgtcgggagctctacagcatataaattctgcagccagtatggcaggaatttcagatatgacaatggcaacagcaaacaatgagaatgcatcatttcagtctgcgcacgcggctcagaggtatcaagttaatgcccctgttgataagcctgctgatgatggctataactggcggaaatatggtcagaaggtggtaaagggcagtgattgtccaagaagctattacaaatgtactcatcccagttgtccggtcaagaaaaaggtagagcacgcagaggatggtcagatatctgagatcatatacaaaggcaaacacaatcaccaacgtccaccaaataagcgggcaaaagacggcaactcttcagcagctgatcaaaatgaacaatctaatgacaccacatctggcttgtcaggtgccaagagagatcaggacaatatatatgggatgtctgagcaagcatctggtttaagtgatggagatgatatggatgatggtgaatcaaggccacgcgaagcggatgatgctgataatgagagcaaaagaaggaatatacaaatttcttcacaaaggaccttgtcagagcctaagattattgtt

SEQ ID NO: 2988 - DNA, 322 bp, Sorghum bicolor
  Clone ID: SORBI-28MAY03-CLUS5252_1
cggacgcgtgggtttacatgtgatgtatccaaactatctcaattctttaatgcatattgaacccccccccccccccccaaaaaaaaaaaaagaagtcaagtgtcttctacacacttccaagattgtgtacatttttcggtagtgaaacccaatcttttcagtttgtgctttgctttgggggggcctgtaagctggccgtatgctgtatacttctttgccgaaccacttttttatcaacaagtcttgttttttttaaagttttttttttaaaaaagaatcttttttttttttggggggggtgggcccctgacaacactttgca

SEQ ID NO: 2989 - DNA, 889 bp, Sorghum bicolor
  unsure (1)..(889): unsure at all n locations
  Clone ID: SORBI-28MAY03-CLUS52537_1
gcacttccacagccgagagcagcagcagccagcacggatgaggaagccaatgccggaaggcgacgcttctccccagccactccgggatcgaagcaatcaggatgaaattggatctttgttgtggcttaagaaggctggttattaggtgctgagcacagatgttggaaggtgggacccataatcttgcaatgcagacgaatcatcagaataccaaatatggggaacttgcccgtaatatccgagaaaaccagcttggaggggtgatctttggctgcaagcatgatacaattgaagaatgcttcagaaaacagctattcggtctgccttcagtccactattcatatgttagaaatgtcaaacctggcatgcctttatttctattcaattgcacgggcagaaagctccatggaattttcgaagctgcaagtcctggtgagatgtatattgacccatatgcttggagtaatgatggttctttaaggacagcttttcctgcgcaggttcgtatttgcacaaagactcagtatccacctctactggagagccaattcaaaacattgcttggtgacaactattacaaccatcaccacttctattttgagctcgaccatgcacagacaagagccttgatttctttgttcaaatcacttgctcctgcntaatcaagttcaagctgtttcaagcaaaaggaatattgcagtatcatcaccaccaactagaatgaagctatcagctgttcctgacccaaagaaggtcacagcaaattctaaggacaccaatccatttagtgttctatcaaatacagccgctccatttaactgggctgatgatgtggaaaatgctagtaacactgatgaccagaaaatctgatgattcagtttctgatttt

SEQ ID NO: 2990 - DNA, 783 bp, Sorghum bicolor
  unsure (1)..(783): unsure at all n locations
  Clone ID: SORBI-28MAY03-CLUS52555_1
gcacgagggttagccgggccggtcggcgtcgaagctacacgacgttacgacgtactacgctccccggccggctggccccggcgtgcacgtcgtccgtctcccgatcctccaacaattaatccgagacgatgatgagcgacgccagaccatcgtcggcagccgccctcgcggtgctgctcgtggcgngcggcgctggcggcggcggccttttccgccccgccgtgtgcgtccgcggcgacgctgcagtgcgcgcaggtggcgcagctgatgacgccgtgcatgccctacatgacgggcgcgcccgggatgacaccctacggcatctgctgcaacagcctgggcgtgctcaaccagctcgccgccacccgcgccgaccgcgtcgccgcctgcagctgcgtcaaggccgccgccgccgggttcccggccgtcgacttcgcgcgcgccgctgggcttcccgccgcctgcggcctctccatcagcttcaccatctcccccaacatggactgcaaccaagttacagaggaaccatcacactaaccgggcacatcacatagaatacaagctgaagaaccaagctgttcaagttgatcgagttgcttcatcttccaatccaaaaaaataaaatgaagaaacgctacgcccatctagtatcttgcatctcttgctgttttattccttcaggtcttttttctttaaccaaacctattcattcagtttgatgatgatgtgatctgctatctggattttgtaaacgagttttcgttcctgtggttctgaactggt

SEQ ID NO: 2991 - DNA, 637 bp, Sorghum bicolor
  unsure (1)..(637): unsure at all n locations
  Clone ID: SORBI-28MAY03-CLUS52592_1
cgctccttccccttcaccacccatcacaccacgcacgcagagacgacagcccgtcgtctcccctccacccggcgagcggacctgtcctctggacccgctcccgtccccccccgccgccgcgcgcgcgcgctggtcgggcgctggtggtggtctggttgatgcagcagcggggcctcgcccacaactgccgctcccgcggcttctcccgctcccgcgtcgccgtcgagggcgcctgaacgcacgcacgccacccagcgcaaccgaaacccccccgatccggctcttcctcgcgttattgcagctttttctaacgccgtagaaaacgaaagagaacaaacacaacagaaataaaacccaccacaccaccaccaccaccaccaccgtccgtacgcccgaaaggaagaggagtcgagatgaacaccgtcggcgtccctgtggtagccgtggcgaatggcgtccccgtggtggacgttgcggatgggatcggtgaggtggagcgcaaggtgcagaagagctactgggaggagcactccaaggacctcaccgtcgagtccatgatgctcgactcccgcgccgccgacctcgacaaggaggagcgacccgagatcctgtctttgcttccctcttacnaagggaa

SEQ ID NO: 2992 - DNA, 514 bp, Sorghum bicolor
  Clone ID: SORBI-28MAY03-CLUS50388_1
ggttgcagcaatacatgtcaaaaactgcagtttgcaaactcatatgcttcaacgaaaccaaaagcagatcccgacacaattgtagatcagtttgcctcgccacgttggtggtcactaacatcacacggcctcatgttttctcactggagactgtgctacaggtaataaaaagctgtaaccatttgatgggtgtgaagcgtttcctaatctgctcgatcgacctcactgagtgtagctaattcatgtaattttttgagtgcatatcaaccatagaagcggcctccccttacctgcagtcgctgcagttggtgtatacagaaatccctagccttgacccaaagataagcttcctgtagatatgaaaagagcttgtcgtttgtgtgcttactcttctgtgtggagtgctcgagtggtgatgagtgtttgtattgttgaaagggagacagttgttggcttgatacaggtgttttcatggcaaaatattaacacggaagttgtttatcctgacttgctc

SEQ ID NO: 2993 - DNA, 505 bp, Sorghum bicolor
  Clone ID: SORBI-28MAY03-CLUS50382_1
ttccatggcgactcggccaaagaggaaggccacccgctgaggatcttcatggtggtgcgcgacttcctcacagccctcgatcacgtctgcaaggacgttgtgaagatgaacgagcgggcggcggccggtgggtcatcgcggcgggtggggaacatgcacgttcctgcggtgtttaactcggtgcggtccaccagttcgtcggaggagagctcgtcgccctagccgttgggatgcagcgctgattgtctgagcaggaatctgcatcttgctgtctagaagaacagcagtgcaggctcagacgcagtaggaccataattatactacatattttgtacctggtgaagatagtttgtagagcaaagtaaatcctatgattcagcgtgatgaacatcgtcctgccaatggcctaccaaaggtgaaagtggcattgtacatgattctgcatgctgagagctactgttggatgagagcttttgagcaacggatgataaagctcagtctcatg

SEQ ID NO: 2994 - DNA, 450 bp, Sorghum bicolor
  unsure (1)..(450): unsure at all n locations
  Clone ID: SORBI-28MAY03-CLUS5040_1
aatgaaaccgcatcagttggaaggtttcaactttttggttaagaatttgattggagacaagcctggaggttgcattcttgctcatgccccaggttcagggaaaacatttatgcttataagcttcattcagagcttcatggcaaggtatccatctgcaaggccccttgttgtgctgcccaaagggatactaggtacatggaagaaagaaattcaaagatggcaagtgcaggatataccattgtatgatttctactctgttaaggctgaaaaaagagtagaacagttgcaaatcctcaaatcttgggaggacaagatgagtatactgtttcttggatacaagcagttcgccacaatcgtcactgatgatgggggcagcaacgtcacagctgcatgtcgggacaggctgcttaagggtcccaaccttntgatacttgaccaggggcatacacc

SEQ ID NO: 2995 - DNA, 641 bp, Sorghum bicolor
  Clone ID: SORBI-28MAY03-CLUS50413_1
tggctgctgctgagcagaaagccagcgttgcgggctctgctatattgagtaaccaatatgtctcggctggtgcctcgtggttaactagtgcatttggtatggtaacgaaggcagcaggtgacatgacctcgatggctaaagataaggtagagagggctgaggaggagaggaaagccatcatgtgggaggagaggaatgggttggtcagcgactatgcaaagatccatcttgacgaaccctcttcatgggagcctgcagttctgcctttggaatcagtggatgagcagaagctccaagctgtctgatacacacaaaccgaatgtctcacacgtaattcttttgcagctcgtcctatatatagattattctttgtcgttgatgcaccgggtcaaaacatacagtcccatgccatgtcttcagatccgatgcactgggttaaaacaaatgcgcttatcagccatagtgtcgtgtaaatttctgaaagttgctcctgtgttattaccaggttttctttctttctccctttttggagagagtggtgctaccagcattgctacactagactactctgtgtgaatggagtactactgtacttgtctattactactacagaaacagaatacaacttccttcgtcagatg

SEQ ID NO: 2996 - DNA, 618 bp, Sorghum bicolor
  Clone ID: SORBI-28MAY03-CLUS50424_1
catagcaagtaacaataggataacttcattgccttcatcaataggagattgtgaatctctcgctgaggttgacctgtcatcaaatctcttaactgaactgccagaggcctttgggtacctttgtaatcttaaggttttgcatataaggaacaatggcctgacgtccttgccagcaacgttattcaaaaagtgctcgcagcttattacactcgatctccatggcacagaaattacaaatgatgttcttcgacaggtggaggggtgggaggagttcgacgagcggcggaggcagaaacatcagaagcagctcgacttccgtgttggctcatctggtgtgttcgacgaaggcgcggatgatgataacaggcgaaggtgattgcctgcctgttgtcagcataatcgtttgctacgacatttccccccaaacaaccgtacaagtgtgcaactgagaactgaagatcattttcctggagcatgagatgaacaactttttttactcagtcacatagattgacgtgttgagaaatacatggcaccgctgaatacttgtaacatggtagtactatgaaaccaggctagacaaaaatatcatgaatgacgcatacagatactgctact

SEQ ID NO: 2997 - DNA, 632 bp, Sorghum bicolor
  Clone ID: SORBI-28MAY03-CLUS50487_1
ataaatcataacttggagcataggttagaagaacggtttaatcagagaactctgaagtctgatcttgcttaccttgttcgtagtgggccaaaggatataaatgcaatagagatcaagaatctgaccagacagaagagaagaattcaagaggttggagggctcccaactccagtttatatgactgatacaaacgcttggaggcaaggtagtggtgtaattgtttttgaaacaacttcatctcggcagaaacagaaggtcgagagaagatgaaccataggagttgctatttttatttggtaatatatgcagagactcggatctctgctagactgctgctttgagataaaggtgtctaatgtggacgggtctgtaaattaagtcactcgtgcacatcaaatgctcccagcttgcacagaaatgccatattatctccatgtacaagcctatttagtcttataggcacgaatggatagtgatggagatagctgatcttgggcacctagtgtcatcttttattttatactgagctgtgtggctcagacaaaacaaattttgtggtgtatatatatatttgtgtagcaatgtccatgtgtatattagatcggtgctctaattcatgtttacattttctc

SEQ ID NO: 2998 - DNA, 663 bp, Sorghum bicolor
  Clone ID: SORBI-28MAY03-CLUS50484_1
ttagctcccaaagtgaagccatgtatggacagctgctctccaaatatgtcgatgacccaaaaaactttttttctgtgtcgtcagacttctgccactggggatcccggtttagttatacatactacgaagagaaacatggtgcaattcataagtctattgaggccttggaccgtatgggcatggagatcatagagactggtgatcctgtagcattcaaagaatacctgcaggagtatgagaataccatatgtggacgccaccccatcagcgttttccttcatatgttgaaacactgctcaacaaaaattaagattggctttgttcgctacgagcagtcaagccaatgcaagaactttagggatagcagtgtaagctatgcatctgcagcagcaaaggttgatgcatcaggggaagaagagaaacaagattgagcaagctacggcttgtttgatatagccgccaaaccttggtgcaacatgtgtgattggtttcccataaaaaaacatgtgattggttcgcaccgggacctgtctatcaaactttatagcattggctcgatgccagtttgtgataaacaggccctggttgaatgccgattatgtcgccagaaacactgggaaaccagacaatcaataaaactgttatctggggatgtgttctgtc

SEQ ID NO: 2999 - DNA, 506 bp, Sorghum bicolor
  Clone ID: SORBI-28MAY03-CLUS50128_1
agtctctttttgaaagggacaattgtcgagagttgagtaatactactgcaacaggcttgtttctgcggacccagatagcctcatgctccacggttgggttttagttgcctccatggagctgttttacaaatcttccaggttatacatgaagacacaggctgatgaatggaagaagtatttttgttgctgagattcagaccttagactcttagagtgtgcatttttatgagaatcggctacattcttaatgtcaccaacacaccagctttcgcttgtgatgactacctgcagtatgcgtcattcaagaatgtgggagagtcttcttcttgtaggaaccacgatttgtgtgacaatgtgctgacagagttgcatcccggattgtgtctgtacacgtaaatgggttgtttgtatgtagagctgtccatagatttattatttttccttcgtcagtgtgatgtaaaggggtgatttgcagacaacatgccagaagtagctctttagtttgt

SEQ ID NO: 3000 - DNA, 660 bp, Sorghum bicolor
  Clone ID: SORBI-28MAY03-CLUS50192_1
gcatctggctgcacatggattgcaatggcagcataggagactggttgctggttgataccatttctttgcatgatttgtgtgctaatctgaaaatatcgaatagcagcaccactgaagatggggatgaccctgataatggggatgaccttgatgcttatgtacatatggtggggggcaatgcagagtatgtattcctggagatggatcgatatattctctatttggatgttaggagcagggcactgcacaaggtgctcaccgtgtccgattagaagactgtgatccctttcatcctgccctttttgttggccgggcctccggtagttcctccactgccagttgcatgccgcgaggtaaggggcacttcaacgtttaaatggaggtggcatgagaatcttcagaaagagaggcaacagatgaattgctgatttgtcggttgcagtagtgccaattactatataataataggagtgccgtatgtaatgtgacttgagggcaagaggttgacttatgtaatgtgacttgagggcaagaggttgacttaattagctgttttacatacctgcatttatgtttgaagttttatcaggactgaaggccagagtgtacaatgttggtttatgctcgtagtgttttcagaccaatagtggtttattaaaa

SEQ ID NO: 3001 - DNA, 495 bp, Sorghum bicolor
  unsure (1)..(495): unsure at all n locations
  Clone ID: SORBI-28MAY03-CLUS50200_1
ttcctcgcgcacgattggcgggagacgctggagaagacgctggcatggtttgctccaaaggcgcacaacatgatccggtggcaggccgagaggaactttgagcagcagcagattgtgttcaacgggaatgtgctgctgctgcagacgctgtattntgctgatcgagagaagacagaggcagtgatctgtgaattgcttgtcggcctgaattacatctgccggtatgagcagcagcagaacgcgctgcttgattgctcgagcagtctcgacttcgatgattgtgtggagtggcaacttcagtagaaccaaggtcaggttttctgctctgttccatagtgtacaagtgatatgaaacagcaaagggtacttgtagtttggttttgcttgtttctcttttctttttaccactttgtttttggtgcattttgcacatgagatcgccatctattgttagatgaaatatagagctttgttgactggaaagaccctgattct

SEQ ID NO: 3002 - DNA, 239 bp, Sorghum bicolor
  Clone ID: SORBI-28MAY03-CLUS50240_1
gcacgaggcttcagagagaagtagcttcagaatgacactagcaacattcaggtaggacatgattgtgagtctgccctagttgggattgaggcagctgattcctcttcagaaaaaataatggatatggtaagacttctctaatataaatgagttcacaaatattccctgtttcttgctataagctgtcgccttaccaatgtactcaatccattccatattataagacgttttccttttct

SEQ ID NO: 3003 - DNA, 641 bp, Sorghum bicolor
  Clone ID: SORBI-28MAY03-CLUS50504_1
gcacgagggagccagctgcctccgaagatccgtctgtccccatccgcgtcgcagcagcagacgtcatcgtcgtcgacgacatttcaggtgcaatcccattcccagtcccagtcatccccaccaccacctccgcctccgccgcctccccctccctcggcggtggcagcggacagcccgcgcctgaacgcggcggggaaggtggtgttcaacggcctgggtcggagctccagcagcccgagcagccttgccggcggtcggcgccaccgcaacgcgggtccaggctgcggcatggagcggtcgtactcggcgcacgtccgcgtggcgccggtcctcaacgtgcccgtctgctcgctccgcggctcccgcaagtcggtctccgtcttcggcatcgaccgcctcttctccccgtcaaacgccggctccacctcctcctcctccgccgccggtgcggccaggaagaacaaggacgccaagaaggacgccccccccgccgccgccgccgccggagggcagtaacccgtcggtcgctgccgccactagtgagtaatgtaacgagttgaggtcttggttttgcttggaacaatgcaatgcaatgctcggggttaggcagttaattaatttccccggttaggggacggtta

SEQ ID NO: 3004 - DNA, 604 bp, Sorghum bicolor
  Clone ID: SORBI-28MAY03-CLUS50511_1
catgatattagaagagttgcagtgcgagctgctgttgcaatgggcgaacaaggtgatgtggtggttatcactggcaaagggaacgatacttatcagattgaaggcgataaaagtgagttttttgatgacagagaagagtgccgagaagcattacagtacgttgatcaattgcatcgagctggaatagacacctcagagttcccttggcggttaccagaaagccactgattttgatttagtcaagatagtcgagtttatcaactcaaggagcagcatcagactcccaatttaaagaatgtatgcttttcgaagataggatatccaagtcctgcaagaaaattactccttaagtgctgagttttctaaccaaaatgctaacagctaacaaactgctagcttatcagctattcagttacactgccatactagttattagataaccagatgctccagtaaatgttgtgtaaatgaggtgtagctgtgaaagtagattgatgaaggttcctgatgtgaaaagtcaaagcacaatgtaaggggggcttctggtatcacgatttcaaaatattttgccccatggcagtgaatgtaagatctttttgaagtt

SEQ ID NO: 3005 - DNA, 690 bp, Sorghum bicolor
  Clone ID: SORBI-28MAY03-CLUS50530_1
ggcaggcagcaacatgcaaggcgatggtggtgttggctcaggtggatcgctcctgacggtggcgttccagatactggtcgactccgtccccacagccaagctctccctggggtcggtggcgacagtgaacagcctcatcgcctgcaccgtggagcgcatcaaggcggcggtctctggcgagagcaatccccagcagtaactttgttgaatcaaacagtgttcttatcctttgcattgaaggagcagcaaattttagagctttcatcagtgggaagtcaagaacgcacctcagactctccttgccatgtggtgctcatagtttgggttatttttcgcctagttttcccagaatttctgggtattattccatttcagtcaccgaagaaaatgagtcaccactacgcaagggtagttggttcgggtattgacttcctcttcatgttggcctctcggatgctgctacctctgaatttaggcttctttttcttctcttgtggagtacaaaaccgttatttagcatgtaatttgtgctgttgctgcagttgttcagactttcagtatcctggattccccaaatagagatttgtttcccttaggttttatacttctgcagtgcttcttaatgtctagccatcatttcagtaccaaacgtgtctgtaacgtggttgcatgcatacttgcgttattgtg

SEQ ID NO: 3006 - DNA, 462 bp, Sorghum bicolor
  Clone ID: SORBI-28MAY03-CLUS5056_1
ctcgccgcccccaagtgcggcgacggagcagagtgaggaggaggaagagcaggaggctaggtttaaggtgcacggcgatggcgtcggcggcgaagactctggcgcgggctggatcatccctcttcggccgcatcctcccgtctccgtccccttccccttccatactccgcgccgggctgccggcgctcgccaggctgcagccgcacgtcccgccgccggcaccggcgggggtggacgcttacgaggcggagactgtcgccaggctgagctcgctccccggcgagatctccttcccctgcggcctcccgtcgctccgcttcttcatcgacgacgttgaggatcctgttgctaatgatccccttcagttgcttccgaaacgaacttaccagcccagtaccatcaagcggaaaagaacccatggatttcttacacgtaaatcgaccaagggtgggcgcaaggtga

SEQ ID NO: 3007 - DNA, 721 bp, Sorghum bicolor
  Clone ID: SORBI-28MAY03-CLUS50562_1
gtcctacggcatcgtgtgactccgcttctcccctggtgcttcctgatgccggcccccgggcttgctcctgccggcgcctaaggtacatcgcctggaacccctagtcctcgctccccgctagttgccgctggtattgcatcgtgctcggcctatgatccttggcggggtccctctttggcataggtgttggcctctgtgggtccctcaattgtgccggggcctgcacccgtggcccggtctggttcgtaccctgtgcttccccgggccgggccgtggtattttactgagtggtcctgataacatcaatatgaggagtgttctaatactgacctgctataattgaataatccttcggatggtattacttcattctgataatacaattctcctcataatctttcaaatgaagtgtacctggcaacttctttccatggcttaaggagttgtcttgtgatggtatctcaatcgtgccagagaatgcagccgatgccaggttttgaacatactatgagaatcccctggccatgccttgtaaattttatgtctctcttagatttctttgtacagtatgtaactataggtaaccatgaaaaccaaaggtttaggctgacagtgttcaggcctcattttttataccgctccagagcgtgcaaatgcagtgccataggtgatatctgttgtatatatgtctgtttcttcatctcttgtagtgtaacatgtc

SEQ ID NO: 3008 - DNA, 671 bp, Sorghum bicolor
  Clone ID: SORBI-28MAY03-CLUS50565_1
aaagcagagaaggacaaggaaagagccgagttcaaagcacgtaaggaagctgaggagagggagaagaagaaagcaaagaaagacaaaaagataggcacaaccccagcagagtcgagcgccattgctgacagcaatgctgcggctttggctacagcggatactgacagcaatgcatcagacaacccaagggaagctgatgtttctcaaccagcggctcccaagaggctgtctaggccagcagcggcaatcaagcaactgaacaggttgcagccgatgccagcgcccctgcgcaacaggggcaggaggaagctgcggcagtacatcctgattgcagcggctgtgctatcggtgctggcgttgttcgtggcaggcaactatattcccaggctcaagtcggttcactcctaagtttatcggtaggaaaggggtgcggtgaacctggttcttctacccagaggattccttcgtcttatttcgactgttccggttgatttgtatttattttccccttatataggttgtgatgatgagagttgagggtgcattgtgttaaagttgtttaccggatggtggtgaaatattcgttagaacatggtaataatgactatagattcttttttgtatataggcccttctggtggtctcccttagacgtatatgatttttaatcc

SEQ ID NO: 3009 - DNA, 203 bp, Sorghum bicolor
  Clone ID: SORBI-28MAY03-CLUS5072_1
cgcagagcaacccattaccgggattcggatgctgccacatggcgagaggggagagatggggctcacgttaaccaagctgatcagccgcttgttcgccaagaaagagatgcgaatcctcataggggcactaagactccgccggaaagaccaccatcctatacaagatcaagctctgagagaggggatcaccatccccagaatga

SEQ ID NO: 3010 - DNA, 288 bp, Sorghum bicolor
  unsure (1)..(288): unsure at all n locations
  Clone ID: SORBI-28MAY03-CLUS50318_1
gcacgaggccgtctcgtggttcgagcagcagcgccagcaactcgagccaccaatgcagcttgatctgccgccaccgccaccaccacagatgccagtttctgtgccagtgcaagcgccccacaggaatggggggtgggaggaggcccaagcccaaggcgagggagccaaacaagagggagatggatgaggaggagaagcagaagctgagggtggagattgagaacctgcctgaggagaagatgctgaatgtgctgcagattgtgcagaagaggaacagtgatccancat

SEQ ID NO: 3011 - DNA, 587 bp, Sorghum bicolor
  Clone ID: SORBI-28MAY03-CLUS50340_1
tggtggcattcccattggtattgggaagaatgcacatatcagaaaagcaataatcgacaaaaatgctcgtattggagaaaatgtgaagataatcaattttgataatgtccaagaagcagtaagggagacggaaggatactttatcaaaagtggcattgtcacagtgattaaagatgccttaatccctagtggaaccatcatataaagtcagccaacaccatgtatataagggtggtttgcagcagatggtgatcacaaatgcgcatcaagttctttcatccctttccagaccatgcttattcccatgttgcaaaaatcaccaagccctgcatcaacttgctgaggataataatcaaataataaaatggtgccattcgaaggcaacagttttctgtcactagtatgaggcactgttctaaatgtactgttgagtggaatttggataatgtatgcttttgcaatcgcacactctaaaatgccctgtgcttgtactctttcttaccttaatatgcttcctgcattgcccagggaatgaggattaaaaatgccatacataatatgttttttgttagattgctgtaaagctt

SEQ ID NO: 3012 - DNA, 661 bp, Sorghum bicolor
  Clone ID: SORBI-28MAY03-CLUS50359_1
cttggtatattcactcgaccttggttcgctgctgggaccttcttgtgcaaggatgatcatcgtaaaattgtagcctgcactaatgatcatcaggtccgcttgtatgatactgcattgcaaagaagacctgccatctctgttgattttagggagtcaccaatcaaggcagttgctgctgatccgaatggccatgatgtctatattggcacaggaacaggggatcttgcttccttggacatgagatcagggaaattgctcggatgctatattggcaaatgcagtggaagtattagatctattgttaggcatccagagctacctttgatagcatcttgtggactggatagctacttacgtatctgggacacaaacacaagacagctgctatccgctgtctttctgaagcagcatcttactactgtggtccttgattcacatttttctcttgaagagcctgaagagataaaatccaagcaactggagttttcagtggaagctgaggctgaagtccgaaaagaaaagaagcaaaagagtaagacaacagaggatgagactgaggctcaagtccgaaaagaaaagaagaaaaagaagagtgaaacaattgaggaggatgaagaacaagttggagtggtcgaccatagcaatattaatggtgaaatat

SEQ ID NO: 3013 - DNA, 594 bp, Sorghum bicolor
  unsure (1)..(594): unsure at all n locations
  Clone ID: SORBI-28MAY03-CLUS50368_1
ggaatattctgctattttttagtattcttttgttctatctgtaatcaggtggaatagtctacaagtagaaagtttcttatatgtgattataaagttttatatctacaagtacaaagttttcttaaatgtgcttttttaggacttatagtatggtcttttttgcattttcggttaattgagatgctttggggggaactttttttttcctttttctagcagatggtgttttccaatgattactttttaggacgattttgattttgaattctaggtatcatatataattgtaaacattagctcagcctccatgtggcaattatgacattttgaagattttacttacctcttttttttttcaggaccacggtctggacaggagtcaattttttggttatttctccctgtttttgctgaggtatagtctttttttgtacatttaatatttttttacttggatatgtaactctctgattgatgaagtcagtatcaaatttttctaaatgcaagttgaaagatgccctatgtacacaaataaactatttttgtctttttttgaagtacagtgtttcaaaatgantatattccatgttcttc

SEQ ID NO: 3014 - DNA, 839 bp, Sorghum bicolor
  Clone ID: SORBI-28MAY03-CLUS50379_1
ctcatggtggtcgccggcgaggccctgcgcaccaacatcaccacgctgggccccctcgtcctgcccatgtccgagcagctccggttcctcgccaccgtcgtcctcaaccgcgtcttccgcgccaacgtccgcgcctacctcccggacttcaagctcgccttcgaccacttctgcatccacgccggcggccgcggcgtgctggacgagctggagcgcagcctcaagctcagcgcatggcacatggagccctccaggatgacgctctgccgcttcggcaacacatccagcagctcgctgtggtacgagctcgcatactgcgaggccaagggacggatcaggaagggggacagggtgtggcagatcgcgttcgggtccggattcaagtgcaacagcgccgtctggaaggcgctccggtcgctcgacggcggcgaggagggaaacccgtggccgccggagatggacgtgctcccgatccacgtccccaaggtgtcgccaatcgacgagtccacctacacgttccctgtcggcgcaacctacaaggtctcatctcttggttaaaaatctaagtctattattattattattattattattattacatgattgatttctcatcatcatgtagtagtaacctaatcgatcaagatattataatttaagaagaagaagaagaagcagcagcgcgtcgttattaattaaatgttattgccaggctcgatgatggtgacagctgggcctttttagctactagctagggcttgatttcgttactgtttgccatgattttgcatcatgcatgtgtacgtaaagaagctctatgaactcacgcgccaagaatt

SEQ ID NO: 3015 - DNA, 572 bp, Sorghum bicolor
  Clone ID: SORBI-28MAY03-CLUS50634_1
gctctctaataaggcagcacacttataagaagtgatgcagacagcaaaccggatcatgaggaagccactggttaatacacattggtggctcatggctgagtagtgaaaatatactgctaccaactctgtataccttaaaggtcagaaggtctcatcaatggatgcactgctttccatccatgtcgaactcattccatgtcaactatgtatggtcttactgcaatcatatgtgacgttcttggaaattgctgactcaatggtagtcatgtgtacaattgtaccattagccatctccgtctgagttcagatttgtatcttggtgttactcctgataaacaaaaaaagacatgtattctaagaaagatcgttcatttatgttagtcataggcatggttgatatgtttgtgatccaatagaagtaggtcaagtctataccttttgttttcccattctgttgacccaccgggttgttatagtagtaaagtttgctggctgtaaatggaattgctgcctcattttgcaggcgatacaatcttatttgacgcagtaaccattaaccaatgtatttatca

SEQ ID NO: 3016 - DNA, 396 bp, Sorghum bicolor
  Clone ID: SORBI-28MAY03-CLUS50637_1
gtcgaagaagggggagaaactatgttcccatacgagaatggtgagaatatggatataggctatgactatgagaagtgcattggcctaaaggtaaagccaaggaagggtgatggactcttgttttactcccttatggtaaatggaaccattgaccggacttcacttcatggtagctgccccgtcatcaagggcgagaaatgggtcgccacaaaatggatcagagacaatatagtgtagaaatcgaaaggctcaggggtcatgtgtccctcctaaaatagatcaagcgcacatatactgaccatatactttagtatttgttcaattggcgcggactcaaaccatcggaaggaaagtgtaaccaaatctatttgcatcgtgtcaatatagtatagcgct

SEQ ID NO: 3017 - DNA, 532 bp, Sorghum bicolor
  Clone ID: SORBI-28MAY03-CLUS50639_1
tatggagtgataaacgacacggcgatgctatggggcatcaagtactacaacgatctgctcatgacggccgggccagacgggaatgtgcagtctgagcttctgttccggaaggagccctccacgttcaccttccagaaaggctgggccttcccgagacgagtctacttcaatggcgacaactgcgtgatgccgccgccggacgcctacccgtggctgcccaacgcctctccgcggctgtcggcttcacttctcctcccgttcgttgcagcttggacagcatttgcaatcctcttgatgacccatccgtagcgaggcataggtggtgtggatgtctcgtaagaagttttgagtgtcgttgcctgctgctgatcattagattgttgcaaagttttatatgatgtcttgaatcttgatcgaggaacagattcagatgtgcagtcatataccaagcatgtacattccccaatacttgtaaatttcggcaaagactgactggcaagtgacaaaatagaaataatgtgtttccttccaa

SEQ ID NO: 3018 - DNA, 516 bp, Sorghum bicolor
  Clone ID: SORBI-28MAY03-CLUS50670_1
cggcggtcccgccggtccatgaacctcagcggcgacgcgggcagcaccagcacactcatgggcagcatcgcctcctccatcggcaagatgggccgccggcgaacagatagcagcgagcaggtcgacgtcaagccgtagcaagatcattgtttcctttttgccatccatacattcataatccacatgaaatcggtgcatatgatcatccttcgccgccgccgctcaaggaatgctgtttttgtagattattttttggcaagtgagtttattcacctgtgtagattcattcaagagagagactgtcctgtgctgacgtgctgtagctaggatgagtagatccgatcagcgatgatccgaaagcagctcgtccttgcctggcagcccccatgcggccatgcccccccgtccccgtggatggagttcttgaaaggctgttgtacatgtctgattcgcagagatctggcctggtctggtaatgagatgagaagccggtacaaatccatgtgaccgattcag

SEQ ID NO: 3019 - DNA, 632 bp, Sorghum bicolor
  Clone ID: SORBI-28MAY03-CLUS50707_1
gatccatttttgtcatctttaatttgtagtttgcctgtggctgaaccatccaaagatttacattccgactcatctgacaataactttttgctaaataaattcccagatgaaaagactgtagagagagctgaaccatcattgtcagagaaggatcagaaggaaaggattcaaaggagcaaattcgtccgtgggcttgtgctctcgacaatatttgatgatgataacttgtaaaggaggtcatcaatcttgataacagcatcacaatacagtcaaggaacacaaagagaatcatctgcacttaagcaaccttgctgctgctgctgccgccgccgtgaacacaagaggttaagttcatgtatgtacggatggaatatttatgcatgtatgtatgtttatctccctgcatttgcccttagtacaacagggtggtagggggaggaaggttgtagtattccaaatttctgcgtcaaataaatgaggacactgtccttcgggttgtattgtgcatataatataggaaaagggagctactcgccatgatttaggatatttatttaattgtcgtaataatatgcattgttttatatgatggtatcacatcccatttttttaatgtaaaactgttcattaaa

SEQ ID NO: 3020 - DNA, 614 bp, Sorghum bicolor
  Clone ID: SORBI-28MAY03-CLUS50493_1
gcacgagggaaacgctggaatgaagccaccttcaccctttgctcttcctggcggaagcagcggcagctatggcaggctgcccacagctcaggtgctaccccaggctgcgccagtcaggtccactccaagcagtggctcttctggagccagagtgcccatcgacgacgtgattgagaaggtggccacgatggggttctcgaaagagcaggtcagggcgacagtccgcaagctgactgagaacgggcagaatgtggatctgaacgtggtgcttgacaagctgatgaatgataccgatgctcagccccagaggagctggtatgggcggtgagcagagctgttctgggccgtccgtggctggcggtgagttccctgaacagagtgctgcaacctgtgtatatcgtcgaagcaccatgggacaaccattcttttgcattctgctttgagttcacaaaaagttcactgctgtttatttcaatcgtgttaggagcaggaatagccatgtttcattttctgatctgaacggaatgttatcccaggacacttggctcctgggcccccagctcgcgtgttctgtactttgcctgcttacttgacgcgtgtcactgcttgcgacg

SEQ ID NO: 3021 - DNA, 514 bp, Sorghum bicolor
  Clone ID: SORBI-28MAY03-CLUS50499_1
atcatgcagttgaaattgaaagagttggggagatacagcagtcaagcaattctaggtagccttgatggatggaggttctggacgtgatggttcattgcaatgtagtattgtcaactcatatgctagtcaaggtcattaatttgcataatcctgaatgagaccttttatgctgctgcagcactgccagcacctgtgactatgattgacggttgcaacaggaccatactcccggcgcggagctgtctatatgaagagtgtaggtagaggcaattggctaaaattgttcaggttcggtttgcagggtcgtagcaacagggttcacagacgtgtttgaatcggtatgatgagaggcgactggggagttccattgatggtttaagctggagccagcttctgaagtccggtcaggtgtctatgtgtgttaccactttttggtttcatttcatgagaagggaccggtattctttccttgaattgtacatggtggtactcatgaatggatttgttcggagcc

SEQ ID NO: 3022 - DNA, 467 bp, Sorghum bicolor
  Clone ID: SORBI-28MAY03-CLUS505_1
tgtcaaggcctttcctgatggtagtagccctggccgccgtccatgggctcatcacgctcaccggcgtcgacgcgaccgtggtagcgacatgcctggcggcgtccaacagcgaccggcgcgtcaactacgacttctgcgtgtcggagctgaacaagcaccgcgacagcccgggcgccgacaccccgggcctggccaaggtggcggccaacgtcggcgtcaacagcgccggcggcgcggtcaacgacatagaggccctgctcgccggcaagcagcagccgccgccggacgccaggaccagcgccgcgctgcgcctgtgcgagcagctctaccacgacatggagctcgccttcgcgggggcctacgacgagatcaacgcgctcaactacacggcggggaagcagatggccgccgacgccgactcgctggtgcgccggtgcaccggcggctttgccgaggccgggctcgtg

SEQ ID NO: 3023 - DNA, 324 bp, Sorghum bicolor
  unsure (1)..(324): unsure at all n locations
  Clone ID: SORBI-28MAY03-CLUS5080_1
gctacctcagaaatatctccttggagagcgtcggttgttgacattgataatggcaaattattaaatgaagatagtgatatcagatcggtccttcagtttttaatggatgatgtgtctgacttcttgtcaacacatttttctagttcagtggagagaagcaagactgacgagaaagggggggcttctacacttcaagctttcattgattatatatctttnagggaaaccgaaaattttcgatcccgaaaggaggaaaataagaattctatcacattaacaactattcatcagtcaaaaggtttggagtgggatgtcgtgtttatt

SEQ ID NO: 3024 - DNA, 663 bp, Sorghum bicolor
  Clone ID: SORBI-28MAY03-CLUS50807_1
ttctctaggcaaatgcagtggaagctcttcagcacgaaagaaaccaatttcaagggtaagaactaagccatctgaaccgagcccagaagttctaaagcctataaagaatgttatcttacatgagaagtacattgatcaattgtcacgtagagaatatacaaaaaggcctcgcaaaagcactcaaggctctaaagctgctgattctgagaaggctctttctgagcagaaagctggtagtctgaaggctgctaaaaatgctcttatctcagaagcaactgactttataagcagttttaagaaggtgcaagcctgttcccttgcgcatgttgtggaaaatagcgaagatgatgagattgaatgtgatgccagtgattacagccatgatgataaagaataaggaggtgcttatggtgttaattcccagcagctcttagcaattattaccttttttgttaatgggcgttagtcatcactcatcagtgcctggtgcttcaataggtagttactagtatgggtggtatggaggtgtattctgcctaatatgtgtcttgttcctagtgccctcggaactgtaagtgaattgagaaagtgttgccttcatcatgccttatgatgattgaaaccaattgaaattgcaacggtcgaaccttttctcttggttgc

SEQ ID NO: 3025 - DNA, 392 bp, Sorghum bicolor
  Clone ID: SORBI-28MAY03-CLUS5083_1
gttagaaagagcagagatagagaatgaacaggggaggaagcctgaagaatatagcataatagtcaaaacagtgagagagtaatagtcgtttgatatgaaaataggcttgtgtgtgttcgggaaaatagagtctgaaatttatgaaatacagaggtgtgtgaggtaatagattgcaggggggggggcaaggaggaagggcataagaaggtagttgaaattcattcagactgcattaagctgaaattcattcagctgattgatggtgaggcatacataaataaatatccatccaaatccagagtgcgtctagcataaataaatataaacatgtatgtagaaatgctggagtactaatgggactagagggacatcatggccttttccctttcctg

SEQ ID NO: 3026 - DNA, 675 bp, Sorghum bicolor
  Clone ID: SORBI-28MAY03-CLUS50846_1
agtgtgcagcgtcgcggagttcatccggtcagggtcatccaagttgaacggcatgcccgtggagttcgacgaggagcagcacatggcggtcgtgcgctccaacagcatccgcatgcttgaggaagaggccaccacagtggagaagaccgttggcccgtcgcatgccagcagggagatacagtcaccatcaccgtcaccgtcgccgtcaccagcgaccccagtggttgtccccaagaagcgggtgcggttcgtgctgccggcagcgagcccgaagccaaacgccggcgtgcaggaggagctgcaggagctgtccgacgcgcgggaggctggcatggcgttcatcctgggccactcgcacgtgaaggccaagagcgggtccagcttcctccgccggttcgtgatcaacttctgctacgacttcctgcggaggaacagccggggacccaactacgccgtctccatcccgcacgcctccacgctggaggtgggcatgatgtactatatctgatctgactgaacccctgaaactctgatcagagggagaaatataggaacaggaaaagatgagaggaaatgaaaccaaaaaaaaaaagttttcagctgtatatgctagattttgtaagtatatactgctggtgagttccagttgtaaatgcaagcttgattttggccttc

SEQ ID NO: 3027 - DNA, 740 bp, Sorghum bicolor
  Clone ID: SORBI-28MAY03-CLUS50866_1
gacagagttattcatggaatggaagaggaagaaggcagaagaaagagaagctggtcaggctgccttgaaagcagagagggctaagaatgatcgcatgagtggtcgtgagttgttcatggctgatgcaagtgtgttcgttgatgatgctgaagcatatgaagtatatgagagagaggaagagcctgaggccaatgaagaatcgagcaataaaagtcaggctgcaggtccaagttcatcagcatgtaatggcaaggaggttgaggagcctgacgatgaagatatcgatgttgacgatgacttagacattgatgaattgaatgaacttgaagcaagcctgtcgagaacttccatccaaattcgagagccaggcgagggaacatcatcttgagcagtgctacaatggaagattgttgagacagctctccatttttgcactcccgtccgatctatttgcttttgcaatcaaagaaacgtggagcacagatgcaagtggaatagatttcttagtctttcactagctttcttgagggagcaatgatcaacaaatgacgcccagtattatgatcccccatgacaattgatgtttgctgtgtgcccttttatctcgtgccctttgtgggaaatatgttgctacttgtgaataacaggactaaacatttttttagttttccgcagactgaacaaagttttgatgcgaccattacatggtgatgatttgcaatgatattcgcatttcaggc

SEQ ID NO: 3028 - DNA, 700 bp, Sorghum bicolor
  Clone ID: SORBI-28MAY03-CLUS50884_1
gcacgaggcttttagcggatgtaaatgattcaaatgagcatctggatgcatcgcagcaagaggtgtttgggctacagactacaatagatgttctgaggaacaagattgatgccgcagaactagctgcctcagaggctttggacaatgagaggactgctatcacaaagattgaaggcctgactgaggagaaaaccaagctcattagtgagctggatgatgctagagacagagaggagagagagaaaagggcagttgaggatcttactgctgcattggataaggcatcttgcgaagcacaggaagcacatgataggtttcagaagagagaggatgattatgaacatgctcttgcacagataggtgatctgaagatggccctgaagagtatggaagagagttatgaggtaatgcttgatgaggcaaagcatgacataacttgcctgagggaaactgtggagaagctggaggctgaggtgagcaagtacagggaagaatgtgaatctaaggagcttgaccttatcacagctagcaagcagtcagaacaagaaattgctgctcttaaagaagaagctgagcatgtatctgcatcactgcgaggtacggagctggagcttgaagcagtcagtgaagagaaagagaggcttcaggagaaactggcgtgcgcagaatcagcagttgctgaagccaacgatgctgtgca

SEQ ID NO: 3029 - DNA, 373 bp, Sorghum bicolor
  Clone ID: SORBI-28MAY03-CLUS5089_1
gcaatttagtttgtgaaaattcatgatatagtgtggattgaggtagtagtgatatagcttaccaaagcctgttatatttcacacttcacagtaagttaccatagatgaagttgtgcagatttttgtattattcacttattcagtatatatgatactgaccaaaggctacggcgatgcggtggaaaagaacaaactgcgttgttttctaatcacagattgcagtatttgcgatgctaattttttgccgctagctaaaagtgactttctgccaacttttgtcttccttcttgatcacatgggaccaagttcactagctcattggctcttgtctagctcatagatatgtccttaggggggggggtggagtatcata

SEQ ID NO: 3030 - DNA, 614 bp, Sorghum bicolor
  Clone ID: SORBI-28MAY03-CLUS50563_1
gttacgtcattgagctcagcttctgcccatatagcataggcctcctcaccatgtacagcatcatccccgataagcagctgttcatcagagattcggaggggcaggactaggccaataagaacacagattatggaagtgataacgatgttccaggcaatgacgaagagtgcgccagcaatctgcttcccaaactgtgatccaccatcaccaccataaaatgcacctctggattcctggatggagaggaagaggttgcagaggacgggctcagcaaaaagtcccgtagtggtgccgccgaggagcccagccaccgcgtgggtgtggaatacgccaagggtgtcgtcgatcctctgcatgaaggaccatttcttgtgcagtaccatcatagtgtaccaggggatgctaccagagagaattcccatcacaatagctgcccacccttgcaccaggcctatttgaatgaaagatatttgttagttaaccaattaaaatggagaatagactaactatggagactgttgtactggtttgctacatattatatacctgtaccatgaaattcttgatgtcccctttgtcagtttgactattatattatggatttatttttgttc

SEQ ID NO: 3031 - DNA, 520 bp, Sorghum bicolor
  Clone ID: SORBI-28MAY03-CLUS50603_1
ggtcaaggagagcaagggtggtgtctgtgcaactcgagaaaacagacaacggtgaatggcgaggagtcaagtccatcaagacatggaagaggcttgatgataaacatcttagcacaattgactctgaggtcctctggaacagaggctctaatgggaggcgcaggaaaaatcctggtggtagttaacttttgatgcagacgggactggtgctctgaaagggatgtctacatcaatgtgtattgttgtatggtcaatttactatagaatcggaaaatgcagaagtgtgtacatgggggagaagatcatatacggacacatacacgcaggtttctgctgttgtatttttccatgtttacaaaataagtaattgcaattcaaggcagctgtcaattattgcaagttttctcatatagtatagtgcaatggtcaaaggacgagaatgctatgtcgttgtagtcccatctctcatgtattgttactggcactgtctttctactgcaattgaaacctcagagttacc

SEQ ID NO: 3032 - DNA, 581 bp, Sorghum bicolor
  unsure (1)..(581): unsure at all n locations
  Clone ID: SORBI-28MAY03-CLUS50590_1
actgctgnataccctcaagggtgagctcatctctcttgacgagaatcctaacaggcttgttcatgaacctgttggtgatctcaagggcctcagggggtggtagctgagaacacaccgacctgaatctttgatggaagaagctggaagatatcaaatctgcaaagggcacatgatagggatcgcaagctgaggatattttctggaaatgagcatccattccatgatcgcgctctttgaaccttttgttatgccgccacggcaagtacgcgagatgcgcccccgtgcaaggcgtgcaatgttaagggcccagaaaaaagagcaggcaaacagagccaaggaggaagaagatgctaagaatgccacagctgaggtcaccgcatagactcctgatgtgaatttgcattctgcaaatttactaggattatatttttttttgcttgataacctttcaagtggagtaggcactagaatctgcgtgccaacctcgttctgaatcacctttgtatttctattacaatttgtactggaaccctgcttgtcacagctgctttctgcaagtgaataaggctctctgaattgtg

SEQ ID NO: 3033 - DNA, 656 bp, Sorghum bicolor
  Clone ID: SORBI-28MAY03-CLUS50631_1
aaatgaagatacagaagaaactgatgatcaaaaaccaaggcttgaagttgccacagccgatatgaactccaacggagaatcgaagcatgaagagaaagatgacagcaaggtggaacaagaggaactgaaaactgagctcagcttacaagagagtgacaaagttagcttcgagaaggaagcacagaccgaaaacaaaagacaagaaactgaatcgtcgaatgatgagttagactcgaagaaggacagcagcaccgagagtgcaaacgggacgactgtatcagaggataccgcgacgactaaagtggcagccatgtctcctacgaaaccacagcagccgaaaaagaataagcctctgctgaagaagtttgggagcttactgaaaaagaaaaacagcaagtagccgaacagtggctgtactattagtgttgttttgatgttcttttttttttggtctgtttgacgaggtgttgtgcttcctatgcgtttactgccaatgcctgtatttgtggtgattggagaagtttgtgggtgtcgtgatttttttttcttccttttaacttgggacctatatggtgttggctgctgctatctacacggttatggcagatcccatgtgtgtaaatggagttcctcctaatcagaatggctattcgttt

SEQ ID NO: 3034 - DNA, 588 bp, Sorghum bicolor
  Clone ID: SORBI-28MAY03-CLUS50633_1
gcacgaggctttctcagtgattggccagaggagcatccaccttgctggatactatatgactgatgtgtgtgaagataggagtgacagtgattctgggagcgattctcttcaaggttcagatgaggatggtctcttggaggaggacgatgatggtaacatggttatgggatattcagatagtgaagatgatgattcagaatatgattcagagtctgatgatgaagagatggcatacaatcagggaaggggcaaaagttcagttgttattgaggaaattgaagaggatgacaaggctgctgttgctggagtgcagaagggatcgaagaaaaagcaatgccgtgaaaatggtgatgagtctcaacttcagcttgctgtaagaaatccacctactgaatccttggaaagtgaagatgaagatggttttcctgtatcattttctgaatcaaagaagagttctgagagtgtttcaaacaagaaagggggaaaagacaaggagactagcaatgaagaccggaaaagaaaaagtggagccattagtgatcgtggtgactcttcaggggaggtaaatgctgaaactgatggtgcatc

SEQ ID NO: 3035 - DNA, 474 bp, Sorghum bicolor
  Clone ID: SORBI-28MAY03-CLUS50963_1
gcacgagggccgccgcgaggcgcctgcaggcgcgctacgatctgtatatggggttcgacgacgcggacgccggcggggatgacgtgacggacccgcgcggcggcggggcggagccctacaactgccccttctgcggcgaggacttcgacttcgtcagcctctgctgtcacatcgacgacgagcatgccgttgaggctaagagcggggtatgccccatctgtgctacaagggttggaatggacttgataggacatttgacaatgcagcatggaagttatttcaagatgcaacgcaggcgcagagtccgaaaagtgtctactgggtcccattctttgttatccttgttgagaaaggacttgagaaatggcagtttgcactcatttctccgtggatcatcctatgtatccaatcctcctgctgcagcaccagatccatttttgtcatctttaatttgaagattgcctgaggctgaac

SEQ ID NO: 3036 - DNA, 599 bp, Sorghum bicolor
  Clone ID: SORBI-28MAY03-CLUS50939_1
gcacgaggcctttccccttctccacgcttcgcccctcgccgactattttaaacccacgcttgttcttccccgtcggattcttttgtacccccgcgggagatccacgcatccacagccgagcagtggagctcgatcgcgaggcttctagagagtcggggggagttcaggcttctccaatggcgtcgtcccacatcatcctgcccaaggaggaggaggcgggggagacgctccccccgcccgggccgcgggccgcggtggccgtcacggctggccgcggaccacgactccccggcgcagcggccgtaccaggagcaggcgccagggaaggcggcgttgccgttctcggcaacgtgcgtccggatctcccgcgactcgtacccgaacctccgcgcgctgcggaacgcgtccaccatggcactccacgatgatgacgccgccttcgtcaaaatcgaggagggtgacttcggatacgtgctcgacgacgtcccgcacctcaccgactacctcccggacctccccacttttcctaatcctttgcaagatcatccggcgtattcaactgtcaagcaatattttgtcaatgcagatgatacagtccc

SEQ ID NO: 3037 - DNA, 498 bp, Sorghum bicolor
  Clone ID: SORBI-28MAY03-CLUS50968_1
gcacgaggctgagccaagcccagatgacgaattctggatgctttctggtgaaactgaagacaccatatctgatggaaggattgttcaagtaactgttcgcaatatacaagagaacaaaataatttgcacctttgattctggtttgaaagccatagttatggcagacaactattctgatgagggttttgatctagaatcatcacagttacgtgaaggtgatgtattaactggcaaaattcgaaacgtgaataaaaatagattcatggtttacctaacgtgcaaggctactgagatgaggagaaggccattctccagaggtgatcaggatccttactatcacgaacgagacatgatctcacaaactgtagaagataaggctcggaaacaaaaggaacttgcaaagaagcatttcaagcccagaatgattgttcatccccactttcagaacctgacagccgaagaggccatgcagtttttgtcagataaagagcatggtga

SEQ ID NO: 3038 - DNA, 613 bp, Sorghum bicolor
  Clone ID: SORBI-28MAY03-CLUS50969_1
gcacgaggctctcttgcactgggggattgcctcgaccttactacgactacgagtagcgagagagcagagatggcgggattggcggcgcagctgcagcacataaagagcctttatttcggcccctcacctgccaagggggtgatgcaagatctggagtatgccatgaggacaaagggcggtttgacccccgaggaggagaagacgctccgggtttacaaattccttccagctttttccttcttcgcgggttcagtatggggcactttgggtggggtggttcagtttcggcaaaggactcagattgcttgggcttccacttccacctaatcctcggcttgtaagattttgtgcaacttctggctgtgcttattttgttggaaagggctcggctcgtgaaatcatgcatcaatgccctgcaatgcttttaaacacggaagaaggacgcatgaagatggagctagctaacataatactcaataagcatagcgatgatgcatacctgggtaatgctgtgaaaagacacttttttgccgagcatctgttcgatgatctgcatcaagatcaaccacttttcaggtggcacccacgccgttcgtatatcgacggcaccttt

SEQ ID NO: 3039 - DNA, 531 bp, Sorghum bicolor
  Clone ID: SORBI-28MAY03-CLUS50979_1
gcacgaggggaaagactgcagccttctgtttccctatcattagtgggatcttgaagtcaagggacttgaggccaccccagacccagaggcaaagagccagggctgcttgccctctggcattgatactatcccctactcgtgagctatctatgcaaattcatgaagaagcaaagaagttttcataccaaactggtgtgagggtggttgttgcatatggtggagcaccaatacatcagcagctgagggaactggaaaggggtgtcgaaatccttgtggcaactcctggtcgtttgatggacctgttggagagagccagagtgtcactgcaaacgataaagtatttaactcttgatgaagctgatcgaatgctcgatatgggctttgagccacagatccgcaagattgttgagcaaatggatatgccccctcgtggtgtgaggcagactatgctgtttagtgctacttttccaaaagagatccagcggctggcttcagatttccttgctgattacatattccttgctgttggaa

SEQ ID NO: 3040 - DNA, 632 bp, Sorghum bicolor
  Clone ID: SORBI-28MAY03-CLUS51022_1
gcacgagggtcatacttgcatgtttgcctaacgatggtaaggatgacatgctttgataatgctggtaaggaaagataggtattgtgcttttatcacaatgcacttcaaactttttgacagaactttttcatatatggattatgactaaagtgctgaagccaatctgtggcctggcaattacttgaacactaaagtttacagtttgtataattgtgaggacattatgaactgctatgcttttgttcgtaggaaacaacataagatatagttatgtgtaaactaatggattgtgtatgtatatattcattctgggtaaggagtgatattatggcggcttggttgaactcaatttatgtgatcggcaattggttgccccattgtgtgtttgatcactttccagccttagttagctgcctggtagcgctacccacagaagataacccccaatcaaacaaataaagctggtttggcgtaacatggaatatatttctcccaaacacaggttggctggtgttagatttgttttatacatttttttgcttcaattaggatcactttcatatgactttccttcaccctcctagtgaagtgtcaaaatgcttagtaatttgctagctatcttgcttagtgga

SEQ ID NO: 3041 - DNA, 522 bp, Sorghum bicolor
  Clone ID: SORBI-28MAY03-CLUS51004_1
aggagggggtacgcaaatcacaagaccactaatgttgtagcaaggcgcacggggcttgacgataacgtggatcttcctaagcatgtagtgccttctaacaggaggagtttcccggatggccatttatctgctacaatggcaagagttaacaaccaaatttcatttgagaagcacacgagttccgccgaagatgtggagtacaaggatgtctacgaagttgggtaccaaccaccaagaggtgatgaatatccaagaaggaggccgaatgaagatcatgacaagagaaggatggatcttgtccgccagaagtttgttgaagcaaagaggcttgcatcacatgataatatcctccagtcgaaggaattccacgatgctcttgaggctctgaattcaaacaaagacttgtttctcaaatttcttgaagaacctaactctctctttacaaagcaatctggaggacacaattctgcaccaacgtcacctcagagaaagcgcattactgtgttgaagccctcaaaatca

SEQ ID NO: 3042 - DNA, 562 bp, Sorghum bicolor
  Clone ID: SORBI-28MAY03-CLUS50737_1
ggatccactacaagatcaaccatgtaagaagggttatagtcaaagtatggtatacgaatctatgctccataatattgatagaatgttcaatctcgccatgggactatcaaaatcaaagagaaactattgtatatattcatggaagcgagaataccctgcatacgtaacaaaggttcaagtaaacacgacagactggtaatcgcttgccatttgattaaactttgataaaacataatcaattatttcagttttgtacaccaaataaacaactcatattgtacaggaacttgggaggcttccttgtatacaatttcatgaagctgcgggacggtgtgacattgccatcgatcaacaatctatcaacatcactgaggacggagttcttggctgacatcttgacaagtcgtgcaaacgaatcttatgacaacatccctgaagatattcaatatccgatcaaaaagttagagaatatgtaaaaattacttcttatatgcattggtgactcccaatattgtatacagactcaaatacaattgtgcaaaggttaaactcttccaaaaaa

SEQ ID NO: 3043 - DNA, 565 bp, Sorghum bicolor
  Clone ID: SORBI-28MAY03-CLUS50781_1
tcgtgtaatgattgttgataattctccgcaggcctttgggttccagttggacaatggcattcctatagaaagctggtttgatgatcccaatgacacggagctgctgaaattgctcccgttcttagaaagcttggtcggcgttgaagatgtccggccttatatagcaaggaagttcaatctaaaggagaaggtagccactgcgtcttctctcgcaatagacatgcagatgtgatccatccgatgctgccagggattattcctgtgtcaaaggtggccatggtgataagtgtaggaacagagctgctatggcaaacctgttgaatgtagcatgtcaggatccccgggctctctgcattgctgtatgtgtttccctcaccgcaatgtaccattttctgcggttgggcggttgtagacttcacttacattttgttggcccagttgactgtgatggcctagttacatattctgtctaacatgttaatatcatgtaggttggttgatacattacatatatataagctccctgcgggggcagagggaaccagatcgaagatggcccccctcc

SEQ ID NO: 3044 - DNA, 518 bp, Sorghum bicolor
  Clone ID: SORBI-28MAY03-CLUS50791_1
ttaccccctgcgccacgtcgatgttgaatgcacaagaagtttgggcatcagtgaagtcaagtgcagaaaatggttgctttccctcacatcattcgtccgcaaccagaacggcgcgatagctgaggcgatccgcacgtggaagagcaatttcgacaaggagtttgagggcgtggaggagtgcccaatctgttacagcattctccacaccagcaaccacagcctcccgcggctggcgtgcaagacgtgcaaacacaagttccacggcgcctgcctctacaagtggttctcgacgtccaacaaatcgacttgcccgctctgccagaccccgttctagttctagctctagacaaatgcctgtttgttggcaccaccgttctatccttcatgtaaatggcgtgtgtacgcagtgttcagcttttacaaaggctcgggccttttctcactaggctcatacgttttggctgtctcgggacaggacgagacctgtatttaccttataggaatcaagtagattgagc

SEQ ID NO: 3045 - DNA, 631 bp, Sorghum bicolor
  unsure (1)..(631): unsure at all n locations
  Clone ID: SORBI-28MAY03-CLUS51056_1
ccagcgctcccctctcttctttccatttccgttcctcccagcccccgagccctaaaccctacctaccccaaaccctcggcggcggcggcggcggaagggactgttgggtttccttgtatcctccggcatcgtcatggggtgcttcctctcctgcttccgcggcggctccgatccgtccggcgatctccgcgacccgctcgtgagggagagccgcctcggggacgccttcctgaacgacgagaaaaagtttgatgaagctactggaaagccggatgcggtggcggcttatggccatggagttgacgaggagcttcggagagaggccaattatctcaagtcatgtggcacaatctcacaaacgccaccggaaattctagattcagtcccaatcaattcagaagatgctgatgaggtaagaaattcatctgcaagcttgtcctgaaatttgccatctgaacttttttttggctcgcaggtggtgagacactgatcaaaacactatttttagtacatccatcatcttaacactgaatgtagggcatgctccactggaggtcattgcgtcaccattcaaatgatcggttatttacatatgctaattnttccatgtgtgcctacacctatgttcaca

SEQ ID NO: 3046 - DNA, 333 bp, Sorghum bicolor
  Clone ID: SORBI-28MAY03-CLUS5108_1
cccccgcgtccggcggttgtcgcagcggacggcgtcctcgtggacatcacctatgtggaaagcgccgtggccaaaggagcagtgtgtttggatggtagcgcgccggcgtaccatctcgcccgcggctccggctccggcgagaacagctggctggtccatttcgaggtttgcttcttggggggtgtcaaggggaatggtcacaatctgcttcaactagtaatccatttttatatgttcagttcaactcagtgcagtagtgcactcattgctttttttttttcgatacgagggatctcccccatttccattgatttccaacgaccgtttgaacat

SEQ ID NO: 3047 - DNA, 829 bp, Sorghum bicolor
  Clone ID: SORBI-28MAY03-CLUS51081_1
gcacgaggccgactttatcagtttgatctgccttgggatgctggaaaggtcctagatgcttccgttatcccatcagctgaggacagagatgaaggtgcttgggtggttctaacagaaaaggcaggggtctgggcaattcctgaaaaagctgtattagttggtggggtggaacctccagaacgcagcttgtcacgaaagggtagttgtaatggcacgagggctgaggagaaaagaagaagtcagggcttcagtgctagtgttgttcccaggagagttagctctgaggcttggagtgctggagagaggcaaaggcctgcattaactggcatagctcagcagtctgtggttgatgaagagtctgaaatgctactgaaccgattatttcatgattttataatctccagtgcagttagcgaggcacttcaaaagcttagagcagcaggagcatttgagaaagagggtgagatgaacatatttgttcggacgagcaaatccattgtaaacacattagctaaacattggacaacaaccagagaagctgaatttcttgcctcaacaattgtttcgtcccttgttgagaagcagcaaaaacatgagaaattccttcagtttcttgtcttgtcaaagtgccacgaagaactcgcttcaaagcaaagagcagcaatgctaactgtcatggagcatggtgaaaagctctctggaatggcacaccttagggaattacaaaatgcccttatccagcaacgctcaagcactcatttatcacctcagtcgaaaacccaaggtactggcgctctttggaaccttattcagttggttggtgagaaag

SEQ ID NO: 3048 - DNA, 811 bp, Sorghum bicolor
  unsure (1)..(811): unsure at all n locations
  Clone ID: SORBI-28MAY03-CLUS51089_1
gcacgaggcagacgttcttgctctcgctctcgctctctcggccttcctttcgtggcggcgacgactggcggcgattggcgacgccctctgccggatcttcgtcagctccttcgccggcgactgacgctgccctttgccaggtcatcgtccggcctccttcgccggcgactggcgatcaccaggttctagctacaaatattcggacgtccttgctcgcgctctcccgctctcggccctcctttcgtgccggcgtcgtctggcggtcgccagatgtgaactcatcattcatcggaggtgctcagttgcagccaagtagaagcatgaatactgattcattcatgcgtgttccagcgtccccaatatcattttcatcaaataacatctctggctcctcagtcattgatggctccgttgtgcagcaaagtccaccccaagaccaggtacaaaagcggagatcttcaagtgtaacatcacatcccatgattgaggctagtggtgcattgcatgctccaaagaanatcaagaattgatgttaggcaagatgaactgcagcaacagctgattccacagctgctccatggtcagagttcccttcatctccaggggcaacagaacccacagcttgaagctttgatccagcagcataaactagcacagttgcagcagaggcagcagcagttgttgcaaccgtttgctcagatacaaccatctcaaattggcatttctcgtcagcttcagcttaggccaccgctagcacagcctggaatagctggacctattaggactcctgtcgatactgggctttgttccc

SEQ ID NO: 3049 - DNA, 420 bp, Sorghum bicolor
  Clone ID: SORBI-28MAY03-CLUS5109_1
ctttgacttcatctgcaacaccagcgcaatcagtaactgcaagtgaagggctcccgttcatttctgcaagccatttggactagctatgcatttttttgaacatgcacgccatggaaagtggtgaggctacagactagcagtgaccctctgttatactttttaatgttatatcgacaggggggcatgtgtatatagttgcaaacagtaaacttcgtgatagtgttcagatagacaaaagataatcatagtagacactactgccctgtaagtgagaaacaagctaacaccatggattgaactgtcagcaagcttttccttgaaagctactattttagaaatttaaatactattgcaaactgaatttatgtgctaaaattgcaacactaaagctactgcttttacgtgagatggatatattct

SEQ ID NO: 3050 - DNA, 633 bp, Sorghum bicolor
  Clone ID: SORBI-28MAY03-CLUS51119_1
gcaccacgcgcctcctcggccgcttccccaacggccgcgtcgaggagttcatccacgcaaggacattgtcagctgccgaccttcgtgatccggaaatttcagctcttgtggcgtctaaactgagagaattccacaaccttgacatgcctggtcccaaatctgtgctcatttgggacagactgaggaactggctcagaactgccaagaacttgtgcccatctgaagaagccaaggaatttcggttggacagtctggagaacgagattactgcattggagaatgagtgttcaggtgattaccaatggattggtttctgtcacaatgatcttcagtatggcaatatcatgattgatgaagagaccaacgtgctgaccatcattgattttgagtatgcaagcttcaacccggttgcatatgacattgctaaccatttctgtgagatggcagcagactatcattcatcaaagcctcatatactggactacagcagatatccagatgttgatgagcagaagcgcttcgttaagacctacctgaacatttctggtgaggaaccggatgcagaagttgtggagaacctgctccaacgcattgataagtacatgctcgccagccatctagtatggggcctct

SEQ ID NO: 3051 - DNA, 646 bp, Sorghum bicolor
  Clone ID: SORBI-28MAY03-CLUS51106_1
ccaccaggctccccccctgatccggtgggcgccccctcctcctcgggcgtgccggccacggcttcccccgcggcgcctggctgtggctggcgccggcctccgcgcgccgccacccaccaggccggcgcccctgcccccccgcccggccctcccgtggccatgccagcagcggcccgccgcctccagccgcccccccccccctgcccgggcctgacaggtcccccgcgctgctgctcctggccggcgcccagccccaggctccccccgccagcgcctctccccgccagcagctccgcctcgggctctcctggcgcgcttggcggccctgggcgcccctctcgctggctccggcctccgggcgccgccaggctccctgcaggcgccgcgggccgccaggcggggcggcacagggtaaaggcagcagcggccctcctcctcccggcttctaatgctccatgcccatgcccgacagatggtctgcgttgctgcacctggccggctcccaattgcaggttccccgagccatggcctctcaactccatgagttatgtatgatgcccttatctctttataagagatgaaagggaggcaaggatgactggaatctttgcggggctttatggagatctgaacaggttaaagttcg

SEQ ID NO: 3052 - DNA, 387 bp, Sorghum bicolor
  Clone ID: SORBI-28MAY03-CLUS50890_1
gcacgagggcctcctcccgtgacgcgacgcgacgcgagcaacctctcctctcgtcgccggatcgtcctcgtctccattagcgcgttccggaatgaagggaggtggcgtcatccgggccgccggcggaggtgccggcggctcgggtctgatgcgaacgcgactgcggctccccgtggtgctcctctcctgctccctcttcttcctcgccggcttcttcggctcgctgctcttcacccaggatccggaggaggcggacatgccggtgccgagggagcggctgctggagacggcgtggcctgagatgccttaccgcgagtccggcgaggctgcgccgtccttaatcccataccagattttgagctggcagcctcgtactttgtactttcc

SEQ ID NO: 3053 - DNA, 562 bp, Sorghum bicolor
  Clone ID: SORBI-28MAY03-CLUS50891_1
gcacgaggaggaaagctgctgctctctctgacccgcccactcatcctcgttccgagctttggctgttgcattcatttccatcccagcccgtcgcgcatacggagtagcagacaagactgaagagagtgatccaggggcggcgtctgcacgctggttcctgatccacctctgctgccggcgggccgagccatggcgacaccgcggccggcgctcctgctgcccgccgtgcgcttcgcctccaccaccatcgcgctcctcctcctcgtcgccttctcctctctaatgcgttcgtcagatgcatacgatccactcgatccgaatgggaacataacaattaagtgggacgtaatacagtggacttcagatggctatgtggctgttgtttctctatacaattaccagcaataccgccacattcaggcgccaggctggaaactaggctgggtatgggcaaagaaggaggtaatctgggcgatgaccggtggccaggccactgaacaaggcgactgctccaaattcaaaaccaacatcccccattgctgcagaaaggaccctgaggttg

SEQ ID NO: 3054 - DNA, 576 bp, Sorghum bicolor
  Clone ID: SORBI-28MAY03-CLUS50917_1
ctcaatcccggcatccgcgctccaaaccctaacacgccgcgcgatcctaatgcgcaggggtctgggcagcgaggcatcgctgcgccggcggcgcgggccggcgcggctctgggtggccgtggcggcgctggtggtcggcaccgtgtgcctcttctcctcctcctccgtcggcctgttcggcgcctcttacaggggcccgggggttgatgtaaataagttgtggagaactgcagattcaactggttggagagcatcttgtgcaccacgcacctactggcctcccccaccaactgaatctgagagcaatggctacttacgcgtccggtgcaatggtggcttgaaccaacaacgcagtgcaatatgtaatgctgttgttgctgcacggatcatgaatgccacactagtgctgccagaattagacacaaattcattctggcatgatgaaagtggctttgtatgtatttatgatgttccccacttcatcaagacattgaaatatgatgttcgaattgttatgagcattcctgagatcactacaatgggaaagtccaagaagctcaaaggccatcagattcg

SEQ ID NO: 3055 - DNA, 637 bp, Sorghum bicolor
  unsure (1)..(637): unsure at all n locations
  Clone ID: SORBI-28MAY03-CLUS50792_1
cctnggagaaaggggatttatttagcattgctcgtgtcatgttaggtacaaagaaagcaagtatagaaatgttaaaaaacccacacaagctttataagcagaaagcattgcggcttggtctcctgatatccagacacacaatctcgtcagcagcaacatagaccaaaatgtcaaaatgtcagttttgttgaggctagcgccgatgatcattctgcagattgtcatgattactcttgactaataatcagtatgaaggactggagtgagtatcttcatcatcttgataagtatttgctgatttctccattttggggagagatggggtacaacattagtgcaagactcaatacggttcagcctgtttatattagtctccccatttttattattctaactcgagaaatcttctccattggcagctctggagtctcgaccatgtgtccatgtctcttgtcacatacaacttacactctgcctttgtaaccagttctgatatttggtcattatttttccttcttttttttgcccctagaccttgtctcgtaggttgatttgtacagaaatggatgcaatttgattttgccatgtgctattaactaatgagcaattctaaaaccgttgactgttctgaagatcc

SEQ ID NO: 3056 - DNA, 576 bp, Sorghum bicolor
  Clone ID: SORBI-28MAY03-CLUS51178_1
gcacgaggctggtgttgtcggtgagtatgggacaaatgagatgatttcaagcaaggtcacacattctcaacctcgacttcagcatcaggaaactacacagaattttaaggcatacgagccagattctggttatgggatgtcatttattactaaagttgttgatggtgaagcagcccaaagtatagcttattcatcggaggccatggttttacattctgtaaatgcctatcagttacctgcatctacagcaactcaacaaccagtgccccagatgttttctcaacaattccaagtacctcattatccaaactttttgccatatcggcaagttttctcaccacagtttgggtctccaatggttgtcccaaactattcaagcaaccctgcatttcctcagttgccacacaccagcagctatgtggtgatgcctaatggagcctcacaactatctgctaatggcatgaaatatggatcaaaccatcagtataagcaagtgtttcaaggagcccctgctggatatggctatgcaaatcataatggttaccctgtcagtaacggtgtaattggcggcacagg

SEQ ID NO: 3057 - DNA, 501 bp, Sorghum bicolor
  Clone ID: SORBI-28MAY03-CLUS51189_1
gcacgaggcgatcttctcgacagcgtcagcgcctcaggtggatcaggtggtggtgggagctagctgctacatttcggtcttacttggagatcgtatcatgatgtcgtcctcgtcctcgtcgtcggccgccttcccgctggaccacctcgcgccgtcccccaccgagcagctctgctacgtgcactgcaactgctgcgacaccatcctcgccgtcggcgtgccttgcagcagcctgttcaagacggtgacggtgcgctgcggccactgcgccaacctactctccgtcaacctccgcggcctcctgctcccgcccgccgcgccgccggccaaccatctcaacttcggtcactccttgctctcgcccacatccccgcatggcctcttggacgagttggcgctccaggcgccgagcctcctcatggagcaggcgagcgccaacctgagcagcagcaccatgacgggcggcagcaacagcagctgcgccagcaacctgccggccgg

SEQ ID NO: 3058 - DNA, 480 bp, Sorghum bicolor
  Clone ID: SORBI-28MAY03-CLUS5119_1
atggagttgaggaggtagaattagcgaagattggtgttgaagtaaaagaaagagctcggaagctactgcttgatgatatccgagccttatctacctgtggtgaatcatctcatgatcagagtcagtcaccaaaggctgatgacgctgcatggattgttactggttcaaggttaatgcgtggggaaacaactgaagaaacgactcgtgaatgtccgcaatggtcggaaagaagcatattctatgctaagaactgctatgcagaaagctgcacagttgaggttgatggaaaaggaaaagaacaaaagcccttcatttgccatgagaatttcggtgcggataaaaaagattgtgtggagcatgttagcagatggaaaatccttttctgaggctgagataaacgatatgatttttgatttcgaccgagactacaaagatattggcattcgcccagttgaccaccaagttgttcgtcctaaaaat

SEQ ID NO: 3059 - DNA, 555 bp, Sorghum bicolor
  Clone ID: SORBI-28MAY03-CLUS51192_1
gcacgaggttgggtactttcccgagattcctcaaccaggtttctccacctgtttggttattccgtccaataaagagtctgctgttgccaacgaaaaccttgaaagtgatgcagaaagtgttggtgatcttattgatggcaataattttgtatcaggacctaacattgccaacatggtagttgatgaggtgggtttcaagatggcacctgctgataaaagttcacctggtgatcactctgatgactcatgtgttattcctgaaagtaggactcaggattatgctggaaagagccatgagggagttggtgattgtggtgtgaattggagtgtctgaattatgtagtgagcctcttaacaaatcatcaggtaatatatgtgcaactcaagatgttcctacaaatacgtctactatgtctgctggtgccagtgaagtgtctagttcgtggagtgagcctgcaactccatgtgttcctgcaaatgcctctaccacgtctactgttgtaccatctgttaaactctggacaaatgctgggctctttggacttgaaccttcta

SEQ ID NO: 3060 - DNA, 396 bp, Sorghum bicolor
  Clone ID: SORBI-28MAY03-CLUS51233_1
gcgtgtctcagagtgctatgaccggcacatcacggatgttgagagctcggaaggcaccccgaatgcgctggatggcatgctgcgcatagcgatccggtgtatccggtccgcatcggagaggccggagatccgaacggtgtttgaggatctcttgtccctatcgtcgtgaccgttagttcttgatagtgtacatctcgtacttacgtcagcttgtggaaacttggagggtatactaacaattgctaggattttggggtgatgtgtgtgtagtccccttgagtattcattgtttgggttgctctttcttctgggaatagttgattcgttttagttagtccacaattttagcagtagatgttgtgagaataagtttgggcattgtggtaagtcttattg

SEQ ID NO: 3061 - DNA, 489 bp, Sorghum bicolor
  Clone ID: SORBI-28MAY03-CLUS51204_1
tgcaaatgcatccatgtgcagctatgtggctatgccctgccaactacaagttctattatttttttctatgttgcaaatgcatcaatgtgcagctatgtggctatgtcttgccaactgcaagttccattattttcttctctatgctttctgattcatgctttccacagtttcaacgaaggttgcatatagtttgtagttaaagtgatatggaggtagttgctgaatggctccattactatactggtttttcaattgtggtcctccctcttcaattggattagtgaggatgtaaaaaaagagtggaggcactcgacaagctcgttgaactggtcaatcacaggctcattgtattttaggagggattcagcactataactgtacaattggtggagtaccacacagcctgactcaggttggtacactgttttgcagtatatggctgcagtgaatgtacgtagtcctgaatggtgagtagctttgtgccaaaaa

SEQ ID NO: 3062 - DNA, 236 bp, Sorghum bicolor
  unsure (1)..(236): unsure at all n locations
  Clone ID: SORBI-28MAY03-CLUS5104_1
ccctcccatgttgcccctgaggagtgcctagagtgctatggcccanaagctgatgtatggagcgctggagtgattttgtacattttgctatgtggtgtacccccattctgggcagagagtgaagcagggatcttcaggcagattttgcgaggcaaacttgatttggaatctgaaccgggggggggtatctctnatantgctaangatctantccntaaaatncttatccnnnatcc

SEQ ID NO: 3063 - DNA, 692 bp, Sorghum bicolor
  Clone ID: SORBI-28MAY03-CLUS51043_1
gcacgaggcctcaaccatctttgtaatatccaagaagcagaaaattcccagagtgtacagcttattagatcaggggactatgctgagagtagtgacaagatgctagagagtatcctccgtttgttcttggcctctggtggctcgggggcaattgcgaaatcttgcagtgaagaggcttcatctgtcataggttctagtcggcatgcttatttgcacttttgggaacttgtggcatcattcataaaaaatgctccactgcaaattagaaagtctgcactggagtccatggaactctggggactgaccaagggttccgtcagtggattatattcgattcttttctcctcacaaccaatatttcacttacagcttgcagctttctctctacttctgtctgagcccttctgtcaactttcactggttaaaaattgttcaatgggagaaaattgctcatctgttcagcaatctggcataagccaaagtgctgagttgatgccagattcagagaagacagtgcatctaagagatgaactttcagacttaattgagttcccgacatatgaacttctcaaaactgatctgacagctcgagatagggttgatgtattcattgcctgggcattgttgctgtcccacctgcagatactacccgcatcttccagtatcaggggagatgtgcttcaatatataca

SEQ ID NO: 3064 - DNA, 568 bp, Sorghum bicolor
  Clone ID: SORBI-28MAY03-CLUS51044_1
gcacgaggctcgagggtggatgctgtccattcgaagcttcgaatggatagcatcaagaatggatgaggatcttcattatccaacagatttattctatgattctgaaaatgtccgctctctttttggtagtgtggctccatatgctgtaccgcaggtatctagcagttcacttaagaaggccattggattcaaaacagaggtatcctactgtgatgcattgatggtcctgaagtattggataacgtcaaaggttccctttagggcaagcatgagccagatgtgcaaattctatacctttttgtcagaaggtgtggcggactcaaagattgacattaaacgggagttcatgtcatctccctctatatttacaccactacagcgtcctcgggcaagtgaggttattcctggaagttttttggcgccagaagacctctattggcatgacccaacaggatgctttgaaataacagaggatttcattgcaacgagaaacagaagcatgttcccaagaagaatgctatctgcagcctatccaaacctttgtgaattatttactctgacatgtggt

SEQ ID NO: 3065 - DNA, 754 bp, Sorghum bicolor
  Clone ID: SORBI-28MAY03-CLUS51444_1
gcacgaggccgccgcttcccctcctcctcctcctccgccccgcctcgccccgcgccgcttcccctccccgctctttctgtgaggagggaagcgaggcggatgccgaggcgacgaggctcgcgcaccgcacgcgtgtgcccgccgccccggggccaggcgaggtggtgaggtgaggtgaggtcgcgcgcggttttaaattgcccgcccgccccgcgcgccgtagtttttcagtggtagaagaaccaacgtcagggctgcttgcctgcctgcctgctgcggacatgggctccggtctcaagtaccgagctggcctctgcctcatcgtcgccgttgtgctgatttgggtcctctccgccgaggtcacgcaggggatattcacaaagtacaaacatccgtttgcaattacttacttgggggcctcccttatggtcatatatctccctttgtcatttctaaaagacttcatatacaactcaatgagacggcattctggaaacactagtgctttaaaaattgcaagcaaatcttcctttggtggtagtgcccctttgaagaatggtgaatttcagaaggtgttggaaatggaatcacagaaaactatagtgataaattgcactgatgtgagcattcctgtagtagaagagacaaaaccactcatatacggaatcactgaaatgaatgatggtgctttcaaggacaagcaactttccacaaaggagattgcaacttatggattgtatctttgcccccttat

SEQ ID NO: 3066 - DNA, 586 bp, Sorghum bicolor
  unsure (1)..(586): unsure at all n locations
  Clone ID: SORBI-28MAY03-CLUS51484_1
gcacgaggaaaagacaaatcatgagtgtgaggagagagcagagggagaaagaaaatagatccaagatgaggatggcaaaggctccccccaggcagcatagtgtttccctacaaagctcagttggtcctagtgtgaataagcgagcagctccttcgagtggagaagttaaaaagaaagtttcttctggttctgccatcacagtagaaggaaaaattgttgactatgctgaatcttcggttccattgatgggtgatacggcttccatggacctcatagggccaccttcaaccaatgcagaaactcatacaaactgctttgccaatcagcctatccagatccagacatccactgacttggtctcctccagtcctgcaaaccttgtgagtggcttatctgaagacaacaataaaggggcatctattagtactccatttaacatggtttcctgngataattcacaaataaaccagcaggttatgccattaactcaaactcaacttgaagaagctatgagaccagctaaatttgaacagcaggctggggctggtttttctttggagtcaacaatgctttgtctcccacagta

SEQ ID NO: 3067 - DNA, 590 bp, Sorghum bicolor
  Clone ID: SORBI-28MAY03-CLUS51502_1
ctcgccaaaccctagcgcccgcgcccgcgcccctggtcctccgcccccaccaccgtcgccgtcgcggtcgggcgccccctatggcgaagtcgcggccgcccaagcggatcctcgagtcctataccatcaagggctcggacaaagtcatcaagcctggtgattgcgtgctaatgagggcctctgatgcatcaaagccaccttatgtggcaagagttgaggcaattgaggcagcaggatctcgaggtaccaatgtgagagtacgagtgcggtggtattatcgaccagaggagtccataggtggtcggcggccatttcatggttccaaggaggtcttcctctctgaccactatgatgtacaaagtgctgacaccattgaggggaaatgcaatgtccacagcttccgtagctatacaaagcttgattctgtcaatgctgaggatttcttctgccgctttgaatataaatcagctactggcagcttcgtaccagatcgcatagcagtgtttttgcaagtgtgagatgccatacaatccagatgatcttatgatccagtgtgaggaatgttctgactggtttcaccctgcttgcat

SEQ ID NO: 3068 - DNA, 499 bp, Sorghum bicolor
  Clone ID: SORBI-28MAY03-CLUS51503_1
gcacgagggttgaacaagtccgcgatggcagtactgttcgtgtgtatttactccctagtttccagtttgtgcagatatatgttgctgggctccaggctccatcaatggggagacgcccatcggtacctactgtaattgctgaaactgatgatactgctaatggcgtgaacggtgaagattctgagggaacacctgcgcaactgactacagcacaaagacttgttgcttctgcagcttctgctgaagttccaccagataggtatggaagagaagccaagcacttcacagagactagagtcctcaacagagatgtgcgtattgtggtggaaggcacagatagctttagtaatataattggttctgggcattaccctgatggagagactgcaaaagacttggcccttgagcttgttgaaaatgggcttgcaaagtatgttgagtggagtgctaatatgcttgatgttgaagtaaaaataaagctgaagaacgcagaacttca

SEQ ID NO: 3069 - DNA, 906 bp, Sorghum bicolor
  Clone ID: SORBI-28MAY03-CLUS51540_1
gcacgaggcacacgttcgtcccccctgctgcacagaagtctccagcacgtaaagcagtatccaagtcagagcttccaatggatagcatcattaccaaccttggataacatacaggacaaaaaacaacatgcacaaattacctgccctaatcgatagcctccaaaagctgcatttgctctaatgcttaggtctatctcaaaatattgtcaaaggggtgaacctgacaaaagcagagacaacgatctctgaccaagaaagttgcatattggtgaattcgtattttcaacgagtgcattcattttcagttgaacagctgcatttcgttctgaggaccattgtgtttttggccaaacagacaacgatgcttttgctgatgttctccattgccgtcatttagccatcctaattcctaactcaggatttcagattcaacttgtagtgaaataatgaagctccagcctttatatgcataaaaagttagagcatacattatagcggaaacacagtttttcttgaatgtacaggtgactggaatagttgatcttgtagttgtagctctacatgagtccttgggttcaaggcagtacgcagcagctccaagcttgacgccctggatctggtaggactgaactatcatcctaaaagcagggtacttggcttacatgtgagttcttggagtacgtttctttgtggcttctgcagctcaatgatggcatcgtgaaaggcgaggaagcaacagaagtttggtagctctggaagtggagggtgtcgtggacgctgagctgtttccagatctgaaatactccaccatgctgaccgtctgggttaatcattctcatctgaaatatatttactaccccatccattccaaatcattactcatttgacttttataaatcctagttt

SEQ ID NO: 3070 - DNA, 493 bp, Sorghum bicolor
  Clone ID: SORBI-28MAY03-CLUS5425_1
cgacggcgacaagctcaggttccccggcggcgggaccatgttccccaacggcgccgacgcgtacatcgacgacattgggaagctcatcccgctccacgacggctccatccgcaccgcgctcgacaccgaagaggagaacccggtacgccacctcccgctcccgcaccacctccccatccctcgacttctccgtgcgccacgccgcggccatcgcgctcgacgatgccgacggcaccgcctcgcccggcgcctcctcctcctcggccaccccgcggaggtacccggcgtgcgcggccaagtactccgagtacacgccgtgcgaggacgtgggagggtcgctgcggttcccacgggaccgcctcgtgtaccgggagcggcactgcccggcgtcggagcgggaggtgcctgggtgcctggtgccggccccggccgggtaccggacaccgttcccgtggcccgccagcccggacgtcgcctggttcgccaacgtgcc

SEQ ID NO: 3071 - DNA, 659 bp, Sorghum bicolor
  Clone ID: SORBI-28MAY03-CLUS54272_1
gggctgcaggaattcggcacgagggtctcgttgtcctccctccctccctcgcttctgcggtgcggtgcggtgcgggatacggccgggccagattcagtcagcgccttactccatgatccggaggagcgcctcacgtgccggggacgacctcttcgccacccagtagcagcaggaggcctccttgccccttgccggttgccgcggttcttgcttgtggagtcgggtttccaggttagtagcatgcgggagtgatggcggccgccgaagcgagggctgcctggcaacgcgccgccaaccgctgcctggtccaggaggatgccaagcgagctcccaagctggcctgctgcccgccgcccctgcaaccgcacgacgcgagcgatggaagccctccgagtccgcaagacctccattcccctacatttatgcccatcaactggaacctgatgaactccagtctgcccatggaaacccagtggtggctccagttgcagcccaactttgggtgccaggcagcccttgctagggaccacctcaactatgtaggtggggacgccgctgagaagaaaatggagggtttagcagcgcctgtatccaaacttgaggatgtccaagcaaagaatgctgcagatccttttgagcctccgtggatcgtttcgatg

SEQ ID NO: 3072 - DNA, 620 bp, Sorghum bicolor
  Clone ID: SORBI-28MAY03-CLUS54275_1
gcacgaggggcgcactacgggcaggcgccacctcctcagccgtactacgccgcgcctcctgcgcccgcgccggcgccggccgcccccgctgcggcggacgaggtcaggacgctctggatcggggacctgcagtactggatggacgagagctacgtcttgggatgcttcttgagcaccggggaggttcaaaatgtgaagctcatccgtgacaagaattcaggacagcttcagggctatggttttgttgaatttacaagccgtgcagctgcagagcgagttcttcagacatacaatggacagatgatgccaaatgttgagttgacatttcggctgaactgggccagtgctggtgaaaagcgtgatgatactcctgactataccattttcgttggggatttggctgcagatgttacagattacttgttacaagagacattcagggttcattatccctcggtgaagggtgcaaaagttgtgactgataaattgacaatgcgcacaaagggatatgggtttgtgaaatttggtgatcctacagagcaagctcgtgcaatgactgaaatgaatggaatgccttgttcttccaggcctatgcgtattggtcctgcagcaagtaggaa

SEQ ID NO: 3073 - DNA, 536 bp, Sorghum bicolor
  Clone ID: SORBI-28MAY03-CLUS54285_1
gcacgagggatgaaaccaagcgtgcagtgtctaataaggattctcagttggagaccatgactggctcagctagtccaaaccagatggcagataaccgttcagctgttagccgccagggtggcactagcccattatctcatcaagaatgctgcagatcagaagacttgaatagatatgtatgctctgatgagagcaaggaggttgggcacctaaagaagagccagtctcttggaaacatgcttcaaaaggatcatgatcataattctagcgaaggctctgagtttgatgttacaaaccatgaacacaaatgcgacccctctagtttcgagagaggtgaagttgttggagaatctactaaggcgtgcagcccagaaaatgaggacgattttgatgcctcatctgacctaatcagccatgatttttgtgaacctttgggtgatcacactgttgattcggatagccatcatcgcatgtcttattcccaaagcaaattccctagatcacaatctgcaatatttcagaatgattgcaccagt

SEQ ID NO: 3074 - DNA, 377 bp, Sorghum bicolor
  Clone ID: SORBI-28MAY03-CLUS51644_1
caaggccaccgcccccgcccccccccggtgcccgcgcgagcgcgagcgcgtgtgcggtccatgcgtgccaattgactcgcgcccacgagcacgctctcccagtcccagtctcgacctcagtcactccctcccggggccggagcgacgacctcctcagctgcagtaccttgctccgccggcccggcgcggcgcggcgcgcggcggtgttagcgagcgggatctgctcccacgggcgagcggccgtccatgggctggccgccgagctgcggcttgggccggcgacgacggggcctatcggccacgctgccgctcttcgtcggcgtcctcctcctcctgctgctcttcttctccacccccgggacgtgtggcacgccggc

SEQ ID NO: 3075 - DNA, 594 bp, Sorghum bicolor
  Clone ID: SORBI-28MAY03-CLUS51629_1
cacgagggccggagggatgaacacaaaattccagctccacctgtaatgcgattccattgtagtgcgatccgcgaggcttgaactgaactgaatctgtgaccgcgcatctggtctctgatctgattccgtcgaattggcagattcggagtttcagaccgcttcgtttacgtagtggagccggtttccccacgttgacgacaggtggtcatcacatcgcgtcagatccgatcaggaggacgccatggctgccaatcaggaggagcaggagcagcgccgccgccttctcgccgtcgcgacccgcttccctctcccaagcggctgcaggttctcctatggcacggcgggcttccgcgccgacggcgccaccatggcgcctgccgtctgccgcgccggcatcctcgccgcgctccgctccgtcaagctcgcgggcgccgccgtcgggatcgtcatcaccgcctcccacaaccccgtcggcgacaacggcgtcaagatcgccgaccccgacggcggcatgatggctcagcactgggagcccttcgccgacgccctcgccaacgcccccgaccccgacgccctcctccagttggtgcttca

SEQ ID NO: 3076 - DNA, 544 bp, Sorghum bicolor
  unsure (1)..(544): unsure at all n locations
  Clone ID: SORBI-28MAY03-CLUS51682_1
gcacgaggacgagatgggcgagccggttcctgagccatcctacgaggaagctgtgctttcagcagaagaggctagattgtggactgttgttactgcgacttccttagattttaatgcctggaccgcacttattgaggaaacagcagaaaaatgctgagaacaatattttgaagataccgaaagtgtatgattcgttccttgcggaattccctctttgctttgggtattggaagaaatatgctgatcatgaagcgagacttgatggtgccagtaaagttatagaggtgtatgaacgagcagttcttgcagttacttattcagtggacatttggtataactattgtcagtttgcaatttcaacatatgacgacccagatatcgtccgaagactgtttgaacgtggcttggcatacgttggaacagattatcgttccaatattttgtgggatgagtatattaagtatgaagagtcactggaagcttggagtcatctagctgttatatatacnagagtattggagcatcccatccagcagcttgaccg

SEQ ID NO: 3077 - DNA, 573 bp, Sorghum bicolor
  Clone ID: SORBI-28MAY03-CLUS51741_1
gcacgagggttcttgattgcgagagcgagagggatccccgaggaaaggtcggagccgcgcgaaagagggatagcgcgaggtcggagaagtccgcgctgacgaagcaggatgcactgtgacgcgttggcacatggtgagcttctgatgtcagttaggattaaacatgcttcctggctgtgctcaagtgggagaacaagaaatcagcctagacagtagttatctgttgcaagcagaaaatgcacccttattcacttaagagttccaagggagcaccaattctgccacggccaatctttgttttcttcattgcgtcatttggattctatgtatgctacctctcctttaatcagataacactagagagcggaagagaggggaatagtagagaagaacaaagggattgcagaaagccttatgtgccacatgaggagcttagttatgtgcactttccaaaacctacgagttatagcaggggggagtgctcatgtactcctgttcgattttttgtaattgtgtctatgcaaagatcaggaagtggatggtttgagaccttgctgaatagtcaccctaaca

SEQ ID NO: 3078 - DNA, 235 bp, Sorghum bicolor
  Clone ID: SORBI-28MAY03-CLUS51742_1
gcacgagggagaggttcaatatcaaacacatgtcgcggagatggaggcacttagggctggaatgcctcctgtttatgtaaaccacagtaatgatggtgggccagctgttagggatatacatatggagaacttcagtgtcactgttggtggtcgtgatctaattcaagaagccactataacacttgcttttggaaggcactatggtcttgttggaaggaatgggaccgggaagaca

SEQ ID NO: 3079 - DNA, 853 bp, Sorghum bicolor
  Clone ID: SORBI-28MAY03-CLUS51750_1
gttcgctgctgcttctcctcgtcctcgcaggcgcgtcgtcgatccggagggcgcccgccgccgccgccgccgccgggagcggaggctcgagtaggagcgggagctgggtcggcgaatctggagcccgggggacctgcattgcagcgggaccgccgcgcgcacgtagccagatctccccagtcccctgccgcggcaccggcacggcatggtggctgccgcggcggcggccaccgcgccagatccggcccaccactcgcgcccaccgctcacgccggcgctcgacaagcccaactccgccgccgcgcggaggaactcgcagcgctccaacaagcccgtctcatccagatacttgtccgccgccgccgccgcgtccccggcccccgccgcttcgtcctccacgtcgtcgtcttcttcgtcctcgtcgcgccgctccctctcagcgcagcgcacccgggcgtccactccgccgccgcagcactccacgtcgcccaccaccaccacagcgtcggcgtcggcagcatccgctactgcgaccacgatgcggagcctctccgtgtcgttccaaggggagtccttcttctacaagacgtcgcgcgccccgcgggcctcgtcgccgtcctcaccggcagcgcgccgcgggcccacgccggagcgcaggaagagcgtctcctccgtgccggaggccgagaacgcgcggccgtcgggacgatggccggcggcgaagcccaaggcgtcggacccgctcgcgcgcagcctcgactgcagcctcgaccgcaaggactccatcctcgccggcgttcacctcctccgtcgctctatggccttcgactccaccacatccctctcggcgtcc

SEQ ID NO: 3080 - DNA, 181 bp, Sorghum bicolor
  Clone ID: SORBI-28MAY03-CLUS5124_1
aacttttcatcgtgcacaccaatctggtgtggggtgcatgacaggcttccagaaccaatcctcagttcatgcactacccaattttgaaattctatgctgttgtatattgaaagtaactaggggactttactcatgatgatacaatcatcattcccatgttcactttttattgggggggggg

SEQ ID NO: 3081 - DNA, 702 bp, Sorghum bicolor
  Clone ID: SORBI-28MAY03-CLUS51242_1
cccataattaagaagctgaaaaaatcttccatacaggcgcaaccatgggaagtaagggcagcggcaccgatggtctccatggttcatagtagtgtggaggaggcggcggcgcctagccaaaatagcgcctggggtcgaatctgttgcctgcctgcagctgcgtgtgcaagattttcatccaaacatgacctgactaatacgtccaggataacagagacagtgacaacctcagagccagcgtcacagtaagggcccgttcggttaagctgaaatctggccaggaataattccagttgacaaaacctattcaaattagaataagaattccgcctgaaatattttcaggaaaccaatccccttcaaacgaacgggccctaagtgcgcccaagtgggttgttaaattggaggctgggcccagtcccaaatacgtgggggtcatttcaaatcatatacctcagaccatattgaacaacttcattatgttgagaaaatttacaaatggcactatattcatgtatttttttttcaaagaaaggacaggggacgacgagcgccgcctatggttatccctgcggctgccactgttagcacaaggcaggtgttgccatgcatgcatggctgtctcctttcggctttcgcagtttgatgttcttaaattgaactactgtataaattactatgtgtgcgtggttattttgctct

SEQ ID NO: 3082 - DNA, 530 bp, Sorghum bicolor
  Clone ID: SORBI-28MAY03-CLUS51246_1
gttgaaacagcagatgtatggtttcaaggtcatagagagagtgccaatatgccatctgcaccgttctacaatatggtgggacaaccagtgtccccccatgcggcatacttaccaccacatagtggccacaccgccttcaacccggccccttcccatcctgctcacttgcagtacccgagctttgcgcatgcactgcacccaacatcaatgacgatggtgcagaacccgcaggccatggtacatcagccaggcgcaccgccattggcaggaaatctaggcctggacatggctgccatggttcctggtagtcaagtaggagcatttcaacagaaccagtggaccacccaatccttttgagattttggcgtgcttctatgattggataagtgaaatttcggttccgtgttgagagagaacctaattgaagtgccatgctgtaatatgcaggatagacctgatgaataccaggttttttgtttttgtttttgtgataaaaggggaaaccattttatagtgccgttgtgattttc

SEQ ID NO: 3083 - DNA, 208 bp, Sorghum bicolor
  Clone ID: SORBI-28MAY03-CLUS5129_1
ctaatggcgtgctgatctgctgcccaccacgcgctttattccccccctgtccctgtgtgtgagcttcatcgaagttttaatcccattcccgtgcccgtgccgtgccgtccctatcacgccggatcgccacccgctggcgctgccccctctccccaccccactccgccccacctggggggggggggatccacccccaatccggcaaccc

SEQ ID NO: 3084 - DNA, 781 bp, Sorghum bicolor
  unsure (1)..(781): unsure at all n locations
  Clone ID: SORBI-28MAY03-CLUS51409_1
gcacgagggatgaaaattgatgaggaaaaagctcaagccgaagccgagattgaaatcttaaagagcacaatccaatcaggtgaaagggagataaattcactaaaatatgaattgcatgttgtctccaaagagcttgaaatccgcaatgaagaaaagaacatgagtgtgcgctcagccgatgtagcaaccaaacagcaccaggaagatgtcaagaaaatatcaaagcttgaagctgaatgccaaagattacgcggccttgttcgaaagaagttacctggccctgctgcactagctcagatgaaaagcgcgggggagagcttgggtagagagtatggagaccacagagtacgacgatcccctgcaaagaattctagtttccatcggcctatgtctcctatgtctcctgttcctgattatgcaattgagaacatacaacaaatgcagagagagaatgagtttctgactgcccgtttattaacaatggaagaagaaaccaagatgcttaaagaggcattgacaaagagaaacagtgagctgcaatcgtcaagaagcatgtatgctaagacagcaggaaagctccgaagcttggaagttcaaatgttgactggaaaccaacataagagtccatcaactccaaacatggatattcactttgatggtgcactgagccaaaatggaagcaacccacctagcatgacttccatgtctgaagatggggtagatgatgaaggaagttgtacagaatcttgggccaacgctctggtatctgagctctctncat

SEQ ID NO: 3085 - DNA, 774 bp, Sorghum bicolor
  Clone ID: SORBI-28MAY03-CLUS51802_1
acgcgcacacacacacctaaccccagctcctctcctcctcgccaacctccccgtcccgtcccgtcgattcgattcggtcgaagcgagcggggcgggcggaggaggctagggattcggatgggcgaggcgccgaggaggttctagaggcgctggtggtccgcggggacgaggagggggagggggagcggcgggcggcgatggaggagaaggcgtcgtcgccgctgatcccgccgccgtcggagatcgacctggaggcgggcggcggcggggagcagctccagggccggatctgcctcgagaccgacgggagggacttcatcgcgccctgcaagtgcaaggggacgtccaagtacgtgcaccgcgactgcctcgatcactggagggcggtaaaggagggatttgcattttcccattgtaccacctgcaaggctccatattacttgagggttcattcccacactgacaggaaatggcgaacactgaagtttcgtttctttgttactagagatatattattcatctttgctctagtccagattgtcatctctgcattggcatatttggtacattttattgatgggtaccagcaatattggttaaggacagcctggggttttgataatgaagttagtttttattatatatgtggtgcattattgttttttgctttgttgggactatcgggatgcttcataacctgttatgaccgaagagtacgaaatgacttggctcagccttgtcgagaattatgtctttgttgctgtcagccaggga

SEQ ID NO: 3086 - DNA, 604 bp, Sorghum bicolor
  Clone ID: SORBI-28MAY03-CLUS51842_1
atttgttcgctccgtcggttctggttctaggtttagaaatccccaaatcccatttttttccaatcgaattcgatcctcgagcgtcggcacagccctgcgccggcgccgtcgaccacggcgatctccggtgtctgattgctttcggagggaggcatggagggctgctccaagacgaccgccggcgcgggggtggccggcctccctgacgaccccgtgctggagatcctgtcccgcgtccctgccaagtccgtctgccggttcaagtgcgtgtccaaaggctggcgcgacctcatcgccgaccctaacaaccgtaagaggctccgccacgccatgcagggattgtttgtccagacgtacgcggatgaattggatgacgacgaattgggcaaggatgacttgggccgtatcaggttccgtttcatcaacctgacagcagtgagatccgtgcctctggacatcgacccttgcttctccttcctgacggaaatgactgggatcaaggccttcttgttggattcctgcaatgggcttatccttttcgggcagtgtcaggatccgtctctcctattgctattggatggctatatcgtgtgcaacccaacca

SEQ ID NO: 3087 - DNA, 604 bp, Sorghum bicolor
  Clone ID: SORBI-28MAY03-CLUS51872_1
ggcaaagcacccgattcgattcctaggcacccggattttccatccatgtcttccttgcttgaccggtctcgattgcccgcctcagctcctttccctcttctcctggcttctctcgccctttccggcggttggaggaccagaagctgagctagccgcccgccttccggacgctgatgtgattgacccggtcggctgattgggaattttagcatcgcgatacctccagcagcggtccagcccaaggctccagcacggcagttggttgagtcaccgcccgccattctgttagcagcttccgctgccggccgatcttgccgcgccagcagcagaaaaggccggcgttttcttcagccatggcgtgcgcggcggcgcacatgttcgtctacaacgccactctctgcgcctgcgaccccgggtacttcctcttcaccaactccaccggcggcagcaacggaagcagcaccagcaccagctgcgtgtcattgccccgcggcggcgacgggttcggcgactggcaggtcgggtccgttggcgcgtccaagaaccagagcttctacttcctgaccccggtcctctccctcgacgtcgtccgccgcctcaccca

SEQ ID NO: 3088 - DNA, 672 bp, Sorghum bicolor
  unsure (1)..(672): unsure at all n locations
  Clone ID: SORBI-28MAY03-CLUS51885_1
gcacgaggcggcctcgagggggctaggatgcggcaaccggccttccggatgacgctggctgagctccttgacgagagcaagctcgtcccggtggccgtgacgggcgaccaggacgtcgcgctcgcaggggtgcagcgcgacgccagcctggtggcggcgggcgacctctttgtgtgcgtgggagagggcgcgcgcgcggggctcaccgaggccgacaagcgtggggccgttgccgtcgtagctgatcaagacctcaacatcgagggcaccctggcctgccgcgcgctggtcatcgtggacgacattttggccgcattgcgcgtgctccctgcctgcctctacaggcgtccgtcgacggacatggctgtcataggtgtcactggcacagatggcgtaactaccactactcacctcgtcaaagcaatgtatgaggccatgggggtgaggactggcttggtgggcgttcttggggcctatgccttcggcagcaacaagcttgatgcacgccctgatgcatctagtgaccccattgctgcacagaagctgatggcgacnatgttacacaatggcactgaggcagttgtgttggagacagccactgatgggatacctccatctggtgtgggtagtgagatagattatgacattgctgttttgactaatgttaggcac

SEQ ID NO: 3089 - DNA, 734 bp, Sorghum bicolor
  Clone ID: SORBI-28MAY03-CLUS51904_1
gcacgaggcttggtttcacttgagtacctcaatctcagccacaactcgttatttcaggaaattggtgaactatttggaagcctcaattcactttcagaactcgacatatctttcaacaacctgacggggaatcttcctttctcaatgggctccctgtcaaaactttctagcctctatatgcaaaataatcaactatcaggcacagttgatgtcctcagcaacataagccttgcaacactaaatattgcaaacaacaatttcagtggcatgatacctcaagaattcagctcaattccaaatttaatagttggaggaaactcatttggcacgaggcctgcctccccgccaccaactctgaagccacctccgaatccacatgatcagccaaacgatcctcaaggacctagtgcttcaactatcccagagactcctattgatcaagatgacaagaagatgcaaacaggtcctcttatagggatagctgttggttcaatagctgctgcctcatgtgttcttttcgtgttggtgttctgccttcacaatgcccgaaaaagaaatgatgatgagagcagtgaaccaaaagataatgtgggttctcttgcagtaaacatagaaagagcatctaatagggaagtcctgaacaacaaccatgaaaatgctgttgtagcaacttcagatctccaacctgctggaaagatgactccggacagagtgcatggtacaaatggttctag

SEQ ID NO: 3090 - DNA, 625 bp, Sorghum bicolor
  Clone ID: SORBI-28MAY03-CLUS51524_1
gcacgagggcccccaattcggtcgggacccttcgattcgcttcgacctccgtcgtcttttggttgggaaacctcaacgctggcgagtcggtcatcactgttgaaggccatgacatcactctgccagggcaccacaggaaattttggcaaaactgaatgaatgagttttggtcagcttgggacccaacaaagaataatacaattcggtcccagggtaaagtagcagaacgttgacaaagattgctcagcgcaccatgcttgaggatttcttcactcttactgagatgaaggatggcatctcgacggtcgcaaggattgcagagctcatatctgagatgcacaagctggaaaactccgccgacatcaacacgtccgatgtgataaggcagtgctctacggctgccaacacactagcatccaccaaaaacgaagagtgtcttcagcatttcgttcagctaaatggtgtttcctttctcaaccgttggcttcaggatgctcaaaaatgtgttggggacgtcagaagttcagcggaggatcttatagttgccatattgactgccttggagtgtcttccaatcagcaatgagcagtcagcctcctgtagaagtatgcctactgttgatcac

SEQ ID NO: 3091 - DNA, 522 bp, Sorghum bicolor
  Clone ID: SORBI-28MAY03-CLUS51561_1
gcacgagggtgcactgcttgcttgcgctgatgtgggattcctgaagctagggaaatcgatacatggtttcatcttgaggaggcttgagttccaatgtattttgggtacggctgtccttgacatgtattccaaatgcggctccctggaaagtgcccggaagcttttcaataagctttcctcaagagacttggttttgtggaatgcgatgattgcatgctgtggcactcatggatgtggtcatgatgcccttgctctgttccaagaactgaatgaaactggaataaagcctgatcatgcaacatttgcttctcttctgtcggctctgagccactctggtcttgtggaagaagggaaattctggtttgatcgcatgattacggagtttggaattgaacccacagaagagcactgtgtatgtgtagttgatctcctagcacgttctggtcttgtggaagagccaatgaaatgctcgcatcaatgcatactgaaccgaccattccaatttgggttgctcttctttca

SEQ ID NO: 3092 - DNA, 488 bp, Sorghum bicolor
  Clone ID: SORBI-28MAY03-CLUS51589_1
gcacgaggctggcctccaaataacctcatgttctagattgactggatgttcttggattggatgctcatcgatcttggttgctgcttttgctaacccctttctgccgatcttggtttagttcagtgtgtgggggccgagatccacaagaacagaacatgtttgaaattatttactaatattatactgtccaattcttggatatgattttaagcttgtatgacatgatgagcttaagtttagatgactctccccacctcaaacctgaaagtattcgaagtttgtatattttcatcatttacaaactatttcattcattgtttagttcttttctgagttcactgcgttcatacttcagttgttttctgtgtgactctgttctcttcatttgatccatactgttgtcaattctcagtcagtgcccaatgaccaatgttacttcactttgatggtaatcctactcctctgaatttcattactacttagaaact

SEQ ID NO: 3093 - DNA, 984 bp, Sorghum bicolor
  Clone ID: SORBI-28MAY03-CLUS51592_1
gcacgagggagcattgacagctctagcgtcagtagcagattcatcacaggaccacttcaagaaatactatgatgctgttatgccatacctaaaatctatcttgatgcatgcaactgataagtccaataggatgcttcgtgccaagtccatggagtgtataagtttggtaggaatggctgtgggtaaggacaagttcagagacgacgcaaggcaggttatggaagtacttatggctttgcaaggagctccgatggaaacagatgatccaattaccagctacatgttgcaggcttgggccaggctatgcaaatgtcttggacaggattttcttccttacatgagtgttgttatgcctccactgcttcagtctgctcagctgaagcctgatgttacgattacttcagccgcaccaggtgatgatattgagtcagatgatgatagcattgaaacaatcacacttggtgacaaaagaattggaatccgaactagtgtgctggaagagagagcaacagcttgcaacatgctgtgctgctatgctgatgagcttaaggagggtttcttcccatggattgatcaggttgccccaacgttggtccctctgctgaagttttacttccacgaggaagtcagaagagctgctgttgcagccatgcctgaactcctacgctcggcaaagttggctgttgagaaggggcaggctcaaggccgtgatcagtcttatgttaaacagttgtctgactacataattccagcacttgttgaagcactgcacaaggagccagaaacagaaatgtgctcatccatgctggattctttaaatgagtgtatgcagctttctggtcttctgcttgatcaaacccaagtacgagctatctcggatgagattaaaaatgtcattatagccagcgctacccggaaaagagaacgttctgagagacaaaagcggaagattttgatgctgatgaaggagagctactcaaagaa

SEQ ID NO: 3094 - DNA, 435 bp, Sorghum bicolor
  Clone ID: SORBI-28MAY03-CLUS51615_1
gcacgaggcccgtctcccaccttggggtctcctagcgcaccacccgagaaatgctcttctctttttccgggtttccattctaccagtaccagtgccttgtctccgagtgttgacatctctctgcgtgctctggccccgccattaatcgcttcctcttcctgctgctgacccagggcagctagcccccagtcacgcacacacgaaatccaagcgttccaattcaatttcaaatcccctttccttcttggctgccttcgctgcaaaagccaagaatttttctttttctgatttgagcgctcgacgcgtccggaggaggagtcatggtggcggagccgctggtgcgcaaggtgctgtccatgacgacgctgtcgtcgtcctccaactcctccaagaagaaggcgcggcgggcggtgagcgccaacgccaacaagagcg

SEQ ID NO: 3095 - DNA, 479 bp, Sorghum bicolor
  Clone ID: SORBI-28MAY03-CLUS51971_1
gcacgagggcgggcctcaagtgacccggtaggcagtcccccaagattccttctcgcgatctcactgcacgccgcaccgcaccgcgccagcatcagcatgggcggcggcggcggcggcggcctcggacgccggcggcacttcgcctacctgccgctgctgctgccgcttctcctgctcgccgtggccggtgccgccgcggggaaggagaaggagaagggcgcgttcggtaagctgcggttccggcgggagagcggaacgttcaaggtggtgcaggtggcggacatgcactacgcggacggccggagcacggcctgcgaggacgtgctcccgtcccaggtggccggctgcaccgacctcaacaccaccgccttcctctaccgcgtcttccgcgccgaggagcccgacctcgtcgtcttcacaggtgataacatctatggtgccaattcaactgatgcagccaagtctatggatgcagcaat

SEQ ID NO: 3096 - DNA, 632 bp, Sorghum bicolor
  Clone ID: SORBI-28MAY03-CLUS51977_1
ctgctacacttcttcttctttcttcttcttcttctccttcccagcagaagcgaaagctcccccctttccaatcccacttccacaccccccttcttctccggcctccctcccgcgcgcggccatgtcttcgccggcgccggcggaagaggacggccgtgcgccgaccaagtacgtgctgatcacgggcggcgtcgtcagcggcctcggcaagggcgtcaccgccagcagcatcggcgtcgtcctcaaggcctgtgggctccgcgtcacctgcgtcaagatcgatccatacttgaacacagatgctggtacaatgtccccctttgagcatggtgaggtgtttgttcttgatgatcggtggagagggtgatttggatttggggagttatgagcgtttcatagatgtaactctgacgagggataacaacattaccactggaaagatataccagtctgtcattgagaaggagagaaggggtgattatcttggaaagactgtacaggttgttcctcatgtcactgatgaaataaaacagtggatacagtccgtgtcttcagttcctgtggatgggcagactcgtccagctgatgtttgtgttattgaattgggaggcactgtaggtgatattgagtca

SEQ ID NO: 3097 - DNA, 421 bp, Sorghum bicolor
  Clone ID: SORBI-28MAY03-CLUS5198_1
ggactatgcaattcaacatagatgcggatctggtactttattttatctaaatcactactaagatgtcaacaggttttgggtccatggaacttaaaataaatccagattttactttccaggagtagaaagcataataattctatagttctgagtagcatgcttgcctgccaacgtgtcacaggggtagtattttgttttatctgataattccagcttccagtgtcatcaatttctgaatttattttaggctgcatgaaatcaacgcacctttgttctcatttaatttcaatacatgatccgtaaacagttgaaattttccaatattattccattttttagtatattttcagcagtaaagtatttcataactcggaaaaagttgagcccataaatgtgatgtttcatttaatatatgatctgg

SEQ ID NO: 3098 - DNA, 757 bp, Sorghum bicolor
  Clone ID: SORBI-28MAY03-CLUS51980_1
gcacgaggacagcatgtgctcatgggcggctttccagccgagacttgactacaagcttaagggatcttgtggactttttgcctgcttctcttgctgcaattgtaagctacttctcagcagaaagcacgcggggaatctggaaacctgttccaatgaatggaattgaatggcctagtcccggtgcttctcttcattccattgaagctgaagtaaaggaaattcttgcatctgctggtgttcagattaacagctgctatccacgtggtgtgccgccaatgcttcctttacctatggctgcacttgtcagcttgacgattacatttaagctagataggagtttggagtacattcaaggggtcactgggcaggcactagagaactgtgcaggggggagttcctggccaagcatgcccattattggggcattgtggacacagaaagtgcgaagatggcatgacttcatcgtcctctcttgtatgcgttctccatttggtacagacaaagatgcagttgcgcagctcatccaaagttgcttctcgtcctttctgcagtcttcacccagtggttctgacataattgcaaaccgtggagttggggctttactaggggactcgatcacgaatcaaggtcttaggctcccaatggcacctggtttcatctacttgagaacatgtcgaactttccatgacacttacttcgttagtgaagtgatcctcaagcaagttattgagtggtctcacaaacttgcaaatggatg

SEQ ID NO: 3099 - DNA, 493 bp, Sorghum bicolor
  Clone ID: SORBI-28MAY03-CLUS52013_1
tggatcctgtaaaagggttcaatttctatataaaggcgtcacttcagaatagctcctcgatcattatggttgaatcagcggcgatggcacttgcagctgatgttacatcgcttttgaacattagtgatatgtcattcatcactgataatcagattcttgcaaccttctacaatggagacaacttcgatcaacctccatcatgggatgtacggcctttcactcaaagatttcttcataaggtctcacatctctcttggagagtaatgaagataggaagaggagataatatcacagcacatactctggcaagtcaggctttaagagctactacacagattccaaatcaagatgtaaacaatcatactgtagtaacctgcagtaacgaagatcatgttgatggatgtcctcttaaggaggctctaaaccttgtaaattgggagactttctcccttattgcagcttcatgctgctaataaaatttctgttctttgtc

SEQ ID NO: 3100 - DNA, 333 bp, Sorghum bicolor
  Clone ID: SORBI-28MAY03-CLUS52053_1
atttttcttccaaacacgtcttcatggacggtggccgcttgtcagtggaacaagatgacagcctttgttcttaatcttgagctagaaactcatcagctttatcggcggaaaaagtctacatcaccccctgaactatggggtggtgtctactttacccccggaactataaaccagtctaatttaccccctgaactctccaaaaccgttcaaatcacccctgggcggttttttatggcggttttgctacagtaccgtggttttgactttttctttttcactatttgttttgcatataatctttgaaaaatcataataaatcacagattaatattt

SEQ ID NO: 3101 - DNA, 627 bp, Sorghum bicolor
  Clone ID: SORBI-28MAY03-CLUS51755_1
gcacgaggggcgttcaaagcccatgagcgagttccaaaaaaaaaaaagaaaaatcccatgggcgagcccactggcgggctcgtccagatccgccgccgccgccgccgccgccacctctaatctctctctcagccagattcgccaccaccgccggcctgccgccccctcgccggtcccctcgcctggcccccctcccccgtcccccgcccgcaacccgtcgcccgattcgtcgtcgcgcaacctagctcgtcggcgctcgcccctgctacgtctagcggtcgggattgatagcgatcggaattgctgttgcggatgcctcgatttatccggacccgctggcgtaatcgcaagccctggaaaccgggtgagcgcgccatcgccgctctccgcccggtccaccgctcccgcctcagctctgccataggtaagaagagttcatccctgcccctgcgtgcgtcgtcttatagtgatgaccgcgtcagtgccctcgccgacgatctgctgctcctcatcttacgccgcctggatacccgcagcgccctcgccactgcagccctttcaaagcgctgggctagcatcccacgcgagcttgacgccctcagtttcagtgtcaacgatattctttct

SEQ ID NO: 3102 - DNA, 376 bp, Sorghum bicolor
  Clone ID: SORBI-28MAY03-CLUS51762_1
gcacgaggaacaccacaagaaggcaggggctatgaatgctctggtccgagtgtccgctgttctgacaaatgctccttacattcttaatcttgactgtgatcactatgttaacaacagcaaagccgtccgtgaagcaatgtgtttcatgctcgaccctactgttggcagagatgtctgctatgtacaattcccccagaggttcgatggcattgatcgcagtgatcgatatgccaataggaacgttgtgttctttgatgttaatatgaaaggacttgatggcatccaatgcccagtttatgtcagaactggttgttgtttctataggcaggcactttatggttatggacctccatctctgcccgcacttccgaagtct

SEQ ID NO: 3103 - DNA, 573 bp, Sorghum bicolor
  Clone ID: SORBI-28MAY03-CLUS51768_1
gcacgagggggagctgtacgagctacttaggcagagcgtcgataaagtttcggcccttggtgacttccagcgcccattgcgggtgctcaggcggcttgtggggatccccaattgcgccaaggccctggtgaaccatcccaagtggataccaaagaatcagatcatgctcattggggaagggagagtcatggagctctacagtgtacttggagccttcttccatgttagcgctatccgagaccgtgagtttgccagcaagcctgatgtcgggcaacaatgtttctcagaggcatcttcacgtcggccagctgacttgttgtcatctttctcaacaatcaagactgttatgaacggcttgtatgatggccttaaggatgtccttctaatcctcctaaaaaatttggatactcgagaaaaggttcttgagtatatagcagaagtgataaataaaaatgcatccagatctggcatgcaggtagacccattaaaatgcgcgagttcaggtatgtttgtgaatcttagcgctgtgatgctccgtctatgcgagccttttctggacaccatggaatcaaa

SEQ ID NO: 3104 - DNA, 607 bp, Sorghum bicolor
  Clone ID: SORBI-28MAY03-CLUS51820_1
gcacgagggaggggaggagcactgagcacatgactgctctgctcggctgctttctccttcctctccccagcgaaaacccaaaagaaatcaaaatgcttttggtacaacattcattcggactgctcttgtcaccgtgttcaacttggtagtagtttgcaaggttgatttgaggggtactgataattggctgggagtggtggacaacaaattggtgctagttcttgttgtctctttttttgctaaggcgagactgtatggcagaggacacaggaatgagtggactcctaggtgcattggctacaaaggttgacctcaagttgtcattactcaaagatgttatggctgagtacacggagataaaacgtgtgatcaatgggttagccgaagaaaaagtgagactccaacaagagaaggagaggctccagcacgagaaggagatgcttcagcatgaagagcaatcaaatggagagactttggcagcaatgaaggaggaccttttggcatcaaaggacacattggtagcagcaagagatgcacttgtggcatcagcagaagagatttctcaaaagaactcctgcctggagtttctaaagaaaaaacttcaaga

SEQ ID NO: 3105 - DNA, 640 bp, Sorghum bicolor
  Clone ID: SORBI-28MAY03-CLUS51827_1
gcacgaggctttaattttaggcctgcacaattttggccccttctatcctgtttagtgtttactccctccgttccaatttataagttgttttggcatttctacatacatagcttttattatgtatctagacatatagtatacctaggtgcatagcaaaagctatatacctagaaaagtcaaaatgacctataatttgggacagagggtggtaatatctatataatcaacagctacatattagacagttctattctattgcattcatgtgtgtgtgcaactgtgcatactacttttggaagtttgcagagcctagcctcttatatatgtccctttatatcatagcaaacgtgtaaaatcatgatgtacatgttgctgcctctgtacaatattattttcaattgatacttctaggatcatccatcaggattcaaatatgttaatcagattttagaaacaaggttttttaaaagctgtgggggggaaatgggctatccgccaacatagtagagacagttgtccaataagatgatgagatcttgcaacattgttttcggcattctcttctctgtgcttatgaatatatatgtttggtagttctataattcaaacttagcatgtaattgtgtatggactactttga

SEQ ID NO: 3106 - DNA, 455 bp, Sorghum bicolor
  Clone ID: SORBI-28MAY03-CLUS5212_1
tagaaccctcttcccccgcgatggccgcagggagcggcggcggctcgcggcgcgcgcgtccgaacgtgctagtgacggggacgccggggacggggaagacgacgacgtgctccctccttgccgacgccgcaggcctccgtcacgtcaacatcggcgacctcgtccgcgagaagagcctccacgacggctgggacgacgacctcgagtgccatgtcatcaacgaggacctggtctgcgatgagcttgaggacgtgatggaagaaggtggtatactagtagattaccacggatgtgatttctttcctgaacgttggtttgacctcgtagttgtgctccagactgacaactcaattctgcatgatcgtctgaccggcagaggttatacgggttccaagctcacgaacaacatcgagtgcgaaatcttccaagtgcttctcgaggaggcgagggagagc

SEQ ID NO: 3107 - DNA, 462 bp, Sorghum bicolor
  Clone ID: SORBI-28MAY03-CLUS5214_1
gggaaatgtttgagaatgatttgagtgttgagctgcgcactgctgttcactggtcaaaatggcttcacgagattgagaggacgggtggtgcactaacagaagcacttcagcgaatatttccacctgattggaactcatcagaaaatttggaggcttcgagttctgtaagtgacgcagatggtgagtcttgcggtgactcagagtttagtgataatgatgaggatcatgatgttgatgacttgtgacataatatcaagacagttttaacctttctctgatccctcactactgcctcagtgccagagttaaactatcaaggctacttgcttgtggcctgccaagaggagggcctggaatctttttgtgtttttaagcctgagctgtctgtcctctgcggggtgtcaagagacgcagaccgctagtaactgttctgctggagctgatgacacacgctgtcaatgc

SEQ ID NO: 3108 - DNA, 532 bp, Sorghum bicolor
  Clone ID: SORBI-28MAY03-CLUS52143_1
ttttttgaaagggctcgtgaaacgagctccagtgcaattcctgatgatggcaacagaaatgctggcgagatgaagaagaagaaaagaaaacatgaacatgatcttgtagatacagaagctaacctaccaaaggctcccttgcagcatgggagtgagaagcaaaagccttctaagcctgctgacgaggccagtgctggtagcctgccctccatggcggcaactcaaactgtgcttggcctaccaacggtgtttggtcataaccaacaacctagctgattatttcggcatagtgttttcaggtgctgtaagaaattgtggcgtctccatgtgttcagcatcgattgtcgagactaacatgtttccgagtcgagaggatatttgactttgtaattttctagcattgcatggttcctttgcccagattatctgtgcagcgctgatagatatgatcggatgcagatttgcatccgtccaaatatcagttgtaattatgaatcgtttctattgctggtagtcgagacatgtattgttc

SEQ ID NO: 3109 - DNA, 521 bp, Sorghum bicolor
  Clone ID: SORBI-28MAY03-CLUS52158_1
tttcttggctgcaaggcccaatggcgatggttggtggagagctgtatgtgctgagtaacagctgcattatgaagcaacgtggtgagaatttccctgataagatggtgtcatgcgcatctgagttccagagcaggatcggttttgggatgattggtgtgggtgacaacatatatttggttgggggagtgattggacctgggccgagaaaccaatgcatcaagccgctatctgatgttgatatcttgaatgtcacaagtgagagaccaacctggagaccagggtcaccgatgacacattgccgagggagcatctgcggctgcgctttgttgaggatttagcctctccccagtgtgataatgtggtattccaccattgctgaagtgattggagacgtcctaagttttattttattttgttttattttattttcaagccaatgactcaatgttggactgccaatgagatatgtactatattgacatgattggtgttccaaagagcctcttatatacttcattttc

SEQ ID NO: 3110 - DNA, 189 bp, Sorghum bicolor
  Clone ID: SORBI-28MAY03-CLUS5215_1
atatgtcgcacctttaaactttgtaattcttcttatagttctcaggcaatttactgtgattgaccaatcagtttattaataggaaatcaattgctgctatgtgctagcaaactgagcaaatccagaagtgtttgctaacactgcttttttactgtacttctggatgtacattcatgggggggggggaca

SEQ ID NO: 3111 - DNA, 453 bp, Sorghum bicolor
  Clone ID: SORBI-28MAY03-CLUS5223_1
atcagcaaatgagagttctcaactatggtgttgacatagtggtcggaactccaggtcgaattattgatcttctcagaaggggtgttttaaacctttcacaaatccagtttgtggttctagatgaagctgatcagatgctggctgtgggtttcgatgaagatgttgaggtgatcatggagcagttgccgcagaaccgtcaaagtatgctgttctctgcaacaatgcctagttggataagaaagatttcgaacaagtacttaaatgatccagttataattgaccttgttggtgactcagaccagaaattacctgaaggaatctctctctattccattgcctctgataacttccggaagcaatcaattcttggtcctttgattaaagagcatgccaatggtggaaaatgcattgtgtttactcaaactaaacgggatgcagatagattggcatatg

SEQ ID NO: 3112 - DNA, 293 bp, Sorghum bicolor
  unsure (1)..(293): unsure at all n locations
  Clone ID: SORBI-28MAY03-CLUS5224_1
cggacgcgtgggttgagaagcaggagtttgggcttaagccaatgaattgtccaggccactgtctaatgtttgctaatagggttcggtcatacagagagttgcctctacgcatggctgattttggagtgcttcatagaaatgagcttagtggcgctcttacaggtttgacacgtgttgggggggggcancangacnatgctcatatcttctgcagagaaaaccaaatcaaggatgaagntaaggctgntntggacttcatcaattatgtttacgagatatttgggttcaaatat

SEQ ID NO: 3113 - DNA, 603 bp, Sorghum bicolor
  Clone ID: SORBI-28MAY03-CLUS51914_1
gcacgagggtggtggcgcggctgctgaagctggccaagatccgcaacgtgaagatctacgacgcggagcacaaggtgctggacgcgttccgtggcacggggctcaacctggtggtggccatccccaacgagttcctcaaggacatggcggccaacccggccaaggccatggactggctgaacgagaacgtgcagccgtactacccgtccacgcgcatcgtcggcatcacggtcggcaacgaggtgctgggcggcgcggacacggggctcgccgaggcgctcgtcggcgccgtgctcaacgtgcacgacgcgctcaggatgctccgtctggacgccaagatcgagctctccacgccgcactcggaggccgtcttcgccaactcgtacccgccgtccgcctgcgtcttcaaagacgacctcatggtgtacctccgcccgctgctcgacttcttctccaagaccggcgcgcccttctacgtcaacgcctacccgttcctcgcctacatgagcgacccgtcgcacatcgacatcaactacgcgctcttcaagcccaacgccggcatcgtcgaccccaagaccggcctgcactacgacaacatgttcg

SEQ ID NO: 3114 - DNA, 701 bp, Sorghum bicolor
  Clone ID: SORBI-28MAY03-CLUS51916_1
gcacgaggctcaatcccaagcctattggcaagagggttaattatggttatcggaaaggcttctctgagtctgagatcaacttgctcagggagaacaagaccctgcaagctcggatactccaatctaaaagtgacaacaaactcttccttgatatcgagaaaggagtcaacagaaggccgttatatgaaagtcatcctctatcatcattttcatggactcgaactgacagtatcgatatggggggttggtcaaagaaatgcaaggaagcattaagcaattttgagctgctgaaggaagggaagagtaaagacgacattgtttatgaaaaggctgttcagatattacctcgtgcaaaggatgaggtgcatgacattgtacaaactgcacttaagtccagtgatttgaagggtctccatgcccaatgtcttacagatatatggataggcagagagaggtttgcttttgttgatctgagtgcaggaccatttgcctggggcccttctgttggtggtgatggtgtccgtacagaacttagtctgccaaatgttgcaaagactgttggggctgttgcagaagttacagaagaagaagctgaagaaaaattgcaagacacaataagggagaggttttcgtcctttggggaggattaccatgctgttgatatcctattagcagagattgatgtgtatgaactttttgct

SEQ ID NO: 3115 - DNA, 562 bp, Sorghum bicolor
  Clone ID: SORBI-28MAY03-CLUS51928_1
gcacgaggcatctctttcatcatcatctaagagtgcacttatgacatcgataattaaagatgatgtggatgacagtaatagtgattttgttgaggaattcgccatggtatctggaagccactcttctactttggacaggctacacgcatgggagagaaaactatatgatgaaatcaaggccagtgaaaatgttagaaacgcctatgatgagaaatgtaacctcctccggcgtcaatttgcacgaggcctaaatgcgcagctgattgataagactagagctgttgtgaaggatctccattccagggtatctgttgcgattcaagctgttgatgcaatctctaaaagaattgagaagataagggatgaagaactgcagccacaacttgtcgagctaattcaagggctaatcagaatgtggaaattgatgctggaatgtcaccacaaacagttcatcacgatcacattggcataccatgtgaaaaactcaaccccagtgcatcaaggcgagcaccgccgccaggcggcaatgcatctgtgcaatgagatggacagcttctcctcc

SEQ ID NO: 3116 - DNA, 869 bp, Sorghum bicolor
  Clone ID: SORBI-28MAY03-CLUS51937_1
gcacgaggatcgacgccggcacacaacaatcgagaccccagcctccgtccgccgtagttttctctcgtccagggtcgaccccttcgtcgtcgtcctcctccgttccgctagcaccactgtggcggagcggagatccactcatccggaaagggaagcagtcctacttcaccggcaccaagcggatacgcacaaaggactacttctgctccaaggaggggctcaaggaaggggagaagctcaccgatacaaatttcaacgacccccacaccaggaccaattgcagggccatggtgcggttcagggtgaatgatcagggggagtggaaggttatccgactggtgcccgagcataaccacaaccttgcaaagcctgaggaacgacaccttttgcgttctgcaaggtcacttatagcagggcggtcgagttctgtggaggcgatgttgtatgggggttatcaggtgcaaccacaattgcctgcagggagtactagtgcaaccaacaatgtggagaatccgaagcaagatttgctccttggctatggtgctacagcaaagacgctgactgtagggactgcggacgtgcagagccttgtgagtcacctgaaaagcagggcaaatgaagatggcatgttctactgggatgttcaattggaccgaggtggtcggatgactaatttcttttggcgtgatgggaggagcaggaccgactatgactgtttcggtgatgtggtcgtgtttgattcaacttatcgcttgagcaaacagaacctggtatttgcaccttttgttggtgtcaaccatcattggcagaccactatgtatggctgcgcgctcttagctgacgactctacttcatcttttgtgtggctg

SEQ ID NO: 3117 - DNA, 431 bp, Sorghum bicolor
  Clone ID: SORBI-28MAY03-CLUS52292_1
gcacgaggctcctctcctctgctcctctcctctcctctcccgggaagggaaccccggccgctactccgatttgcaccgccacccgcgcaatctcgggatcccagccgtccgcacctcgccgcggccacgaatggtggcctctgcctattgtcttcttccaagcacctaacccaacccaaggcggtcggtagggtaggtgccaggtaaactctgaaggcgaccaccgggaccgggcggcgatggcgaccgccgcgagggacaggcgcctgccgccggcgctgcccctggccacgctcatcggccgcgagctccgcgcgggtggctccgagcgcccggcgctgcgctatggccacgccggcttcgccaagcgcggcgaggattacttcctcgtcaagcccgactgcctccgcgtccccggggaccccgcatcc

SEQ ID NO: 3118 - DNA, 462 bp, Sorghum bicolor
  Clone ID: SORBI-28MAY03-CLUS52297_1
gcacgagggccacccgtcgggcacgcagacgcagcctcctcggaacctcggcatgttctctccgcagacggggcagctggcgacggtgccgccgaagcagcggacgccggaggccatcgcgcgcgccgtggaggccatgagccaggtccccgacgcggcgctccgtggcgggttcatcctggagaaagtgctgggaccgcagtccacgggccacctggtgctccgcaacctgaacccggacgacaacccctcggtgcggttcaactacttcgcgcacccggacgacctccgccgctgcgtggccggcatctccgccatcgagcgcgtgatccgctccagggccttctcgcgcttcacctaccccaacttcgcgttcccggccgcgctcaacgtcacgggcgagttccccgtcaacacgctgtaccggcgcggcggcggcgaccccagggcgctggagcagtt

SEQ ID NO: 3119 - DNA, 421 bp, Sorghum bicolor
  Clone ID: SORBI-28MAY03-CLUS52327_1
gttttctccatcatgtctaattggatcaggatcttttagttgtgcttatattcatggctccatgctattctgtttcagttttctctgcttgcccattcccgatttttgcgttcgttcccttccacctttctacttcgcatcgctccttgtccgttgcagggttcgctctgcgtatgcatcgctgctacagcggtttgagcttgccttgcctggtctccctggtcctgtgccgaggggcgcttcagtcttgcctccctgatacactattgtttcattccctaacatggggacagtgtctttggtggatgacaggctcgattctgctatggttgcaagacacatacctaaacatatagttgcaaatatttgtgaccatgtcagtaatatgtgtgaggaaatcataataaattgtcactgattt

SEQ ID NO: 3120 - DNA, 598 bp, Sorghum bicolor
  Clone ID: SORBI-28MAY03-CLUS52363_1
gcacgagggttccggtgcgtcttcgtgctcctgctcgcggcgggggtgctcgtcccggcgctgttcctgctcgtgccctcgcgccaccgcgcggggtacctctcggatgaccacgacgtgctcgctgctgaaatcaaagttggtttcactttggaaaagccagtgtcattccttacttctcacatagacaaactagggaatgacatatttgaagagattggtgtacctaatagcaaggtttccattgtttcaatgcatcctttaacttctaaatactccacaaatgttgtttttggtgttcttccttatccaaaagatgcttcaataagtttgccggctctaagtgtgttgagatcatccttaatagagatgatgctccagcaggtgaacctgtctttgacaccttcactttttgggcatccatcttctttcgagctgttgggattccctggaggaattacagtcattcctgcacagtctggttttacatgggcgaacacagaccccctattcaactttgtgttgaacagctccatttatcagattttgggtaatcttacagagctcaaggatcagctgaaacttggattgaacttaa

SEQ ID NO: 3121 - DNA, 468 bp, Sorghum bicolor
  Clone ID: SORBI-28MAY03-CLUS52359_1
gcacgaggcttctctggtgcccggccccggctgttcctgctcgcggctcgggaagccctcctccccccacccatcatccatccaatgcgcggcgatcgttggcgcgccggccgctctccgccaccgtccccgcgggcaacctcctcggcatccatctcttccagtgccccgacgccgttggcatcgtcgccaagctctcggaatgcatcgcctcccgcggcggcaacatccacagcgtcgacgtcttcgtccccgacgacaagcccgtcttctactcccgcagtgagttcacctacaacccaaggctctggccgcgccatgagctccacaacgatttcctcaatctctcccgctgcttcaatgcacacacatccaccgtacgagtacccgaccttgaccccaaatacaacatctccatcctcgcatcaaagcaggaccactgcttgttcgatttgctccatagatggc

SEQ ID NO: 3122 - DNA, 182 bp, Sorghum bicolor
  Clone ID: SORBI-28MAY03-CLUS5238_1
ggtcgagaagaccgtccagtacctggggggggggggcatggaccccggaacggagaacaacccgtacctgggcttcgtgtacacgagtttccaggagcgcgcgacggccgtctcgcacggaaacaccgcgcggctggccagggcgcacggggacgacgtcctggcgcgcacctggggggggg

SEQ ID NO: 3123 - DNA, 628 bp, Sorghum bicolor
  Clone ID: SORBI-28MAY03-CLUS52098_1
ggcagaagcttaatgaagatagatcactctggaaacttggtactctccctccgggtttgatcacattctggaacaagacatttcccctcagccgatcatggcatgttcttggtctaggttacaatcctcatgtaaacagcagggacattgagcgtgccgcggtcatacattacaatggcaacatgaagccctggctagagattggcctgcccaagtaccggagctactggtccaagtatctggattatgaccaatctttcctgcgggaatgcaacattaatccatgaaggaacctggtccttctaatcccttctgacataaccaatagcttgttttctgtcgatgtgccctttagtgtagtcagcatagtattcaatttgattcttgctttatatttcagttgttaacatgatctcttattgcctgtgcttcttgttggacccctttgcataattgcagatatagctgtaatgtttttagagtagatgctttggagcatggaaaaatttagatagtgcaaatgctcttaggtgatatcgcctttttgtactgaatgtttgctgcaaacttggtgatctgaaatttggaagtagacttacccaacaatttaataggcattcaactggtt

SEQ ID NO: 3124 - DNA, 429 bp, Sorghum bicolor
  Clone ID: SORBI-28MAY03-CLUS5210_1
cggacgcgtgggtcctgaatgacttttttcttgtcttgcgtgaacgatgcgaagcattgcaattgtcgaatacggcattagaagatcagtctttgtcaaaaacttcgtgtgcaatcaacgccgctcgttactgcgagaatgttcttcgggaatgggatgaagatactaccttcttggatatgggtcctcatggatctctgtttacagatgaaatcagctttttagttaaattagggaccaattacctggaacagatactgtcttcggttctgcttgagtttgaagatctgtcctgggaatatgtccagaacattggatcatggagtggacagaccatcttagatgatcagaccttggatgaagaaaatgcaggagtatcttctgggtttggtgccagtctagaatgtctgacagacaggaccactaagt

SEQ ID NO: 3125 - DNA, 601 bp, Sorghum bicolor
  Clone ID: SORBI-28MAY03-CLUS52112_1
ccacaagataatcatgtacggcgttttctccagaggcatggaatcccataccactacttacccactgcacctggcaacaaaagagagcaagagatcttggaattgatccagggtacagattttgttgtgctggcaagatacatgcagatactctcagaaagcttcttaaaagcatatggtaaagacattatcaatattcatcatggccttcttccctcatttaagggagggagtccttcaagacaggccttcaatgctggggtgaagttaatcggggcaactagccatttcgtcactcaggaacttgatgctgggccaatcattgaacagatggttgaacgagtttctcaccgagacacgttacagagttttgttgtcaagtctgagaaccttgagaagcagtgcctagcagaggctatcaagtcatactgcgagcttcgtgtcctaccatatgaactgaagaagactgtcgtgttctgagctccctttatttttctgtcttatactcttgtggattggtgtgtgtatattttttttccctcacagaacaagtgatagatgattcactttttgatatatctcagcaatcgcttcctagctc

SEQ ID NO: 3126 - DNA, 590 bp, Sorghum bicolor
  Clone ID: SORBI-28MAY03-CLUS52115_1
tcatgttccaaaagcagtatctggacccacttctcaaatgatgccaaaaccttcaccccgacgaccagtgtctcaacattcgatgcccccaaggaaaaaatggaatagcagaacatcagagtcctcttcaattgcgccatcaccatatgctctccttcactacttgaagttatgcttgattggatacctgggttgcttcgactgttggtcatgcgtcatcaggaaaatctagccagaagacaaggtcacagttttgcttcaagcataaccatgaatcgcaatcatgggctatgatgcaagcatcaggttttgtttattggctactgtaactatatggtaaattctaaagcttttgaggtcaggttaactgtagatataggtctatatcatgctaattaaccagggtattacgccacgaaggtggctgccctacgccctatgcctctatcaaattttaagttctcaccgaagggtcgggagcttatatagaggagaatgtaaggactctgttacttgggtccacgttctgcaatattactttcttgtaacgtattgaccatataaatccataatacaacatacaacttctc

SEQ ID NO: 3127 - DNA, 532 bp, Sorghum bicolor
  unsure (1)..(532): unsure at all n locations
  Clone ID: SORBI-28MAY03-CLUS52460_1
gcacgaggccggctcttccggcacgagaagcaccccacctgggtggacctcgtggtccggagccccggcggcggacccgacttcgtcggccggagctatgccggtgaggctgctgtgcctcagatctgtgagtatgcgctcggcgtccttgacaaggcatccggcaccctcagggtcgttcccatcaccgccaagaagattctgaggctagagccacatcatgaagtacagcgtccagcacattcgcagcactctgaggtggcatcagaagcggcttcagctgctggaaatgatgaattgaaggttcaagatctgaccatgatgtatggagccaagatggacagggacaaggacaataagtggagatcattaaatgaacaaaggaatgatccttctgcttttgaggacattgaccttggaggatcagagactgctgccaacatcattgatagtcaggaaccagtacttactcggaacattccaccttatgatcctaccgcagatacatcagaaaaggcatatctnttggatg

SEQ ID NO: 3128 - DNA, 495 bp, Sorghum bicolor
  Clone ID: SORBI-28MAY03-CLUS5247_1
ccaagactgatctcgatgatgaacaagaaattgaaattgtttttgatgaggaatcaggttcagatgataaacttcctttccctcaaccagatgatagtctccaatcaccacctgtcattattggggaaaattctcctggccctgtcattgagacagaaaatcaggagaatgaaagaattcccttttcccagagggccacatcactcccaaaggatgatgaaagtcctagcgttgacatttcttcccagactgcaatgctttcagaacctaacaattctttggaactgaaatattcagtttctagcccagggaagaattcttttcatgatcatgctgaaaagtctaattatccttctattggtgtgtctgggagatcatctgtacaagcagatcatcaacatttatctcgtagacatgaaaagagaagtccacgaaaatattctgagacttctctatcaagtggatcccatgggcatgagcatagacattccaata

SEQ ID NO: 3129 - DNA, 583 bp, Sorghum bicolor
  Clone ID: SORBI-28MAY03-CLUS52483_1
gcacgaggcggaatcaccgctagctaagaagccatggcgatgatggacaagtggacaggcctgggatctgcgctggcaagcttcttcttcctctggtccatggtgcagaaccacatccccgtcgccttccgctaccgcctcagcacctggggatccaagctcgtctctttcttcagcccctgccgggcgcgcaccctcagcgcgtccgcccccggggccgcccgccgcagcgacgtcggccccgccgccgtggcccccctctccgacgcctgcgcacgccgcgcgcgcaagctcagggctgagctcggcaagaacagcaagaacctccaggtctccgtcgacgacaacgacgaggtcaccgacgtcttcgccggggccaccatctggtggtacgcctgcaagcagatggccgggtcccaagtcatcagctggtaccccggcgaggaagtgcgccgcttctaccgggtcgtcttccaccgtcgccaccgcgaccttgtcttcgacaggtacctgccctacgtcctcgaggaaggccgcgccgtcaccgtccgcaaccgccagcgccgcctcttcaccaacaacc

SEQ ID NO: 3130 - DNA, 391 bp, Sorghum bicolor
  Clone ID: SORBI-28MAY03-CLUS52501_1
gcacgaggcacattcgctcgctctaccccgcaagtcgaggccttccgctggctctcgctcgctccgcgaccggttgcctctccgccccgccgcccctgccctgcgaccggaggccaccgctccccgcggcggcgctgccacccggcgctacgatcagtgtgactgaaaagggaggaattcaagtcagttctttatgaatcctgaggcctgtgcttagtagagggagggcaaggcaagctgggatccgaaatgagggggagaaatggctcggggcacagcaagaggccggttgtgctgtgctgtgtgatgattgtgtgcctatgcctcctcttcttgtatttctcgggctccaaaggacaggctgggaccactgcatttgagtacgggacca

SEQ ID NO: 3131 - DNA, 509 bp, Sorghum bicolor
  Clone ID: SORBI-28MAY03-CLUS52504_1
cacgaggggaccaccgctgatataactcctctcccgatcctcccctccatggactccgcttgatcacaagaggtagcggccgcggattgctagctaggaacttggtgtccgtgctccatttgatcgtggaacaacacctacaacgcgctgtgactttccatttgcttgatctcccaatgctgcaaaggaacctaccgaatctctgcctccagataagcccgccagcggcctcgtcggccgtcgttgcatccgacgcaccggtggcggcgtcggcgaagcctccgccgacacaaccaataagcacggcgacgtacgctgaaggaagcggcgaggtagggttctttgcaaaccctagccccggcgcggagcccccggggcttagccttgggctcgccacgccggcgcttggcgacaacgcggccggacggcgaggccaccacctccagccgcagggatgcgcgttcaagcgcgcggccgccagggcttccctgcctgccgccggatcgaag

SEQ ID NO: 3132 - DNA, 331 bp, Sorghum bicolor
  Clone ID: SORBI-28MAY03-CLUS52242_1
ctctcaagatgagttagtttgatgttgctgtggacaatcgatctgatggtacctgcccaattgctagacaagtagaggctgtgattggtgccaactggttgcaggtgacatatattaaaatcgagttttctcctgagatgccggcaacggtggacggaagcctcatcggaggggaggcagagtgagagtgtgagatagagtgagtgtggttgggatcagaatggggtggataaagttgcttttctagcttttatttttttattgaggcctctattcatcttaataatgatcagcgggtcaatgtagagattagataatagtctaaagacat

SEQ ID NO: 3133 - DNA, 793 bp, Sorghum bicolor
  unsure (1)..(793): unsure at all n locations
  Clone ID: SORBI-28MAY03-CLUS52251_1
gcacgaggagtcactcccgactctccgaccggctcgcgagctaaccccgcggagtccccgacacagccgagcctcctcctcatccgtcgtcaccggttgctgcttcccgccgccgccttgcgcctccatgctctctcagcaatgatgggaacagaaggcattgcagccacagtcatcgaggaccctgaaccctcaattccgcctggatttggacctttcgctgccccggcatcatggggaatccaaaatgatgttaaacccgctgatgctcattcgagttctgttttagcattacagagcatcgacgacgatgtggaaattttggaatgtctatccagttcagtggatcgccagagtgacacaggttgcagtatttctgggagcaatacctgtaggaaatcactgcgcaatagacctccaatagattatagtcgctttgatcagattgcatatgaagattctgatgctgaagtagcagacaagggtgcaagttcagtgaaacatagacaacaattccctaaaggagtacttcgaggatgtccagaatgtgccgattgtcaaaaggttattgcaagatggaatccatctggtgcacgtaggcctgttcttgatgaggctcctgtttactatcctacagaggaggaattccaggacaccttanaatacattgagagtatccgcccaacggcggaaccatatggaatatgccgtattgttccaccagcttcatggaagcctccatgccttcttaaagagaaaagcatttgggaatgctcaaaattttctactcggg

SEQ ID NO: 3134 - DNA, 385 bp, Sorghum bicolor
  Clone ID: SORBI-28MAY03-CLUS52276_1
gcacgaggtgaagcctaggcatattgctgcatgcgcttcttccctctgcaactcataaccttgcacaacaatgggctccttatggagcttaattcattcctatccagatgtctgcatagccgcccgcggcttcttcgggctttccatttttcgcttcatccagcagatccagaagagctgcatccctctgaactggcctgttgttgggatgctccccttcatcgtagtgagtaggcactgcattcatgacaaggtcatgggtctgctacgcgaggcagggtgcacattcttcttctttggcccatggttgctggacatgaacttcctgatcacctgtgatccagccacagtcaaccactgtctcaatacccacttcgagaagtac

SEQ ID NO: 3135 - DNA, 678 bp, Sorghum bicolor
  Clone ID: SORBI-28MAY03-CLUS52272_1
gcacgaggatagagaagagtacaaaatcaactagtattgttgattgcattttagggtaagctaaacatgtataactgtttggtggcgcctcccagctttagttgcttttctttgctatattttatacttcctttttcccattaaaaatgttgattcattgatgttcactaagttatttaagaaagcacaaagtagcacctgagtttgtaggataatgtctctttttttgtctactgcagaactggatgttaagtctagatagcaacttttcttgcctattcggttttgattatttacatctagcattctaatttccctttcaagccaaatttatgtttttcttttttgcaggaaagaaaccttcttgtgtggatggatgcttttagttgattaccacagatgtacatgtcgccgtggcctacctctaaactattagaatcctgatatcctccattacatgtgctataatagattgttatagaattatttatggtatcctactatcttctacccataatcttggtttcaagggtgactaggcgtccaggcgagatctaggtgtgcgcctaggcgataaggcaccactgttccccagcgagctaggttcgccctggacgcctagacgttgcctttgaaacagggctcataatacttttccttttgttttgtttcaagcta

SEQ ID NO: 3136 - DNA, 571 bp, Sorghum bicolor
  Clone ID: SORBI-28MAY03-CLUS52568_1
gcacgaggtaactccggtgctgaatctgtaacttcagcatatgagagcagctctgtttatgattcggagagtgaaggtgctgacctatcagacagagatacttttgaatcccatcaggatcaagaagataaccaggatgctccactggtacagatatatgatgctagtatacagcaaggccagacaggtcaaaatactgaggaaaatttggcagatctcatctctactgatttgactgagttgatgtctaagtcagccttggaatcatggcttgatgaggctcctcctgagccagttgttcagaatttgacacagacatcatctgccagagtttcttttacaaacctcaactttgagcgaaaacctaaattacacacattgttagactcatctggcagtaatggcttaagtgctctatatgccttctcgtctgaggtttcacccagatcacgcttgctagtatgtgtggacttatattttgagaatgtcactacacaacagctaacagatataaccattgaagctgaagaggcttctagcagtgtggattctatagaccagacatcagaag

SEQ ID NO: 3137 - DNA, 866 bp, Sorghum bicolor
  Clone ID: SORBI-28MAY03-CLUS52596_1
gcacgagggtggaaacggctcggtgaaagcccaagtttggttttggtaattaatgacaccaagttgctaatgccttgtgtttaagtgatttgagttaggcatagcaacacatgtgataaaggtgcatggtggcatggaaaggtggccacacgatcacaaagggatgaagcatgaagtggagatcatggtgatagacgaggagcaaagttatcaaggcaaaggtataaacatagggttttacttttgccggtctaaaatgagtagagaagtgattgaccgggtttagaatagatagccgactatcaagaggggaaatcacggttatctctcgaatcaagtgctactaggtcccatcttgagcatatgcattaggatcgagtaaagtgctaacttaactcctttggtaaaaatgtttgtgagcacctggcacacttgcactttggtggtggacacttgttggtgttagcacactttgcaaaggaggtggagttcctagggttgagaggggattcagtgcttttgagaaaattaagtgtatattttctattgcgctggtgagaaattttggagaagtcacggacgcactgtgcggaggcaccggaagctggcctttagcgtccggtgtactgtcgggtgtagcagagtgcactggacgcaccggagtgagtctggtgttcagcgtccggtgtgcgggcgttttgcgaacctctctgggtatgagtccgatgagcaccggacggtctggtgctcagcgtccggtgaccccaaaagtttgcatacctccttgagttttagtccggtgtggacctaccgagtgttcagtgttttgcaggtagccgttagagactgacatgcgagattcaaga

SEQ ID NO: 3138 - DNA, 604 bp, Sorghum bicolor
  Clone ID: SORBI-28MAY03-CLUS52597_1
gcacgaggagagactgtatgtgtgtgtgacagtgacaggtgggagaggaggcgccagacgcgagaggcttcccgaggtctccgccgggcgccggcacaagtccacccaccggcactttcactgggagttggagattcttgcgtggatctcccagggatctgctgcccatccatatattaggctgcaacagttcagtaggcggaggaaggcgcatcacacgaacaaggtggaaggaaccggacggagcttggacaaggacaaggcgaccgggcaaggggagtggtggactggtggttatcggtttctccgttaaccactctgtccgatccgccggtgtgtccgaagtccgaccgatcctcccgtgcgcgaccctgtcgacgaatcaatcgctgggacgattagttaagcattccaatcctcagccatggccgtggacactacccaaccggagtactggctcaactggaggttcttgctgtgtgcgctctgggtctactcctgcatggccttggcgttcttcttgatttggaagtatgagggggcccgttcactggacagcagtggtgataatggcgaggacagagaagaggcattgccacaggtc

SEQ ID NO: 3139 - DNA, 788 bp, Sorghum bicolor
  Clone ID: SORBI-28MAY03-CLUS52609_1
gcacgaggatcgccggggaagaagacaaggtgtaccgcctgcacaaggctttgtacggtctgcgccaggcgcctcgggcttggaacgagaagctggacgcaacactcaaggagatgggattccagcagagctctcacgaggctaccatgtaccggcggagcagcgggcgggcaatcctgctcgttggcgtctatgtcgacgacctgatcatcaccggcaccgacgagaaggaagtggcgccgggcaaggctcagatgatgaaggcaattgagatgagcgacctcgggctgctgagcttctacatcggtgtcgaagtccgccagtcagcttctggagtcaatctccggcaaacacactacgccgagaggataatggagcttggaggcatggagggctgcaatcctgcagcaactcgcatggaagaaagactgaagctcagccgtttcagcactgccgaagcagtggatcctacccactaccggcggttgattggcagtctgcgctatcaggttcacaccaggccagacattgccttcaccgtctgcttcgtcagcagattcatggagaagcccaccatggagcacctcgcagctgtgaagcgcatcctgaggtatctcgccgggacgctggactacaggttgcagttcaccagagaccccgacagcgctcgcttcgtcggctactgcgacagtgaccttggtggtgacattgatacaagcaagagcaccactggagttctcttcttggtcagtgtctggtgtcctggcagtccatcaagcagaaagtag

SEQ ID NO: 3140 - DNA, 680 bp, Sorghum bicolor
  Clone ID: SORBI-28MAY03-CLUS52612_1
gcacgaggctgacgccgccggtggaggtgccggcgctgcgtgccctcctgcggacgagctcactgctgttcctggccgaggcgtcgcggacgagctcactgctgttcctggccgaggcgtcggaggttgggaggcagcaggggctggctggatggggttcctcccgggatggcgtggaacacgcggcgaggctgccggcgagtgggagcccttcctctgcctcggtaggtgatgggcagagattgcaaggtgtgtgcggcttctctctgtggggtttatactagctttagtattttgctacccttgataattaatttggcttttagataccatgcttagcagtgccgattgtgatcgctttcgtaaacggtggtagttgtgaattattttgcaaaactgtgttaagtagctagcataatattttatttgcatagaactctgttgattcagtcattctgttataggtgtatttcttcatcaaatatctctgagaaaagatcagtagtaacctgtgtgatgttacagtttgaagtttagtatttgatatttccatgaatacttagtgtatgtaaagaagcaatactgtatctcaagtactttcaaaacatagttagatccattaccatagtcaaatacatgttcttctgttcacatgagcactggattgctaccatgccctt

SEQ ID NO: 3141 - DNA, 570 bp, Sorghum bicolor
  Clone ID: SORBI-28MAY03-CLUS52615_1
gcacgaggggcaactggaagatatgctatgggctcaaatgaacctttgggtgtccctactgatattggtcaggattagagtaacctcactgatgatgtcaagactgaggcgcagtctggcaaggctaatgatgtgccagctgaagcctgtaagggcacggatgatggccctgggaagggaaagagaggaaaaaaggaaggtagggcaagatgagcttgacatcatgaatggcatggtgaaggctgtggaaaatgttggggcagctctcaaagctccacaacacaatgaagtacataaggacctatatggttgtgtcatgaactgtcctggttactctcaggaggctcttatggtagctctggtttatcttctgaggaacaaggctgaggggctttgctttgttcagatgtcagaggcacatatgatcctttggcttaggggccacctgagcaactccatgggaccttagatgaccatcttcttgcctctccacttttgcaaatcaccatgctaactgtctaatgctataggatgtattttgcagtacagcactgcaacactaatggtgct

SEQ ID NO: 3142 - DNA, 603 bp, Sorghum bicolor
  Clone ID: SORBI-28MAY03-CLUS52389_1
gcacgaggataatttgaaaactaagcacgatgggtattttgttaacaaggggaagctggaacagattgaacctggcacatcagcaaatgttgctccaaagaaaaggagaagaaaggatgcatcaaatacttatctggaaactaatcaccttgctccagttgattatttcaatattggcgatgtacctggaaaatcctctgcaagaggtactgtgcaggcaggaaaacaattagctagtagcaacataggttcttatggtcaataccacgaggacaatagagtggtgaagaacaaaaccagtggtcctggaggagcccctaaaagaaaatcttctgaattctcgggtggtgatgctgcagcacgtgctaagattattaaggatgtctcacatcctcctttggagctcagagacttggaaaaacataaagctgcagcactacctgttgactatgcacataagtcaaagaccagtgagacatttgattatgcttatcaagtttacagggataaaggcacttcagtgcaacttgatttccaacaaagaaaggtaagcggagaaaatcaagatccatcaaataaagtctaccgcaaagagagacatgg

SEQ ID NO: 3143 - DNA, 777 bp, Sorghum bicolor
  Clone ID: SORBI-28MAY03-CLUS52437_1
gcacgaggcagtcattcccagggagagagaggaggcatttcattcgaaatctctcgcctccccctcgagctcctccacctcacctcgccgccagccgccggtgccgcagcccgcaccgggcaagatcagggcggcggagcctgcccatttcgcaccccgctgatccgctcccccgaggactacaaaattccaagatcctgatgatggccacaactgcttatattgatgattcctgttcggaggttattgatcccccaaagactgaggcactggatgttgttgagctccctggtgaccatactcagcacccaccaaaaccaaatgtggtggtgtctagcagtgtgcgtgaacttctggaatgtccagtctgcttgagtgccatgtatcctcctattcatcagtgctctaatggtcataccttgtgttctggatgcaaaccaagggttcataatcgttgtccaacttgtaggcatgaactgggtaatataaggtgccttgctctcgagaaggtggctgcatctcttgaagttccatgcaagtaccagagctttgggtgctcaggcatttatccttactacagcaagctgaagcatgagtcacagtgccaatataggccttatagttgtccatatgctggatctgaatgcacagttgttggtgacattccatatttggtaaatcacttgaaagatgaccacaaagttgacatgcacaatggctgtaccttcaaccatcgctatgtaaagccaaaccctcatgaagttgagaatgccacct

SEQ ID NO: 3144 - DNA, 771 bp, Sorghum bicolor
  Clone ID: SORBI-28MAY03-CLUS52439_1
gcacgaggcctacgtcttcaaaagttcttggaatcaccgactgcaacttgttggcgtgctcttgtgggtgcagttcgctccaccacctttttgtctgcctttgtcactatattccaggctgctatatgtttgcaccgaaaagttgcgaacaaagaccacaaacttgtatattggtttgctggtttgatgtcgggtctttcaattcttttggaaaagaaagctagaagggctgagctagccctctatgtgcttccccgtgctggagattctctatggtatatattgatcaatcgccacctgctcccaaatattaaaaatgctgaggtggctctcttctgcatgtgcatgggaggaatcatgtattttctggagtacgagccagacacaatggctccattcctcagaggggctcatcaggcgcttcctggcaagcaaaatcagcaaatccaagccctccgcctcccgatcgcaacgcttcctactcataccttcagacgctgaatgctctggagcaatcaagaccccagccaggggtggataacggactgacgacatcggagaaatataaccttgaatcaattcctggactttagagagctcatctgtggtagtagtaattgggtcttgtagcttgggaaaatcagtaaaactcaacacccattacgtgtgccatcctgtgttattgtggtacgattgggtttatactctgatacgtgtgtgttttgagatcagttgcaaaataaatgaataagcaagaggtggttgtgcggg

SEQ ID NO: 3145 - DNA, 183 bp, Sorghum bicolor
  Clone ID: SORBI-28MAY03-CLUS5244_1
gttttattgcattattccatattccttagtttattggtgaaggtgggttctcaagaagagttagctttcttctttattataacagtaatgcttttgcgtgcctcatcacaggtactttgctcacagaagttgaattttgcaatctgttttctttgtttgccatatgacacataaggggggggg

SEQ ID NO: 3146 - DNA, 625 bp, Sorghum bicolor
  Clone ID: SORBI-28MAY03-CLUS52442_1
cagccgtccccctgcccgcctccgcctccgactccgactccccgcaagtgatctccttcctccaccttcgccggccgttgccactggccgggtgatcttcattcttccactcccaccatggccgccgccgccaccgccaccgccaccgccgtctcttcctccactttccccctcctcctcctcctaccgctcctgctctgctcctgctcgcacctcaccctcgcctcggcagaagaggcggcgccggcggcggcggcggcggagctcctcggcgaggcgcgcgcgccggggttcgcggagtggctgcgcggcgtgcggcggcgcatccacgagcggcccgagctggccttccaggagcaccggaccagcgagctcgtgcgggccgagctcgacgccatcggcgtcccctacacgtggcccgtcgcccagaccggcgtcgtggccaccatcgtcggcgccgccgccgccgacggccccgtcgtcgcgctccgggccgacatggacgcgctccccgtgcaggaattggtggattgggaacacaagagccaggaaagtgggaaaatgcatgcttgcggacatgatgcacacacaacaatgcttctgggggctgctaggatacttcaag

SEQ ID NO: 3147 - DNA, 580 bp, Sorghum bicolor
  Clone ID: SORBI-28MAY03-CLUS52819_1
taaacggtactagcaaggttgactcagtgtcagaggctgtcagtgaaaacaaaacattgtcagctagtggcggcagtgcagcccgtgaaggtctaaaccctgaggaactctcatcattaccaagatcgcttctgtgatcaactctcttcagttggtgttcatgaaacgttctctggacagccgacagcaagcctaaagggaaaaataaagtgtatcgttgcacttgtgccagaactggtgctcattaccgtgtaccagggatggcttgattggcatcatatttgtttggatttctgcaggtgatcatgttactgacatgtaggaagccccaaccccacaaaaaaaaaaaggtataggaatggcctagtccctggtggctactgcgcccatttgggtcaatttgtattctattggtagaggccaatgaaactgtaattcttgccattaataacttgtacaggaatgtagccttttgcagttttgatcccatctcttgcactcggtggcgaactgatgtattgccattcttggacagcgaactaaaataaaataataaataatggaactatgtttatcatgt

SEQ ID NO: 3148 - DNA, 647 bp, Sorghum bicolor
  Clone ID: SORBI-28MAY03-CLUS52827_1
caaggggatgaaagaggcccactttgggaggcctggactcgcgcaatggatgctgttcatgttgatgatatggactctgcttatgctgaggttctttcaactggtgatgctgaattacttgtaaagttgatggagcaaactggaccagttgttgatcaactttcaaatgaggttgcaaatgaagtcctacatgctgtggggcaggccctcctggttgattgcttcgctcacggtgcttggggctgccgtcggcagttgactgatctggtaatggaaaacggctctgattatctcggaatacctctagatgcaaagcaggacctcttacttggacttcatgaggctacagcgattgagctgcctgatgactgggagggagcgacacccatgcagataatgaagcagctagcttcgtcctggcgcatcgacctgcagcaacttatcaattagggttacattgattgtcgacatatgggttaatttcatttgttcattaccccttgttcttgtctggcctgtttctattagtgttaggaatattatattgggtggagtggaagtggcactgtgttgaaatggattggttgtattgggaaatatgatgttgatattgtctcaccttcattgaaagtctttcataattcata

SEQ ID NO: 3149 - DNA, 937 bp, Sorghum bicolor
  Clone ID: SORBI-28MAY03-CLUS52839_1
tttatggatgctatcagtatgtttccagtaccggtggagatacatatgatctggtaagatctggtgcagatcatggcacatatatgacagctccaacagcagaaagtgcatatgaccctacaatcaaaatttcttattacactaaagcaaacaatggtcgagcaggattttggggttatatgttccagatcttgtttcagacaaatgcaggtgctgtgatgattacagatttggtgttctggtttattttgtaccctttccttgcccacaatcagtatgagatgaattttattctgattgggacacattcaatcaatgttgtcttcatagttggtgatgctgctctaaacaaactgcatttcccgtggtttaggatagcatactttctgctgtggacaggcatttttgttaatgttcagtggatcatccatgctaacgtgtcaacctggtggccttacccatttttagacttggcattccctggtgcacctgtatggtacctggtggtggcagtgctgcacttcccatgctacgctctattcaccctggtgctgaggctcaagcatatgttgttggaaagttggttccctcaaacttatgtgaagtaatcaaggaggacagtattcgttatcaaaaagaaagaaaaaaggaggacagtagtcgtagttggttgtccttatacgttaccttcagcaagattaagcggagattctgcaaactgtctgcacacccgaaatcacattgttcagaaatagatcacaccggcctgtcgacagatttctctgaaagtgggcatgtaaattgacagagcatgttccaaaaattttgagatcagcagcttatttcaaccagctgctgtcaccaggcattgcaaccatatgtttatcccccaatggagaatatgtgtacagtccactaaatatatccaattatttcc

SEQ ID NO: 3150 - DNA, 768 bp, Sorghum bicolor
  Clone ID: SORBI-28MAY03-CLUS53000_1
gcacgaggctcaagatcagggtctgatagaagtgcttactctcctggcacaactacagatgttcttgtaccaaagcccctagagtcaaatgtaatgctcgatgtgagttatgtggcttgtggtgtgaaacatgctgcccttgttacaagacagtctgaggtatttacgtggggagaagaatgcagcgggcgtctcggtcatggcactggaacaaatgttttccagccacgtcttgttgagtcattatcgatctgcaatgttgaactaattgcctgtggtgaattccatacttgtgctgtcactgcaactggtgatctctacacttggggagatggcacacacaatgcacgattgcttggtcatggtagtaatgtgagccactggatcccgaaaagagtctcaggtccactggatggtcttccggtatcaactgtatcttgcggcacatggcatacggccttgataactagttctgggcagttatacacatttggtgatggcacatttggagtcttaggtcatggaaatcgagcatcatgctcatatccaaaggaagtggaatctttgaagggtttaaggacaatttctgtttcgtgtggtgtgtggcatactgctgctgttgttgaggttatcatttcacagtcaaatgcttcatctggaaagttgttcacttggggcgatggagacaaatatcgcctggggcatggtgataggtcttcaaaactgaaaccaacctgcatcccttcgttaatagattacaactttcat

SEQ ID NO: 3151 - DNA, 613 bp, Sorghum bicolor
  Clone ID: SORBI-28MAY03-CLUS53025_1
agagagagagagagaggggcgaggagaagcgcggcggagaacagcaccggatggagccctcgccagcggcgggagagctgggcgcgatgcttcgggcggccgctgacttcgcgtcctacccagggttgcatagtgatgatactgtgaggcagttcctggaacgatgtcctctgcctaagctcttaggtgcattgcagagtgaagcagatgtacctgggatggttgaaactgtcacagagtgtttagacaaaatattttcctcaagatatggagcgtcacttctgccaagctacggtgcatttattcaagctggattgctcacagactcgaagcaaatcagaaaattagcctgcaaagctgtactccatcttcttgacaaggctgaagatggtgctgctgtggagacagttgtgcagcacaatctgtttcctcttatgatcaattgcttgattgagggagatgaagagatttcagcaatcattttggacactgtaaagcgtttagcacaaattcctaaaggagccgaagtcatattcccaccagatggtcaaggatctgtccaacttggtaaagtggcggctcagtcatcctcattgccacggattcgtattct

SEQ ID NO: 3152 - DNA, 498 bp, Sorghum bicolor
  Clone ID: SORBI-28MAY03-CLUS53003_1
ttgccaagtacaaacacgatgtggatgaagtgaaccaacgcactggtggccgcgaggatggtatcgagtttgatggcacggatctcattggcaacaccaagcacctcatgaatgccgtgaactcgctcccagagctcacagaacgcaagaagatgattgacaagcacacaaatatcgcaacagtgttgcttgggcacatcaaggagagatcgctggatggatactgcgactgcgagaacgacatgctcacgaagggcaccgtggacaggagtgcgctgttgggcctcctccgagggaagggcaccaaggaggacaagctccgtctggctgtgacctacctcctctcttttgagactcctgttgcgtccgagctggagcaggtcgaggcggcgctgcgtgaggcagaagtggacatgtctgcgtttcagtatgtcaagagagtaaagtcactgaatacacagtttagtgcctcgtcaaacacagccaccaggagtaaca

SEQ ID NO: 3153 - DNA, 789 bp, Sorghum bicolor
  Clone ID: SORBI-28MAY03-CLUS55821_1
gcacgaggctctgctctcgtacagctagctaggtagcaggcactgtgctgctccggcctctcgatcgaacgatcgatcggtcatggactacggcaacgcgagcacgggcagtacggcggcgccggagcaatataactactgtcgctccgtgtcgccgccgtcgagggtgtcgtcgtgctcgccaccaccaccaccgccgccgcctcctcccgccgtcctgcaggtggtgggcaacgtgcccccgaccgtcgtcctgagcccgtgcgcggcgtgcaagatcctccgccgccgctgcgccgacggctgcgtgctggctccctacttcccgccgacggagcccgccaagttcaccacggcgcaccgcgtgttcggcgccagcaacatcatcaagctcctccaggatttgccggagagctcgcgggcggacgcggtgagcagcatggtgtacgaggcggaggcgcggctgcgggacccggtgtacgggtgcgcgggggcggtgtgccggctgcagaagcaggccaacgagctcaaggtgcagctggcgcgcgcgcaggccgacctgctcaacgcgcaggcgcagcacgccaacctgctggccctcttctgcgtcgagatggccaaccgccgcggcggcaaccagcagcagcacccgtcgtcgccactgacgacgacgatggacggcggtggcggatcaagcggattattcggcgccgcgtaccagcagacgttttacgactcggacctggactcggcgaacgtggcccgatcacgaagcccagctctggacct

SEQ ID NO: 3154 - DNA, 529 bp, Sorghum bicolor
  Clone ID: SORBI-28MAY03-CLUS55824_1
gcacgagggccacgcctggcaggcatcccctcctcctccccggccggcgatgacgtcttcgtcttccacgctggccaagggcaagtccgcatccggatctgccaaattcgaggccaaagggaaattctcctcctcttccccagcggcggcagcagcagctaccaagcgtggaaccaccaccagcagcagaggcagagggaagggcagagggaaggccgacaagaaggtctactccttgcccggccagaagttcgatcctccggaggagagggagcctctcaggattttctacgagtcattgtccaagcagatcccctccagtgagatggctgaattctgagagagcaaagaaagcatacgaaaggaagcaaaagcgacagcagcaagtaagaatgggtaccccaatcaagtcttctgcagtgaggaaagataaacctgaaagttcgaagaaaccaagcactatggattccaaggcaaagagaagagttgattacagcgacgatgacaatgacttcattgtgaaaatgaa

SEQ ID NO: 3155 - DNA, 468 bp, Sorghum bicolor
  Clone ID: SORBI-28MAY03-CLUS55849_1
gcacgagggggaaacaacatacctttccccatctagctccgcgctcggacaacttctgcaagcagagccatggctctcgagaaggccaaggagatcgtcgcttcctcccccgtcgtcgtcttcagcaaaacttactgtcctttctgcgcccgagtgaagcaattgttagcacagctgggtgcaagttacaaggccattgagttggatgtggaaagtgatggcgctgatctgcaatcagctctcgctgaatggaccggtcagaaaactgttcccaatgtctttgtgaaaggggagcgtattggtggctgcgacgcaaccatggcaatgcacgacggtgggaagctggtgcctctgctgaccgaggctggagcaattgtcactgccagtgccactgcaactaccactccgtctttgtagacatgttttacagtgtcattccgtttgcttcgtggctaatatatatatgtt

SEQ ID NO: 3156 - DNA, 767 bp, Sorghum bicolor
  Clone ID: SORBI-28MAY03-CLUS55863_1
gcacgaggcgcatggaggcatagggccggccggccgctgcgcacgcaagccgccgcccgccgccagaaagcgcccgagccggcgcgccagccctcaaccgcccgagcgagcaggagcggcccgaacgacggccaggtggagcggagttgggagcggcctgtggcctgtgggagtgcgggcgagcagcgagccggcgatggagtgaagaggaggagcagcgcaaggtacagcaacccagagctagggctaactgctgccacggataggtcaacggtagagaggggtagcagctcctcagcaactggatttggtcaaggccaaggtgcaagcagtgaagcagagccaaagggattggtagagagggttgtggtcatcttctatgacaaagagcatgtaccaattgagaagtttgtcttcaagcttgcagtcaaccaatcatattgttccaagttagaggaggcaaacctggagtttgctctgcgagcattcttgatcaagctgactgttgctgagcctgttaccaaaccccttccatcagatggtaactgggagatcactgcctacttccggtccctccctggcgatgacgaccgagaagctcagctgtggattcctacagacaccaagctgtggatgcagcctccgcaaattacccctatcaagtcagttagctgtgaccctctgaagatgcagctttacttggagcaccctagcatcacagaaccgaaggatccggcagcataacaggaatcagtgcctgtgctaca

SEQ ID NO: 3157 - DNA, 570 bp, Sorghum bicolor
  Clone ID: SORBI-28MAY03-CLUS53094_1
tggatggcaaaatgacataatggatgttctactaatctgttggtgacttcacattaactgcagagctgcaaatacactggcacgcctatttcacaggtctttggcaggcctgatattgtttctaccatagcttttcaccaaaagaaagagtcatttttccctccgccagcacaactgtatatacttgctgggaaaggatctttcatgaggtcacatcacatcacctggttttccagcctggtgattgtgcacaggatgttcctggtaatttgagggactacgcgtgttgccagtttaacaaggtgatgctgccgagcttaaccaaagcgagctgctgtgtttttaacgcgtgctgtactgtgcatgctggttcagtagccttgtcatcccagctctgtaatatacagattttgtacgtgagaggcacatgaattcgggaaatgagaatgaggacgtgagggtgtttggacataagaactaaagttcaagatgtgtcacgtactcacgtcggatgttacggggtgttgtatagagtatttggattctaataaaaaaattgcagattctatt

SEQ ID NO: 3158 - DNA, 601 bp, Sorghum bicolor
  Clone ID: SORBI-28MAY03-CLUS53108_1
gcacgaggcatcgatctctcgacaccttcttcgtcttcactcttcagagcagatcgagctggttcgacagctccgaattgaagaaggtaggtagacgtacgtgcatcatgaaggctgtcgcggcgatgacgatgacgcttctgctgctggcgctcgtgcatcatgcagcaggatcaggtcaccaccaaggccacatctggaaacacgacgacgccggccaccagtaccggtcgtcgtcccctctggccgggctgacgcagtgcgtcaccatctgcggctccggggtgacctcctgcatgctggactgctaccagccgctgatcgacctggaccccgtggagctgcccgtctgcctcctcaagtgcaccaacgacgccatggtctgcgcctccggctgccccgtcaacgggaacggcgtctaggtcgatcgtcgtctattagctacccacgcgtgttacacatatcacccagccatttattcactactaccaatccaacgcggtagatatacccgcacctctgaatgttgttttaagtcctttgtgctaagactcgacatcactactaccaaatggcttgtgaattgaagaccggtgttctc

SEQ ID NO: 3159 - DNA, 481 bp, Sorghum bicolor
  Clone ID: SORBI-28MAY03-CLUS53128_1
gcacgaggcactgatcagatcacatcacgaaatgtgacaaccaaacaacgcctatgttttttcatttacttaagtggcaaaataagggaactcaatgaaacacaacctaaacttcttgatgtatcatgactgatctattaggtttggctcttaattattgaaaatatatggaatgatgtaggtttgttatggatggattattgtgggaagctagcagccttgaacaagttacgactaatatgattcattgtttacattaatatgttgtatatacaatcttattcaattaatcttctggtggaatcaaacaaaatactgcagctctttattagctttaaatcgttatcacttcttgaatatgttttactaacttgaatacaggtgcgtattgcacgcattttcaatacatatggtcctcgtatgtgcctcgatgatggccgcgtcgtcagcaattttgttgcacaggcactgcgaagacaac

SEQ ID NO: 3160 - DNA, 535 bp, Sorghum bicolor
  Clone ID: SORBI-28MAY03-CLUS53132_1
gcacgagggcacggggcaggtataaaatttggcgggctcgtgccgcgtctccccccgcctatcgattccgccggcgccgaagcgtttacttcttctccgtccgcgatctcgaggagagagcgagagagggagaaagaggaagcgcgcgcccatgttttgacctcgcccgtgtcgtctcggcaacaatctagatctgaggttgtgaggttcttgattgggcgatcacaagaactgtcgctgcaatggtcgccaagatgttgccatccccatggatctcggcgtccgtgctcattctgctcctgagcctgcacccgggtgtccatgccttctacctccccggcaccttcatgcacacttactcctctggagaggtgatctcggccaaggtcaactcgctcacctccatcgagaccgagctgcccttcagctactacagcctgccgtactgcaagcctcctgatggtgtcaagaagagcgctgagaaccttggtgagatcctcatgggtgaccagatcgacaactccccataccgctt

SEQ ID NO: 3161 - DNA, 597 bp, Sorghum bicolor
  Clone ID: SORBI-28MAY03-CLUS53142_1
cacgccgccgcacgcacctggcgacaggtcaacatcgcggcggcatctctcatccagtcacccctagcggcccagcgactgctgttccatggcggacggcgacggcgccggcgcggcggcgacggggaagctcgcggagctccctagcggcgccgagaagggactccccaggagggccaaggcttcttccggaaggacattaaacactgcacaaattccgcttgttgcgagccatccagatgtgtatgagccatgtgatgattcctttgctcttgttgatgcgctactctcagacaaagcacaacttttgacactacagccaaggttatgtatggaggttgggtctggtagtggttatgtcatcacctctcttgcaatcatgctcaggcaattaggctctggagcccagtacctagcaactgacatcaaccaacatgctgccgagacaactcaagcgacccttgaagctcatggggtgcatgcagatgtgattgttactgatatcgtgtctggtcttgataaacgccttgctggtatggttgatgtggcagttgttaaccctccttatgtgccacctcctgtggaagaagttggatg

SEQ ID NO: 3162 - DNA, 587 bp, Sorghum bicolor
  Clone ID: SORBI-28MAY03-CLUS53165_1
gcacgaggctgatgtgaatgctaatcagagtacgaagaagccaccttctatgcgaatgttaaggcaagctgccactgtatatacaccttctgcctttaaaatgtttgagagggaatttgaattatacatggattgcatgctctacatctgtggtgagatgggcacaattttcgagtatagaataagtgtcgaggacaaaccaagagatcactttgttaaatttgattcagtcaattccatgatgaattgtacttgtaagacgtttcaatttattggcatcccatgtcgccatatgctgaaggtacttgacacgaggaatatcaaggaccttcctattcagtacatcgtgaaaaggtggaggaaggatgccaaatcaggatcctcaaatggcggttgtgctttctcatttgatggtgatcctgattctgctcacataaaacgttataattttctgtgtcggatgttcagtatagcagctgctagggctgcaacttctgctgaatcatttgcatatatggaaaaccactcaaacatactgatggatcagatagagcaagttattcaaaccaggccccctggcatagctg

SEQ ID NO: 3163 - DNA, 616 bp, Sorghum bicolor
  Clone ID: SORBI-28MAY03-CLUS53158_1
tggtaagccgagataccgtcaaggcacggccccgcgccgctccagctttctcccccacagggccggccgcagcgcagcagggcgggcgcgccgcggcggcctgtgcgccgccaccgccccggcggccccccgcggccgccccccccccgccccgcgccgccgggcgcccaccccgactgccacggcggctgcatcgacggcggcgccggcgccgcccccccgccgcgccgcccgcgcgccggccgcgcccccgcggccctgccccgcctccgcgacggcggccccgaccgcggcggcgggccccgccagccgctgctgcggaagcgcaccatgaacaccacctcccagatcgccatcgtcggcgccaacgtctgccccatcgagagcctcgactacgaagtcgtggagaatgaccttttcaaacaagactggcgatcaagaaagaagaagcagatatttcagtacattgtcctcaagtggagcttggtgctccttattggcctattaactggagttgttggcttcttcaacaatcttgcggttgagaacattgctggattccaattgctgctcacgagtgatcttatgctcaaggggaggtatattggagcatttt

SEQ ID NO: 3164 - DNA, 624 bp, Sorghum bicolor
  Clone ID: SORBI-28MAY03-CLUS52632_1
acagggttcatcagcacaagctgcttgcttgtctggtggtctcaggcgccgccgtcgccgtcgtcctcctcctcctcctcctctactgattttgattcggggttcgactaaatttcctcggatggacacccagccggtactcgctcccgctatcgatgccagcgctagcgtcatgtgccagctgctgagccccgagggagaccctctcggcgctgcgctctatctgccccagaacgtcggcaccccgcagctccaggagattgtcaatcagctcctccacaatgaggagaagttgccctatgcattctacgttggagacgaggagctctctgtccagctgggcgcttacatgcggcaaaagaatgccaatgttgaggttactctgcgcatagtatgccaaccacaagcacttttccggatcaggccggtcaaccgatgctctgccacgattgctggccacacggaagctgtaattgctgtttcttttagccctgatggaaagagtttggcgagtggttcatgtgacaccaatgttcgcttttgggacctgagtacacagactccattgttcacatgcaaaggacacaaaaattgggttctctgcattgcgtggtcacctgatgg

SEQ ID NO: 3165 - DNA, 517 bp, Sorghum bicolor
  Clone ID: SORBI-28MAY03-CLUS52635_1
gcacgaggatttgatccctcctcccacccccacatggcaccgcgtctcaccccgccaccactcccccatctccccgtcctcctcccgtctcgccgccgcctcctgctcctcctcttccgccgccgccgccgtcgatagccgccgctgcctgtcctagctcgccgtcgccgtccgatcacactagcaccatcagcagcaaggtccctccttcccacccatcccatggacctcgacccctccccggcctccgcccacggggacggcggcggctgcgccgacgcctggcccttcgactcgctcaccacgtccatgctcttctcctccgtctccgcctccccgcagctccagccgctgccggccaactcctcctggcttaccccgccctcgccgctctggctcttcgaggaccgccacatgctcccgctcgacgcccccgacgccgcgcccgaggcagccgtcgcagccgccgtcgtcgaggaggtccagcgggcacgctccgggaattctgacacttcaa

SEQ ID NO: 3166 - DNA, 371 bp, Sorghum bicolor
  Clone ID: SORBI-28MAY03-CLUS5267_1
gcgtctggccgcccacaccgatgcggggcgagggggaggccatagaacctcagccacctggccgggcatcgagcacactcttggcgatatcttcacctatgcggtcctcgtgcagctcgccatggcggaatccatgccggtgccgcacatcgtggtcactaatgtcatgtgggcggggggctgatcctgaacttcctcaatgacgatgggtggctccctggaaccctctggctgctgtgggaggatatcatcacagtgggcgggcttgccgtgctccctcaggtcatggggacaacgattgttccctttatccccaatagcgtactgcctggcataatctgagggactttggctggttcagctgttgcgat

SEQ ID NO: 3167 - DNA, 590 bp, Sorghum bicolor
  Clone ID: SORBI-28MAY03-CLUS52747_1
atggcgactacttccgctgctcacttcctctgtgcgccagcagcaacaactgctccactggcggcagcaccgtcacctcctccacccattcccccgaggagcaggactactgaccacgcagcagcagtgccggaaaaaggtgttgcaattgttgactcgttgcaccggccagtgcttgaagatactcatcaggctgctcaagaaaaggcaaataatggtcagctgccaatgggactgcacgggtgtgttgacctgcttgaccccatggctacaaactgctcaagtccagcgagctcttctccatctctcgctagcctggagcagctgacggccgacatgtacgcgccgaacctggagatctccctggggaggcaggactggagcatggaccgtccggaaggactttgcctgaaatacctgtgacaaaaggggatatcgagctttgtttttctggtttcggtcaactaattaaccaattgatcaatattcatgaagtagctagctaggctttatgttcggcacggcatggaatgaaatcgatctatgatgagcaggttgtgagtgatataattattagtatcttgcatggg

SEQ ID NO: 3168 - DNA, 521 bp, Sorghum bicolor
  Clone ID: SORBI-28MAY03-CLUS5272_1
ggagcggacagtaggtgccctaatagcaaacggagctgcatcaggtcctttaacagatccaacacagcagtatccatctggaagaactcctgctgatctagcatcagaaaatggtcacaaaggcattgctggttttcttgcagagtctgctttgacaagtcacctctcagctcttacactaaaggagtcacagggtggcaatgtggaagaaatatgtggagtaacagcaccagcagctgaagattttgcagaaccaagttcttctcagcttgcttgtgttaattctcaggaagagtccttaaaagattcacttggtgcagttcgtaaatcaactcaagccgcagccagaatatttcaagcttttagggtggaatcattccacagaaagaaggttatcgaatatggagatgatgattgtggactgtctgatgaacgcacactttcacttatttccctaagaaatccgaaacctggacatggtgatttgcattctggtgctggtccgatccaaaacaagttta

SEQ ID NO: 3169 - DNA, 1154 bp, Sorghum bicolor
  Clone ID: SORBI-28MAY03-CLUS53244_1
gcacgaggctccgctctgctcctctccctatccgcgcctccgccgtccccagcgcccgctcctccgccaccgcctgcggccgaaattcctcgcagcagcagcagctcgccgatggtggccagctctcgcttgctgtgccagaggcggacgaaggtgacacggtgctgccggagaatgtgcacaagtggaggatggtcatcgcctacgatggaacaaagttcaaaggttggcagtatcaaccatcaattccaacaatacaatactttctagaggatgcactgatatgcatcactaagctggatcggaagaaactgtgcttggttggtgcaggcaggactgatacaggtggcacattttactacacccttcagttactgttgcctcaatagtattcattctgcaatgaatggattacttcctccagagattcgagtcagggaaattagcgcagcacgtcctgaattccatgctcgcacatccacaaagagcaaagtctatcgctacaagatctataatgaagcaatcatggatccctttcataatcgctatgcttatcatagtgcttataaacttaatccccatgccatgcaggaggctgcaaattattttgttggaacccatgacttcacatcctttgctaatgctgcacataatgatcgtgagcgcagatccacaaagaagataacacgttttgatgttactgaaatgggtgctgtcctacagcttgaggttgaaggcaccggttttctgtacagacaagtgaggaacatggttgctttgctgcttcaagtcggaaaggaagcactgcctcctgatatcgttccagcgatcattgcggtcagggaccgcaaagaactggcgaaggtggccttgtcagcgccaccacatggattgtgtctcatgtcggttaactatgacgaggaaatcctcaagcctcctgaaggttctcctccagtttcctttggcagaactcaccatcttagtaaatgcaaacttccgttttattaatttgttacagatgaattgtcttccagagatctatcgtttttttagtttcccttgcctcctagaattttcttgcttcacaactgtcaattgtaggcccttatggcctgctagtttttgcgaaggtattgaaatactttctttaaaaa

SEQ ID NO: 3170 - DNA, 618 bp, Sorghum bicolor
  Clone ID: SORBI-28MAY03-CLUS53247_1
tctaccatagcaaggatccagttgtttgtgatgttgaagttctagaaggcattgtcaaggtgggaaccccaatttgtgttcgtgttccaagtaaggatagcagtgctgatgtgattcatgcccttgggaggatctcatcaatgaaaacatccaatggcatgcagattaattctgccagtaatggagttgtgtcgataaagataattggagagaatcctcaggagaggtcctgggtgtatggacgccattttaactctgacaatgagctgctcagccaaatttctaggaaatccattgatgtgctgaaagaacactatcgggatgagatgagtgatgaaaattggcaactgatctgcaggctaaagaaacaattggggatcccctaaatcgttttaaagatttttatactgtcatttcccttttgaatcgagagacctgtaatctatttaagtttttatgttttgattgtgcgtggagacagcttgtctttttttttttggtattttagaattgttcatggagactcactttgagtacttgagtggtttgaagactcttttctgttatattctggattgtcgaaatcaataatagatgctggacatgttgaaaagtccg

SEQ ID NO: 3171 - DNA, 832 bp, Sorghum bicolor
  unsure (1)..(832): unsure at all n locations
  Clone ID: SORBI-28MAY03-CLUS53273_1
ttcttgtggaatattgatatgggggacaaggtaaatggcgctgttgaattatgtggtctgaaactgggtgaaatgaaaaatgtcttgggtaaaacagcgtatgatcccaatttgtgtgcatggatgtcaggggtgaatttgattaatttggataaatggagggagcataatgtcacagagaactatctgttgctcatgaaaaagttcaaattcaaggatgaactgtccctgcgagcagcagcatttcctctaagcttgctatccttccaacatctaatatatcccctagatgaaaaattgaccctggctgggcttggatatgattatggaattgatgaagtggttgcgcggagatctgcatcattgcactacaatggcaacatgaaaccttggcttgaattaggtataccggactacaagaagtactggaagaggtttcttgtccgaggagatcgatttatggacgagtgcaacgtaaatccgtgatgcagttggacctgaaatcacaacaactgagtaaatctgtgacgcagttggacctgaagtcagaacaattaggatagatggctacatcagctagccttacttaagtttgtgccggcaaattgtggaagagaacgaattctagtggtggagccagagatttttggagttggatattccncaacatgaaangtagtaaacacaanaaatatatatacgagtagtataaatttgagntaaatgctgggactgtgatcnncatggaccnaccctcttagtgccgcttcgctctttctaacannaatatttcaaatcgtcgnacttcatcttaggcccttgtttagttccc

SEQ ID NO: 3172 - DNA, 598 bp, Sorghum bicolor
  unsure (1)..(598): unsure at all n locations
  Clone ID: SORBI-28MAY03-CLUS53297_1
tggattcattgtgttcattgctgttgtntgggtcatacaagaatttacatctttccatgttctgaaatatgtgatcttattcataggtgtgatgaacagcttattttcagtttatgatatttatgatgacttgatatcccgaagagttaatacaagtgatgctgagaagtttgctgaaatctgcccttgcccctgcaatggttttgcatggggtgttatatggggattcatctcgtttatctttctctgcgcttcaatataccttggactggtcatattgtcttgaggattccaacctcgcgcatgccattttgatctgacaaccaactctgattggcttttgcagagttttccttgctctagattttggttcaaacttacattgttctggtagttgtacagtatacatgcagggtaaacatgtatatccgttggagttaaattggtggagattattcatgtgattcttcgattttagtggttctatagagataccgttttagtcaccagttgtatttatggtcagtagcctcttctagtatttatgtacctgtatatcatattaccttgccttattgcccatttaaccaattcaaaa

SEQ ID NO: 3173 - DNA, 630 bp, Sorghum bicolor
  Clone ID: SORBI-28MAY03-CLUS53302_1
aaaggaggatatattatttctgataactcatcaggcaacaaacctgatttcattctcattggcactggttcagaacttgagattgcagaaaatgcagcaggtgagctgcggaataaggggagaaccgtacgagtggtttctctagtttgctgggaattatttgaagagcagcctgaggagtataaggaaagtgttctcccaaatgaggttacttctagaattagcattgaggcaggggtcacatttggatgggagaaatatattggacaaaaaggcaaagctattggtattgaccgttttggtgtaagcgctcctgcggggaaaatatatgaggaacttggtttgacagtggaaaacgtcattgcagcagccgaggccctataaatggtcatcacattactgaaatacacatattttgatgggtatgttccagtattaagacttcagtaatgccactggtttgaagcactatttgtggtcatgtggttgtatatgaacttttaagggtcctctttactagctaatgatgcgtagattaattgtcaggcaaatttgcactttgctcctacaatcatactttgggaacttgtcatgaaataaaatgctggtcatattaccagcgaaatttga

SEQ ID NO: 3174 - DNA, 1166 bp, Sorghum bicolor
  Clone ID: SORBI-28MAY03-CLUS53006_1
acgcaactgcctccaacgcggcaacggcaagcgtagtcaccgccgcagtgagtgagatgatcagcggaggggccgcggccgccgggaaccccaggaggaggaggacgcgatgaaggcgcagccgctgctaccggcggcgctcaagaggcggaggggcccgcgcgtggcggtgctggcgctcgtcctctgctccctgctcgtgcccttggccttcctcttcgaccgcgccccctcagggtacgtgacgacggaggagcggcaccggcaggaggtcgttctgcctaagttcgatcacgaggagaagaggcgtcctactggcgctgacagcggaaagcgacaggatgcgctggagaagatcatccctagaagtagatcaggagtcattcatcaacaaacacccgagaagaacatttccaaaggcagtacaggtgtcattcatcaccaaacaccggagaagaacatctccaaagttcttccagcaccaaaagttgaaccatcaaaggatgtgacggattcaactaaagtcgcaaaagctcctggccaagaaggcgaaaaggctgatgaagtggaaaaggcgaagtcttgtcaacttgaatttgggagttattgtctctggtccattgagcacaaagaaataatgaaagatcatatagtgaaaaggctaaaagatcaactcttcgtagcacgctcatactatccaagcattgcaaaacttcaaggacaggaagctctgactcaggaaatgaagcaaaacattcaagaccatgagaggattcttagtgtatcaacagttgatgctgatcttccatcctttatcagcaaaaggatgaagcagatggagcgaacaatagtgagagctaaatcttgcacagtagattgtaagaatgttgacaggaagcttcgccagatacttgatatgactgaggatgaagctcattttcatatgaagcagagtgcattcctctacaatctcggtgcccagacattgccgaaaagtcatcattgcctatctatgaggttgacactagaatatttcaaatcatcttcattggattctgatgattctcctggcaagttcagtagtccagaatacaggcactatgttatactatctaggaacgttcttgcggcttctgtagtgatcaactcaactgtgagcagttcta

SEQ ID NO: 3175 - DNA, 423 bp, Sorghum bicolor
  Clone ID: SORBI-28MAY03-CLUS53026_1
gcacgaggccgcatccgctcggcgcggcctgccccccggcccgctccaggcgggggatccggcccccgcccgctcccagccccgacgcgccgcccaatctcgactactccatcgccctcgagtacgacggcccgccggtgccctacgacctccccagggtagaccccgtccagatccctgcaatccccacggcggagccagtgtccggttcccaggtgctcggagccctcccggtggcccctgttgttcagcccatccgcctccccgtctctaggatcgcccgctgcgcagatccggtggccgcgcagcctgctggcagctctgagtcagtcctgcacaaccaggagttcagtgacgacgatgaccaagccgatgattcccgctcacagtcgcacggctcagcacagacctcacctggcccac

SEQ ID NO: 3176 - DNA, 660 bp, Sorghum bicolor
  Clone ID: SORBI-28MAY03-CLUS53060_1
cacaaatcaaggatgctgtccgtgatggtctaagatctgttaagaacacaattgaggatgaagcagttgtgctgggtgctggtgcttttgaggttgcggcaaagaagcatcttattgacaacgtgaagaaaaccgtcaaaggacgagcacaacttggggtggaggcgtttgcagaagcttcttcttgttatacccaagactttagctgaaaactctggtttagatacccaagatgtgattgtttctctccagaacgagcatgaccgtggattagttgtgggattgaaccatcactctggggaaccgattgatccccagatggaaggcatctttgataattactctgtgaaacgccagatcatcaactctggacccatcattgcatctcaattgctgcttgtggatgaagtgatcagagcaggccgcaacatgaggaaaccgacttagatgtttgttggcaccgagcgtccgagccgatactaatttgttgtaccttttgtttttgttttgtgcttagtagtgatctggatgatacatttatggcttcagttaggcccatttcacgaagcaggttgcattctctgtcacttgtgccctgaaccgttgcctggaattttggattgctgcgtgcttatatttcaagaatgagattttagtttt

SEQ ID NO: 3177 - DNA, 589 bp, Sorghum bicolor
  Clone ID: SORBI-28MAY03-CLUS53088_1
agctagtcgcattgggtgaagtagttggcacagaaaacagaggtctctctgctgatacacttgcttctttaccttcagtaacatacaagatgcaagatgttcaggatggcaacacagagcaatgtgtgatttgccgcgtggaattggaggagggtgaatctttgattgcacttccctgcaagcacttataccatcctgaatgcataaaccagtggctgcaaataaataaggtatgccctatgtgcagtgcagaagtatcaacctcgggcaacaaggagccatgactgctctcagatggccatcttgggcacttgatgggaataactagcggcacactgcagcatctgtattgtcgaaacaaaagcagaacgttttacatacatgcaaggagatcaggaaataatcctcttgtcagtctaaagttttgtcctggttctctgctcactggatttattggccttgccgcttatggtctcagttcccttcgggcgccttatggctgttgtatgatccataagatatgccaattatattatattgttagtcattctttttactgatcgcatgatcatcgtatatatttgcttgt

SEQ ID NO: 3178 - DNA, 596 bp, Sorghum bicolor
  Clone ID: SORBI-28MAY03-CLUS53449_1
aatggacagcagtaagatcagttctgaaaaggtggctgtcttagtcttctttgtgatttttttgactgctggtgtactaggggtcttgctagctcatattgcacaaggaccagcggttaccagggttgttggtgcatttactttattggttatcatattgattcttgggttcatggattatatccttctgaagaccatgccagacaatctcaccaacacgttgatgtttctttcacatttcatcgttacgacgactattatctgctttttgtggttcaaatatgtatggccaagcagctgttgtcagggaggaaccagacaagactgatccacgtaagagtccaactacctggtctacagcgatgatgttatgcatcatgttgatatgctttttgtgtcatagcctatgaatagaacagttaaagcttacacttgacagggtcatgcttaattgttgttcggctagcgttaccagctgttgtgggcttgtggctggctgcaactagtatagtctactgtaattctacagtgaaatgtgagagaaaccacaaccagactagatatgtatagtatgatagttttctacttttgagttt

SEQ ID NO: 3179 - DNA, 681 bp, Sorghum bicolor
  Clone ID: SORBI-28MAY03-CLUS53479_1
cactcgacacaaaatgattctcagaagttggataaggatctgctagacaaacgtgtcaagaagaaagtggcggcggtaaactcagccttgcgtggttggtcaaatacggtatttgattctctaaagttaccagctacggaggttgctgagtttttttatgatgaaccaaatgtgctggagctggaacctgagattcttccggacatcagttggcgtctcactagttcagcagatgataaagcaaagatggctgaagaccgtcttgatgagcttgaccagtacccttctttggagaacaagccagttatgtttgagctgagagacgaggacaagccagcgataccgccactgggagtgtattgaagaatctgtgccagttggacagaaagttctgcttgctacggagccgtctagtctagaatgctactaggttttgaataatgaacctgatgtttttccccagctatatgctctggtggatgagggtgatgtgggatttcacagtttgagtactggtacctgttccagcggaagcgaccgtgcttcctgcctttatgcttgctgatggtgatgggtgatggttgtggaactgcggctgatgtaattctgtcatttttcagcaaaaacaaatctatgaactttatacattctcatgaatcatgatatgacttggcaggtttc

SEQ ID NO: 3180 - DNA, 424 bp, Sorghum bicolor
  Clone ID: SORBI-28MAY03-CLUS53482_1
agattatcgtaccaaacaacatcctgttcgtccaaaacctgccacacgagacaacacccatgatgctccagatgctcttctgccagtaccctggcttcaaggaggttcggatggtcgaggcgaagcctgggattgctttcgtggagtatggagacgaggggcaggccactgctgccatgaacaaccttcaaagcttcaagattacaaaagaaaaccagatggtcatcacatacgcgaagaagtaacaacctcccgagctgtgttgaccctgatctgttaaatgttgtattccgagtttttgcacaactggtagatttccttcatacgttaggtagccagcatcctgaacaactgttaatggtacccgcttaacagcagctatgtgcacttcaggaactgagatgaaatgcaaactgtttttttt

SEQ ID NO: 3181 - DNA, 582 bp, Sorghum bicolor
  Clone ID: SORBI-28MAY03-CLUS53511_1
aacctcaatgacccaaagcttgcagacaacgtgaactatgcatgttccatggcagattgcaccagccttggttacaagacatcatgtggtatgctggacacgcgaggcaacatctcatatgcattcaacaactacttccagaagaatgaccaagatgatgtggcctgtgggttccagaatcttgcaacaaccacaggccaagacccaagcactgggacatgcaggttcgggatcatgatcgaggttgactccgccttctcatggaggcttcaggggcatggaagcaacctcctcttgatcctcctgcttgtgcttctccagctattcctgtctttctcttagatgcaggtttcgcgagagatgacaatgagagcataaaaaatctgacagcttgaggatattagatgtatgttgtcagtatcattcatttagaaactctttcctctataaccctttttcttctctttggcaaggaaaccgcagactgcggtttcaggcatgcttgattattgttagggttagctttgattcatcagttcccttgtgatagcaatgaatgatgcattgagccatccactggct

SEQ ID NO: 3182 - DNA, 690 bp, Sorghum bicolor
  Clone ID: SORBI-28MAY03-CLUS53512_1
tccctgtcagtaggcgaaggatgataatgccgaatgagttcacatcggaccacagcatgagttccgctgctgacttgaattcaccctggtccatatagtagagtgttcccttatgggtctctgtagggtgactttgcaggctggtgattgttatgtcgggttctctgagaaagtagcagatgcccaagcctcccagcttgctgacgaaattggcatcgaggagaatgttgcccagatttagatcaccgtgaacaattggataaggcttgtgtgagtggatgaaagccaaagctgagcatatctccccaatgatccttgtgcgcgccttccatgtgagaggtggcatgtttttcttgcatgagagccaatcctcaagactaccatttgggaagaattcgtacaccagcgcaaaattgtcgggacatactcctaccagtgtggtgatgttaggatgcctcgctctactgaggacagcaacctgcaggagtggatagtgatgccacaggtgcaacaatagatatgccactgctcgttcgaaaaaggggtgctatagaattagtaaagggaagtgatgtcaactacctcttgataaaatcttgcttgtccttttaagcttctcggatggaacagctttattgctatatttgtgttgcggacgaaacctttatagatgcttgcaaatccatcttc

SEQ ID NO: 3183 - DNA, 574 bp, Sorghum bicolor
  Clone ID: SORBI-28MAY03-CLUS53520_1
tcacatctgagtggttcggtcttgaagcttcactcctaacattaggccttaccattggagctctatcatttgtgctggaaccaagtccgaagactgcgaggagaatgttctatggcagcctgctgtatctccctgctttcatggctggacttcttttacatcgacttcctaatgaacaaaaggtgcacaacctagccgagaaaactgacctggctgagaaaagtgagctggatggagttctgtacggggctgatctgcaggacaaagaaagatcgcaacagaaaccccgagacaggaaaccttctcgtctgcaatcacgccctccagttgcctatgcttctgtggctccattccctttcctaccggtacccatatatgagtcatgaaaactctctggttcttcctgcagcaatgggacagttggagcaatgtattcatgcattttttggcttacttgaatttctggaatcaaggggagtccttggtgcgtctgttgttaaaattatagaataattttttttatggattgagctttttgtggctcacctaaatgtaaaaagtgctgttgatgctc

SEQ ID NO: 3184 - DNA, 636 bp, Sorghum bicolor
  Clone ID: SORBI-28MAY03-CLUS53196_1
aagggcctgggaagcaaatatgcccgtattgagctggaggagatggtgcaagtggcactgctatgtactcagttcctccctggtcacaggcccaagatgtcagaggtggtcaggatgctggaaggcgatgggcttgcagagcggtgggaggcgtcacaacacactgagtcacacaaattcaaggtgcccgagttctccttcagccgctgccattttgacctgacagatgactcgtcgctgctggtgcaagcagtggagctttctgggccgagatgataccatgggagacggtctgaggcaagaagtatccagcagttgtttcccagtagaatatgtaaataatacaaagtgaagcaactgatgctgcatcctgtcagaaatcgaagcagatctcaatcagctgaactgtacaaagattaaaagaagagcacaacctagtctaggcatggtacattactacatctacaggttaagtaactgttggtagaataaggccatagagcaatatttccaatttctaatgtaagattttttttgtattttttcctttatattctattactctagatataatttgtaaaaagcaaaaaaaaaaaaacattggaatgcagaggcttggaagtgtcgttgtctggc

SEQ ID NO: 3185 - DNA, 488 bp, Sorghum bicolor
  Clone ID: SORBI-28MAY03-CLUS532_1
acccacccgttcctatacaccatgctcacggtatgcatgacctatgactatgcgcgacaccaacacgtctaccacgagagccacgcagcagcaagcatgagggtggacaccatcacactgcagcccttcaccttcgacgagtgggacgcccacgcccggcgctccgccggcaagtcccgtcaacgaaccgtgaaggtggtggccatgggcgccgccgacggcaagccgatggcgcacgccaacgtgagcatcgagctcctccgcatgggtttcccgttcggcaacgcggccaccaaggagatcaccgagctccccgcgtacgagaagtggttcacctcgcgcttcaccgtggccaccttcgagaacgagatgaagtggtacagcacggagtggacgcagaaccacgaggactacagcgtcgccgacaagatgctgagcctgatgcagcggcacggcatcaaggtccgcggccacaacgtgttctggga

SEQ ID NO: 3186 - DNA, 644 bp, Sorghum bicolor
  Clone ID: SORBI-28MAY03-CLUS53211_1
ggaagggtgtattttgttatcctcgagatgtcccctgttacatatattgattcgagtgctgttcaagctcttaaagatttgcaccaagaatacaaagcacgccatattcagattgccatagctaacccaaaccagcaagtgcaccttttgttgtctagatcgggcatcattgacttgataggtgctgggtggtgctttgtgcgagtgcatgatgctgtgcatgtatgcctacagcatgtgcagaattcatcttcaaatgcgttgaagctggctgttcaggcatcaggtgagttgtccgattctgtttcaactcctaaaccagagaagcagcatcgaaagtactatggcttcttcaagaacctatggaaggcacgggactacgcgcacgctgatggtgaggtgcagccgctgctccggcaaaaccttgtgtaatacagaatacttaacgggatggactcactccctcactgtcttggacatatatgtgtttatttatgtcgttaacttgttgtgatgaagaaagtgaagtgtacaattgttactgtgctgtttatttatcattttttataacatatagacacgtagaaggaaaggagaagatatctcgtttgttcacatgaagatttttatcaaaaaaaattttc

SEQ ID NO: 3187 - DNA, 638 bp, Sorghum bicolor
  unsure (1)..(638): unsure at all n locations
  Clone ID: SORBI-28MAY03-CLUS53215_1
gccaagacggtggcggagaaggaggcatggcggctggccaaggagcacggcatcgacctggtggtggtgaacccgtcgttcgtcatcggaccggcgctggggcccaagccgaccagcaccatactcatcgtcctcgccatgctcaaaggggagctgggaaagtacccgaacacgacgatagggttcgtgcacgtggacgacgtggtgctgtgccatgtgctggccatggaggacgccagggcgtcagggcggctcatctgctcctgcgacgtggcggcgcactggtcggagattctggagtcgctgagggagcggtacccgcagtacccgatccccagggagtgcagcagcagccagaaaggggacgacaggccgcacaggatggacaccagcaaggtcaaggcgctcggcttccctcccttcctctccgtgcaccagatgttcgacgactgcatcaagagcttccaggacaagggcctgctccaatgaataattatccatgcatcatcatcagaataattcaggcacatcaattattgatgagaagtagtatacagccaagagatagatggctaggcacattgagtcatatcatatatatagcatctcccanaataattggaagtgatcaaacctcc

SEQ ID NO: 3188 - DNA, 482 bp, Sorghum bicolor
  Clone ID: SORBI-28MAY03-CLUS53621_1
aaaaaaaaaaaaaaaaaaaaaaaaaggcccccagggaaaaaaaaaagtcttcttccacgtgcctcgacggctcgaccgcttcgcctccctcgccccgccggaaccctaaccctagccgcggagctccaccgatggtacggtctttgtgaattgaagtagcttggaagagtggtgttatgccctgtgatgggagacaatgttctaaaactcagggggaggttgtcagggtgaactgcattatgggttctgacaaaagttcatgctctagaacacgaagtggacttgtaaggaaaaaaggcatttttgctctcagtagagcttcatgttcaagaactcgaagtgggcttctaagagcaaagagctttgtggattccagtgatgtttcgagttctagaactcgaagtgggcttctaaggataaagagatttgtggattcccgtgatggttcatgttcgaggtcacaaagtgaccatgtaaagaag

SEQ ID NO: 3189 - DNA, 546 bp, Sorghum bicolor
  Clone ID: SORBI-28MAY03-CLUS53619_1
gcacgaggggtggcccgccctacacgttcctggcagggtccttgccggaggcgaagcggctgctgatggccggccggagaggcgtgccgcccctcgacgccgcctgccacgacatcatgcccgtcctcctgccgcagttccacagatgggtcgcagactatgggagaacgtttctgttctggatcgggccgattcccgctctcttgtctacggatctacagctgattaagcaagtgctgacagacaggacgggcctgtatcagaaggacttcatgatccccgtgctcaagttcctcttcggcaacggtgtcatactgataaacggagacgattggaagcggcaccgtaaagtggttcttcctgcgttcaaccatgagacgatcaagagcatgtcggcggtgacggcagaggtaacgaagcagatgatgcggcaatggcgggagcagattattattcagggaagcggcgacaaggaatcggccgagatagacatgatccacgccttcaacgacctgaccgcaaaggtcaacggccgcgtcgccttcg

SEQ ID NO: 3190 - DNA, 859 bp, Sorghum bicolor
  Clone ID: SORBI-28MAY03-CLUS53631_1
gcacgagggttcctggcttgcttgtaattgacaccccagggcaccagtcattcagtaacatgcgctcgaggggatcaagtctgtgtgacattgctgtagtggttgttgatattacacgtgggcttgagaagcagacaatggagtcccttgatcttttgaaacaccgcaatgtgaggtttattgttgccttgaacaaagttgatcggctatatggttggaagacctttatcagtgcaccaatagcaaaagcgcttaagaaccaaactgatgatgtacaaagggaattcaaatggagggtaactgaggttataacacaacttatggaaaagggtttcaatgctgccctgtattacgagaacaagaagctgaaacaagttgtcaatattgtcccaaccagcgctgtaagcggtgaaggcattcccgcccggcttatgcttctggtgcgatgggtgccaaaaataatgatggagagactgacatatgtcaatactgtggagtgtactgtgctggaggtcaatgaagataaggactttggaacaacaattgatgtagtgctgattaatggtgcacttcggaaaggtgatcgaattgttgtctgcaccaaacaggggcctgttgcaaccaatataaggtacttgttgactccttctccaatgaaagaactcaaagttaaaggagtatacaagcatcacgaggagcttaaagctgctcaaggggttaaaattgcagtactagggctgcaacatgctatggcaggcacttctctcattgtggtaaagccgggggatgatatggaacgagctgaagctgcagcaatgcaagaaatcagcaaggccatcagcctcattaacggagatga

SEQ ID NO: 3191 - DNA, 626 bp, Sorghum bicolor
  Clone ID: SORBI-28MAY03-CLUS5368_1
gcaggagactgattgcgcacagcaggaggctattgatttgaaatctaaacttcagtccaaggaagctgaaatcgaaaagctgaaattcgagcatctgaaaattactgaggaacattgtgatttgatcaatcagaaccataaattaagtgaggaagctgcatatgcaaaagaattggcatcttcagctgctgttgaacttaagaatttggctgaagaagttacaaagctatctgtactaaatgcgaagcaagcaaaggagttattagttgctcaggagatggcacattcaagggttcatggtagaaagggtcgtgcaaccagtaggggcagggatgaggttgggacatggagcctcgatttagaggacatgaaaatggagctacaggccagaaggcagagggaggctgctttggaagctgctttggcagagaaggagcttctcgaagaggagtacaagaaaaagtttgacgaggcaaagaaaaaggaactatctttggaaaacgatctagcaggcatgtgggttcttgttgctaagttgaaaaaaggggctttaggcatatctgatttgaatgttgatgatcgaactgttaacctagctgatataactaatggcacaaaggaaaaca

SEQ ID NO: 3192 - DNA, 638 bp, Sorghum bicolor
  Clone ID: SORBI-28MAY03-CLUS53755_1
tcccccggagagtcgcgggcggaggccggtccccggggcggcggcggcgcggtcgggctcgggccccggcgccgccggccccgcccccgcccgcccccccccccccccccccgcctcgggggcggcggggcggctcctccctcctcccccccccctccccccccccccccttctttgctcgctccgcgcctcccgcccctggcggtctgctcggctcccccggcgtcttcctcccgcgcggccctgccctcccctcccccgccgtcgtcccccccccctccccggccctgcccgcctgcggccgcgcgcgcctctctgggtcctcctccccactaccgggcggcgccctccccgtctccacttccgtcgcctccggcggccagcccgtcacctactccatctccaccggtgggggctcgctccgctgctgcatcaactggcgtgcgcgcgcgcccccctgtgtcacaagagtaccattcctgctgagaggtttggctgcgcgctcccccacgatggcttccttctcgggacacctccaccgccccctctctgccatggccgtcgctgccttcgccgccgtctcctcccacgagcttcctgacaagctgtcccaccacaggctctctgatgcaagcacg

SEQ ID NO: 3193 - DNA, 771 bp, Sorghum bicolor
  Clone ID: SORBI-28MAY03-CLUS53820_1
gcacgagggattgctgatgttctagatactttccacgtattagctgaacttccttcagacagctttggtgcatatgtaatatctatggcgacagctccctcggatgttcttgctgtcgagctcttgcagcgtgaatgtcatgtgaaaaaaccactgagagttgtgccattgttcgaaaaactggcagatcttgaggcagcacctgcagctttagctcggctgttctctgttgaatggtacagaaacaggatcaatggcaagcaagaagtgatgattgggtattctgattctggcaaggatgctggtcgtttctctgctgcttggcaactgtacaaggctcaagaggagctcattaatgttgctaagatgtatggggttaagttaactatgttccacggacgaggtgggactgtgggaagaggtgggggccctacccatcttgctatactgtcacaacctccagaaactattcatggatcgcttagggtaactgttcaaggtgaagtcattgaacaatcttttggagaggagcatttgtgctttagaaccctgcaacgtttcacagctgctactcttgaacatggtatgcatcctccaatttcgccaaaaccagaatggcgtgctttaatggacgaaatggctattgttgccacaaaggaataccgatcaattgtgtttgaagaaccacgctttgttgagtatttccgccttgcaacaccagagatggaatatggtaggatgaatatcggaagcagaccatcgaaaagaaag

SEQ ID NO: 3194 - DNA, 664 bp, Sorghum bicolor
  Clone ID: SORBI-28MAY03-CLUS53813_1
gggtgcgggccgcctgccgatctgtgaccacgcgcgtcgccacagagacagaagcgagcaaagaaagcggcagctaggcggggcacggcggaacgtgtttatcaagaagacagccaatccccccttcaccctgtccgcggacaggcagcgtcggtgcgccggcggtgccaacgcggaggcggacggagcgctggggcgccagcgcgcggggagggaggggagcggaggaaggagacagcccggggcttcggctgtctgcttttgcggcctgcgggagcgatcccgtattccgtcgaccagttccgggcacgaactagaactgccttcacataaacttctggaggaggcagcgggattgggatttggaacatggggagttcggtcggctgcctgttaggcggctccaagtccaggcaagattcgtctcctcgttcaggtcatgtattatcaagagctggaaataatgtacaggtattctccctaaacgagttgaagactgccacacgaaactttcacatgttaaattgcattggccgcgggggtttcggagcggtgtataagggaaacctgaaagatggcactcaaattgcaattaaaaagcttgcagctgagtcaaaacaaggaattagtgaattcttgacagagattaatgtcatatcaaacg

SEQ ID NO: 3195 - DNA, 627 bp, Sorghum bicolor
  Clone ID: SORBI-28MAY03-CLUS53333_1
ctatcccattcaccatctttgcagctgtgtactgcgtcttgtttggactagttgctgcagtggggctgtccttcttacagttcactaacatgaactccatgcgcaacctctttatcgtcggcgtctccatcttcctgggcctgtccgtgccggaatactttttccggtacaccatggctgctcaccgtggtcctgcgcacaccaaagctggatggttcaacgactacatcaacaccatcttctcgtcaccgccgacggtggggttgattgtggccgtgttcctggacaacacgctggagatgaaggacgcgggcaaggaccgggggatgccgtggtggctgcggttccgggcgttcaagggcgacagcaggaacgaggagttctacagcctgccattcaacctcaaccgcttcttccctccggcgtaaacccggccgcttctctggaacaagtcacactcagattgctgagcccagctttgatttgtgtaggagatcgatcgagttgcccacattgtttgattcgttgatctctagctgtttcatgttgtagattatcttggggaggggaggtctcctagtatgctactgaccaacccagtaaaaatggtcgcctaccgtttttgtt

SEQ ID NO: 3196 - DNA, 569 bp, Sorghum bicolor
  Clone ID: SORBI-28MAY03-CLUS53354_1
acaaaatgacgttagggaggtgaagatatgaaacctcaccaaagtgacagtgacaaactgacttgtgtgaacagcagcgacatactcccctgtgaatatcgtctgttatcttggcaaacatctagatctaagttgcgcaaggcaagtagtttcgtgcatgcatacaactctgtaggtagctatttcttatgcagattaattaggtacttcgcacattatgattgtcagagatggcagtgtactgatggcacaaggatgagggtaagagcttgcaggttattgtgggctcttgcctgccagagttacacaagtagttgtagtttcaggcattggccgtttggttcttgtcctcacctcagccactaggtcagactggggttctctgcattagataggtttgtctgggcctctagggggcaaaccaaacaggtccatagttgtttattttgtttttatgacttccatccatgtgtttgataaactacgattgtgtttggactgtaacaagataatatgtgaagccaaagttctgccgatcccaaaatccatgtgctttaggactttatgcc

SEQ ID NO: 3197 - DNA, 615 bp, Sorghum bicolor
  Clone ID: SORBI-28MAY03-CLUS53386_1
gctcagggtagcaagagattatggcttggttgacaaacccagtgtgacaatccctatgagcttatggtgggtggtccctcaattcattctgtctggcttggcagatgtgttcacaatggtcggcttgcaagaatttttctatgatcaagtcccagatggtttacgcagcttggggcttgctctatacttgagcatatttggacttgggagcttcatcagtagcttccttgtgtatacaatcgacaaggtaaccagtagggaaggagacagttggttctctgacaatctaaaccgagggcaccttgattacttctattggcttttagctgtgctcaatgttcttggcttggctgcatacctgtatttttcacaagtgtatactcacaagagaaagggtgttttagcacagtgattgtctggtaactcccatcagggataaattgtgcctgagcaatgcatggggatgcctctctctctctctatttaattttggtggaagttcagcaaaagccctcaggctcgaaggggggttgcagcttgttatattgttgtacaatacctatcatgggagagaatactgtctgtcatggacacacttgttgtactatttttttc

SEQ ID NO: 3198 - DNA, 722 bp, Sorghum bicolor
  Clone ID: SORBI-28MAY03-CLUS53396_1
gcacgaggctcttcccgaccagaccaagcacgccaccgctcccgtcgtcctcctcccgaccgtctcactctcactcccgcccccacctccgcatccgatctccaccaatccctaattatccagcggccttgcccgcgtcctctcggatggaggtcgcccagggaggggcggaggagccggccatgaagctgctgttcgtggagatgggcgtcggctacgatcagcacggccaggacatcaccgccgccgccgtgcgcgcatgcaaggacgccatcacctccaactccatccccgccttccgcggcgggtccattcctggagtgaacaccgaccagatgaagctgcagatcaagctcggggtgccgaggtccacgcagcacttgctggatgctgagagagtcaaggccgtcttcccctatggcaagataatcagctttgaggtcgttgacggcggcatgatctgttcaagcggcgtgtgcctggaagcaatgggggataagaacgatgactgctacattgtcaatgctgcagtttatgtcggctactgatgaaattccggaagagttgctttcacctggtacctggaacagtagagattggttatggctcctcaattttagaaaactgctcctactacagatgatttcgtgccgcaataataagccaataagcatgcagctgctatcagcattcccaattcaaaaaaaaaaaaaaaaacccac

SEQ ID NO: 3199 - DNA, 1212 bp, Sorghum bicolor
  Clone ID: SORBI-28MAY03-CLUS53438_1
gcacgagggcgtgtgaggacttcagtaacattgtggcaacctatccacagtacactgtctacaagggaaccttatcaagtggtgttgagattgctgttgtatcaaccatgattacctctagcaaagattggtcaaaacattcggaagggcgattcaggaaaaagactcactctcgcgagtcaaccataagaactatatcaacctgcttgggtactgtgaggaggaagaacctttcatgaggatgatggtgatggagtatgctcccaatggaacactatatgaacacctccatgtcgagggatttgatcctattgattggaatggtagaatgagggtaattatgggagtagcatactgcaccctacacatgcatgagcttagccctcctataacacacccagacataaagtcaagtgctatattgctatctgaggatggagctgcaaagatagtagacatgagcgtttggcatgaagtatattccagaggaaacatgcccaaggatgacgacttagttgatcaccatgaacgagtagctgccgatccagctgggaatgtctacagttttggtctactcatgctggagatcatctcaggaaagcctccgtattccgaagaaaagggttccctgtcgaacttggctttggagtgcattagggataaccggagcatgtcttgtttgcttgatcctaacttgaaggatcacaaagaaaaggacctagaaatcatatgtgatttggtccaggactgcatccaaagcgatccgaagaagagaccaaccatgagggaggtcaccactagattgcgagaagtactgtcaatttcgcctgaggctgcgacgccacggttatctccactctggtgggcagagcttgagatcctttcagttgaagcaagctagcaaaaatgttctttgtttgcagcaacaccgaggtacttgcattgtgcatactgtaatgcaaccctgtacatccctgttgtatgtttccatcttgtgttgtaactttggtgtccgagtgttacatttttccctccccagtgaattcaattacctgatttaattttctcatttcttcctcgctttccctctgtatactaaacatacacggtgtgaaagtagaatgcttcatgccaccctaggactgattgtaatcaggaaatgtgtaaggttctatggttttacataaaactatattctttgattgttgatgg

SEQ ID NO: 3200 - DNA, 930 bp, Sorghum bicolor
  Clone ID: SORBI-28MAY03-CLUS5391_1
gcggctccgggtggcgctcggcgcggcgcgcgggctggcctacctccacgagctcgccgacccgcccatcatccaccgcgacgtcaagtccagcaacatcctcatggacgagcacctcacggccaaggtcgccgacttcggcctctccaagctagtgtccgacagcgagaggggccacgtcagcacacaagtgaaaggaacactgggctatctggaccctgagtactacatgtctcagcaactgaccgagaagagcgacgtctacagcttcggcgtggtcatgctggagctcatcgtcgcgaagcagccgatcgagaagggcaagtacatcgtccgcgaggcaaagcaggtgttcgacgccgacgacgccgagttctgcgggctcaaggacatggtggacgcaaggatcatgaacaccaaccatctcgcggcgttcggcaagttcgttcagctggccctcaggtgcgtcgacgaggtggccacggcacggccgtccatgagcgaggtcgtcaaggagatcgagatgatgctgcagagcgaggggctcagcagcgcctccacgtctgcctcgacgtccgcgaccgaattcgacgtcaccaagggggctcctcgccacccgtacaatgatcctctccccaagaaggacaaggacgtgagcactgactcgttcgactacagcggaggatattctttccaatccaaggtcgaaccgaagtagctgatttctggattgagactatcttcttcgttcggccttttccttcttccccagcaagtggctcgacgaaatgtagagataccgacaaccttttttgttattgtattttgcttaatatttgtgggagactagtgattctgtatggttactaggagagacacatcaagagcaaacccatctgcctctaaagtgctgctagctgttgtttacgg

SEQ ID NO: 3201 - DNA, 635 bp, Sorghum bicolor
  Clone ID: SORBI-28MAY03-CLUS53919_1
aaaaaaaaaaaaacacaatcgactcggctaatcattcatcgccgttcctcggttctcgcccgagttcggctattcctcgccgtcttcctctttcgcctccgggctgctagcatccaaccgacaacgcggcgcatggcgttggttgctggcggcggtatcgacaagcccccccccccgccctcctcagcccgctccccccaccggttcgcggcctccgcatcgctgcgccgtactccagccacgatgacgagcgtgcgcccctcatccccacgggcacgccggcttcctccacctccgcctcctccgacccagcgccgaccaccagtttcccgggggcgacagcagcaaagcagtggagcccgttcacgcgcgtaggcgacgtgttcgacacatgggccaagcaggggcacgaggaaccatacgccgacatcgacattgagatggcattcccccctcccgcccgccccctccccgccgctgcgccgctctccggccacgctgccctgccgccgccccccatcccccccggcgccccgggggccgccccccccgcccccgccgcccccaaggattctggtgctggatccagccagcctgctgctagctcctccgtggccagtgcacctgggcagtct

SEQ ID NO: 3202 - DNA, 611 bp, Sorghum bicolor
  Clone ID: SORBI-28MAY03-CLUS53950_1
gcacgagggtatctgggaacggagggcgctgggtgaccgccgccgcgctttgccggctgcgaacaccgtcagacccttacccttgcgctaggcacgtcaggcggttgatgacgccgtcgcagcagcagcaataagaggaggcaggagaagatcctaattcatccttgttggagcagcaatatgaggagaagaccacacaagacgtattcagaatttcagagaaggaagcacacctaggtccaagtggtttagttccacttcaggtaacttgaagatgattacatctaactgtacaagttcaattacatgctacaacttatatcatatagtgacaaattcaaatgcatactgtttacagataatttacatcactgtcaacacccaaaactgtacttcttaccagccatatcaactgataggagggcctggagtgttggtcttttgcttcttttttccatctagaagtaatttgtcaactcaatgaagttgttctagcatatgttttgtttgaccattcagtcatcagctgacaggagggtctggactgcatattccattgttggtcttttgcttctgtcttcctccaagcaggaaactgccaatttgattag

SEQ ID NO: 3203 - DNA, 654 bp, Sorghum bicolor
  Clone ID: SORBI-28MAY03-CLUS54004_1
tcctagcttcctcccccaatccgcccttgggcttcgcgcgcgggggcggcggcggcggcggctggggaaggcaggaatcccggcctttgcttgcgcgctactccgggcaccggctgctgctcgctgaaatggttagccagtagtatgtatgtgcattctgtatatatacaagagagcaatcatttctgtggaaaatggcattttcagtctgagtgttaaatagggcggcgtaccttgtggaaaggggtcgaattgtaatctgacactccacatctccagctgaacaaaatggcttccaacggtaacggaaatctcaaagctgacattgaaccagtagagtcaatagcttcagacaatgttccaggagcaacaggcatcaacaatcttgccagtcagggtgtttcagaacgtggaaagcggtggagtgggtttaggaatttctggaaacgcctttgtactggcccccagttaaagaagtttggttcctcaacttcgttcaggtttcaacagatcgcaattcaacgggatgagttctcacgttcgatccattcggacaaccatgttagccatgagcatttccagtttatcaggaggattaattgggaacagctgtggctgatggccaagaattggataaaagagcctatgaatatg

SEQ ID NO: 3204 - DNA, 589 bp, Sorghum bicolor
  Clone ID: SORBI-28MAY03-CLUS54047_1
gcacgagggagctaatcacgggcacggggcacggccctatctcttccggaattccaaatgcccttggtggccgcacgacgatgggagctaactaggattcaggccgtgagcctgtacttcatggttcggggcttcgggcgggacaaccaaactccgaccagccttcggggtcgcttggtacgccgctgcccgctggcccgctgctgtggccgtcggctcgacggcgcctacccttgtgcctgttcggctcttaccagcgaaagatggatgaagcatctggatgagctgctgcatccacatccggtgaaagcatcatctcccatgctgtttctgttgccactcgagaatcgccgaacggagcgccctgtttggggtgagcttgcggtgtgcaagtctcagggtggtcgtcggcgatctgctcgcgcccccgagcctccccctgattgcttcggcttcatatgtgaacccatctgccgccattgtggatgtggtgaatcagtacagtacctgaaaaattggacagatgaagtacgatggaggggaagcatcttctgtcgatgatgcaaatcgagatggtccggtggtcagg

SEQ ID NO: 3205 - DNA, 827 bp, Sorghum bicolor
  Clone ID: SORBI-28MAY03-CLUS53559_1
ggcgccgttactttgaagaaattagagtgctcaaagcaagccatcgctctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaagaacgaaagttgggggctcgaagacgaagcaaccatccagcctccatggcatggtgcaaacagccccacaatagtgaactccacgccgcccagccctggcccctcccttgctccaacactcagacgttcacatgatggacgcggtctccgacgagtttgcgtttgggagcagcacgaatggcgctcagcaggctgctgggctagtcagggcgtgggaaggcgagcggatccatgaagactctggatcagacgacctcgagcttacgctgaagctctagagcaggccgggtgggcgctgatgcttaacatcgctaacatgaggaattgctgctgttgtttttagtgtacttgttattgtttagttcctgatgatggaggcctatcatatggctccaggatagattcacttgtgttgatgataattgtggtgttatttatgcttggagagagcgcagtagaggtgaaagacttgataggttcggggcaaaattagctcaaaatgtagcccggagccgcattcagctaactgacggtctcaagttggctgttgcatactgtgctgttgttgtgacaactgtaaattaatgtcagaa

SEQ ID NO: 3206 - DNA, 604 bp, Sorghum bicolor
  Clone ID: SORBI-28MAY03-CLUS53580_1
aaactggagaccttaggctgtcttgatgatgaatggtttcttcatcgcaggcttgtatatgacaccacatctattcagggattaaaagttgttcggagaggctcgacgttcagggagattgaatcgatggcgtcgtaaatacaaggatttcattaaaagttttgatatccctctcaagacaatagtgttgaagcagtatcgaggcatcagatcacaagtcaattttgcctcattctttctactgaatgcaagagagttagagtcaatgagactcgaagttggagccagtgactgcaatgaggctttttttgcagaacaatatgcgatgcttcagatggagaaaagggcatcgagaggtgcacggttacattttataaaaaaattatgtacccatcctatgtatgttgatcatgtccgtgagttgtctgtagcagaccccttcgaatgtagatgttagaattgctctaggtcgttcgccctgggttggccactctcattttgtatttgtcggaacaaccatttctcattattgtagtgttttgattatctgttaactagaagtttgggatatttaaacaaaatatgctcgttcttagtttatggt

SEQ ID NO: 3207 - DNA, 638 bp, Sorghum bicolor
  Clone ID: SORBI-28MAY03-CLUS53592_1
gcacggccactccatcggtccatccagccccagcccctagcggcgcacccaagcgagcggcggcagaccacgcgagcgcaagcgcgactgcggcactgcgcactcgaacagcagccagcaagtagcaactcggtggatccaccattccaccctgcgtccaggactccaggtctccagtctccagagtccaggcatcgacgtccaccctgcagcatagcagcagtgattctgcggtccgcgtgcagccgtccatgcgcagccttggagattctgccgtcctcgcacagctgttgcaggtgggcctcggatcctcgccgctggagctcacaggtaacatggatatgcctggatctgaatctcccatgagttcggatggagaagaaaggtcagaaactcacaagtcaaatgtatactcgtatatacatctattgctattgctagttctggttccgtcattccgtgagacaagtcaaatgtatactcgtatatacatctattgctattgctagttctcgtgacacatgtattgctagtttttgttcatacgtgatacatgcagtgcagtattgctagtttagttcttttttacttttgttcgtggctgcgttttcaaatattgactaacccacgtccggcgg

SEQ ID NO: 3208 - DNA, 510 bp, Sorghum bicolor
  Clone ID: SORBI-28MAY03-CLUS53604_1
gcacgagggaacaactagcttgctagagagagatgccagagtactgcgtgactggtggcacgggtttcatcgcggcgcacctcatccgcgcgctgctcgccgccggccactcagtccgtgccacggtcagagatccagaggatgaaggcaaggtcgggtttctgtgggagctggagggcgccggcgagcggctgcagctggtacgcgcggacctgatggtggaggggagcttcgacgacgccgtgagcggcgtggacggcgtcttccacacggcctcccccgtggtggtcgtcggcaaggataacaaagacgtccaggagacgctggtggagccgatcgtgaagggcgcggcgaacgtgctgcggtcgtgcgcccgtgcggcggcgcccgacgagcgcccgcgccgcgtggtgttcacctcctcctgctcctgcgtccgctactgccacgccgccacgctcaacgagtcgcactggtccgacgccgactactgcaagtcgcacgacctgt

SEQ ID NO: 3209 - DNA, 732 bp, Sorghum bicolor
  Clone ID: SORBI-28MAY03-CLUS54196_1
gcacgaggaacacacagagcagcatcacactcctctgctctgcctctgcagcaccactaagaaagcgcccaaagaaacagctcagggcggcgatcgctatggctcagggaaggggcagtgcgacgcgggggcttgccctcggcggcctgctcgccgtttgcctcctcctcggcgtcgccgacgcggccacccacagggtcgactggtccttcaacgcggacggctggtccaagggcaagagcttccgcgccggggacgtcctcgagttcaactacgacccctccgtgcacaacgtggtggccgtggacgccggcggctactacggctgccggccctccggcacgtcgtacggctcggggagcgaccgcatcacgcttggctccggcaccagctacttcatctgcagcctcaacgggcactgcgggatggggatgaagatgatcgtcaacgctagctgagcatgcatatgcccggccggccatgcgcatgaataagtgctgctgtgtcatcggtgggtccggccgattgatcgtgcaagtgcaagaactcaatcgtgtggtgtggcagcggggatataccggttcatgtgttttgtatgtatgcgactggtaggtcaggaatgatgtacgtgtgggtaatgggcatgcatgttagtaaagcgtactgcagctttgttgtttgtttatcgaagccagtggcctcttttgtttgtttagtgagatactggttttg

SEQ ID NO: 3210 - DNA, 580 bp, Sorghum bicolor
  Clone ID: SORBI-28MAY03-CLUS54199_1
aaaagtacacgcgggtggaaggaaaggtggttcacacagaacagcaccatatcgaaccttggctcagagatgaggagggaggtcaatgctgggatcgctgccgtgtcacgcatgatggagaaactggagacacgggatggaacaggaccgtcgtctgcttccccagctaatctgcatcctggttcagatgcagatagtcaaggagctgtcgtcgttccccttccccctacagctgcaactgctttacataacgcctcgtcttcaacagcttgaatgccaagatcatgttctcagtgaatgtatgcttgtatgtatgcttgcactaaaggagacgtacttcgcagcgtgtcgcgtgtataatcggtttgtcacttgctcattagtcagcgaagcagatgttacatgccaagttactggtcggtggtgctttcagaataaagttgtagtatgtgcataaccgggagaacatgacaatgttttgataggcctatattcctatcatatgtcaggcatcgtatagtgtactgctgcattagtgtgtactatgatgatagagtgggaaaacagcaatcggtacagg

SEQ ID NO: 3211 - DNA, 644 bp, Sorghum bicolor
  Clone ID: SORBI-28MAY03-CLUS54221_1
ccagaagctgaagaaactgcttgagagccaaagcgccaatgaggatgacaaaccatctgatccaactcaggatgatcatccaagcccaatggagtttatcgcaaagcagaagatggagagaaccgcgaaactgaacgagctgcttggtaagctgacaagagcacggagcgaggatgatctgaagccttgccgtgatcttattgagcagctgtttgggaaggagaactgtgcatctgtggacaagccagacagaatggagacggaggcgggcgatcaagagccgactgcagcagtagcacggccttattccatcccaaagttgtgcactaggatggaggttgatgaggacttggcctcaaagatcaatgatgaattgtcctcgttgggtcatgtggtgcagctctgaatctgaaatctgagctcctttgatgtgtactaactaggctcaacagtgttattcatccatgtgctggcctaagcaagtgtttggctgtttgaagtgaggccaaagcagcgtggcaactagggtgacgctgcgttttcttgtatcctgtttcttgtcctgtatttattcaattattctggtacatgaagtatgaatggatagaaaagaaaatgtcgcatcaaaggcctgtttagttctc

SEQ ID NO: 3212 - DNA, 496 bp, Sorghum bicolor
  Clone ID: SORBI-28MAY03-CLUS5423_1
ggcatccgccacacctcctcctcctttctctccccccccgttaaaccccacgccaccgcccaccgccgacgcgcgatggccgccgccgccatgcgggtggtgcgggacctggacctggagcggtacgcggggcggtggtacgagatcgcgtgcttcccgtccacgttccagcccaagacgggcaccaacacgcgcgccacctacacgctcaaccccgacgacggcaccgtgaaggtgctcaacgagacgtggaccgacggcggcgggcgccgcggccacatcgagggcacggccttgcgcgccgacccggccagcgacgaggccaagctcaaggtccgcttctacgtgccgcctttcctccccgtcttccccgtcaccggcgactactgggtgctccacgtcgacgccgactaccagtacgcgctcgtcggacagccctccaggaagtacctctggatcctttgcaggcagcctcagatggacgagtccgtgtaca

SEQ ID NO: 3213 - DNA, 657 bp, Sorghum bicolor
  Clone ID: SORBI-28MAY03-CLUS54246_1
gtattgtgatgattggtactcttactggagcccagtggggtatttatgatgcattcaaagtcatggttggactgccgacaactggaggtgtcacgccagcaccagctcctgctactgaggaggctgcattgaaggccagtgcatgatctcgatattaagatataactaaacaatcattcttcaccgagacaactgtatgcattcattacatgagttcaaccctacttatacgttgaatgttttagaggatggttatcttctgaacgagagcaactttctaagccgggaatcatagcgttctgctcaagtgtactgttagtgcttgtaataagttttaggtgggtaaattactgttaggagcccaggttttccccctgaggcaaggtttattcatggtacactgcctgaatgcccttctgccattcatgttcccgaaggagttattctgtcaattttgatatacagtcatgcaagtgatgggaagattcaagcagtctgtttcagtaagatgcttttgtttttcctcaatcaagagttgcttgtgcattctcattaaatcagcattctgttgtgctagctacttgtggcaagcatgctctagttcatatcttcgataaattctctgtacacttattgaagctaaagatcccttgtgtt

SEQ ID NO: 3214 - DNA, 399 bp, Sorghum bicolor
  Clone ID: SORBI-28MAY03-CLUS5427_1
gcaagaagctgttctccaactcgcccgaggggtccaagcttgtcaagaggagcgatgaaaccgtgctgtcagggcgtctccacttgggtgatgaagatgaggggattggtgtatcaagcttcaaggggagcagtgactacagctgtgcgtcttctgtaaccgatgaggaagggcgtgagatgaaggcgccaggtgtggtggccaggcttatgggcttggacgccatgcccacctcgggtgttccagagccatactgcacaccgttccgagacacaaggtcgttcagggacagccacagcctcaagaggagccctgagtactcaatgaatgaccagttcggtcatgttcctcgaagagttgatggctatatcaggaagccattggatctcagagcaccca

SEQ ID NO: 3215 - DNA, 509 bp, Sorghum bicolor
  Clone ID: SORBI-28MAY03-CLUS53856_1
gcacgaggcaggagccaaaagcccacgaagcggggtccgctcaccatggacgcagcggcagagcccctcctgccgcagccggcgacggccctggaccacctcggccggccggtctcccgccacaccaccggccggtggtccgcagccgtcttcatcatcggggtggagatctccgagcggttcgcgttcgggggcatctcggggaacctgatcacctacctcacgggcccgctcgggcagtccacggcttcggccgccgcggccatcaacgcgtggagcggcgccgcgcttattctgccgctgctcggcgccgccgtcgctgactcatggctcggccgctaccgcactatcatcagcgcctccctcctctacatcctggggactgggtatgctaaccttatcatcaatttttgtgccacaacaaccggcacaatttggagacagcataggttcctccatatcctcgatgggcatccatttagcgttcttctatgtgtcactttacatag

SEQ ID NO: 3216 - DNA, 576 bp, Sorghum bicolor
  Clone ID: SORBI-28MAY03-CLUS53844_1
gcacgagggagtactcaggccaaaaaatggtgcgagaacttgaaagtgatccccatcttttctcatgcatcctgcccgagggcaatttgaaggtcaaagaaatataccactttactcaagatgatctaatgacagaagatgttttcattctggactgtcacacgagcatatttgtttgggttggtcagcaggtggatgttaaagtcaggttacaagctctggatgttggggagaaatttattgtgcttgatttccttatggaaaaccttgcccgtgaaacaccaattttcaccgttatggaggggagtgagcctccctttttcactagattcttcacctgggacttggcaaaatcactgatgcatggcaattcataccagaggaagcttgccattgtaaaaggtggaggtgctccagcactggataaaccgaaacgacgaacacccgtctattcaggaaggagtactacacaagataaatcccaacgctccagaagcatgtccttcagtcctgagcgcgtccgtgttaggggaagatctccagcattcactgcattggctgctaattttggaagtt

SEQ ID NO: 3217 - DNA, 666 bp, Sorghum bicolor
  Clone ID: SORBI-28MAY03-CLUS53861_1
gcacgccggtcggtccagtccacggtccaccccctcgaccaaaccctggaatcacgccgccgccccactcgccgcccccgctggtccatccccccttccccaaccccactcctgacctcgagcgacggggatcgacagcgggcgcgcgagcccggccagcaacctgatctgcggcgagggaccaccaggtgtgaggcggcgagatcgacgacgggctcggttcgattcggctgaacgctgagcaccggcttagctgaggcgggcatcggcggcggagagactttgcgcggggcggaacgctgaggttatcttgtattcttgtcaagacagaactctcttgtccctcagggcactgagcaatcattgtgttttatgactaactgttggtggtgaaattattcagaaagtagagaacaccacgatggctgtttggtgctcttgtagtgctgttctcccagtcctcttctgtttcatgatctgtcagctttgctatggcacagtaactgatatccagtgtctgaagaagctgaaggcatcagttgatccggacaataagttagaatggacattcaataacaacacagagggatccatatgtggattcaatggtgtcgagtgctggcatcctaatgagaacagggttctttcgcttcatcttggtagctt

SEQ ID NO: 3218 - DNA, 616 bp, Sorghum bicolor
  Clone ID: SORBI-28MAY03-CLUS53906_1
gcacgaggaagaaccctattgagccaattgtgtacccaccactcaagagtgttgggtcccatgctcaagctgaaatctctgctcgagcctggaatcccaagtttcaacatatagttgcttcaacttcgagtaatgggatgacagttgtttgggatttaaggaatcagaaaccactgactagtttttcagattcaaatcgaaggaaatgctctgttctccaatggaatccagatatgtccacccagctgattgttgcatcagatgatgacaactctccctcactgagagtttgggatgtgaggaagaccatctcaccagtaagagaattcgttggccattcaaaaggtgtaattgctatgtcgtggtgcccctatgatagttcattcttgcttacatgttcaaaagacaatagaacaatttgctgggatactgttagtggagagattattagtgaactacctgcaagtgctaattggaactttgaccttcactggtaccggagaataccaggtgtcattgcagcatcctcatttgatgggaaaattggcatatacaacctagagttctctggtctttatgctgctggtgatgctgttggtgccccagcacgtccaag

SEQ ID NO: 3219 - DNA, 531 bp, Sorghum bicolor
  unsure (1)..(531): unsure at all n locations
  Clone ID: SORBI-28MAY03-CLUS54302_1
ctctctctcttcacactcgcctcgcctttaaacgcaaagctccaaaaagaaaaaaaaaaaaaagaaaacactttgtgncggaaaaaaaattcatcttctctctctgctcctatccccatcccctcctaaaatcttccatctcgaaccgtccctgtccgcgaattccttgccccccgatcgccgccgattttttttcctggattttctccgatttttcgaggtatttttcggtgcggggggcggttccattgccattcctcgacgggggttgccgggcggctgggcggcggcgcgggggcacggggaggtgtcggacgatgaggctggggccgcggcggcggctgtgactgtggccggggagacggtggtgccttcgtccccgccgcccgcctccgctgcggggcagcagcagcagcagccgcagcagctggtggtggggtacgctctcaccaagaagaaggtcaagagctttctgcagcccaaactgctcgcgctcgccaggaagaaaggcattcatttcgtatcaattga

SEQ ID NO: 3220 - DNA, 615 bp, Sorghum bicolor
  Clone ID: SORBI-28MAY03-CLUS54391_1
attttgggggcgacggcgatcgctatgctattgcgtgctgcttggagttggccggcttgggggtagccgccacactactcgcccaggccgatttccctcccgctgccggcgttcgtgttgcagggagagagagagagagagagagaaggagggagaggtggggctcgacgcgggggcgtcggcggcgcagatggagaagcactcgtcggcggcggccttcgtggagggcggcgtccaggacgcgtgcgacgacgcctgcagcatctgcctcgaggccttctccgacagcgacccatccgcggtgaccagctgcaggcacgagttccacctccagtgcatccttgagtggtgccagagaagctcccagtgccccatgtgttggcaagcaatcagcatgaaggaccctatgagccaagagctccttgaggctgtcgaggaagagcggaacgcacaagaaaatcatgcgcgcaccacaaccattttccgtcatccactgctcggagactttgaggtgcccgcggtcgcagtggccgcccagtgtgggcagcggctcgccctccgcttggctgctgctgccgccgctcgttgcccgcaccgccacgcttgccatgtttc

SEQ ID NO: 3221 - DNA, 623 bp, Sorghum bicolor
  Clone ID: SORBI-28MAY03-CLUS54308_1
ccgggccgctggtatgcggcacggggaggttctcgggatcctcactgtccgtggcctgcgcttccgccctgtccccaagcccgtggcccctctccgcgtgctgctgcctcttccactggctcctggcgtgctcacgcccgtccgcgctccacgcctcctggcccgtgcgccacgcttcgcgtgcgcccccggagctggcctcgtcgccctcgtccgtccacgcgttgcccccgcctccttcggcgtcggccgccgcgcaccccccgtctctaagcactgcctcgctaactctgcaatctcctcgagatactcgagattctcactattcttgatctgatcatccacgatatcctcaagcttgttttccttcatcgcatacagaaacctcatcgacagactcctgtcattctcaggtccttcgaggttgaacgctttcttgcccgtgagcaactctagaagaacaactccaaagctgtacacgtcgctcttgtccgtcaactcgtatgtctgcatgtactccggatcaaggtatccgcacgtcccttggacaaccgtgacaaactgtgacttgtcatttggcgccaggatggacgcgccaaaatcggagactttggccgtgtagt

SEQ ID NO: 3222 - DNA, 607 bp, Sorghum bicolor
  Clone ID: SORBI-28MAY03-CLUS54415_1
gcacgaggcgtcttctccttcgtcatctccttgttccacgccaccccgaccgccgctgccacctcgtgtccttgctcgtcgccggcgaggcctcctcccacccaatttccttgacgagaggcgctgctctcttccccggcccgcgcctgaggccttgcctgccgtcgattttggcctaaaatacacttcagcactcagattttgaaggcccaatctcgagaaaaagccccagccctaataactctcaactcccaagccgtcagcgtcgacccccgcctgacgcctgttcgcccgttcttcctctccccggagcgagatacgacgacgtgccgccgccagctgcctccgcgcgaagacgacgccacacgcaccgctggtaggcgcgcagccgtagaggggactgccccggcccggccgattcccgatctgctactctcggattcccccgtcgccttgcgggctgcggccgccctgcgctttgcgggctgcgtccagcggaacctcacctctcccagcgccccgcagggtagtctgactctgaccccagcgtgtgacgcgcctccaggcctgcagctgaccccttgccaactggttcctgtttcgctgg

SEQ ID NO: 3223 - DNA, 414 bp, Sorghum bicolor
  Clone ID: SORBI-28MAY03-CLUS54418_1
gcacgaggtatggataaggctgaagatgcagaacctacatgtattagctctgtgcagaaagaaactggccataaggtaatggatgccttggagcagcaagatgccttacttaaaaagacaaaatcactgttagtgccatcagtcttgaaccaccatgatgacattccaggagaagccgacaactacatggatgcacttaatacacttgaatctgagacagaaactgaatctgaatttcaaactaagaatcaaggggtgccagcaccttccttcaatgctgaagcacctcaagtgggggcaattgataatattgttccacagtgtcccgattcctatgttgctgattttactgacacatgtcaagaatctggtattctttgtgcttcagagagagcaattgattttcccagtttg

SEQ ID NO: 3224 - DNA, 421 bp, Sorghum bicolor
  Clone ID: SORBI-28MAY03-CLUS54430_1
gcacgaggcttcaaagccatctcacctcattatattgttcgcttcttcctgagaaataaaaaggaagggtggcgcatgctcggtggaactgttctatgcatcaccggtgctgaagctatgtttgcagatcttggccacttcagtaagaagagtattcagatagcgctcctggctagcatatatccttctctgatcctcacatatgctgggcaaacagcgtacctcatcaacaatgttaacgacttcagtgacggattctacaaatttgtccctcgccctgtttactggcccatgttcatcatcgcaacgctggcagcaatcgtcgcaagccaatccttaatatctgcaacattttcagtcatcaagcaatccgttgtcctggactacttcccacgcgtcaaggtggtgcacacgtctcagc

SEQ ID NO: 3225 - DNA, 428 bp, Sorghum bicolor
  Clone ID: SORBI-28MAY03-CLUS54080_1
ctcaagctcagcgctgaagtacacaagagcccgcaacacgcccatgactttgctggggtcaagacccgttgagcatgcgagtgccatagatctggcgaagcaaactctgccagagggaaagacccagtaagataagtcaagtacgaccatcatataccatgtcagtgctgtgaaataaatgagacaccagttttgctgatcgattttttttctcacgtgaataaagctggaaacaataagcagagcagtgctttcatatcagcacatatttttctaatattgttgagtggtattggtgaaaattgggaattgtatgattttttccccttatgaataaagcctgaatgaaacaataagattagcctttttttttcaagacgtattctgtaagactaatgtaatattggttggtgataaattttgtgagc

SEQ ID NO: 3226 - DNA, 621 bp, Sorghum bicolor
  Clone ID: SORBI-28MAY03-CLUS54077_1
tgcccgtaccttcacagcaagtgagaccaggatagtggcccctcttgtgcagcttctcgatgagcgtgagcctccagtcataaaggaggctgttgttgcgctcaccaagtttgcgtgcactgagaaccacctacatgtgaaccactgcaaggccattgttgatgatggtggtgcgcgccaccttgtccagcttgtctaccttggcgacgaggtgcagattgaggcgctcatactactctgttacattgcactgtatgtgcctgagagcgaggaactcgcacaagctggtgtgctggctgtgttgctttgggcatcaaagcaggctcacatggtgcaggacacgcgtgttgaggtgttgcttccagatgccaaagcgaggcttgagctgttccagtccagggcctccaggtgatgttggagacgggatcattggacatgggttagtagttctttattgcaatgtgtaattagagtagaattatttccatcatccgtaattgctcttgtgaggtatgttacattttaggctgtacatatgaagtcatctatttgtctatgaaattggttggggttattgaattataaattataaattcacgagacattgaaatagaacatatt

SEQ ID NO: 3227 - DNA, 737 bp, Sorghum bicolor
  Clone ID: SORBI-28MAY03-CLUS54087_1
acccaggggtcaatgaattggacatggaggtggatcgacatggtgaccccgatgatgatgaggtttatgaatacgactaccattttgggggtgttccgttatttgggtctgctgggactgaggccagcaatcccagttcttcacaggcacatgctgatatgatcaatattagagactacactgttagcactaccaccggcggttatcatcatcaagagtttggctactctggcacgagacctaattataataggggacggcgtggtcgccgtaaccgctcaagggcgtcaacagatcaccttttgagcgctgatgagatgatggtgatgccgggcagcagtggttttgtacataataataatggcagcagttctaatgttagtgcaggcgctgcttttcagcctaatcatggctggactgagagaagaggaagaagcaacaggaactcgaattcaggtggtggaagaggagggatgcaggatcgcaggagacagaggacacattacaattgatagtgatgttgggacatgcttggcaatagcattgatgagataaacaaacttgttaatctgtcatcttcctttttttttcgttgtttgtcttaatccttttgtagtccgtggctataaacatgttgttcatctttttctcgccttttaacccagaaatgctttgcttggataatgttgctactttttagtaccatcatctatatatctgttaataaggcattggcc

SEQ ID NO: 3228 - DNA, 648 bp, Sorghum bicolor
  unsure (1)..(648): unsure at all n locations
  Clone ID: SORBI-28MAY03-CLUS54162_1
gtctgaaaaactgcctattgaaatattctaacatcctatgctgctaccaccttagatgggaattcttcctgcccagctttgtcatgtcagtagttgcctcattcttccatcatcaggttcgaaagagttgcatgtttttctgcagtaattaattctactgtggaaccatatattaatataagttctttccaaaaccttcatggtaaccatacattattcagaagcatctatcccaaaaagtccctgaaaccctctatcaaagtaaaattcgccccatccttcacctgtgcagttaccctttatgcattttgtgataacaatcaattatgacaccatcaagtgtaaatgttgtagtgtgtcataatgtctgttaacaaattgtactagagtttgttgttttgttaacagctgttgtggttgctctgagctgtcttctgtaaataatgagcgttcatgttgaaattttgtagtganagtagaatgcncatgactttttcccccagccgttgcgattgatgccttgtgcatatgttacaatagaatcctatgtgctgcttggttatctcttgcatttgtgaatggtataaatctactgctgttctgcatgtgtattggtaaaaatcaaggtgatgtcttgagatttctttg

SEQ ID NO: 3229 - DNA, 465 bp, Sorghum bicolor
  Clone ID: SORBI-28MAY03-CLUS54187_1
tcaatagatgcaaaaccaggcagcagggctgatgacagtacagcaagttggcagtcactcccagaacagaacaaaaccaatacggcgcttcctgagaacaccagcatggatgccccctccccatgaataagaacatatcacggttcaatcagctagaaatgtgttgaaggggtcagcataggatagaagacgggcattcattttcttgttgctattatacatatatatatgcccctgtgacaccatagcagaaactgctgtacgaggctttgactctgccaaaaccgatcttttgtagttgagatagcttgtacattcttgccataatttaaatgggctcctgtagtttgccttttttttcccctagtggtgctgctgctgcagccgtagcagctgtgacacacttctaatcttaaagttattattaggcattttatgtgttaatgaaatgtctgtcgataatgg

SEQ ID NO: 3230 - DNA, 527 bp, Sorghum bicolor
  Clone ID: SORBI-28MAY03-CLUS54606_1
acgccaagctctacgagaagtccggcttccgctacccactccagatgccatacaggtctttaccaagatgccgaaccggctggacgccaagttccaggcgccggtgttcatggtgatgggggagaaggactactgcttcaagttcccggggttcgagaccgccatgcgcagcggaatcatgaacaacttcatgccggacctcaagatcacctacatcccggaggggagccacttcgtgcaggagcagctcccggagcaggtcaacgagctcctcctcgacttcctcaaggccaagggccaccccgtcgcatcgtgagaattgattggcatctgttgccatcggatgatgcttggccctggtctgaattttctttatgcgtcttgttgaattgattgatttggggatgctgtactatctcaactcgcgattatgttggagcaatttgcttgacggacattattggtgcttcgcctgtgcagtgaactgatggaaagaatgaaaatgaagtgtgaagcatctcggttct

SEQ ID NO: 3231 - DNA, 701 bp, Sorghum bicolor
  Clone ID: SORBI-28MAY03-CLUS5465_1
gattctggttatggattggctggacttgttgttgcagccagtacaaatgctgacgaggttgttatttctgatggcaacccacaagtagctgggtaagaacataaccctcaacgcaaagacttttggtgagacaaaggttaaatctatgatactgcattgggacaaagagcaagcttcagaaatattgaatacttttgacatcattgttgcaagtgactgcacatttttcaagcaatttcatgagggccttgcccgaacagtcaaatccttgctgaagcattcgacaacctcacaagctatcttcctgagccccaaaagaggcgattctctagacaaattcctgggagtaattaaagagaatggtctgtgttgtgagttgatagagaactatgatccaactgtctggaatctgcacaaaaaatatgtggctggtgaggatagaacctggcctaattatgacaaggagcattgctaccctctcctggttagaattagctattttagtgagatctagtttccttaaattctatttgatcttggatgatccatttataatgtgcattagctatatatttttttttatatatatcccatccagcacgatagtgtaaacctggaggtggatcttggctaaacatttctgaaagttctttgcttttctatggaagtaccaacaaggcagttcaaaagcattcacttgc

SEQ ID NO: 3232 - DNA, 535 bp, Sorghum bicolor
  Clone ID: SORBI-28MAY03-CLUS54674_1
gcacgagggccccctcctagcgctctccctctccccgccttcgccggcaccaccgcggccggaggttctcaatctcaagaaggataaggatgccaaggaggcgcccctgacgaaggaggaggtcggccgggccacgtggatgctgcttcacaccatcgcagcgcagttccctgacgaacccacgaggcagcaaaagcgggatgcaaaggagttgatgcatataatctcgaggctatatccttgcaaagaatgtgctgatcacttcaaggaagttttgaaatcaaatcctgtgcaggctggatctcaggctgaattctcccagtggttatgttacgtgcacaacgtggttaatcgaagccttgggaagccaatatttccctgccaaagagtaactgcgcgatggggtaagctccattgccctgagcgctcgtgtgatctagaaggcaacatcgacatcatgccaaaccgatgacatggccaagaaatcgcttgaactttctaccccacagatgatttgtataccactaatcgatga

SEQ ID NO: 3233 - DNA, 320 bp, Sorghum bicolor
  Clone ID: SORBI-28MAY03-CLUS54676_1
gcacgaggccaatatagtgtgtagacaagacacaagacaacaagcaataactgagtaagatcgaaatggagaactcttactgccgttgggtgcttgtatgttcggttcttgcgctgtgcctcggtagccggggtgcgaggtgtgagctaacaccaaatttctaccacagcacttgccctcagctgtactatattgtgcggcatcatgtgttcgttgccatgagagctgagatgaggatgggtgcctacctactaaggctacatttccatgactgatttgacaatgggtgtgacggatcgatccttttggatggctgcgat

SEQ ID NO: 3234 - DNA, 335 bp, Sorghum bicolor
  unsure (1)..(335): unsure at all n locations
  Clone ID: SORBI-28MAY03-CLUS54677_1
aaaaaaagcacctagagcttggctacaattttgatccaaaggcatacattgatacatggatagcagcagccagcagaagaaacaagacgacgtcgacgtcatggaggtgccggagatccacggcgacctcctcgtcgagctcctggacgcatccctcgccgccgaggacgcaggcagccaacagcttggttcggtggccgacgtcgtcgacggcgacgtctactgttggatcgacagccaccaggagaactacgacatccacgcgcaccaggactgcgaggactgctgcngcctcgacggcggcatactgnccgacttcgacgagtacgggggcg

SEQ ID NO: 3235 - DNA, 758 bp, Sorghum bicolor
  Clone ID: SORBI-28MAY03-CLUS5470_1
cgaccacgaggtggtcgaggtcgaggcgaggcggaatccggcgctggtggccgccgcggcaacagagatagaccgtggaagcaggggtggattgggattggaacccacgtccgtctcgtcgctgcgtcgtgctgcttcagcaggtactgacacagaaaagctgggccttatccaagtggcaagccttatagagtcatcagcaaggaaggggactacagagctcaatctccggggtaagctggtggaccaagttgagtggctccctgtctcacttggaaagttacaggatgtcactgagcttgatctatctgagaataggatcatggcactcccatcgacaattggtagccttagatacttgacaaagcttgacctccactcaaaccagttgatcaatctgcctgatacctttggggaactttcctgcctgattgatcttgacttgcgtgcaaaccagctaaagtctcttcctacatcatttggaaatctcacgagccttgccaatcttgacctgagctcgaatctgttgaaggtccttcctgattgtttaggaaagttgaaaaacttgagaaggttaattgctgagacgaatgagcttgaggagctaccctatactattggatcgtgtacctctcttgtggagcttagattagattttaatcagctcaaagcccttccagaagccattgggaagttggaaaacctggaaattctgacgttacactacaacaaaatcaaaggccttgctacaacaattg

SEQ ID NO: 3236 - DNA, 803 bp, Sorghum bicolor
  Clone ID: SORBI-28MAY03-CLUS57175_1
gcacgagggtcatatagtcacccggttcaaaatcttattaatcagtcaagaaaatatgatcttttcccctttgagaaagttcgagttgagagaagtgggggcgcagactacaagttccaccacagatggtactgtaaatgctaacactgtcgacttccatcctctcttgcggaagcagaagttgatgtgcataatgaaatagcagaacatgataataaccttgattaccatcagtctgataataacatgagcgaagtccctgtagatgaccagtcaacagctgggcaagcatccacaagcccttctgagagggagacaagtattgacttgaacattcagctcggggctccaatggccataaaagatacaaatgacttcagaagtagttttagcagaccaaatgttcaagttgatgtttttaggaaggacaaatcaagtattccagagctcgaggttgtaaattcctattttcatcattgcattcaagaacctaatgaagaatcaatgcaaggaattgtaatggagcaagaagaattaagtgattccgaggaagatagccagcatgttgagtttgaatgtgaggaaatggatgattctgaagaggagcaagttcagggtccagaaacgtctccaattcaaaataagggtatctcagcatcagctgtttttggggaatttcatgttagtactgaccagagtcaaatccagcaaggatctgttcaaaaggataaacagggtgcaagttcgattcagaaaatgcaagttccttctcgttcagtgagggctaagctgaagccggaaac

SEQ ID NO: 3237 - DNA, 619 bp, Sorghum bicolor
  Clone ID: SORBI-28MAY03-CLUS57189_1
gcacgaggattatcttgtggcctgggtcaaggtttgtcggccaccggaactcggagggctgggaatttcagatctcaagtctcttggttgggctctgcgtatgagatgggtgtggctgcaaaaaacagagcctcatcgcccttgggctgctcttcctgtacatgtacctgatcaagtgagagccttcttctctgttgcagtagagtctattgttggaaatggtgcaaacactcttttctggacagatcgatggctccatgggaaatgtattgcagaccttgcccctcgccttttctcggttatccctaaaaggagggtcaagcagcgcactgtccaggacgccctcactaatcatgcttggacttcagacattcggggtgctctcacagtgggtgtctttgctgaatatttccaattatgggatcttttgataggttttcagctacttccagaggttgaagataaacatgtttggaggctctcttctaatggacaatactcagctaagtcggcgtatgatggattctttttggggtctacgatttttggaccatgggaaagaatatggaaatcttgggcactgcccaaatgtcgtttctttatgtggctggttgcacac

SEQ ID NO: 3238 - DNA, 488 bp, Sorghum bicolor
  Clone ID: SORBI-28MAY03-CLUS57192_1
gcacgaggcccaaatcaacccatcggccatggagacacaggtggagcctcaccgtgccaagagaaggaaactaagggttccatccaagagccctggccaggagagtgaagcaaacatctcgtcactggcgcctgattcctatcctcctggagccggaggagacatatccccaatccaagatccgccgcctagagccagagcatagaacaagaagatgggttcgactggaatagcctcctcccggataccattattgatgagatcctctctcccaccccatcaaggatgccgctcacacccaaaccctttccacccgatggcaccatctctggtgctcaggccctctcaaccttgatggcagcaaccccttcaccattgatatcatctcctgcatcctctccacccaccgcttacatgtccccacacaatgcctatgggtcaacccaccactatggatgcttagctccaatcccccgcccttgacaacc

SEQ ID NO: 3239 - DNA, 945 bp, Sorghum bicolor
  Clone ID: SORBI-28MAY03-CLUS57194_1
cctactggaacgtgttggttatttaccccgtttgccactgagtcctccgcaagccatctttcccgacatggcgaaacccacggccacgcacgacacgagacagagatgaggacgacgacggcgatcagaatcagggtttgagcacggacccctccatcgcccgccccaatctcttcctcccccgtcagcaacccttgcagtctctgctatcgtcagcccgcacgcgatcaaagccccgccgcgctgcggccaaccgtctccggcaccggatccgctgcctcccccctccaggatggcgatgatgagccggacgcgggacctgctggtggaggggttcgaggggcttgtgcgggatgggtcgttcaagtggggcccccgccgcggtgacacggccctggacgacggcgacgacgacgacggctccctctccgtgcagcgctcctccatccctggcctttccttcaaggccaccgccgtcgtcgcccgctgctctaggatccttggcgtttctatcaacgatctgcgaagtaactttgataagcaagcatctgattccgtaaagcaacaaagaagctacgcaagaaactttttggagtactgctgcttcatggcacttgctcagatatcacaagtcacagggtatcttgctgacaaaaactttcgccgcttatcttttgacatgatgctagcttgggaggtcccctcttcctcaagccagctcactgttaaggttgaggtagatagcacagttagcttagaagcttttacaagaatagcacctgccatcccaaccattgctgatgtagtaacttgtgcaaatctcttcgatgtactttcatgttcgaccggaggccgtctttcattttctgtatacgagaagtacctttcagaattggacagagcggttaaaaagatgaagacacaatctgagtcgtcacttctatc

SEQ ID NO: 3240 - DNA, 376 bp, Sorghum bicolor
  Clone ID: SORBI-28MAY03-CLUS54839_1
acggcgccatggacccgttcaccagcgagtgcacggggggctggtacatggacggcctggtcatggccatggccatggagtgggaggagcaggacgacgggacgagcggcggcttcccgtttgagccctgctacggaggggaggctggcgcggcggagcaggtgtatgccagcccgttgtgggagtgaactctcggttacagtacgtcgtgtacacgtgtcagtgttctagtaaatctgtgccgcattgccgccgccagctaactactactgcccccgtacctactttgcgccgtttttgcaaattcagcgcattatgaatttgcttaagagaacaggacttgtgtgccttttgtggttagtttcgtgggctcaga

SEQ ID NO: 3241 - DNA, 725 bp, Sorghum bicolor
  Clone ID: SORBI-28MAY03-CLUS54861_1
gcacgaggcagttcaacctgacccagttgctgcagatattctacgaaaagaagctcagcaagaatcatttatcaagatgttaactactccagaggagattccaactgctgacgaaattgaggtgttcaaaatccttcagaagtgcctcgagttaagagactcttatctctttagagaagaggttactccatgggagaaggaggccataaatgacccctgtactccaaaacctaaccccaacccgttcacttatgtgcctgaaccaaagtcagagcatgtcttccaaatggttgatggtggcgcccgggtttatgcggataaagattgtacagagagcatttatcctgtggctgatgccacaaccttcttcacggacctgcattatattctccgagtaacggctgcagggaacacaagaactgtctgccataatcggttaaatcttcttgagcataagtttaaatttcatctgatgttaaatgcggatagggaatttcttgcccagaagaccgcaccgcatcgtgatttttacaatgtcaggaaggttgacactcatgttcatcattcagcatgcatgaatcaaaagcatctgttgaggttcataaaatccaaactaaggaaagaacctgatgaggtggtcattttcagagatggtacttatatgactttaaaagaggtttttgagagcttggacttaactgggtatgatctgaatgttgatttgc

SEQ ID NO: 3242 - DNA, 422 bp, Sorghum bicolor
  Clone ID: SORBI-28MAY03-CLUS54877_1
gcacgaggcccgatcgggaaagtttcaggtcggaccgccggagtagctagctaggtgtgtgtgacagtgtgatacttgagagagctagctagctctagctggggagtatagttttgcagagatggccgagagcaggagaagaggaggggccggcctcgcatggcgatgagagcactgctctggtagccaaggatgacttgcctgtggcctccactccacctgcggcaggaggctcttcttctgcgcgcgcgtgtgtgtgtggttgtcgatcgcaggcagtctccttggctagcctcagcggctctcatccttcatgccaggctcgtctcttcttcagtttaatttcatcacttgctgcactgcaatgttcgggcagcagtgcatggatgcaacatgagaataatgtcacggactagacataa

SEQ ID NO: 3243 - DNA, 988 bp, Sorghum bicolor
  Clone ID: SORBI-28MAY03-CLUS54891_1
gcacgaggtgtcttcccgcttctattttcgtcctgcgcttcggctggcccaagtgttgttatcaaattccgatctctacatcaagctatccaatcttctcaatctttgttgaccaaagtctgtgaatcacaagttcaacttcaacttcattcattttgccaataactcagccatcatgtacaactcagcccggatgatgaagccaaagctgtccttgagcatctctgctgcgcagaatgccactcggccatccttgtcgctcaagtccccaatcaccctcaagtcaccaagtgctctgcctcgcactcctatctcgccaatgtccgctgctagcccgtcaagcaagatgttctcaacgttgcaagtgccaaattatgcatacaccaactcttgctcctcaaagagcattctcaagaagcagccatcctcgggagctgctgtcgacaagcgaattcagttccaagtgacaccgactgttcactgtgtgacaccgatcgagaacccagatgagtactacggtaaacacatgaaaatgtctcgagaggaacggcggtggacagttcgacagtgaaatgagcttcacactttgtacaacgaatgaccgttcaccattgactttcgctcgatcgatttggaagccatgcattactcggggatgtgtactgtggctttggaatagtacctggctttaggctcttgggatttgcttgtcagcgggcaccgtggatcgaaaaccgaggtcttcaaatttcgaaccggcactgaaagaaacgaagagctccgacaagtacattcggctccagcctcaagtgtgctcagaaccctagctcagagcctgttggaacctctgaagttgaattgcgctatctcggagcatcatgccgtccagcgatcaatggaagaacgatgcagcaatgattgaactgattatattgatgattatatgagacgggacctggatgatttctttttttttgtttttttagca

SEQ ID NO: 3244 - DNA, 909 bp, Sorghum bicolor
  unsure (1)..(909): unsure at all n locations
  Clone ID: SORBI-28MAY03-CLUS54906_1
cttgattttgagcacaatgtaagacctgcccctgtaatcaccgaggaagtgacagcttcccttgaagaaatgataaagaaaagaatcacagagagtctttttgatgatgtcgagaaacctactatgttgccatctaaagctccaaaggagcacaaggaactggatgaaactaagagcaagaagggtcttgctgaactctatgaggatgattatgcacaaaaggcaggcattgcacctgcccctctttctatttcagatgaactaaagaaagaggcaaatactttatttaagcggatatgtttgaaattggatgcgctatcacatttccactttgctccaaagccagtcattgaggatatgtctatacaagcaaatgttcctgctttagccatggaagagattgcacctgtagctgtttctgatgcggcaatgcttgcccctgaagagatctttgaaggaaaaggtgatgttaaggaagagggggaacttacacaggctgagcgcaagagaagaagagctaacaagaaaaggagatatgcagcatcccataaggagaggccagccaagttgcagaaagattgaactcaatgttagtaaaccatataaatttctcattagcttcaaatggtacaagagtgataatacaaattttcncaaattttgtattgtaccctgtactattagtcctttacgtgaaacagtaaaatgtgagcatttatatctctacagaagtacactagaagatcgagagttttgatttgctgagatacaattttgagagtgaaaaaaaaagaattgtgtctgtcgaacactcgaacacggtagaatgctcatccttcgccccaaccaatggatttggttacaggttgcgattcactacatgtataatttttttgcagctatgcaaag

SEQ ID NO: 3245 - DNA, 711 bp, Sorghum bicolor
  Clone ID: SORBI-28MAY03-CLUS54931_1
aatattgttgaatatatcgagatcatatcaaaagttctgaaggatggtggggtctggattaacttgggtccccttctatatcactttgctgattcatatgggcctgtggatgttctgtccagcgaagctacgttgggagctgggctgagtgctgcttaccgtcttcggtctcccttggccctgctggtgttgagtgtgaccgcctgcccttcttgcacctctgccgtgttgcagaatcggtaccatgcagcattctggacaatgaggaaggatgcatctcggtcaaaagcttgtaagccccgttgaagtgaagatcatccatggttgacgatcaattagatttagtgccatcgtcattaaccactgtattcgaactccacattccgtgccagactgggttacatagtaacatatacataaatcagatgagctgcctgattcacagaatataattggcatcacataggaaatgggcgatgtctaggataaaaggatgagctagctagggtataaaggcgtgtatgggtctggtgagcaaaaatgagatgcattgctggtagaactgtaacgcttgatcttctaaggaaaataggaaaggattacaatttgtgaattaaactgttccatacttcttgaactctgacagatattcaaattgtattatgaactgtaaggatgagcaatataaaggcgtgtatgggtgctggtgat

SEQ ID NO: 3246 - DNA, 473 bp, Sorghum bicolor
  Clone ID: SORBI-28MAY03-CLUS54434_1
caggggaggaaaaataaactagtggccaaaccctagcctgccgagcccccccgcgtgcgctctccgccgcccgccccgccccgcccctcccctccggtacgcgatgcgccgggccacgccgccgcagccgcagccctcgccgtcgccggagatccggtaccgcggcgtgcggaggcggccgtcggggcgctacgccgccgagatccgggacccggccaagaagaccccgatctggctcggcaccttcgactccgccgaggccgccgcgcgcgcctacgacgccgccgcccgatccctacgcgggcccaccgcacgcaccaactttcccagcgccgcggcaccggtcccgcggcacagagccccctccgcctccgccgccgcagcccccgcggcggcggcggcggccacgtccagccacagcagtaccgtcgagtcgtggagcggcggcgcaccccgcgccccctccgccctgc

SEQ ID NO: 3247 - DNA, 464 bp, Sorghum bicolor
  Clone ID: SORBI-28MAY03-CLUS54466_1
gcacgagggctaccgtttccttcttcccgactgcacctgtccccgaggggagaaatctcggcatcctcctcctgatacctcgccgccggggacccaactctgacccctacccctccgcagtccgcaccaagctgccgccgctgcagcatcagcatcagcatcagcaatggtgctgatcactctcgtccgcggctacatcgaccgcatgctccacgacatcccgggcatgaaggtcctcgtcctcgacccccaaaccgttgggatggtgagcgtggtgtacagccagtcggatctgctgcggaaggaggtcttcctcgtcgagaccatggacaacgcctccagctccagggagtccatggcgcatctcaaggccgtctacttcctccggccctccgccgacaacgtccagaagctccgcaggcacctcgccatgccgcgtttcgccgagtaccacctcttcttct

SEQ ID NO: 3248 - DNA, 698 bp, Sorghum bicolor
  Clone ID: SORBI-28MAY03-CLUS54578_1
ctactggaagtgccccccgcattcctctctctttctccccctttgtcttgtgcgtgcctgtccggtggcgacgactgggcggccgccgccgccccgccggccggcttccccatcttcgtgaccttcgccggcaacgagcacccaggaggaattttctatacatttaagatgtacagggcctcgaatttcgtacctgatcctaatcaggtgctcctggatgccaagccattaaggtctttagctccaatgttccctgcccccatgggagtcaatgttaatcaatcaagtacaccaccattggtctgtgtcactccagttggtcaatttccagcagggtttggtgcagggaaccttcccgcctttggatcgttcactactttcagtgccactgcaaatggtgtttcttacacaggcaccagtgctaatggggccattgatgccactcctatctctgcatacaagacaaggacaggcatatcacttggtgatgatgagctttactcgggtaaccaaactttggtaaccaagcgtaagagaggccgtcctcttggttctggtcgtaatggcccaaatggtaaggtaaagcgccctaagcccacatacaagaattttgttgctggcaaagagcttgcctttctgtcatcttcatccgatcccagggagattgtggaatctgttcacatggcctttgaggcact

SEQ ID NO: 3249 - DNA, 943 bp, Sorghum bicolor
  Clone ID: SORBI-28MAY03-CLUS54601_1
tattaagagtgaaggtaacatgggagtaccccagagatctttacccatggatccatcatcgttgtatggacagggaataattcagcctaaacctggattgagtggtgcaggactgaaccaaggtgtgagcggtttaccattgaaaggctggccattaactggaattgatcaattaaggccgaatttgggtgctcaaatgcagaagccatttctttcaacacagtcacagttccaacttatgtccccacagcagcagcagcaatacttagcacaggcccaagcacaagggaaccttggcaactcaactaattatggggatattgatccccgcagacttacagcgttgaccaggggtgggttgaatggtaaagatggtcaacctgcaggaactgatgggtgtattagttccccaatgcaatccagttcacccaaagtcaggcccgaccaagagtatctcatgaagatgcagcagacatcttcacagcaaccccaggaacagcttcaacagcagcagcagcagcatcagaaccagcagcagcaacagagccagcaacaacaaatgcagcagaacaatagaaaaagaaagcagcctacttcttcaggaccagcaaatagtactggtacaggaaacactgtgggtcctgccaactccccaccatctacaccatccacacatacgcctggggatggacttggaatgggtggtaatatgcgccacgttccaaagaacttaatgatctatggtgctgatggaactggacttgcctcctcttcaaatcaaatggatgaccttgagcagtttggtgatgtgggctctttggatgaaaatgttgaatccttcttatccaatgatgatggagatcccagggatatttttgcagcactcaaaagaagtcctgcagagcctaacccagccacttcgaaaggttttactttcagtgaa

SEQ ID NO: 3250 - DNA, 417 bp, Sorghum bicolor
  Clone ID: LIB3476-006-Q6-K1-D8
gtcagagttccttgggctatctctttggcagtgacgaagctccaaaatcagctgagaagcctgcaccccaaaagccagctcctccatcttctgcagagaaactaaaagatatccctgctggtattcaaagtagtaaatcaaacaattacataagagctgaaggccagaactgtggaaatttccttacggtcagtatccattgacacttgtgaacatttgattatgctattttggagcaccaattgagtgctgtgcaggtggagcaaaaagggtttctatttgctcttgttcatagcatatgatccagaagtacttgtttaggttttgctgcaagaagcacccttcataaaatgattatgttgctatggtctacatttacatttattagaccctgatatttgacattatagcaagaat

SEQ ID NO: 3251 - DNA, 718 bp, Sorghum bicolor
  Clone ID: LIB5052-011-A1-XP1-G6
gccggccgggttgggatgcccagagcctttttctcctgtccttctgtacagatagcagtggtggccgcggaatcccccgcctcctcctcccggattcggcgacgaagattaattgaaaagctttggtaagatgggtcgtggtgttagtactggaggtggtcagagttccttgggttatctctttggcagtgacgaagctccaaaatcagctgagaagcctgcaccccaaaagccagctcctccatcttctgcagagaaactatcagatatccctgctggtattcaaagcagtagatcaaacaattacataagagctgaaggccataactgtggaaatttccttacggaccggacatcaaccaaggtacgagctgctccaggtggtggctcttcactcgattatcttttcagtggcagcaaggatggcaagtgatgggctccttaaaaagaaaaagaatcttgtattcccatgagtaactatcaaactgctcatggtcgtatctgtgtcgttgggattgcttgtatgtgtgcatgtgtttgtgtgtgccgtgtgttgatccacagctactggtactaagagcttctatccctgttgatggaactgggcgttatgcctatgatgacattatcgtgtgtgatgctattatgtataaacctgttccaagttgtggcgtattggatatgcgtattgcggaaacagaaaaataaaatgccccta

SEQ ID NO: 3252 - DNA, 657 bp, Sorghum bicolor
  Clone ID: SORBI-28MAY03-CLUS54993_1
ctggcttgaggcagcattttgcagctgaaaggaaatgggcccttggtcttcagtctcgagcacatccacgagaaataatcagtgaagtgcttaaagctctgcaagaactgaatgtttactggaagaagattggacactacaacatgaaatgcagatggagtcctggctgcctggagagtatgatgcatagcagtgatggctttagtgcggagtctgctataattgaaactgatgatctcatggcgaaatcaacccctatagtgaagtttgagattcagctttacaagacgagggatgagaagtaccttcttgacctgcaaagggtcagtggaccacagctcctctttctggacttgtgttccgcctttctaactcagctgagagttctttgaacctgacatgattggcttcccaagcacaatccttgatgcacccactggagtttaaagttacatttgagatgtacataatgaacatatgtttatcctccagtagattatattttctggagtatgtaaacattagaggcaggtcctggtttgcctagacggttgtcaccaaaggtcctaaacaagaggccacaggcgagccccaggctacttcctcaattagatgatgcgagaaatttttggtctccttggacatgttatcccttta

SEQ ID NO: 3253 - DNA, 650 bp, Sorghum bicolor
  Clone ID: SORBI-28MAY03-CLUS55046_1
tggacgtccgcggcgtcgacctccgcctggcaccgttcggcgccgggcgccgcgtctgccccggcaagaacctggggctcaccaccgtgggcctctgggtcgcccgcctcgtgcacgccttcgagtgggcgctgcctgatggcgcgccgcccgtctgcctcgacgaggtcctcaagctctccctggagatgaagacgccgctcgccgccgcggccatcccgcgcaccgcatgatccatcctgccgctgccgccgacgcgtgcaacaagaaccgattatgctttgtcacgtcacgtcacgcgttctttgtctgtgtgtgtgtggttctaagctagtgtgcttcttcttgtcgatcgtcggttcgttctcgtgcctgcctttgcctagggtttcgtttcttgcaaagtagtgacagtgtctcccttagagtcatcaacggggctccaattttggaaaggtgcgtgttaggagttaacccctagacatgtctgcgtctcgatcaccacctactatgtcattatcagcgcagcacctatatatagatcagtgtctgtcgatcagtcagggaagtcgatcgtgtgctcaagtctgctgtattatatataatgtattgtaatgtgattatcaagaaccgtgctatctatatgttgc

SEQ ID NO: 3254 - DNA, 801 bp, Sorghum bicolor
  Clone ID: SORBI-28MAY03-CLUS55065_1
gcacgaggcgccgcccatcacggacgtcggacgggagaagagaagcggggagcaccggagcaagcaccaccgccggggcgtcgaggtcgcggcgttcaccgttcgctgaggtagctacgctccggcctccgcggctgccggctccgccaacacccaccggccaccgccaggcccaggccccaggcggccagccactgcgactccagctctaagtacgggtcgccagctgttcccctcaccgtgtgatagtgtgatggtgatggacttggacgagccgcttgatgcggcggccgccgagaagggcgaggcggcgctgcggcgactgaccgaggccgacccggcgctcttcctctccccctcagtggacctcgccgccgccgcccgagcggcctcacagtacatctattcctctctggcgccacgcgcccttgctcagccgccgccgctccctaccctcctcgcggaccccgccttcgacgccgagcagatttggtcccagatagagctgctcgcccgcccgctccttcctcacctgcgccgccagctccgccgtctcgagcagcaacctccctcgcaacagcctcctgtggagacgcttgctgttgccgagggtgagcagttggaggaggatggagaaagtagcgaatcagaggagttgaagaatgaggaggaggagttggaggggacagaggacgaggaggagttggaggggacagaggatgaggaggaaatgggcgacgacgaggaggaagaagcggagctggatggtagacgagggaatggggtcggaggataagttcc

SEQ ID NO: 3255 - DNA, 513 bp, Sorghum bicolor
  Clone ID: SORBI-28MAY03-CLUS55067_1
gcacgaggaccaccaccaaaccaaggcaagtatactagcagacagcctgcccgcccgactgcaacggtgatcatccactggaccggattcccccaatccctgttccggcacccgccgccaatcaaatcttgccgccactcctcacccccatagactggacgccgggcctcctactactcttctaccataaagtttaccggcaaccaccacctcgtcgccatccgattccgcgcccacctcaccaccgcaccccaccactacctgcccccgccggcctccccctccgcgcctcccactccgagtcgtcccactcctgcaccgagagagacgccaccgttccgtttcgccgccagtacaccactcgggcactcgctacacacctcggcaagaaaagcgagcgcagccgcgcgagaggcggtcgcgtgttccttgcttcgtcctcacgtgccttgccccttccgcttcccccgtagtatatccgtcctgttcccgcccccggccccgagcaaaccg

SEQ ID NO: 3256 - DNA, 582 bp, Sorghum bicolor
  Clone ID: SORBI-28MAY03-CLUS55082_1
gcacgaggctctccctcgttccctccgcaggccgcgacggcgcgggcgagcccggtggccggccccctcccttcccccacctctcgcacgggcggcccctgcggcacggcgtggcgtggccggcgcactcggcctggccaccgtcggcgaccgtgaccgccccttcagcgcgcgagttcctgcagccagatggcgtggctctgctcttcctcgatccgtccacttgctggtttactcctctctctccctctccctctctcctgatgtggcatatgcgctgcgctctcccctctccctctctcctgatgtggcatatgcatggatgcatgcttgattttgccctaaatatggtattctcctccttttttctatccatctgcatagttattgcgaatattgttgttctttaggtcttggtctgctccatttcaatggacctgacagcgggcaactattatgtcagagatctgagcacatgagcatgggagtgatatttgtttgacaccatgtgtcctgcagtgctaacatttttaggtttattatttgcatttcaatcatgtgcagtgatgagtacgattttct

SEQ ID NO: 3257 - DNA, 565 bp, Sorghum bicolor
  Clone ID: SORBI-28MAY03-CLUS55086_1
gcacgaggggacacgccactccacagtgtcagtcactgcccccatcacgccaccctccctcccttctcggccgttgccacgagctcgctccgacccaccgccgatggcgacggcgatgggcgcgttggctgccacctccctgaccccggtcccggctgccgctacgttccccggtgatctcggcctcggacgccgccgggcggctgtgtcagggtggcgcgccggcgggagacggctgcgtgcgtcgccgcctgcccggaggccgttcctgttctcgccgaggggcgtttcggactctcggagctcgcaaacgtgccttgatccggacgccagcacgagtgttcttgggatcatccttggaggtggtgctgggacaaggctgtatccactgacgaagaagagggcgaaaccagcagtgccgttgcgcgccaactacaggctcatagatatccctgtcagcaactgtctgaacagtaacgtctccaagatatatgtgctaacacagttcaactctgcttcgctcaaccgccacctctcaagggcctatgggaacaacattgccggg

SEQ ID NO: 3258 - DNA, 567 bp, Sorghum bicolor
  Clone ID: SORBI-28MAY03-CLUS54788_1
gcacgagggtttggtcctgtctgcccgtcctgcgtccgcggcgcctccccagcatccaaacttggaaatagcctgaaaaccggcatcccctccccgatcccctccacattcctatcttgaccttgagcagagacctccgatcccctccccctttccaccgtgagcagagaccggagacgctgtaggcaacaccttccgccagagcgcagtagagtcgaatccgagccgccattcgccgtccgcctcgcgagatcgaccggcgcgagcagagaccgaagcagccggtcagccgctgtccgccgcgaagactgctcgcccggcgcgactagagaccggagccgccatccgccacgaagaccggccgctgctccccgtcctccgtccgccgcgaagatcggccgctgctcgccgtccgcgagaccggccgccgtacgccgcgagccggtcccggtccaccgagaagccgccgtacgccgcgaagacaggccgccgcgagaccggcgtccgtccgtgcaggaccggccaccgtacaccgcgagaccggccgctgcacgccggtcgccgtcc

SEQ ID NO: 3259 - DNA, 468 bp, Sorghum bicolor
  Clone ID: SORBI-28MAY03-CLUS54815_1
gagagcgcagcgcagagtttctagagcatggaccacggcgacaggaggagcggcgcgacgggcaggccctggcgcggcgccggcgccggcgtcgcggcggggggcggcggcccgccaccgcccaaggtgtaccgcgtggagcccagggacttccgggagctcgtgcagaggctcacgggcgccggcacgccctccgccgccgccggcgcgccgggcccgtcgccgcaccagagggcgacgacgctgacgccggccatggtcactgcggacagcaggcgcgcccaggccgcggcggccgtgcccgtgcccgggccaaccgagcagttcgactacgcgtcctggttctccgcgccgctgctcagcccggcggcgtacggcgcgccgggcttcggtggcggacaccagcagcaccaggggagcagggggcctctgctttagggcttgtaggtacagtagaaaacagagtcg

SEQ ID NO: 3260 - DNA, 334 bp, Sorghum bicolor
  Clone ID: SORBI-28MAY03-CLUS54825_1
tctatccgcttatagaactccttactgaacacttttgttgtttcttttttaatacgtacagtttcattcagtctactacgtccccggcctcatcgcaacaccttgaacaaccttggctttggtgtgttctgtgacctccagcaagggacgaagggacactaactgggggttttcaggcacgtacgttgaaatggagaaggaacacacaaaggggtacagatgacaagatggagatgatcagaccaattcacgagttaacggcactttatttgcccttctgttcatttcttattcctgcttcagagtgaagccagagaggtggttatgggtaaaa

SEQ ID NO: 3261 - DNA, 862 bp, Sorghum bicolor
  Clone ID: SORBI-28MAY03-CLUS54833_1
tttgagccgcgtgcgcagcgaacgtcatccctccaggccaccatctccaacccttacaatcaccacctccacgacacccatcgcgcatctgccctctacaacccaccaccacggccaaaacctcttcttcattctcaccgacccctaaaaacatcaagatgaaccgcctcttcggctccaagcccgcgggtcccaaacccaccctcaacggcgccataaccaacctcgacacccgcatatcatccctcgacaccaaactcaaagccctcaacgccgagctcggcgcctaccaagaaaagctctcccgcatgcgcgaaggccccggcaagcaagcgatgaagcagaaggccctcaaggtgctgcagcgccgcaaggcgtacgaggcggagaaggacaagctcgagagccaggtgtggaacatggagcaggctagcaacatgcaggacaacctcaagaacgtgatgacgcaggtggatgcgatgaagacgacgaataaggagctgaagaagcagtacggcaagatcgacatcgataagattgagaggttgcaggatgagatggcggacctgatggatgtgggcaatgagattcaggagagtttggcgaggagttatgatatccctgaggatgtggaggaggatgagctggatgctgagttggaggcgttggggatggaggttgagatggagcatgagatgggtggtgctgtgccgggtttcttgcaggatgaggtcgtgccagagtttgtggacgagcctcctcaaaccgaggacaaggtgaagcaggttgctggttaatgaacggcgttgctggaccacagtagacttctcggagatttatacatggaatttgctgtacacgg

SEQ ID NO: 3262 - DNA, 653 bp, Sorghum bicolor
  Clone ID: SORBI-28MAY03-CLUS54835_1
gtcttgcctcgtacagcgcagattgccgcctcaacgatcagcgtgcccaaaacacggctgccagagtgtttttgaaggcccctcctcatgggacgagtggactgagcatgttggtcggcatatggaaaagggagaaggcggtggcaggctcggagtagatggcctactcgcccaatgggcgctggacgaaggcattattgagcgtaaggcagatggtgaatatcgattgtcaaccagtaacggaatgggcggaggcaacagtggaggtgtgcctcctgttttcgagcaaaaagagtcgacattaacctcggtttcgacaccgggacccgtcacagccagaggagtccttgatcgtggagacaaacgcaaaacctccagaagacagaatggaggttgacactcccgagtaaagtgggcgcttggtgactgactatagggcgcattacgaaacttgtgcaatacaatgcactgcaacgacatgacgatacgaagtgaatgaccaaatttcaaacagttttcttttcttatgtagtgacggtcgctacctcgcccagtcactcgcttagaatacgttctcatgaacaggatgaagtctcgtgacttcaaggcttgaaacaaaatatcgaatggagatgagaaataagtaaaagggt

SEQ ID NO: 3263 - DNA, 574 bp, Sorghum bicolor
  unsure (1)..(574): unsure at all n locations
  Clone ID: LIB3476-007-P1-K1-C12
ttgaggaatctttntgctcatatcttcttggagaggaaactggcaccacagtgtttgaaaagcttcagcagcttcaaagtactggagagttcaaattcgaagaattatgggttagataaaaagaagggcagcagtgacagggttactgtcaaccagtcactggaactgtggctaaaggatgtggccctttctcgtttcgcagatacgaaagattgtcctccatctttgaccaacttttttggagctcctaagcgcgtccttaacacatccaagcagaacttcagcagagcagaccccaagattgagtccaaacagccatctgggggaggctgttaagcaacctgcacctgccaacttggggctccaatcatcaatggataggcaagtaaatggttcagggacagcatctgttcccctgaagcgcaatcctggatcccatctcagaacattggaattatggggacttagtggagatgttataggaaagcttgcctatagtgcacttcttgggtttgttgtatttagcacattaaaattgggtcaaggttcagtttgggcatgtgagatacacgaa

SEQ ID NO: 3264 - DNA, 477 bp, Sorghum bicolor
  Clone ID: LIB3476-010-P1-K1-B6
aagaaagctaaaaccatatgtgaatgtttagttgcatctgagagcacagacctaaaatttgaggaatctttttgctcatatcttcttggagaggaaactggcaccacagtgtttgaaaagcttcagcagcttcaaagtactggaagttcaaattcgaagaattatgggttagataaaaagaagggcagcagtgacagggttactgtcaaccagtcactggaactgtggctaaaggatgtggccctttctcgtttcgcagatacgaaagattgtcctccatctttgaccaacttttttggagctcctaagcgcgtccttaacacatccaagcagaaactgggatccccaagatcagtccttttgagctctcagccatcttctagtgcctcagcatgcaacagaacttcagcagagcagaccccaagattggtccaaacagccatcttgggggaggtgtaagcaacttgacctgccaac

SEQ ID NO: 3265 - DNA, 526 bp, Sorghum bicolor
  unsure (1)..(526): unsure at all n locations
  Clone ID: SORBI-28MAY03-CLUS5524_1
gaaaacccacgcgtccgcccacgcgtccgcaagagtgaggtttgttccaaaagcaaaagatatgagaccattagtaaatctcaaagctcaatcaaaaaatgtcctcctcaataattgtcatctgattataaaaaaagtaagggatgagaatccagacaagtttggttcttctgtttttgattacaataatgtgcatcaaaatctctggcattttatttcttcagtaagaagtcacctgaaggaaaaattcaagatatatattgttgttgccgatgtatcaaaagcatacgattgcattaatcatgatatgttactgaaagttgtggatgatgcgttgaaatgtgatgactatgttctgaggaaatgcaaaaaagtagtttgcaactggtctaagaatgccctctaccgttttgattcaaatgtttctatctccaacggtgatggtatatgtgattntctcgatcagttatcatcaaggggtggcattttagttgaccagggaaaatttaacaagatacaaaagaaa

SEQ ID NO: 3266 - DNA, 581 bp, Sorghum bicolor
  Clone ID: SORBI-28MAY03-CLUS55265_1
gcacgagggcttcatcttcttgcccctttcaatccagcagctgtctcgcccacctcagctacaactatatctctacctaccatcactatcaacaacagcaacaataactctttactacaacattcagaatgtctgctcttcctcctcaaaagttcctccctctcaccccggctcccaagtcttctttcctgtctctcgccccagccacttctccctcataccctcagaagcccgctgcccgctctcacactcgtccgtctgctcctcgacgagcctcgactgagtcgtccagctccagctccagctccaacaacagctaccgcatcctcaagcttggacctgttcactacggcgagcatgccgatgagcacaagaccgactttcatgatgttatccttcactaaagagagtcacggtaacctttgtgtgaatggcgtgcttttgtgagaaaggcgtgaaattatgacagcgcaagcgatgattttattttattcatttcactttttatgaatatggcacaaccaacaacaaaacctacaggataccactttgatttgacaattttcgaatcaaacaaataa

SEQ ID NO: 3267 - DNA, 556 bp, Sorghum bicolor
  Clone ID: SORBI-28MAY03-CLUS55266_1
ggtgtactataaatccaggggagaatgaggctttggtgaggtatgcattggatacctacaaatatctgtcactggtatcacagtatccaaaagttggagggcctggtattgttggttcatgtgagctgttcaacatgacatatactgaggaatggttgagagaggatgaagctgaacttgttcagaggtttgatccatcatcatctgtggataccattggtttcttcattgcgaaattcaatgttggagataaagatgaataaacaaaagggattgaaattcaatgtttgatacccgcaacttacagtagggatatcagcactttttgcaatcagaatggtgaacctatacccatggagcggaatgcaggctgtcccctgaaattttgtttgccagtgtttgatactccatccattttaaattataagtcgttttggcttttttagatacatagcttatgcccctagatatatactatgtctagatacataacaaaacttacatagaaaagcccaaaaaccgacattttgaaatgggagtatatttcttttgttcg

SEQ ID NO: 3268 - DNA, 987 bp, Sorghum bicolor
  Clone ID: SORBI-28MAY03-CLUS55286_1
gcacgaggccgcccacgacgtcagcgcgcgtgctccaccttcaccaccatcccaccggcatcgaggcgttttcgagagtgatacggagctgggcatggaagaagtttatgtctggatgtgtcatcctgctcccgatcgccatcaccttctacacgacatggtggttcatccgcttcgtcgacggcttcttctcgcccatctacgtccatctcgggatacatctcttcggcctcgggtttgtcacctccatcagcttcatcttcctcgtgggcgtgttcatgtcgtcgtggctgggcgcctccctcctcggcctcggcgagttctgcatcaagaggatgccgctggtgcgccacatctactcggcttccaagcagatcagcgccgcaatatcgccagaccagagctcaagagccttcaaggaggtggtgatcatccggcacccgaggatcggcgagtacgcgctgggcttcatcacgtccacggtggcgctgcgtggcgccggcgtccgcggcgaccagcaggaccttgcctgcgtctacgtgcccaccaacaacctctaccttggggacatcttcctcatgagccgcgccgacgtcattatcccggacctctccgtccgggaggccatcgagattgttctttcaggtggcatgtcggtaccaaagatcatatcggcggtggagggggccgttggcctcggcgaccacggcttagcaataaaggattcctagctcacacttcttccaactccttgacagttgacgcttccttctcatcgtcacaatctttgggttgctctgggaggttctgttcaaggttctcgatgtcttagatagatggcaggtttagacgtgttccaattttcatcagccatacgaaaatacagttttagtaactagcgatcttttgttgtataaattctttcctgtgagtttttgtatgaactgacaaaacattgtgtccacaaagtaaacagcataagtttgc

SEQ ID NO: 3269 - DNA, 582 bp, Sorghum bicolor
  Clone ID: SORBI-28MAY03-CLUS54941_1
aatgcatagtgtccgttcctggcaatctgtggagcactaatctcaaatcacttcagagattggagtttcgtcattgtccagagcttatatcaattggtggaccaaacgcaactgcaaacataagagatgtagttattgaagactgcccaaagtttgagggacacgcaggctcagggtctttttctatgttggaacatggaatttaaagacggttgagatggagcaaatagctgcagggtttcaagcgtcaagacccactgagaaaacaaaaccaatcacttatccggaatggccgaatctggttgttatgttcttatgggtgttctgttccctttgctgcaaggtgacatgaaaaaacatttcacagactctggtttctgttatatgcctaatggtgttgtatctgtgatctatctatttgcgattcctggttctgtgcaaaataagtcggggcacaacactacaacacttacattatattacatatcttgtaactggaagaggggcaagaggtggagtagcccctcctttgtcttgtgtttggtttgtggaaaaattatagagacagttgcaatattgcgc

SEQ ID NO: 3270 - DNA, 1076 bp, Sorghum bicolor
  unsure (1)..(1076): unsure at all n locations
  Clone ID: SORBI-28MAY03-CLUS54971_1
gcacgaggcgcaagtgcagaagatggccgagcaccaccacctcccgccggagcaccccgaccaccaccaccacaaaggcgggaggaagggggtctacgccgacgacgtcaagcccggctcgcgcggccgctcccggtacagctactactacggcggatacggggacggcggcggcggtggcgccgtccgtgccctctgcttcgccgtcctcgtcctcctcctcgccgtcgggatcaccctgctggtgctctacgtcgtgtaccgcccgtcccaccccaccttcgccgtcacctcggccgccgtcctagacctgtacaacgccaccgccagcaccaacaacaacgccgccgccgcaggcgcggcgcccgcggcgctgctggccgcgtcgttccagttcacgctggtcctcggcaacccgagaggtcggtcggcggcgcggtacgaccggctggaggcgtacgtggcgtaccacggggaggccctgacggcgcccacgccgatgcccccgctggcgcaggacgccggcaccgccgtggcgacggcgcccgtgctgggagcaggcgtcgggggcccgcccgtgcccgtgtcgcccgacgccgcggcggcgctggccacggacgtggccaacgccgtgctgccgctccgcgtggtgctgctcggccgcgtccggttcgtgcacgggccgttccacagagggtggcactcgctctacgcccgctgcgacgtcctcctcggcgtacgcaagatcggggggaccggcgccgccaccggtggtggtggtggtgtgccccaggcgccgattcttggcgaccccaactgcaacgtcgacatgtgaatatgtgatcgatcggatcatcacctcctcatctcgtgtcgtgtggacgtctaagagcagaatatatacatactatagcaaatctacctacgtgcagatgcgtgaatgtctccgtcgttgcgtatgtgatctgtatatgcaaaaacaaaattacatgtacacgctagaaacaaataaggagtttgtaatgtaatgctttgatagcagtggtgncttgttggtcgtgaaataacagcaatgg

SEQ ID NO: 3271 - DNA, 1037 bp, Sorghum bicolor
  Clone ID: SORBI-28MAY03-CLUS54972_1
gcacgagggaagaaactagtactagggagagaggggacttgaaatctaaccaggctggttttaatagtaaaacacagtcacttcaggaatcaattagttctcaagaagaggtgaaagtgacaaaagtctcaccaccccggagaaaaggtaacagggatgagaaatcagaaaggcaggtcaacttcatgaaaaaagaaagtggacctgaaattagtcggactgttgttaaacagcaacagcaacttaaacagcagcagctgcaaagaccatcatcaacctcagcatctcaggtttcatccaagcaatctgaaaaggaagatatggaaataaatgcaatacttgaggaagaggcgctgatagcagctcacagaaaggaaattgaaagtacaatggagatagtacgggaagagatgaacctattagcagaggtcgatcagccaggtagtcttattgacaactacgtggcacagctaagctttctgttgtcacggaaggcttctggtttggtaagcctccaggcacgcttggcacggtttcagcagcgccttaaggaacaggagattcttagccgtcaaaaaacactgagatagtttaaacccaaaaaagttggaaacctttcggtttgtcattgattgcgagaagccacggatgttagaaattgtcattgactgcgagaaggaatattgtatcatggcctccaacatcgacttaaaagaagggaaggcggataggatctcagggtgattaggatgggagatggaaatgtgggtgcaagcattattgattttgaggttttatgaatcgagtttgccaatttttattttcctgaaaaaggtgcttgggtgtatttactattggtggcattggattgtcaacgtttgccattttcttttgcacgaatatagttgtaaccgttgtttgaatgtcggtagtgaagtgctgcggtgaggaaataaccgtaccttgccttgccgctatagtgttgtattctttgttgatatttatttcgcatctatacaaaagaaaaggcagctctg

SEQ ID NO: 3272 - DNA, 462 bp, Sorghum bicolor
  Clone ID: SORBI-28MAY03-CLUS5503_1
gcaactgagttcgaatgctagtgttggcatgcatgctagcttggactattcaggcacaggaggactcgacaagatttgccaggagagccgagcattggaaactagcccttttggtatgaggagcttgcccgatctcggttctttcggtggctacagcagatcaaccgcagaatcgacatcgtcagtgcaaccatacctgagatccagcaatctcgctgaaaccagtaaacaagagccggatattgtgtcggcaaggagcagcagcagtggcagtggagcggcgagcgatcgaaagaagcgggcgtccgaggaaaggacgagcaccgtgaagaagtctaagcaagagggctctaaaccatctcctcccaagcaacaagtgcctaaagtgaagataggagagagatcacagcattgcaacagatcgtttcaccatttgggaagactgatacagcatcagtgctg

SEQ ID NO: 3273 - DNA, 656 bp, Sorghum bicolor
  Clone ID: SORBI-28MAY03-CLUS55410_1
tccggatggcgccgaacatggcagacgcggcggtggcgcggctgtcgcaggggaccaaggtgtacgcggagggtggccacgacagggtgttctaccagacgttcggcgccatgcccggggagcagctccgcaaggcctacgcctgctacctctccacctcctcgggccccgtcatcggcacgctctacctctccacggcgcgcctcgccttctgcagcgacagcccgctctgctaccagggccctgccggccagcagcaagagtgcatgtactacaaggtggtgcttcccctgagtcaagtgacgtcagtgaacccttcttccagtatgcgcaaccgtgcggagaggtacattcagatcacgaccatggataaccacgagttctggttcatggggttcgtgaactacgataaggctctcaagaatctctacgaggccctgcagcacccccatgtcaacggccaccagcgcagctgatgctgatgaggcttcggttcggtcctactgctattgtacttcgttcatgatgaactgtgacatccgttatcttgatcttgatgttcttgaataagatagacaccgaaaaatcctgatgtttttgtgtcgctaatctgatcggtgcagagaaaatatagataaaagctgtagctgcatctc

SEQ ID NO: 3274 - DNA, 538 bp, Sorghum bicolor
  Clone ID: SORBI-28MAY03-CLUS55437_1
gcacgagggcggaattgcttccagtgcttttctggttgagcttgaggggacattatgtgctgttcttgcagaccctgatgcagaagagctaagtatttggaagcgagagaatggtcagtggcatagcgcatacacggtgtatttggaaggttggccaggctattcccttggggcaaatgttgtggtgccatgggctatcgatcccaaggacgggaagatcttgctaaacacggggaggaaattgggattctatgatccagcaaggcgttttattgagaacctgtatgatcttgaagaggtgctgcgtgtcaggagtacagagcaatcctctcatattggagtccctgaaaatctttgcattgccaaatgcaaacatgatgttgagaggttctgttcacagaaatcactttttgtgcagcacaaggtttcagatgatccttcgcctgctttatctggaaatagttctgcatgctccagcggagagcaatgtttggatagaagaaattcattacatactgaaataatacccttggtccct

SEQ ID NO: 3275 - DNA, 660 bp, Sorghum bicolor
  Clone ID: SORBI-28MAY03-CLUS55443_1
gcacgaggataagtgtgggggcggaatcgccatcaaggtaatcttacatagaaaaaaatttcagaattatttttattcgtcctatgacaatttaaatctgatttatatgataaaaatattgctaataaaataaaaagataaaaaaataaatgaatactccatttcctttctgcttttgaaattaaacatgcatactctttattcttcgccaaaagcctaccatttatgagcaactttttataaggaccccattgcttctaagtaattgagatttgcgatatagtaggatgatttgaaacttgctcacttatgcaatgaacttggggatttatttgataaaattaaaattgcaaaaagtctactcttcaattatagataattacctaccaaggccaaatatattactcttgataaaaaatctacaaatagttgcttatttgttttgagttgtgtcaagtcttgttgacccttgttaagagatttatcatgctctcaagatcaagatcacgtacactccagatacatatatatgtcgcttctacactgggagtgcgcaaaaacatgccttacatgtccaccatacaaacactccatgttttcaagaatgatctctctagtgcatcttagataaagacatgggctatgcaaaaatatatatat

SEQ ID NO: 3276 - DNA, 727 bp, Sorghum bicolor
  Clone ID: SORBI-28MAY03-CLUS55457_1
ccactcgtggtcattcccctctccggtccgcagtgcgctcctcctccaacaccggcatccgcgtagtcgccggcgccgcccgcgcgtgaagcaaggagccttcctctccgccggtcagagactcagtctatcgatttccagttcaggcaggactacacagcgcgcaaggaaacaacgccacccgcgaaaccaggaaggaggcactcaaagcaagttacagttatctctgaacagctggacctcttaccaacttcagcacatcagtggaatatatccatcagcaaagaaaccaaggatcaagatggcactgcggcgggcactaggatggtcggaaggggaagttatgcgaccagagtcaaagccctgctcccggttgatgcggcacactgctggcatcttctctgttggtggtggtctggctttctgggtgctttgccgcctgcactatggtccaagaataactgttccaaggagtctcaggtgggcgtcatgcggagcagtctctatgagcgcgacatcagccttgcttgtgcggctctttagcccagagtgtgaacctcaaaacatagctgcctttgacaaacctgaactaaaggccgaatagcatagtcgaaaattggtgttaatctaccaagacctatccaaatttcttgtccttataataatcctggcagctcctgtaagatacttttgcatgatatatacaaccgccacgaagtgttatgtt

SEQ ID NO: 3277 - DNA, 757 bp, Sorghum bicolor
  Clone ID: SORBI-28MAY03-CLUS55473_1
ttgctgctatcagaacatcggctctcgctggcacggtgacaatcatgttgcagttccttgccaattcttgctccagattcatggcatgctcgtcagttacgagcacaaaggagtctcctttgccagcatctggtggacccttgaaccccgggcatttgattttgtattcctccaatccaaacggcacggtgtcacagccgaagaagaaggtgagattgtggaaggtgctgctgttgtacagccacaactcatcgaagctgacgttgtggcggagtgcagggcagctgccgccggggagcacgtcgctgtctgccagaatgatggtgcgggtgtcgtagaagatgtgctgaacggtgtagttctctccgccgagactgatgaccgcggtctcggtcggccactcgccttggcaggaaatcttcaggtcggtgtagccgcaggagtagttgtatccgtaatcagcgatctctctggtcgcgtcggagaggtagaagggatagctgatattgacgccgccgcacatggacgatttcgagcaaatcgaaccgtcataggtggtcgggagcgaaggagagacggcatgggaggcggggagatggacatggacggcgaggaagacgaagaggaggaggacccgcgggcgtggtggtactggtaggtgagcagccatggcggcgagaagccaaggtgggttcacgctcatctggctgttttgttaagctcccaatgcaactaggccggcacgagggggggcccg

SEQ ID NO: 3278 - DNA, 756 bp, Sorghum bicolor
  Clone ID: SORBI-28MAY03-CLUS55087_1
caatatttgggagccgccgattattaacacatccagaaaaacagtccacctcgccgccgccggagaggatgggtgagcggcggtacaccgagcaggaggaggccctcgagatcaagtccctccgccgcatcatcgccgcctacgccaactatcaagatgctgcagaaagggatgtcaagagatatgagcggtcattcaacatgcttcctcccgcgcacaaggaacttcttttccaccttggtctgaagtaccaaagactgagatggtgtatatccatgaatgcatcttttatcatgaacatgcttgaggcatttgaacctccttttgacatgagtcagtatgtagatgctgatccatcgaacttgcatgaccatagtcatatgggttgcactcattccagcgagaggggtgattgctctataatttctatctccagaagcaatttgtcattggatgggcagcatgatagtcccaaagaagataccaagacacatgaatcttcaagagaaactgataataagaaggtaacaccgcggcactgcacagcttcattgttcaagttgaatgttcctccaattgatgttgacaaggtaagatgcatagtaagaaatatcgtgagagattggggcgaggagggtcaaaaggaacgtgatgagtgctataagcccattctcgaggagcttaatcgtctttttcctaaccggagtgatcagaggcctccttcatgtcttgtccctggtgctgggcttgggagat

SEQ ID NO: 3279 - DNA, 873 bp, Sorghum bicolor
  Clone ID: SORBI-28MAY03-CLUS55104_1
gcacgaggatcagacggcagcagcaccaggccgccggccgccttcgttttcctcggctccgctccactccaccgacggcggcgcccggagctccccatgacgacggtgagccacctggatctcgaggccggctggcccggccccggccccggccgcggcggcggcggcggtccgcccgaatatgagcaggcggaggtcggcaattttcgcaaagatctagcccttgcttacaagactctcggcgttgtgtttggtggcctcgtcacgtcccccctctacgtttacccctcaatgaacttgtcatctcctacaaaagatgactacatggggttatacagcataatgtgctcgacgcttactttgattggtgtggtcaagtatgtaggcatagcacttaatgccgacgatcatggtgaaggaggtacatttgccatgtactctctgttgtgtaggcatgctgatataggcatacttccttccaaaaaagtttattcggaagaagagcctctacttcagaatcagtctgcaagagctggaaggcctagctggctggggaagttctttgagcgaagcataacagccagaagagcactgctgttcatggcaatactgggaatgtgcatgctcattggggatggcatactcactcctgctatttcagtattatcagcaattcaagggctaagagggccatttccttctgtcagcaacgctgtagtcgaagttctgtctgctgtgatccttatcggcttattcttactgcaaaagtatggaacctcaaaagtgagctttctgttttcaccgatcatggcagcatggactttcaccactccaattatcggcttgtatagcattgttcattactatcccggc

SEQ ID NO: 3280 - DNA, 564 bp, Sorghum bicolor
  Clone ID: SORBI-28MAY03-CLUS55179_1
tttcgttggaagaagccatagagaaactcaggagactctaccatgtggccagaacggatgaggagcagatggttttgaattggcattttgcaaatttggaattctccaatgccggctgcctatcagagctttcactcgcgcactgggaccaggacgatcctgctgcgggggggggagatctttgtttcttagctggaggcaattctagactcatacatgcattgtgtgatggggtgccggtactctatgagaagaaagtgtcgcgaatcgagtatggagtggatggggttagtgtcacagtggaagaagggcagatttttcaagctgatatggttctctgcaccgtgcccctcggggtgcttaacagtggaagcatcgtgtttgacccagagttgcctcaggagaagcttggggcaatacagaggttgggatttgggttgttggacaaggttgccatggtgtttccccatgtgttttgggatgagaatattgacacgtttgggtgtttgaataaggatagcagcaagcgtggggagttcttcctcttctacagctaccacactg

SEQ ID NO: 3281 - DNA, 827 bp, Sorghum bicolor
  Clone ID: SORBI-28MAY03-CLUS55142_1
gcacgagggcgcattccgcctctcctccgctgggcttctctcccgagctccccccgccccccctccccggcctcgtatccgccgcgagccgcgcctccgccgcctgctccggcgggcgggacccagctcgcggcgtctccccggcagcgaggtacatgatggaggggactggaagagatgccaacccattgagcggttaccgaattggcaaaaccctgggaattgggtcgttcggtaaagtgaagatcgcggaacatatattgactggccataaggtggcaatcaagatcctcaatcgcaggaagatcagaagcatggaaatggaagagaaagtgaagagagaaatcaagatactgagattatttatgcatcctcatatcatacgcctttatgaggtgatagatacacctgctgatatttatgttgtcatggagtatgttaaatctggagagttgtttgattacatcgttgagaagggaagactacacgaagaagaagcccgtcgcttttttcagcagatcatatctggtgttgaatattgccataggaacatggttgttcaccgtgatttaaagccagagaatcttcttttggattcaaaatgcaatgttaagattgctgattttggcttaagtaatgttatgcgtgatggtcactttcttaagacgagttgtggtagcccgaattatgcagcacccgaggtcatatctggtaaactatatgctggtcctgaagttgatgtctggagctgtggcgttattctttatgctcttctttgtggtactctcccttttgatgatgagaatattccaaaccttttcaagaaa

SEQ ID NO: 3282 - DNA, 630 bp, Sorghum bicolor
  Clone ID: SORBI-28MAY03-CLUS55198_1
ggtctgggatgagcgtttcctgactgaggccgacgccgaggcgaaggccagcgatggtgccgcagaggatccccagccggagctccggcactccaggagcgtcgggagcatcggcatgctgcgccgtggcggtggcgacagcgacaacaagaaggcgcgggcgaaggagaagaagcagaagcaggggcacaaggaggaggcgcgcagcaaccaacagcaggtgttccggaccaaggacgtggccccggacgtcgacccgccctcgccgagggtgtccggctgcatcctctgcgccatcttcggcggcagctctggcagcaccggcaaggcacgccgccggtccaagtccaagcccaggaagaagtgacggcatggcaacacgtacgtacgtcgttgctgcatctgtttttcccactgtaaaaagtttgttggggccatggttatgagtgagtgcacatgtttatactgatagggtcatatcatatgagctttgctactcgatatacaccatttagtcaggttagtagtttcctcttttttgggtcggttggtttcttgatccagatccatgctttgaggtttgagcgacggtttagatcttgctggtatatgcatgcagcagctatgggt

SEQ ID NO: 3283 - DNA, 840 bp, Sorghum bicolor
  Clone ID: SORBI-28MAY03-CLUS5556_1
cggacgcgtgggcgaggttccgggaggctctgttcttttactcggcactgtttgatgctctggatgcaaccaccccaagagacagcaaccagaggatgctgattgaggagaacctcttcgggagggctgccctgaatgtcattgcgtgtgagggtacagatcgggtggaacgccctgagacgtacaagcaatggcaggtgcggaatcaacgagcaggcttgaagcagcagccgctgaaccctgatgtcgtgcagatagtgcggaacaaggtcaaagattgctaccacaaggactttgtgatcgatgttgatcaccactggctcttgcaggggtggaaaggccgcatcctctatgccatctcgacatgggtggcaaatgatgctccctcttacttttagctgttcttttgactcacttgtctacaaatttaggtttaggtatgtcatctagatatatctagtgacaagtgtgttctgtatggcccagttagtagccatggttcagtggttacttggactcgaggtatgcgatatgcctagtgccctattgagaattcaacatgcacctgttctttccaagggtagattcagcttctgaggaacatgggtgacacaagatatggaggatcagaaggcagaaggcattccgaaatcagtcctttgatgtaatgtgaattagatgcttattatcactcagccatgttggtgcacagtgctgaatatgatctagctctaggtcctggtctggataatgttctccgtagcatctgctgtgcgtgtgccctgtgatcaatccagtcagttgatcaggctgtaattgacactgctctgtttactggtg

SEQ ID NO: 3284 - DNA, 727 bp, Sorghum bicolor
  Clone ID: SORBI-28MAY03-CLUS55613_1
gcacgagggaactttgggaggtttataatgggaacaacgtgaggctcccatggaaattggaggaatttgttgccagaagcccatatgttcgggattctgttgttactgttggatcgaaagtttcaactgtttttgtagttaatgctgatagtggtgagattatttacaggcacagtattccagctgtgttaaatgaattggaaggaccagggatgcacggggcaccatccaagctaaatgcccgtactagtgatggcagtgagaagatcatagtgcttgtgagaactgactattctctcagcgcatcagatcttggcaagcatttatttaactggacaagaacttctttcactgcaaaccaatatgctaaatacaaccaccctgacatgcttgatcagtcaccttgcctgcgaggagatattccatgcattagaactgagggtttgccacttgctttacctgattcagattcagctaatgtaattgtcttgaaagatggtaccccttttatttccatccatggttctgatgctctggaaccaggtcaaacctcaaggaagctaccaaacactgctgggaagtcaaatatcatattggatgattctcaaaatcaaacttatgatggtgcacgatctcatgtcatctctgctgatcctgaagctaccaaataccccactaggaacacttatggatggctattccctttgtttcccatatttttggtcat

SEQ ID NO: 3285 - DNA, 601 bp, Sorghum bicolor
  Clone ID: SORBI-28MAY03-CLUS55616_1
gcacgagggcttcttctgtgccagaatcattcaaatttgctcgctggttgctcgaggaagacttgaaacctgcagaagatttatcttcaaagagcctgctctccatgattgtcaaaaatgaaaatccaggtccagaaaatataatccatgctcctttatctgatgctgctgtccagaatttatcaccaagagcacctattcataaacttgattctgcatcaaagctcatctcatttacatcccctacacctgctgagggaattcttgaacaatacaaccatcctgatattccagaggcagttcctgttatgatgacatgtgaggatcttgagcaaacaatgttagcacaggttagcaatagcagctcaactcagataaatgctacaaaggagcaactgactgtaacggatgagccagttgccatgcagaaagtagctgtagataatcatgcatcacatcatcttctttcattgttgcaaaaaggaacagataataagggtgcaccttcgctgggtttccagagaggatcaacggatgaacctcagagtgttggcgcaaatttaatggccaatggtggaatatctggaagtgatccggttaa

SEQ ID NO: 3286 - DNA, 586 bp, Sorghum bicolor
  Clone ID: SORBI-28MAY03-CLUS55619_1
gcacgaggtaaagatggtcatcataaaagtgtacgaattgctgacaaagtcgctgaattgcaaattgatgcaaaaatttcaccatttcatcaaacattgcctttccttcaatatcttggagttcgttttgggcttcgtccagaagatgatttttgttctcctcatgttattggaaaacttgctcctctgaatggactttttgttcgaactatccatcaatcaaataatgaaatctttcggattagtggaattacaagcattcctgccgagaaactaacatttgaagatcgtaatggcacaatggtttctgttgctacttatttcgaaacagtttacaagaagaaattgcaatttccccattttccatgtgttatcaaaaaagttggtaaagataagattacgaaaaagccaattgaaatgcactatccatttgaagttttggaagttcaacaaggtcaaaagtttcctaaagatgctatgaataataatcaggaacagaatatgataaaagctgcacaacgtttgcctcgtacaatgattgaagcaattcgaaatcaaaagaatcttgctagtattaatcaagatg

SEQ ID NO: 3287 - DNA, 505 bp, Sorghum bicolor
  Clone ID: SORBI-28MAY03-CLUS55627_1
gcacgaggcaaacttcgtcctactgcgttcgcagaataaaatcctgcttcacctatcgtcttgactggtgtaacacagcgggccaactactccatcggaccctgttatcttcagcttggcttctcatcggcggccagactgactagtaaggcttgtcctgccactaaaggccatccacaactcgaccttacaacttaccgccggcttcatcagcgatgcatggtttgacattgataacaacaggcctgagcctgatctgtccagctgctgcaattctcgttgcagataattcgccctgtggaacggtatgtggcaacgttctcgatgcgactacaaacgacgatatcgtctgccaggaaggcgattataccagtggcgcgggcattgtatttcaacagtgcctgacgtgtgagcaaagcagcgactacaccaccaagaacaatcaaacagaccaggaatactacctctacaacttgcgttacgcaacctcgttttgcctcttcgg

SEQ ID NO: 3288 - DNA, 637 bp, Sorghum bicolor
  Clone ID: SORBI-28MAY03-CLUS55656_1
agagagctccgcgccgcaccagttgtcctcctcttcaccatcctccttccttgcccacctcaaaacaagaatcttgctttttccgacgataccatagctccacccaatccttgcgctccctgccgtcgccatccctcctcctcctagcgcatctcattcagtcattcctcgtcctcaaactgactgatgcggttggtaccaaggttccggcgctcgacggcccccgcgccgtgctcttctagcctctagtgccgcttgaattccgggcaatgggcgccgctcagttggtgattctgttcttggcgcttggcgccgcgatgcgggcggcgtcggcggcgggggcgcggccgagcgaggtgaccgttggcgctctcttcacgtacgactccacaattggtcgcgcggcgcagcttgccatcgagctcgccgtcgatgacgtcaacgcggacggcaaggtcctcccggggacccagctcaatttggtgccccaggacaccaactgcagcggctttattgggaccatcgaagcgttgcggctaatggaaaaaagcgtagttgcggtgattggcccgcaatcctctgggataggccatgtcatctcccatgttgttaatgagctacatgtacctcttctatc

SEQ ID NO: 3289 - DNA, 669 bp, Sorghum bicolor
  Clone ID: SORBI-28MAY03-CLUS55276_1
caacgaagccccaatttcaatgcctgggtgcggcaacaaagatttctgtccattcgaggagttcaaggagaagattgtgaaaccgcacctgaagcacgactacaacatgatatgcaagatcaaatccccggcggcaagcgaggagcccgcctcgttcccctccagagtgtccagtttcttcgtaggactcttctcgcagagagggtaccacgccgtgggcgctgaaggcgtcaagaccgagctgtaggtcacactagcataggtgcatagcaaccatctgccacggtgccgcctctcaccgtctgcgagcagcgagcacgagcaaggaaccagactaaccgatgcactgccctgcggtgtatttgtagttctgtacgggacgaggaggcgccagttcaatttctccagggccagacgcctcataaattctgtttcacttcgaactcccttccgcgcagaaagaaatgcatcccgtcgaggcacgcgtggcttttgccgttgtggtcatgtcactgtagttttaatgacagctgtggactctactgtgccatttactatagtactctgctacaaggctttgtttaattctaatttttttataaaacagacgcccataatatttttgtttgtatttaacaaatattttctaattatagaataattagactt

SEQ ID NO: 3290 - DNA, 700 bp, Sorghum bicolor
  Clone ID: SORBI-28MAY03-CLUS55341_1
gcacgaggcccttctcttcctccatcgcggcaccgcaaaccctagccccgcggctctctccttcccgtcctccctccgcggcgtgtccctccgctcccgggccgccgccgcaccgcccgcagagaccctctctgacgacggcatccccgacgcgccaccggaaggggagggaacaggaattccgttgccatcgtcgattggggatgatggggagcagctcgcacccaaacagaagatcagaatcaagctgcggtcctactgggtgccgttgatagaggactcctgcaagaagataattgaagctgccaaaacaaccaacgcaaagaccatgggtcctgttcctctgcccactaagcggagagtctattgtgtgcttaactctcctcacgtgcacaaggactcacggttccatttcgagatccggacgcatcagcggctgattgacatcatgtatccgactgcccaaacaattgattcattgatgcaactccagctccctgccggtgtggatgttgaggttaagctatgattctgttggagctgaacttttcaaagtttgatgtaatatggcacttattttccgcagcttttctccttgatccttttgttgtctgggactgaaaaaaacgtagagcctgtactaggaaagaagatattcagatttgaattgtcttgcatttgaagtatcaatgatatgtcc

SEQ ID NO: 3291 - DNA, 579 bp, Sorghum bicolor
  Clone ID: SORBI-28MAY03-CLUS55365_1
ttcctgtctgcggatttctagtcttccgcttcgggcctcgccccgcccttcccgttcgggacccgtcttgcatctgcctgcctgtgcccccccacgagatgccggcgggtgttctcggcctcgttgcccccgcccacctcatgtcctctgccacggggcgccacttcttgcaactgcgtcgccgtgcacccccacgacggtctggctcggccctcaggcctcttatttgtgccaccttgtcccttttgagtcctttgctgcctctggatctgggactcctgcttctggcaccttgactccttcgcctcctttcgcgcttctggacctcaggcctcatctcccgtggccccattcaccccccctatggtccacgtcctgtcgccatcttcttcttcgtttacctaccggttggtgatagctccggctcccacacctgtccggcgtcacgccctagttctgttctctcgcagggcgtctatttgttctggttctttccggctcttggtgctctgctcaccccttgctgccgttcatcatcggttacaactttatgttcatgcttgcttaacaacatgcttt

SEQ ID NO: 3292 - DNA, 483 bp, Sorghum bicolor
  Clone ID: SORBI-28MAY03-CLUS55371_1
ctaaacctaaaagtgatataaggcaacaagatcttttgaagaacattgttgggatcaaaccaaagcgaccaaaagttagcagcccgtcacagccaacagatagcaataagcctaagcatggggaagaagattctgtcagcgagttgtcttcatcgcagaaccagtcggcctcgggactacttgtgggtgagaagggatcatctcatgggattgtgaatcctgaccatacagcgccaaggctagataacccaagagaggtgaagcaacagaacacagctggaagtttgcttggtttagcttatgagagttcggacgaagaatagttgatcatgtgagccctatgggaactggactatttactgtcagatgtctgcgttccaaacggcaaaatgtagattgtatattagtttttttaatgtactatcattaggttgtgttttgcatcaggattgaatggaaagctgcgttaatgttgctaaaaaa

SEQ ID NO: 3293 - DNA, 509 bp, Sorghum bicolor
  Clone ID: SORBI-28MAY03-CLUS55425_1
aaccgccattggtaagatcggcggggttatttgcccactcgtcgccgtgggcatgctgcggaactgccaccagatggaagcagtgctggtgtttgagctggtgctgttcctcgctggagttgcgtgcattctcttccctgtagagaccaagggccgagaaatggactgaaggacgcatggtgttagctaactcaggacacttggggcgtccagatgggcttgtggttcatcataattgtgtatagatacaactatatccacgacaagtttagtggatatatgcaaagacgtgtaaagagaagttataatcattacgaaaaaagaactagcaatttgtaataggatttattcttatcaaacgtcctcatcttcaggtaaataaatttgtaaagttaagtaaacatgtggtggccagtgattataacgagaggatattctcgtggtgctggatatgcccaacacgtcaattcgttgggggtaacatgacctaacgcgtgcctccaacctct

SEQ ID NO: 3294 - DNA, 497 bp, Sorghum bicolor
  Clone ID: SORBI-28MAY03-CLUS55741_1
gcacgaggctcacccacgactttactttcgctcaagatcggcgataacaaagaccttctctcatccgattaccatctatccacatcactttcacgacagatcaccgcaatcatgcagatcttcgtcaagaccctgaccggcaagaccatcaccctggaggttgagtcttccgacactatcgacaacgtcaagtccaagattcaggacaaggagggtatcccccccgaccagcaacgcttgattttcgccggcaagcagcttgaggacggccgcactctatctgattacaacattcagaaggagtccacccttcatcttgttctccgcctccgtggtggtatgcaaattttcgtcaagacactcactggcaagaccatcacccttgaggtcgagtcatccgataccatcgacaatgttaagtcgaagattcaggacaaggagggtattcctcctgaccagcagcgcttgatctttgctggaaaacaactcgaagacgg

SEQ ID NO: 3295 - DNA, 499 bp, Sorghum bicolor
  Clone ID: SORBI-28MAY03-CLUS55752_1
ttgcgtgtcatgtttgagtaacttttctgtatgaatatatttaatccatgtttttgctaaacttggaaaatgcatagtaaataaaatatggttcggaaaaatgtgaaacatgatttgttggctctgcatgtatgtttactcgctgggaaaatattggtacatattatttggtgtataaatgaatttatagtaatttaaatgcttgcatggaagtgatttatgatttttaataattaattggatcatgcaataaatctggaaaattttgtgggtgtttcttatgatattagacaaattgtaaaaatatgaaatctgttgtttgacacttatatcacagtagagtgattatacttaccttattaattaatcttgtgatttttgtagctcaaaataagtatccaaaaattatgaaaaatttacagtagactttatgcttggctggtagcctccagtaatttttgtggaatttattgatgaacagaactgcatgtaattttta

SEQ ID NO: 3296 - DNA, 504 bp, Sorghum bicolor
  Clone ID: SORBI-28MAY03-CLUS55758_1
gcacgaggagcccagttagaagcaacgctccctccctcagtccccgacaccctaccccgacttccgcacgcacgcatcaccagttcaccaccgtcttctccgccgccaccgtcttcgtcgccccagttcgaaccatgtgcatgcgcctctgcagttaaaatggcttacatttttaaggttgcccagaaagtgaagacaggcctgagaggaatctcaacttgtgttattagggggaagtatgaagatattacttttcctcaacacatgtttgagcctatcgttgaatatgcaactcggtgcccattggtctcaaaagtacctactggaaggttgtttcatgtagcttctgataaaccaaatcagatggaagagcattggcgaaggctattcttctctggattagttcactcagtcaactgcaaggccaactctgattgtatttacaaggcttttgacctggacatgttggagtgctgagggatcttaatgttcttgcttttagaa

SEQ ID NO: 3297 - DNA, 381 bp, Sorghum bicolor
  Clone ID: SORBI-28MAY03-CLUS55760_1
gcacgaggaaaaagcggccgctcgctacccacaggcacgccttgctctgtaccgcacgtacgctgccagttgagtatcctgctcgtgtacccgccccccagccatccgctacatcatctttgcccaaacgggtaatccacaccgccagtcccgcggctacaccgggactttgctacaagagtccgccatggaccactcgtactccagctcgcaaaaccacatggactttcaccacaccccgctcgacaggaagccctctgccttttcctttgacgacaacgccaccctagactctgccattctcgacacgcccgtcctcatgtcgccctcgacgagcaaccagggcatcttctccccagacacatccatctgggaggactt

SEQ ID NO: 3298 - DNA, 1018 bp, Sorghum bicolor
  Clone ID: SORBI-28MAY03-CLUS55811_1
gcacgaggtgttagaccacggacaatcacataagctccttttgtaaattaataatgagcgccaccaagtttgagcgaaagcaagagtactttgccaagttgagcaacctcttggatgagtaccccaagattttgatcgtccaatgctccaacgtcggttctcaccacatgcaaaagatccgcaagatcctccgcggtgaagccattattcttatgggcaagaacactatgatccgaaaggccatccgctcgcacattgagaagaacgccgatttggagaacttgttgccttgcgtcaagggtgaagtcggtctcgtgttcactaagggcgatctctctcaagtccgcaagaagctcttgtctgaaagagttgctgcccccgccaaggctggatccctcgcccctgttgatgtcgccatcaagtccggcaccactggtctcgaacccaccaagacctctttcttccaagccctcaacatccccaccaagattaacagagggcaaattgaaatcatcaacgatttggtcttgatcaagaagggtgacaaggttggctcttctgaggccactttgcttcaaatgttgaacattaagcctttctcatacggtctccaaaccaagactgtctatgacaacggtcaaatgtacgacgatgctatcctcgaaattaccgacgagcaaattttgggtcacttcgctgctggtttgcgccaagttgcttccatctctttggctattggtatccccaacattgcctctttgcctcacaccattgccagtggtttcaagaacgttttggctattgctatggctacagatatctctttcaagctcgctgatcgcttcaagaacgccgctgccaaccccggtgccgtcgtctctgcccccactggtggttcctctgcccctgttgaggaagagaagcccaaggaagaagaagaagaagctgttgaagtcggtggtctcttcggtgatgacttctaagcaccaaacttgttaacaaaattaaaaaataagtt

SEQ ID NO: 3299 - DNA, 560 bp, Sorghum bicolor
  Clone ID: SORBI-28MAY03-CLUS5548_1
gcacgaggccaacaccaacaggcaacaaggaacattctgctgtttacatagttgaaagagaacttaagttactgaatttccaattgtcaaacacagcgaatccatcccttgggaatgctggtgttgcatctgatgcaggaagatcaaggaatgattcaatagaacagttgatagtaaagcagaccaagaagcatatcagtactcctgctccccacgattcctattcggtcctttccgttagcagttctgggaagtatgttgcaattgtatggccagatatcccttcttttgctgtatacaaagcaagtgattggtcagttgttgattcaggcacagggaagctttttgcctgggacacctgtcgagacagatatgctttagtagagagtgcattggccccaagaatgccacttgttgtgaaaggtggttcttctaaaaaggcaaaagaagcagcagcagctgcagctcaagcagcagctgcggcagctagtgctgcttctgccgccacaggtgcagtgcgtatcttattagatgattgaacagcacatgttttgcaaaga

SEQ ID NO: 3300 - DNA, 652 bp, Sorghum bicolor
  Clone ID: SORBI-28MAY03-CLUS55518_1
aggccatcctggttgctgactattccttcacgcctctcgaatactggcgtggcgtctccctcaaggcacgcgaattcatccgccgttgtctcacagtcgatcccgcggcccgtatgacggcgcacgaagccctctcgcacccctggattgcagacctcggagacatttctgctgaaggcgaagaggatctcctgccaaccgtcaagaagaacttcaacgcgaggcgcacgcttcatgctgctatcgataccattcgtgccatcaatcagctgcgggctggcggtgcagcaggtatgatggacggcgctcggtctggcgagccgagacggggtgctcctgcgaatgtgccacagccagtggctgacgaggatcccatggacattgacaaaatcgacagtcgtggaaatggccacggccagaccgaagagatgatcaaagagcaggagcgacgtattcacgagacacagcagggattgtggagtaggcgatgagtcatccacttagttttgaagcattgtgcgacgaccacggtggaattcttgtatagcatcggagaaagcttggtgtctgcttgggtataccagcggtggatctaggatctcctggtccacatgattatacgatttctttgagacatactctgtcaacaact

SEQ ID NO: 3301 - DNA, 929 bp, Sorghum bicolor
  Clone ID: SORBI-28MAY03-CLUS55522_1
gcacgaggcacgacacaaacgcaccccgatcatatctgagttatacatgctcatgatgcccaaccaaccaaccaactctaagctcaggactgcgtcacagttggcatattccaggtccctaaagagaccagacatctcagtagaacaagtgaacgcactcgcaacaaagctgtctagctacgagtgcgctatgtttcggatcgcgcacatcattcgtcagtttgacagttcaagtatcgatcgggtatacaagcgtgctatatacaagtaccatacctctccaggcccagagcaatatccgtgcttgctccccacggatcctgcacaacgggtcgaatattacacttctgtcgatcgcattcttgataatgctgttaacatgcgcacccttctggatgcgttcatccaccagtttgccgcgttttccggcacaaattatatcatggaagtagagttacgatcctgtaatcttcgtactcgcactgctgtgctctctcaagcacgggatctgactgcctcttatacacgagaagggcggccagaatcttatgatcttatggacgaggaagacatacctctccttctacctgagcctatccctggccagcattctgttcctccctttctcctgaacatgtcagaatcagaagatgaactggaagctgtcagcgactctaacaacactatcctcaactcaggacctctccacaagaccttcgagctcacaaccaaggcaggtgccaagcgcacgtataccgttgtcaacaccaagactgattcgcaaaatgttgccatgtacgaattctgctatgaggatgacccagagttcccggcgtgggttgatagctggaggtttgagtatatgcaaagcatgagcgtacctatctaattcactacagtatgtacgctgtccactattcttcttcttg

SEQ ID NO: 3302 - DNA, 581 bp, Sorghum bicolor
  Clone ID: SORBI-28MAY03-CLUS5554_1
gcacgagggaaagatgacccgtgtcgtccttgaggtggatgtgaacggcgaggagctcttcttcgttgataaggacgttcttgcgcgcttctgcggtaggatcaggaggctggtggccgccggcgcagcgacggcgaggcggcatccgagggtggctctgcacggattccccggtggacccgaggtgttcgagatcgtcgcgaggttctgccacactgacggcgggcgcggcgcggcggtgaccgcggccaacgcgtgcgtgctgcggtgcgcggcggagtttttgcgtccggcggcggcggacgcacccgaggccgcgtccacggccgcgccgagcctggtgcggatgacggagaaggcgctcgaggagatgccgcactggccgtggcacaccgtcgtggacgccgtgaagcagtgccagcgcctactcccgctcgcggactccacaggcgcgttcgacgcggccgtggccgcgctggtgtcccagatggccgtacccccgccggcggcaggtgacaccactcccacgggctcctcgtcggagagcactgtgtttcggttcttgtgcgacaccaatagca

SEQ ID NO: 3303 - DNA, 683 bp, Sorghum bicolor
  Clone ID: SORBI-28MAY03-CLUS55541_1
cagcaacatcgagatcattgctgagcctggccgatactacgttgccaccgccttcaccatcgcctgcaacattatcgctcgccgaactgttgaggaccccactctcgatggcaagggctacatgctctacgtcaacgacggtgtttacggcaacttctcaaacatcatgtttgaccaccagcagccgatcgccaaggttctccgtgcctccggcaagactctcttcgagaccgccgctgcccatcccactcccgagggcgagggcttcgagtactccgtctggggtcctacctgcgatggcatcgatcgcatcactgagagcactcgcttcgactccattctcgatgttggtgactggctgtactttgaggacatgggtgcctacacaaagtgctctgccactcagttcaacggcttctccaacgcccgcgacgttatctacgtctgcagcgagcctggtgccaaggcccttcttggtctgtgatctcgatcacttcatgcatctcaatggctagcgaaaccatttctttcgtgttctctttggagaatccttttgttcgtatgttttgaatctcatcatgggccgatgaaaatagcaacccaaggagttgacagtcaatatttgaaaacgagaaaagagctagatagacggatattagattttaattaattcctgaactgtc

SEQ ID NO: 3304 - DNA, 820 bp, Sorghum bicolor
  Clone ID: SORBI-28MAY03-CLUS55865_1
gcacgagggcttaactctgttagaatcagcgaatagctttcgctgtcgcttccagtacccaccggcctggccggcaggacccgtccgtccgaccggcctcacatggtctcgtgcgcgatccatccaagggacgacttgccgccgagccgagtcgcacgccggacagcgccgcgctagcgctgcccatctgatccttgtcccagcacgaggcgagcacctttaaatacgcgacgcggcgctgcgatgcgacagcaacaagaggagggcgttcgtttcggagtcacgtcgggggcggtgccttgcgggagggtgactggtgccggccgggcggagagctagctagagagccagcggcagggaccggggagcttaggggagggggaagcagagcaacgacgacgcgccccgcgatatatggccacggcgagagccattgccgcagcggcggccgtgttggtggcggcgctcctcgcgccggccgcgcgcggggtcgatcgcggcgagttcccgccggggttcctcttcggcgccgcgacgtcggcgtaccagattgaaggcgcgtacctggaggacggcaagggcctctgcaactgggatgtcttcacccacacacacactggagcgatcatggacggacgcactggggacgtagctgacgaccactaccatcgctacatgggagatgtggagatcctgcaatcgctgggcgtcaacgcctacagattctccatctcatgggcgaggattctaccaagaggccggcttggtggcgtcaatgcaggtgggatagccttctacaaccgcctgattgatgcgctcc

SEQ ID NO: 3305 - DNA, 700 bp, Sorghum bicolor
  Clone ID: SORBI-28MAY03-CLUS55886_1
ctggtatagtgttcagtcatttgtatgctcgatggtaattttgttagtcttttgctctgaatcgttggaaagccattttaatatgtgcatggttggtacaaccaattagcgacaaggcatctgggaacacaaatatgcgtaaacaggtaactatggctgcacctgtctgtggcccaggttctctatttcctagtactttttttgttgtcatcaagaaatttcttgaggagaagagccaattgcttctaacaaatgcagtaaatggttgagttgttaactcattccacaaatttgcatctaccatattggtcaacttgggtaaacaagcttgaaaaaagctgacagtggcacaaatttacatagatcactttgtatttttcaaaagcagcttgtctgtagacagggattttctacggtatgtaggcttaattgggtagttttgcacttttgctggtgagtatagtatttatagttccttcagtttagctattaaagctagcactgctaccaaattctggttttctggagcaatcgacaccctgacacagcactaattgcatctctcaactcctagagtcgaagatccgtcgattttgtccataaggggtatacatcactcacttggtattatcacctttctgttaactttgttatcaattctgttcgtttggtaaacgaaggctgaacaaatttcaccgat

SEQ ID NO: 3306 - DNA, 553 bp, Sorghum bicolor
  unsure (1)..(553): unsure at all n locations
  Clone ID: SORBI-28MAY03-CLUS55889_1
gcacgagggttttccccttcctctcggctccatccagcctcggatccccaaccgcaagaacagcaagaatcggcggcggcgatggtgtgcgctaagtgcgagaagaagctcgggaaggtgatcgtgcctgacaagtggaaggagggcgccagcaacaccaacgagagcggcggccgcaagatcaacgagaacaagctcctctccaagaagaacaggtggactccatatggaaacaccaaatgtataatctgcaagcaacaggtgcaccaggacgcaaaatattgccacacctgtgcttactcaaaaggagtgtgcgcaatgtgtgggaagcaagtgttggacacgaagctctacaagcaaagcaacgtgtgatcatatagctgtactatattgctaataacttgtatgaaaacttgtactcgcaatgcaatcgagctgtcgacaatagttgtgtgttaacaaagtatgtacttgactaacaattctggaacataaaatgtttccaaaatcaaagctccagtgactttaaaaaaaaaaaaaaaaaaaaactcgn

SEQ ID NO: 3307 - DNA, 432 bp, Sorghum bicolor
  Clone ID: SORBI-28MAY03-CLUS55895_1
gcacgaggacgaggccctcgttgcgagcgggcggggcggcacggtggagtggttcgagtccaagggcaaggagcacgtcttcttcctccacaaccccggctgcggcgaggccgtggagctcatggatcgacttgtcgcgttctttgctgggaactgaaattcgtcatgtgtggatgtgaccatgagacgaatagagcacaagaagattgtttcaaagatgcagctcattgctgaatcgaataattgagcacgaagccttggactgatcagtttgtgccatcgctttgggtcgggtctcttttttctcatcgagaataatatactagtaggaccaaaattatctgggtgatgctatataagtatatgttagcatccgaaactatcaacttgtgtcgcctcctgttgtgggtgttattaaaactgcatactatt

SEQ ID NO: 3308 - DNA, 655 bp, Sorghum bicolor
  Clone ID: SORBI-28MAY03-CLUS5591_1
actcgcttcgtcgccacgcgtcgaggcattctttgcagtctcgcctcgctcgagatgaccggtgctactaggatgctgtcggtgcttcttctggtggtggtggtcgcggccggcggagcggccgcgtcgcactcgagcccgagctcgtcgtgccccgcgacgccgccggacgccgggaacacgctgcaggtgtcgcacgcgttcgggccgtgctcgccgctgggccctgggacgacggcgccgtcttgggcggggttcctagcggaccaggcgtcgcgtgacgcgtcgcggctgctgtacctggactcgctggcggcgcgtggcaaagcccgcgcgtacgcgcccatcgcgtcggggcggcagctgctccactagcccacgtccgctgtgcgggccagcctcggcacgccgccgcagcagctgctcctggccgtcgacactagcaacgacgccgcgtggatcccctgcgccggctgcgccggctgccccacgtcgtccgcgccgccattcgacccggccgcgtccacctcgtaccgctccgtgccctgcggctcgccgctgtgcgcgcaggcgcccaacgccgcgtgcccgcccggcggcaaggcctgcggcttcagcctcacgtacgccgactcctcgctgcaggcggcgctgt

SEQ ID NO: 3309 - DNA, 549 bp, Sorghum bicolor
  unsure (1)..(549): unsure at all n locations
  Clone ID: SORBI-28MAY03-CLUS5600_1
cccagaaacggcgcccgctgatggccagttcatgcggtacagatggtaccgcatacagagtgatcggaaagtccctatctgcagtgtgcatccaatggaacaggcaacgcttcagtgcctcggctgtctcaagtcaaaaatacctgttgctaagagctaccactgttcagctaaatgcttctctgatgcatggcagcaccacaaagttttgcatgaacgagccagtagtgccctaaatgaaaatggggctgaagaagaggagttatttggcagatttggcagcggtggttctggggttctaagtactgctggatctggttctttgtcaaattttggacaaagccctggtgttaacaatggacctgtgcctttgtatccctcaggcactgataaaaattctggagaaacttggtttgaagttggacgcttacgaacatatacaccaactgctgatgatattgggcatgcactaaaatttgagtgtgtagctgtggactcagaaaaaaggtctncaattggacctnctacctcaattatgacatcacgtgt

SEQ ID NO: 3310 - DNA, 493 bp, Sorghum bicolor
  Clone ID: SORBI-28MAY03-CLUS5567_1
ggcgcccgcttaataagttgcttactgagcttgtttttgtggaggacttgatggaagctttggaggaagccaaagcaattggagcgtgagcttggcgatatatatgattacgttgcaccatgctttcctcctagatatgaaattttccagctcatggtaaacctgtatactgaaagattcattcagatgcttcgacttctcagtgatagagcaaacgatattcaaaatataaatatcctgaaggtgactggttgggttgtgcaatatcaagaaaatttgattggtcttggtgtggatgaatcacttgcccaagtttgttctgaaagtggtgcattggatcccctcatgaacatgtatgttgagcgtatgcaggcaacaaccaagaaatggtacagtaacattttggaggctgacaaaacacaaccaccaaagagtacagaggatggaaaactatatacacctgcagcagtggatctattcagaatattgactg

SEQ ID NO: 3311 - DNA, 638 bp, Sorghum bicolor
  Clone ID: SORBI-28MAY03-CLUS55686_1
ctgctcgcccccccgctccccccccgccgtcgcgattgttgaacgattggcggccgccagcgagcgcacgcccgttccagttcctcgcggtgtttggtttggtggtggtggctagagtctcgactggactggacgccgcggctcgccgcccggtcggagagatggactcggtcatggccgccgtccccgactcgccgccgcagactgtcgtgctcgtctccgccggcgccagccactccgtcgcgctcctcacgggcaatgtcctgtgctcgtggggcaggggcgaggacgggcagctcggccacggcgacgcggaggaccggctcgtgcccaccgtgctgagcggcttcgacgcgcccgggatcacgtcggtcatctgcggcgccgaccacaccaccgcctactccggggacgagctgcaggtctacagctggggctggggagacttcgggaggctcggccatggcaactccagcgacgtcttcacgccccagccggtcaaggcgctgcaggggctcaagatcaagcagattgcctgcggggacagccattgtcttgccgtcaccatggccggacaagtgcagagttggggccgtaaccagaatggacagctaggccttggaaccactgaagactcg

SEQ ID NO: 3312 - DNA, 588 bp, Sorghum bicolor
  Clone ID: SORBI-28MAY03-CLUS55685_1
gcacgaggacgacctcgtctctctctcgctcgcgggctagctacctccagcctccagccatggcagccgggcaaagctcgaccccatcgttcttcaacttcctgaaagaaggcctgctcctccctagccacaaccggaggctcttcgcagctgtcctcacagttatcgccgcctccacctgtctcctcctcctcggcaacgacctcgccgtccagcccctcacagaccagcttgacctcgacacaaaggcgctccacagcgccgatccccgtaccagtagcctagcagacattcttcaactcatccaaaagaccaaagatgacgcccgggctctcgtgctcaccagcgcagcctatcctctgctcgccgccatcaccagatccgccatccaggtcgtcgtcctcttcgccgccgtcgcgacatactccggcgataagctgctcaccttcgggtcgctccttggcaaagtcaaggcgcagctgaagggccccgtgctcacgctcgccttcgtctacgcactggagatcgcctacgtcgcgcttctcgctgccatgtccgcgctgctcttgttcctcatgatcaagaaat

SEQ ID NO: 3313 - DNA, 524 bp, Sorghum bicolor
  Clone ID: SORBI-28MAY03-CLUS55700_1
gcacggggatccggattcacaaaaccctagcgacctcgattcctccccaggcatggccgtcggcccctacactctccgcgtctccccgccgccgcggctcgatgccttgctcttcccacagctgcggcctcacctacgttgccgcgtgtccgctcgggttgctgccgccggcaccagctggtctcccgccgccggtgactccgaagatggggtcggcggctggtgggttcccgagtacgagaagccgatgaaacaggggaggaggattgggtttgggagagctgtcgtggttgggctgggagctcctgtggcgatcgccttggctgggctggcgtggcgcttcccatcctccaggaagcgtatacagcaactcattgttgctccattacactatgttcaagagaaaatgtcaacaatggagtcaacagagacaatcaaggaggatgcaagtgacagggaatctgatgagattgaagtttctagtgcaacacatgataagaaggctgaagcaataactgatgatt

SEQ ID NO: 3314 - DNA, 468 bp, Sorghum bicolor
  Clone ID: SORBI-28MAY03-CLUS55714_1
gcacgagggaatactgaggatactctgtctatgtttagtttttttttcctgccaagaaatggtttgttatgttagaaaatgaaaacgtgatccttccattgctccttatagttgatagttaacctatatggcattcatcacccagtgtctctggttttcagtattcactgattgggtatctggtggccttcttttaaattttaatcaacaacacaggaggacatagtagtgtttagtaattggtggatgaagatcaatggaatgatcaccaaaccattgaggaggggtctgaactcgctaatcatcttgggagatggatgctttgaaaacattgaaaaggatgtattttttaatggggcttgcctgatgtgctgcgagtggctgcaattagctagagaggaagcaaatctctagggtctgactggtgctagggaattagcacaacttgacatggattcattacagtgt

SEQ ID NO: 3315 - DNA, 687 bp, Sorghum bicolor
  Clone ID: SORBI-28MAY03-CLUS5606_1
gtgcagatgctgatgctaatgctgatggttctgtgaagattgtggttgaaatcaaggagggaggaaaagatgataaaaagtcagagatgggtgcgactgaagtggtggatgtgttagttgatgaagatgctgcgaaacagacgaagaagcgcaaggttgatgaagatgctgtgaaacagacaaagaagcgcaagggtgatgctgagactggcaccaacggtgccaagaggatgaagagcagtgctgctgtggaagaaggtgctgtgtgtggcactcctgtgaaacggaccaggaagagtggtgatatggatgctgaaggcaacggcagtcctgctgtgagcagtggccgcagggtgacccgtagcagcagtgtgaatgccactggagctgatgatagtccggcgaggaggaccagaagccgtgctggagctgatgctggttgctgaaggggtagaggaagcgtggagcgtggatgttgatggtctggatggaagcagaagccagccatcgaagcgaggagccgtctttttttggggtggttgtacgtagactgggaaccttgcgttttcttttggttgggtgatgcaggcaagtgttgcagctgttttcttttggttcggtttgggagaccgattgctgcttcctggatgctaagcgttcatccaagacccttaaaactattaagtc

SEQ ID NO: 3316 - DNA, 427 bp, Sorghum bicolor
  Clone ID: SORBI-28MAY03-CLUS56081_1
atccggcacaggaagaccttgggaactggaggccccagtctattcggcgcaaagatcaccggtggagggtccggtggctcagtttgtgtgattgggaagaactgcctgaaaagcagtgaagagatacttgagatccagaagagatacaaagcagctaccgggtatcttccgattgttttcgagggctcgtctccaggcgcctgcaagtttgggtacctgaagattcgacgccgatccacgtcgccatctaactgaactggaggaagagctcggccgccgtagaataggttgtgcaattaagcatctgtcgagaggaacacgtagtagcgaataccacacggtcatattgatcgtataccacgaacagcattgtcaataattgaacaaagacatgagcactgccaataataatgctagtaacttgccg

SEQ ID NO: 3317 - DNA, 750 bp, Sorghum bicolor
  unsure (1)..(750): unsure at all n locations
  Clone ID: SORBI-28MAY03-CLUS56107_1
tcaaatgacttggtagttgtttctcctgatgttgnaggtgttgccagggcacgtgctttgccaaaaagctgtcagatgcacctctggctattgtagataaaagaaggcaaggacataatgtcgctgaggtaatgaatcttattggagatgtgagaggaaaagtggctgttatgatggatgatatgatcgacacagcaggtactattgccaaaggagctgagctactgcatcaggaaggagctcgagaagtatatgcttgctgtacacatgctgtttttagcccacctgccatcgaaaggttatcaagtggattgtttcaagaagtaatcatcacaaacactatccctctaaaggaggagaagacttttccgcagctgaccattctttcagttgctaacctcttaggcgaaacaatctggcgtgttcacgatgattgctcggttggtcatgacccatactccagcttggatattgactgatgcttaaggtgtatgacccatgctatgctcttcatgcctaggaatagttgtggcagctcgcaacattttttcttctttttctttgccctcagtttttctgcgtatgtgtaataatcagtgttatgtggaattctgttagcacagaatctcacccttgtatttgagtgccagtacataagatgatgtcatagattgtagtgcagtgtttcagctatcctcaatatacatacatacggctccatcctccatgacatcccagtttttggttccg

SEQ ID NO: 3318 - DNA, 676 bp, Sorghum bicolor
  Clone ID: SORBI-28MAY03-CLUS56144_1
cagcttcaatccaaaaatttcagactttggccttgctaagctgtgtgcaagggaccaaagcatggttaccttgaccgcagcaagaggcacaatggggtacatcgcaccagagatatattctccaaattttggtggggtatcatacaagtcagatgtttatagtttcggcatgctggtgttagagatggtgagtggaaggaggaattcagacccaggtatcgagaaccaaaatggggtgtatctaccagagtggatctatgagaaagtagtcggggggcaggagctgacacttagtagggaaatagctgaccaggacaaagaaacagtgaggcaactggccattgttgcactccggtgcattcaatggaaccccaagaaccggccatcgatgacaaaggtggttaacatgttgacaggaaggttacataatctacaaataccacctaagccatatgcctagcctgaaagacatcctatgacataaaacatgggggatatactgccatgatttagcaagcatgaaaaacagttgtgcttactttcatatgtgagcttagtagtgcttagcagtatattatactgtatttggatcattccactgtatccacgcatgtgatttttttagttttcaatgtgtagtaacttaattaaacgtatcacattgcatttgatttcc

SEQ ID NO: 3319 - DNA, 565 bp, Sorghum bicolor
  Clone ID: SORBI-28MAY03-CLUS5615_1
ctttccccaactcgctcgattttggcttcccccgcaccgccccgcgtcggcgccgtcggtcctggccatctccggcggctgatcactctcagtggcatggactgctccaagaacgagggcgcggtggcagtggccgccctccccgacgaccccctggtggagatcctctcccgcgtccctgcaaagtccgtctgccggttcaagtgcgtctccaaggcctggcgcgacctcattgcggaccctcaccaccggaagaagctcccccaagcaatgcaaggactcttcttcatggtgccagaggaccttatcgatgtcagtttcagtttcatcgatctgacagcgaggtccgtgcctccagacatcgaccctgccttctccttcctgaaagaacggcctggattccagttccacaaccttggcttcctggactcctgcaacggtcttatcctcttcaagaaccaccaggagccgccgtattctgatgcagtgggctatgttgtctgcaacccgaccactaagagatgggcagccgtgccgacttgtggctctctggatctgacaacct

SEQ ID NO: 3320 - DNA, 644 bp, Sorghum bicolor
  Clone ID: SORBI-28MAY03-CLUS56147_1
attcccaaagatgataaaatgttcaagtttgtcctgctactgcagcattctatgcccacatcagtgctgtcaggtgctgttgcaaatctgagagggtgtggaaaagaatcagctgcaattttgttctgggttcacatttttgctgtgttctccatggcaggatggattattttctatctgagcttgctcttctaaataccttactgcacaggaatatctttgagatcaaatattgtccaaaatattgacgaagaaacaagtaccatgaactgtacagtagccactaaatcgaagttggagaggtacaattgtatcaggacagatatatggatatgatcaccccctataataccgtggtctcctgctgctgcaagcagtgagcgatgtgaggacagtgtttccctgcacgtatcatcaggtcacggagcctagattgggatgatgcccttcttatcagaaccctagactatgcagtgctccacgatattcattcatttgtacttccgcgtattgtaaatgtgaaccttgaggctttgttcaaaatagtgtccttctgggcgagggctgaaatagtatagatgtatttaatactaccttaggcctgtctatttgggtgttggctttgcaggaaatgatgctttatc

SEQ ID NO: 3321 - DNA, 758 bp, Sorghum bicolor
  Clone ID: SORBI-28MAY03-CLUS58229_1
gcacgaggacgagatactagctgcagccaacatctgttcaagtgtcatctgctttgatccaccggattgatgctgcgagttggacttccggcccccattctcgtctgcggggctgccggctgcgagagtagattcgattcgccgtgcaatgatgctcccgtctcctgtctccgccccgccgcgtcgcagccggcgccgcccttcggcccggccgcccggcccccactcctcagccccgaccgcggcagaacccggcgcggcaccgagccggcagccggcggcccccggcctccagcacccctgggcccggccgccgccgccgccccgttctgcgccctccccgccgcgttgctggttaacaaagtatgagcgattcagagtgtgcaggagcacctcaacttaaggggaagtactttggtttgctcgtctgctttctattggggaatggatgcctcttcgcatggaacagtatgcttacaatagaagattactatgtctacctcttccctaagaaccacccaaccagagttctcacgctggtatatcagccttttgccctgggagttacagctcttctagcataccacgaagcaagaatcaacacccggcctcggaatctgacaggatacacaatttacttcttaagttcttttgcaataataattctggatgtggccactaaagggcgaggtgggtttggagccttcgttggcatatgcgtaacaagtgcagcattccggatagcagatgctcatgct

SEQ ID NO: 3322 - DNA, 562 bp, Sorghum bicolor
  unsure (1)..(562): unsure at all n locations
  Clone ID: SORBI-28MAY03-CLUS58237_1
gcacgagggcagcatgttcatgtctgaagaatatctccaggtcaccaaaggtactcagtggaggtcgattatcctgcgatacagttattggtcccctagtccaccttttgaatgactcatcaacatcggtccaggttgccgcccttggtgccatttgcaatattgctgttaatttgacacccaggaaatcagttcttcttcactctggggtcgtctcacaacttgttcatttgtcaaagtccatggatccaatgttgaggctaaaatctgtatgggctctcacgaatattatgttccttcttactcctaaggataaagacttcattgttaaggagttgaccttatctactctttcaagcctcatttgtgattctgaacattttgttcaagaacagaccttggcacttgtgcacaatcttgttgatggatatgtggactctgctaattatgtcattggtgaagatggaatggttatggatgctattgcaagacaactgatcaatgcatctgccccgggagtgtgcattcanggtatgtacgtgcttgcaaacattgcggctgg

SEQ ID NO: 3323 - DNA, 628 bp, Sorghum bicolor
  Clone ID: SORBI-28MAY03-CLUS58238_1
gcacgaggctcacactatttttgcttcgcgtgcatcatggaatggtctagggttgagtcgagatgcccacggggtaagcagcggttcactacaatcaccaagtcatcaaaggtagatcttggtcttggagtgagaaaagctgtaatcaaggtcgaagagcgtgatcaggtttatcagcccactgaagaagaaatcaggcgttggctagacccgtatgagaatgtcgtttgtatagagtgcaatcaaggtggtgatgatagtctcatgctactatgtgacatttgtgattcctcagcacatacatattgtgttggcttgggaagagaagtacctgaaggaaactggtactgtggaggatgtagactcggtgatgagggaccatcatatactggaattcagcgtacagtggcttatgaaagacaaacttacagaaatcatgtcgatagtagttctgtaagttttggcatgcttgcatcaagtggcacatttgaaaggccaccatcaatcaaccctcgccattcttttcaagggattgatctaaatctatcaccaagagagtttcctggagaatcacatcctgctgaatcacaagtttcaactgatagcgtatcaactcccactggaagac

SEQ ID NO: 3324 - DNA, 565 bp, Sorghum bicolor
  Clone ID: SORBI-28MAY03-CLUS58272_1
gcacgaggctcaaaagaagggttaggtcagcaaccaaaaacagatcccaaagaaaaggccaaagctgaaacaagagactggcttaataatgtggttagtgatttggaaagccagattgataactttgaagcagaggttgaagggctttcaattaaaaagggaaagcaaagaccgcctcgactggtacatttagagaagtctattaccagacataaagctcatataaagaaattggagtcaatcttgagacttttggataatgatgagttgagtcctgagcaagtcaatgatgttaaagatttccttgatgactatgttgaacgtaatcaggaagacttcgatgaattcagtgatgttgaggacctctatagcacattgcctatggagaaggttgaagcacttgaagacatggtttcacttgctccttctagtcttgtgaagggtgctgcttctgtttcgactactgcagttttgagcacaaagaggtcagttgcatcttcgcctactcagcctaccatatcaacaactccttcacaaagtacatcacaagatcaaacagaggaga

SEQ ID NO: 3325 - DNA, 178 bp, Sorghum bicolor
  Clone ID: SORBI-28MAY03-CLUS5624_1
tcgggccccgcccacctcctcactcgtcgtcttcttcttcatcaactgctataaagaacgggagggcacgggcaaggcaactccaactcctatgcaatcgcaatgtggacgcgtgagagagagagagagactcactgaccggcgaccgacttggggaaggaagcagcaacaaaagatg

SEQ ID NO: 3326 - DNA, 631 bp, Sorghum bicolor
  Clone ID: SORBI-28MAY03-CLUS56248_1
caacctccttaacttggttgatcatttccatagacgtggcctttaccggtccatctttctcagtattatggaaggtgaagaatcactccagaaattctctccacaagttatgattatgcaatcatctgctaggtctgcagttcctttattgcctcgtatcatccttttccatgggacaagtgattattcaataccttcagttgaaaggatcctcttcggggtggcagagataaaatgctcgaagagatcgccagtgtgatacacagtgaagatccagacaattctgctcagcaccttgtcgtgcctgttgcaaggcgtcttgttcctgagtttatgctgaagcttgctggaaaagtaagccctttctgaagctgctagtttgattgcgatagtaaccacatggaactgtaaaattatgtacattaggggaatgcaatctgacgccaaatggatcctgcgatcgggaatattctttcttctgagaagagggtcaggaaagtgtgtcgctccctgattactcaggttgtccacttgtctacaggttttaaacacctttgtgacccttgtttactcacatgtcactgctttaaaaaaccgtcgtccaaaataatatagtttgtgacgtttgtgc

SEQ ID NO: 3327 - DNA, 639 bp, Sorghum bicolor
  Clone ID: SORBI-28MAY03-CLUS56251_1
ttcaacggcaagaaatgggagaagttcaacagtgagaaagtggcatcacttgcatatgccagaatccagggaaggaatgctttgattgctcattttcagaattcgagcctgatgaacgaagagaaatggtgccgccctatgcttttccacaaagatggtccacatgcaggagatcaggagccattccctgtgggtagcaatgtccgttctcggtctgggagaaacagaccactcactggttcagagactactaaagagggaagtccatcaacctctcctaactaaagagaagctggctcccaatccaactgaggacaggcggtatttgcccactaactggaggctgaagagcctgtaataaatcatccccagttttgcttttgttgctttttttttttttttgtcctcgtcagcaaggcagtgacttgttgagtgtgacaattaatgagaattctgctctgcatgagcctgctgaagatttcaccctaaattaccttggttttgccctaccgttgagcaagctatgtgtcaacggcaacaggtatgtagaagagctgaagtggtggagagggagaggtgtgtgtttcaggcgggtgaaattgaagttgtacagttgaactcaccaggattggacaatgg

SEQ ID NO: 3328 - DNA, 516 bp, Sorghum bicolor
  Clone ID: SORBI-28MAY03-CLUS56423_1
gcaccccgtcattcgtctcaagctcgcccacatggcgcgccagatcgaggcctcgtacgcgtggctcgagaacctcatctaccagtgcgagaagatgggagagaccgaggccatgctgaagcttggcggtgctattgcaagtctcaaggcccaagccaccgtcacctttgagttctgcgctcgcgaggcgtcccagatctttggtggtctgtcatactcgcgcggaggccagggcggcaaggtcgagagactgtaccgcgacgtgcgcgcatacgccatccctggtggtagtgaggagattatgctcgacctgagcattaggcagagcatgcgtgtgcacaaggcactcggcatgaagctgtaaggtgtaggccactgcctacagggaagggagaaccggaggaccaaagactgaagactatcacgtcatgtatgaataacctagcttggatatgtttcatttgtcggggcgttttgcatggtggcaaaaccgggatcgggctcatcatcataaca

SEQ ID NO: 3329 - DNA, 605 bp, Sorghum bicolor
  Clone ID: SORBI-28MAY03-CLUS56351_1
aagattggaaatgatgagcatctgcataaggcatttgcatactttgaccggaacaagagtggttatattgaaatcgatgaactccgtgagtcattagctgatgaccttggacaaaatcatgaagaggttatcaatgccattatccgtgatgtagacactgataaggatggcaagaataagctatgatgagtttgcggcgatgatgaaggccggaacagactggaggaaagcatcgagacagtattcgagagagcggttcaccaacctgagccttaagctgcaaaaggatggatcgttgcagatgacgagtacgcggtagccgataacacccataggcaagttgtgaattacagatggaaaccctgtgtagattttctggttgtttgttgacagctcttctgctcgtcctgatgtttgatgattgctttctattcttcgctcgccgcctgtttgaagcattagctagagggattgttgatgctacgattgtatttagactgcatgatccacgcctcactcatttccacgccttattagggcaaagtgtactgtacaagagaaagaggggaaaaagattaggaagttgtacgcatttcttaactctg

SEQ ID NO: 3330 - DNA, 710 bp, Sorghum bicolor
  Clone ID: SORBI-28MAY03-CLUS55968_1
gcacgagggccctacacggcacggtacttcgagatcctcgagaagcgccgcacgctccccgtgtggcagcagaaggaggagttcctccgctctctccgcgacaaccagaccctcatcctcgtcggtgaaacgggaagcgggaagacaactcagatcccccaatttgttcttgaggcggaaggcttgagtaaccgttccatggttgcttgcactcagcctcggagggttgcagcaatgtcagtctccaggcgtgtggcggaggagatggatgttactattggggaagaagcgcgtggcagcattcggtttgaggattgcagcagccacaaaactgttctcaaatatttgacagatggtatgcttttgagagaagcaatggcagacccacttttagagaagtacaaggtgattgttcttgatgaggctcatgagaggactttggcaacagatgttctgtttgggcttctaaaggaggttctaaaaaatagaccagatttgaagcttgttgttatgagcgctacccttgaagcagagaaattccagggttacttcagtggtgcacccttgatgaaggtgcctgggagacttcatccagttgagatattttatacccaagaaccagagagggactatctagaggctgctatcaggacagttgtgcaaatacatatgtgtgaacctgctggtgatatccttgtattccttactgg

SEQ ID NO: 3331 - DNA, 709 bp, Sorghum bicolor
  Clone ID: SORBI-28MAY03-CLUS56012_1
ggtcggggtcatagattcaagggcaaaggtaaggaagaagatgctcaggtttttacccttgatgaatgggagaagaggaaagccattggtttgaagcccgcagccgtgagcgctgcccttgccacttgccgtgttggcgacttcgctgggcaacggcgggttctgcttcatcgtgatgttttgcagggtggggcagatgttttcagtggtggggcggagagttcagatgctgaacgtttacggatgagcatgttcagcttcagtggccctgatgaagcaggtggtggtagaagagattttcgaggcaggggccggggcaggggaaggggccgaggacgaggaaggggcagaggaagattttagtccagcgatacagttggaggtttaggtttataggtttgttgtgtgttcagtgtagtgcactggttgtaggggtaaaagtggtacgatgatgaccttctcaaatcatgtgcccattttcactagcctaagcctaatggataaggctgatgctagtagttagattaaggaacaatttgtagacttcctgtttttttgttctattcttagatgcaggtgtacatcgtacatggtttgcacaaacgaattgaagtctgaaattttcatgacttctatcttctgtttacttgtgctgttcatccatttgaaacatgttgatgtatactgtatacaatattttgttgcttct

SEQ ID NO: 3332 - DNA, 498 bp, Sorghum bicolor
  Clone ID: SORBI-28MAY03-CLUS56044_1
gcacgaggcaaagaaaaagaggcctggtgtttctcctggtgacaggtctggtggtcttgccaagcgaggtaaagaaggaaagaacaggagggcaagggattccaagtttgggcatggtggtcgtaaagggctgaagaagcaaaacactgctgagaccactaatgatttcagaagctttaaccagggggggtgagtctcaaaacaagaagagaaagaggttttgaacttttgatggatattttaagaatctgggtgagtttcaaaacgagaagagaaagaagtttggaacttttatcgttattgctattctcgttgcggcattattttgttatggggtgtgccaaaagcaaaaattagctaatattagtctagggaagcagtccaaactccaaacccaagacttaatattttgcgtttatctggtgatggtcttcttttatcgtggaatgcagattaattttaccccccctgaatgtatactcaaaagttgctgcggtt

SEQ ID NO: 3333 - DNA, 729 bp, Sorghum bicolor
  Clone ID: SORBI-28MAY03-CLUS56049_1
gcacgagggccgcctccaaaccctagcgccctcgctccgccgcgccgccgcatcgtcgtcccctgccgccgcccgcgccgcgcccctctccacgtcgccggcggccgcgttccggcgcacgtcggccctcctctcctctcccggagacaagccggcgccaaccaaggtcgaggatgtcatgccgatcgccacggggctggagcgcgaggagctcgaggcggagctccaggggaagaagcggttcgacatggatcctcccgtcggccccttcggtactaaggaggaaccagctgtgattgaatcctactataacaagagaatagttggctgtcctggtggtgaaggagaggatgaacacgatgttgtctggttttggttgcaaaaggataaaccgcatgagtgcccagtctgctcacagtacttcgtgctcaaggtcattggtgatgggggtgatccagatggccatgatgatgaggatggtcatcactgaggccttgtgtcgataatgataataataactttgtgaaacatggttttgggcctatctttgcagcatcaaactgccctatagtgttgtaattgattagtgtttgaccatgaagcaggtcaggtggtgttttacacctacgaattttgttcagatcgttttgaccatacagttgcttctgtttggaatgtacatttttctctggagtgcatcatcaaataaaggatgagtgcgtcggtttc

SEQ ID NO: 3334 - DNA, 734 bp, Sorghum bicolor
  Clone ID: SORBI-28MAY03-CLUS56061_1
gcacgaggaggattagagggggagaaagaacaagatgagttccaagaaagcaaacatggttttggtacttgttcttctgcttattgttttgccagcgctttcgatcggtatgcaccacaggttgatttccctgttcaatcgttttgttatatttacttccaataaatttcttattttctttaatttgtaataaagaacttgtcaaaatataatcgaacatgtactatcggaagtatgtaacattttttccacgcttgcaaaagtgaatggtttgattctgtagtcttctatattttgcttttgcaggagggagggagttggcggatgaaaaggatcacaacaagcagcattccacggctgcttctgaaaagggagcaacggcttcagaagatatggtcaagacaaatgattatgggcgctacgatccgtctccggcgttttcgaagcctcgattcaagcttatacccaactaactcgctgccgcctgccttctttaatttgtaccaggcacgaaggttaaacttattaactaaattggagtaaaaaggaattatcctatatatatatatatatatatatatatatatataatagatggcatatgaggattgaggtgtgatgctacatgcttagtatatgaatggcacatagaaatagtcgcgtacggaatgtatataacttgtgtagtatatctggcgttggtgcctcttatgaatatactcggcttcagttct

SEQ ID NO: 3335 - DNA, 366 bp, Sorghum bicolor
  Clone ID: SORBI-28MAY03-CLUS5648_1
gaccgtgctgctggtggcagttcctgctcgagtacctgtccaagatctaccactccatccgcgtcctgcgccggatgcaggacttctccggctacctcttcggcaccatctggtgggggatcgccctcaacctcatggcctacttcgtcgccgctcacgcggtgggcgcgtgctggtacctgctcggcgcgcagcgggccaccaagtgcctgagggagcagtgcgcccaggccggcgggagcgggtgcgcgccgtgggcgctggcgtgcgcggagccgctctactactggcgcggcgtgaccgtcggggcggacaggctcgcctgggccggcaacgccacggccaggggcacgtgcctcgacagcg

SEQ ID NO: 3336 - DNA, 901 bp, Sorghum bicolor
  Clone ID: SORBI-28MAY03-CLUS56550_1
agtttagatcctgaagatgactcatcaggaaaaggacccaacacagatctaccaggtgatggcaggcatttgatacaagctcctcttggattgttccctcgaccttggccacctaaagttgatgcttcagaaggtagcagattgttcaaagttttggagcatttccgcttaataggtcaagtgatggcaaaagtcctgcaagatggcagacttttagatttgcctttatcaacagcattttataagcttatacttggacaggaacttgatttgtttgacatagtctcatttgattctgagtttgggaagacattgcaagaactgcgagttcttgttgaacgaaagcagttccttgaatccacttgtggcaagaatcagctgcacgtggcagatttgcgtttccatggtgcttctattgaagatttgtgtttagattttactcttccaggttatcctgattatgtgctcaaagagggggaaggaagcacaattgttaatatttacaatttagaagagtatattactttggtagtggatgctacagttaagtcagggataaagcgacaggttgaggcatttagatcagggtttaatcaggtgtttgacatgtcatccctccacatattttcacctcaagaacttgactatctaatatgtggccgacaagaaatttgggagttggaatcgctggtggataacataaaatttgatcatggatacactgctaaaagtcctgcgatcgttaatctacttgagattttgtcggaattcacccctgagcagcagcatgcgttctgccagtttgtaactggtgctcctcgtcttccacccggtggattggcagcccttaatcctaagcttactatagttaggaagcacccttcaagtgctgtgaatactt

SEQ ID NO: 3337 - DNA, 470 bp, Sorghum bicolor
  Clone ID: SORBI-28MAY03-CLUS5656_1
aagctatccaggtgcccatattggaccagagccaacaacagacagatttgtagttgtcatgtcaggacctgatgaaaggactattcctggaaatactattgctgttcaagctgacatgccttttagtggtcttacaacatttgggactgcatttttgtccaagtttgagtgctctcagatgcgacatccactgctagagcatatcacatttgttgacacacctggtgttctttctggtgagaagcaacgcacgcaacgcagctatgatttcactggcgtgacatcatggtttgctgcgaaatgtgatcttattcttcttctgtttgatcctcataagcttgatatcagcgatgagttcaaacgtgtcattggatcattacgtggacatgatgacaaaattcgtgtagttttgaacaagggcagatcaagtagacactcaacagcttatgagagtttatgggggcattgat

SEQ ID NO: 3338 - DNA, 780 bp, Sorghum bicolor
  Clone ID: SORBI-28MAY03-CLUS56606_1
gcacgaggattctactttggagactcagtcttaccatgttttgagagtggcatccccttgctaaaaagtaggcttcaggagctacctgattcccataatataaccatagcatttccagatgacggtgcatggaagcgcttctataagcaacttcaacattttcctatggttgtatgtaacaaagttagagaaggggagcaaagaattgtacggataaaagagggagatcctagaggacgtcatgttgttatagtggatgatttggttcagtctggtggtacattgattgagtgccagaaagtactggcagctcatggagcagcaaaggtcagtgcatacgtgacacatggcattttccccaataactcatgggagaaatttcagcatgataatggagagggtccggagcacggcctgagccacttttggcttactgattcatgcccccttactgtcaacgcggtgaagggcaggcggccatttgaaattctaagtctggccggacctatagcttctgctctccagatttaggaaaatctggtctgctcgatcccttaggatattgttggctattcagttcattcttctttcttttttctttgaggaatttggtgctttccttccgacagctatagagcatatcgcaatgtatttaatagaaatagagaagcttaaaatggcagatcttcactgcagcgtctgcttggcgaaaagcattcgtagtcgtaggattgcctgttcaataatttgactgagcaagtcaagtgtcgatctggttct

SEQ ID NO: 3339 - DNA, 474 bp, Sorghum bicolor
  unsure (1)..(474): unsure at all n locations
  Clone ID: SORBI-28MAY03-CLUS56619_1
gcacgaggcttggtctctcctccccgtctctcctcccgacgcgacgacagttggggcgacgggcgacgtcgccgcccgtgggcggccttcccttctctccctccctctcctccagcgtcaaagcatgctgggcaggctaggtaagaccgcggcttcctcatcgcgtggtacggtggagcggcttcctcgccggcagcgtcgacggccaagctcaccggttgtatctagcggtacgtcaccatcaccttccccaacttcctctcgtggctcctcccctagattcctactccctcgctcgcggacacgccatggcgtgcaggctgcagtagccagtagattgacagcggctcacgaccgctgctgtgggtggcgacctgtagcaggtgttcttttgtgcaggtgctcgcgctattgtcttcaggcgccatgggcttcgcccgtcctgacatgatgcttcgtgcgttgtgaagacna

SEQ ID NO: 3340 - DNA, 620 bp, Sorghum bicolor
  Clone ID: SORBI-28MAY03-CLUS5664_1
attggctcttttagctggggcagcagctagcgccctgcgtgagaacagcgcgcggctgcaagcaagtgcaagtctctgcaacatgccgtattattactcttattggtcagattatgttgaacaataccgtagggcacagcggctacagcaagagaactccagactgtccaacgagaagcgtgaactggagaggcaactggccgagaagacgagggctgctcaggtgtcctcggcccaggtcttcacactgggccacaaggtgcgagagctggagcgccagaacaccagactgtccggtgatctggccaagcaaagggacgacaccaggaaggctggcctgctgttcatgagtgccgccgataggtaccaagaggaagccaagaagcagattagggcaaaggtagaggagttggcgaacacgaggaaggcaggcctgatgctaatggacactgctgatacttatcaagaagaggcaaggaagcaaattaaggagaaggcggaggagcttgaggacgcgaggaaggcggttgtggcgctcatgaaagcagccgatgcgtaccagcaagaagcgaagaagcaaattagggataaggtggaggagctgaaggtcatgggggcgc

SEQ ID NO: 3341 - DNA, 666 bp, Sorghum bicolor
  Clone ID: SORBI-28MAY03-CLUS56155_1
tgcagacagcaagcgcccgttcgtttgggcagttcggccgagccttgtccgtagccgtagcttggagtccgccaagctacagctaccggacggattggaggaggagatacatggtcgtggtaagattgtctactgggcaccacaggaagaggtgctatctcatccagcgatctgcgccttcctgacgcacaatggctggaactcaaccgtggagagcatatcccaaggcgtgcccatgctatgcaggccgtgttttggggaccaatttggcactgccaggtatgtttgtgacttctggaaggtgggagtggagattggggtggtgactcagctacgaagagggaatatacgagctgctattgacaagctgatggacgacaagcaagcgaaagagtacagagacagagccaaggacttgaaagagatggctgaaaaatgtgctaccaaagatgggtcgtcccacagagcattggtcagcttggtcgatttcataatatcattttagcatactttctacctgcaagcgcaatattggtgccagcataccgatgttcgctgtattttcttttacaatgatattatatgctcctagccgaatttgtttgaataaagttcatccagtcacagaacagtttatgtggatatttcatacatactattttgggg

SEQ ID NO: 3342 - DNA, 533 bp, Sorghum bicolor
  Clone ID: SORBI-28MAY03-CLUS5617_1
gcacgaggatcactccggcctcttccacggccgcctccgccagtccgcttccgccgccgccacctcgccgccgaccaccatagcatcaaatacttcagagctcgcgcccctcgcgcatggttcttggcttcttgctttttgctcgacgttcactgtaactaatcgactataagcgtggtgaccactgacgagatgatgccggtggaggcagcggcggcggcggcggcggatgactggtcggagtgcgcgttctcgctgacctgcgaggaagactgcgccgacctcggcgacggcgtcgtagacgacggcgagttcttcccgctctacaatgccggcgacgaggaggaagaggagtacttggagcagctggtgtttaaggagaccagcttctgctcctcctcctccgactcaggcgccgactgcgacggcgacggcgacggagacggcgaaggagacgaagagtacccctcgctcgcctccgaggagtggttccggcaagctcgcctcgccgccgtcaagtggattcttgaaac

SEQ ID NO: 3343 - DNA, 645 bp, Sorghum bicolor
  unsure (1)..(645): unsure at all n locations
  Clone ID: SORBI-28MAY03-CLUS56171_1
tctgaacaagactggagatgaccctctcatggtgcttccacccaagtttgcattctctcatgatgtacaaggtctttcaagtgtgaacggtctgcatggcaggcccatcggttgaagagttcatttccagtcatgctccggttggaaagctgctagcccaattcagtgactcatgctttgtgaatatcaatagcacctatactcatttatcccccggagtcagatggaaggagtctggattccccagttagatgtcccccaatcaaatgggttatcctgtctgttgttctttctcattcatttgattgtcatgttgtaagttgtatcattcattgtactaagttatcagaagcttagataggtaggtgaagggtcccagaacgaaggtcccctgggacccttgttcaaaaaatcaaaaggatgtagtgtaacgctgggtataccagggaaacaaaatgttgtacatcatctgatttgctgtattaggctagtgagtcgacatgggtatagtagcttcagtaaatcttctttttttttttttgttctagaatctagactctagaactacaatgcagtaaattcgttcagtcgcagatatgtattgttaatctgatctttcaaanagggttagtaatttgacatttt

SEQ ID NO: 3344 - DNA, 627 bp, Sorghum bicolor
  unsure (1)..(627): unsure at all n locations
  Clone ID: SORBI-28MAY03-CLUS56200_1
tagatgatgagcgggagcacaattctgattgccatctggtagcagatgtcactgagaggttaataaacctgttggctcagcagcaagaggagcttagtgcgctgcaaaggaagcacaaggcagacatagaggacatgttgaaaactgtacctgcacaggctcgggaagagaccttaactcgatgccgcttgaagatggaacagaaaaacagagccaacaaaccttagctaaactgtttcctgtgcatcttctctgtgtgttgttagatttatacatactcacaccaaggagttgtttacagcccttgttgtgcaaaaggggatctctgttgtgcaaaagttagtctgaagcctttttcattgttctttttgatataatggagaagctggaagtgcttgtctggaggtctttgaattcactgaccaagcactatagtaatcaaatagtgtggaggtttttgacggcaagatgaagtttctgctcaccaaatgaaatctgcagatactactatgccgctgtgtgcctgaatacataaggagtgcctccctttctttttctttttctttttctttttcttttttccttttgtactttgacttgccaaggatatacatgagtgtttgcgcn

SEQ ID NO: 3345 - DNA, 644 bp, Sorghum bicolor
  Clone ID: SORBI-28MAY03-CLUS56194_1
agacgagctgaggactataccaaaggaaatggaaattgttactgaagacgatttgaatggtctgtcctacctaaaggcagtcatcaaagagacactacgactccatggaccagctcctctccttgtgccccacctctccatggctgaatgtgacatagagggttacacgataccgtctagaacatgtgtcatcgtgaatgcttgggctcttgctagggatcctatctattgggagagtgctgagaggttcatgcctgagcggttcttggaaggtggcagcgccatgtccatggactatagaggaaacgatttccactacttgccatttggggttgggcgaaggatttgcccaggaataagctttgccatttcttctatagagatcatgctagcaaaccttgtgtaccacttcatctgggagctaccaccagaattgaagaaaagtggcattgatatgactgaatcatttggagtgacagtgcaccgaacaaagaagcttctccttgtacctgtattgcctcaggactaattattatttggtattcttgtgtgcctagcagatagcgcataatgcctatcatgacagttgtagctcatatgtgagtattgggcttgttatacagaagggtttgctgaacaaataa

SEQ ID NO: 3346 - DNA, 605 bp, Sorghum bicolor
  Clone ID: SORBI-28MAY03-CLUS56236_1
gtgctatccaacatgatcttcctaggatattctgaaggaaatagctgtgtgtgtgtcttgtggtggttcagtcatggtgctggctagcagtgcctatctttgaaattgattggcaaactgcaagtgatgatcaaggagtgcatcacgcagctgaaagaagctgaccaaaatcaagcaattaccatgatatcatatatgcatcgtcagcagagacagcacaggtaagaaggaaaattgtgtaccttcagtgctccaatagataggagattgtcaacaacaagacaattggggaaggttcagacaacattttgcttgtgggaatggagggtgttgcaccaggttctgtcagcattgatgttctacatgtgaaagttgaagatccacttcacttttataatcaagttttggattccagagagctcactaggtcagtatcatttctatttcactagactagagaacattacacttgtgactatcaggtgatggcttggggggaaaggtcatgcttggatacgcagggagtggcaagcttattgccttttgcaaaacaaaaaacagtttttaggagtggcaagcttattgcttttgcacacaaaaaacag

SEQ ID NO: 3347 - DNA, 629 bp, Sorghum bicolor
  Clone ID: SORBI-28MAY03-CLUS56729_1
gcacgagggcaaagctggctggcaagtcgtttaggatgcgggtcgagcctctggttgacaaagccaagcaagtgggtgcttatctggtacgtgtttcatttggcactgcactcattgcctgggggtgctggtgtacactacaatcattgccattctctcaagctcaagtgaggaagatagtcgtggcacgcggcggagatcttatggctctactgtcatcattccgacagatatgttttggtacttggacgcacattattacacaaggcgtccagtagaaaacgaaaatgggatgaactttattgaatctgtaatctaaaagggtattttcgtttgtgtttggggatggcgatccccatgatgggcttgaacagaagcggcggaagatgattgggcagtacatttcatcaaatggtggagttgttacagctgaagaactggcaccgtttcttgatgtgccacctccatcacaagagtccaaggccggggaactcttgcccattttttgccctaagacgatgaatcatttgttcttccagttcttttacgcttccagggacatccagaaattgatgagcagggcaatatcctgtatcgatttccatcgctgcaacgtactgcttcatcaa

SEQ ID NO: 3348 - DNA, 718 bp, Sorghum bicolor
  unsure (1)..(718): unsure at all n locations
  Clone ID: SORBI-28MAY03-CLUS5673_1
gcacgaggctcaaacaaagccctgcgcgccgcttgccagcctccgcctttccatgaccacgccgctcctgctgtgatcctaggacgacgcgccacgccggggagaggaaaggaggctgaagcacgagcgccgccgccacgagctcgcggaggaccatgccgagatccaggggcaacgagccgccgccgccgcgggtgtcgcagcgcgcgccgctgcacctcaagacgacggccgcctccgaggcgaatggcgcgcaccaccgccccgtcaccgaccggagcagccccaaggtcggggaccggcactcgccgcgcagccctctgcccgagaagaagcgtgcagcggggacgcgcgtggcggagctggagaccaagctgggggaggtgcaggacgagctgaagaagctgcgggagcagctggcgtccgctgaggccgccaagaaggacgcgcaggtcgcgctcgaggaggccaagaagcgcgtcgggaccaaaggaggaagccccgcctccaccaccaccaccacctctcctctctctcccccttcggcgggggtcgaaagcgcgaagaagaccgaggagctgaaggtaactcaaccggcggcggtcgaggaggagagcagcatcaacgcgccggcgaccgatgtgttcgaggtcgtccgggccgagtcgggggacaaggagaaccagagcgcggctgangactgcgaggttgtgagctg

SEQ ID NO: 3349 - DNA, 804 bp, Sorghum bicolor
  Clone ID: SORBI-28MAY03-CLUS56735_1
gcacgaggcttgggccgtgtgatccccccctcctccgccgccctcggatcagcgccaccgcgccggaagaccgggatcgtgacggccacatggacatggttacggcggccgccgcgttgccatggggaggcggttccccggcgtggatcgacgtgccggagcggagcaagagcgcgttcatggagctgaagcggaggaaggtccaccggtacgtgatcttcaagatcgacgacaggagggaggagatcgtcgtcgagaagaccggcgcgcccggggagagctacgacgacttcacggcgtcgttgccggccgatgactgccggtacgccgtctacgacctggatttcgtcagcgacgacaactgccggaaaagcaagattttcttcatctcctggtctccttcagattctcgcatccgtgccaagaccatatatgcagtgtcaaggaaccaattccgtcatgagcttgatggggtgcactttgagatccaagccaccgaccctgatgacatggatctggaagttctcaggggccgtgctaacagaacctgatttcactagcgagcaaccaaaatgcggctcgggggtcgctgatttgaggcatgatgtagaagtaggctgccgatcacacccgagcttgcaatgttttttctctttctttgtttttggaggtatataggacctccgtgatgtttgtctaactagactagataggttccctctaatatgatttggaacctgtccttgttttataattgtctatgtagtatctatatgttgctgcgatgaatggatattatggatt

SEQ ID NO: 3350 - DNA, 728 bp, Sorghum bicolor
  Clone ID: SORBI-28MAY03-CLUS56779_1
gcacgaggctctgaagcacaaggtgtttctcttcttgatagcatcttacaaggagaacttccttgtgatcttgagagaacaaactcaacatacaacattttagcattattgcgtgtactggaggggcttaatcagttatcctctcgtttaagactacagggagcatctgatgattttgctgagggaaaaatcactaccttggatgcgcgaggtagaactggagccaaggtaccttctgaagtgtttgtcaatagcaaattgacaccaaagcttgctcggcaaatgcaggacgttctcgcactatgtagtggcagtttaccttcttggtgttatcaaatgaccaaggcctgcccatttctgtttccttttgagacaaggaggcagtacttctattccacagcctttgggttgtcgcgagcattgaatcgacttcagcaacagcagagtgacaatcacagctctggtggtgaaagagaggtccggtttggcaggttacaacgtcagaaagttcgtgtttcccgtaaccgtattctagattctgctgctaaagttatggagatgttctccagtcagagggctgttcttgaggtggaatactttggcgaagttggaactgggctggggcctactttggagttttatactctcttaagccatgaactacaaagtgctcaactgggattatggagatctagttcatatgattcaggattgcacattgataggaa

SEQ ID NO: 3351 - DNA, 482 bp, Sorghum bicolor
  Clone ID: SORBI-28MAY03-CLUS56781_1
gcacgaggatttttttatattggggctggtggttttctccagcaactggaactgtccagggttccctgtgtttgttcactaaccatcctctctccccagtcattgttcttctaaaattgacttccttcataggctccctttgatacttcgttagtaaatctgcagttttgggagacatcactatagagtttgtcctcctatatgcaaaaggaatggtccttggtggttatgtgagagcagttgaattcaagggtggaggtttgcttatgttcgttatttttgatttgttatatggctattctgatgtcaaccatggtggtgtgaagattgccaccggactaattagaagcttgattatccttaattcgtaaattgctgttagctggatctgcagaggcaaccgagggtgatgttttggaggtagattggagatttgattgatgattggactcattagttcatagcatttggagagacggaga

SEQ ID NO: 3352 - DNA, 652 bp, Sorghum bicolor
  Clone ID: SORBI-28MAY03-CLUS56425_1
gaagagcatgacatgtcggcaagtggcggtggacaaggttcagcagcgtttagagtcatcacacccttccccaacctcaaggaactgtatctccatggcttggcaaagttcaggaggctgagcagcagtacatgtacactgcacttcccagcgctggagagcctgaaaattatcgagtgcccgaatttgaagaagctgaaactttctgctggaggactcaatgtgacacaatgcaccagggaatggtgggatgggctggagtgggatgatgaggaagtcaaagcttcttatgatccattgttccgcccattgcactgaattcagttttggttgctagagattctgttattttagagattgctcttccccgtggatacaacagatcgcgtgaattcagatattgctagtctgcagtgggtgtaatcttttcttatttgatttgatcgtttgtgtagttcaggattgctgggctgtgttgtccatcttgtaaatacaagttgggcgattctatttttttgcacagcccgtgttctagaaatacagaatgatcaattagcatgtgtggcagactggcagccaggaaactagcaaatgtaactatagagttctccagaacagtatgactggtggataccagtacaaccgtttcctc

SEQ ID NO: 3353 - DNA, 586 bp, Sorghum bicolor
  Clone ID: SORBI-28MAY03-CLUS56433_1
tctgccacatgatggaaggaacatggatgccctgaacagcaccttagtagggatccgtgacagtgctccaaaacctgttcgggcagcaccaacatcagacccgaatgctcctctgtggaacatgctaaaagaaattccactgacgcaatctgataggctatctgtaggaatgtatctttgtaagccagagtctgaagtgcatcgaagctttttcacgaacatgggcaaggagtaccttgaagcatgggcccgtaagttcttggctggagaggaacctggagccgtatagtttgataactgaatccagattgagcttcttgcctgcagcagcgcgtagcctatcctgatgaactttcatttgtcaggccttgttattgctgccagtttatgttctatgattgatgcatatggtgtgcttgaacagttggtaaataccattttgttagctgtcatgtaacttaaaatgtgtggacaagttagttcccctttcggccttgaagcttttcaaggtttatttaggtccgattcccccaggttgtagatgataacaatgtaatatatttgtggagatctagttttgtttccc

SEQ ID NO: 3354 - DNA, 528 bp, Sorghum bicolor
  Clone ID: SORBI-28MAY03-CLUS56450_1
gtggcagcagctgcagcagcagtgcggcagcaagggcaccggcgtcttcatcccgcggtccacgcccgggtccgcgcaccccaagaagaagggcaagaacaggggcgccgccgccgccgccgccaaggccgccgcgcgggcggcgcaggctgccggcgcgggcgcgccaaccaacaagcgcgcctgatttctacttgaggagagaaggggagaaaaaaaaggagggcaaaaaaagcacaactactaactccaggatgcagtgcaacacggtgctgaacgaagtgctcgtcgatcgggatcagccgcattagcttaatctgtttaattaattaattaattttcgagtattattattactgcaattcttatatggtaaataataaaaccactgccactcccctgggttaaaaatgtactataatgtgagccctaggggaggacgactgtgggctgctggggcaccacgccacacgaataatctctgtgtatagtataagctagcggttggtggtgccgtagttttctttt

SEQ ID NO: 3355 - DNA, 661 bp, Sorghum bicolor
  Clone ID: SORBI-28MAY03-CLUS56460_1
acgagaagtgccgggagtgcatcattcactgcgacatcaagccggagaacatcctgctcgatgaggagctgggcgcgaagctcgcggacttcggcatggccaagcttgtcggccacgacttcagccgcgttctgaccaccatgcggggaacgatgggttatctcgcgccagagtggctcgcgggcgcgccggtcaccgccaaggccgacgtgtacagcttcggcctgctcctgttcgagctcgtctcgggccgccggaacaacggctcctcgcaggccgccgtgtacttcccggtgcacgccgccgtcaggctgcacgcgggggacgtggtcggcctgctagacgagaagatcgccggggatgccaacgtgaaggagcttgagaaggtctgcaaggtcgcgtgctggtgcatccaggatgaagaaagcgaccggccgaccatggggctcgttgtgcagcagctggaaggtgttgctgatgtcgacctgccgccgatcccgtcgcggcttcacatgctagcgatagatgaataacggtagcaaattagacaccgaagtgcaagtgtgtaacgagtagaagtgtgaaggtactacgtaggtccgacaggtaattgtactttcagcatgcgtgttcatcatgggtagtatcctatcctatggcc

SEQ ID NO: 3356 - DNA, 741 bp, Sorghum bicolor
  Clone ID: SORBI-28MAY03-CLUS56863_1
gaaagcgtagaaatagttgatcaccagcttcttcaggaagaacgactccttccgggccctgatgtctccgtgcccgagaaggtacaccacgcctgactccttggccttgtggacgaaagagagctcgttgtccaggctcgatccgtcgaatgacaagcttgatcccagggctgagttgtcggtgccgccgcctggctcggcaagtgggacgccgagcgagtagatgctaccattgggaccaacaaggactcttgatgatgaagatgcaatctcatcttcagagtctgtgtcatcattatggtcgctctccagggagcgttcctgggcctctcggcgtatgaacttttcaaggctttctatcagaagctgttcgaatgcttgggtgttctccttgcgtacatctttgtacccatacctagcaatacagcggaacatatggtagttctttgggcagacgcgacggaagagaaacctttcattctgaggcacaactggaactgggacccatttgatgcagacaaaaatgatcattgaatgcatggctggcagtgtagtgaggaagtgaccaaagggggcgcgaacacccctgaccagttcattatagagcaatccaataccaggtgccctcactgtaccaagattgcagcctagctgtgtcaataaatccattgaaagtttttgcttgacttcagtttcgtacttcaatttggttccatagttccatatgtacattcctcgtgc

SEQ ID NO: 3357 - DNA, 596 bp, Sorghum bicolor
  Clone ID: SORBI-28MAY03-CLUS56866_1
gcacgaggccggcttctgccgtgtcctttgcaggacgaccctccaagaatcgagcacctcgtggctcgcgaggacgaggtagcagccgatttcatctccaggtcgctcggcctgcctcctctgtatgctgcagacctcatcaagtttggtgctgtgtactacgcgctcgtcgcgccgcagccgcctccctacgcttctccggagcattttaaaatctttcgggaagtcactgagccttccatcctgcgccggagggcgtccattaaggggaagacggtgagggaggctcagaagacgtttagggtgacggaccccgaccagcgcctcgaggccggcacctacctgcgggttcatgtgcatcccaaacggtttccaaggtgttatgaaattgactggaaatccagggtaatagcagtcgctgatgaatatgttggtcttgataaacctgctgcaacatcggtgggcggagcaactgataacatcgaggaatcatgcgcagtgtttacttcgcgtgcattaggaatggaaacaccattactgacgactcaccagattgacaactgctctgaaggctgtgtggtactatctaaaacgaa

SEQ ID NO: 3358 - DNA, 1144 bp, Sorghum bicolor
  Clone ID: SORBI-28MAY03-CLUS56872_1
agagaacaccattgataccagtggccgctacacctgctcactccattgtagtagcagcagcaggaggagcgcaggactcgagcggtcttggcatggcttcttccctcgcgcccgcgtcgtgggtgctgccgctgcagacgggcggtgctggggcggcagcggcggggccttcctcctgccgcttcatgctcgccgtcgcggagccccgctgccgctgggcagcgtcgccgcgccgggcaagggtgctcgtggcgccccggtgcgcggcgctcgactggcccggcggcagcggcgaggaggaggccaagatcgaggacgagaggaagaagaagccggcgcgcggccgaccggtgtggaggcggatcctgttcgcctccaagaagacacgaagcatcatcatcctcaacgccctcacggtcatctatgcaagtgatattccggttctgaaagaggtcgaagccctgacagagcctgcggtcttcaacatggtgcggttcgttgttgcagccatccccttcgtgccattcgcggtccgtgccttgcgcgaccgccgtgtacgctatgcaggactggagctgggagtctgggttagcttaggttacctttctcaagcaattggattgctctcatctgatgctggccgagcatccttcatcacggccatcacggtcatagttgtgcctctaattgatggccttcttggtgcctcgatccccaaactcacttggttcggagccatcatgtcactatttggaatcggcctgctggaatgtggcggctctcctccctgcgttggtgatattttgaacttcttcagcgccgtgttttttgggatccatatgcttagaacagagcaaatatcaaggagtacggacaagaagaagtttctagctcttcttagcttcgaggtccttgtggtcgctttctcttctgttctctggtgtatgttcaaagacggctatgttgatactagtgaatccagctttgactcttggactttcggtatgctttgggatacagcagcttcatttccttggataccagcattgtacactggagttctttctacggtgttatgcatgtgggcagagctggtagcgatgggcgatgtttcagcaactgaaactgcaattgtttacggctt

SEQ ID NO: 3359 - DNA, 986 bp, Sorghum bicolor
  Clone ID: SORBI-28MAY03-CLUS56887_1
gcacgaggccatcaggaattgattggatcgccttctcctttttcttggattacttggaccgctgctcgcaaacacggggttggcagggcaatccctctttccaaagtgagctcggacaggtttactttggctctgagatggctgatgaggactcatccgacttcaccttctgcaaggttatttctgcagaaaatgacggtcaaccagaatctcctaaagccattcctgtagaaagtatgacactcgaggatgttcatgttgatagtgcaaatacttcaaagaacaatgggttggaaactgttgactcagaaaaagataggtctggtaacaatgtcagtgtttcaacaaaagacaataacatgcaagcaccagttacacagacaagtggtggagcagaatcaaatgtgccatcacaggcaaagcgttcatcgaagaaacctgcagcacgggcaaaggttccttttgagaaaggctatagtcaaatggattggctaaagctgacacaaacacatcctgatctagctgggcttaaggggcagtcaaaccgaaagttaatttctttagaagaggttaagcagcacaaagcaggaggttgtatttggacagttctcaaaggccgcgtgtacaacattgctccatacatgaaatttcatcctggaggtgttgatatgcttatgaaagctgctgggaaagactgcactgctttgttcagtatccttccattattatttctgcactgtaactcattatcttgctgcttgtggacacatactggaagaccattcttattatgcaagttagtgtggtagctaaaggcatggcatacatacagcgaccactatgatgcctttgcagcctttttcctcaatctcttggtgattgacctgctgatgattacattcgttaactgtcccattttgtgattgtagatgcttatgattcttgattgctccttgacttgactatagataaataccatgcttggg

SEQ ID NO: 3360 - DNA, 676 bp, Sorghum bicolor
  Clone ID: SORBI-28MAY03-CLUS56912_1
ctggggcacgaccgtcgaatcgcaccaggaaagtcttcgcttcgctcctctctgcggctccctccggcgagcggcgatgcccttctcacccccgctgatcgactgggaggcggagagctaccccgcatacccagacttcgcagccattccctttttcgtcgtcttcttcctcgtcgtccgtttcttcctcgaccgcttcgtattcgagtggttagccaggaaattgattttcaaggaggatgagaagcttggtcctactacatacgcaggcaagagaaagatcaggaaatttaaagaatcagcttggaaatgcatttatttcctttctggggagctattggcattgtctgtgacatacaacgagccttggttcacaaccacaagaaatttctgggttggaccaggtgatcagatctggccagatcaaaaaataaaatttaaactcaaggcggtctatatgtatgttgctggtttttacacatactcgatatttgcccttttgttttgggaaacaaggcgctcagacttcggtatttcaatgactcatcatgtagcaactgtttgtctgatagcactgtcttacatattcagatttgctcgggtgggttcagttgtccttgccattcatgatgcaactgatgtgttcctggagcttggaaaaatttccaagtatagt

SEQ ID NO: 3361 - DNA, 686 bp, Sorghum bicolor
  Clone ID: SORBI-28MAY03-CLUS56661_1
gtctttgtctctccccttctccccttcgccttcctccttcctaaaccctagccagactgtcctaaatacgctcctctccgctgcgatcgctgcagcgatccgatctttcgccggtcaccggcgccggagacgccgggctccataatcatggctgtgtccgccgcccccgagcagccacagcgggagcagccacagcaggaccacgatgaggagatgctggtcccgcatcaggatgccattgaggggccgcagcaggatgttgttgagggtccgcagccgatggaagaatctgcatccgctgttgagaaccaacttgtgccagatacctccacatccagatttacatggtgtattgaaaatttttctaggcgcaatgttagaaagcactactctgacgattttattgttgggggatacaaatggcgagtgcttgtcttccccaggggaaataatggtgaccacctttcaatgtatctggatgttgctgattcaaacttgctgcctcctggttggagtaggaatgcacaattcagccttgctgtggtaaaccaattagacagcaaagcatcattaagaaaagaagcggtgctccctgtccgttcccctgttggtgtctggggctttgcctcctttaggccgtcgggggatctgggcctttcaagtaaaggatatgttgtgaatgataa

SEQ ID NO: 3362 - DNA, 585 bp, Sorghum bicolor
  Clone ID: SORBI-28MAY03-CLUS5667_1
atctatttcagttgagatctctaaagatcgtagcataatgtcatgaggtggtgttacctagtaaaattgggagtatgcagcaactggaaacatttgaaatcaatgctactataaaattgtctaaggggcaatcattttgtgaactaccatcggatatagttcatctgagccggttattgcatctgattattccaaatggcacaatgttgccaaacgggatcaatgacatgaaatccttgcgtactctgcactgcttcgatttatgtaactcaccaaacagtatcaagggtctaggggaactgaccaatttgaccagtcttgaaataatatttagttattctagacaaatggctattgatgagattatggagaaagggcagggaagttctgcagacttgtcttggaaagctttgcaacctcaaatgtctatatatgaatattaattctcccaggtttccctattttgatgcgttgagttcaacacctgcttctttccatcatctcgagatattccatggacgcaagttctcaagggttcctggatggatcagccaacaacataacctctatgagctggatcttgat

SEQ ID NO: 3363 - DNA, 707 bp, Sorghum bicolor
  Clone ID: SORBI-28MAY03-CLUS56662_1
gcacgaggccgctccatccgcccccaagaatgtccgacgaggccaggcgcggcgggcccgcgggcgccgcgcaggcggtggtccgggcctcctccgaggaccgcaagccggtgggcgcggggtccccgccgccggccgcggccgcggcggcggtggcggcgcacaagatccagctcaagagcgccgacatgaaggaggagatgcggcaggaggccttcgaaattgcccgcgtcgcgttcgagaagcacagcatggagaaggacatcgcggagtacataaagaaggagttcgacaagaaccacggcccaacctggcactgcatcgtcggccgcaacttcggttcttatgtgacgcatgagacaaactactttgtatatttctacatcgactctaaagctgtcttgctattcaagtctgggtgattggcgcagccgatgcaatcaaccttgcatggctacatctcattgctctcatgtatgcctcccttccctccgagtcatctgcagccaagctggaagccggtaatcttatgagcctgcatattgatgtatcagcaatggattattctccgtatgccggtagtgtgagatcagattgcatcttatttatgtctgatatatctaggtgttgtgaggacattatcttgttgcaatatgattgccggacaattggacgaactgcctctcgtctgtttgtgattgtttcgg

SEQ ID NO: 3364 - DNA, 639 bp, Sorghum bicolor
  Clone ID: SORBI-28MAY03-CLUS56676_1
gcacgaggcacgctcccccttcctttccctttcctgccttcctcgggtggagccggagagtgaagggctcgcggcacagaaccttcgactcctcgccactggctggagaagccacctccgattccgcacgagaagaaagcaaactacccgcagttccgttccgcaagaccagattgccccgctctcctcctctctcccctgagcgctgatcaaatcgatccacagtgccggcggacgtctcgaccccctcccgtcccgttccatccaatccaccagcgaacagatggcgtcgcagtgggctactccgccgccgggctacccggccgtgcacgggcaggcgtacggcaaccagcagctggccacgccgccgcctcaggccgccacggccgtggccgtgacggcgacgagcaacggcgtgggcaacccctacgtggtcgtcacccccgcgtccgccacaccttccaccggccagaccgtcaggaaggcgctgtgccgctacggcaagctgcttgaagacgggacccgcaaggccgccgacgccaccggcaacatctggcaccacctccggatggcgccgaacatggcagacgcggcggtggcgcggctgtcgcaagggaccaaggtgtacgcggagggtgg

SEQ ID NO: 3365 - DNA, 369 bp, Sorghum bicolor
  Clone ID: SORBI-28MAY03-CLUS56722_1
gcacgagggccacctctgcgcccatcgcgaccactcgccaagtaatttttcttccgcccacctgactacgcctcgacctcgacctcggcctcgccctcggcgtcgcctccgtccgccggacgcggcagccatggcgccggcagtggggctcaagcgctccgccacgcagaccatcactctgccgccgcccgagacgcggctggctgtgcgcgatgtcatgcggtccacgatcccgtcgcagcccgccgaggcgccggcgtccacggagaggccggcgccagccgcggcgctgcaggggttcctgtgcctggaggaggtggacgggaggcggtggagctacgtggtggacggcggggccgccaaggggag

SEQ ID NO: 3366 - DNA, 529 bp, Sorghum bicolor
  Clone ID: SORBI-28MAY03-CLUS56963_1
gcacgaggcggcgtcgggatcgacaacggcgcccgcgccgccgccaccgagcatgggtgcctcgtcgtcaacgcgcccaccgctaataccgtcgccgccgccgagcatggtatcgcgctgctcactgccatggccaggaacatcgcgcaggcggacgcctcactcaaggctggtcaatggcagcgcaacaagtatgttggtgtatctcttgtgggaaaaactctcgctattcttggatttggaaaggttggatcagaagttgctcgtcgtgctaaaggcttgggaatgcatgtgattgcacatgatccatatgcttctgctgatcgggctcgtgcaatcggggtcgagctagttagcatggaggaggccatgacaactgctgactttatctcgttacacatgcctcttacgcctgcaacaaacaagatgctcagtgatgaggcctttgctaagatgaagaagggtgttcgcattataaatgttgcacgtggtggtgtaattgatgaagaagctctagtcagagcacttg

SEQ ID NO: 3367 - DNA, 597 bp, Sorghum bicolor
  Clone ID: SORBI-28MAY03-CLUS56964_1
ctactgggtcctgcattgcagaagccggagaaacttccaagcccaagaaaaaagctgctacctttaacacgatcccctccctctccgtctgtgtccgtgcggcggcgccggagccgaaagcctccggcgagcccggggctacttgcgcccgcgcgctatttcggcggttttgcgccacggcgggactggaaccgcccgggctgcgctgtcaggatcaccaagccggaacgaagttcagttgcgctttggcggttggattcgcctgttgccgcgcttcaggatactaaactgccatctcagttaaatgatacactgcacatcggtgggcaccgatagtttgaaacacatccgcaatgagttgttttgctcacttcttcaagaggaaaagagggccgcaacaacaagacaatccatctaacgattatttcaaaggttctgagaatataacaaaatacagctacagggaactggttagagctacatcaaattttgaccagagcaataagattggtgaggggggttatggacctgtctacaagggaacgctcaaggatggaacagctattgccgtaaagattctctctttacattctagac

SEQ ID NO: 3368 - DNA, 559 bp, Sorghum bicolor
  Clone ID: SORBI-28MAY03-CLUS56966_1
gcacgaggtgagattgagaatttatcctgcagatatatatggacaaaccctttgaatgggaacaaccaaagaagtgatgctaatggtaatgattgtgagcttgggctgagccagaggggtgatgctgatgacaagaactgggagcagaggcgtaatctactactaatgcttgctattctagctgcaacagtcacataccaagctggcatgaatcctccaggaggtgtatggtctgatgacgaggcggtgagtggtaaaccaggagacccaatccttcagcacaacaattttaagcgttatgatgttttctactactcaaactcactctcattcgtggcatctgtagttatcacaatattacttgtgaacaaggaatcctgcgagcatggtatcaagtcctatgcactaagagtgtgtttggtggtgggcttggttagcctcttgattgcctattctgcaggaagctgtaggaaagcaagagaatctatttatctcatcatcattgctgttgcagttctgatttcccttgtgattcaagtgattcttctctcctcaacac

SEQ ID NO: 3369 - DNA, 679 bp, Sorghum bicolor
  Clone ID: SORBI-28MAY03-CLUS56971_1
gcacgaggctgcaattctgctgtagcaaagaaaaggttagtgaaaatagctatcctgtttgtgaatttgtcttagaaataattagttcagcactaagctgatatttgatactttggttaaatcattacccaaaaatgtcggaagtgatttcaagtcatttatttttttagactgcgcgtgggcgccgtcgcggccgccgccgcgggctctccggcggctccgcatcgcgatcccatcctgcctccctggggccgtgctccccttctagcatgcgctggcggccgcctctcctgccgccaccgggtaccccctgcagcccttctagccgcgcgccttgccgtcgtctcccttgggcgcgccacccctcacctgtttccgtcgcggggcggtggccccgcggtacgccttttctcatgggaagcttctgcacttcggctgctgcattccttagagatctgtttcgtgcattgttatgagcattgttgttccccaaccgagtgcagtggagaacctagagatatctctgaagcatatcccgtcaagaaagaataaaacgttacctgatcaactctttgatctcaaaagtaaggaacaggaattgcatgatcccaataaagacctaaggaaaaaggactccttgaccatccgagcaatgatccttcgctgcagatcggggtaa

SEQ ID NO: 3370 - DNA, 634 bp, Sorghum bicolor
  Clone ID: SORBI-28MAY03-CLUS56996_1
gcacgaggcgcacgtggataatgctaatacagctcaagcgctgcaagggatgcagcccatgggtgtcatgggtaccatggggatgaaccagatgagaccgaatggaactattccctatggtgctcaacaaaggtttgctcatgcgcaaatgaggccacaagcgtctcaacaacctgcactgtctccacagaaggtacctggtcaaggtctgtcgaggaccgcgtctattacagcattaaattcacaactgtctggatcatcacaaaatggacagatggtggcaatgtctgtgcctcagcaacagcagcagcagtggttgaagcaaatgcaatcatccatgggctcaccagtttccccacagcaacaatatcagcaccagcagaggctcctgttgatgcagcaacttcagcagaagacaggattgagccaacagcaacttctccaagtccaacaacagcatccacatctcagtgcccaacagctgattcagcagcaacattttctgcagcagttgcagcagcagcaaccgctacaatctccacgtgtttcagcatctggttcgcagaagtctgcgaaccttacaggctcacaaccgggtacacctttgtcagttggaactatgactggtggaagt

SEQ ID NO: 3371 - DNA, 605 bp, Sorghum bicolor
  Clone ID: SORBI-28MAY03-CLUS5698_1
gattcaagtaagtagatcaagatcactgatcttatctgttcaagtaaaatcctttgctgttgccgttactattggagtgcttcttcatcttgctctgctggctttcaatgctgcaatgttggagatcttgtcacgtcttgaacagaaaggggagtcagtctttgcaaagaaagagtatgcacgagctgtcattttggtggccagtcagaaaacgttgccagtgttggttgctgtggttgagcagcttggaggagcgttcggggagtctggatttctggtcatcccttgtgttgctgcacacattaaccagatcattattgattctatcatagtaaattggtggcgccagaaggatcaacaatttacttctgcaaagtaacttgagaattcaatttcggtgtgtaacacagggaatcagtcagtcaggagctcttaatgtttatctcatgacgccaaagcaaaatgagatctacatgttcagttgtttggaacgaaagcagtcatatcgagattattttacacagaattgctttcgtgcctgaagaaacgatattatgtctttcctccacaatcttcagatttcttcctctcaaggttttggatag

SEQ ID NO: 3372 - DNA, 430 bp, Sorghum bicolor
  Clone ID: SORBI-28MAY03-CLUS56788_1
tttttttatttttttccttggtatgcagtatatgatcataccttggttcagttttcatcacctttcgggtaaaacaccagatcggttatactttggctcaattttcaccaactttcggtaaaacaccagatcggttagtgttccctctatcaaaaaaaggaaaagcagcttgagacacctctcgcttgcacctcactatctaccgccgcgagttagtatcatcttgtgtaagagagagaataaagagggggcttgtagctagacaaccctaaaccatgtattgcatcgccacctgcatcagcctcgtgtggggtacgctcagcgtcgcgatgcccctcctgcagttcttcctcaggaaagcgtagaaatagttgatcaccagcttcttcaggaagaacgactccttccgggccctgatgtctccgtgccc

SEQ ID NO: 3373 - DNA, 780 bp, Sorghum bicolor
  Clone ID: SORBI-28MAY03-CLUS56799_1
gcacgagggtcgcctagaggagagtgtaaggagagtagatagcgagggatggcttcccctgatccatcggcggcaggcgccggcgccgggggcgagtcgacgagccaggcggcggccgtggagccgatccggatgcccacggtggaggagatcaaggggcaggacatctggaacaactgcgccgtccgcagcgtcgtcagtggcgtcatgggaggcggtcttggtgtacttatgggactattctttggagctttggacaacccaataatggcagaggagatgacagcaaggcagcaaatagtatacacagcaaagcagatgggtaggagaagtataagtaatgccgaaacctttgcagtcatgggtctgattttctcagcagctgaatgtaccatagagaaggttcgggcaaagcatgaccctcccaatacagcagtagctggctgtgtcactggaggagctttagctgtaaaaggtggcccaaaagctacatgcattggatgtgcagggtttgctgcgttttcagtggcaattgagaagttctttgaccggcatacttgaaatgggggttgtcaatttgaagccttttagctgagtatgagtagcgttggcagaagaacctggtattttgcaacatccagtcatttacatatcatgaaagatcatgtaactttttttttactattcccaattccttggggggcttcatagttataactggactactggagcgcataagagatcccccctgatcaatatgatgcccgatgcccttggctg

SEQ ID NO: 3374 - DNA, 593 bp, Sorghum bicolor
  Clone ID: SORBI-28MAY03-CLUS56805_1
gcacgaggcggggaggccaacatctcccaccagacggcgttcatcatcttcttcgtcttcgactcggtgtcgctcttcatctcgctggccgtggtggtggtgcagacgtcggtggtggtgatcgagcgcaaggccaagaagcagatgatggcggtgatcaacaagctcatgtgggtggcctgcgtgctcatcagcgtctccttcctggcgctgtcgttcgtggtggtgggccgcgccgagcggtggctggccgtgtccgtcaccatcatgggcaccaccatcctggccaccaccatcggcaccatgctctactgggtgatcgcgcaccgcatggaggccaagcggattcgcaccaacaagcgcaacaggctcagccgctcccgctccttgtccatctccggcatgtcggagggcgagtgggtcgaggaggagtacaagaggatgtacgccatctgacattctgactctgaccatcccacccacgctagctacctgcatgcttaatttcatctcgtgcatttcaattgcatgagcatcgatcgcattgccacaagtacgttgccgtgcttcggcccgggctaacattttcctcc

SEQ ID NO: 3375 - DNA, 617 bp, Sorghum bicolor
  Clone ID: SORBI-28MAY03-CLUS56831_1
catccagccgacacaggcgatccgggacctcgccgtgaagctgaagctcgcccccgtgcgcggcgtcatcacgggaaagagcgtcgtggtggtggacgactccctggtgcgcggcaccacctcgagcaagatcgtgcggctgctccgcgacgccggcgcgcgggaggtgcacatgcggatcgcgagcccgcccgtcgtgggctcctgcctctacggcatcgacacgccgagcgagggcgagctcatctccaaccggatggacctcgatggcgtgcgcagggagatcggcagcgactccctcgccttcctgtcgctggacaagctgcacagcatctacggcgaagagtcgggggactactgcgacgcgtgcttctcgcgcaagtaccctgtgctgcccacgctggccgacccggccgtcgagccggacgagtgagccgggagcagccgagcaggtgagctctgctctgtttcgtctgcctgtacttttaggttgttggattcagctctgttcgtagtgttggacaattttgcgcgcctcaaggctgtagctttataatacgatgtagcgctttatcatggaactgatggattaccaataagaaaatgacaaaagccaa

SEQ ID NO: 3376 - DNA, 542 bp, Sorghum bicolor
  Clone ID: SORBI-28MAY03-CLUS56837_1
gttcctgtacatgagcgaggtcgacgtcggcatcaagttcgtggacttcgtcgccgccgtgttgcgggacaaggtccccgacgccgcggccaggcgcgacctggtgatgcgcggggacagggtggccgcggccgaggccgtgcgccggggcctcgtggacgccgccgtcgacggcggccccgaggacgtggtggccgccgccgtcgccgaggccgagaggctggccgctaggggctgggacggggaggccgtcgccgagatcaggaaggccgcgtggccccagctgtggggccaggtcaaggaccacggcgccggcccggcgccggcgggtgtgcggccgcggctctaggcgcacgcgccgcgtggtgcgctggttgcccggtacgaccggattgctcccatctacagcgacgcgcgagtcacatcaagaacatgtagcgacgcacttgttgtacttggtcagactctcggatggttgtatacttgtattgtatgattgtgtcgtatcttatctagtattagtacttgctgcccagtacttt

SEQ ID NO: 3377 - DNA, 701 bp, Sorghum bicolor
  Clone ID: SORBI-28MAY03-CLUS56852_1
tccgagccgagcttctctaccctggcggcatgctctgcccggcgcacctcgccgaaccttgcttgggtgccccgccctcggctggaacctgcgagccgtcagcctggggccccggttggctggtggcgcaagcgctcctcgacccgggcaaggcccgatcatgtgcggcaacaccccgtggattcgtcgggccctggttcgtgtcgcgcgggtgatgccctcctcgtgtttgtctgcctaccgcttcctgcgcggccgggtgctcggttctttggttccggccgtaccctggttcccggccctgctcgtcgcctgccgcgctgctccttcggtcggctgcgccgtttcgcaggtcgtgcttccgcccctcggccgtcgtgcggcgctgcgctggtgcgcgacccccgcgcgtcgggctcagcgcccttgtcttctcccggctctctgcgcagactcgtccctcttgtcgtcgttgccgccgtcaccccttgcccgtccgtgctccgcggctgccgggcgccttctttgggtctctttggagtttcggatttcttttttccgccactttgctgacttgcggcacttgagagttgttcaaacccttcgcttctaacttagcgccctagtaaactccagtttctcagtgaagagtcatcactcatgtcgtcgatgacttattcaaaccttgtacatacagctac

SEQ ID NO: 3378 - DNA, 520 bp, Sorghum bicolor
  Clone ID: SORBI-28MAY03-CLUS5714_1
gattgctgcaatcgctcccttttctcaccgccttgcatttgatgatttgcctgcggatcttcaacgcttgcgttgtaaagttaacttccaagctctggtctttcggtctcacattatctcactcggagagacacttgtgaagcgcttgaggtcttcagtcgggggtcgttccaataaatctatccatcaagttgtaggagacacaaatcaagctcaaaaatatgcagttttgcatctccgttttgataaggatatggctgcacattctgcctgtgactttggaggtggcagagctgaacagctagctcttgctaagtacaggcaagttatatggcaagggagggtattaaattcacagctaactgatagggagcttcggaacacaggacgctgcccattgaccccagaagagattgggctgttactggttgcccttggctttgacagcaaaactcgactctatcttgcttctcacaaggtatatggtggagaagccaggatctctagcctgcgcaaacta

SEQ ID NO: 3379 - DNA, 578 bp, Sorghum bicolor
  Clone ID: SORBI-28MAY03-CLUS57144_1
aaaaaaaaaaaaaggaaggccacctctgggtactttgtgcacgagccctatcggctcgattccaaagctctagctggtatctagctatataaattaaggtcatcagtagatagaaggattagattccaggagaattgggttccgatccaattacacatacaccatcaacttaagtctctcctctggccatttgggtggcttatcttgaagccgtatatatctcccaaatctagagtctccaatagcatcagagctagtggactaatgcaaaaggagagattctttgggtcagtggcatgcagctgggagaagcttgtggcatcatcatcaggaaggataccattctctgcaggctctgggtgtgatgagggagaggttgagtcgttcttggattcgtcttcttgaggttcttgttcagttaacaaggagattgttcctgtggagaagagaaaagatggcgcctcctgcatcatcgtcgccgtcgccgctgacgcccgccatggtttgcgcaaggcagggacggctccggcagcgctacgaaggatgctaccgccttgtctcaggatgcgttccttacg

SEQ ID NO: 3380 - DNA, 685 bp, Sorghum bicolor
  Clone ID: SORBI-28MAY03-CLUS57159_1
gcaagtctgtagagttgctccctgagctctggaaatcaggggggttttcacttgagaccagctcgtcgtacaggaggtcacttctcaataattggaatcttgatggagagactatagcaaggatacagaagaaatttgctgtttttctcctatatagtggctgtgaagcgcgccctccaaatcttcattctcagttggacggttcatttgtacctcgcaacaatatggaagaggctattcttcttttgatgattcttttgaggaaattcaatctcaaaaggattgagcgagatccatctgtgatgcatcaccttacttttgcactgtccatgtcaggacagctaattccactggctggacagtttgaagaattgttacctagcgtgttagacaaaaaagaatggttgtacagcgttgcattgtgttatttagcagaagaagatgatctgagtgccctgaatctactcaaaagaatactaaagtctggagaggattctgatcatctcaaagaactactcctagcttcaaaggcttgcattgagatgagtgctcatagtgaaggtgcttcttatgcaaggagagccattgctaatatgcagggaggatgcaaaccaatggcaggacttgcagacctattgcttggtgttgcactctctaatcaggctagaagtgccatatctgatac

SEQ ID NO: 3381 - DNA, 804 bp, Sorghum bicolor
  Clone ID: SORBI-28MAY03-CLUS5716_1
gcacgaggctctttggaaccttattcagttggttggtgagaaagctcgaagaaacacagttctcttaatggatcgtgataatgctgaagtgttctacagtagggtttctgatatagatgatctattttattgtttatctcatgagcttcaatacatcattagtagagaagaacacccatctgttcagatgcaacgtgcacttgagttagcaaatgcttgtatcgccttagttcaggcagcatcacactacaggaaggatcacaaggaatggtatccatctcctgaaggactgataacatggaacatccaacctgttgtacggtctggaatctggagtttagcatccttgattatggagcttttgggagattcaggagctgcagacatgtcaatgaaatctagtctatggtctcagctggaaggactcacagatattctactggaggcatatataggccttttaactgcccaatttgaacgtgggcaggaacatggtgtgctagtccaagaatattgtgaacgaagagatgaacttctcagatccctctacaaccttgctaaacaaatagtggaggtcaaataccaggagtcaaaagatggtacggacaatctggatctgaaagaatctatatttagaaaggttatttctcctattttagcaacagccaaacgacatgaagggtaccagacactgtggcagatttgctatgatctagatgattcagatctcctccgcagcctaatgcatgatagtgttgggcctcatgtgcggatcagtttctttgtctttaaagagtagtcaac

SEQ ID NO: 3382 - DNA, 603 bp, Sorghum bicolor
  Clone ID: SORBI-28MAY03-CLUS57166_1
gcacgaggtggctctccccgtcgcgctcgtcgtccgctccctgccgaggcccgcccgcccacgctcgccgccgaggcggagcccggggcgtcagccgctgggctcccgacccaactgccctgccgccgcagcgccgcgtccgcgacgctggctcttccgctccccctcccccgccgcagaaggattgtattttccgcttgtttctgtgtatccatactctaacatgtgggtaactcttgtgctgcaacatggagatatgttcaagtaacggtttgcttcaatccctgctggcccatatagagctttgatagaaggaagacactagcagaggaagcgagcaccgctccaccaaagcaggccatgtcgagtccagtaagcagcggcacgctcttgaacttctcaagaacccccacctggagcagcaggagtatggcatggctgatcctcgtcttcgcctgcgtgacggacctgatcctggcaccttctttcagcttctggttgaatgcacctaagtgggacgtgtcaacatgccgtgcctgttgctgaatgctctgagaaccatagaacatggtgtacatccccatgccaaacgtgagaagagca

SEQ ID NO: 3383 - DNA, 482 bp, Sorghum bicolor
  Clone ID: SORBI-28MAY03-CLUS57185_1
gcacgaggcagcaatcttcctgaaagccagtccctcctgcgtgtcgaacttggagagacggataggtatgcagcttgacaaggccagcctggaagatcttttgataccgaatgtctctgattctgtggaaacactgtatgatgtggattgtgcgcagaggattctagaccatttcttggcaatggaccaagaaactggtggggcctcccctggcattggtgaagatgggcaaatgttggcctcaccatctttaatgccaataatgatggttgctaagttgattgatggttatctagctgaagttgcaccagacatgaacttgaagttgccaaagtttcggtctttggctgctgctataccagattatgctcgtccaatagatgatgggctttatcgtgctattgacatatatctcaaggcgcatccacatctgtcagaatcagagaaggaagagctctgccgggtgatggactgccagaagc

SEQ ID NO: 3384 - DNA, 985 bp, Sorghum bicolor
  Clone ID: SORBI-28MAY03-CLUS56928_1
gcacgagggaagctggtatgcaagattacaggggatacggttaacaagttggaggatcacatatggaagcacatcaacgggaagagatttcttaacaagctaggtaaaagttaactgttaatgtcagacaaattgtttgtaccttgctgagaacaattcattattatcaaacacagattccagttgaactcggctaccaatacaaccaactgcataaaacctgcaccagaatatttgtatgcatgtaacccatttaatgtgaccatcactgtgtaacagaaaaactagaagaccaggtggcttctggcgagatggctgatgaagaacctgtgaagtcaaatgaagtggcaaagaagagcaagtcaagaaagaaggacaagaagaaagctaatgttgccagtccttctttgccaagagaacctaaaccagagatggatgattcagatgatccagatttctgggtgcctccggttggaagtcgctgggatgacgatgatgggaaagacagatgggagtcatcaccaggaaagcccaactcagcaaagaacaaaggtggttctgatgatgatggtgctggtgataatgacggtggtggtgatgatgatacggctgacaaggatgatgctgaatcaagggaacttgcttcgagcaggacaaagcgaatgtcaatagaggctgttgggccaagtagcttcgcttcaaggaagaaaaaacccaagaaggagcagtaagacatcggtgatttgtgacgactcaaattaagaatttggtctcgtcgagaggaagaagtgttatctattgactattgggtcgtgtttccttagatttgggtaatcaatgactggatctatgttagcatatttctggttaacgcttgtctgctgtgataaatctacatacgcacgtatcttgcaaggttttttttggaaaacattgagggaaatagttgcctttgcattgctgtgtgactcaagattttggttgg

SEQ ID NO: 3385 - DNA, 391 bp, Sorghum bicolor
  unsure (1)..(391): unsure at all n locations
  Clone ID: SORBI-28MAY03-CLUS56946_1
gcacgaggagcgcagtgcgtcgtcctggtgctttggttcgccaccggatcaccaacccaaatcctgcttcttggaccgagccagagagccaaagccgagagccgaggagggaccgccatggcgacgacgcggccggcgcgcagcgatccgcacctgccacccgaggaggcggcccgggtggaggccgaggttcgggactacttcgacagcttcgcgcccaggcgccccgccaagccgccgcgcagcgacccgtcggaggatgcctgcgcggaacccgatgccgtcgatgctggggaccacgacttgccggagctccgcaagctgcgcgacctcgaggcgaagccccagaagctggtgttggacggaggaggaagaggggatgtggacnnng

SEQ ID NO: 3386 - DNA, 923 bp, Sorghum bicolor
  Clone ID: SORBI-28MAY03-CLUS56951_1
gcacgaggctggaactgagacaaacatcaatcttaatcatcagatatattaccatgttttgggatctgatcagtcagaggatgtattgtgctggaaagatcctgaacacccaaagtatacctttggtgcttcagtcactgaagatggaaagtacatcatattgggcatctatgaaggttgtgaccctgtcaacaaattatactattgtgaaatttcttctcttcctcgaggaatagagggcttcagagagacacaggaattacttccatttgtcaagcttattgacaattttgatgctcaatatgaagttgtggccaatgatggtgatgaatttacatttttgaccaataaaagtgcccctaagaataagctggtaagggtaaatatcaaaaacccagagctgtggacagatgttcttccagagcatgaaaaagatgtgctcgagtcagccgacgccgttaacaataaccaactgttggtgtgttatatgtcagatgttaagcatattctgcagataagagaccttagaactggaaactttattcatcagttgcctctggagattggtgctgtttcagagatctcgtgcagacgggaagacaaggaagtatttattggcttcacaagctttctttctccaggcattattttcaggtgtaacttagcacctaccatccctgaaatgaagatgtttcgagaaatttcagttcctggatttgatcgcacaagttttgaagttaagcaggtttttgtccctagcaaggatggaaccataattcccatgttcataatgtcaaagaaagatatcaatcttaatggatcgcatccaactttgctatatggttatggaggattcaacataagcataacaccttcattcagtgttagtcgtgttgtgctatgcaagaacatgggtttcgttg

SEQ ID NO: 3387 - DNA, 655 bp, Sorghum bicolor
  Clone ID: SORBI-28MAY03-CLUS56953_1
gcacgagggagagatttagatagaggggttgatgttgttgttgcaacacctggaaggttaaatgacattttggagatgcgaagcgcgaggcttaagcaagtgtcatatcttgttctggatgaggctgatcgcatgctggacatgggctttgagccacaaatacggaagatagtgaaagagatgcctcaccgtcggcaaacccttatgtacactgctacttggccgaaggaagtccgaaggattgcagatgatcttcttgttcatcctgtacaggtgacaattggaagtgttgatgagcttgttgctaatagtgctattactcagcatgtagaggtcataacaccctcagaaaaacaacggcgcctggagcagatattacgatcccaggattcgggttcaaagatattaatattttgtaccaccaagaggatgtgtgaccaacttgcaaggacactcaccaggcagtttggagcttcggccattcatggtgacaagtcccagagtgaaagggagaaggttctgaatcattttcgatctgggcggtcacctattttagtggcgactgatgttgctgcacgaggtttggacatcaaagatatcagggtagtgatcaactatgacttccccactggtgttgaagactatgttcacagga

SEQ ID NO: 3388 - DNA, 432 bp, Sorghum bicolor
  Clone ID: SORBI-28MAY03-CLUS5720_1
caaacattttacattgcatgcatacccaactaaaaagtctttatttggaaagacacacagagttcagaaagacttctgctttatagcctctacccttgacgaggccattttgtgggtgacatgctttgccgaacaaagtatatatgttaatttactacctcgccctgcagcatctagtatcaatccagactcagacaatcccctcagtgagtctttattcgaccagccaccgattaaatgcaaatctccgcaaagagtacttgttatattgaaccctcgatctggacatggtagatcaagtaaagttttccatgagaaagctgaacctatatttaagcttgcaggttttcagatggaagtagttaaaactactcatgctgggcatgcaaaatctcttgtatctacatttgatttcagtgtatgccctgatga

SEQ ID NO: 3389 - DNA, 1020 bp, Sorghum bicolor
  Clone ID: SORBI-28MAY03-CLUS57217_1
gcacgaggagatacagtgacatacagacaccggatcccgtccgcccccggaccaagaatcccaacctcgcaccgatggcagtggcagcgtcccgccgcgaggaccgtgatcgggatcagccagtggtgcttgtgacggggtgctcggagggcggcatcggccacgcgatggcgcgcgccttcgcggcggccggttgcgccgtcgtggccacggcgcggtcgcgcggttccatgcgcgacctcgacggcgacccgcggttcctgctgctggagctcgacgtgcggtccgacgagagcgcgcgcgccgccgtggcggatgcgctgcgggagcacggccgcgtcgacgtgctcgtcaacaacgccgggatccacctcgtcgcgccactcgccgaggtgcccatggagtccttccaccaggttttcgacaccaatgtctatggtgcaatgaggctgattcaagctgttattcctcacatgatggagagaaggaaaggtacaattgtgaatgttggaagtattaccgctttggcacctggaccatgggctggtgtgtattcagcatccaaagctgctcttcatgcactgagtgactcactaaggagggacaaagtcgaatcttgggagttcctctgcagccaagtatgatcagatgcatgagtggaagtactacaagaaatacgaggaagggctccgagctaggactgacatttcccagggccccggggctactccagcagaagagcttgcaaagaaggtggttgcatccgttctaaagaagaatcctccagcttggttcgcttacggccagttctctgctattctgtcgatgttgtattatgcaccactatggtttagagattacttctataagcttgtcatgaaatgttagtccctgggaaaaataatggttgttatggaccaaagagagagctggtcaggcccagttctgttcattgtactgacagcctgttactacgtactcctatatcggtaaccacaaaaaagcatacacgttatacgg

SEQ ID NO: 3390 - DNA, 637 bp, Sorghum bicolor
  Clone ID: SORBI-28MAY03-CLUS57228_1
gcacgagggcggaacaaaccaaaaaatttgctttatttgataaggttctaaattaacaaataagacaggaaagagtaaatattcgcccgcgaaatccttagagcacgtggccacgattcaataagaataaaaaaaagagattcaaaaaaaggaaggattacattttatataaatattgaattttgatatattctagatcttctttcttgactatatatttatttttcttttttaagaaagtcaaaatcaaaaaaacctaactttttctattatatattgatgtatacctatctataatattttggaatattatggaattagagaaatgaaattcgcacgctttctcatttcattcgcgaggagctggatgagaagaaactctcatgtccagttttgtagtagagatggaactaagaaagaaccatcgactataaccccaaaagaactagatttcgtaaacaacatagaggaagaatgaagggaaaatcctgccgaggcaatcatatttgttttggtagatatgctcttcaagtacttgaacccgcttggatcaccgcgagacagatagaagcaggacgaagagcaatgacacgatatgcacgtcgtggtggaaaaatatgggtgcgtatatttcccg

SEQ ID NO: 3391 - DNA, 612 bp, Sorghum bicolor
  Clone ID: SORBI-28MAY03-CLUS57236_1
gcacgaggattcttttcctcctttgaaggctggattatttttccttaagcatgctgaagcagtaggaaaagagataccagcacgagagcttcatgaaatactattgctctctcttcaatggctaagcggaactatgactaaatcccctccggtctatcctcttcatcttctgcgggaaattgagactagggtgtggctcctggctgttgagtcagagagtcaatctaaggctgatggtgaatttgccacttatgctgttgctcataacatagctgttggaaacagtagcagtattatagaacagactgctgatgtcatcacaaaaatagacagtaatatgagctcgccgcacatgaaagttacagaaaggaatggcacacgggacagtttatcaagccaacatgcgcaactctttgagtctaacagcgaagcatcttcaacaacaataaataacacgagagcaaagcgaagggtgaaaacaaattcaccacttagacgtgggggcaatgacaatactgaaagtagaactaatgagctggataacagttctcatagttcaaagattggagaacaagctagaaatttactttctgaagaggaatttgcaaaaat

SEQ ID NO: 3392 - DNA, 761 bp, Sorghum bicolor
  Clone ID: SORBI-28MAY03-CLUS57234_1
gcacgaggagcagagcttcaaaaggaacaaggacagccctgggaagcggggtgacaccgagctccaccttgcggcgagagctggcagtgttgcacatgtccagaggatccttgcggagtgtgatccagagctggtggtggagttagctgctcgccagaatcaggacggtgagactgcgttgtatgtgtctgctgagaaggggcatgttgaggttgtgtgtgagattttgcacgcggctgatgtgcagtcagccggactcaaggccagtaacagcttcgatgcattccatattgcggcaaagcagggccatttggatgtcttgaaggagctgttacaggcctttccctcattagcaatgacaacaaattctgtaaatgccacagctttggacactgctgcaactcagggccacattgacattgttaatcttctgctagaaacagatgcaagccttgctaggattgcaagaaataatggcaagacagttttgcattcagcagcgagaatgggccatgtggaggtggtcactgcactgttaaataaggatccagggattggtttcagaacagataagaagggacaaacagctctacacatggcttcaaaaggccaaaatgcagaaattctgctcgagttgttgaagcctgatgtctcagttatccatgtagaagacggcaaggggaatagaccattgcatgttgcaactcgaaagggaaacaccattatggttcagaccctaatatcagttgaggggattgaaa

SEQ ID NO: 3393 - DNA, 636 bp, Sorghum bicolor
  Clone ID: SORBI-28MAY03-CLUS57238_1
gcacgagggccgcctctagtcgtgcccccagctcggcaaccccccactcgatctaggctcggggcaccctccgtttgctcaaagcgccgacccctcgccctgcgtctccatcccaccaagcggagtcgagggcccgcggcatctcttcgggcgccatggcggcgttggtgcaggaggcggatgacgtcgaccactacgaggtgctctgcctcccgtcgggggaggaaggcgcggcgctgaccgtcgagcagatcgagaaggcgtaccggactcagtcgcggctgcgccaccccgacaagcgccccgacgatcccaacgccaccgccgacttccagcgcctctccagctcctacaagctcctccgcgacgaatccctccgccgccagttcgacgcgcgcctccgcggccgccgcgaggcagccgcccgcgccgctgccgcgggcgtcaagcgccggaaggccgtctccgacctcgaggagcgtgagcgcgcagccgccgcgggcattcccgctgaccccgaggagctcgccaagcgcgaggccaagcggatggccgccgacattgagcgcgagctcgcagcgttccgcgccgccaagcaggcttctgcatcaggtgccgcatcgacttcggcgcatg

SEQ ID NO: 3394 - DNA, 433 bp, Sorghum bicolor
  Clone ID: SORBI-28MAY03-CLUS57040_1
gcacgaggatttgatcctctgatcattccatcacattcagttgatgagactaaggacaatcttgaagtcagaatgaacatgatcctccaatcattccatcattctttgagaacttcttttcaagcagaacagaagtcagaatgttgtacgtcaggtgaacatgattctcaaatagttccatttcctttgcatgatgagaagatcgacgaactggatggtcctcttttgagcaatgctgatgaactggatcggggatcaaaagtttgtgttccacatggacatgatgctcaaatcactccatgttcaactgatgaggatatacatgaattagatcaccctcctttgagcagttccgctttagtggatcttgaatcagaagaccatgtctcggatgaccgtgattccaaagtcgctccatgtttggttaaagata

SEQ ID NO: 3395 - DNA, 399 bp, Sorghum bicolor
  unsure (1)..(399): unsure at all n locations
  Clone ID: SORBI-28MAY03-CLUS571_1
gcgtccngagactagtacctacaaccagcatgaaggagacctctgcttcattcctagttcttccgagagaactacttaagccgagccatgggacgccacctgctgtgacgtctggagaagaaggaatagccggtggcaatggcgggtcggcaacgtgcaccggcagcagcttcttcatatttgcagccggtgatgccagcggttctgtttctatgggtctttagctgtaagttctttagtaaacgtggagttctattatttctttaatcttcttaattatttcatttgttcccgaagaattatggatttattacgggataagaatcatgctcatcacgtctgatcttggcataactatactcatgcatgcagctagcacagacaactgctgctccaaaa

SEQ ID NO: 3396 - DNA, 591 bp, Sorghum bicolor
  unsure (1)..(591): unsure at all n locations
  Clone ID: SORBI-28MAY03-CLUS57109_1
gcacgagggttacatactgtaatggaatagaatatgtgagagagttcattagcaatatggcatgcatattactatcttcatgtgtatttgtggttttcaaatgctgttgacctgcctgttccctttaccatggttgcagccttgtttattaggatttaaaactcctacataagcaagcaatgtgatgaacaatgtctgtcgtctagcattttaaaccaaatgcagttgaagaattcagtgtctcataactagaggactaggatttttttttctcgaatgcacaggagaactactcatcattgcattaagcaggatataaaatatttacaagacaacatgctgcactagctcagattatgaactgggatctgtatttgtaatggtgaataattcattttattgtatcatataatatggtattatgatatgaactgatgatacaatgaactgtagaaagagatttgtacgctcttatccttttacccttcagcaaagttcttctaggatggtcacttactttctttacattctagtatatggaatttggaaacctatccttnaaatctttactatctgcttcattgattttag

SEQ ID NO: 3397 - DNA, 572 bp, Sorghum bicolor
  Clone ID: SORBI-28MAY03-CLUS57130_1
gcacgaggatgaggtggagctcaccagggagatactacagtccattggctgtgcagatgatgcaccgtgtgatgatggtctttccagtttagatagtttgcaggaggagcttgagaaattggttgcatctaagaggttcctcctggtacttgatgatgtttggattgatgagggtaaaaccgagaaagagaataggagcatgtggaagaaagtgttggcgccacttagatctgcggcaatcgggagcaaggtcttggtgaccactcggatgaagctagtagctgaggttctgaatgcggctcatgtggtttctcttgacaggttaagaagcagtgattgctggttgctgttgaaggaagttgctttgggtgggcaacccatggattttccacccgagttgcaagagattttaggagctattgttgcgaatgttaagggattacctttagctactaaagctattgggcaaatgataagtagcaccaggagcacaaggaaatggagagcactgatgaacacagaaattagtgataatatcattatctcctcgcctcaactcagttaccaacaat

SEQ ID NO: 3398 - DNA, 603 bp, Sorghum bicolor
  Clone ID: SORBI-28MAY03-CLUS57292_1
gcacgaggcactccacggggcggaaggcttactaccggcaggcagctccccaggaccatatccgaaccctaacccaaccgatttggtcggtgatggaagagcacgtgcctcgaggcggcggcggcggggggaggcccccgatcccggcggcggcgaggaagccggcgctcgcgcggcactcctctttcgtgaggagtcctgcaaacaataagaagcctgaaaatgagagaacttttgaaagcatggacactgaatttattccagttgtacgatctgctgggtgggctgatattggctcaaggcacacaatggaggatgtctttatctgctctgataatttcatgcaggactttggatttgaaagttctgacgaaggccccagtgccttttatggggtttttgatgggcatggtggaaagcatgcagctgattttgtgtgcagcaatttaccaaggtttattgtcgaggatgagggttttcctagggagatagtgaaagcagtatcctctgcattcttgcaggttgatgctgcttttgcagatgcttgttctctgaactgctctcttgcttctggtacaactgctcttgcagcacttgtggttg

SEQ ID NO: 3399 - DNA, 487 bp, Sorghum bicolor
  Clone ID: SORBI-28MAY03-CLUS57317_1
gcacgagggtcaagtcatcaactgcccctagcactaacattactggagcacagagacgtggtctaaaaaatcttggttgcacttcaatatctgatgttctgccttcaggatgttcttcatctgattctgtccgtgataggagggtcgaagttacaaagaagagaacttctgatgcagaaagttcttcaagatcaaggggaataagtgaacaatctaatttaagtcagccacgtgctagttatccgggtagtactggtcctagagctagagctgttgaacaattagcttctcaacaaatagcaaggaccaatagcagaagtattcaggatcctacagattcgataaggactagacgaccttttactctgcgtgccagggagaggatgataccaggtgaaagagaggacagcgtatttgctctgcatgagactgttgcaagcgttcatccagaatgtggtcattttcacacagatggtgctcccccaga

SEQ ID NO: 3400 - DNA, 741 bp, Sorghum bicolor
  Clone ID: SORBI-28MAY03-CLUS57305_1
gcacgaggctcctgcagctgccgccggaggtgccggccccgggtgcccccgcgctgcgcggcgtcctcgaccgcctcttcgcgcactggctctcgctcccggacaccgccgcgctgctcgccagcctcgtgcacaaggccaaggccagcggcggcggtggcgccgcggccgcgatgctgccctccatgatgctgcaggggcgcgccgccgtgccgccgctctcaccgaggtccccgcgcctctcgcggaggcccagcagcctcggcgccggccagcccaaccgctccgcgtcgccgctccgcccgccagccgcgcgccccgccaaggaggtcataccgcagttttattttcaagatggacggccaccgccgtacgaggtgaagaagcaatgcatatcgacagttgatcagctcttcgccggccactcaaatggtcttcgggctccagaatttcggatggttaccagggaactctgcaaactaccgacattctttaccactgttatcttcgataagatagacaaggagagcacgggattcgtgacaagggatgccttcattgatttctgggtgaatagcaatttgatgagtatggatagtgcaacccaagtgttcacaattctgaagcaacagaaccgcaattacctcacaaaggaggattttaaaccgattctgaaagatcttttggacaaccatcctggtctggagttcttaaagagtacacctgaatttcaagaaagat

SEQ ID NO: 3401 - DNA, 554 bp, Sorghum bicolor
  Clone ID: SORBI-28MAY03-CLUS57321_1
gcacgagggtatgcctcatgctctacttttactctgaatgttgtatgcctatgccttgtgctctgcttttgctcacgctgcatgtcctttgctctgaatattgtatgctaatgtctgcgtatgcactgaaatacttaatattgtatgactccacatacactgctatggagtacagcacaaagcacaactgcaaaagggtctttctttgattagtatataatgtctgccattctgtttgtgttctttcttaattagtatgttgtagagttcagcagtttaagtttgtggactatttgagacagactatgatgtcatttgtcatgctcatgcatgaactaatgcttgctaatttgttattttgcctcttgtgtattgtttcctatttaattcttagcaaatagcaactaataacatgtttgattgctgaattctctaattgtcatgcaggagaagagcttttggaagggaaaggaaggaacttgggatcaagaattggcaacaaacgagactacgctccggaggaatctaatcctcagtgggttgcctccgagttt

SEQ ID NO: 3402 - DNA, 515 bp, Sorghum bicolor
  Clone ID: SORBI-28MAY03-CLUS57339_1
gcacgagggcaacacatgatatggcatggaaagctcattacagggaagtgttcgaccacggaattcgagaagctttgtgctgcctagcacgtgcaaaatatctaaccgtattggaagaagatgaggtttattctgttgcaagactccttggtgatttggttgcatatcgtgcttctgggacaggacatttggagctcttagcagggcttgctctattgcagaagcatggtaatttacctgaatcgcagactgaccttatggaggcatcccatgagcttatgcaagaagctgctttcctccatccatttgcagaagcatgttacacgggaccgcttcttgatgttggacgaaatcctattctgtttccctgtgcatgggtttatagacaaggtgtgttaactccatgggcacgcagaagacgccctgcacttgatggtgataattggtggcgaggccatgcggcagccttccttagagttgttaatataccacctaaagcacttctgagagggcgt

SEQ ID NO: 3403 - DNA, 644 bp, Sorghum bicolor
  Clone ID: SORBI-28MAY03-CLUS57354_1
gcacgaggactggtaaacgtccccgccaacacagggaatatgaaagagaagaaaggcacgaccaacacaagaggccatttccccatgctcaggaaagctctaataatgatggattggttctttaccgtatactctgtccagacagtttgattggtagtgtcataggaaagaatggcaatgtgataaatgctatccggcaacagacaagtgccaaagtcaaggttgttgacccgtaccctggtgcagacaaaagggttatcttggtatattgctacgtcaagcatagagaccttgatgctgaggttgatgacaatgagcctgtttgtgcagctcaagatgcattacttagggtgcacaatgcaattgttgatacattacataggaatcgtagagactctgataagaagaatacagaggaagctaacattcttgtgccagctagtcaggcgtcaaatgttataggaaaatctggtgctgtcatcaaacatcttcggtcaacatcaagagcattcattaaagtgagcccaaaagatccaagtgacgctacacattcatgtgctatgagttttgataattttgttcagataactggtggtgctgaagctgttaaaaaagcactatttggagtatcaaccatcatctac

SEQ ID NO: 3404 - DNA, 758 bp, Sorghum bicolor
  Clone ID: SORBI-28MAY03-CLUS59709_1
gcacgagggtttccggtgccggggatggtgccgcaccccatgtacagaccgacgatggtccctccgccgccgccaccgccgccgccgcagccaagcaccaagctcgccgaactgcagcttgagctcgacacgcacccgtccaaggagagcatcgacgcagccatcggagatgttttagtgaggccttcgcgcccgcggccccgcggccgcgcgccgccgtcgcccggccgccccgggtccgcgcggccctggccaggcgctccctccctacccccggcggcccccgccaccgccagcgccaccggtcgctctcatcgcacctgatgacgatatcatcaaccactgcaccactcgtcgacatgcatgtacaatagtaactctccggccgtccctacggcacggatagatgtgtagtactatagactgctgctactggccggtgtgtacgtagctagcatgcgcactgcatgccttacgtacgtacgcatccgatcatttctctcgtcacccttttggcccccatctgctccccccccctagctagctagctacctactagtgacgatcattgagatggagctacacacagcctatctagctacctatttgagggtttcttgttttcttcttgcgcctgttgtatgctatatatattgatgctcctgctgagacgaccgagatgtacgtacgtctgtgcacacacatcggattatattgatatgaataataaccatgcgtatgtgagctagctacttctc

SEQ ID NO: 3405 - DNA, 667 bp, Sorghum bicolor
  Clone ID: SORBI-28MAY03-CLUS59736_1
agcataaacggagactgggcgacgacttgtgatgaacaaggtcgtcttcctcacaaatatctacgccctccatctactctctgtcagctaccctccccagggggttagattaatcccttattcgaagaatggtatatatgctcacgctccagccgcttgagagagctacttcgctgtgcagattagttaacaacaaggcggatattatgcacgcttgatcgagcagttgccatcaactgcaagaaggaaccgtggtatgagcaaactgcatgagctgccaatatggaaggtaaaggaatcaaccgccaatctgctgtggatctcatggcaggggccattggatgcctactccccaagctgggcgagttcctcaagcaggagcacaatctggaaactagtataaagcaggacatagagtctcttgatacacagctgaggacaataatggacactgccctgccatgggtgcagcaggacgataagcattgtgcctaccaactgagagggctgtcatatgacatagaagatatcatggacaacttgctgctactcgtcggcaaggcctcagcctcaaagcctatcacaaaccaggacagcttcaaggagacgttggaagacatcaagatccaggtgaaaaatctggctgcctcacatgctggcaattttg

SEQ ID NO: 3406 - DNA, 491 bp, Sorghum bicolor
  unsure (1)..(491): unsure at all n locations
  Clone ID: SORBI-28MAY03-CLUS59830_1
gcacgagggtgaagaccatgaaagccatcgcagtgggaaggttgaaacaaaagaagtgaatgaacaagagagtagtagaggtcatgcaacattatcaaagaagagccagaatcctcaaccagataattcattactgaatcaagtggaagaagacgccatatcagatgatgaaaaccatgaggattctagaaggggtcgttctaagttggagcgatggacaagccacaaagagatagaatatagtaatatcgatgatgatagcacacagacatttccaaccatcaaagctgatgctgaagccgacgaggttggtaaatctgaagtttctgctgcagttggcaactcagacatcaatagtaatgtcgatactgggcagacatctgataagatgactgaagaacgtgaccgacatctagacacagtcgagaggctcaagagacgaagtgagcgtttcaaacttcccatgcctggcgagaaggatgcacctcana

SEQ ID NO: 3407 - DNA, 617 bp, Sorghum bicolor
  unsure (1)..(617): unsure at all n locations
  Clone ID: SORBI-28MAY03-CLUS59831_1
gcacgaggctcacatgaccagctcattgcaaaggtgcggtcaattttggagaaccaaagttgtgagaataacagcatagatcaccaagctaaaccaactgctcctactgcagctgatgccaacgatcttgacatgcatgatatccataacggagataacatacagtctgaacatgtaactgaggcgccaaatcattctaaaggatatggcactaaccaacatataaaccatgagagacatgtgccactgcaacagaacagtcccacggaggctgcggcaccacagcccatggatgccgcaacgaatgccgggtcagaacaggaattggatcatgaacactcaccggttcacacggatgtgacaattggcgatgttgttcctccaattttgggtcaggcgatggaccaagaaggcactggacaagcatcacacattggcagtatgtgttttcttaaatttgttccatcaaatattaccataatacctatttatttaagctgctcgtgccaatgtcaatattcatggaggaacctcatccctggattctctagttgacctcatcactgcatctgttatacggactgcccaccgacnaactacaacaactgacacgatga

SEQ ID NO: 3408 - DNA, 527 bp, Sorghum bicolor
  Clone ID: SORBI-28MAY03-CLUS57409_1
gcacgagggaactatcccacagaacttctctgggctccccaatcttcagatattgtcacttgagggcacgtggctaaatggttctgttccctcaacaatctggaatggcatcaggcttactggaagtagaagccttattctagacttccaaaacaattctctcaagacaattccggccgcatttgatcctcccccaaatgtcactgtcatgctatatggaaaccctgtgtgtgaggatactaatggagctctgataaccaacctgtgccaacccatgtcagtaaacatgcaaacatcgaaaaatgaacaaggatatagttgtcaaccttgcccaacagataaaaattttgagtacaatccatcatcaccgataccttgcttttgtgcggtgccacttggctttggacttcggctgaagagtccaggaatcacagattttcgtccctatgaagatgcctttgagatcaacttaacctctttattgcaactgtttctgtatcagctaaatattgagagctacatatggg

SEQ ID NO: 3409 - DNA, 845 bp, Sorghum bicolor
  Clone ID: SORBI-28MAY03-CLUS57436_1
gcacgaggcccaagcttccgcttctctcatggccgaggccgaggccgacgccaccgccgccctctcagctcggagcaaagtgcaggcgttcctggaggctgcgcgcgccggcgacctccagtctctcaagagcttagtcgcggtgctcgacgaggacggcacgggcgccgcctccgtcgcctccgccgtgcgcgacgccgactggcgcactgctctccacttcgccgcgcgcgagggccgcgccgacgtctgtgaattcctcatcggcgagctcggcctccctgtcgacccaaaggacgatgatggcgaaactccactcatccatgctacacgccagggccatctggacactgccaagtacctccttgaccatggagctgatccttcggtggccaccaacctaggagccacagcgctacaccatgctgcaggcatagggaatacggagctcatgaagcttctcctctccaagggagttgacgtcgaatcagaaagcgacgctggcactccccttgtgtgggctgctggtcatggcaacccggatgctgtcaaacttctgcttcaacacaatgctaagccaaatactgaaaacgatgatggtgtcacagcattgctatctgctgttgctgcaggttccctcccatgcttggaggttctaatcaaggctggtgcaaacccaaatgtcaaggctggtggagcaacccctttgcatattgctgcagatagtggaaatatagaagtcatcaaatgtttgcttaaagctggagctgacccgaatatctgcgatgatgatgaactgaagccagttcaggttgctgcttggagaaataaccgggaagctgtgg

SEQ ID NO: 3410 - DNA, 762 bp, Sorghum bicolor
  Clone ID: SORBI-28MAY03-CLUS57438_1
gcacgaggcagcactgatgagtacgagattcaccaccaggctgccgctgccggcggcggcttcgagcaagcagatccggtgtcctactccgaagagtacgggctctcgttcggcgtcagccactcgactagcaccgaggacgggcagccgctgtacgtgtcgaggaactcgtccttcaacaccgtcgacgaaaggatgatgggcaaagacggcaagcttcaccggcttatggggtactcgtcggcgagcgagctgctgcggcggcattcgcccgacctgttcgagagcttcgacaggcgcacgcccaccatcgaaagaacgcacgtcgtcgacaggaagggtaaaggcgtctgcgtggcagaaaacgatgccggcgagcgagacggtggtgcggtggtgaagagatcgaaggcgaggagtggtggcttgccgctccatgggatcctgaagaaggggatccatggcctggaatcactcaagctcaggtcgtagctcatgatcttcgttaggcggtggcgaggctcaggcgatcgagtttaggagagagtagcatacacgacaggtttagagtttagtggttggcgttctgaggtgtgcttactgcttagttgctagcttgtgtgtgagtttgtttgcaatccatctgtgtgtggagttggttgatttgcaaattttgtgtgatcttcgatgtgtgtaaggtttgcacgccacacatgctcgatgctgtggatgtgcatatatttgattggtgatttgtgcgcg

SEQ ID NO: 3411 - DNA, 466 bp, Sorghum bicolor
  Clone ID: SORBI-28MAY03-CLUS57468_1
gcacgaggcaactttcagaaagctctatggaagaattgagacagatattatggaaaatgatcaactcacagtggttatacagaacaactataacacatacagttttggagggtcaaaagcactggtcctttcaactacatcttggattggaggcaaaaataattttattggtgtcgcatatctgagtgttggtggtttttgccttttccttgcactgctttttttagttctctacatgattaagcccaggtacaatgtattgtttcagtcagatgcagatgcatttcccattatattagatttaagttaaaactgttcttagttctgtgaatgttgaaacgcaaatactaggaggagccaaatagttccttgtttatgattattgagacctgattacttgaattctacggagtaaaaaccagtaacatatgtgtttgcatctcttgaacatgctaattctgttgta

SEQ ID NO: 3412 - DNA, 460 bp, Sorghum bicolor
  Clone ID: SORBI-28MAY03-CLUS57476_1
gcacgaggcaaggatctaatcacgctggaaacaatttaactctgaaaggctggccactcacaggacttgatcattttcgctctggaattctgcagcagaagccatttatgcaatctccacagcaatttcagcagctccagtttctgactccacagcagcagcagcagcttttgctgcatgctcagcaaaatctgtcttcctccatgtcaaatgatgttgataccagaagattaaggatgcttcttaacaacaggaatgtggtccttggtcaggatgggcagactaatagcggtggtgatattatcccaaatattggttcgccagggcaaagtggtggatcacgtaatgatatagatatactaataaagaagaaacttgctcttctacagcagcaacagtcgcagcagcaaagtcatagccagcagcagcagcttcagcaacctgcactctctggacagca

SEQ ID NO: 3413 - DNA, 404 bp, Sorghum bicolor
  Clone ID: SORBI-28MAY03-CLUS57242_1
gcacgaggccgcccccggcttcggcctgctcaaggtcggccccgagggcgggctggccacgccgctcgcaacggaggccgagggcgtgcgcctcaacttcaccaacgacctcgacctcgacgacgagggcaacgtctacttcaccgactccagcatccactaccagagacggaatttcatgcagttagttttctctggggatccctctgggagacttctgaaatataacccacagacaaaggaaacgactgtactgcatcgcaacctccaatttcccaatggtgtgtccatgagcaaggatggctcattcttcgttttctgtgaaggatcacgaggcaggttgagcaggtactggttgaaaggtgagaaggcaggcactgtggatcttttcgctatcttgcctg

SEQ ID NO: 3414 - DNA, 718 bp, Sorghum bicolor
  Clone ID: SORBI-28MAY03-CLUS57243_1
gcacgagggtgatcactgccgttcaccattccagaagggtcaaggttcagtgagtgatcctatctatatgaaccctcgttggactcggccagtccaacaacattttgaccaagcaagcatgattagtgattatccaagtcaccatgctagttcttgttcagattactgccgccctggtgagcattatgtgggaggtcaagatgttagattggaaaatggtgtttatgttaaagagcaaaatggtggccatcctcccatgttttataatgagtcacatcctcatgatagagtctggcatgcacataccaaccaaagtcatcagcggtatgaggatccaaggctgcagcctcctgctaatggtagagtgattgaaccatacattgtcgatggcaactctgtcaattcagcatttgcaccaaacaaagtatatgaaatgcattcagcatctcttggtcgttctagtcatgaaagtcctcaccattttcatggtaccagtgagctcataaatgacacgtaccacaaccaacaagttggaggcagtgggtcgtatgtgcaaccagcagggtttgaagaatcctctgggcagcattacaaccactcttcggcctatggtgcagattccttttaccaaatgcagcagaatttgccaccgattcagtccctgaggaggagagcgaacagccctgttcacactgcctcaccatatgattccccacac

SEQ ID NO: 3415 - DNA, 1051 bp, Sorghum bicolor
  Clone ID: SORBI-28MAY03-CLUS57246_1
ctgtagtttcctagcaaggctgagaaatctctcatccaaatcacggttgcagcagtgtgctggttagtcactacctcccgctcggcgaggaggagctcccatccaccgccggatgctcgcgcccacgcccttcatctcctccacctgcagatacacacacatcacgcgcaccagatcagcgaaaattcgagcagcaaaatcgctcgccgtacggggacggaagcttggattagatcattagacgcctcaccgatccgacgcccgcggcaagcaccccagcggagacggcggtggcgcccgccccgacgaagagggaggcgatggcgaatgccttgaacggcatcgccacagccgttccgcccctgccgcgtcggaaccacgcgaccccggccgcggcctgagccgcactcgcagccgcccaccacggccacctctcggcccccccgccgccgccgccgcctcggtcgtccatccccgccggcgtcactagggtattcggggttcagctgctggagtggcaccctatagaagtcgaaatctcaccgcccgggggagcccgcatggaagtattcaactgccagcccactgacatgtgggacaggtccccatcgaagcgccactatgagccccggcagacccgccagtacagtatccggtcaatcgcgacgcccgcttccatggattccatgaggcggagttccgtggggcttctcatagggctcctgctaattcggctcaatcggtgctcggcggtgggcgacgaaggcgcgggtgaagtaggcgcggcgttcccggtggtggtgagcacctggccgttccgtgaggcggtcagagcggcgtggaaggtggtttcgaccggtgaaggagggggttcggccgtcgatgctgtcatcgctggctgctccgcttgcgaggagctccgctgcgatggtacagttggtccaggtggaagtccagatgagaacggtgaaaccacattagatgctcttgtcatgaatggggaaactgtcaggcaacaatggaaattggagctgtggcggccatgagatat

SEQ ID NO: 3416 - DNA, 589 bp, Sorghum bicolor
  Clone ID: SORBI-28MAY03-CLUS57263_1
gcacgaggagatgctgcagcaacttctactctccaaatttacaggtgttacaggtccagtccagtttgattcagaccacaatttggtacgcccagcgtatgatatccttaatattgctggctctgccccccgcttgattggctattggtctaactattctgggctttcggtggctgctcctgaaattttgtatcagatgccacgaaatacatctacaagtgcccagcagctgcatgatgtggtatggcctggtgattccactactaagcctcagggatggatattcccaaacactggccaacctctgagagttggggttccaattaaagcaagctttaaggaattagtgtcaggcagaggagataacatgagtggttattgcgtcgagatattcaacgcagcaattaaactgcttccttacccagttccttaccaatttataactattggggatggcacaaaaaaccctagctatattgacatcattagaatggttgctgccaattcacttgatgcagctgtaggcgactttgctatagtgagaaatggaccgcagcttgcagaatacacacagccttatattgagtca

SEQ ID NO: 3417 - DNA, 533 bp, Sorghum bicolor
  Clone ID: SORBI-28MAY03-CLUS5728_1
ggcggctggtggcggtggcgcgacgttcgagcgcgggaagatggtgtttcttgaggacgtgagctgcagcaacggcggcactcggcggttcgagctggaggagctgctgcgcgcgtccgcggagatgctggggaaaggcgggtgcggcacggcgtacagggccgtgctcgacgacggcaccgtggtgaccgtgaagcggctgcgtgacgccacggcgccggccgccgcgtcgaagaaggacttcgagcaccacatggccatgctgggccgcctccgccaccccaacatcgtgcccctcaacgcctactactacgcccgcgacgagaagctgctggtgtacgagtacatgcccaacggcagcctcttctccgtcctccatgggaaccggggccctgggcggacgccgctggaatgggcggcgcgcctgcgcattgcggccggcgccgcgcgcgggctagcctacatccaccactccggtcgccgtggcagcggcacgccgaagctggcacacggcaacatcaagagcaccaaca

SEQ ID NO: 3418 - DNA, 566 bp, Sorghum bicolor
  Clone ID: SORBI-28MAY03-CLUS57578_1
gcacgaggcccatccgtatatgagcagtggtgctactactttgcatgggctcctgcaagatggtcaccagcaggacatgagctcaacaactgagcaaagcgccatgacggcatcaagcctgatgaacccttcatccaataacctagccctggccctgcaaggtcaccatcaccaagagcaggaccaccagcagcagatgctgtccagcttcggatccgagctgctcttgtcgccgacctcgccctacgggttccagtcatccctgctaagaagcctcatggagccgacagcaacggcggcggcgaagccgcaggctttgccggggtaccagcagtatgatcagtaccagcagatgggcatgggccaggcgaggtttccaccggccggagctaccagggaggcacttcagttcaccaacgacgcgccgttctggaacccttctgctgctgggttcggcgtggcgccggcgccggcgcctgaccaagctagcagcgttcgttctgtcaaaccatcgccgacggctgcgcgtactacagcaacccttgcattaaagactgcgttggaag

SEQ ID NO: 3419 - DNA, 787 bp, Sorghum bicolor
  Clone ID: SORBI-28MAY03-CLUS57650_1
gcacgaggattgaagccacgcaccaagcgttggctctttgcaaggaatcttgaagaatcaggcagcagtctgaaatttgccaagctagagaccgaggaggcagtgtcaaggataatgaaatattctgaagacatcgagaagggctcattcactccttctagagagaaggacgagcttagccttggcttgggaaaccccgagcacccaggccgtgtcaggggtttagggaaacataagacctgggcgcgaggatttcgagaggatgtggagatgtacaagaaacatggtagaaaccgggaggtgagtcttgccaccctagtgaagaccctagttgccaaggagctacaggagcaaggactgtctactgagcgacggtcacaaatagagccgcctagggatttggttctagttggtagccctccaaatgttcaaagcagccaaggttccaatgcagcctccgcctcagtcgatcacatacgggtgccaactcgttgcatcctgttgattcccatcggtaggggacaggagatggctgaggtggcaacgggtctggcacatcctccaattccaggcgacatctggcaccataaaccggtcccggccgactatagtaaggttgaggtgcataccgtgaatcccgagtacgcgaagcataagattgaacacccaactagcgaggggattcgtgagcttggactactcatgaaacagttcatcctctggtacaaaaaggatattgtgttgaatgtttcctcgccaactccaagtgatgtacacctggagagag

SEQ ID NO: 3420 - DNA, 616 bp, Sorghum bicolor
  Clone ID: SORBI-28MAY03-CLUS57651_1
gcacgaggggtcgccgtcacggccgtggcgattgcatcgggggcgtgcctctcaaccaaagtcgacttcctctggcctcgcatcgagcagttgccagatactcttatatttgaaggagtggaggtgacaggataccagatatttgaggatccaaaggtgcagaaagcaatagaatttgctagtacagcccaccttgggcaatttaggagaacaggagatccatatgttacacactgcatacatactgggaaaattttagctgccttggttccatcaactggagaaagagctgttaacacagttgtggctggcattcttcacgatgttgtttgtgatacatcagagagcttgaagagcatagaagaacagtttggggatgatgttgctagcttggtatctggtgtatcaaaattaagctacataaaccagctacttcgcaggcatcgacaaaaaaataccggtgggagcactcttacttcagaagaagcaaataatctacgtgttatgttattggggatggttgatgatcctcgtgtggtgctcatcaagctggcagatcgcttgcacaatatgcggacaatctatgctcttcctgtacctaaagctgaagctgttg

SEQ ID NO: 3421 - DNA, 511 bp, Sorghum bicolor
  Clone ID: SORBI-28MAY03-CLUS57664_1
cagcgcgagcgcggcacaacagcaagacgcaagcaaagtaaacaagccaatcaagcttcaagcccttattacgatctgaattgatctagctagagcatcgatctccgagaagaaaccctcgaaacttttgtagttgctgtccgcgcgtgtacgtgcctttgacgagaggtcgaggtaacaatggcgcccgtgtatactggagcggtccacggcaccaacggcggctccggcctgaccctgaacccggccgtggtggcgcagcgggcgctcagcctcggcggcgcgtccacgccgttgtcgtcgtccacgccgccggcctacgggaacatcgtcaccgtgctgagcatcgatggcggcggcgtgcgcgggatcattcccggcaccatcctcggcttcctcgaggagaagctgcaggagtttgatgagcgaccggaggcgaggctggcggactacttcgacgtgatcgccgggacgagcaccggcgggctggtgaccgccatgctcacggcgc

SEQ ID NO: 3422 - DNA, 406 bp, Sorghum bicolor
  unsure (1)..(406): unsure at all n locations
  Clone ID: SORBI-28MAY03-CLUS57670_1
ggcacgaggtgcaattaaggaagttttcttgtacattaatgacgaacctgatcatacaaactcgagtgtaatcactcttggcacaatgaggataaaatgccttgagaaactaaacactctgttaagttgcttgaaacttcctcttatatcctcaaagcgtaccattcgtgatttctgcattgaaagtgcttccataattttttggactgtatcaacttccacaaaagtaattactaacaaaaagcttgagttgcttgtggttgatgaggctgcccagttgaaagaatgtgaaacactgatccctttgcgcttgtggaccttanagcatgctgttctaattggtgatgagtgccaattaccagcaacagtcaaaagcaaggtttgcacggatgcattatttggaaga

SEQ ID NO: 3423 - DNA, 596 bp, Sorghum bicolor
  Clone ID: SORBI-28MAY03-CLUS57692_1
caagtccatcgtcctacagatcgacagcaagtcccagcaggtgtcggcaagtgcactccgtcattcactgcaggataggcttagcaaaggggcatccagtggatctgggagaagccgaagcgatgagatttaccttaagttgcggacaagtacagctcctccgctgaaattgattgatttacctggcatagaccaacgggttatggacgattcaacgatcagtgaatatgctgggcacaatgatgcattattgattgttgtgataccagcaatgcaagcggccgatgttgcatcttctcgagctcttaggctcgcggaggacatcgatccagatggaactagaacaataggtgtcttaagcaaaatcgatcaagcagctgcagatgcaaaaacagtttcttgtgttcaggccattttgtccaacaagggtgccccacgagcagcagctgatattgagtgggttgctctaattgggcagtctgtctcaattgcatctgctcaatcaggatcagttgggtcagataattcactggaaacagcttggcgagctgaggctgagaccctgaaatccatcctaactggtgcacctcagagta

SEQ ID NO: 3424 - DNA, 866 bp, Sorghum bicolor
  Clone ID: SORBI-28MAY03-CLUS57708_1
gcacgagggttaagatatcttaatgctccttggacccgggatctacagtttccagaatgtatcactaagctctcgcatctaattttcctcaatcttcacggatctgatatagaaaaaatacccgagtcaattggagaaatgaaagatctgaggcatcttgatttatcatgctgcagaatcaagcgattaccagactcattcatgagtctacaaaaactggtgcatttggatttctccaattgccatctgatgttaggtgaatcagaatctttgtggagcctgagccgattggagcatttgagtttatcaaaatgcaggatcgaaggagacctggccaaagcattgtgcggccttagagaactgcaatatttggaactatcacatctcttttgttggggaaacctcggcagagggctacagcacgtcgctaaactcatgtacttggatatacgtggattcctggacaggaacatagttggtggagctgaaactgagactgttattgaggccatcagcagcctttccaacctagtgtatcttaatctaggttggaatcagaatctgtattatatacccgaatccattgggaacctcagcaagctacgtacactagatctctcccattgcatcaacctggagaggctgccagctgccatatctggaattaacaacatgaagtttgtacatgtcgctggttgcgacagattggataagtccactctacctctgtacaagaatgttgcaaaattgttaccatattttgcggtccatgctggtgatagtgaatctagcagcaacttacgttggcttgaatatgaaaatcccactaaactggagttgagcgggcttgagaatgtgaagtccat

SEQ ID NO: 3425 - DNA, 489 bp, Sorghum bicolor
  unsure (1)..(489): unsure at all n locations
  Clone ID: SORBI-28MAY03-CLUS57359_1
gcacgaggggaaggagggaggcaccattgccgctgtttaatcaggagaggctgtactcagtggctgcgaggcgatttggcaggaaatggagaccggattcgtcagatgatgatgatgagggtacgtctgcgcccaagaggaatctgagatttggaaagtttggggcttcgagcgaagaggattcagaaattgatgagtctggggacacaggtgccattaggagaagatggagcagtgctgcgctcaggaactgtgatatgaagaaggaaaggcgggtgctcaagtattacgaggaggaaagtaatgatctcgcaggtagaatccgagagctgcgagaggagatcagaaatagggaggttttgggtactgaaaggaggcgttacgagtccaggggtgaatctctgcttccagtaaaagatttgatgagtgtggtgtctcccctctgacagtcaaagcacttactgatgctggatatgtacatacnactgt

SEQ ID NO: 3426 - DNA, 669 bp, Sorghum bicolor
  unsure (1)..(669): unsure at all n locations
  Clone ID: SORBI-28MAY03-CLUS5736_1
ggaggaatcccccccccccctcctcacgcacgctcctctactcgccatctttagcctgggccccacctcccgtgccgtggccattaaagcgggaccgaccgggcgctccctgcctcctcgtcgttccgttccgttccgttccaccgaccagatccacccgcccagccatgccggcgccgacgcttccaacgccgccgccttcgccgctgctgccgccggcgggggagccgttccgcgtgttcgtggggtacgacccgcgtgagcacgaggcgtacgaggtgtgccgccgcagcctgctccgccgctcgtcgatcccgctggacgtgcgcccgatccggcaggcggacctccgcgccgcggggctctacacccgggcgcgcggccccaccgagagcaccgagttctccttcacgcgcttcctcaccccgtacctcgcgggctaccgcggctgggcgctcttcgtcgactgcgacttcctctacctcgccgacatccccgagctcctcgccgccgccgtcccgcccgccgacgccgccgaccgcattgccgtcgcctgcgtcaagcacgagtaccagcccgctgaggccaccaagatggacggcgccatcccagacgggtacccgcgcaagaactggtcctncatggtgctctacaactgcgcccacccca

SEQ ID NO: 3427 - DNA, 804 bp, Sorghum bicolor
  Clone ID: SORBI-28MAY03-CLUS57368_1
gcacgagggtttctgcctgtttggctatggacgcgacggggcagcaggagcagcatgcaggagatggaggcggagatcgctacggtgtgcttctctactacaagtacgccgaggtgcccgacgccgccgcgctcgccgcgttctacgaggcgcactgccgcggcctcgcgctcgtcggccgcgtccgggtcggccccgacggcgtcaacgccacgctcggagggcggatgaccacgctggagaagcatatcaaggagatgagctccaacgccttgttcgagggcacggatttcaagctggcgtcctgcgacgaccctgtcgacgagagggtcgccagggagtgcggcttcacctcactctccgtccgggtcgtcaaggagctagttaccctgtgctccaaccccacgtcagcaccgccagaggtttcgagtgctgggaaacacttgtcggcggctgagttccattcggtgctccagaatgttgctgggactagtttggatgctgtggcatctgcagagaagaaggaagtggttgtcttggatgcaaggaatgtatacgagactcggattggcaagttcaatgtgccaaatgcgaagaccttagatccggaaattaggcaatacagtgacctgccttcttggatagacgagcatgctgagcagctgcatgggaaatctattcttatgtactgcacaggaggtatacgctgcgagatggcatcagcttatattcgctcaagaggtgaaggatttgagaacgtttttcagctatatggtggcattcagcggtatctggagcaatttc

SEQ ID NO: 3428 - DNA, 626 bp, Sorghum bicolor
  Clone ID: SORBI-28MAY03-CLUS57378_1
gcacgaggccactgttgagccgccaatgcttgtcatctccactgtcctatctgttatggcctatgactacccgcaggagaagttgaacatctatttgtctgatgatgctggttccatcataacattatatgctctatatgaggcatcagagtttgcaaagcactggcttccattttgcaagagctcccgggtggaacccaggtcgccggccgcttactttggtaaagaagctacccctcccgatgcatgtgaccgtaaagagtggttttccttgaaggagatgtacaaagatttggcagatcgagtgaattcagttgttaattcagggaagatccctgatgtttcaaaatgcaagcttaggggcttctctaagtggagcgagaatacaagttttagagatcacccttcaatagttcagattttaattgatggaaacaaaagaaaagcaactgatgtcgatggaaatgtgttgcccacactggtttatatggctcgtgagaagagacctcaggaacatcatcatttcaaggctggatcactgaatgctttgataagggtatcatcagtgataagcaacagcccagtcattatgaatgtggactgtgatatgtactccaacaattcag

SEQ ID NO: 3429 - DNA, 803 bp, Sorghum bicolor
  Clone ID: SORBI-28MAY03-CLUS57719_1
atctcactagtagtcaaccaagccgattccattcccatccaaccaaccccgcacaccgccgcgggaagcagaagacaccagaagagcctacaaaagctacggggcgcggcagcacaacgcagaatggtgggcggcttcctccgggccttcgccgccgcttccgctgtgcccgcagcagctgccgcagcctacgccctctcttcctcctccgccccctgctcctcgaaactccgcttccctctgcctgcctccttcctctccgccgcctcctcctcctcgtcctccgggcgcgctcccagcgccgtgccccccacggccaccgccgccgcggccgcggccgatctctcggcgcccgataagcagcaggactcggcgcttccggggctcacgacggaattcatggtggacatgaaatgtgagggatgcgtaacagctgtgaaaaacaagctgcaaactcttgaaggaataaaaaacattgaggtggacttgtctaaccaagttgttagggttctgggatctcttccagtgaagacaatgctagacgcccttcatcaaacaggtcgagatgcacgactgattggccaagggaacccaaatgatttcttagtttccgctgctgtagctgagtttaaagggccagttatatttggtgttgttcgtttggcccaagtaaacatggagttggctagagttgaagccacgtttagtggtctatcacctggtaaacatggatggtcaataaatcagtttggagatttgacaagaggtgcagaaagcactggcaatgtatataatccgccaga

SEQ ID NO: 3430 - DNA, 591 bp, Sorghum bicolor
  Clone ID: SORBI-28MAY03-CLUS57733_1
gcacgagggccgtccaatcgtaggcgctagcgtcgtgcagggagggatggcagcgcactattctctctctcggtcccggcgaccggcgtcattcactgcagcggcgccgattccggcaccaccgtccttggtggcgtacgtggcatccggcggccggaaagcttggtgatggcgaccgaccgtacctgtggctctctcatccgaccgcaccgcagggaagaacgaaggttgttggaaccttcattcaccatgggaaggccaaggtaagaagaagattctgtagcacttagctcgatttgggggggtctagtccaacacgaccgagattcctaatcgacggcgtggcctccatttgtgcagcttcaggaggttgagatagcagctaggctgggtctgaataatgattgtatctttagatgtactaccacttttgtagaaccacttcttccacgtatgaaacctacagctttttacaaagggatgaaccgatgctgagccattagcaggtgaggatgcatattgcttgctgctttggtagctgattaaaaatagcaccaagagtttgaatcttgtagacactatataagatag

SEQ ID NO: 3431 - DNA, 611 bp, Sorghum bicolor
  unsure (1)..(611): unsure at all n locations
  Clone ID: SORBI-28MAY03-CLUS57748_1
agattcgtctcgcaaactatagataaactgtgcaattagttatttcttttatctatatttaatactccatgcatctgccgcaagattcaatgtgacggagaatctaaaaaattgtgcaaatttttttgagaactaaacaaagcctaaaaaacaccatctttttattcgcaatttatttatttatttttattcatcacttgttcatgtcaaatttgcaaattgtggaatcaagatttcagacctacatattttttgtttctgtaccacgcagtccactgaggactgactaggacatgttctttaaccaggtgactgagctccttagtgttggatacattaacagttcagtgcaaaacttatattattgcatatatagtttgctaatgttctatttcttttatttctatttttctgcttttacctatagtaatcagtagtttctaaatattgtggactgcagttccgtgttcttatcatcgtagctaataatagggattttggttgtagacattggtgcaatttaatttggttctggttgatgatccgtgttcagatatatgcacacagcaatagacttgaacaagttctcaacttcagtgagcaacanagga

SEQ ID NO: 3432 - DNA, 381 bp, Sorghum bicolor
  Clone ID: SORBI-28MAY03-CLUS57749_1
gcacgaggcctcgtgccgatttgctgagtctagaattcgagctgaaactattgctgctgaggacatattgcatgacatgggagccataagtattatatcgtctgattcacaggccatggggcgcattggagaggtgataacccggacatggcaaactgcaaacaagatgaaggtccaaagaggtagtttacctggatctgctgactctaatgctgcccagaacaatgacaacctccgtataagaagatacatagcaaaatacaccataaatccagcaatagtgaatgggttttcagactttgttggttctgttgaggtgggaaaattagctgaccttgttctttggaaaccttctttctttggcgctaaaccagaactggt

SEQ ID NO: 3433 - DNA, 983 bp, Sorghum bicolor
  Clone ID: SORBI-28MAY03-CLUS57753_1
acactgacgacgcccatgctgctctgctcatcatctcctatttccccgacccgtcgccgcgccactcctccgccttgctcaccaccactgctgctctcccaagcctccagcccaaccaccgccaccgcgtgatggcctcccgcctcctccacctccacctgcgccgcgggcgcgtgcgcgtgcgcggcgggagcccggcgggcagccccgtgcccgcgcccgcgcggcccctctcctcctcgcctcctccaaccgcgtcctcggcctcggcgggcggtggcgggggcatcgagaaggtgctggtggcgaaccggggcgagatcgcgtgccgggtcatgcgcaccgcgcgccgcctcggggtcgccaccgtctccgtgtacagcgacgccgaccgcggcgcgctgcacgtgcgcgccgccgacgaggccgtcaggatcggcccgccccccgcgcgcccgcgcggcctcaacgccggggccatcatcgacgccgcactccgcaccggcgcacaggctatccatccaggatacggttttctctcagagagtgctgattttgcgcagctctgtgagaccgaggggctcaaattcattggaccaccagcatctgcgatcagagatatgggcgataagagtgcatccaagaggatcatgggtgctgctggcgtgccgctggttccaggataccatggggctgaccaagacattgagctgctgaaacttgaagctgataaaattgggtatcctgttttaatcaagcccacccatggtggagggggcaaggggatgagaatagtcgaaaggcctgatgaatttgtggatgctgtactgagcgctcaacgggaagctgcagcatcatttggtgtaaacacactactgattgagaagtacattactcaaccaagacacgtagaagtccaggtatttggcgaccaacatggaaatgcaatatatctctatgagagagactgcagtctacaaaga

SEQ ID NO: 3434 - DNA, 488 bp, Sorghum bicolor
  Clone ID: SORBI-28MAY03-CLUS57768_1
gcacgagggaaacattgaaagataatgatgtccttgttcagtacaagatcatgagggaaacactaatatacttgtcacatcttgatcacgaagatacagaacagcagatgttgaggaaattaagcaagcaattaaatggtgaagactggagctggaataacttaaatactctatgctgggcaattggatccatttctggttctatggtggaggaacaggaaaacaggtttttagttttggttattcgtgatttgttgaatctttgtgagattatgaaagggaaagataacaaagctgtaatagcaagtaatattatgtatgttgtggggcaatacccaaggtttctaagggcgcactggaagtttttaaaaacagtggtcaacaaattatttgagttcatgcacgagacgcatcctggagttcaggatatggcatgtgacacattcctgaaaattgttcagaagtgcaagcgcaagtttgtgacactc

SEQ ID NO: 3435 - DNA, 499 bp, Sorghum bicolor
  unsure (1)..(499): unsure at all n locations
  Clone ID: SORBI-28MAY03-CLUS5748_1
cgaccggctcgcgacgccgtgtcatgagggtcatgcacacagtgacggaaagagagagtgcaattctgatgaagagaactcggaaggagaaagaaagcccaaaaagggctctctcaagaagagagcagctactgcagggtataagtttaggcattccttaaggagaaagagtaaaaccaaggatgataaccatgtagcctcaatagaagacatcagagatgttcaagagctggagactgttgaaaggttccgccagtgtttacttgacgagggcctgttgccagaacatcacgatgattatcacacgatgttgaggttcctgaaagcaaggaaatttaatattgacaaagcaaagcatatgtggtcagagatgcttagatggatgaaggaatttggtgctgacaatatagatgaatttgactacaccgaattagatgaagttgtgaagtactatccgcagttntatcatgggtggcaaagagggaaggctgttacatag

SEQ ID NO: 3436 - DNA, 568 bp, Sorghum bicolor
  Clone ID: SORBI-28MAY03-CLUS57486_1
gcacgaggccttgccttaatcatgatcaatcagttttagtggaaagcctagatgtacctgattgggcgacttgtttccctggttattttgaagactgtgggccagttgctacatataaccatgttgatgacattggttcacctgttcatgagtacctccctagaaagggtgtgccaattggacctgagcaccaggctgacattccagaatggaggccccggatctctatgattgtacctggcacttctgagttttgtgctgatctggattgtagttctgcttccacttcagagtctgttaccagaggtgatgactatgtaagtgaaagtgacaagtggatcaggtgctgtgttgttccgatgatgagctgctcatctcttgttgactgggctggagacaacaaaatagattgtaactgcagtgacgagggttctacgaggtgttccagacagcatattattgaagcaagggatagcctcaaaatgagcttgggacaggacacgtttcgtgagttaggtctttgtgaaatgggagaggatgttgctcaaagatggactgatgatgagga

SEQ ID NO: 3437 - DNA, 473 bp, Sorghum bicolor
  unsure (1)..(473): unsure at all n locations
  Clone ID: SORBI-28MAY03-CLUS5753_1
cgaatgcttactctntggtttgaatttggaagcatatatgtccgaaatgaatcttcctccaatcaacgaatgaaagagattaatgcaaatgcctcatacgtgggtgtttgaaggatctaccaacatatcagtggcttactgtgctgtctcagttgatctcccgcatctgtcaccaaaatgctgatgttgtcaaaatggtcaaatgcatcatcacatcgattttacgggaataccctcaacaagctctttggatgatggctgcagtgtctaattccactgttctggcaagacgagatgctgctgcagaaatattgcagtcagcaaagaaaggatgtcggcgtgcgagtaatgcactcttcagtcaatttactaatcttataggccatcttattaggctctgctctcatccagggcaaccaagggcaaaaacaataaacatcttaaactgaggtcagtgccttgaaaagaatgat

SEQ ID NO: 3438 - DNA, 608 bp, Sorghum bicolor
  Clone ID: SORBI-28MAY03-CLUS57619_1
gcacgaggggagtaggaggcggcattctgtgggtagcctccgccctctctgtgccgccccggcgctcgcgccgctcccgggcccgagcctcatctcgccgccgccgtcctcctccctccatcccctcctctagcaccgccctggagttgcgcggctcgccgctggcggtcgcctttgtgggccttcctctagcgccgcctcctctcaccggcccgtggggccttggtgatggtggttttggaactgtttacagagggaaactccgggatgggagagtagttgcagttaagcgcctgtacaagaacaactacgaacgggttgaacaattcataaatgaggtagacattttgtcccgcctccaccaccagaacctagtcatcctatatggctgcacatctcgtagcagtcgtgaccttatgctcgtgtatgagttcatccctaatgggacggttgcagaccatcttcatggatcccgtgcatcagaacgtggtcttacatggactctaaggatgaacattgccatagaaacagctgaagcactcgcatacctccatgcagtccgaatcatacaccgtgatgttaagaccaacaacatactgctggacaac

SEQ ID NO: 3439 - DNA, 499 bp, Sorghum bicolor
  Clone ID: SORBI-28MAY03-CLUS5751_1
cggacgcgtgggcgccgcacaggcaggcagacggacaggaccgccgccgcagttttcaaatcccggggcggatttccttccctgcacctgcagagagagagagagagagacggtgcccagcaatagcaccaccgggatctcgccttctcgtcgtccgtccacctgtggcgccggtgaccgaagggtgagggcgctagctagagcctagaggctagagccatgtggaacagcatctaccggttcctgtgcggcctgtgcgcgccgtcgtcgtcggagcacgggctccacggcgcgcacccgccgtcgccgtcctcggccgcgacatcctcagctttcagagcacctctcaggttccggacgagctgagccggcacgtcgtctccttcaagaaagcgcaggcgaattggtacaagaagctgctggtggcatggaagaaagcccggccgcctccgaagacgcccgaggaagctgcggccttcgttgtgcagacgctcaagaa

SEQ ID NO: 3440 - DNA, 616 bp, Sorghum bicolor
  unsure (1)..(616): unsure at all n locations
  Clone ID: SORBI-28MAY03-CLUS57837_1
gcacgagggtatgataaggaatcaggattgtggggaaaggtgaaaaaccagaccgcgtggttagcactaacctcaactttaacggaaagcttcagcctgatgctagtaacggcaacgctcaggttttcattaacggacgggaaattacaaagattgaactgagaattctaaagattgcaaaagtccaatgcccccgtgatactcacttttgggtttaccatgatggcggctatgaggaagaaggacagaacaatatcaaagggaaaatatgggagtcacctttgacacgttttgcgtgcgccttggtttcactaccagtgcctcctacacactttgatgcgacaaaagatgacgtcccttattcatcaagaactgtacctgactacttagatcataaaagaatacaaaagcttcttattcttggatcacctggagctggaacaagcaccatatttaagcaggctaagttgttatacggcaatagatttactgaggaggaacttgagaatatcaaattaatgatccagagcaacatgttcaagtacctgnggattctgctcgagggccgtgagcgctttgaagaagaggctttggctgtatcagatcacccaggctc

SEQ ID NO: 3441 - DNA, 965 bp, Sorghum bicolor
  Clone ID: SORBI-28MAY03-CLUS57842_1
gcacgaggcgaagagtccactcatggagaccgccgtcttctccgccgcctccctcttccacggcgccgacgacagcgacgacgaccgagacgagatgcaggtcagcgacgaggggaagaagccggcgaagttggagtatgaggagagagcccacgacttccctggcatgtgggacaggagctctggctatctttcttaggaaggcatttgaggtggacattacaacctctgattatgatgacaaggaaatcgaagagaacatagcttacaattgcagagcgaataccttggatgtcttacctcatatcagacacacatggggacacccatttccagtttccagaccagattgggacattgtcattgcaagcgatatcctactttatgttaagcagtatgacaatctgatcaaaacagtgtcctttcttttgaatgaatacaagcagaatggtcacaaatctgacagcataaccatcacgaacaaatcaggaacgccagtacctgcaaaatcaccagtgtttctgatgagctggcgcagaagaatcggaaaggaccaatcacttttcttcgatgggtgcgagaaagcgggcctggaagtgcagcacttgggtgatcttgtgtacctcatcagcaaaaagaggtgaaaattgaggaaatgatatccttgaaaaaaaattgaggaaacgacactcatcgttaaatttctcacgaacggcacaggggaatatacctgggtggtcagtgttagggacgaaaacgtggattttgaataggttttgttagtgatattttaatcaactttccagtaaacactggtttgtttgaggaaacaaaggtactggaaggacccattttcttttggaaaattggatgcaccctctttcttcgattctaggtgggatatactgtcgttacttacaattgtaataatactctacagagcaagaagctgttattagagaggc

SEQ ID NO: 3442 - DNA, 532 bp, Sorghum bicolor
  unsure (1)..(532): unsure at all n locations
  Clone ID: SORBI-28MAY03-CLUS57846_1
gcacgagggaggaggaggaagaagaagaggagaaggaagaagaggctccgggggaggtggaaactgcggatgggatagaggcggagttggtggagccattgccggtgctgaagcccggggaggaggacgaaccggaagagctagagggggagaaggaagagttgaatgaggaatcagaggagaccgagccagaggagcccgaggaagagttggacgaaccagaagagcccgaggaagagttggacgaaccggaagagcccgaggaggcggaagagtgtaaggatggcaacggtgttgcggaggtcgatgggtcagtggcgaacgaaacaaatgaaatgtctaaactggaatatggtaaatctggcaacacaaataaggatgaagatgctgatcaattgagcagtgggagtgatagtggtaatgatatgcagaactctgaacttgctggaggccttgaaatatttgttgacaacttgcctcatgactgtgttaaggaagacattgctatggccttttctcaatcaggngaggt

SEQ ID NO: 3443 - DNA, 595 bp, Sorghum bicolor
  Clone ID: SORBI-28MAY03-CLUS57847_1
gacgaggaactggatccagctcgaaccagcgatagagcggacgactccgagcgatatcaatggctgctggacaggttcagccacaatcctcaagagtgaccagcctgccattatatacactggtgctgacacggagaagcgtcaggtccaaaacattgcgtttcccaagaacttgtctgatccatacctgagggagtggatcaaaccagacaacaacccactgatccaaccagttggacaaggattgatcccaaatcagttcagagatccgacaaccggttggatcggaccagatgggctatggagaatagcagttggggctgaactggacggctacagtgctgcacttctgtacaagagtgaggattttttgcactggactagagtggatcacccactatactcttccaatgcctccaccatgtgggagtgcccggatttcttcgcagtgttaccaggcaagaacattgggctggacctgtcggcggcaatcccgaatggcgccaagcatgtcctcaagatgagccttgacaattgtgacaagtacatgattggcatttatgatctgaaaagtgatgtctttgtgccagattcc

SEQ ID NO: 3444 - DNA, 626 bp, Sorghum bicolor
  Clone ID: SORBI-28MAY03-CLUS57854_1
agcacgagggtcagcgctgcgcgcgagggtaacacatcagatgtgaaagaactaattcctgagttctattatttgcctgaatttttggagaacagttttaatctggacctgggcgagaaacaatcaggagagaaggttggtgatgttgttttgccaccttgggctaaaggcagtgctagagaattcattaggaagcatcgggaagcattggaatcagattacgtgtctgagaatctgcatcattggattgatcttatttttggatataagcagagaggaaaggcagctgaagatgctgtcaatgtcttctatcactacacatacgaaggcaatgttgacatagacgcagtatcagatcctaccatgaaggcttcaatactagcacaaatcaaccattttggtcagaccccaaaacagttattccagaaaccacatccacagaggcggactgacaggaaagtacctcctcatcctctacggtacagcgcctatctaacacagcaggagattcgcaagacagcatcttcggtgtcccaggttgtctcctacaatgataaaatcctaattgcttcagttaactgcttgctcaagccgctaacttataatgaatacatttcctggggatt

SEQ ID NO: 3445 - DNA, 734 bp, Sorghum bicolor
  Clone ID: SORBI-28MAY03-CLUS57713_1
gcacgaggcttgttcgtcgggttgagcctactgctccagcaagcagtgttttgcgaaagggagatgtaattgttagctttgatggtacctcagtaggatgtgaagcaacagtaccgtttcggtccacagaacggattgctttccgctatctcacaagccaaaagtgcgcgggggatattgctcagctaggaatcattcgtgatggcaattccatgaaagtccaaactattttgcagccaagaaaacatttggttccgtttcatgtcgagggtggccaaccttcttatctgatagttgccggccttgtctttacacctttaacagaaccatttatagaggaggagtgtgaagatacattaggggtaatttcaccattaccatgctaatcttgcttgcagcttacttttgtcctgaggcatgcattttcttattgttagtgttgtcatcttatcttcatatacagttgaaattgttagcaaaagcacgttactctctagcaacatttgagggtgagcaaattgttattgtctcacaggtatgctttattttgtggctagttcagtcaactatttttatagtttgctatgctattatgctcttgattaactactgccatctaggttttggcgcacgaggtcaacatcggatatgagcacatgggcaatcaacaagtcatgagactaaatggaaccacaataaagaatatccatcaccttgctcatcttgtggacact

SEQ ID NO: 3446 - DNA, 563 bp, Sorghum bicolor
  Clone ID: SORBI-28MAY03-CLUS57716_1
gcacgaggctctatatgaaccatctgcacctcaggaaaatccgttacaacttataaagcaaatgcctgttaaggctgcggctgttgcaacagctgcagtggtttcatcttcaatggtcattgctgccgcgaaatctaacggcgacattaaactagatgtgccagttgcagcagctgccactgctgctgcagttgttgctacgacaggtgctgttaacaagcaatatgaatacttggatcctggttgtcaattgctttgcttgccaagttcatcaaataaattaatccaaaaaggtaggcatgacttgttggatgatgatcagctggaaacaaatcatggacaggataattcccttgagcatgaaaaggattcagttcaagcacctcaggaagctgagcgaatctctgataggtcaactgggacagagagcgccagatctgaaattgctcttgatgaaattgccgagtttgaaatccagtgggaagaacttacccttggagaacgagttgggctgggatcttttggagaggtatatagaggtgaatggcatgaaacagaagttg

SEQ ID NO: 3447 - DNA, 599 bp, Sorghum bicolor
  unsure (1)..(599): unsure at all n locations
  Clone ID: SORBI-28MAY03-CLUS5773_1
gcacgaggcttcgattcgtccagtttcccactcctctcaagctgcagagcgcagatccgggcttttcactttcatatccatggaattctccttttatattatttagttaacttgttgcagatctgtgaaattaagaagctagttcaaaagggaagattgttgattgtctattggttttctcttttaatgtgtaggcatttgtggtttcatgtaagtggagcagcggaggtcaattaatctgcaaggaattttgaactgctcttatattgtagtgtaaattttactgtattctgaattttgtcttgcttcgtgtttcatagggtctaaaactggaagcttgaacaagctttcctcccatattttttttgttaattgcagtttggtcatctggtgactatcttaaagaaatgaatgggcaaccgatctatgcaagagatatctgaatgtactatacactaatttttgccgctgaagcttaccctctcattcttaaagaaattgcagtttgctttgcttgatctaacagtggagctgtaatgactcgtatttaaaatttaatagaagaagagcactagagcctaggcanatcaagatttttt

SEQ ID NO: 3448 - DNA, 761 bp, Sorghum bicolor
  Clone ID: SORBI-28MAY03-CLUS57392_1
agaagaagcaggcttccgttcggttccgctgctgcttccccacccgaatccaagccgccacgcccccaccccgaccccccacgcccacgcccacccgaaccccaactcgcgaagctggcgcgcgaggcggccgacgcgagcgcccggaagcgcaaggcggcggacggcggcgaggtccccgacggcaccaccgctgcagaggttgcggcggcgccggcccccggggaggacgcggccatgggcgacgtgccccaggcgccgcacgccgcggaaggaggaggaggaggactggaggagggggcggtgcccgaccctaaccctgccccgggcctgagcctcggcggctgctcggaccccgtgtcgctggagctctccatgggcggggactactaccgcgcctgctgcggcgaccccgaccccgacatccccgaggggcccaagctgccgtgcgttggggaaaaggaacctctctcctctttagcagccgagtttcagtctggcagccccattttacaagagaaaattaagttgcttggcgaacaatatggtgctttaagacggacacgtggagatggaaactgcttttatcgaagctttatgttctcctacttggaacacatcctagagacacaagacaaagctgaggctgatcgcatcatggtaaaaattgaggattgcaagaagacgctcctgtctcttggatatattgagttcacttttgaggatttctttgcgatattcattgatatgctggaaagtgt

SEQ ID NO: 3449 - DNA, 473 bp, Sorghum bicolor
  Clone ID: SORBI-28MAY03-CLUS57902_1
gcacgagggcaacatcaaccccggattgttcgtgagaagcgctttactgaggtcattcacaataccgtttcacaggggggtcgtgttcttatcccggcatttgcacttggcagagcacaagaactgttacttatccttgatgagtattggtccaaacacccagagctccataagattcctatctattacgcttcccctcttgccaagaggtgcatggctgtctaccagacatacataaactccatgaatgaaaggatacggaaccagtttgcacaatccaatcccttccatttcaagcatatcgagtccttgaatagcattgataactttcatgatgtgggtccttcagtggtgatggctagtccaggtggtcttcagagtggtctctctaggcagcttttcgataagtggtgcacagataagaagaatgcttgtgttattccaggttatgttgtggaggcgacccttgcgaa

SEQ ID NO: 3450 - DNA, 576 bp, Sorghum bicolor
  Clone ID: SORBI-28MAY03-CLUS57924_1
gcacgaggcaccggttctaccagcgatcaccctcctccgtctcccaccttgtctccaacttccggaagaggctctgtgataatgatcccggggtgatgggtgcaactctatgccccctctatgacctgattttggaggaaccaaattcgtacaaggatttagttgttagttttgttaacatcctaaaacaagttgcggagaggcgcctgccgacttcctatgattatcaccaaatgcccgcaccgtttattcagataaaactattgaagatacttgctgtgcttggtagtggtgataaacaagcaagtgggcatatgtacaccgtattgggtgacatattcaggaagggtgacactgcgagcaacattggcaatgctatactgtgtgaatgcatatgctgtatttcatccattttcccaaaccctaagatgctagaggctgcagcagaaacaacatcaaagtttctgaagagtgatagtcataatcttaagtacatgggcattgatgctcttggccggctaataaaaataaatccagatattgcagaagagcaccagctggctgtcattgattgct

SEQ ID NO: 3451 - DNA, 644 bp, Sorghum bicolor
  Clone ID: SORBI-28MAY03-CLUS57932_1
gcacgagggttgaacagccttccccaaggttgctgaagcacataatccgctgctacctcaggctgacagatgaccgaagggcttgcaatgcgctacgcagtagcctgcccaccgcgttgagagatgggacattcaacgacttaatcgaggtcgatctcacggcaaggctatggcttcatcagctgctgcataacatcatgatgatgtcaaacggtgggggcggccctcaccctgtcctgggtcgtgccatggggatgtgaatatcatctgtcaagacccaagagcgtgccttgtagttgtaggtagtaagtgaccataggggaagcgatcccttttggaagggaacacttttgtgccgtttggatagcaaagagaatccctttgtaacaatggagcctagttggtgtttagcgctgtacaaagcccagtttaatttagcgtctcgaagatggaaaagggccaaacttggccggcttgcagttgcaggcatctcttatgaagtgttgcatcttcttgtcttgtgagaagtctaggtatcggtcgttagaaatttgaaacaacaatacaggtaagtttgcgttgtgaagactgcatgtttatgacaggattcaatcagagtcaggataagccgctggcttgatgcc

SEQ ID NO: 3452 - DNA, 622 bp, Sorghum bicolor
  Clone ID: SORBI-28MAY03-CLUS5794_1
gcacgaggtagaaatctaaattcaaacaacaacattatatttcttagatgttagttctgtatcctgcttcaagtctactgtctgcgtgagttcccatttttgggtggtgtaggtctagtgtgttagtatcttttactcgtatcaggagttcacatatttagtatcagatagtttttttaaaagtttttcttgagccatctattaattgccaacattcattttatactaccacttttgcagatataaaaaaaattgtaggttgcagatgtgcttattttgttcaatatgaatgctatttttgtattgcagaactgtttattttagatctaatgaatttatttatcaattatcctgcgtggtattttcaattattattggtgacataggtctatcagtattgttatcttcaaaatgatatttctttgaggtaatatgcatatttaagatctatatatctttatgaaattgttatactgcacaaatgttcagatttgtagctgatttaaagtggcactttttaacagtacattagctcctctaagttgtagtgtagacctgctgcatttgttgcaaccagattatactgctgcataagcctgtttttttattgaaaatagttatt

SEQ ID NO: 3453 - DNA, 524 bp, Sorghum bicolor
  Clone ID: SORBI-28MAY03-CLUS57956_1
gcacgaggtagttgtctagcggctgttgaaggttttaaatcttctgctgatatgctggtgacgtacatgaaggagtacccaatgtgtcctcagattctgcttatctcagctcggttagacagaaagcatggtacatgtcctggtctgaaaagctttgatgagttgatcttgaattggcctaaagaggcacaaggaattcaatatatgtggaatcaatatgttgagcatgttctggccactgataccgagttagctgagaaggtactgacttgctggtttgatgaacacggaaaagattgtgatatccaaaccaattctgctatttgtatagaactgagcagcgaagagcctggaacatcatcacttgtttctccccaggaagttggctctggtccatctacatcagaagatctcatctttcggttattaaacctctcattgtacaagatactagagaacaacctacaggaagcacaaattgctgtggataaagcattgaaattggctcatggggagtggtacga

SEQ ID NO: 3454 - DNA, 505 bp, Sorghum bicolor
  Clone ID: SORBI-28MAY03-CLUS57774_1
gcacgagggtagtttctagcattgggagtgcctatacggcaactacgttagtaaactgcaactacatagctcaagcatgcggggggatacatacggcaatttcctgcagtaagtgtgcgttgtcttgtcgaaaacaattactatttcactttaattattaattaaccatactgtgcaacgtaattaagcgccacaggccgtacacaacccacagccacaggcaacaggtggtacccgggccacgccaatgcggcggcctgcgacgtcgcgctctctgctatggtctatgggcttctggcctgcgacggcgctctctgctatggcctctgggccactccaaccgcaggcataatagcgcgtgtagggccgcgccggaccctagagctcaagccggcccgggatgcctcaaaatgggggtggttcaaccttggattgaaccgtaaccgatccattgattcatttgttgtcaaatggagcaccgaccaaaccgtttaagtaaattttc

SEQ ID NO: 3455 - DNA, 537 bp, Sorghum bicolor
  Clone ID: SORBI-28MAY03-CLUS5779_1
gcacaaccgagcccagccgggagctgcccttcatctctctgcacctccgccctcctgtgctccagcttcttctcacccgtggtggctggcggccggcgggctcctctcgactcccgtcctccgcgactgcctgactaggaaccgggaagcgggagagtggcgcgcggcgcgctagcagatctgccgccgccgttcgctcccccctgctctgccttgaccgccggctgggcactgcctactccacactggcagtgccacgtcgaccccaggctccggcggcaccgcgtcaccgccccctgcaccagagcacagctcacgcctcacgataagcaagacaatgcagctctgttcgggacgctgcttagtgtacctaccgtcggcgcagcaaggaggtcgccatctctgcgagccccagcacagctgtgggcaggatcagcagactccctgttgacctgcttcacgagattctcacccgtctcaggtctcccgatgaagctgcatgcgctgggacagtctgccacagctgctgggcttcac

SEQ ID NO: 3456 - DNA, 573 bp, Sorghum bicolor
  Clone ID: SORBI-28MAY03-CLUS57798_1
gcacgaggtcggagtccgccgccatgttggcgcgcaagccgccgcagaagatgacgacggcgcggaggagccgcgccgccgaagtgcacaacctctcggagaggaggagaccgcgcgggataaacgagaagatgagagccctgcaagagctcatacctcactgcaacaagacggacaaggcgtcaatgcttgacgaggcgatcgagtacctcaagtcgctgcagctgcaagtgcagatgatgtggatgggcagcggcatcgcggcgccgccggcggtgatgttcccgggcgtgcaccagtacctgtcgcggatgggcgtcgggatgggcccggcggcggcgatgccgtccatgccgcggctgccgttcatggccgccccgcagccggtggtgccgcccaacgcgcaggtgaacccggtgccgggctaccgaggccaccaccacatgccggcggcggtgggcatggcggagccgtacgggcactacctcggcgtcaaccacctgcagccgccgccgtcgcagcactacgcgcagggcgtgggctactacccgccgccgctgggggcgaaggccg

SEQ ID NO: 3457 - DNA, 492 bp, Sorghum bicolor
  Clone ID: SORBI-28MAY03-CLUS57816_1
gcacgaggcgaggatgctctaattttgtagtcatttggctcggggctacctccactatcttctgtctctccatatacaaaaccacaataagcaacaataatcttagtcgggaccttgaggcaacatcagcaaatggctggaggagatgagctgaagctgctaggcttttgggggagcccgttcgttctgcgagcgaggcttgccctgagctttaagggtctgagctacgagtatgtcgaggaggatctcaagaacaagagccagcttcttctccagtccaacccggtgcacaagaaggttcccgtgctcatccacaacggcaagcccgtctgcgagaccaagatcatcatgcagtacctagacgaggtttatggtccctctctcctacctgctgacccatacgaccgggccatggctcgtttctgggctgcttacattgatgacaagctgttgggctcgttgatgatgatgagcatgggcaagacagacgag

SEQ ID NO: 3458 - DNA, 747 bp, Sorghum bicolor
  Clone ID: SORBI-28MAY03-CLUS57817_1
gcacgaggagggttgtggtgctagtcgcgggctcccccgtcgactccgcctccgattccctccctcctcccgttgcggcggcggaggccaagcaggagcctgcgacggggccagaggagtctaagcaggaggaggcggcggcggcagcaggagcagcaggtgtgcaggctatggcggtcaccgtagtgcgggacgtcgagacgggcctggacgcgagcaccagcgaccgggacggtgacggagccggggacaagccttcctggttcacacccaagagattacctcgtgggttctgcattatcaacatgctgaactatgttgatcgaggagcaatagcaagtaatggggtcaatggtacccgcaaaagttgttctggtggcacatgcacctcaggctcaggaattcaaggggacttcgatctcaataatcttgaagatggttcgttgtcctcagcatttatggttggactgttgttgtcttcgctgatatttgcatcccttgtaaaaagatataatcctttcaggcttattggtgttggcttgttagtgtggactatcgcaacagctggttgtggggtatcatttgatttctggtcaattactatatgccgcatgtttgtgggtgttggtgaagcttcatttataagtctcgctgctccgttcattgatgacaacgcaccaatagctcagaaaacagcatggcttggtatgctctacatgtgtataccaactgggatagcattacgct

SEQ ID NO: 3459 - DNA, 528 bp, Sorghum bicolor
  Clone ID: SORBI-28MAY03-CLUS58080_1
gcacgagggcgaaacagaggagaggacggcgcgcgagaggggggaaaggaaaacaaccgcgccccccccccctccgctccacttccacccgagctcaccaccgatcgcggcggcgacgatggggaaggggccgtcgtcgcgggcagggtcgcggcaccaccagttccgcgcccgcgccatgacccgcgtcgacgacctccaggaggtcttctcgggcctgcagtccgcgcgcaaggactcgcgccccgccgacgccgccgtcctcgaggcgcagctccagcagatgctgcgcgagtggcgctccgagctcagcgctccctccccggcctcctccctccagggcaacgccagggaactgtcggatccgccttcggatactcttcgtctgctgcagttggcggcggcggaggaggaggacgacgccacgagcaagatggtcgagcagcagcagcagcagcagcagcccccgcctccgcctccgcctccgcctccgccctcagctgaccagaaccaggggcacgcgcaggt

SEQ ID NO: 3460 - DNA, 643 bp, Sorghum bicolor
  Clone ID: SORBI-28MAY03-CLUS58131_1
gcacgagggcctctagcgctaggctacctagcttcccgtctcttccccatcagatcaatcgtcctcgccggctatctcaacttcgtcttgcttcttcctgtgctcctttttgttcctggacggctaataactagatctgagaggcagaaaaaagagggatggggagggggaagatagtgataaggaggatcgacaactcgacgagcaggcaggtgaccttctctaagagacggaacgggctgctgaagaaggcaaaggagctctcaatcctctgcgatgcggaggttggcctcatcatcttctccagcaccggaaggctctacgagttctccagcaccaacatgaaagctgtgatagaccgatacggaaaggcaaaagaggagcagattggcaccaacaatgcaacttcagaactcatgctctggcaaagggaggcagcaagcttgaggcaacaactgcacaacttgcaagagagccacaagcatcgtctgcgagtggttctgaaaaaaaaaggatcactcatcaataggaagtttcaatgacacatgaaaaacttcatagaacataaaaaagtgaaacgtttcaaccaaggattaagtaaatatatagttattgaagacattaacaacattcattatttcag

SEQ ID NO: 3461 - DNA, 589 bp, Sorghum bicolor
  Clone ID: SORBI-28MAY03-CLUS58133_1
gcacgagggcgccggcgccccccgccctgcccgccctccgccaccgccccttcccgcccctcccccccctcggcggcccgggcgcgcctccctcgtcccggcccggtccggcgccgggccccgcggcggggtggcacggccggggcggaggggagccgtgccggcggcggccgccccagtcccccccgcggcccctgctcccgtccccgcctgcccgtgccctctccgccgcgtcggcggcggccagcgccgggcgccctgtgccgtggggcgggggccgggccctggttcaggtttctgcgccggtccccgtcgcggtgccggcgccagttcctgcgcctccgcctcctccgcggccggttcggcatggtcggcgtccgcctcgcgccagtgttccttgatgtccggcttctgggccagttgtccaggtgcttgcccctcctaagggtggggtcggtcgctcggcctcggccacctcctcaagccttcctccaggtggggcgcccacgtgggccctctggacccatattgcctccttttgggccggtgggccgggtgctccaccctccctccggcgggttcgttctca

SEQ ID NO: 3462 - DNA, 845 bp, Sorghum bicolor
  Clone ID: SORBI-28MAY03-CLUS58152_1
gcacgaggcggcagcggccatggcgatagcgacctccgtgaaggcggccctcttttcccgtctcttaacttcccctctctccttccgacctcttaagaagcccgacctctgcagaagcgaacagggcgacgacacaggcagcacccgccggcgcgggcggagcccgacaacaccctccattcccccctcaacgcgcgagcgggcccctgcgccacgggtgccgcggccggcgcgcgagctcctaccgtggccaggcgccttgcgcggcggcgtggcgcccaggcaaggccagaccctagcgtggtggtgcggcggagtggcacccacgcgaggcctcccccacacgcggctgcaacccggcgcagcggccacagccgcggccacgcccccacggctccttgtgtgcttgcttctatttccttgaagtttttcatttggtgttagttttactctcaccaacagatcggttctacctcaagcaaaccactaatatggcagatacttcacattaattttgcgttgtttacaattctgctatttatttgctcgtgtgcctactaattaaaattatttttaccattttacaggaagtcaggaactcaacacactatagtaaagatgggcagtaatcatgaattgaacaaagaacttatactctgcagttattaaactggtatatcatatctccctttgctttcttaatttattgtttgtgttgttttgcccctatcatttccaagccaaactaattttggtatttgaataattcatgatgtttagagctgcactatttacttgcttgtgtgctagcgaatagaatttatttttcagcatttcacaagagc

SEQ ID NO: 3463 - DNA, 666 bp, Sorghum bicolor
  Clone ID: SORBI-28MAY03-CLUS58153_1
gcacgagggctgctcgcaagagttcttggctatctgaagaagagttccgcgtgggacacattgatctgaagccagcaacagcaagatctgtgcttggaaaccagtcagcagatccgtcgatgccaaaagatcaaaatgcccgtgcaaagtctatagagaataggcatgaaaggtcagagggtgctatgaagcctgacgttcagcaaaagaagagctctgtggctgcaaatggatctgatattcaaatatcatcttcctccatacaagggaaatcttcagtggttgtacgtgcagtcgatgaacctccaaaacctgtgtctgatgagggggttaaagtttccacaaaacctacttcagaatctgagacaagagcaacacaaaagcgtgcacacaatgctgggaaggtaatgaagaatgatgttgcaaaggaagatgcaaaagctgggaaatctactagctggaatgtaaatcaacaagtatcaactgttgatagagaagcaatgcctcatggagctgatgctgcccaagagaccaataccactattagcaatggtaacttgcatccagtgcagcggaaggtttcgtcatcttctcaaagaaatgcagtgttggttacacataatggagcagctaatccctctggtgagtctattgatctgattgact

SEQ ID NO: 3464 - DNA, 658 bp, Sorghum bicolor
  Clone ID: SORBI-28MAY03-CLUS58172_1
acgggttcctcctcttcttcttccctctcccgctgcttggaaaaggaaaaaaaagagagacagaaaactcgcgcactcgcgcgctccgttcggtcaccgaaagggaggagcgcgggcgaggtgtcgcccacacggagctccggggttcggtgtttgtaggatcgcctaggtgaggctcctgctgcttggagacagccatggccaccggcgtggctccagctcctctcccacatgtcagagtgcgcgatggtggcgtcgggttcaccaggagcgttgacttcgcgaaggtcttgtctactcccagcgctggcactatgaggacaagctcctccagaggcagggcactcgtggcgaagagctcaagtactggttcggagaccgtggagctcgagccatcttcagaaggaagcccacttttagtacccaggcaaaagtactgtgaatcaatacaccagacaaggaggaggaaaactcgaactgtgatggtggggaatgtgccacttggcagtgatcatcccataaggattcaaaccatgacgacttcagataccaaggatgttgcaaaaacagtagaggaggtgatgaggatagcagataaaggagctgatattgttagaataaccgttcagggtaggaaggaagctgatgcctgctttga

SEQ ID NO: 3465 - DNA, 771 bp, Sorghum bicolor
  unsure (1)..(771): unsure at all n locations
  Clone ID: SORBI-28MAY03-CLUS5787_1
gcggaggaagcccgcaggaagccacgcgcacaccgcaaccgcaaccgcaaccggaacaggtcgacgacgactttcttcgcgtctctcacctcccgcctcgcctcgcctcgcctccgatccgtccgagatagtataaagaaggcacaaaggcgacgagggagggggagagtaggctcgccgcgagatctgtgagagctccccacccattcttcccaagatgcacgacttctgctncaccatcccctacgggttcgccgtgctggccggcggcgtgatgggctacctccgccgcggcagcaccgcctccctcgcggggggagccggcgccggcgccatcctcctcctcgcgggcttcgtcagtctcaaggccttcgagaagcgccgcaactcctacgtcgccctcgcgctccagacgctttgtgcattagccttaacttacgttatggggcaaagataccttgagacctcgaagattatgccagctggtgttgttgctggtctcagtgccgtgatgtcagtgttttatctgttcaaaattgcaacgcggcggcaaccacatccctccaaagaaagagtaaaccaggctttaacttgtagtctatgttcgattgaacttgaagactacgagcgattgtgtttgtctagttgcatggtaacttcagggactagcatcttgttctccttttgtaatgtggctagaatgtaccatggtttgtgaacaatgtacaanaaataaatatgcgattcacggaaatgaatgtgatgttactg

SEQ ID NO: 3466 - DNA, 597 bp, Sorghum bicolor
  Clone ID: SORBI-28MAY03-CLUS57874_1
gcacgaggcattctggcagacatcatcctatttccacagtttttttctgggatctgtagtagatgtttgctaagctaaaggtccttaccctgaaaattcacaagatctggattgccttgtattttgaatccaagtgtgttaatattttgggcaactttgccaaggttaccaatatttcctttggtttccttttttttcccagttgcctatatcatccattgcttgattgccgcactcaacacaccttcttgggtttattgtaggcattctggcagacatcatcctatttccacagttttttttctgggatctgtagtagatgtttgctgagctaaaggtccttaccctgaaaattcacaagatcaggatcgcctcgtttttcgactccttgcgcggttttttttcgggcatctgtgccaggggttcccatttgccctgcggtttccctcttgttcccggtcgcctctttcatcctgcgcttgcctcccggacccttcgcaccgtcttgggtccactggaggcagtctccctggctccgtcctattgtgataaaagtattgtcattgttggaattgaatttcttggtccctagaagcc

SEQ ID NO: 3467 - DNA, 625 bp, Sorghum bicolor
  Clone ID: SORBI-28MAY03-CLUS57875_1
gcacgaggcttgtgccaaggaggacatgcgctataaaccttcaggagcacgcggattcatttcaacttgtttgaacatgttcgtggagccggtgttgaactattggccacttaacaagctaagagagagagctttgaaccacatcctagaacatatccactatgaagatgaaacaactcaatatattggcttatgtccagttacgaaggcactaaacatgatttgttgttgggtcgaaaacccaaattcagatgcgctcaagcgacatattccaaggatatatgattatttatggattgctgaagatggaatgaaaaccaaaatatacaatggcacccataactgggagttagcacttataatccaggccttgttatctgcagacgctgctaatgaatatggtcgaaccattgagagggctatgggatacataaagagagcacaagttactacaaaccctccggggaacccaagtgattggttccggcatagatcaaaaggatcatggccactttcgactgtggacaatggctgggcttcatcagacactagtgccgaagcaactaaggcaatgttgttgctctccagggtatatcccaagcttgttgaaaattcagacggagat

SEQ ID NO: 3468 - DNA, 582 bp, Sorghum bicolor
  Clone ID: SORBI-28MAY03-CLUS57884_1
ctcttctcccccgcacgtttctcagatctgcgccggcgtagcccccgcaacaccgcccctgcggcggctcgcccgccccgcgccatccctgcgccggcacctcgcccctctccagcgcagcgccgccgtcctgacgcacgcgtggaaggagcgcgggcttcgacggcctgacgcacgccagtgaggtgtgtgcgtctccggcggcccgacttgtagaaggcgagggtgtctcgggactaaggacaccgaaggtggcacacaggagggcagtaacctgcagcggcgtgcagagctcctatctcggcaggagatagaatcggtggggtaagagcacctcagggtactgcaacccagcagcaggggcctgacctcagcgcacctggatggcagggctggaggagttgaagaagaagctacaacccttgctgttcgatgatccggatagaggtggcgccagtacgagggtgcccttaccagaagatacttgcgattcctatgcaatttctgatggtgggactgttaatttacttagtagatccttgggtgagtataacatcaatgagcttggctttcataaacgaa

SEQ ID NO: 3469 - DNA, 817 bp, Sorghum bicolor
  Clone ID: SORBI-28MAY03-CLUS57893_1
gcacgaggtagattagttactttcatttattcatgcagtattgatttggattcgttgttgcttaagtcattgttgatttctcctatcttttgcgatagttataaagagatcaaggacagccagtacttctatggagatggcaacctttaaagaaacttaatatcagtttcgccgtgtatatatgacatataaaggaaagttaaaaacatgtagtattagcagcctgtatgtgcacagctatattcatgctgcctatgtccctgtgctccttctacttgcatagatctgtgcctacggatatgttattttcattaaatccactatttctatctcaaatattttttgttttcttttttccttttcccttcagaaacacgcgaaacttcggttctctgcattttttcctgccttaatttgcttttactccctatgacactagcccttttcttcataccacaacagatttgacatgtaccttgcatactctctaggctgctaacccttttcctactgctatagaatggagcagcaagatcggtcctgcatttgcaacatgaacatggtcatactcagtgcatagaacaacttgcggttcaacttgataggttcaacctgtgtatatgacaatgccttctgaacccagtgtaaatacatgtgaagcacctatactcagctatgtatacctacattttgcacatgtgccatgtataggaactgctataggttcttccacagtgagctaaaatcacatatgttaacatcttttgtaactagagtttatccagtattatataatatactacttactgttttgatc

SEQ ID NO: 3470 - DNA, 561 bp, Sorghum bicolor
  Clone ID: SORBI-28MAY03-CLUS58242_1
gccggcaggcgtcaagttcgatccaactgaccaggagctgatcgagcacctcgaggcgaaagtgaaggatgaaggctcgagatctcaccctctcatcgatgagttcatacccacgatagatggggaggaccgcgtgggttacacccaccccgagaaacttccaggtgtgacgagggatggcctaagcaagcacttcttccaccggccgtccaaggcctacacgacgggcacgaggaagaggaggaagatacagacggagtgtgatgtccacaagggcgagacgaggtggcacaagactggaaagacgcggcccgtgatggtgaacggccggcagaaggggtgcaagaagatattggtactgtacactaactttggcaagcaccgcaagccggagaagacgaactgggtcatgcaccagtaccacctcggcgacctagaagaggagaaggagggggagctggtggtgtgcaagatcttctaccagacacaacccaggcagtgcagctggtcctctgatcggggcaccgccgccactgctgccatggcagcaacgacgatggc

SEQ ID NO: 3471 - DNA, 915 bp, Sorghum bicolor
  Clone ID: SORBI-28MAY03-CLUS58273_1
gcacgaggtccaagggcaattgcattagcaatagctcaagtcctgatggcgattgggcacttcaactttgcaatggcttggcctgggacaatgtacattggcacgctgcttgtcggagtaggctatggtgcccactgggccattgtgccagccgcagcctctgaactgtttggggtgaaaaatttcggagcactctataatttcctcacagtcgcaaatccagcaggctccctggtattctcaggggttatcgccagtggcatctatgacgctgaagcagcaaagcaggctcagcagcgccacaactctatgttgctggcaatgagtggcagagtggttaacatagtctctgaagccgctccatcattgaagtgtgagggcgccatctgtttcttcctctcatccctgatcatgtccgggttctgcatcattgcttttggcttgagcttgatcctggtctatcggacgaagattgtgtacacaagtctatatgggagaccgcgtacttgaaaaatgaaccttcaagggccagagggcgtgaaatggctccagaattctcaaaacatacgtcaattttgaatttagtctggtacccccatgcttgtacaggtatagtgttggtcttctttctttgaggagagtagaacaggagctttgcgttccattacaaatggaacgctgctgaggcacgcgagtcccagaaggttaatctctcaagcagcatttcaagtttgtggctgcagatgggaggttcattattgtgaagtatacgagagtagaaagttcgtggtggaaatgctgttctttgctcaaattttgctgtatttagtttggaaaaattgtatacccatgtaataagctggagacatttcgacgtatgtcagagtggagaacatattcttttatgatttgctg

SEQ ID NO: 3472 - DNA, 601 bp, Sorghum bicolor
  unsure (1)..(601): unsure at all n locations
  Clone ID: SORBI-28MAY03-CLUS58298_1
gcacgaggatgggctcggcatcatcaccattgccgatatacctgagtttccagagctaagaaaaaggctgctgcggttggcaccaaggattgcaaaccttcctgaagaggtgaagaaacagcttgaagatccagatagcagatataactttgggtgggctcgtgggaaggagaaactnncgagtctgggaaacttgacacatttaaaggttccttttatgcgaaccctgttttggatgtccctactactgatgatgtgcttgtaagtaggtatccatcatattgccgaccaaatatatggccaaatgagaatcttcctgaacttgagatagcatttaaagctcttgggaagctgatgatggaagttggtttgatgttggctcatcattgtgatcgctacgtaatggggcaaggagtgggatcatatgatggtgacagtcttgagcagacgattgcccgttcaaggtgtcacaagggtcgtctgttgtactatttcccacgacagtttagcaagcagatagacgttgagtctgtttcatcatggtgtggatggcacactgatcatggatctctaacaggtctcacatgtggcttgtttacga

SEQ ID NO: 3473 - DNA, 496 bp, Sorghum bicolor
  Clone ID: SORBI-28MAY03-CLUS5830_1
cttcaaagtcagatgactaccaagacagcgatggtgaacaagaaaatgaggcacttgatcgcagcaaccggcgaaggaaaagatctcagagatacacacaagactttgttgaggctgtctcggatattgatcctaactttgatagtgatgatgatatcatgggagaggcagtgtatgatgaggaatacctgagaagtcgcaaacagaataaagcatcaagtgcctctgaagaggatgaagagttccggttggaagaagatgctgaagatgatgatgaagaggaatattcattaagtagcagtgaagatttagaggagccgcaaccacaacggcataaaaaattggaaactcgtggccggcgaggtaccaagctgagatctgtgatgaaatcgaaacaggtctagacgcagcagcgttctttcgtccccgtattaactcatataaatatgatttttcggactcggatgatgaattgtcataatctgtctgtcatgca

SEQ ID NO: 3474 - DNA, 562 bp, Sorghum bicolor
  Clone ID: SORBI-28MAY03-CLUS58310_1
gcacgaggctgttcttcagtttgaatgctgcaaacgaataatggaatgcctttcagaggacactgtatgttcagtcttacaggcaggctcgtcgatctcatcttgtaaaccgcttgaagaagtatgcaagaggaattttgctatgcattttgattattgcacaactgcttgcacggactttgtgttgttagatgaggcaccatttaaggatattcttgagcatggtgatatgacagtaacgtcggaggagagggttctggatgtcattttaacatggtgcatgggagcttgtgaaacttttcactggacttcagtagatgagctcttgagatcttcaacaccagagcagctctttggagagaggctttccggcatcaatactttgctaccattagtgagattccctttgatgcagctgtctatactaaagaggatggagagaagtactctagcaaacgacatacaagcattcagacagttggttgcagaggccattgaattctctcatgctggacaattgatgcttacatcatatgaatgtgagagatttcagcataggcgc

SEQ ID NO: 3475 - DNA, 656 bp, Sorghum bicolor
  Clone ID: SORBI-28MAY03-CLUS58309_1
gcacgaggctttttggtggaattctttgcatttgtaaccatttggctgaataggaggcgagatattcttcctctcgctcgcgcgcgcgcatggtgacctcgccgctggtgacggtgagggcggctgccttcgctctcaccctgaccccgtcatcacggctcagccgcgcctcctttcgcgcctgcctcgcacagcgtcgccgccgccgttggccccctcgatgtagcgggaagcaagctgccgtggtcgaggaggaaacaccatctccgcaggaggccaagaacggcgagggggaacaggggcgcgggccgcagggatggtttgctctggatacgatcgggctggacattctcagcatcgccctgcccgccgccctcgcgctcgccgccgaccccatcgcggcgctcgtcgacaccgccttcgtcggtcacataggttctgccgaacttgctgctgttggtgtatcaatttcagtgttcaatttggtgtcaaagctgtttaatgtgcccttgcttaacgtgaccacatcctttgttgctgagcagcaggcagtggatgatgattctgctgggtcaagagaaggatacgactttccaaggtctcctgaggagttgacccagaaaaggaagtttcttccagcagtatcaacatcactg

SEQ ID NO: 3476 - DNA, 605 bp, Sorghum bicolor
  Clone ID: SORBI-28MAY03-CLUS57979_1
cttgtcttcgcacgcctcgtcgatcgagagcaatccgcgcattgatcggtcggtcgagaaatgggggaggagtcgacggcgtgcccggcggcgaaggtgtactacgaggggtgccccggctgcgccatggacaggaagaaggagacccagtccggcgtcccgtacaaggagctgctcttcgtcgccaccaccaccttcgcctccgctctgccaatcacgtccctgttccccttcctctacttcatgataaaggacctgcatgtcgctccaagggaggaagacattggattctacgctggtttcctcggcgcggcgtatatgatcggcagaggtgtcgcatcggttttctggggtgtggcggcggatcgtgttggccgaaagcctgtcctcgccttctctgtcttttcggtcattgtgttcaacactctgtttggactgagtgtcaagtactggatggcgatctctacaaggttccttcttggtgctctcaacggcttccttgcaccagtaaaggcttactccattgaagtttgccgacctgaacaacaggctttgggtatatcagttgtcagcacagcatggggaatgggtgttataattggccc

SEQ ID NO: 3477 - DNA, 1071 bp, Sorghum bicolor
  Clone ID: SORBI-28MAY03-CLUS57989_1
gcacgaggctgtggtgggttggcatgatcactagtaagtgattgtaggtgagattgccaatttcgtggcatatgccttcgcccccgcggtgctggttactccccttggagcgctcagcataattgttagtgcagtgctggctcatttcattctgaatgagaggttgcatgccctcggggtgcttggctgtgtgatgtgcattgcagggtctgtggtcatcgttattcacgctccacaggagcaggagattacttcagttagggaaatatggaacatggcgatacaacctgctttcttgctatatgttgcgtcagttattgtcattgtttttgtcctggtgttctatttctcccctctctatgggcagtccaatgtgttgatctacactgccatttgctctttgatgggctctctttcggttatgagtgttaaggctcttggtacatcattaaagctcactttcgagggaacaaaccaattaatatatccagagacttggttctttatgcttgttgtggctacttgtgtgctcactcagatgaactatctgaacaaggcacttgacacgttcaatacggcaattgtatctccaatatactatgtgatgttcacaactcttacaatacttgccagcgtcataatgttcaaggattggtctggtcaaagcccgggaagcatcatttctgaaatttgtggtttggttgtggtgttgtccggtaccattttgttgcatgtaacgaaggattatgaaaggatcccgcaatcaagaagtgtttatgcaccattatctccctccttgacaactagattaaatggagaattgttgaagcatgtcgaggatgagaggacttcggacgaagaaaaggcattgagaagacaagagatgtactagcatcagaatatcaaaggaaaactctgatggactctccggcaagggcttgtatatggcatgatagtgataaccttcccatagcgattgttgattcctcaattacagtttgatagtttgtgtacataaccggatacctgcagcattgtttgcatagttaaatgtggctgccgagtgattgc

SEQ ID NO: 3478 - DNA, 321 bp, Sorghum bicolor
  Clone ID: SORBI-28MAY03-CLUS5803_1
cccaccaccacccgtctccttcctccctgccttccccgagccgagcgcaaagccagcgcagcgtcgcgcccatcctcttctccctccttgttggatcgcagctccttcctcctagcgtccgatacaccaggcttccttctgcgagcaacgattattggcgtgcgcactggcaatggcgtccacgtctagctcgacgacgccagcggtggagctggaggcagtggatgaaaggggccggaagcggtagcgcgcggtcggggcggctgagccagcggcgccgttgcagccgttcaagtggcggacgcggcgcgagcactagat

SEQ ID NO: 3479 - DNA, 574 bp, Sorghum bicolor
  Clone ID: SORBI-28MAY03-CLUS58065_1
ctcgcggcttcttcttgcaaggcacaccgcgctgattttggcgcgggggcctcgtggcctttcaaccattgggcctgatttcccctgacgccgccctgaggatccaccaggggccgctcggtcgtgcctggcagtcggcccggaggttcgtgggcgagccgccatggctctcatccatgaggtgtgagttctttgtgctgctcccttatgcacccctcttggtcgcgccgatcttgctgggtctccccccggaggtgctttgacactctgccctggctcgcttccatcttctttgggcgggccgttccaccctccctacctgccggctcgctctccctgcctgccggccgtctctctcttggtcgttccctccctgagtgagtttggtggctggcgtgcgttcgtgctcgcgctccgtccgttgttggggtcccgccagtgtgtctgtttttcttgttatcggcccctggccctttgcggcctggtatcctccctgcccccacttcccgggcatgcctgacactccagttcatgcgcactccttctccagctcctgggccaatggataagcatc

SEQ ID NO: 3480 - DNA, 815 bp, Sorghum bicolor
  unsure (1)..(815): unsure at all n locations
  Clone ID: SORBI-28MAY03-CLUS58072_1
gcacgaggggaaagcttcggatggtggacgataaacttatgcagcaaaaggcacaacttttactggacgaagctgcttcctggtcacttctttggcacctctatggcaaaggacatgaggagctttctggagagctgttggtgccgccaattacatcccatcaggaggcttgccgctttgttgcagcagaccttacagcgcaactgtgtctgcggatcatactttggcttgaaggtcttgcttccgcggcgcttgatttggagaagaaggtgagaggacctcatgttggttcatacctaccaagttctggtgtttggcaccgtacacagaggtacctaaaaagaaataataatgattctactatagtgaagcatgtggattttgatgctccaactcgtgaaggagcccaacttcttcctgatgacaagaagcaagatgaattgcttctagaagatatatggactcttttaagagcaggaagattagaagaggcatctgagttgtgccgttctgctggccaggcatggagagctgccactctttgtccttttggtggcatagatatgttcccttccctggacgcattgcacaagaatggaaagtacagaacactacaagccattgaattagaaagtggtgttgggcggcagtggcgtctttggaaatgggcatcgtattgtgcttcagagaaaattgctgagcaagatggaggccgttatgagatggctgtatacgctttacagtgcagtaacttaaagcgtatcttgccaatctgtactgactgngagtcagcttgttgggcaatggcaagatcc

SEQ ID NO: 3481 - DNA, 865 bp, Sorghum bicolor
  Clone ID: SORBI-28MAY03-CLUS58421_1
gcacgaggcagcggcatcgagtacgactacctcttcaagctgctcctcatcggcgactcctccgtcggcaagtcctgcctcctcctccgcttcgccgatgattcgttcgttgacacctacatcagtaccatcggcgttgatttcaaaatccgcactgtcgacctcgatggaaagactgtcaagctacagatttgggacacagcaggccaagaaaggttcaggacaattacaagcagttactaccgaggagctcatggaatcattatcgtgtatgatgtgacagacatggagagcttcaataacatcaagcagtggctgagtgagattgataggtatgccagtgacaacgtttgcaagctgctagttgggaacaagtgtgatttggttgacagtaaggttgttgagactgaaaaggcaaaggcttttgcagattcgttaggaattccctttatcgagacaagtgcaaaggaatccatcaatgtggaggaagctttcctgaccatgtcatcagaaatcaagaaaaggatggcaacccaaccaaccgtggagaggagacccaccgtccatgttcacatgagagggcagccaatacagcagaagagcagctgctgctcatcatagtcagggttcaggaggcacttaaatttgtcttgtggttagatggatgctgtagaatgttgtccaatcaagactatattgaaggaggcactgggtggaatggaggatactaagatactataagcgtgtcatttcagtaggagatattcatctttatacagattagcataatttgccacagtttgtattattagtacctagcaaagtgtaccattcgttaatcttaaaacttgcagttaattgcatg

SEQ ID NO: 3482 - DNA, 595 bp, Sorghum bicolor
  Clone ID: SORBI-28MAY03-CLUS58434_1
gaggcggcgagagagagagttctcgagctccacgagcgccgcccgaggagagagagagagagagagagatgagcggcgaggcggcggcggcggccgtgggcggcggaggaggaggaggaggcgagggagagacgaacggcgtccagccgaacgtcaccatctacatcaacaacctcaacgagaagatcaagctcgaagaacttaagaagtccctaactgccgttttttcccagtttgggaagattcttgatgtgctcgctttcaagactttgaagcataaaggccaagcttgggttgtcttcgaagatgtcgcatcagcgactgaggctctcaagaggatgcagggatttcccttctatgacaaaactatgagaattcaatatgccaagaccaagtcggatattgtagcaaaggccgatggcacctttgtacctcgagaaagaagaaagagggtcgatgaaaaacctgaaaagaagcagaagcgcgagcaccaccatgatgctagtcaaattgggatgggtgtaaatgcttaccctggtgtatatggggctccacagctcacccagatacctatagctggaggacagagggtcat

SEQ ID NO: 3483 - DNA, 551 bp, Sorghum bicolor
  Clone ID: SORBI-28MAY03-CLUS58466_1
gcacgagggcgcgacggagtagggctcagtccagttcaaagcgcccacacacgcctgaccactgtcagcaatataaagcagttatccagggcaggacagggaataggactgttagcaatatcccacatgagattgaagctcattctgcagtgcgtcaaatagaaacagaaatggcaacaaagtggaaccatcaattcatgaaagcttcccagggtgcagattatggttacattgaacacaatcagagggatgctggtggagaaatctattcactgagggaggagcttatggtagctcaggaccggattcatcagcttgaagcagagtgtcgatctacaaagaagcagcttgatcacttggtgaagaatattgcaggggaaaaggcttctttcaagagcagggaacatgatgagtttcaccacatcttagatgcagttaaggaagaactgaaccgggagaggaaacagcgacagcaggcagaaatgatgaattccaaactgcacaatgatctatctgagatgaagtttgttgcgaagcgtcatttgccagat

SEQ ID NO: 3484 - DNA, 558 bp, Sorghum bicolor
  Clone ID: SORBI-28MAY03-CLUS58487_1
gcacgaggctctcttcctcttttctctctccccgccgccaccgcaccataatgctcgtcgcagtcgctagagcgcggggtactgcatgagcccgccgtcctcgctagagcgtagggagccacacgacctcagcgccattcgacgggcgtgctgaggaacaaccagaagatggcaacgtgaatcgagggtaggaaacaatgacaacactaggaagagcaggaagttggtgacggactcgacattgatttttgtgaagatgtgaaatcagattgtactactaaaggaactctatggtgtgaaattcctatttcgattttctatttgctaatgctactaaagattgagtttttgcccgtatatggctgaaattttcatagtgtacataaggttaggtgagagttcgtttttaagatgaatagatagatactacctctgttccaagttataatagataaccattgtcaatcataattaacatataagcctcccttgttaaatataaattttaacttcttggtgtaaattaagggtaggaactattatttttatattggcatt

SEQ ID NO: 3485 - DNA, 946 bp, Sorghum bicolor
  Clone ID: SORBI-28MAY03-CLUS58499_1
gcacgaggtacaatacaagcacgcggcgatggcgaaaggcggtggtggcggtggcggtggtggcgacgtcgagccagcgacgagcgcggccggcggcatgtgcgaccggttcctcacgttcctggccaagaacctgtcggtgagcaggatgaagggcatcgccgagggcccaaggagcggcgctggcgccggcggtggccactctccgccgccgacggagggaggagacgacgccggtggcgtggaagaagacgagttcgctatacccatcgagagggccgagttcgacttccagttgagcggccatggcgatggaggccagcacagcagcggcgtcgagccgaccatgctggaagagagcgccgcgccgacgacgacgagggacgttcctgatgagcagaaggacggagctgctgctgcggcggccgccgctgccgacggtccagcagcagtgccggctgtggaggagacgaaggtgaggaggacggtgacgatcaaggatgaccgtcctcatgcacaggacggcggcgccgccagctcggcgccggcgaaggtggagaggaagaagtcgctgttcaggaagcggcaggcgtcgtcggtcgcgggaggggaggaggagcagcagggcggcgccggcgcccgggtgccgaagcggagcggtctccggccgcggatgccgcaggtgccgcgggtgccgtccaacatcaacgagcggtcctccaccttcatcgaggagcgcaagaagagcttcgtcggcaagccggcgccgccggaggagaagtgaacggacgactggaccagagaggctgcatgccgtgcgatcacacagtggctctctagctcactctcagcgagtgtgtagctagtgtaaatacgatacgattcgtgggtgtgtatggccgggtttgatgtattgtgaatttgtgattgcatgctaatcgtgtcc

SEQ ID NO: 3486 - DNA, 555 bp, Sorghum bicolor
  Clone ID: SORBI-28MAY03-CLUS58514_1
gcacgaggccgatgtgtcctggctttccgctctccggtgtttagagcggagctctttggtccaatgaaggaaaaagctgaaaatcgcattaggatcgatgacatggagccagcaatcttcgaggctctgcttcagttcatctacacagatcgtctgcctgatagctgtagtgatggccggaatccggcgatcacacacttgctggttgccgcggaccggtatggagtggagaggctaaggttgctatgtgaaagtaagctcagcgaagccattgatgtggaaacagtggcgacaacgctagctttagcagagcagcacaactgctcgcagctgcgacgagcctgcattgggttcatggcctcgccgaacatgcttggcccaatcatggaaactgatggattcaatcatctcattgcaagctgtccgttggttatgaaggaaattctagacaaggtgtcctgcatctggagtggtaagtagtgccactgataagtgagtgatactgattcttagtcagtgttcagttatcaacagtcatgtgtattactgtgacat

SEQ ID NO: 3487 - DNA, 651 bp, Sorghum bicolor
  unsure (1)..(651): unsure at all n locations
  Clone ID: SORBI-28MAY03-CLUS61595_1
ancaaggatgataaagggctggaaacagagacttggtatgatctagctctcttatacctagatatggcacaatggagggatgcagaggtttgtgtattgaagataagatccatcagtccttattctgcattggcttggcatgctacaggaaaaatatatgaagcaaaaggtcttacaaaagaagctttgggagcttttttcagagctttagatcttgatcctaaacatgtcccaagtttgatatcaactgccactgttctacgacaacttggtgacaggccattgccttctatacggtgcttcctgactgatgcattgcaactggatagaactaatcatgttgcatggttcaatcttggcctgctttacaaagaggaaggtggcaggtcagcggctgaggctgctgaatgctttcaagctgctgcttttcttaaagaaacagcacctgtagaacctttcagatgacagatatgtctacagggactatagatgtaagctgctgtatgtattttgatatatttcagtacttcactgatgaaatagtggattacagagttctagaaatgattgggagatcataacatcagaaactgttgtaaaaaaatgttaaacaattcaatctatagttccaattgttgcctatgtagcaac

SEQ ID NO: 3488 - DNA, 666 bp, Sorghum bicolor
  Clone ID: SORBI-28MAY03-CLUS61602_1
cagagaggggatacagtatggggtggtgttaccagatgtcgaaggtgaaggaagatttctgtccgtttggaatgccttggaggttgccctgagcaacctgccgcttgccactgtcattgccgagcttgggttagatgagaagaaggtgtgcaactgtgagtctgtgactgtatatatacgcacatgcacgtgtgaagaataaacggccagtggggttgaagggcggatgccgggtggaacagaaggttctgaaaccggcacttgtggctggagtgcatttgtcccggagctgatccagctcaacggaatgcagggaaatcaaagcaatgtgcggattatcctgagaacattttagaattggactttggaggaaccactgcaattgatgcaatcatgcaaagatgatttcggccagctcttaatcctgattctaattagtggctcgttcaggagggtccgacgatgccatatatttttttttttttggggggggggatgccatggtgttggacaagcagcaggagcaaagatgtctgcccttacaagaaagttagaagtgtgtgcatcaagagttaaatatggagatgatacttttgaactttgctgccttcgttgtaatatggcacatatcagttcaaataaaatctgaggccaggctattccttt

SEQ ID NO: 3489 - DNA, 675 bp, Sorghum bicolor
  unsure (1)..(675): unsure at all n locations
  Clone ID: SORBI-28MAY03-CLUS61609_1
tggccttcgcccggtggctggcacgtctgttgtcgggtcctcggtccggtagcggctgcgtatgcttcccgtgcatcaaggtgcgagtcacccaggaggcatcccccgcggtttggctccggaccgccgtgcctcgacgtcctcggagggtcttcggagcgcgcctccttgtcgcccccaaacggtgtccggtgtgcgccttctgcttgccaccgctcgggcctcgtgcggtttaggcgtcctgcgtgggttgagccttcttcccaggcctgagaccttgttttctttctttctttctggctggttctcccgttgtctcagtccagtggtttgctacggcttgactgtgctggcgcctcgtgcgtttttctcctctcgtgtggtgtgatccgacatcccaggagtctgtcagcctgcactgcctctcattcacggatcgtcctcccttgggcccctagctactcgtgcgctagctgtgtgaatgttgttcatgcctttggaatgttttatttttcctggcagtggcaatgactttgaactgattctaacatttgccgacgaaaccgaacatcatcatacaaacatggaggctgcctaggtctttggtaccatgttgttttggtggaccangaaccagacagctcccaggtaaacaaangaggatcttatttgggt

SEQ ID NO: 3490 - DNA, 537 bp, Sorghum bicolor
  Clone ID: SORBI-28MAY03-CLUS5864_1
gcttgaaacagtcctgtctgagatatctaagaagactctgataagggggcagaactataattccagaaatgcagtctcctatgctttgttggataaggacaaacaatctgcattcctgtcatcgtttgacaagtctggatataggtcatctgacaaactgctcatcgcctacaagcctcgccgggggaggttcgcggtgtacgacggcgaggtgacattggaagaagctgaaaggttcgtgggatctgttttgaacggagacgttcaactgtcaccgaccaaacaaaagcctgtccttaggtagacgactattgcaagttttgagagttttagatctaacatttattatctttattacggtttgtacatagctgaacgaagagagtaaaattgtgtataacgtttgctggacagttttgtcgttcggtaaaccagaatactgacttatctctccctcaactctgccaatgtaattgtgcgagtgtctgtgagatgtgatacatacggccattctatctaaccatggtactgcttgtt

SEQ ID NO: 3491 - DNA, 817 bp, Sorghum bicolor
  Clone ID: SORBI-28MAY03-CLUS58658_1
gcacgaggcgacaaagaggtcggcatccaactagcgaccaacgaaatcaaggccatcatcttggacatgttcgcggcaggcacggacacgaccaccacggcgatggaatgggccatggcggagctcgtcacgcacccgcgcgccatgcgcagagcccaggacgaggtccgcgcggcggcggccggttccaccggcgtcaacgaggaccacgtcgcgcagctggactacctgaaggccgtggtgaaggagacgctccggctgcacgcgccgttgccgctgctggtgccccgggagccggcggcggacgccgagatcctggggtaccacgtcccggcgcgcacgcgcgtgctgatcaacgcctgggccatcggccgggaccccgcgatatgggagcgcgccgaggagttcgtgccggagaggttcttgggcggcaccgccgccgcgtccgtcgacttcagggggcagcacttcgagctgctgccgttcggcgccggcaggaggatgtgccccgggctccggttcgcagaggcaagcgccgagatggcactggcgagcttgttgtatcattttgactgggaggccgccggcgggcaggggagccgggaagggacgccgacgccatcgttggacatgaccgaggtgaacgggttagccgtgcatatcaagtccggtctgccgcttctagctaaaccgtgggtcccttaatctgtttctgttgcagttatcaccggtggttgcgtgctttttgcacctgaattcgcgtcatgttgtgcgatcgtgtttctcacctgatcgagcaataaatggtcattccctt

SEQ ID NO: 3492 - DNA, 736 bp, Sorghum bicolor
  Clone ID: SORBI-28MAY03-CLUS58677_1
gcacgaggattacggatcacatcagctggtagccggtgtataaatatgggagaagagcacagtacaatcacaagaccaacaaggtggttgaggtgagaacaggagagtcccatcgcaacacacaagagcgcgcgtaagggcaagcgaacgatgggcgtgctcctgcttgttcacgtcctcctcgtcgcggtggcggcgagcgctccggcggccgacgcatggggcaaggaggggcactacatggtgtgcaagatcgccgagagctttctgacggaagaggcctcgacggcggtgaaggagctgctgccggggtgggccggcggcgacctcgcggaggcgtgctcgtgggcggacacggtgaggttccggtacaaatggtccagccccctgcacttcgccgacacgccgggggactgcgagttcaactacgcccgggactgccacaacaccaaaggagagaaggacatgtgcgtggttggagccatcaacaactacaccgcggcgctcaaagactcatcaagtccatatgatccgagcgagagcctgatgttcctggcgcacttcgttggcgacatccaccagccgctccactgtggtcacaccgacgacctcggcggcaacaccatcaaagtccattggtacaggaggcagagcaaccttcacaaggtatgggatgtgaacgtcatcgagaccgccatgaaggacttctacgacaatgatcagagcaccatgatac

SEQ ID NO: 3493 - DNA, 876 bp, Sorghum bicolor
  unsure (1)..(876): unsure at all n locations
  Clone ID: SORBI-28MAY03-CLUS5868_1
cccacgcgtccgatttctaggaaatattcaattatttttcaggaagttaataccatgtagtagctcacatagcttccattcttccttgctataaagtacacaactgcaaaggcgatatcttctggagacctcaattttgtatcattaccgtatataagatagctggatgcatgaacactctaccattaagcatgttatattccatcacgattagaaaatgttaaattaacaagtgaaaatattgtagcacatataccgtgaggtccaattntctgtccataatgcangcttgttagctgagtttggtccaacaaatgtttctccacaaatgagcccgttgcatgtattgatctaatcatgaagttgttattagactcgttggaactttctgctagcattggggaagtcaagtggaatagtatgagaatgaataccgacaactggatctggagcatcattttgcttgcacatcgtccagggaacacctgttgtcggtctacagccattgcagctgcccaactgacataacgctgcccacttgagccaaatgcatgctcaaccatttggtattcgttctcaatctgcatgtaatttatgtagttagatgacgtgcacgccaaanattgataactttgttgttttacagacctgagaagttataatggggcctccttgtgggtagtaaagcccttcatgtttcatcatgtttactatatctgtaacaaatccttgcatatgttgctgcatagatcaaatgaagtaatttagtatgatgcttaaaaacaggttaccatgantaaatattgatgaaagtactaaaagagtgcttatatttgatcttggaaattaaacccctactattggctggtcttcatt

SEQ ID NO: 3494 - DNA, 659 bp, Sorghum bicolor
  Clone ID: SORBI-28MAY03-CLUS58706_1
gcacgaggggaaaaggagagagatgataacaagaaagaaaaagctaagagtagaaggaacgagaacacaatctttggtgctcttcaaaaggtgcaacaggacaagaaacaactggaagagtccatagagaagcataagcaggctgtgaaagagttgattgagaattatcctggattatcatctgaagtgccacctggctctgccctagaagagcaatttctttcatacttccgtgcagctaaagatatggaggaatcttctagtccattccgtgatggtgcagcgactcaaactccagttgttgaaactgcccctgtggatgcatctacttcagctgcaggacgtccagtagatactccgccaaggccagctaaagctaaaatgacggaagatagagcagttaccaaaccaagcactgaagtgcgtaggcctggaggaagaagaccccttattcgtcctactctacggactgaagaacctcatgctgatacagatgcctcagctgttgatgcctccacagttgttcaggacaaagggggtccatcagtagagcgtgaagctactggcattttacctgtgttacagccttcgagtcgtaaacggcctatctcatccgcacagacggtagatagtgcctcacaaggtgaggctaatgatgc

SEQ ID NO: 3495 - DNA, 629 bp, Sorghum bicolor
  Clone ID: SORBI-28MAY03-CLUS58333_1
gcacgagggccaatgctacaatctgacaagaatactgccaaattggacccgaagttccttgagttacctgtattttggacacaatcacggcaataccgtttgctcaatgctttccccaatgtattgaatctatgcaacaatagcttgacaggcataattccgcaaggaattggtcagttgaaagtgctcaatgtcctcaactttagctccaacagcttatctggagaaataccacaacaaatttgcaacctcacaaacctgcagacgctagacttgtcaaataaccagctcacaggtgaactcccaactgcactgagtaatcttcacttcctttcttggttcaatgtgtctaacaacgacctagaagggccagttccaagtggaggacagtttaatacctttacaaattctagctacattggaaattccaagctatgtggtcctatgctcagtgtccattgtgacccggtagaaggacctacaaccccaatgaaaaagaggcacaagaagaccatctttgcgcttgccttaggtgtgttctttggagggcttgccatgcttttcttgctgggacgtcttattctgttcatcagaagcacaaaatctgctgacagaaacaagagcagcaa

SEQ ID NO: 3496 - DNA, 606 bp, Sorghum bicolor
  Clone ID: SORBI-28MAY03-CLUS58339_1
gcacgagggatgtactttggtgagcacaatattgaaggaatgcttgctgtacttgagccattgcatgcaatgcttgagaggggacctgagacaattaaagaaaatgccttcattcaggcttatggacatgaattactggaagctcatgaatgctgttcgaaatatcgggctacaggagaggatgctgagctaactaaggcctgggatttgtattaccatgttttcagaagaatcgacaaacagcttccaagtcttacaactctcgatttgcactctgtttcgcctgagctactcaaatgtcgaaagttggaacttgctgtgccaggaacttatgctgcagattcaccacttgtgacgattgagtattttgttccccaattgattgttataacatccaagcaaagaccaagaaaactgacaattcatggaagtgatggcaatgattatgcattcttgcttaaaggccatgaagatttgcgacaagatgaacgtgtaatgcagctttttggtctggtgaatactctcctagagaactcaaggaaaacatcagagaaggatttatcaatccaaagatatgctgttatacctttgtcgcctaacagtggt

SEQ ID NO: 3497 - DNA, 669 bp, Sorghum bicolor
  Clone ID: SORBI-28MAY03-CLUS58346_1
gcgcgaggggcagctcctgggcatggtgatcatgtcggtcccggccgccatgagcgccgagccatgtcgccgcctgagctggcgctcgcccgcgccgcccccacggtgcctcctccgccccatcctggagcgctccctttgccgcctccagctggcgtaggcatgggctcgacgtatgccacggcagagtgtccctcttcagtcgccgctgctgatgcgtctgctgcgcctgcaggtggttcagatggtgctggggctttgccaacccctcctgcggccgcggaagttcctgggcctcgccatcaggcggggccgcgcgcacaggtggtgatgtcaccacatgcagaaactgcacccgctactccgcacagaggtcctgctgacactgcggctccctctgtgccggtccgagaagcgggccccccggttcgagcagttgtcgttgcggaagctcacgtgcctccggtgaccgagcctcacatgctctctcatcctggaccagctgaggtatacataagctcaacaaatgataaggcagattattcttcttcagtagacgcaagtgaagtgaatggtgggcctgtaaatgtttcaaatggtactggaactatgctaagcgatgaaatgaaagctaaagaagatgagacacaccatcagactgatacgcac

SEQ ID NO: 3498 - DNA, 667 bp, Sorghum bicolor
  Clone ID: SORBI-28MAY03-CLUS58396_1
cggatacattggattggagtactttggccgcactgttgggatcaagatcatgcccatgggaatccatatgggccaactgcaatcggtgctgcgattacctgagaaggaggacaaggttgctgagctgcggcagcgattccaggggaaagctgtgttgctgggggtagatgatacagatatctttaaagggatcaatttgaagcttcttgcatttgagaatatgctgaggatgcatcccaagtggcaggggagagctgtgttggtgcagatagccaacccgccccgggggaagggtaaggagatggaggccatccaggctgagatccgggagagctgtgacaggattaatagggagtttggccagactgggtatagccctgtcgtcttcattgaccgcaatgtgtcaagtgcggagaggcttgcatattacacaatagccgagtgtgtggtagtgacggctgtgagggatggaatgaacttgacgccttacgagtacgttgtctgccggcaggggatacccggctcagagtctgctccagaggtgagtggaccaaagaagagcatgctggttgtgtcggagttcattgggtgctcgccttcattgagtggtgcaattcgtgttaacccatggaatgttgaaacaactgctgaggcattgaatgaggcc

SEQ ID NO: 3499 - DNA, 599 bp, Sorghum bicolor
  Clone ID: SORBI-28MAY03-CLUS58784_1
acacaccaagccaaatacacagcttaaaactaaactgtgtccatggcctcccctcgctatccacctgcccgctccaaagcacgccgtcaccttcgtttacggcgggtgcacgagctagcttcgaacgagtctccgaggatcaagctagctactgtactctgtagttcacagccatctcaggtgcggaacccctcggagagagagtttggatatattattggcgaatataatggtgattgcgtcggcacgtctgctcgcttgatcgggaacatcatcggcaactcgtaatgcctgcaccactgcagtctacatctcagcaaggttttgtcgacatgggatggataggcgcttgcgcacttgctacacagaggacatgatgggacggaagaattgcgcagcgtcgtggcgtttaatttcgtcgtcgaggaagctgcacagctggtagtatgtgatcccgcccgggacgccatggtgttcggggtgagataagggagcgtgttttcagccggctcagaataccccgcaaggtgcttctcttggggttccgttgttgcctgaatatttcaacttgttaagacagatgatcaattcatgtattg

SEQ ID NO: 3500 - DNA, 744 bp, Sorghum bicolor
  Clone ID: SORBI-28MAY03-CLUS58807_1
ttcggcacgaggcagatgaagacgatccacacaggactgtgcaaaacaaaaactttatcaccaaggtgatgtttttgtctgcacaaaccaggccaagatatgatcatgaaggaaattgctactttgatggaaagataggcttatggccttttgttagagaggatcaagcaaaaagaagaagtcaaaacagagagcgaggggatcctgtaaccaagactatgatagttgacaggcaaacgatgtaatcatatttgattggtaaagtactgccagaaataaaaagatgttggcctagagaaagcagaggtgaaacaatatggatccaacaagataatgcaagaacacatgttcctgctgatgatccagattggctcctcgcagtcgcccaaacaggactcgatattcggcttatgcaccagcctcctaattcaccagatatgaatatcctcgatcttggtttttttgcctctctacaatcgaaggcagatgaccttaattccagtagtttgaatgatctcatagctaatgttctagcggaatatcaaaattataatccatacctattgaatagggtgttcctcacactccaaggcagcctgatcgaggtcatgaaacaaagaggtggaaatcactacaagatcccccacatgaacaaagataggctagagcgtctaggcattctaccagatagattgagttgtgactgtgaactgtatgaagaagtaaagcaggccttatctacat

SEQ ID NO: 3501 - DNA, 688 bp, Sorghum bicolor
  Clone ID: SORBI-28MAY03-CLUS58866_1
gcacgaggataagattcaactaggtccttcagagtttcttacaggagtatctggaacaatcggtccattcaaaagtctaataaacgttataacatcacttacgtttgtcaccaatactcgtagttatggaccatttggaaaaggccgcgcgacgcaattccacattcaaatgcaaaacaatggcagggttattggtttctttggtcgttccaaccaatatctcaatgcgattggtgtctacacaagaccaaaatgctagagttgcaaggagtgggccttcgggtggagatggaggggttcttcaagacatcatagaccacagcagggcagcagcatagtgcaggtccatcgggagaatgtggaggtagcgatcataagcctgatgtgtatgccaaatttggcccatggggtggagatggaggaaatccacaggacatcaaaatgctaccctaccgtttagatacggttaaaattagcagtggagttattatcgattcaattgagtttacatacaccgaccatgatggccagtaccacactataggcccttggggcggccatggaggagacaataactcttttcagctagggccttaggagtttcttataggagtatctggaaccatcggtacattcaatagtcaagtaaaggtaataacgtctcttacatttgtcaccaacaacgctc

SEQ ID NO: 3502 - DNA, 712 bp, Sorghum bicolor
  Clone ID: SORBI-28MAY03-CLUS5889_1
gatggacaacctcaagagcatgggtttcccagtagatgaccttaaatttgaccctgagctggtcataagaggtcttattattgataaagagaagggaaacttggttaaagctgatcgatttggctacgttaagagggccatgcatggtactcagatgctttccactcgtgctgtgagtgaaatatatggaagagaattggtggacctgcggaaagaaagtcgatgggagtttcttaacacccttttctctgtttcagaagctgtcatgttcatgcagatggtcgacaagttagatcagggattggtgccagctgaacttgggccattggattacaaaggactgtacaatgctgtttccaaagcactttttcgagcacatgtagaaggccaacttaagctggttgaaatgtagagagaaataatggctgagcctgagcggtttgtagagcctgatccagaacttcctttagctcttcttgatcaaaaggaggctggaaaaaagttgcttctcattactaattcagatttccattatacaaacaaaatgatgaatcatgcattcaatcgctttcttcctaatgatgtgggatggagagatctttttgaaatggttatagtctccgcaaggaagccagagtttttccagctttcacatccattatatgaggttgtaacagatgatgggctgatgcgcccctgttttaagtaaagt

SEQ ID NO: 3503 - DNA, 615 bp, Sorghum bicolor
  Clone ID: SORBI-28MAY03-CLUS58894_1
gcacgagggtgaggctcgtcgccgacgacgcccaccaggtgttcgctgtttttgcctcgcggcgcccgccctggacctcgcccccgccgctctgctcgggcctgggctcgtgtcgccggtggggcgccgtcgcgccgcagttgggctctgcgccagctgcacctgggcgatgggggggtgccccgcaacagttgctcctctgcttgacgggggtgcccctcctcgctgtctactccctcgcccgggtgtcggccccctcgctgtttcctcccgcgcctgggtctcccaccctgctctttgacctcatgcttctgtctcccccaacggggtctgtgaggagttgcctccttctcccgcagctgcagctgctaggagttctctcccagtgcttcgggctcagcccccgagtgcactctcacggggcatggcgccgagccctcgagcgccctccttgctagcaaccagcaggagttgtgggtgcagcccagctgcttagcttcgctttgattcagctcaatcagtgggaatatttggtggatttcaaaactccaataaagatggtgatgtctatggtttcaagtcttcattgttcacttcgagtgaatctgtccctgc

SEQ ID NO: 3504 - DNA, 1053 bp, Sorghum bicolor
  Clone ID: SORBI-28MAY03-CLUS58909_1
gcacgaggggttgactcacatgaaacccagagacagattatgttcgaggtgaattcatttacatgtcctgcttatggcaaattctgtaatgatgctcagcgtcatgcaactctgaagttggaggttgaactgaggaattggagatcctgctttattagctatttcaatgctcagaaagcatatatcgaagctcttgattgctggttatcgaagtttattttgaccgatacgatccggtactcccgaggaatctcatcgattgctccagatagagctggtgccccaactctagttgtgatttgccatgactggtacactacaatgtccaagtttccaaacaagcgggtctccctcaccatgaggaattttctcagaagtgtgagagtgctatggctgaagcagggggaagagcaacagcagaaaagaaaggtggacagcctggcaaaagagttggacaagaaggtaactgcctacaaaagagcagagaacaggatcattggcaccaagcttctggagcataagcctgagatagatgccaagcagcgcatggaacacttgtcggagaagaaagagatgctcaatgtcctgaggaagaggatcgagacagagaaagcgaagcatcatgcttgcatgcgggatacgcacgacgtcactctcaacgggttcaagattggcctcgccagcatcttcgaatcattggctgagttctcgaaggattcggtgaagctctacgaagaccttctggcacgagcccatgacaaagattaagataaggcaactactgataaacggccctgcgttggggggccatacccgcacatagcggtggatgctacatgagtgacagtgatctgcatgttaggacctctgatctccatgttgctagttgcattgccccagtttttgggcccctagaatctttgtctgattttagcctgtagagagtaccatgttgtttgtttggttggttggttgctgagtgtagggtcattcttgtgggcaacttatgcttgtaattattctttagcgggaatatcggtggggattcgctct

SEQ ID NO: 3505 - DNA, 706 bp, Sorghum bicolor
  Clone ID: SORBI-28MAY03-CLUS58910_1
gcacgaggcgtcactgtcctatcctgctcctttcccctgcgccgccgcctcaactaaaaccctaaaacagctccccttccctccgccgcctccacggccggtcgccatggcggacacggtgcagtaccgcctggagcgcgtggcggacgagctggacgacctggagcgcaggggcctcttcacgcgcgctgagctctccgacgtcgtccgcaagcgccgcgacttcgagtaccgcctccgccgccactccccgctccgccaggacttcctcgactacatcgcctacgagctccgcctcgactccctccgcaacctccgcaagcgcgccatcatacgcgccgccgctgacgaggatgacgagccccgtgatggcgctcgcagcagcgacgacgaggagggaggcgggaggaagaggaagaagaaggataaatccaagaagaagtggaagaagtccgtctccgacgtcgccggcgtcctccgcgtcctcgacatctaccggatggccaccgtcaggttcaagggcgacctcgacctctggttccgctacctcgagttctgccgcgacaagaaacacggcaggatgaagcaggttctggcacaagctattcgcttccatcccaaggttcccgggctttggatctacgcggcagcatgggaattcgatcagaacctgaacgtcgccgcggcacgtgcactgatgcagagc

SEQ ID NO: 3506 - DNA, 734 bp, Sorghum bicolor
  Clone ID: SORBI-28MAY03-CLUS58525_1
gcacgaggctagagctgaaactcgagtctcgcagcgaaaccttgctctattcgttgttgaattggccctgatgtttcgtgtccagtgttcttctgctccgtgattcgtgactatccagcgagcatgtgttctgcgatagattcagagcgtcgcggagttttccgtgccgccgatcagagtcgggatcgcgaccctgttttgcacccgagcatatcctgcttttcattgtcgatcctcgtttgtgacgtactgccactgttcagctcggtttgacttttccatcactcgtcttcctgatgccactgaaacagcgacggccacggcctgagcggcgctgccaagagggcggcggcgagcgtgagcagcatggagtcgcggccaggcgggacgaacctggtggagcccagagggcagggcgccgccgcgctgccgtccggtggccctgccgtgcagccgtggtggacgagctccggggccgtgctcggtgcagtgtcgccagccgttgtggcgcccgggagtggggtggggattggcctgtcgagcagcccggcaggtggtagtggtggtggcggcacggctaaaggagccgcgagtgacgagagcagcgaggattcacggagatctggggaaccaagagatggaagctctggtcaagaaaagaaccatgccacatcgcagatacctgctttggtgccagagtatttggcaccatactcacagctggaactgaacca

SEQ ID NO: 3507 - DNA, 738 bp, Sorghum bicolor
  Clone ID: SORBI-28MAY03-CLUS58529_1
gcacgagggtcattatacttttctctttatattcactcttcaaacactaattgtatccaagagagcactggtgtcataggtcttgttacattatttagtgacttcctacatgtttctcttgtgttgttatttatacatgataggatggtttgcaaatttttatttggttaggttccttacattacaggagcatagaccatgggacttggaattcttcatgcacttcactttgaaatgaatgatccaaggttattttattaggtactgtagatagtagatgtcacatttgattgagatagcatgaccatattaggttagttgaattcctaaaaattacaatacttctcaaattaatacaggttccatacgtgtgccccatcgggtaaaagaagtagtcatatgtgttgccatgaattttgtcaacgtgtgccacatcacagtgaagacctgcctgttttattcatcgggatgcccctcggctgcctggctgtttcttgtgttcctcatggcaaccatgcatgttggtctggtttgtattcgggtattttgttactcttgttgcttctctattggagtctgccttgcttcttgtggttgccatgcacgagacctctgccatgacatgtctgccatggcacttttgactactggaaaatgatttggagcaagtgccatcatatatgttcagttgtgaaaccatgatagatgtgcatggaagttttcaaaactttttagtgc

SEQ ID NO: 3508 - DNA, 627 bp, Sorghum bicolor
  Clone ID: SORBI-28MAY03-CLUS58595_1
gcacgagggactatagtgcagcactacacaagaaatatccaagaaagcccacgtcgccaagacgcaaagctagaattcttccaccacagttgtgggaccatcacgacaaacaattgagggtcattgattccaacaagtttctaaatcttgtaggtgcaaccttgctttgcctgctggctgctggcattcttctgccacacaaatgtctaatttgtttgctgtagctttggtgctctcatctctctactatggaatcaccatggccaccgcaagcagtgatgaaagcttcttccaaaagtgcctagcatccagttgcagcgaaggaggaccagagatccgatttccattccgccttgtaaccagccctctatcatgtggtgcacctggtatggagttagtgtgctcgaaagcagataccatcctggttcacccaaatcttggcttatgcaaggtaattgccatcgagtatagtgtcggtactataatcattgtcccacttgcagaatccaagtgcccttttcagaagatcatctccaccaatctatcaaccgatgtatatagaccttatggggaacgtgcaaccttagtgagttgttcagcagagttcataccaagtgataaggccaa

SEQ ID NO: 3509 - DNA, 828 bp, Sorghum bicolor
  Clone ID: SORBI-28MAY03-CLUS58606_1
gcacgaggtcgcgccgcctccgagacagccgccgcaaccatggccaccaccgccgccgccgctgccgccgcgctagccggcgccactaccgctgcgcccaaggcgaggcgccgggcgcacctcctggccgcacggcgcgccctcgccgcgcccatcaggtgctcagcggcgccacccgccacgctgacggtgacggctcccccggccaccccgctccggccgtggggccccaccgatccccgcaagggcgccgacatcctcggcgcggcgcttgagcgctgcggcgtccgcgacgtcttcgcctaccccggcggcgcgtccatggagatccaccaggcactcacccgttcccccgtcatcgccaaccacctcttccgccacgagcaaggggaggccttcgccgcctctggcttcgcgcgctcctcgggccgcgtcggcgtctgcgtcgccacctccggccccggcgccaccaacctagtctccgcgctcgccgacgcgctgctcgactccgtccccatggtcgccatcacgggacaggttccgcggcgcatgattggcaccgacgccttccaggagacgcccatcgtcgaggtcacccgctccatcaccaaacataactacctggtcctcgacgtcgacgacatcccccgcgtcgtgcaggaggctttcttcctcgcctcctccggtcgcccgggaccggtgcttgtcgacatccccaaggacatccagcagcagatggccgtgccggtctgggacacgcccatgagtctgcctgggtacattgcgcgccttcccaagcctcctgcgactgaattgcttgagcaggtg

SEQ ID NO: 3510 - DNA, 1126 bp, Sorghum bicolor
  Clone ID: SORBI-28MAY03-CLUS58596_1
gcacgaggagacagttgagggtggtggtttgataatcctgctgctccgctcactgtcttcgctaaccagcctctatacaatggtcatggatgtccatgaaagatttcgaacagagtctcatactcaagcggccgcgaggttcaatgagaggttcttgctgtctatagcatcatgcaaagcatgtgttgtgatggatgatgaacttaacattttgccgatatcatctcacatgaaattcatacaaccagttacaaacaatgaggattctgagggattgtcgaaacgggagagggagttgaaagacctcaaggatcaatttcgtgaagactttcccgttggtcctttaattggaaagtgctgcacaatggatcagggtaaagctgtcatcaactttcttgactctattttggataagtccctgaggagtacggttgctttgcttgctgcacgcggacgtggtaaatcagcagcccttggtcttgccattgctggagccgtagcagctgggtattcaaatatattcgcccccgccccaagtccagagaacttaaaaactctgtttgactttgtgtgcaagggaataaatgcattggagtacaaggagcatttgcattatgatgtggtgaagagtgctgatccagaactgaagaaagcaacagttcaaataaatgtctataagcaacatcgtcagacaatccagtatctgagaccacatgatcatggaaagctttctcaagttgaactccttgttatcgatgaagctgctgctattccattgccaattgttaagtccatgcttggtccatacctagttttcctctcttccactgtcaatgggtacgaaggtacaggtcgatcattgtctctgaagcttcttcagcaactagaatcccaaagccagccatctgctcaatctaatggatctaattccagtaggctctttaagaaaattgaattgaccgaatctattagatatgcctctggtgaccctattgagacctggcttaatgacttgctttgtttggaccttgcaaactccattccaaatatcagcaggctacctcacccaaaagaatgtgatctgtattatgtcaaccgggacacacttttctcatatcacaaggag

SEQ ID NO: 3511 - DNA, 773 bp, Sorghum bicolor
  Clone ID: SORBI-28MAY03-CLUS5863_1
ccaaggcgcaagacctcgcgcagccgctggtcgacgcccagatccccttcaagatccacgtcgtcaaggaccacgacatgaaggagcgcctctgcctcgaggcggagcgccttggcctctccgctatgatcatggggagccgcggtttcggggcatcccggaaaggtggcaaggggaggcttgggagtgtcagtgattactgcgtacaccactgtgtatgccccgttgtggttgttcgctaccctgatgatgctgcaggtgccggtggagatgcagcaggggcgacagatgagttgcacactgtaccagaggacgaacctgtttatcacgatgcgcctgaggtgcagaaagaaaactgaggtaatggtcgcaagcagctgaagaacgaaggaaaacatgaggcttgtagtgaggcgatcctgtgtatctggaagatgggactggctgtttgtctttgcttctgtatatcaactggcgtatcatgatcagctggctgcttcccgtttgagtttcataccagagtcctagatcatcggagtctttgttggtttgcttgtgagatgtttatgtcgttgacactcgacaccatgtagagtactcttcccgtgggtagaagctgtattgcatatgcttatgctgggggctgggttctcctgtcttgttttgtggagccggtgatgtgctttatgttctcaaatggtagcttatctacacgctatcatctgctctattcagcctatttactgtattggatacttgtaatggagaaccgc

SEQ ID NO: 3512 - DNA, 531 bp, Sorghum bicolor
  Clone ID: SORBI-28MAY03-CLUS58981_1
gcacgagggtgtggtcgaaggttctgatgatgctaactttgctattgagtcagacaccacggaaattgtgagcactgataacatcatcttcttgtggggctttagggaaaaatctgtcaaggagttaaaaccttaccttattggcttacatcaagccttctcagaagattttgaggtcaagttgttggataagacatgctcagctttgatattccgtgattctaatactgcaacgcagttactaaaagaaataaactcagaaggcccctcgctaaatagattcttatcagaaggtctgaaagctgcaggttttgaagtgtacagaaaggtctgcaggttaggactttgggattcagatttagcggaggtcctcgaggatgtttcaactgagctaggtgttccaacgcttcctgcgtgcagcacctctcggacatactggaatagtgcattgatgctggatctgaaggagtatctggaatactagaacattatatagaccctgatatcttttaccaggttctaagattaatg

SEQ ID NO: 3513 - DNA, 852 bp, Sorghum bicolor
  Clone ID: SORBI-28MAY03-CLUS58991_1
gcacgaggatgatgatgacgaaaactccggccgcagccgcgccgcgaagcgggcgggcggcgggcagaagaggaccgggctccggctgctctactgggcacggaacgtggtgaccaagtccgactcggccagggagacggagaggtcccagtctcaggccgccgccagccccctggagatcgagaaccttgctgagataatagaagatttcaaaatggtgctggtcgtgaggaatgatctgaagatgggtaaagggaagattgccgcacaatgcagccatgcaactcttgggctattcaaaaaactccaacagagagctccgaaatcactaagaaggtgggagcggtgtgggcaagttaaagtggttgtgaaagtagaaagcgaggaggatatgcttgttttacaagggagagcaaagtctttgaatctgccaactcacataaccatagacgctggaagaacacagattgctccaaattcaaggacagtcatggctattctggggccagctgatatggttgatgacgttactggcggtctgaagcttttgtagaaaatcaccttgtcagcatcctcaacttgggtcttcatagagcagtgctggaactttacagcccacagtgatctccgcactttcactgatgtatggtagaagaatgaacctcggccttgttgcttgtcccgatcttcttgtccatgaatttatttgaaaggaggttgcattcattttcacttgtatcgactgttatttttggagttgtgattttagcagttccagttgggtgttagagaacttaaatgttgagaattatagaccatcatttcctctgtaacatagataagaaaaggttc

SEQ ID NO: 3514 - DNA, 844 bp, Sorghum bicolor
  Clone ID: SORBI-28MAY03-CLUS59032_1
gcacgaggccccatcgcagtggctgccggaccccgctcacaccccaacgtgccaggcgcaactctccctctcccagacgccgactctccatctccctgaggccacaccccatctccccgacgccctccctcccccacaccatcatgatgccagggctgcacgccgccaacaacgcacgccggcagtgtcgcgcacaggccagagacgcacgccaccagggctgctcgccggatctccaacgacaccgcccctcaggccatggatgcaatggcgtgggcctaaaaggcagccataggagggcttgagatgcggaggcatgggccccgggggcggcggccgacgcgggtttgggatgtggcggctgcagcttccacgaggacggccactaggtcgccaaggctgccggacaccaggctcacaggtgtcattacgtacaagatgatttttggcttcggctgatttgctaaacccagttctacgggaagctgaaaggtggtggttttgatatgctcatagagatgctaaggtatatatgaccctgatggaatgttttggctagattgtgggcatgcaggacctaaaatgattaacaagatatcaaaaggctttgctttttttatctttcacacagaagcaagatgcacaaaggcttgtctcagttagagtgccttgatggcttgtctcagtccttcctgtgatccatgtgttgcagcctgtcgtacttgggcctttttttgtcgggttcatgatttagggtctcttctctttctcagtttatttgtttattttttggtagttgatatcatgcttcataattattgattatccaagttccaagcttgca

SEQ ID NO: 3515 - DNA, 839 bp, Sorghum bicolor
  Clone ID: SORBI-28MAY03-CLUS59035_1
agatgcaaatgcaatgttatcaagtaatggggaggagagggaggtcagattagtattgtccagggatcaaataatagagcgaaatgtggagataacaccaattaaattgccaagaatggtatcaattagtgaagattccacagatgagtcaattgatgattacaaggtctgacttaacaatatgcataaagacagaaaatacatggaatttcaagatgtatacagggaagacacagtcaagacttacaaagaatgctcgagggtgcaaggacaacttgatgatattagtgcatatgacaaccataggaatcagattgatttactaaattcaagtcaagatagcaatccaacaccacctttgaacctaccctctcatgctcaacgtgagaaaacacagggaaataactcccaaaagaggaaggcacgaggtaccctaaaaggattggcagcctcccacaagagatccaagcagggcagtcagaagcttaaagtcgaattctctagaattggaggagttgcaggtgagaacacacgcacatttattgatgaaatagtattgtttacaaggaaaaaagcaccactcattggagtgagaacatggagagatatccacgaagatgttaaaaagtcaatagcatctaatattatggtaagttctgatttgttttcggttgcatacacatttaccaaattatttaagaagtggcctagtatttatattttttgttcaagagaataagtgggaccttgagaataatgaggaaaacaggaaaaaatatggaccatcgcaaatgagcgttacaaaggatggcgatcaacattaagtgctacgtacaggg

SEQ ID NO: 3516 - DNA, 785 bp, Sorghum bicolor
  Clone ID: SORBI-28MAY03-CLUS59061_1
gcacgaggaaagcatccgcccagctcccccgccccgccgctcgcgctccgcggccgcgcaaaaccctcgggtgatggcgaccgccgcagctacggcgcctcacccgactccgccgacgccgctccagcagcaacagcatcagcaggacaaggaccagaagcagcagaaggcgctgtccatgaacgcaatccgcctgaaggcgatcggcgaccgcctcaaggcccacctgcgcggcatgaacgtccctccaatcgccgagttcgcccacctcgtctacgcgttcgccaggcgcgtggccttcgccctcgcaccgggcgtcgggcctcggtccgccgctcacgttcccgtcattctgtgttcgggctttgtccgcaggtgagtcttctttctacgttcagcgcgtatggtactcgggctgtcttgcaagaatgcttgttccaataattggtttcaacctgcagattctagagacattttcagaatggctaatgagctctctggcaacttctgcacatccacaggccaggcagctagtgacagcactgtgcttgaaattatatcacaaataatgccaaggtattaccctcggttgaagtttgagcgcctaatcacttctattgaagcaaaggttggctatgatatactaatggctgacttctttattgagaggaacctatctcgagatgaaaagattagactaattgtcgtacaaaaggaaaatttagatgcctcgtcttgtgtttcaagcccaccacatgtgagctttttggtcaatgggaggggtg

SEQ ID NO: 3517 - DNA, 808 bp, Sorghum bicolor
  Clone ID: SORBI-28MAY03-CLUS59043_1
gcacgagggagcaccccacgctgctaccatggccgacaactccagtgacaccaacccaccccgtcatcgctcgtctgtgaatactgcagccaccgtgcactcatagcaagtccatttagccgtgctcgccgtcccgccgctgcagctcgccccacctgcgcgttgatttttaatgtttaatagactgaagattgattttctttctaaccataatcaggcttcaagggtcttacagatggagagaaacagccttgagcacctattgcttcacttttgtggggtgacagcaaagaaggaatatcaaaatgcacgcgcgaggtcgaggccactgcctgatgaaatgatcaagtattgtatgctagagaagatacacactatctgctgtacatatatgacttaatgagacagagactacagagggagtcaacatttgaaaatgatcttcttctagaggtccataagcgcagtaatgaaatttgcttacagttctatgagaaggagcttctgacagatacgtcctatctccacatatacgggttgcgggaacatgaactggatgcaaaacagctggctgttgttgctgctctacatgagtggagagatagtatagctcgtcaggaagatgaaagtactggttatatactgccaaataaggctttaattgagatagcaaagcagatgcctacagatgttggacatttgaaaagaattgtgaaatcaaaatatccatatgttgagagcaatcttgagctaattgcttacactgtctggaatgcacttaagtattcttatgcctatgaaggaatag

SEQ ID NO: 3518 - DNA, 549 bp, Sorghum bicolor
  Clone ID: SORBI-28MAY03-CLUS58725_1
gcaccacggggatgaggtgttcgcattccctaaggaagtcatgcagtcaacgatgcttgaagttgttgtgaaggacaaggatgtcgttagggatgactatgtcggtcgagtgagtattgacctgaatgaggtccctctaagggtccctccagacagtccattggcaccagagtggtatcgtcttatgggcaaggatggcatgagggacagaggggagttgatgcttgcagtctggtatggtactcaagcagatgaatgcttcccaagcgccattcatgcagggtcaacaccagttgaatcccatcttcacaattatatccgtgggaaggtttaccctgcgccaagaatgtggtatgtgagagtcaatgtaattgaggcacatgatatatacccaatggagaaccacatacctgatgtactggtaaaagtgagactgggccatcaattgttgaagacaaggcaagttcgctcaccaaccagaaacttcatgtggaatgaggagctgatgtttgtcgcagcagagccttttgaggacgacttgatcatatc

SEQ ID NO: 3519 - DNA, 626 bp, Sorghum bicolor
  Clone ID: 14188380
ctcaggtgggctggtcagctgcgcagcattataattccaatgctgtagagcacaacaataagtcatatgtagcaccagttcataaatataataatggaacgattgttacctcagatgtgaccacagcctctacctccacagaacgccttgatggctcaaacatggaagctgcttctgattatgacatgattggtaccccttctgtgaacacgagttgtatgtatggaattggtagtgttgtaataaagggcccttgtggtgatgtagagaaatgccccatgcattctagatacgatagtcaactttctgtcaatgcagatggatttggtttacaagtgaatgagaacaaggaaaactatggcaagcctgaccacaaacagttatatcctgatccaaggaagtcttctgaaagatccatgggtgcaccaaagcagcatttggggtctgtctctccatctcaagttggttctaacagggttggcatagtgttggaggatgtatctgaatgcgaaatcctctgggaagatcttgtaattggtgaaagaattggatttggttcatacggagaagtgtaccatgctgattggaatggaacagtaagcagttttgcattttaactgaaactt

SEQ ID NO: 3520 - DNA, 455 bp, Sorghum bicolor
  unsure (1)..(455): unsure at all n locations
  Clone ID: LIB3476-011-P1-K1-G4
cccacgcgtccggacccacgcgtccgcccacgcgtccgcccacgcgtccgtagatacgatagtcaactttctgtcaatgcagatggatttggtttacaagtgaatgagaacaaggaaaactatggcaagcctgaccacaaacagttatatcctgatccaaggaagtcttctgaaagatccatgggtgcaccaaagcagcatttggggtctgtctctccatctcaagttggttctaacagggttggcatagtgttggaggatgtatctgaatgcgaaatcctctgggaagatcttgtaattggtgaaagaattggatttggttcatacggagaagtgtaccatgctgattggaatggaacagaagtagctgtaaagaagttcttggatcaagaattctatggtgatgctctggatgagtnccgttgtgaagtgaggattatgcgccgtcttcgaca

SEQ ID NO: 3521 - DNA, 866 bp, Sorghum bicolor
  Clone ID: SORBI-28MAY03-CLUS58738_1
gcacgaggatccccgactccccttccctcgtacggtacctccctctcatccttcttctctctgcccttccctcgctcgcccgctcccccccgcccttcgcttgccgtcccactccccttgcttccgtggcgcccacgccgcgcacgcgtgctcgcctcgcctcgcctggagacccgtctccgccgccctcccgcgtcgcggcgcaagaggacacaactgaatttcgtcagtggcgaaccgcatttgcctttggtgtgacagctgaatctttgtggttcaaaggcgattgatttgggtgcacgggcgcctaatgagctcccaagtctccacatcacggggtcttcaccccccgggcaagcttgggacatttgagtcgccccatgcctggccgctgccagcgcctacagcccagcccgaagcgggccgtggtgatgatcaggaggtcaggctgttgtcggttgcctggaaccaggattgtggatgctttgctgctggtaccagcaacgggttcaggatctttaactgcgaacctttcaaggagactttcaggagggaccttaagagcggcgggttcgggattgtcgagatgctgttccgttgcaacatccttgctcttgtaggcggcggctccaatgtgcagtacccgccgaacaaggtgatgatctgggatgaccaccagagccgttgcattggagagttcgcctttcgctctgatgtccgggcggtaaaattagcaaaggactacatcgtgattgtcctcgagcgcaagatattcgtttacaacttcaccgatttgaagctgctctaccagattgacaccctgtcaaatcccaagggactttgctgcctctctcatcattccaata

SEQ ID NO: 3522 - DNA, 668 bp, Sorghum bicolor
  Clone ID: SORBI-28MAY03-CLUS58752_1
gcacgaggaccaggggcacgcgcaggtccgccaggacatgaagccggagccacgcgaggaagcaattgacgtcgctgtggagcagccgcagccgcagctgctgagtcagggggttctgcctaatgggcccgcggccgcgtctgcggtgttccatgatcagatgtactatgtgaaccaggaacttacggttgaggattttctctatgatgatgattacaagatagacctttctgggtctaatctggatgtccttaataacctggaaggaattgttcagctggaatatccacagttcaattttccgcaagagttagcccctaatgcgtgccttgacatgagtaactgtggtacagagtgctgggggtgttttcctacacatgacagatttgctcacaacgatgacttcggcaccttctgcattcctgaagccaaaatgcgctctctgggactgccccaggcctgctattggatcagaaagatggcatgattattgcagcatgtatcatgctgatttggctgtgcaggaagagggccctccaggcacaatgcctgtgatccgtccaagaggcattgatctgaaagatggccctctgtttgctgctcttagtgcaaaaatccaaggaaaaaatgttgggatccctatctgtgaaggagctgccactgcgaag

SEQ ID NO: 3523 - DNA, 961 bp, Sorghum bicolor
  unsure (1)..(961): unsure at all n locations
  Clone ID: SORBI-28MAY03-CLUS5924_1
agggcacattcggcactcgggagaggtcccattttttcctctctcaccaattcctccccgggtccgggccgagccgccgttccaatccggtggccaccgcttacgccgcctctcttgcctccgctcccgttcgcggcccccgctcccacacttcgccgcctgctagcgctccagtttgatgctgatgagacctgatcccaccgttgggtaggttcctgcgcgcggaaagaagaaagaactcgtcgtgggtccgggtccgcaagagcaagaccctaggtgttcgtcagcagcgaggatgcccggcctgcctctgcctcaaccgataaatcagaatattggacgtgaatatgcttatcctgggtctacaggccaggccttccatcagcagctaagaactgcattgtctccggatgagaaactggctgctgaaagagatttggctctgtattgcaagccagtcgagctctacaatattattcaacggcgagccctgaaaaaccccctttttattcaaagatgccttctttacaatatacacgcgaggagaaaaaagaggattcagataaccatatcactttctagaagtacaaatactgagttgcaagcacattatatctttcctctttatgttctgttagctagacctactagtaacctttcacttgaagggcattctccaatttatcgattcagtcgggttcacttgcttacttcttttagtgaacttggaaataaggacaacagtgaagccacattcatcattcctgatgtgaagagtttgtcaacctcccatccttgcaaccttgacattatctntattagctgtgggcaagtcggacaaagtaatggtgaagacaactgctctggaaaccatgtggaaggttcttctctccagatgtttgaagggaaatgctccttgggtaaaataccgactaatttacttgcttcgtctttggagagt

SEQ ID NO: 3524 - DNA, 677 bp, Sorghum bicolor
  Clone ID: SORBI-28MAY03-CLUS59247_1
gcacgagggaagcaggaaagacggatggcaaagagaccgagggagggccgaaaagtgagggtgtgtcctctaatcccccggggtctggtgccaatgcagcaccggagctttctactgctgagaagcaagagcttcagaacaagatggcaaagctgatggcaatgttggatgaggtggaccggaaatacaagcactactaccatcaaatgcagagtgttgtttcgtcttttgatatggtagctgggcctggagctgccaagccttacactgcagttgctctccagacaatctcacgacacttccggtgcctgaaggatgctatcaatgatcagatcaatgtcatcaggaagaagctcggggaggaggaaagttcatctggcaaggagggcaaactaactcgtctccggtacatcgatcaacagctcaggcaacaacgagctttccaacagtatggcatgatcccacaaaatgcttggaggccacagagagggcttcctgaaaactctgttaccattcttcgtgcttggctctttgagcatttccttcacccgtaccctaaagattctgaaaaattgatgctagcaaggcaaacaggcttgacaaggagccagatttcaaactggttcatcaacgcccgtgtccgtctctggaaaccgatgatcgaggacatgtacaaa

SEQ ID NO: 3525 - DNA, 503 bp, Sorghum bicolor
  Clone ID: SORBI-28MAY03-CLUS5925_1
gcacgagggttccatggccagtgctgctggaggtaatgaagggcctgatcccagggaaattgaactttatcttgaggagattcttgcattgacacagcttggggaggactacactgaatttatggtgaataagatccgcggattgagagatgtcaagcctgaacttgggccgcgggcaatgaaagccttccgtaatggtaactttaataaaatggagcaggatctgactgggttctatgtgatttttgaggagtttttcatggtggagaatgtgaggaaagccatacggattgatgagcccataccagatggtctcacaacgtcaatggtggatgatgtattctttgtactgcagagttgctgccgccgagctgcttccactgcaagcataaactctgttcttgctgtgcttggtggggcaacgagccttctgagcaatgagtatcatgaggcactacaatggatgatgcgggagccaaatttgggtgcaaagctcttccttg

SEQ ID NO: 3526 - DNA, 585 bp, Sorghum bicolor
  Clone ID: SORBI-28MAY03-CLUS59251_1
gcacgaggcagtgccgcaccatcgtcgcccatggctctcctcaagaactccctcgtgctccaggggcggttgcgccatgcggcggcggcggcgttgttcacggcgcggcgcggcgcggcgacggcgacggaagagtacgcgcgccggaactacgccgataacacctccgagtacaacacggtcatcggctcgctcgtcgcccagcgcaggccctaccttctgcgtgatgcttatgacgacatgatgcttgatggcgtgaagcctgagcgggatacattccacacactcatagtcggtaccatgaaaggcagccggctacaagatgcactctacttccgtgatcagatgaaagaaatgggtttgcagcctgatgttaacctttacaacttcttgatctccacttgtggaaaatgcaagaactcagatgcagcaatcatgcttttagaagaaatgaaggcacatggtgttaagttgaaaggagagacctacatttgtctactgaatgcacttgcatcaacagggcagactgatcaagtgtatgccatagttagtgatatgagtgctgctggtcttggattaacaagt

SEQ ID NO: 3527 - DNA, 766 bp, Sorghum bicolor
  Clone ID: SORBI-28MAY03-CLUS59286_1
gcacgagggaaaaagaaagctttgaaggctttcgaactgaagcaaaacggcactcactactccctcgtcaacgcctttgtcttctacctcgcttccttctcttttttcccctttttttcttcctctcctccctctctgaattccttgttccgttgtgccttctctctctctctcgctctctctcgtgcgcttgtactacttctgaagccgcaaggtcagaagagaggatccacctttgagttcgattttcggtgactcgggtccttccgccgcgggggatttgagcgttttccttgagaaaattgagcttcttccagagtgtttttttgtgtgtgtgtgtgtgttttctcttgagagattcgtgccaaggatgtcgccttcgatccattttcttgggtagtcgaattgcagtcctatatagcgtcaaagaatccaactttgacttctccttggtggctccttctctgtgttgtcgaggagacaatttgatctttatttaattgggttggatgcttgttcacgttgagtagttggtaagggtagcagaagacaccatcattcctggtgattttggtgcttctctgaataattgggggtcaaattagccatcttcagtttttacttctcaattcaattgggaggatttggtgaattttagtggcagggcagagcttccttcaatcctccctcctcgtttttatggatttgggtgggttgggggtatcttaactttatccttgctgcaaaagggctataaacttgggag

SEQ ID NO: 3528 - DNA, 570 bp, Sorghum bicolor
  Clone ID: SORBI-28MAY03-CLUS59316_1
gcacgaggggggagcgccccatcggattcgtgcctctcaagatatcatcatttagtgaaagtaaatcagatgataaacggttttatataattactccgaccaaaacacttcaactgaggactggttgtgctaaggaccgggcgacttggattgaagcgcttgtctctgcaagaagcgaatattcttttaatggggatttatcgggtgatcagaatgatgcatcattttccacagaaaagctcagaaatcgcttgcatgcagaaggcattggtgaggccgttattaaagactgtgagcagattattcattcagaattttcgcagtaccaaacacagatgaagcagcgttgcgaagagtatttaagctttattggcagtcttccacgggaagttgaggtagttaattcagtagattcaactgtccctgagaagccacagctggagctgttcaagcatgactgctccagctctggaaaatgtagtgaatatagcaacacagaatcttctgatgatgttggcaaacaagagattagtgaactatcagatggagatgaatttcatttctatgaca

SEQ ID NO: 3529 - DNA, 664 bp, Sorghum bicolor
  Clone ID: SORBI-28MAY03-CLUS58923_1
gtctttctgactcgtcgtgcacccaccgcatcaacatcagatccccgctccacggtctcctccttcctagacgagatccctcttctcctcccgctccgacccccaccccactccggccacccccgcgggtcaatccatgggctgatactcgaagtcagagtcaccgggtgccggaagctgcgggacacggagttcttcacccgccaggacccctacgtcgtcctcgagtacgccaccaccaagctccgcacccgcacctgcaccgatgggggaagaaacccaactttcgatgagaagttccatatacccctcattgaagggctccgcgagttgaatgttactgtatggaacagtaacacattaacccatgatgacttcatcggcaatggcagagtgtatctgcacaaggtgctcacaaatggctatgatgactcctcatggtcacttcaaacacgccacatgagatctgctggggaggtgaagctcattatgcatgttgatgtctcagcaatgaagaacaagatgggtaaaagtgttgccgcatcaagtgcacatcctgttcctgcactttcaatgcgagtcccaaccccagccccagccccagctcctgctcctgctcctgctcctgctccagcaccagcaccagcaccagcgtctccgattc

SEQ ID NO: 3530 - DNA, 685 bp, Sorghum bicolor
  Clone ID: SORBI-28MAY03-CLUS58929_1
ccgcgggcccccgggccgctgcggccggcagcccgggtgcgcctcccgccgccgccgccccgcgcgctgcggcgcccccccccccggcctgctcctcccctccccccgagctcgtcgccggtggcggctgccccgtcgtggtcgtcgccggcgcggcccccctcgtcggggcctccgccgcgctcccgttcgcccgctccggcgcgcgcctgccccacccccggatcccgtgcctgctgcggtccccccttggtcctgtgctcgtcgccgccgccggcgtcagcgcctgcgcctacttcctcgggtcctgcgttgcccgcccccctggccgcgtgcgcgtctcgggcaccgtcgacttcgctagccgctgcgcggcggtcctcggtgcccatggcgcccgggcctctgcgggccccggttccggcgctcctgccgctgccgcctcgctgctctcgggggcgctgtccctcgccccgtgctctatacggtcggtttcccggcctggccctcggcttccccggcccccgcctctgtgcctgctgggtcctcccgttgggcctgaacaatatgtggcagtgatgaattcaatattttctgctcaacgttccatggtaccaattgattcttgtattgtgggaacccaggattctgctttcttgcagcaggcttcgtacataacaggagg

SEQ ID NO: 3531 - DNA, 483 bp, Sorghum bicolor
  Clone ID: SORBI-28MAY03-CLUS58944_1
gcacgaggctgataatggcattgttgccatacctgttcggcccgaggcatatggtaaaggtttgccctatgctcctgaaaattggccacactctggagacatatggcactggaaagttggaagcaggtcttctggagcaggccattgggctgacaggtatcttatgccaccatcccgttttcctgacgctactcctaagaagttacgatttgcaagtagagtacaagttgaagaatttgttaagagagaatttccggatgtcgatcctagcacattcttttctatgtttatctggaggatccctgctgaaggatacaggatccaaaaaggcacccagcaagtgtggcacaatgaacctgaacctgtggtggctgatccaggtggtctctgcaaggctaggaatagcttgtgcaaccttgaaagagaaggttttgttgaatcatcaccagcacgggcttgtaatatctgctgcaaagagcctgg

SEQ ID NO: 3532 - DNA, 750 bp, Sorghum bicolor
  Clone ID: SORBI-28MAY03-CLUS58976_1
gcacgaggctctagtgactagcgaactagcaagtgacaagcaacaagcaagaagcaaccatggccgacgaccaaccagcatggaagataccgccgatcgttcaggagctgaccgccggcgtgcaggagccaccaagccggtacgtggttggcgagcaagatcgtcctgccatggccgccgccgccgccatgcccgagcccattcccatcgttgacctcagccggcgctccgcgaacgacggcgccgacgacgacgagaccgccaagctcctgtccgccctgcagaattggggcctcttcctggcagtcgggcatggaatggatccaggatttctcaccgagatgatggaggtgacgaggggattcttcaacctcccgctcgacgagaagcagaagtactccaacctggccaacggcaaggagttcaggttcgaagggtacggcaacgacatggtgctgtcggaggaccaggtcctggattggtgcgacaggctctacctcaccgtggagccggagtcccggatcgtccggagcctctggccggcgcagcctcctgccttcagcgacgtcctgcgcgagtacaccaccaggtgccgggagatcgccggcgtcgtgctcgccagcctcgccaggctgctgggcctgcacgaaggccgcttcgtcggcatgatgagcgacggcgtcgccatgacgcacgccaggttcaactactacccgcgatgccccgagccggaccgcgtcttgggcctga

SEQ ID NO: 3533 - DNA, 860 bp, Sorghum bicolor
  unsure (1)..(860): unsure at all n locations
  Clone ID: SORBI-28MAY03-CLUS59402_1
gcacgaggctttagagatactaggtaacatccaacagactgatggagctgtccttattgaacatgactctagtcaagatccaggttcagagcaggcattaattgaccagaatgagcttccccctctacccgatggccctccaccgcttccatcagattcaccacctcctccacctcctttgcctccttcgccaccacctgctacaccaccgccgccaccacctccactttctccagcttcaccacctccgcccccacctcccccactgccatctggaccacctcctcagcctgctccaccacctcctcgcccggcgccaccacctctgccaacccaggccccacctcttccttctattccgccgcctgttccttcatctccgtcatcattgggttatcagcctccagctccagagtacttcatgacgcccaatggtaatcaattgacccagatgacaggaaatacatcaattcaagctattggaaatacaacaactttcattcctggtggaccagttaatgggcaagctgcggttaattttgttacttcaatgccggcaaacaataacgtatttatggcaccacaaacttctaatggtaattaccagtttcggcccactggtgtaccttttcagcaagggaatttcagtgcctttccatctgcacaaacgcctctagttcatccccactctcgtatggcacacatgaatcccatgggccaacaagctgtaccacctccgcgcaatccttatgccgtgcagtcctttccaaacagtcagagccattatccacctgaagaacataattggctagcaggtggcagagcattatcttgctcagaagggccattcatgcangatg

SEQ ID NO: 3534 - DNA, 620 bp, Sorghum bicolor
  Clone ID: SORBI-28MAY03-CLUS59433_1
gcacgaggccccctcccaccgcccgccccctggcccccagccgcctccacgccccaccccccagcgcccggcgcgagtcgggaacctgatcccggctcccgccgaacccggttcccgggtcgccgcccacccccctggcccctggtcccggggtcttcggcgcggcgcgcgcctctcggtgcgatggggccctgctcggcgcagttcggggtgcggtgcggtcgggacgtcgcgtttccggtcgcgccccggggcagcgacgagctgcgggccccgggcttcgcgcggctcgtggggctggtcggccgggaccacgctggtccggcccccccctcgggcgcccacgtgccgcgggccgctggggtcctgcggccggatggcttcgggtacccgcaccgtccgggtgcgtcacgcttcgctgcggcccacatggcggctgctgcgcggcatctggtccctaatgtcttcggggctcctcctaggcagtacgattctagcttggcttcaggcgccactgctgctccggtgcggcttcgggtccgttttccctgcagtgcagccccttgcgatttctactgtatatttacatcaggggcaacagcagctctgaaacttgttgg

SEQ ID NO: 3535 - DNA, 852 bp, Sorghum bicolor
  unsure (1)..(852): unsure at all n locations
  Clone ID: SORBI-28MAY03-CLUS59436_1
aatcttgcggcacatgcatgngagtattaaatatagaacgaaaataaaaactnaattacacagtttaccnntttaatttgcgagacgaatctttntgagcctagttagtccatgattggacaacaattaccaaatacaaacgaaaatgccacagtacccaaaatccaaattttttgccaactgaacaaggcctatttctgttatatgcatgatgcatctataattcagtcatttaaggataaatccaacaaagcatgtgaccatggctcgagggcgttttccccttcgcttggcagtgctgggcagtcctagaaagcaagggtggaaatattcgaagggcacgcgagctatttgatgctgctactgtggctgatgcaaagcacattgctgcttggcacgggtgggcaattttagaaataaagcaaggaaatataaaaaaagcacggaacctacttgggaaagccctgaaatattgtggaggaaatgagtatatttaccaaactcttgctttgcttgaagctaaagcagagcgctttgaacaagcaaggactttgttcgaacaagccactcaatccaatccgaaaagttgtgcaagctggctagcttgggctcaggtagaaatgcgtgcaggaaacaataccatggccagaaatctctttgagaaagctgtccaggctagtcctaaaaaccgtttttcatggcatgtatgggcactatttgaggcaaatgaaggtaatattgacagtgcaaggaagttgcttaagattggacatgctgtaaatcctaaggaccctgtaatcctccagtcacttgcactgctggaatacaacttttcatctgcgaatgttgctc

SEQ ID NO: 3536 - DNA, 1112 bp, Sorghum bicolor
  Clone ID: SORBI-28MAY03-CLUS59447_1
gcacgaggattatgaagcaggtgtgcgaggacatagccatgatcgacttccctgttgtggcattggttttggctggttcctgttcatattcggtttcttccttggtgccattccctggtacattggagcccttctgctatggtgttccagagttgattacagggagaaaccaggctatgtcgcatgcacagtagcggtgagtaaacagcttgtagtattacacaactcatgtgttatgtggtccatcatcaacaagataagatggtactagtaaataatctcacctccatgcttcctcaacttctacttcctttatctgtgcatgactagcagtaaactgcgaattgactgagagcaagccttaaatttgatgttattagtaaattggctgcctagtaaacttggccgttgttcattcatgttgacactaggctcccagaagaagaagaaaatatttagctttaatttgaccttgctagatcaagttgctagaaaaaagtttgtattcgtacggtcacctaagaaaatatatataattcagtcatcttgaatatcttgggttcttcaaaaaaatcttgaatatcttgttatggggctgctgtatcgtattcttttttttccaatgaactttattccggctcttgaccactaaaatgcttgatggaactgttagtttgtaattcatgcattgagagttctaacttgtaactagagcccatttatgaatcatgagacagaaacggagcacttccagagatggtgctgcatttttttttaagaaaagatgcttgtctattctcttggtactgccaaaagctatgcaattctgtagatgccctcacgaactcttcattcgatcacttctgtacgagtcatttgtaaattgtagttttgaaatttagtgattctgatgagagaattacttggtgtaacaggctatcctcgctacaattgctgttatcattggggcggcagctggaactcatgtttttttattttagcttacatcgtcttgtcattgtacataacgtacatattatccatgcgtcagataattcacgcaatcagcattgtaatggacatttgttctgcattcgcaatcattcatgttt

SEQ ID NO: 3537 - DNA, 919 bp, Sorghum bicolor
  Clone ID: SORBI-28MAY03-CLUS59462_1
gcacgaggcatgaatggtgaaaagggtctcttacggaatcagaatgcagggttcactgcacttgcaagtcctgtgaggagagaaattggaaacagatcgttgacaaggtccttctgtgttgatgacaatgacttggaagatggtaaggcctcaaaagaaagggagagctctgcacagtcactcaagctcccaaagattcagaatcaggctttcctatctggtctggcttactgcatatcatcatgcagcatgatcttagtgaacaaatttgttctatctggctatggtttcaatgctccagtatttttgatgctataccagaacattgtatcagtgaccatagtttctacactatccctgtccggtgctgttccaactgaaccattgacatggaatctaatcaaagtttggttgcctgtgaatatcatctttggcgcgaggctgatcacaagcatgtttagtttgaagtacattaatgttgcaatgctgactatactgaagaatgtcgccaatgtcctgactgcttctggggaaacttattttttcaagaagcagcatggtactcaagtctggattgctcttttgttgatgataatctctgcagttgcgggaggaataacagatctttcattccatgctgttggatatatctggcagaccttgaactgttttctgacggcgtcatattcgcttacattgcggcatgtaatggacagtgctaagcaagccaccaagtctgggaatttgaatgagctttcaatggtgttgctgaataatgttctttcactgccattgggaattatccttgttcttggtttgaatgaagtggagtaccttttggagacacctctcttacagatgcctgagttttggctggtcatcactgccagcggagttttggggcttggaatcaacttta

SEQ ID NO: 3538 - DNA, 452 bp, Sorghum bicolor
  Clone ID: SORBI-28MAY03-CLUS59486_1
gcacgaggctgccctctccccccgcgtcgtcccctcctccgctcccccttcctctatgcgcctagatctcgccagggtttgccgcttctcttctggatttttcctccggaaccagggctccgtcggggcagagaggcaggagggataggccatcccggaaagtggcggatccgggtgaagctgttcggctggagagcgtcgtgtagcgtttctgttggtggcagaggcatcgtcgagttgcgatttggaaggcatttgtgattccggcatggagtgcggcggagctgtggacagcagcggaaccgatgatgatcttccaccatcgtatcacaacagcagaggcatgaaaggcagtgcacgcatcactggtaatggaagagatactattggtgcttctctgtatactagagttcaacctcagacagatatggaaacacaaatacatcagcttg

SEQ ID NO: 3539 - DNA, 574 bp, Sorghum bicolor
  Clone ID: SORBI-28MAY03-CLUS5909_1
ctcgaacgcgcgtccggccggcacgcttcagatggcggcgctgcttacccgagccggcgcccgcctcaagcgatccggctccggcttccacctccgctccgtcctcgcggggcacggactcttctcatctgaagccgcgacgaccgctgctcctgcggcctccgtggacgaccgcgcggtcgctgtcgcggccacgggcgaggaggatggggacgacctgcgcagccgcatcttccggctgggcctggcgaagcggagcgcgacagcggcgctcgacaagtggtccggtgaggacgcgccgcacccgcggcggagctccgccgcatcgcgcgcgacctcagccgcgtccgtcgctacaagcacgcactcgaggtagcagactggatgaagacacatcatgagtctgatttatctgagagtgactatggaatgcgcattgacttgattaccaaagtttttggtgctagtgctgctgaagatttctttgagaagcttccacctggagccaaatcgctagaagcctacacagctcttctccattcttatggccgatcaaagatgacagataaagctg

SEQ ID NO: 3540 - DNA, 1164 bp, Sorghum bicolor
  Clone ID: SORBI-28MAY03-CLUS59108_1
gcacgaggatggaatgtacctaacggtgagccccctaagcctggatctagtcccagtaagcgggatttgaactttggcggcatcgtcgccagagctggagcgtactttcggaggcaaaacccggggtttgggccaaacccttctcccccatcatttgaggaaatgtacttccttggaaacacgacggacggcattgtttctgataataaagccggcgaaccgacgcctttttacctgagcattcttaagtccgcaaacgaaacagttgggcccaatgccctagaaaagcgtcagaattctggagagtcctccggtaatatctcgatatctctgccggccccggatctcgaagcagacggcactggagcccccgcacaactattccctcgtgccgtacagcaaccagttcgtctctacgaccgcggcctacagacggagcactacggcttctacacctacttcaagcgcaccatctatctcaagtctgtcacaaccctcaacggcaccgatgacgagagcgatgtgcctctcgacaaggacggtggcgcccgccgtagcgaggcaaagttcctcgtgacgtggtcccaaacgcgctttctcgtgcagatttggacccgctccgaaaacaatacacagctcctgcgctccaacaacggcgaggaaccaggtactatgccgtatcccatcaccatcaaaacggacacacacggcggccggtcgggcgagaagtttgtgtggcactggcctgtcgacgaccgccaaggcatcgacacggcgaacccgaaactattgcccaacgatattggttttggtggcagactagtgaacccgcgtaaggacagggatacatcttttggtgggtttgatggcggtaccggggggtgccggtgcgaatgggtgaactttgtcgtccggagggatagcggaaattgacgagattcaagaacaagtaattatcagaattcgaaagtcgagctatgaaaatgaatatcgacgcggatacgggtatggttggacgtggatacggggtttggcatcggcatcagcacattacatggatggtatatggtggggttaaaagaattcaaaaatgcgtagcatctgctcagtatcgtaatgaaatatcgcactccaagtccttcaggtagatattccatacgattt

SEQ ID NO: 3541 - DNA, 578 bp, Sorghum bicolor
  Clone ID: SORBI-28MAY03-CLUS59129_1
agagccctcccatgaagctcggcgcgaggaacttgcagttcttgagaacaaaaaggtcagagtcatgccgtgttgatcaagataatgctgaagagatacaaccattgctttgtacaagagctgaatctagatatgagacgttttccattagcttgggtggaagttctaattcagattctcagtacagccaaagaatcaatagcttggagcatgattttgaaccatctcttggggtgccacgctaagggcctctttgaagtgtcagaatccccccagagcatcaagaggccaagaagtttttatggggtggatatctgcaagtcctaccaaaaatactgtgttgagcatgaacatcttaaggtcatccatatttctatctgcggaagatgatgaactgtcctttactctcttgttttctacattatcatacataagtatgttgtacttatttccctgcaaattggacttactcttatctattgttttgtcccttgattctcttatctattgtttgtacttggatccttgcggtccatactccatacaatgatacaatggatatacatgtttaaattttt

SEQ ID NO: 3542 - DNA, 598 bp, Sorghum bicolor
  Clone ID: SORBI-28MAY03-CLUS59152_1
gcacgaggccacggtggtgatgcgaagcagcacaaccagaatgcagaaggctttccgtcttatagaagtaagcgcgcggctttggaagtccctatgcagaaatctcttggttttggcttgaagtctgaaaacggcaaacgggattatgttgcaaatgatatggttcaatccttgcataagcaagatagtaagatagtggcgaaaaagaccataaagttgttggacggtccaccttattcaaaaaggccaaagcttgagcctgtacaaactggtagagatgctgaggccaagggacatgaattcatatcacagaagaatgtgcctgatttgacaccatgcgcagcatctgaaaaatctcggttgctcaagcagaagcgcatttctgatgcaaagagaattgataagaagaatattaggtctggtgtcagatcaaaatatgattgtttctcatcaaaggctggtctagcaaattttgattctggtttctcaggagacagcgtacttggagcacatggccttaaatctgatgttcgtgacatcaccaatcacattgagaacctctcattgagtgaacttctcgatggcacttacaagtatt

SEQ ID NO: 3543 - DNA, 893 bp, Sorghum bicolor
  Clone ID: SORBI-28MAY03-CLUS59557_1
gcacgaggggctaacaaacataaaggattggtgtataagtagacaattgtggtggggtcatcgtataccagtttggtatattgttggaaagaaatgtgaagaagactatattgttgctagaactgaagaggaggcacttgcaaaagctcaggaaaaatatggaaaatcagttgaaatatatcaagaccctgatgttcttgatacttggttctcaagtgctctgtggcctttcagcacacttggttggcctgatctttccaaggaggattataagcatttttatccttcaactgttctggagacaggccatgacattttgttcttctgggttgcacgaatggtcatgatgggaattgagtttacagggcccgtgccattttcttatgtctatcttcatggccttatccgggacgctgagggtcgaaaaatgtcgaagacattggggaatgtcattgatcccctagataccatcaaagattatggcacagatgctttgagatttacactatctttgggcactgcagggcaggacctcaatctctctatagaaaggttgacatcaaataaggctttcacaaacaagctgtggaacgcaggcaaatttttgttgcagaatttgcctgataaaagtgatgtctcggcatgggatgtcttgttagcaaataagttcgactcagaagcatcactccagaaactgccattgccagaatgctgggtggttacaggactacatgaactcattgataaggtcagcagaagctatgacaagtttttttttggagatgctgctagagaaatatatgatttcttctggggggattttgctgattggtatattgaagctagcaaaacacggctttaccactcaagtgacaagttcgctgctgctacag

SEQ ID NO: 3544 - DNA, 1014 bp, Sorghum bicolor
  Clone ID: SORBI-28MAY03-CLUS59602_1
gcacgaggcaagaacaacaatttcatctgtttatcgcacatcgcaaatagcagcgtctgtctacaagtcatcataccatcagaaggcatttcctgaagctttatttcaccagcttctcttagcaatgttgcacccagacaataagacaaggattggttcacatcgtgttctatccaccattgtagcaccttcattgctgtgtccatggtcggccatgagctttcctatcccaatgaagggtgatgattcgcagaacttgcatttgttggttctctcagctttctcttccgaagccataatcaatgaagcacggaccaaaaacaagatccaagcatccttgcaggaaaacaacaaatcagaagctatagttgatgctgagaatggatacgcacagacagaaccagataaaaggaagtacccagggagcccatatctgaatgagcatgatcgtacaacatttaacgatgaagacttagagttcatgaagttgaataaccaccagattgttctccttctttcatctatttggagtcaagcatctctggatgataactcacctgcaaattttgaagcaatggcccttgcatacagcattgctttattatgttcaaaatcaaaaagctccagtcatgtggcactagttcactgtttccagttggcgttctctctcaggagaaagtctcttagccatgaaagtgatttgcagccatctcgtagaagatgtctgtatacgatggcatcagcaatgctcatcttttcagcaaaatttgctgatcttcaccagataattcctcttgtgaaagctgcagcaccagagaaaatggttgatcctcatctttgcttgacggatgactgccagctcattaatacctctgcagagtcatctaacagtgagatggtttatggttctgaggaagacgaaagtgatgcactggcctttctttcagccgtaaacaagcatgacacagagctaatagaaacagtgatgtgccactttaaggagaagtttgaaaa

SEQ ID NO: 3545 - DNA, 469 bp, Sorghum bicolor
  Clone ID: SORBI-28MAY03-CLUS59622_1
gcacgaggagaactttggaggatgaagagaactatgagagcaccttaatgagtgtggatctcactaaagtgcctctagacaccgtagccactgataatgctggtatgaagccagtaggctgctcaaaaaatacagtaggagcttcaagtgcttcaccagaaaatacccaggtaagtgaacatagttccagtgacgaagatgccaacatgactgagcagcatgatgatgatggtactgccgatggtggcagcactcaaggtctagaatgcaccagtccagaaaggtcagaggagagattaaggccgggttttcatggcaatcctgtttctacagctcctgagagggaggtaacagacactgagcaagttcctgagacggaaagccaagctggtaatgttggttgtgatgaccaaagatgtgacaatatgggaggagagactatgccactagaggacgaagtgcagcttcc

SEQ ID NO: 3546 - DNA, 425 bp, Sorghum bicolor
  unsure (1)..(425): unsure at all n locations
  Clone ID: SORBI-28MAY03-CLUS5965_1
ccctcctcctcctctctctctctctctctctctctgtctcgccncctgggaggaaggagggctccgtccgccgctcccggggaagagcccgccattgctgccgctggcctaactggggaagatggttgtccaggagttcacagttgatctcaacaagccccttgttttccaggttggccatcttgaggagcgttaccaagaatgggttcaccaacctattgtcagcaaggagggtccacgctttttcggaaatgatgtcttggagttcttgacttgcacaaagtggtgggctgtgccaactatatggctccctgttgtttgcttcatgttcgtgaaatcaattttgatgggtaataccattcaggacgtagttctgatggctctatttggaatatttatttggacgctgattgaatatactttgc

SEQ ID NO: 3547 - DNA, 748 bp, Sorghum bicolor
  Clone ID: SORBI-28MAY03-CLUS59641_1
gcacgaggcaaaagacaagacctcatccaagcaaccttgatattttgtcggttgcccgctctgtatgctgtaagacaagtcttcttgctgcattggaagttaaatacggatctttacctgagaacatatttgtgaaagctgcaaagctttgcagtgacaatggcacccggattgattggcatcaagaggaattcatatgccctaaaggttgcaagtctagatctaattcaaatgctctgcttcctatgcaactcacggcagttgattttcctgaagctccttcagttgatcctcttaatgatgatgaaatgtgggaaatggaagaataccattatgttcttgattcgaagcactttggatggaagcctaaaaatgagagagttgttctctgtgaagacataagttttggcagggagaaagttccaattgtctgtgtcattcatgcagacgcaaaagattctttaggtatgaagcctgaagaacttttaccacatggcagttctgtgccttggaaaggtttccactatatcacaaagcgtttgatggattcatgtcttagtgattcatagaactctatgcctgggtgtgcatgttcctatactgaatgttctcctgagaactgtggtcacgtgagtctctttgatggtggtctacagtggcctgctggatatcaatggaacaccgatgcatggcagatttgcatatgataaagatagtaaaattattttacaggaagggtatccaatat

SEQ ID NO: 3548 - DNA, 558 bp, Sorghum bicolor
  Clone ID: SORBI-28MAY03-CLUS59677_1
gcacgaggccgcctccaagctcggaagggagcggcactcggtctccgcgagcgcgaggccgggagcgcaatgctggaggcggaggaagggtctggcggtgagctgccagacgggcgccgccccggctgttctcaggatggaggagaccacggccgcggcggcggcggggagcaatgctcaggcggagttcaccgttgtcatgaagttcggcggctcttcgctcgcgtcggccgagcggatgcgggaggtggccgatctcatccttagcttccccgacgagacccccgtcgtcgtcctctccgccatggggaagaccaccaataacctcctcctggccggagagaaggcggtgagctgcggcgcccccaaggcgtccgagatccctgagctcgccgtcatcaaggacctgcatcttaggacggttgatgagctcgggttagataggtcgattgtttcaggtttattggatgaattggagcaacttcttagaggagttgctatgatgagagagctgactcttaggacaagagattatcttgtttcctttggtgaatgtat

SEQ ID NO: 3549 - DNA, 542 bp, Sorghum bicolor
  Clone ID: SORBI-28MAY03-CLUS59334_1
gcacgaggttgatgagtaacttgatagattcctgagaaatctccatgttttcttaaactcttgatagctttatctctgtgagatcatgtgatgaaaaattggtttcatatgaaattagcattgcaaagtgatttggattatggcatagggtgatatgcatgtgctgcttatatatgcttgtggtagcatggtgatttggcattgtttcatgacatactcatgtgaggtgttgtgcggattaacttgagtcaagtcgtggacttgggctcggacacagtttgcgtgtttgttcatgtgcaggtgttgcttgaggcggaaggtggtcgatgacggactgaaactgaggtttcgggactaagttcagggaggaactgaggtcctatcggtcaaggatgtcatacgtgacgtttgggctaagagaacaatgagttacacgttaccgtggtgtgtgcaatgcatggggcattggcatgttcgtttgacaaagtccaggcatggacttggtgctatgatgcacctatgatacatgcatggataggagc

SEQ ID NO: 3550 - DNA, 799 bp, Sorghum bicolor
  unsure (1)..(799): unsure at all n locations
  Clone ID: SORBI-28MAY03-CLUS59336_1
gcacgaggaaaacaagactgctgctcgaagagagattattcgagagcgcacgcagcaggcgagaagaagtttccaagagaagagaagcctagagggagggagggggagagatgggggagggcanagcangagacggcctcatcaagctgttcggcaagaccatccccgtgccggagacgcccgccgcgggcgacgctgccaaggacatccaacaaagcggcagcagcggcacgactgatctgaaggggcaagagaacacccttcaggattccacaggctcgcctccgcagcaggaggttgcggacactgaagactcgtcggctgccaagaactcctcggcagacaaacagcagggcgaggcggccaaccagaaggagaagctcaagaagcctgacaagatcctgccttgcccccggtgcaacagcatggacaccaagttctgctactataacaactacaacatcaaccagccacgccacttctgcaagaactgccagaggtactggactgctggcggtgccatgcgcaacgtccctgtgggtgcaggccggcgcaagagcaagagcgcgtcagctgcttcccacttccttcagagggtcagggccgctttgcccatggatcccctctgcactgcagccaagatgaatggcacggtgctcagcttcggctcagacatgtccagcttagacctcacagagcagatgaagcacctgaaggagaagctcatcccaatagcggggatcaagaacggcgatgaacgttcagttggctcttgcactgaaggacctgcgaaggcaga

SEQ ID NO: 3551 - DNA, 958 bp, Sorghum bicolor
  Clone ID: SORBI-28MAY03-CLUS59349_1
gcacgaggatttaggtgaacaagcatcttgattttttgaccaatctttgctctacccaccctgtggtcttcgcttttaaatcctctggagtctggaggtgggaagacggacgaggcgaagccgaaagcaagaacggtcgtttcaagtatccagctgccggcgtccgaaggaactatcaagtgttccagtggaggtattgggagtttaaagaaaaaaaggattgtagaggttgttgttttacctcgttttcctaacaatgttgaggcagagctctagtagaaatcagagatccaaaggtctgaagctgaagaaagctcttcagattagtctcttgcttctggtttctgtttggttgctctaccaagtaaagcattcttatgagaagaaggcgtatagtgaagatgaagcgaatgatttgcataaagatgacaaagaccagcgagaggcagtcagattaggcaggaaggatctgcctccaaagatggaggctgattcttcaacattggatgaacgggttgaggatgaagagaatgatgaaatggagcaagaaatgaagcatgatgagaacgatgaggatcccatcgatgagcaggacctggagaaggatgaagatcttcctgagcctggtgagcattcttctgagaaggatggagatgtgggtgtgtttgaggatgaagagcggaaggagcggtcgcaggaggatcaagagaagagcttccatggtgacaatgtttctagtgctgttactcacgaccctccatcatctgagcaagatgagctgttccatcatgcccaagagaaggtcttattcgtggatgatgcttcaactgcagtgcctaacgaaaatcatgatgaggctggaagcaaggaggaggaagtgcgcagggctagggagaggagtttcagaggcgatgatgtgtcaagctctgtggatcatgatgccaaggtggcaaaacct

SEQ ID NO: 3552 - DNA, 435 bp, Sorghum bicolor
  Clone ID: SORBI-28MAY03-CLUS5939_1
gcacgaggcgcttttgtagcaaattcagtgcaggtcgcagatggcaggagagaagtggacatcagggatcgtgacacagatggcgatgacagtgagagacagaaattcacagaagaagaggaagatgaggttgttaggatgaggaacactcctgatttctttaataagatagttgatagcatatgccctaccgtctttggtcatcaagaaattaagagggcagtgcttcttatgcttttgggtggtgttcataagataacacatgaagggatcaacctgagaggtgacatcaatgtctgtattgttggcgacccaagctgtgcaaagtcccagtttctaaagtatactgctggtattgttccaagatctgtttacacatcagggaagtcgtcatgtgctgctggtctgtgagcaactgttgctaaagaaccagag

SEQ ID NO: 3553 - DNA, 625 bp, Sorghum bicolor
  Clone ID: SORBI-28MAY03-CLUS59392_1
gcacgaggccccgcctccgtccccaccccctgcggccccgcccccgccccctccgcctccggcccagccaccgtctgtccaagccccgctgcccccaaaggagcagccgcctaaggcgacgctgccaagagtggagacggaggaggagcgtcgcgcgcggaagaagcgcgagtttgagaagcagcgggtggaggaccgcaagcagcagcagatgatgcgccagacgcaggccgccattctgcagaagacgcagcagcgcgctgctcagcagcagccacagagccgccaccaccaccaccagcctccgagtggctctcgggcaccggcaactggctctcgggcagtggtaactgggtctcgggcagtggcaactgggtctcgcccagcatcagcgcctaatgctgagaggtttgagaaccggctaagaaagccaacaactttcctctgcaagcacaaatttaggaatgaactccctgatccaagtgctcagctgaaatggctgcccctgaataaggataaggaccgatataccaaatacaggataacttcattggagaaaaactacattcctaaaatgattgtccctgatgatcttgggatacctcttgacctacttgacatgagt

SEQ ID NO: 3554 - DNA, 620 bp, Sorghum bicolor
  Clone ID: SORBI-28MAY03-CLUS59854_1
gcacgaggccgccgggcccatggtctccgtcgacagcctccgcgcctacctccagatcgtcgacgtcgcctccatactccgcctcgacagggacatagccgaccacgccttcgagctcttcaaggattgctcgtccgcgacctgcctcaggaatcggagcgtcgaggcgctcgcgaccgccgcgctcgtgcaggctatccgcgaggcgcagcagcctcggacgctgcaggaaatctctactgctagcaatcttcctcaaaaagagataggaaaatacatcaaaatactcggcgaatctctgaaactgagtcaaccacttaacagcaactcaatagctgttcatatgccccgattttgcagtttgctccagctgaataaatctgctcaggaacttgcagctcatattgggtgaggtggttgttaataagtgcttctgtacacggcgaaatcccataagtatatctgctgccgctatctaccttgcatgtcagcttgaagacaaacgcaaaactcaggcagagatctgtaaggttacgggcctcacagaggtcacattacgcaaagtgtacaaagaactgttggagaattgggatgatttgctcccccctgactatacacct

SEQ ID NO: 3555 - DNA, 568 bp, Sorghum bicolor
  Clone ID: SORBI-28MAY03-CLUS59868_1
gcacgaggggatagagctgaacgagtacctgaagccttatggcctatgctcgccgcgtgttccagggcctggggccaccattggaggaatgtgtgctactcgctgttctggttcattagctgtgaggtatggaacaatgcgggataatgtgattaatcttcgggctgttttgccaaatggtgatgttgtgaagacaggctcccgggctcgaaagagtgcagctgggtatgaccttgctcgtttgatcattgggagtgaaggaactttgggtgtaattacagaagtgactttacgactccaaaagcttccatctcattctgtggttgcaatgtgcaattttaaaacaattaaggatgctgctgatgttgctattgcaacaatgctttctgggatacaggtttcaagagtggaattgttggatgaggttcagataaaggcaataaacatggcaaatggcaaaaatttgcctgaagtgccgaccttgatgtttgaattcatagggacagaagcatatgctcttgaacaaactctcttggttcaaaaaattgccaacaaacaccatggatca

SEQ ID NO: 3556 - DNA, 795 bp, Sorghum bicolor
  Clone ID: SORBI-28MAY03-CLUS59886_1
gcacgaggctgctttcaaggatggaaaggcaccaatggatccatcaaccttggtcaaggcagaggacatggatgcgtatgcccctaaagatcttctggttgtcactacgggttcacaaggagagccacgtgcagctctgaatcttgcatcttatgggggaagtcatgctcttaaactatcaaaagaggatgtccttctttattcagctaaggctcgtcctggaaacgagacgcgggtaatgaagatgatgaatcgtctcactgatcttggcccaaaaattatcatgggtaaagattctggcctgcatacctctgggcatgcctaccgagaggagctggaggaagtccttcggattgttaaaccacaacatttcttgcctgttcatggagaactcctatttctcaaagaacatgaattgcttggaagatcaactggcataaggcacacaactgtaataaaaaatggagagatgcttggtgtgtcacatctaagaagcagaagagttttgtccaatggatttgtttcattagggaaggaggatcttcagctcatgtatagtgatggggacaaggcttttggtacatccactgatctctgcattgatgagagactaagaattgcatctgatggcattatttttgtcagcatggagatcttccgacctcagaaggaacatggtttagcgcaatcaggtttgacaggaaaatttaagattactacaagatgtctatggcttgataatggaagattgttggacgcactctacaaagcagctcatgctgcattgtcaagctg

SEQ ID NO: 3557 - DNA, 586 bp, Sorghum bicolor
  Clone ID: SORBI-28MAY03-CLUS59895_1
gcacgagggaggaccaattttggcgcaggaagcaatgattcagtgagataccctgatgacccatttgatagaatctgggaatctgattctgtgaggagagcaaattaccttgttgatgttgctccagggactgaaagaatatcaactacaaaacccatattcgtcggtaccaacgaagaaccacctgagaaggtcatgcagacagcagtagttggccaggatgggtcattgaactaccgccttgatttggaaggtttcccagcaaatgcttggggagtctcatattttgcagaaattgaagatttggcaccaaacgaaacaaggaaatttaagttagaggtccctggcatgccagcactcagtaaaccaactgtggatgtggaggagaatgctcaagggaaatatcgtttgtatgaaccgggctacacgaatttgacacttccgtttgttttctcgtttgggttcaggaagacaaatgattcttcaaagggacctattttgaatgccctggagatttacaaatatgtccaaattactattggatcacaagatgcaaatatcatggccaccatggtatcacgatatc

SEQ ID NO: 3558 - DNA, 1004 bp, Sorghum bicolor
  Clone ID: SORBI-28MAY03-CLUS59891_1
aacccccccacccaaatcaatctccgactcacggctggctcagctgcacgctgttggccggaggagcaccggcgccaggctcgccgacggaactgcaggccgctctgcctgcgctgagccactgcagccagccaccacgcttctccaccgcccggccaccgagttcttcacctcctccacgcccacgcccacggagaagacaaggcagcagcagggaggtcaacggcagcggcaacggcaacggcgtggagctgccggctgcgtctgcggccctcgccctccaggctccgcggcgctcacgttcacctcctggctccctccctccctcagtctgctgctgcatcgtcgggtcgggcttgggccccgctgtttttgctactgtcggccgggttctccatggcccgaccccaacttttgtcagctgtaaatgcccggggccccgcctgccgctgcctcggcggggaccaacaatcgcagaatccgagtgaaagcgaacatgatgactgcctcttgctacgtctgccgatccgtcgtccgtgctcctccgctcaagtccaggactgcagtgcgctgccaaagcgccgcgccgccaggtgccacctccacctccaagcttgtcctagaggtgaaagaacggctagcgagggagcacccaggcctccccactggcaggaacgggagagacgatgacgacatggtcctctggttcttgaaggaccgcaaattctctgtcgatgaagccgtccccaagctcaccaaggcgattgagtttggtgtttcagaattatcagaagaatcagtgaaaggcctctaccaaactggcaaggcatatgtacatgattctttggacgtttatggccgacctgtgctggttgtagtggcagccaaacattttccttcgacacaggatccagttgaaaaccagaagctctgtgcctatttggttgagaaggcagtaagcagacttccctcaggagcagagaatatacttgggatctttgatc

SEQ ID NO: 3559 - DNA, 521 bp, Sorghum bicolor
  Clone ID: SORBI-28MAY03-CLUS5995_1
ccaacgcgtggaaagggaagcctgaccgatatggtgcacctgtgtcctcttcaggcagcaaaaagagaaaggccccttctaagaaaacaaaatgtaaaagtgctgcagagagttgcttgcctgaaaaacctcttgcgaaagttgcttggtttagggttattcttgatgaagcacaaagtattaagaattaccgaactcaggttgccagggcttgctggggtttgagagccaaaagaagatggtgtttgtctgggacgcctatacagaatgctgttgaggatctctatagctatttcaggtttctcagatacgatccctatgctgtatataagcagttttgcactatgataaagattccaatcagtaggaacccaactaatggttacaagaagcttcaagttgttttgaagacggtaatgctacgccggactaaagcaaccatgcttgatgggaaaccaatcatatccttaccgcccaagactgtttcacttaagacagtggacttcactggcgaagagcgt

SEQ ID NO: 3560 - DNA, 627 bp, Sorghum bicolor
  unsure (1)..(627): unsure at all n locations
  Clone ID: SORBI-28MAY03-CLUS59488_1
gcacgaggccaaggcccaattccatccccacactggcccggcgtcttctccgatagcttttctctgctttcctctacaatcttcccaggtttccctgaccaaagatggctgaatcctttgttctcaataccggcgcgaggatcccatcggttgggcttggcgtatggcaaatacaacctgacgctgctgtcaacgccatctacgctgctgtcaaggctgggtatcggcatatcgattgtgctccagcatacagcaatgagaaggaggtgggtttggctttgaagaaattatttgaagatggtgtggttaagcgtgatgatttgtttatcacctcttggctatggtctgctaatcatgcacctgaagatgtgaaagagggatttgataccacacttcaagatttgcagcttgactacttagatttgtacctcatccatggtccaatccgtatcanaaaaggaactagcattacgagccctgaaaattttatccctacagatatccctactacatgggcagcaatggagaagttatacgaatctggcaaagctcgtgcaatcggcgtgagtaatttttcttgtaagaagctggatgatttgtttgccgttgctcgagtgcctccagcag

SEQ ID NO: 3561 - DNA, 644 bp, Sorghum bicolor
  Clone ID: SORBI-28MAY03-CLUS5950_1
tggagtgttagctcgctcgctcccatttccgtctctcccctccctgttccctccgctcgatccaaaccctaggcttggcgtgtgctactccactccagaacccgcccgaacctccgctcttctcgcccgagtggcgagtgccacaccgcggtggcaatggattcgacggggaagaccacggagcctccccagctatcgccgcaagcggcatccgcggcccagatctccgcggtgctaggcaacgacgacatcctccgcgagatcctcctccgcctcgacttccccacctgcctcgtccgcgccgcggccgtctccaagcgctggctcaggcacgcctccgaccccgcattcctccgccgcttccgccgcctccacccgccccgcctcctcgggttctacctcgacaccagcaactcctggctgcgcttcataccgctcccacagcccccggagctggccgcggtcatccgccgcggaaattttgatttcggcagaggcgctggacacgtgtccgactgccacaatggccgcctcatcgtctacatcgatgaccgccccggcaaaacaacggtgtgcagaccgctgcaccctgtgagaggagccacagtccttccactgccccagatcccttccgtgggtcatga

SEQ ID NO: 3562 - DNA, 536 bp, Sorghum bicolor
  Clone ID: SORBI-28MAY03-CLUS59504_1
catatcactcacacaagcaggcagaacgccccacggccatacagcaaaatcatacacataggcatcattagcagctttgcttggtttctgattaggttgtttagttagttcgagtagttgcgctctctaccaggagcaataatggctgctgcacctgcgcgcttcatcttctccttctcctccgtggagccccttctcattgcagcttcgccggcagcagctagaaacagccggcaaggccgccaccgtggccgattcatccgccctttggcggcatccagcacgctgctgcgcaatgattttgatctccaggagggcctgacggacgtccaaaagatcctgcatcaacgtcagaagagcggccgggagatgatggtcaccatcgataacctcaagcgcctctgcgtcgaccactacttcgaagaagagatcgagagcgccatgagtgtttgcatgaatctcgtccacagcaatgatctcttcgatgcaacccttgcattcaggctcctgagagaggcaggctatgatgtttcagc

SEQ ID NO: 3563 - DNA, 959 bp, Sorghum bicolor
  Clone ID: SORBI-28MAY03-CLUS5955_1
ggagttcgtaggcatggaagaggaaattgggatgctatgcttagagatccaaagttgaagtttttgaacaaccgaactagtgaagagctggcctcaagatggattttggaggagcaaaagattattgatgaacctatgtctacagccaccagacgttctaactcaacagctttcccgggaatatctgatgcaatgatgtctcgggcgctgaatgaaagtaatttctctaaaatgaggatggagcagcctaaattgcagtcccacttaactgatattcagttaggttctagtgatatcctatccagatttccacatattgaggctgctaattacattaactcaggggagggtggcacacctcagataccatggcaggatttcaagcatagatcaagttatggtggagattttcatggcggagcatttgacaagttggagaaacctgatgttggaccgatcccgccatttatgccaaatcctttcatgactgatagcattggttcgcttcccataaacagaaaaaacaatagttccattccacatagtgaaatcagatcaagttctcgtgagaacattcatctttctggtgtttcggatggacagatcaacttgcttcatgagatgcagcgtcgtgtgaggtcaggcaaacaacccatggagatgaatctcaaccacatagaccactcaaattctcagcttgataatactagtgacctcggaggtttaaaatcaaacaagttacctcattggcttcaggaggctgtacgtgctccttcatctaagccacctgaacgagagctaccagcaactgtttcagcaattgctcagtccgtatgccttcttcttggagaacaagaaccatcaatacctccattcttgatcccggaagcccctctttctcgcccaaaagatccaaggattaattcaaagaaaaggaaactccgcaaagctcagcaatc

SEQ ID NO: 3564 - DNA, 681 bp, Sorghum bicolor
  Clone ID: SORBI-28MAY03-CLUS61610_1
aactgatgcagattcagaagattggttagcaagaacattaggttacatcaatgccaatgaaaaggagggtgtctcgggtattgtagatcctacccttgttgtggatgaagaccacctagaagaagtatgggcagtggccatcgtcgcaaagacatgcctgaatccaaagccctctaggcgtccactcgctcgttacatcttgaaagcactggagaacccactaagggtggtgcgtgagcaggaagagctccaatccaacgcatctcatctcagaagtaccccatctcaggggtcttggcgttttgccttccatgggaacaagtaccatggctgggaggtcatgccagcgtcggggcaggcacttgctgggaaaaatacagcgaagtctcagggaaccgaggcaagtgacgaggacgaagagaattcattctcattcaagagggcttcacgggaaaatttcccagatcccatagagtttgaagaaagtgttgttgtgtaggagtacccgcagattagctatacttagtgtgcatctctttgatgcctctaggtgaaaagttgtgtatacagaatagatctttcttttttctttctctttccctccctgtctcagtcatttgaaatagaataaatggcgcactgggtgtgcgatccttgaaatgcaagcccagtaaaattttc

SEQ ID NO: 3565 - DNA, 632 bp, Sorghum bicolor
  unsure (1)..(632): unsure at all n locations
  Clone ID: SORBI-28MAY03-CLUS6001_1
gccaagaaagacacagctgngaagcatgcccttcaagttcnnntcctttttgtctgccaactatgtcctgtttttcaaattgtacaagatggcacccaacttgaactcatgtcttatggatctctatgtggagcaaatgcgctttgcggctataaaatgcatgtccaagtcatatcgcccaactgtaccagttagatacgctgcacgggttttgggatttgtgggagttgataaagtttgtgaggctctggaagaatgcgaggaatggttaaaagcacatggtgctattctttccgtagataacaatggagaattacaaatagacacaaaggtttcttctacttctttgtacttgccggaacctgagaatgctgtttctcatggtgatgcatctctggctgtggatgactttttgacacgagcatcataaaatatatgttctggtgagtgcccccctgcccccctctttttgcactggtctttggaggtgctgtacaattgcatgtttgccaataccagtagaggtaagttctctttatgcaaagtagaaactcgaaagatagatgaaagaagcccactgttacatcaaacaaataggtatccaggacagaatacatgcaagtaggggtaac

SEQ ID NO: 3566 - DNA, 807 bp, Sorghum bicolor
  unsure (1)..(807): unsure at all n locations
  Clone ID: SORBI-28MAY03-CLUS60015_1
aaaacagaagttttaatttttaaagccacactggggtctcgcctgcttggctcctgtaaactgcagtttttacatcctctcatctcccgcgtgctgatacttgcctgctatccctgctgttaacgacgacgttcgccgtagcagcgaaggagcctcgccggctcgaagcaaggctgtcctagccaccatggccgtgtccggcgagaagcggcccccgccgccggccccggcctccggcggaacggcaaggaagaagcttatcctagcactgtttatctgtttctcggcgctgctgtacaagcagattcttcagccaccactgcccaagatcgccggctcgccgggcggccctccggtcacggcaaccaggacacggctcagcgacggcaggtacctggcctatctggaacacggcgtccccaaggagaaggccaagtacaagatcatctttgtccatggattcgactcgtgcagatacgacgcgcttccaatctccacggagcttgcacaagagctgggcgtttacctgttgtcctttgatcgccccggctacgccgagagcgacccgcacccgggcaggaccgagaagagcatcgccctcgacatcgccgagctcgccgacaacctgcagctcggcctcaagttctacctcgttggcttctccatgggcggcgagatcatgtggagctgcctcaagcacatcccacacaggctctccggcgtggccattctcgggccggtgggcaactactggtggtccggcttgccggcgaacgtgtcncgggacgcctggtaccagcagctccc

SEQ ID NO: 3567 - DNA, 851 bp, Sorghum bicolor
  Clone ID: SORBI-28MAY03-CLUS6004_1
tcaaaagctagcagaatctcccaatcccaagtgctctcatccctggctatcagatctaggctcaagctctggtgtgcactacatctgagctccacaaagatctgatctgcccagtacttggcattggaaactatactgaagaaaactttatttgtccgagttccaggaactgaaggtataccaactagaaagacaatcgctttagtgcttgactctggcccactgcacctgggagctaggtgtcctcaattggcttcaaatgatatgaagaattctctgcgcgcctgtgtagtgcaatgctttgatctttgaggcataggagtatggaatttcagattccagaagaacagacgtttgtggtctgttgttcaatcaacatgatgggccagctcgtcatctcgtcagtcacaattcacatgacgctcgtctgtgtctatgcaatttcgttgtgtgtatatcaaaatagaacatgaagcaatgataatcctaatgcaggccaaggggtttggccagttatggataaaatggatgagaaaaatctttgagtccgatacttctgcagttttactgaatggggtgccagggaagacttttaattgcaaaaggggagtcagacaaggggatcccttatcccccttattatttgtcctggcagcagatttccttcagtctttggtcaataaagggaaggatttaggtctgctaagattgccctttcccttaaattctaatctggacttccccatagtgcaatacgctgatgataccttgataatcatggagacagactcaagacagttaatgtttcttaaatctctgcttaacacctttgccaattgtactggcctgaa

SEQ ID NO: 3568 - DNA, 1007 bp, Sorghum bicolor
  Clone ID: SORBI-28MAY03-CLUS60081_1
gcacgagggtttgttgggtactgtgctgaaacacatgaagaggttttgcatcaaaaagggaaatatatttttgcagaaaaacgagaaaggttgctttgcttcgagtatttgcataatggaagccttcacaagcatattactgctggaccatgtgggcttccatggcgtgtttgttaccaaataataaaaggaatttgtctgggcttgcactatctccacgagaagcacataattcatttagatctcaagccagacaatatattgcttgacgatggcatgatacctaaaattgcagattttggtttgtcaaggctgttgggggaaaaaagccgcacaatcacacaactaagactcggaacaccgtaagataagtatataccaaaaaattagggatattatcatcgcaggttgtttttaaatcaaagatatcaaaatgttttttctttggggtaaaccgtgacattatcagtgttcatgcgcgcgggggttacatggcacctgagtatatagatgatggagtgatcacaatcaagtcagacatatatagcttgggtgtgataatcagacacatgatgatgggacgtaactcaggagataccactgatcaagatatactggagagctggatgattaggctggaaaaggattcatcacaaatgaggcagcagacgcaattattggaaataggctacaaagagcaaataaaagcgtgcatcgagatgttacatagatgcacgcggcctaaaccaaaggacaggccaacgatagaggatatcctacttacactggaggaaacagaagctagggtcaaattggtcgctgggcctacttcaaatactgttcagcttgagcttgccaaatttgggccatggggtggagatggagggaagccacgagacatcaaaatggtgccttacctcttggacacataacaattagcagtggaactattatcgattctattgggttttcatacactgaccactatggacagtaccacactatag

SEQ ID NO: 3569 - DNA, 442 bp, Sorghum bicolor
  Clone ID: SORBI-28MAY03-CLUS60119_1
gcacgaggatttattgtgaggtggaatgcacatgtggatgccagctttgttttaattgctccttacaagcacactcaccatgttcctgcatgatgtgggagctctggatccagaaatgccgtgatgaatcagaaacagtgaattggataacagtaaatactaagccctgtcccaagtgtcacaaacctgtggagaagaatggtggctgcaacctggttgcatgtatatgtggacaagcattctgttggttatgtgggggggctacaggtagagatcacacatggtcaagtattagtggccacagttgtggccggttcactgatgatcagactaagaagacggaacaagcaaggcgagacctgtacagatatatgcactaccacaacagatacaaggctcacactgactctcttaagcaggaagcaaagctaaagaatgagat

SEQ ID NO: 3570 - DNA, 537 bp, Sorghum bicolor
  unsure (1)..(537): unsure at all n locations
  Clone ID: SORBI-28MAY03-CLUS6002_1
ataagtagtaagcccaccccaagatgagtgctctctcagtttagcttaagcgtgctgacaattctcagttaagttgtcgtaacattcaaggttcagctgacatgcacactacaacatatatttagcttaaattaccccctatctgttgctatcatgggctcatgctgcacaaccaccacagtacacattatataaatgatgggaaggggaagatacaatgtttacttccttatgattgttgcccaaatttctctactgtaaacactacacagcagaagatttgcttggcttcaggcggatttgatgaaccatagaacattgcgacataggccgaggctgcacaatactgctggtcgtcggacaagcaccgcgaggtcaagataccggtctgaggagcttgtggctgctgctgctgagtctgtgtctgcactaactctgcaagaaccagatgttacatcctcagaggatttgattgaagtngtgtcatcagaggaacttatcactgtcagtccacaaacacttgcggcgcataacact

SEQ ID NO: 3571 - DNA, 353 bp, Sorghum bicolor
  Clone ID: SORBI-28MAY03-CLUS63755_1
gtggtggtgttcacgtatggctatatttggttggcttggagttggtcaaggaactgaccaggccaaatggttgtgcgggatttgaggataggttttgcatgccgtgtccatgttgggcatcacaggggtgttgtgcctgtccataaaaagagaacgaggtgtgcaagtcgaggtttcagtggagaatttcagaagtagccgagtgcaaccccagagaaaaagagaggcagtgtaggctgggtttagccaacagttgttgcagtgctttgggattttgtgtagaatccttttgtggatgcttataagttgcatcttgtgaacccattatcaaagtaatgaagtccagttctctc

SEQ ID NO: 3572 - DNA, 630 bp, Sorghum bicolor
  Clone ID: SORBI-28MAY03-CLUS63826_1
cttgatagagttgtaaactgaacctcttattcggttttaacgtggaaatctcagggcatgggaggcaatttgaattgagtgcaacagttggtggctttgttagtctgtgatggagatgcacttgcctgggtgtaatgatgagatctgccatagtatatggaatggacattttacaatgtaactagtcttgacaacagcatccagcagactaatctctcttagtgtctgaagaacgatagtcaaacgatgacgggttttgatttgtgatgtgaatattgggatttgggtggagttgaggggagctggagcagctaaagccttggtttgaagaggtaaaatgtagaattgtatgtaggaaaaaaaatgtacagttgctaacacaatgtgctgtagtcccttggcacaagctggggaggactaatggagcttctggtacaattttacgcaatttcatggaaggcttacagatgggttagttaggcatgtagtgtgatacaattatcgtttctgttcacccgagccattttttttgaagagaaatcaatgtgacgagcagctaagtggtgatgttacccttatatatctgtgtatgtgcggtgtgtaactgggtgatggtgatggtgtgtggtc

SEQ ID NO: 3573 - DNA, 735 bp, Sorghum bicolor
  Clone ID: SORBI-28MAY03-CLUS63858_1
tgttgtacattctccaatggggaatacgtgaaagctggtctgtcattgttggagaaatggattactgatgtcacagaggagtttgcgggtacatcttggcatgagctaaattatatcagagaagctgttggatttttggttatacaccaaaagagaaaaaagacgcttcaggagatcaggcaagatctttgcccgtccttgagtgttcgccaaatctatagaatatgctcgatgtattgggatgacaaatacaatacccaaggcatttcaactgaggtggttgctgcaatgcgggaggtggttaacaaagatacgcagaatcttctgtcaaattccttcttgttggatgatgacttaagtataccattctccaccgaggatctgtcaatggctatcccggcaatagattatgctgacgttgatcttccagaatgtcttcagcactacacatcagtacagtttctaataaggcagcaggatctacagcctgcccaatagaatgaatgttgtcaggctgacctgaagatttgtctgtcccctggttttattggggttacatccatctgcgatgttgtattgttgtttagagttcctagattggtggagagaagtggacttttacagttgaaaagcaaccattgttgctagatgcatcattcgttgtacagggaatgttgtaattctgttgactgtcgtaaaatgattagtatatcagtggcaaattgggcaatgtgc

SEQ ID NO: 3574 - DNA, 608 bp, Sorghum bicolor
  Clone ID: SORBI-28MAY03-CLUS63861_1
acatcatcgaccctgccctagacagcgtgaagaagctgctaaacctagatcagccttctgggccaacgaggcaagatgatgttaaaagcactgccaggagttctgcagctagggagtcttcagaaacctctgcggctgtaggttcagatacccctggccttacgagcaatgatgctggtaacaacgggagggaagcaactaggactccaacaaatgatttcgatttggatcgtttcatcaaaaagaggctggccctcgacccggcggagctggatgccgtgctcgagggctctgacccgaggggtgttgtttctcagaggaggaaacagcggctgcccaggaagccactccctgtcccgtaatccagatcggtctgtctcatttccaccggtaaaatccactaacagtagcaggtatacgtggatatgtgtgaggagaggacgacccctgccgctgccatagcaatcacctgttaattgtcattccaggcacgtgtatgtaattctgccaccatttgtagtataagtctagctctgtacataaattagactctctttatctacataattcccccgagtaattagtcgagaaatattctgataaatgcc

SEQ ID NO: 3575 - DNA, 480 bp, Sorghum bicolor
  unsure (1)..(480): unsure at all n locations
  Clone ID: SORBI-28MAY03-CLUS60241_1
gcacgaggatgcccgcccgggtggtgtacctcggcgaggccgagctcgtccccgaccgcgacgacagggtgctcgagctcgagatcgtcaggaagctcgcggccggatgcgccgaggccgggaggagcatctccctcgcgctcgaggcctttccctgcgacctccaggagcagctcaaccagttcatggatggcagaattgatggcagtagcttgaggctttatacatctcactgggcaccagagcgatggcaggagtatgaacccattttgaattactgccgtgataatggaataaaacttgttgcatgtggaactccacttgaggtggtaagaactgtgcaagcggaaggaattagaagcctttcaaaagctcaaagaaagctttatgctcctccagctggctcaggcttcatttctggttttacatccatctcaggccgatcgttgatagacaaaatttcatcanatcgtggttccc

SEQ ID NO: 3576 - DNA, 832 bp, Sorghum bicolor
  unsure (1)..(832): unsure at all n locations
  Clone ID: SORBI-28MAY03-CLUS60307_1
tgcaacaaggacacccattagctttcatcagcaaacctctaggtccgcgtactcaaggtctctcgacatatgagaaagagtacatggccattctactggcagttgagcaatggcgtgcctatctacagcatgctgagttcctcatatatacagatcagaaaagcttagtccatctaaatgagcagcgcttacacactgtgtggcaacaaaaggttttcactaagttgcttggcgtccaggataagattgtctacaagaagggacaagacaatcgcgtagctgatgcgttatcacggcgaccacattcctctgaaacctgcatggccatctccacagtggttcctcagtggtgctctacagtggtggctggatactcatctgatccacaagcttcaacgtacattactcaactctctgttgacccaggcgcagtcccacacttcacattgcaaaatggcctgctcaggtacaagaaccgtatctggctcggtaacaacaaagttatgcaacagagagtcattcaagcacttcacacgtcagcagttggtggccactctggcgttcctgttacctgccgccgcgttcgtcagctttttgcttggcctggcttaaaaaatgatatatatgagtttgtcaccagttgtcctacgtgtcagcagtcaaaaccagatagagcgcgctaccctgggttactacaaccactgccagtaccatcatctgcttggcaatccatctcaatggactttgttgaagggcttccggtttctcatggctatnattgtatcatggttattgttgacaggttctccaaatatagccatttcctcacact

SEQ ID NO: 3577 - DNA, 660 bp, Sorghum bicolor
  Clone ID: SORBI-28MAY03-CLUS60351_1
gccgtccgggcgggtcgcggcgcggcggccccggcggccgaacccctcgcgctcgcgggcgcgagcggggctgggcgcccgcgccgctccggcccgcgcgcccgccccctgcgcgtgcgcggtccggaggcgggcgagccgccggtcctgctccgccgggcgctcgcgccccgtgctgcgcctgggtccccttgcgatccgcgatccgcgcttcgcccggccactgggccgcggtctgcgcctgggtgccctctccgcgttcagtcttcccatcgcgctgcccctggggcttgggatttgagacagccgcttccctgggtccagctctgtttgccgcttctgcggcccagctgccaggtccccctacaggtgggcgcctgcgcgcccggccttgcttttcgccctggtgcagtggagcggctaccacggcggcgctgacggcggcgcgcctgagccctgatggccaccgccgcgctgtcggcggcgcgcctgcgcccaatgggccggcggccactgttggcgcggtcctctgcgtgcaatggtccggcctccgccgctggacaagtggagtgacagtgaagttgactccatgatagaagttggtgggaattctcaggcaaatgcaatatatgaggcttttctgccagagggctaccagaa

SEQ ID NO: 3578 - DNA, 658 bp, Sorghum bicolor
  Clone ID: SORBI-28MAY03-CLUS60316_1
tggcatgaagatgcagggttataatggcagccaactttgggatacagcttttgcagttcaagccattgtggctaccaaccttattgaagagtttggtcccacccttaaactagcacacaactatatcaagagctcgcgggttcttgatgactgccctggtgatctggatgactggtaccgccacacatctaaaggtgcatggccattctcaactgctgatcatggttggcctatatctgattgcactgctgaaggactaaaggcttcattattgttatcaaagatctctcccaaaattgttggtgaaccggtggaagctaatagattttatgatgctgtcagttgtctaatgtcttatatgaatgataatggtggtttcgcgacatatgaactcacaagatcttatccctggctggagcttatcaatcctgctgagacctttggggatattgtgattgattacccgtatgttgaatgtacatcagcagcaattcaggccttgacatcattcaaaaaactataccctgggcaccgcaggaaagaggtggatagctgtgtcagcaaagcttctaatttcattgagagtattcagaaaagtgatggttcatggtatggctcttgggctgtttgtttcacatacggcacttggtttggtgtg

SEQ ID NO: 3579 - DNA, 801 bp, Sorghum bicolor
  Clone ID: SORBI-28MAY03-CLUS60368_1
gcacgaggatgatacccaggatagtcagctgggattgagaaaaacgagaggggctggcaagagtagaagattcgactatattgatcagaagagtgacaatgattatgatgcctctccctatgaagggttccgcaagcgtggggcaagcatgaggaaaccggaccagagaagaaccactgccaggagcagaggctttgacgatctggaggatgattacaatgcctctccctatgaagggttccgcaagcgtggggcaagcatgaggaaaccggaccagagaagaaccactgccaagagcagtggctttgacgatctggaggatggtctccttactgccaagagtagaagggctaaggaagacgaggatgacgaagtcttgccgtacgaaggtgtgcgcaagcatgttgtgagcagaagggcaacgccttctcagaggaggttcacggctgcccgtaaccagtaataatacccgaacttggagctttgatgactccgttctgtaacatatttcacggttgcatacttggttgagcaaccataatttcattattcaggccattaccataacaattggatatatctttctcagaagtatgacatttgtaatctagaaagaattttgacagcgtcgctcgctctgctgtggtgcagatgagggacacaagcatgttcgatttgtagtgttattatacagattattagggaaaccacattgatacaactagctttttacaaggatttgtttgtcgtcacttctgtgtgacgagatatatgatgatcatgttgaacttgttttgcttt

SEQ ID NO: 3580 - DNA, 661 bp, Sorghum bicolor
  Clone ID: SORBI-28MAY03-CLUS60376_1
gcacgaggaagaaccccacctggccaccttccccgagcccgcgactgacggctcagcttccgcgcggcacggtcaaacggacaccgcaggcggcaggccggccgaagagcacaagcgagcaagtccaaaccggaagaggcgatcgctagccgcgagtgcggggcggccatcatcatggcggcgagcgcgagggggagcgtgtgggagatccagccgcgcgacgtggaggcggcggggctcgccgcagccgacgcggccgcgttcgtcgccgcgctccgctccgccgcggccgccgcgggctcgggagccacgcgggacgccgtgtgggcggcggttgcggcggcgggggtgctgcggccggagcacccgcacgcgctccaccagctcgtctactactccacctacgctgggtgggaccgcgacgcccggggcccgccgccgtactggttcccgtctccaattgactgtaagcaaacaaacctggggagattgatggaagcaaatggaccaaagctgttaggatcatcatacaaggaccctatatcaagtcttagccacttttacaggttttccgtagagaaccaagaggtctactggtcaatggtgctaaagcaactagcagtgaattttaaacaagaaccaagggcaattctgagtacat

SEQ ID NO: 3581 - DNA, 1110 bp, Sorghum bicolor
  Clone ID: SORBI-28MAY03-CLUS59950_1
gcacgagggaggaatgcatggaaagactacttcctccagaagagtcaaagtcactagattatgataaactgtataaaggcctggaggtgctagctgattttgagaagcttgcaaattctagggttgttgactctggtgtcctgaggggaatgaatgtagaagacatcaggaaagctggggagcggcttattctccaaggtggctgtaaaaatttctttcagaagattgtaaaaacaagggagaacctcaatttggatatccatattctttcctattgctggtgtgcagaacttataagatccgccttctcatcagccggttgtctggatggtttgaacatacattcgaatgagtttgcctttgaggaatctgtttcaactggtgagattgacagaaagatgcagtctccgctagacaaagttgaaaagttcaagagcatcagaagcgacgttgacagtacagtgccatccctgtctgtttatattggagattcagttggagatttgctctgcttattggaggcagatattggtatcgtcattgggtcaagcacaatcttgcgtagagtgggcaaacagtttggtgtttcttttgtcccattgttccctggtctagtagataagcagaggcaactgacagaggaagatgcttccgtgttgaaggcacggtctggagtcctttatacagtttctagctggtcagaaatacacgccttcatactgggaagtgatttcagctgatggatgttctgcttcttttctccatttttttccccttaagaagcaaacacttttgccggttgatgctgatgcacatgatacgtgaatccccaatgtggtcattttatgaaagccacatgtcaattctggctaccagtatgtatgaatgaataccaataccagtttgtggtgtggaatgggtcaagtatgtaccccacgaattgtgatcaatgtttcattgattcgtccttattccatttgggactaatttctgggtggttgctggcattatactgcagcaactacagtataaatatagagtggtatatatcccaagtccaagtgtaacgacgactgcatatatttagagatttgtttttaaattggcaat

SEQ ID NO: 3582 - DNA, 1087 bp, Sorghum bicolor
  Clone ID: SORBI-28MAY03-CLUS59961_1
acgctccactccctcagccgccatcctactgccttccctcctcctcatcttccttgcgggggcggcaaccaggccacaggcggcagactgacgccgcgcacctgctcccactcccgctcacgctcctcccaccgcgccaccaaaataaaagtagccgttgcggcgtcgcgtcggcgagcacagcacagcggctcggctgcatgagggggcggctgcggaggccgtgacgaggaggcggagaacgatgccgctggtcaggttcgaggtgcggaatgaggtggggctgggggaccccggcctctacggcggcggagccgctgcagccggggtcgccgccgtggcggggaacaggggagccactgcctccgccgccgccgcgggggaagaggagcccaaggcgctgctcgagggcgtcgccgtcgcggggctcgtcgggatcctgcgccagctcggagatctcgcggaatttgcggctgatgttttccgcgcgcggcacgagcaagttatagctacgtctgccaggggtcgtaaggtgctgactcgagtacagaacattgaagcagcacttccatctcttgaaaaagctgtgaagaatcagaagagtcacatacattttgcctatgttccgggctctgattggcacactcagcttcaaaatgagcaaaatcacctgctagcgagtgatctgcctcgttttatgatggattcctatgaagaatgccgagatccaccacggctttaccttctcgataagtaagtgcgggaactttccttaataaacattttttggtatctaaattactgccttccagatttgatactgctggcgcgggggcttgtgtaaagagatattctgatccatcctatttcaagaaagcatgggatatgacgagagcagacaaaactgctaatctacaaagagaaaagagatcgcagaaaattaagagaaaaggatcacgactaagggagccatatcatgggcaagccacatctaggcataggggcactgaatttcagcgatcacttactgctggccaacttgttaacaggcagtttgcatctcccagcaacgatggtcagagcatct

SEQ ID NO: 3583 - DNA, 973 bp, Sorghum bicolor
  unsure (1)..(973): unsure at all n locations
  Clone ID: SORBI-28MAY03-CLUS59975_1
gcacgaggggaagaaggcatgggaaatgttcatgttgctcttcgatacttgcatgaagcactgaagtgcaacaagagattgctaggagctgatcacatccagactgctgcaagctaccatgccatagccatagccctttcaatgatggacgcgtactccctaagcgtgcaacatgagcaaacaacattgcagatacttcaggagaaactagggcaagatgacctccgaactcaggatgctgctgcatggctagaatattttgagtcaaaagcattagagcaacaagaggccgctcgaagaggcatgccaaaacctgattcatctattgcaagtaaaggacatcttagtgtatcagatcttcttgacttcataagcccagaccaggaaagaaaagaaagagatatgcaaaggaagtgcaggcgtgcaaagaataatatcagagcgcaccagggtgaatcagttgaagagaaggagaatttccagcatgactcaggatctcctcttgaagcaagcaaagacggttttcaagaagaaaaactggatgtgcatcctcctgctgtattagaagaaaattatgctgcccatgacgagcagaagcagtgtgatgttttatcaccagaagaatattctgatgaagggtggcaagcagctagtatgagaggaagatccgcaaatgtaaggaagaaaagcagtcgcaggaaaccggctcttatgaaattaatggttgatcgttttgaagatggccatacaggttctgtatataggactagtttgcagcctcaaacaaaaggagacaaagaagattctgtaagtgctcctagccagctttcatttggtagttttttaaaaaccgacaaggttaatggggatcccagcattgctgaagataaatcttgcaatggtagcactaaagcagaacaacgtancaagccaacaggaattaacaggccaaccaacattgctttcaagttta

SEQ ID NO: 3584 - DNA, 1097 bp, Sorghum bicolor
  unsure (1)..(1097): unsure at all n locations
  Clone ID: SORBI-28MAY03-CLUS59980_1
gcacgaggtgggcattgtattaatgtgttttctctccaaaagagaggagaaaggaaatattgatcctgtcctgtgttttctctccaaaagagaggagaaaggaaatattgatcctgtccactcttcgtttggggtgatgttgaagtatattgttgcccctctcatggaccaaaggattcttcttattatccctcttatagtatatataggtctgcaacatgcgtttgtctgggctgtattcacaaagaatattgtaaaacctgtccttggcatatctggagttggtggagctatggcaatctatggtgctgcggatgcaatctgtgcattggttactggatgtttgacctctggactttattccgctacattcatagtgtcgattggaactgttgtccagggtgtagtcctattctggttgcttcttttttatagcccaactgttggagtgcttggcacagcagctccgctactcataggtgccttatggggtgttggtgatgggatgttgaatacagtattaaacacagttctcggattgctgtttgaagatgccaaggaggctgcctttgcacagtgcaaggtctgggaatgcgctgctgttgccattatcttcttcttgagcccaaacatcacgctacaagccatgctcatcataatgacgacagccctcttcatctcatgtggcgcattcctgttcctcacaattgtcatcgataagccatcgaccgtcagatcctgaggcaggtgtccatccttgcatcttcgtcagttctatcagcagcttggagtgcctcatactgtgtctgtgttcacagctgacatgagaggaaaatgtccctcccgccaaatgtgagttgtgacatcgtatttcatcgccttgttatatcgaactaaccattgctgaacaactgatgtaaaagttgcagtgctcaactgaagttgtagtggtgaaaagacagggaagatgaaaatcggcttgatattgggttgataagatgtggtgctttgagttgggaaatcttgaatatgttgtacggagtattagacaaatacatggactttcttacactacagaagtgntatatctatttttt

SEQ ID NO: 3585 - DNA, 547 bp, Sorghum bicolor
  unsure (1)..(547): unsure at all n locations
  Clone ID: SORBI-28MAY03-CLUS60008_1
gcacgaggcagtgagcacaaaaagatgtgacatatctttcattttagattctatggccatgaaaatttacagagacatgtgcaaacatatgatacatttgtggatctaaggtattgtcaattggagttgtggattgcccagaatatgcatgccaatcgttaagggtgttgctgcatagatgcaggagcagcaagcacaacgatatcaataactttggcaccatggctcctatgaccaaactgatttgtggaggtgtgtacaacatcaagagctatatcattatcaaagggtttgatgactagaggcctgtatcactgggaaagtgaacggtaaccggcggcatcattgctgtccaaaaaggacagcaacacaattgcagggatacatcaccgaaattcgatcaaactcggattatggctcatgatttatgtaaaagaacatatatataggatggggacagcggagagggcctcacatcatggttcatgcttgccagngatgagctcgatggcgtccaacactgatgatggacagcaaagcggttgac

SEQ ID NO: 3586 - DNA, 658 bp, Sorghum bicolor
  Clone ID: SORBI-28MAY03-CLUS60428_1
tacttgactcttaaggaggtttttgagagtttggacttgacagggtatgatctcaatgttgatctcttggatgtccatgctgataagagtacatttcgcccgtgcgacaagttcaatctgaaatataatccatgtggtcaatctcgcctgagggagatctttttaaaacaggataatcttatccaaggtcgcttccttgctgagctgacaaaagaagtattttctgaccttgaagcaagtaaatatcagatggctgagtatcggatatctatttatgggaggaagaaaagtgaatgggaccaaatggcaagttggatagtgaacaatgaattatatagcgagaatgttgtttggttaattcagattcctcggatatacaatgtatacagggagatgggcacaatcaattcattccaaaacctccttgacaatatttttctccctctttatgaagtaactgttgacccagcttcacatcctcagctccatgttttcttagaacaggttgttgggttggatttggtggatgatgaaagcaaacctgaaagacgcccaacaaaacatatgccaacacctgagcaatggactaatgttttcaatccagcctatgcatattatgtgtactattgctatgccaatctgtatacactgaacaagc

SEQ ID NO: 3587 - DNA, 516 bp, Sorghum bicolor
  unsure (1)..(516): unsure at all n locations
  Clone ID: SORBI-28MAY03-CLUS60437_1
gcacgagggttttgttggaattgcaccgaggaagcgcatcgtccagtagactgtgccactgtttcgaagtggatcctcaagaacagtgccgagtcagagaatatgaactggatactggctaattcaaagccttgtcccagatgcaagcgtcctattgaaaaaaatcagggatgcatgcacatcacatgcactccaccatgcaaatttgagttctgctggctatgtcttggtccatggtcagagcatggagagaggactggtggattttatgcttgcaaccgctatgagtcaccaaggcaagaaggagcgtatgatgaatctgaaaggagaagagaaatggcaaagaactctcttgagagatatacacattattatgaacgatgggcagccaatcagtcgtcgaggcaaaaggcactgggggaccttcaaagcctacagaatgacaagcttgaaaagttaagtgacatacaaagtcaacctgagtcacagctgaagttcattatagaggcatggnta

SEQ ID NO: 3588 - DNA, 584 bp, Sorghum bicolor
  Clone ID: SORBI-28MAY03-CLUS60442_1
gcacgaggcgcagttcctcgacccggctctccccgtcgccttccaccaccaccgcagatcgccgaagcgaggcaggccgcaggcgagctccggaccagatcccgctgcgggcagctagagcggaagggccatggagacgccgccgcctttccaggagtccgcccactgcgacgtctgccgctgcaccttcggcaccttccgtcgccgtcatcactgccgcagctgcggacggacgctgtgtcacgagcattcttcgtaccacatggctctcccgcagtatgggatatatactgacgtcagagtctgctacgattgcttcaacaaatcttcgagccaaggacgcgttggtaattcagtgtcggctggtagcatttccggagcagctgactctttttcagggctgagtttgggtaaagaggatgcttcggcgcctatgaaaaactcaacagttcagagcgcgacaccccttattgagtgcaaatgtgggatgcctttgtgtatttgtgaagcaccaaaaccagaacctgcacctacacctgtaaagaatatcagcaccgttccctcaaccacacagtcgaatccaa

SEQ ID NO: 3589 - DNA, 1031 bp, Sorghum bicolor
  Clone ID: SORBI-28MAY03-CLUS60473_1
gcacgaggcgattgttgcagcacctttactaattgcgttcgagctgcttctttgcatatatcttgaaagcataagagaaatcatccgtctgttgatctgaagatcgtgttccttcctttgttggcctttgaagcaattatccttattgacaattttagaatgtgtagagctttaatgcctggagatgaagaaagcatgagtgatgaagctatttgggagacacttcctcatttttgggttgcaatttcaatggtgtttcttatagctgctacaacattcacccttctcaagctgtctggcgatgttggtgctttgggatggtgggatttgtttataaattatgggattgcggaatgctttgcatttcttgtctgtacaagatggtttaatcccatgattcataagtctcccactcatggggaggctagctcatcatcagcggcaattagataccgtgattgggaaagtggtcttgtcctcccatcactagaagatcacgaacaagagaggctttgtggtctccctgatattgggggccatgtaatgaaaatacctcttgtggctttccaagtattgctttgtatgcggttggagggcacaccagcaagcgctcgctacatcccaatatttgctcttttctcgccactatttattctgcaaggtgctggtgtccttttctctctagcaagattagtggagaaggttgttctgctattgcgtaatgggccagttagtcctaattaccttacagcctcatcaaaagttcgcgattgctttgcttttcttcatcgtggttcaaggcttcttggttggtggtctattgatgaagggagcaaggaagaacaggcccggttgttttatactgaatctactgggtacaatacattttgtggctatccaccagaggtggttaggaaaatgcctaaaaaggacctcgcagaagaggtttggaggctacaggcagttgttgggaagaaagtgaaacaaaaacagattgtaaataaaaacattgccttgtttgaatgtagtcc

SEQ ID NO: 3590 - DNA, 540 bp, Sorghum bicolor
  unsure (1)..(540): unsure at all n locations
  Clone ID: SORBI-28MAY03-CLUS60488_1
gcacgaggacagattccattggacatactcattttcagattagttaagcaatatcttcgtgctactcctcttaaacgtttggcattaaaggtacagtacagacttcatggccttttctgtatttgtaagcattctttctattcttcattgatctttgttgatacagcaatatgcaactgatagatgtacatgtgctagatgtgctaaaagaggccacatgatggctgtttaaccctccaaacagtagaagttacagaagatgggttcattagtggtgtatgtttctatttgcaatgttttttaggtgtttatattttattttcctttgtgatcctgtaccttttcaatttattatgagaggctggtgttgctgatcataatattgctccaaactattatggacttccatagaagtcatgaatacaaatatgttcatagtggcaaattgtagtgtaactgacaaccagcaaagtactgctcattaatgtagttatgtgtgtagtaacacttaatattattccttgtcacaggcactatcan

SEQ ID NO: 3591 - DNA, 543 bp, Sorghum bicolor
  Clone ID: SORBI-28MAY03-CLUS60126_1
gcacgaggcaaagaagtgtggagagaacttttgaacccttctcccgctgttcgtaggatgctgtatgctggctgcggtattcagttgttccaacagatcacaggaattgacgctactgtctattacagcccaacaattttcaaagatgctgggatcaagtctgatcaggagcttcttgctgcaactgttgcggtgggtttcactaagacagtgtttatcttggttgcaattttcctaattgatagagttggacggaagccacttctttatgtgagcaccatcggcatgactatctgcttatttctcttgggggttgcacttacacttcaaaagcatgctgtggggcttatgtctccacgtatcggtatcgacctagcaatttttgcaggttgtggcaatgtggcattcttttcaattggcatgggaccaatatgttgggtcttgtcttcagaggtatttcctttaagattacgagctcaagggtcagtacttggtcaagtaggtggtagagtgagcagtggattggtttccatgtcattcctt

SEQ ID NO: 3592 - DNA, 729 bp, Sorghum bicolor
  Clone ID: SORBI-28MAY03-CLUS60224_1
tttataaatttatatttatataaaaaaatacaaacactcacgatacaaaataaggtgtcattagattagttatagaaaatattttcgtgataaatttatttagagacataaatgatactactatttactataaacttggtcaaaactgagcttcactggccggcacagatgccataattgcattcttttgtggacggaggagggattacatcccacgaggtgctatttcattcctcacgtgtcagttctatggttagctttgttcttgaacaactgactttttgagtggggcttgctcctaggaacaggggattgcaatgagttcacttactattgtaatagtcacccatcattcaccatgaataggtgacttttgttatcattattcatagagaactatgtgcgagctgttttctgatatcttctggatcattatttggctattttgaatgcaaagtttttgaatcatcgttgtatgcatagactctagtgctacattcatcagcaagaagcaatttcactgtacatgtcagataaccaatatctgatccagtgatgtaaaatttttattttgcacaaggcttttgctacaataggatttgcggcttgaagttaactggtacctgatttagctcacattaatccgaactcactacccccaattcctgatgtaaatgttgcagtgtgatacatcagaacctgattcatgtgattctgggtgcaatggtg

SEQ ID NO: 3593 - DNA, 586 bp, Sorghum bicolor
  Clone ID: SORBI-28MAY03-CLUS60230_1
gcacgaggctacaatttttagctgtgtctctgattgctgctcccaaattttcattgctacttccctccctgacccacaacttgctaaggtacaacgtagctcctccatgtgcaaagctcgccaacactcccgagcccccttgcacttgaaaaaaagatggccacagtcttcatcaagccaacacatggggcatagggtttctattttgatcctcctccttttcaaatttctccgaagtggcaggctgttgtggacaaaacactagaaaaacatttggactttgttaggcactttcaactgccatattttttgccatggaaaagaagctgccgctggacctccttctgctgatgtcccagcctcccaatctgcctcattgtcacggtactgtgcagccagcttgtatgccgatttcacagagaactgcccctttgaattgaaatgccatgctggccagtctagcaaaccctccccaattgggattgttagaattacctcagcttcctcctcccataaagtatctcttactagttgctcatcccagtttccagtgttcgggtctatgagctcttctactcttgttagc

SEQ ID NO: 3594 - DNA, 614 bp, Sorghum bicolor
  Clone ID: SORBI-28MAY03-CLUS60225_1
gcacgaggagaacttccaaaacttgctcatcagcaaccatatactactaccatcggtacaaataaatatgcattaaaccacgaataacagaacaagatgacctcttgggttgattgccactggctcactgccaagagatggatcagggcggcataaaaccagcaagcttgcatgaatcatgagtcatgatgccaatgctaaataagattcaggtaaggaggcaatgaccaagtagcactcccaaatcaacgctactgcaattgcagagacatactgaatttccgacttgttaaatcacataacaaaagcatttcatccatttcgatccaaaatatcactcgatcacttgcgcacatcgacacatggtttcattcatcactgcatactggttcttagtgaccactacttgcaactgatagttaccatatcaagctagcatttgcatctgcattgcatactatgccactactactgcctactgatcccttgctacatcatactgataccgaggatgatcataccaactaacgtgacagaggaaattaaacgcagcagggaaaaaacgaacgaacgtaagcagagccatgttcagatcacgaccgctagtgagagtg

SEQ ID NO: 3595 - DNA, 611 bp, Sorghum bicolor
  Clone ID: SORBI-28MAY03-CLUS60603_1
gcacgaggctcagggtgttcgatccaatgactcaccgcgtgtcttcggttgaccagctgccaaggcgcggaggcagagccccagaccaccgcggccgcagattgtgtctccccccgggcggcgacgaccctgacgcgttccgtgtgatgtcgctgcagcacgggaacgccaagaagctggctcggttggaggtgtacaactcctgcaccagagcttggcgcgtcctcacaggagctggaacagccaagataccagccaggaagcacatggccaagatctaccgcggacagtatgcacctgcgatgcacgcgggcgaccgaatcttttggaagtacgacgccgcaaatttgcttctctcgctagacacccagacgatgacgttctccaacgtgtgtctccctcccggcgtgactcgtctgtcagcttacgccgttggtgagacagaggatggcacctgctgcctagtgcatgtcttggaatctggcaatcgacaaatgcaagtgtggcgtttcaaagtaggagatgatcatgagggcaatggggatcagatgtgggagttggagcgacaagtgccactaatcttagcctctccatcagcatgtctcagtggg

SEQ ID NO: 3596 - DNA, 560 bp, Sorghum bicolor
  Clone ID: SORBI-28MAY03-CLUS60610_1
tggaggaacgccaccgcggcatcgcctggccgtcacaagctgcccgacgccagcaagagtcgcccgctcccgagtccgcgataagctgcctccccccgcaagttgggtggttgaaaatggatcttatgctgccttttaaagttggagacatagctgagtcaaggtccttctctctcggttacaggggtgcatggttccgcagtaagataaaccttatgtgtataaggcaaggtcacctggagtgtcttttggagtatcttgactttccagatgaaaagaagacatggactcggctatacaaaattcccccaggtagccacaggaggaaatcacatctgagtaggatgatcatggtacgccctacctttccacagtgctattgggagaatgaaaaacctaaccaactcccaaagacacatgctgtggcaattgtgactggtccatggaaagtaggtgacttgatcgattggtggtatactgattgttactggactgggaaaattattgagttacttggtgatgacaaagtaaagatagctttgcatgaagagccaattggt

SEQ ID NO: 3597 - DNA, 736 bp, Sorghum bicolor
  Clone ID: SORBI-28MAY03-CLUS60680_1
gcacgaggggaaacaatagtcttaatgggctcaaccctccccttccatctgttgaaactaataatgggaaatctagtggcagaaacaaaagttctgtgccggcaatcgttggtggagctgttggtggttttgctgcgctgctcattgcctttattggtgtgtgcatcatctgcagaagaaaggaggtagcaaaggagcccggggaacccgatgatggccagtggactcctctcactgattacagcaagtcacggtcaaacacctcagggaagacaacaactacagggagccgtacatcaacattgccatctaatctttgccgccacttctcatttggtgaaatccaggcagccaccaataattttgatcaaacctcgctcctcggcaaaggtggttttggaaatgtgtaccttggagagatagatagtggcacaatggtggcaatcaagcgtggtaacccaacgtctgagcagggtgtgcacgagttccagactgagattgagatgttgtcgaagctccgacaccgtcaccttgtgtcgctgattgggtattgcgatgatatgaatgagatgattctagtgtatgattacatggccaatgggactctgagggagcacttgtacaacaccaagaagccagcactctcctggaagaagcggcttgagatatgtatcggtgccgctcggggactgcattacctgcacacaggtgcaaagcataccatcatacacagaga

SEQ ID NO: 3598 - DNA, 316 bp, Sorghum bicolor
  Clone ID: SORBI-28MAY03-CLUS60683_1
ggggaaggagtcactgacgtcgtagccccactggtcagcgacacaaggagtggggtcggcctgtcggtgggaagggcgctggctgcctgttgcggcgccgggtgctaactaggccccgcgtgggggagagggggaaaggaagggcacgggctggggagttgggctggttgctggccagcttgggccgagcgcggggagaggagagagggggagaaagtttggttgggcctctcgggccaaaacagatgaattgttgacatttttgtccaaattcggtaaaatccattcttcgttgcataaaaaaaaaaaaaaaaaa

SEQ ID NO: 3599 - DNA, 870 bp, Sorghum bicolor
  Clone ID: SORBI-28MAY03-CLUS60685_1
gcacgaggcttatggtcgtccatctgctaacattgttattcagaatgtcgtaatccgctctatggtcagtgctggagtatcgattggaagcgagatgtctggtggtgtctcggatgttttggtagagaatgttcatgtctgggattcacggcgaggcgtgaggataaagactgcgcctggaagaggggcctatgtaaccaacatcgtgtaccggaacataaccttggaaaatgtacgtgtcggtatagtgataaagacagactacaacgagcacccagacgaaggcttcgacccaaaggctgtccccaccatcgggaatatttcttacacatcaatccatgggcatcgtgtgcgagtaccggtcaggatacagggaagcgcagagatccctgtgaagaatgttaccttccatgacatgtcaatcggtatagtagacaagaagcaccatgttttccagtgctccttcgtccaggggcaggtcattggctatgttttccctgtgccttgcaagaacctggacctgtatgacgagcggcgtgagctggttaaacaatcaacgttacagaatatctctgatatcgactacagtttttgacaagggcatttgatcccaatgtactacagaatgtaggtgtattcagtattcacagctatcatagtcctttccaacacatttagaagcaaatttttgggggtagcttttacacctttcacctctcagtcaggcatgtatttaaggaggatcgacttgtccatactgtctcgtagagagacgccaggaatgttgccttttcactttcttatcactgtattattacaaactaactcgtttacacagttaacagtacacttttgacagtgtttactgtt

SEQ ID NO: 3600 - DNA, 684 bp, Sorghum bicolor
  Clone ID: SORBI-28MAY03-CLUS60704_1
accgtgcttcgccggaggtcggcggctccacctccacgccaatatgggcggcgggcggaagcggcggcggcgcggcggctcggatgctccgtcgatgcacccgcggaaccgctacgccgccgccgcgccggacgcccccgcgctggcggagctctacccgtccttccgccccttcgtctccgtctccgaccgcggccgcgcgtccgtcgacttcaccgatttctccgccactcgggagctcacgcgtgtactcctcctccatgaccatggcgtcaactggtggattccagatggacagctctgccctactgttccaaacaggtccaactacattcactggatcgaggatcttctctcctcagatctgataccaccaatatccagctcaagtgagagagtgaagggctttgacattggaacaggtgccaattgcatctaccctctccttggagcatctttactgggatggacctttgttggatctgatgtcactaatgttgctcttgaatgggctcagaagaatgtggagagcaatccacgcctagcagaactaattgaaatcagaaatgcaaatgcaccgtcctctgagtctgaatctgttgtcagggaagcagcaagggagaagattttagagcctgcggaggatgtagctatgccaaagccacatatccttgttggtgttgt

SEQ ID NO: 3601 - DNA, 547 bp, Sorghum bicolor
  Clone ID: SORBI-28MAY03-CLUS60384_1
gcacgaggctggaacaagcaccatatttaagcaggtctcactgaaatttacatctataacaccttgagtttccctatatgtttctgcagggtagcggcgaggtgccacgtgacatcacttataggctatatagcagcatgcatcactcatctatagctatctgtagcgtatttatagctagctatttagaaccttggatggactccaaatttgtcatcagctcttctgtgaaactcttctgaacatttatattaataaactttgtctgttcaagtagtccaaattctggtaacgcagaaacctttgactattttggagtgtcggcttctgcaggagtttataaaaccttacgcacactaggtcttatatacattatatgtttggtagaatcaacactttgaatcttggcaataaagtttgagcaaaagaacaacaaaaaaggggttctcttcaggaaactcctatatgctttctataaaagccgggttttacctctgtcaaaaaaggagtcccttgttttgatagtgtggaaatagtattattgttt

SEQ ID NO: 3602 - DNA, 594 bp, Sorghum bicolor
  Clone ID: SORBI-28MAY03-CLUS60391_1
gcacgagggctgaaggacctgaacttccaagctcagcgaggcatgcgtgttgcagtttgtgggacagtgggctctggtaaatcgagcttgctatcttgcattcttgggcacgtcccaaagttatcaggagaggttaagatttgcgggatgacggcttatgtcagccagtcagcatggatacagagtggcaaaattcaggagaacatattgtttggcaaggagatggacaaggacaaatatgaaagagtccttgagtcgtgttcactgaagaaagacttagagatattgccattcggtgaccaaactgtcattggagagcgagggatcaacctgagtggtggacagaaacaaaggattcagatagcccgtgctttgtatcaggaagcagacatctatttgttcgatgacccattcagtgctgttgatgctcatacaggatcccaccttttcaaggaatgcttgctcggggctttgtcttcaaaaacagtagtttatgttactcatcagattgaattcctaccagcagctgaccttattttggtgatgaaagatggcaaaatagcacaagcaggaaaatacaatgaaatacttggt

SEQ ID NO: 3603 - DNA, 543 bp, Sorghum bicolor
  Clone ID: SORBI-28MAY03-CLUS60400_1
gcacgaggatgatgtgctaatctcccaggagcatgctactacctgcactgcaaacatggcaaaaggattcaaattcttcaggttgggggcttctgtttcctcacaatcgagggatttatcactctttgttctccaggaagctgagccatatacctgaacagaactcatcatgccccattgtaattggtaactctaagcttttatcggataaaatagaagctgagcggttacagactgaaaaaaccctgagtaaggatcttctgaagcagaagtacaaaaagaatttcagacctcaacttgtttcaaagtgtctgatacttcctgagaacctgcgtggcaagtctatggaattcctacatcaccagtatcatttggtaaacaggataactccacagtacctcagtgcttatgagttgatgatacagagagaaagaatagttgatgaggaggagtggaatttcttatggaaccacatactgagcaatacaacatttattgttgaggattgggattccaacatctgcaacattgaaacattgcact

SEQ ID NO: 3604 - DNA, 717 bp, Sorghum bicolor
  Clone ID: SORBI-28MAY03-CLUS60405_1
gcacgagggcagcattgaagaggagagactttcttcaattaggtttcaaatttgacaatttgctgatggaagaaagtgcacagatattggagatagaaacttttataccgatgctgctgcagcggcaggaagatggccatgctcgccttaaacgttgcatgctcgtgggtgatcaccatcagttaccccctgttgtgaagaacatggcttttcagaagtacagccacatggaccagagtctctttacaaggtttgttcgacttggtgtcccttatattgagctcaatgctcaaggtcgtgcaagacctagtattgctgaactttataactggagatacagagaactgggagatctgccttatgtccgtgagcaagcaatcttccataaagctaacgctgggttctcttttgagtatcagttagttgatgttcctgattataagggaaaaggcgagtcagcaccttctccttggttctaccagaatgaaggcgaggctgagtatattgttagtgtgtatatctatatgcgcctgattggctaccctgccactaagatttcaatattaaccacctacaatggtcagaagcttcttattcgtgatgttatcaacaaaagatgcaagccatggaatattgagccccctaacaaggttaccactgtggacaagttccagggccagcaaaatgatttcattttactctctcttgtccgtaccc

SEQ ID NO: 3605 - DNA, 528 bp, Sorghum bicolor
  Clone ID: SORBI-28MAY03-CLUS60417_1
gcacgaggcacgccgctcgggcaggagccgccgcaaacggtgagcgcgcacgggatcatgatggaggtcagggacaggaggcaaatggacctggccagggtcagccccggtgctcgcggaagcagggaggaggtgctcggtgagccgctcaccccatctgaggtgcgcgcgctcgtcaagccgcacatttcacacaaccggcagctcaacattggaagagatggcttgactcacaacatgttggaaatgatacattgtcattggaggcgccaggaaatctgcaaagttagatgccgaggcgttccaactgttgatatgaagaatctctgttatcatcttgaggaaaagtcaggtggaaaagtcattcaccgagtaggtggcgttgtttttgtgtatagaggaagacattatgatccgaagacccgtcctcactatccactaatgctctggaaacctgcgactcctgtgtatccaaaactcatcaaagaagttccagaagggcttacaaaagaagaagcagatgaaatg

SEQ ID NO: 3606 - DNA, 745 bp, Sorghum bicolor
  unsure (1)..(745): unsure at all n locations
  Clone ID: SORBI-28MAY03-CLUS60799_1
gcacgaggggaaaattctctcaaggaggaagatgaagaggagtaccaagagaaaatagaacagcagttagcaatgcaggaggaagacgaccctngaaaaaatcaaagaggaagcaaggaggaggaaagaagctatcatggcgaagtacagacagcagcaatcgcagaagcaggatatggaatctaaaccaagtagcaatgatgaagaagtaagagcaatggatggaaatgaaactatatatcagaaagatgctcgcggtagcggctctacggggaatgacgaagctgaaaataagcataattcttcagaggtatttgatgacaaaacagactttactgtgggaaagtctcctgctcataatgatgcttcaactagcgcgggagcattcactgatgagaggacaataggtgtttcaggtcttggagagggttctcccaagagcgagagatcagcagacatgttttgtgatgacattttcggagaatcacctgcaggaattagaaaatcaggcaaggatgatggtttgcatattgagagaaatgctcttcatgacaactgggatgatgcagatgggtactacacttaccggttcggagaattgctggatggccgttatgaaatcatagcagcacatgggaagggtgtgttctcaacagttgtgcgggcaaaagatcttaaagcgagtaaagatgatcctgaagaagttgctatcaaaattattcgcaacaatgagacaatgtacaag

SEQ ID NO: 3607 - DNA, 554 bp, Sorghum bicolor
  Clone ID: SORBI-28MAY03-CLUS60816_1
gcacgaggaacaaccgttgatgcatcagaaacacaagtgattgaggctatgcgcacgagggcttcacacatagggaatacttcaaaattcagcaaggcatcaaaactagctttgcaacttattgaagctggaagcgtcaagcctggaacaatcagtcatttctttgctatactagaggctgcgatgtcttcaccgggagcatgcaatgagccttctgtacgagcagactaccacaaattgtttgatgctgctcagggtgtcacagagttattcaaccaacagcagaaaaatcaattcgacatatgggtgctgcatgctgtggtggctaatgatcttttcactgatgacagttttgtgttctcaaaggctgtaggaaagatcaaagatgccatctcagccctgccagtggcaacagtggatgatgacaatgatgaagctgcagctcttgctgccgcaagcaaaactgactcagtgacggacaataaaactgatcatagcgccccagctgcagcttctaactctgtggcagatgatagcacacatgctgcagcctc

SEQ ID NO: 3608 - DNA, 861 bp, Sorghum bicolor
  unsure (1)..(861): unsure at all n locations
  Clone ID: SORBI-28MAY03-CLUS60840_1
gcacgagggttttctatgtgtgctgcttattaatgttcatttatccagttgacagattttggattgtccaaggttggtttgatcaacagcacagatgatctgtctggtcctgctgttagtggggcttcactgtatggagatgatgagcctcatatgaatgaacttgagcaaatggatcaccgagcacgaagacaaaatcgttctgctgttggaactcctgattatttagcaccagaaattcttttggggacaggacatggttgcagtgcagattggtggtctgttggtgtcattctgtttggccccagggttggcatacctccgttcaatgcagaacacccccagacaatttttgacaatattctgaatcgcaaaataccttggccgcatgtcccagaagagatgagttttgatgcacaagatttaattgacaaattattgacagaagatcctcatcaacgactaggagcaaatggtgcctcagaggttaaacaacatccgtttttcaaagacattagctgggatacccttgctaggcagaaggctgcctttgttccctcctcagatagtgcatctgatactagctacttcaccagtcgctattcttggaatccatctgatgaaaacatatatgaagcatacgagtttgaggattccagtgataatggaagccttagtggaagcagtagttgtgtgagcaaccgccaagatgacatgggggaggacagtgggggcctcaatgagtttgaatctagtgcaaatgtcaattattctttcagcaacttctcgttcaagaatctatcacaacttgcttccatcaactacgatctgctcaccanaggattgaaggatgatcaaccg

SEQ ID NO: 3609 - DNA, 932 bp, Sorghum bicolor
  unsure (1)..(932): unsure at all n locations
  Clone ID: SORBI-28MAY03-CLUS60868_1
ctttgcttctgcaatgtatcagtggttctattactgagcactacccattgtcaatgatgtatttgcggttgggcttccaatgaatataacttttctatctgaaatatgattttgctcttacctaatgtcaactctgtgatgattgcttattatttttggcgtatcctttgctgttggatttattttgcagtgaatgggattctgctgtcatgactgtatcataaaccatgtttaatgtctgatttccagtgatcgtgggctaccgttacacattttgcatctctttcttttttcctgctaactcaggcaacggtcaggatctatgacaattcttcctttacatgtacctattatgttgatggctgcggcaatggtcatgagtagtgttagctccattttttctgtctctttttagctccgctcgtggctgagttaaaattttgccgtcctaatattatggggttcatgaaaaatttagcttttctatgctaacagcttgccaataattttagttggggattacctttagttttactacatgttttgatgatctaataacttttccaactattgtgtttttattttgtagcgaaagtcctaattttatttgtcaaatctttggagtagtctatccttgagattgaactacatgaatgcacccttcttgcaagattcaactgaattcgttaggtaaatagttaagttagacgttattcgtttgcaaaaattcttagagaaaaaatcttgcaggagatgagacacttcagttctaaggtaaatgatagtggtttcatgtttctaaagttgtcacaaatgggcaatttatgtttaaccatttaaataaagttgacttcgaagcanaccgttttcttgtttttgaactgaccaggtcaattgggtgggtagcataaacatagtgcattggaatagga

SEQ ID NO: 3610 - DNA, 616 bp, Sorghum bicolor
  Clone ID: SORBI-28MAY03-CLUS60901_1
gcacgaggaagagcgagagctccaacttgtatcagaggattgcaacacaaagaggaagcatggggaagacaaggatataatgggagaggtaaccaagacccatgaagccatacaatcattggataagtccatctcaacgctgcagatggagcttgcagcaaagaggagcacacttgagcggctacggtctagtggttcaccagtaacctctgaaactagccaaccaaggaaaaaggcatttgttgtcattggagtcaacactgcattcagcagccgcaagcgccgtgattctgtccgggagacatggatgcctcaaggagaaaagctgaaacaattagaagaacagaagggaatagttatccgcttcactatcgggcacagtgctacgtccaacagtatactggacaaagctatagattcagaggacgctcagcatcatgactttcttaggctggaccatgttgagggatatcatgaactctcagctaagacaaaaatattcttctctactgctgttggcatctgggatgctgacttctacgtcaaggttgatgatgatgtgcatgtaaacttaggaatgcttgccactacccttgctcggcataaaacgaaacca

SEQ ID NO: 3611 - DNA, 1035 bp, Sorghum bicolor
  Clone ID: SORBI-28MAY03-CLUS60919_1
gcacgaggattgattacatacgttctctaagtcgctgcaagagatggaatgcgcagggtggaaaaagcaatgtttactttgcaaagacgatggatgaaaggttcataatcaaacaagtcacgagaacagagctggagtcttttgtagaatttgctcctcagtacttcaagtatttaatggaatccttgacttctggtagcccaacttgcctggccaaaatagtagggttatatcaggttagtgttaagagcttgaaagctgggaaggaagtgaggatggatctgatggtgatggagaatattttctttgaaaggaagatatcccgggtgtatgacctaaagggttcattgcgctcacgctacacggctggggacagcaaagtcctcttggattcaaacctcatagaggcattgcatactaagcctatttttttggggagcaaggcaaaacgaagattggaaagagctgtctggaatgatacttcatttcttgcgttggcggatgtcatggattactctctccttgttggaatcgatgaggagaagaaagagctcgtcattggcatcatcgactacttgcgccaatacacctgggacaagcagctggagacctgggtgaaggcctcaggcattcttggtggccccaagaatgaatcccctaccgtcatatctccaatgcaatacaagaagagattcaggaaggccatgtccaagtacttcctcactgttccggaccagtggtcctcttgacaactgactaacatgctctattatcgattatgtatccattattctttctgtgcctagagtgagagaaatagtcaattcattttgtgcccacctgtaccatctgtagtagccatagatagatagatagatacagggggggggatcatcctcccgctggatgccaagcatggccactgcagtgtccagctacagatacaggcttggtccatgactcccatctccattgtacattacgccagctatatacatatatatagctgagaaaggaaatttgtcgatggaatgc

SEQ ID NO: 3612 - DNA, 666 bp, Sorghum bicolor
  Clone ID: SORBI-28MAY03-CLUS60519_1
gcacgagggcaaaaggtacgatatggaaaagccggttctccagataaagaaatcactgccagaaacatcataattgccactggttcagttccttttgttcccacggggattgagattgatgggaaaactgtatttaccagtgatcatgcactgaaacttgagtcagttccagactggatagctattgttggaagtggttacattggacttgagttcagtgatgtatacacagctcttggaagtgaggttactttcgttgaagctcttgaccagctgatgcctggatttgatcctgaaattgcaaaattagcccagagagttcttatcaatcctcggaaaattgactatcacactggtgtttttgcaagcaagattactccagcaaaggacggaaaacctgtgctcatcgagcttattgatgcgaagacaaaggaacacaaagaaacccttgaggttgacgcagctcttattgccacaggaagggcgccattcacccaagggcttggcttggaaaacatcaatgtcgttacacaacgtggttttgtgcctgttgatgaacggatgcgagtcatggatgcagatggcaatgtggtacccaatttatattgcattggagatgccaatggcaaactcatgcttgcccatgctgccagtgcacaaggaatt

SEQ ID NO: 3613 - DNA, 949 bp, Sorghum bicolor
  Clone ID: SORBI-28MAY03-CLUS60525_1
gtcgtgtcgtgcccgtcccgtgccgccccacttgcacttggactcgccacttgctcgctgttgccgggccggcctaccgcctcctacccagcctccgaccaccgcctcgccgccctcgtgcgtccctcgtccaactccaatggccgcgccctgccacctccacctccacctccacctcccgggctgcccccaaaccctagccctgcccctgccctcgccgcggggcttctccgctcggcccggcctccgctcccgctcccgcctccgcctccgcccggtcgccgcgctcggccccgccgacgccggcgacctgctcggccgcgtcgaggcgttcctctacaccgtcgcggacgccgccgtctccgcggcggatcccgtcgtgacggccgccgacggcgggaccaaggaggcccccggggactggctctccggcatcaccaactccatggagaccgtgctcaaggttctgaaagatggtctatcagctcttcatgttccttattcatatggctttgcaataattctcctcactgttcttgttaaggcagctacatttcctctaacaaagaagcaggttgagtctgcacttgcaatgaggtcactgcaacctcaagtgaaggccattcaagaacgatatgctggtgatcaggaaaggatacaacttgaaactgctcgcttatacaagttatctggtgttgacccacttgcaggatgcttgcctacccttgtgacaataccagtttggattggtctatacagagctctctcaaatgtagctaatgagggacttctgactgaaggctttttttggataccttctttggctggtcctacaacaattgctgctcgacaaaatggccagggaatatcctggctttttccttttactgatggtcatccacctcttggctggtcagacactttggcataccttgtgttaccagttctt

SEQ ID NO: 3614 - DNA, 597 bp, Sorghum bicolor
  Clone ID: SORBI-28MAY03-CLUS60531_1
gcacgaggatgatatcgccatgttcttgctgtgttgattgtgatgatgttttttaaattgttatatgcatggtgctcacttttgaagtacgcctgcagtgtttccatttagtaaggattgatttctaatatcaagaaaacaggaaccctgtttagcttattgtgggtggctaatgataagtatagggtggtggtaccacaacccaaattctatctcaggagttaaggtaccaaactttactctaaaattttgatacatccttggttatactttggtgctgcctacctagtaatgtgtggttgtttgcctacctagtaatgtgtggttgtttgatcatctcttatctttcaggctggagatgggcaaatggttttcttaccatcaaccttctaaactgtttgctacatatatgcactacaattttgaattagtgttgttattttgtgaaccagatgtttattgcttcttgcattcttgcttaatgtctggtttacttgtgctggctctttgagcaaaactttttcgcgaccggttgtgtgcccgtatttcactctttgagcaaaactgtgatatcttctcaggctggttaatcatttg

SEQ ID NO: 3615 - DNA, 517 bp, Sorghum bicolor
  Clone ID: SORBI-28MAY03-CLUS60561_1
gcacgaggatcgtactttatatgtactaaatccgtactactattctgcaaacatcaaattcttctgcatgtgacaatgttcctgacactctcttcagcgtgatatggatatgtcctctgttctcaattgtcaccgtcggctgtcatttgctgatgttcagcttgttcactgaactcactgttcttgttgtggcaatgtagcagtgttagtgttggagtaaaacgaagaggtggtcctggagggttaaacaaagtctgcggtgtgtcttcagagctgcaagctattgttggtgaaccagttatggctagaattgaggttcagtttttctagcacatctttctaattaatgttactacaaagattgtttacatcatggcaaggaaactgatgctgttaatcaatgcagattgttaagtagttttgggcgtacattcgcaggaacaatttgcaagattttaacaataagagaaagattatatgcaatgatgagcttcgattagtttttgagactgatagc

SEQ ID NO: 3616 - DNA, 861 bp, Sorghum bicolor
  unsure (1)..(861): unsure at all n locations
  Clone ID: SORBI-28MAY03-CLUS60589_1
gcacgaggctctcggttcccccctgcccgagctgaccgccgccgagacgccgccacgccgccaccccctccacctcccgccgccactacaaccttcgcctccgcgcaattggccgcacgcactcctttcccacctcccgctactgggtggcgtgggccggtcggcggcgcggacgcgtggagatccgccctctcgcacgcggactgctgcttccttcgctaggagatggaaagtaagtgctgtcagggctcatgatttctttcgggagatccggagctgtggttcctgactgactcatcatctcagggacactgccaagtacaattcaggaaggattttgtaaatgccactttttggagtttctggccttttggtttagtcctcaagactctagctagcaattatctaaagaaacaaatgaaatgttaattgccaccaagttggcaaaatccctggaaaacagcagttgagggagaaactccattgcaatgctaacaataccagtgcccaggtcatgacaatcagagccagtagcaactgaaccttaagtagccaccaagtttggcaaaacttctgcaactcaataactgtgggagaaaattttgatgcaactgttgatgcccaagccgaacggcccaagagttcttcagttgcttcttgaaatactctctggataggaagggcaaatttgtagatgtcgtgagagtgtagaaagcatgcactgttgtcctctttttacctgtaagtgtaagataagattgtatggcctatttgagttgtaaagagataagttcacaaanagtattgtttttttctttgatgtgtcttgattggaaataattgtaatgagaaaagctgcgc

SEQ ID NO: 3617 - DNA, 546 bp, Sorghum bicolor
  Clone ID: SORBI-28MAY03-CLUS61150_1
tcgatggcgcgagggacgacgagttcgagatgggggccgggcctcggagattctcctacacccagctgtcacaggcgacgcgcggtttctccgacgacgagaagctcggcgagggcggcttcggatcagtctaccgtgggtacctgcaggaccaggggctccatgtggccatcaagagggtctccaagacgtcgaggcaggggaggcgggagtacgtctccgaggtcaccatcataagccgcctcaggcaccgtaacctcgtgcagctcgtcgggtggtgccatgacgccgacgagctcctgctcgtctacgagctcatgagcaatggcagccttgacaagcatctctatagcacagacaacattcttacatggccttttgtcacttccaagttccaacacgaggagtgcgacgaaataaggagtttttcggtgtatgatactgtgagaagagaaatatgtaaattgcgtatggaacagggttgatcctggacactgaatgcctgacctgtaaagttctaggatgttgcctatagcaagttcgcct

SEQ ID NO: 3618 - DNA, 494 bp, Sorghum bicolor
  Clone ID: SORBI-28MAY03-CLUS61172_1
gcacgaggagaatgatgaacatgtacaaaaaggcagctgaattttgggctgaattgcgccttgaactcctatcagcaagtgaattatttgctgacggcagttcaaatcaaatatggcggctgtattgggccagccatcagcgtttcttcaggcacatgtgcatgtctgcaaaggtacctgctgttgtgaggttagctaaagaggccttggcagagaacaaatgtgtggtgattggtcttcagagcactggagaagctagaactgaagaagctgtcacaaaatatggagttgaaatggaagacttcgtttctggccctcgggagctccttcttaagttggtagaagaaaactaccctttacctccaaaacccgattcttttcagcaaggtgatgaaaaagtcacagagatccagcgtaagcgccattctgcactggatgtatcgtttaaagggcgagttagaaaagtagcgaaagtggtagatgtgagtgatgac

SEQ ID NO: 3619 - DNA, 645 bp, Sorghum bicolor
  Clone ID: SORBI-28MAY03-CLUS6118_1
ggaagctgacagtttaagggccacctacattcgtaggctaacttctgtacttatccagcatgttccagctttctggagattagctttatctgttttcagtggaaaatttgccaaggcagcttctggtaatgtagtttctgattctgacatgaatgcaaagccggctgcaaataagaacgatgacaaaagtggagaagtaaagtacacaaaccacactctcgatgaagttgctagtatggttcgggctactatatcggcttttgacactaaggttcagagcaccttccgtgattttgaggaatgcaacattctttgtccatacatgagtgacactataaaagaaatcgctaaggcctgtcagactcttgaagggaaggattcgtctccaactgccgtaaaaatgttgcgcacccttcattttgaaatgacaaagctttacattctacggctttgttcatggatgcgggcaacaactaagaagatatcaaaagatgagacttgggttactttatccacccttgagagaaacaagtctccgtatgcaatttcatgcatgcctctggagttccgtgacataacaatttcagcaatggaccggattgatactatgattcttaatctgatgagcgagactgcgaagtcata

SEQ ID NO: 3620 - DNA, 622 bp, Sorghum bicolor
  Clone ID: SORBI-28MAY03-CLUS61236_1
gcacgagggtgcaactgctgtggtccagcgcatgctgctgctcccgccatcggctgagccaatcttggccaccactcagctgacccggtctgtcccgccgcttcgtcatttccctccccccggtcctgggttgctgatggggggactgcttgagagcggccgtgctatccttgctcggctcctggcagagtcttctcctgtggacctgtctgctcagctcctctccccggctgctgtgcctttccatctcatcccttttgtgggccagagtctccctctgcctcggcactttctttccgctgctgcctcgatgctgtcgttcggtcttcgggcgctcgaccgccctcctctggtttgtcttttgcgtgctcttattgtcactgtcgttggtccctctgcctttcgccttgtctcatgtccgccaggcaggcccgtgcctcagcagagtgtccacctgtgctggtttccgcgttctcctgtgccttggctgatgtgccttcgccccatatccgctgagctccagaaagctcttggcagtcatctctcatggaaggaccgctatccacccttcttcgatgacattgctgcacgcttgctccctgttatcccgctgattatttat

SEQ ID NO: 3621 - DNA, 1001 bp, Sorghum bicolor
  Clone ID: SORBI-28MAY03-CLUS61249_1
tccacgactgcttcgtgcagggctgcgacgcgtcggtgctgatcgactcgacggacggcaacacggcggagaaagacgcgcaggcgaacaagagcctgcgcggcttcgaggtgatcgaccgcatcaaggaggtgctggagtcgcagtgcccgggcgtcgtctcctgcgccgacgtcctggctctggcggcgcgcgacgccgtgctcctcgctcggggcccctactacggcgtgccgctgggccgccgcgacgggacgcggtcggtggactcggacaccttcacggcgctcccgccgcccttcttcaacacgacgtcgctcatcaagctcttcggctcgcacgggttcacggtgcaggacctggtggcgctctccggcggccacacgctggggatcgcgcactgcggcaacttcaaggccaggctcgccgagacggacacgctggacgccgcgctggggtcgtcgctcggcgccacctgcgccgccaacggggacgacggcgccgcgccgttcgaccggaccagcaccaggttcgacaccgtctactaccgggagctgcagatgcggcgagggctcctgagctccgaccagacgctgttcgagtcgccggagaccaagggcatcgtcaacatgttcgccatgaaccaggcatacttcttctacgcgttccagcaggggatgctcaagatggggcagctcgacctcaaggaaggcgacgagggtgagatcaggcacacgtgcggggtcatcaactcctaggcaactgctggtatacgtgtggctgctgtgtcgtcagcaaaagtgtgtgtgcaattgtgtgcttaattatatgcaatgcaagtatatgtaggtatcatggtatatgtgtagcttgtaaaagtaaaacaaagcatgatgcatcatggcactggtgtatgatacatgtgcccatatgcataccctgataggaactactaagaatgaagctcttgatgaagcaaaataataatgcaaggatactac

SEQ ID NO: 3622 - DNA, 490 bp, Sorghum bicolor
  unsure (1)..(490): unsure at all n locations
  Clone ID: SORBI-28MAY03-CLUS61584_1
accngacaacttgatccagagaacactgaggcagcagtttaaagagacgaccgtcatcacgatagcgcacaggatctcgtccgttcttgacagcgacatggtgctgcttcttgacaacggcgtggccgtggagcacgacaggcccaacaaattgctggaggataagtcatctctgttctcaaagctcgtagcagaatacaccatgcgggcggcgcatacataacatagcagacgattgaagatggttctttcgtctacccatcggttgaggcataccaagtcatcgaaaatgaccaaaatttactattgccagattgcgctagtccaagcacaaccatggcgatcttctcaaaagaaaaacccaactacaagcagcgagagggattacagagcagatgggtagtagttattaccacattaaaaataaaacccataaatacagatacttggcaaaaaaaaactattttaatacaagtacatgttaaatttc

SEQ ID NO: 3623 - DNA, 592 bp, Sorghum bicolor
  Clone ID: SORBI-28MAY03-CLUS60708_1
gcacgagggcaagaagctattacagaagctgtatctgtggctcgagggattaatacaaagtatggttcttcaagttacaagcctgtcgtcctaattgatcaccgcataccattttatgaaaagattgcattctatgctgcgtctgattgttgtattgtaaatgctgtgagggatggcatgaacttagtaccatatgagtatactgtttgtcgacagggaaatgaggagattgataaactcagaggtcttgacaaagacacccatcacacaagcacacttattgtttcggagtttgtgggttgctccccatctcttagtggtgctttcagggtaaatccttggagtgttgatgatgtggcagatgccttgtgccgtgcaactgatttgactgaatctgagaaaaggctgcggcatgaaaagcactatcgctatgtcagtactcatgatgttgcttactgggcacgcagctttgctcaagatctggaaagagcatgcaaagatcattacagccgaaggtgttgggctattgggtttggtctgaattttagagttattgctctttctcctggcttcagaaagctgtctttggagc

SEQ ID NO: 3624 - DNA, 1003 bp, Sorghum bicolor
  Clone ID: SORBI-28MAY03-CLUS60732_1
gcacgagggattctatgagacacagtcctatttctacaaggagacacttgctcccttgagcatttatgccagagcagccattgttcgtgcaccgcctgtgcctcttgctccttcagttgcttcaaattagtttcttcgaggctcttgcactctgaagttttggcagcaagtactgacgaatggtttaatatggagagtgggtaatggggatcgcacacatatggaatgatccctggtttcgtagagagtggacttgccatccacgccaaggggtgcaaatctcatgaactgagtaattgagatgattgacccatgcacaggcaattggaacaagacactaaagatgtgaatgaatcttattaatcccagttcatatggagatggatgatgtggcagcctggtgctatggggtcttttcttgacgaaatcagcctacatagttcaggaggagtttgaaaaaaaagcaattatgtagctcattcatcttcaccgggggctttgatcgataaggattcaagagttttggaagaagatttggagcatgggttgcccggggcctggggaagatcaaagattttcctatgcacattttatcctgctattacgaatggtattaaagaaaagatggatggacttgaacacaaaatgtgttgtctgtcagtggggtagatgaagaaggacacctcgtttataagcgtaaagaacttaaggagggtaatgccagctgaatttgtaggaagctcggcagctcgctgcatgcttgcacgcaagtctcagcgcggggtttgatgaaggagatacttgagatggaacggggatagctcaggttgcaagcccgcaatggctatagagaaggcattgtgatgaaacaggcagatgagttctgattccctcctctctcactctctaaaagaaggtgagcaactgagcatagcctgtaacttaggaagattgtcacgcttgaatcctgatacaaaatttctggtgtaattttgacagtaat

SEQ ID NO: 3625 - DNA, 715 bp, Sorghum bicolor
  Clone ID: SORBI-28MAY03-CLUS60741_1
gcacgaggggcaacttcctcatcggatgctccttccttatattcatcctcaccacacgcttcatcgggaggaggtacaagaagctgttctggctgtcagcgatttcacctctgctatcggtcatcctgtccaccgctgcagtctacgcaacaagggccgacaagcacggcgtcaagatcatccagaaggtgcacgcaggctcgagcccaagttcagccaagcagatacacctgaacgggccgcacgccacggaatgtgccaagatcgccgtcatctgcgcagtcatcgccctcacggaagctatcgccgttgggcgatctttcgcctcggggagagggtacaaacttgacggcaacaaggagatgctggcgatggggttctccaacgttgctggatctctgtcctcgtgttatgtggcaacaggttcattctccagaacggcagtgaacttcagcgcgggcgccaggtcgactgtttcgaacatcgtcatgtccatcaccgtgttcgttgccttggagttgttcatgaagctcctctactacacacccatggcggtgctcgcctccatcattctatcagctcttccggggctgatcgacatcaaagaagcttgcaacatatggaaaatagacaagatggatttcctcatctgccttggtgcatttgttggtgtcctgtttgggtcggtggagattgggcttgcagttgcacttgg

SEQ ID NO: 3626 - DNA, 874 bp, Sorghum bicolor
  Clone ID: SORBI-28MAY03-CLUS60786_1
gcacgaggaatagaaaaaaaatacgaagatggcaactggtacaggcgacttgggctttgagtgtgccgttatcaccggcggtgccggtggtattggcaaagcgatggcccgacatttcatctcgaagggcaagaaggttctcattgccggccgaacagagtcgaagcttcaaaacacaatgcaggaaatcggggccgcgggctattatgtccttgataccggcgaagtccagtctatcccagacttcgtcaagcgcattaccacggaccaccctgaactggattgtctggtcaacaacgccggcgtacagcgacccctcgaggtcctcaaggacgacgacttcctttcaaaggcagaccaagagatcaacatcaacatccgtggtccgatgcatctcgccttggggctgctgcctcatctgcagaccaagaagtctgctctcatcatcaatgtttcgagcgtcctcgggtttattccattctccatcatcaaccctgtttacaacggcaccaaagcttggttgcatttctggaccatgaacctccgcacacagctgaagaatggaggatcaaatgtcagggtggtagagattgcgccaccgacagtctccaccgacctgcaccgcgaacgatcggaccccgacgataacaagaaggagaagaaccccaacgccctcagcgtcgatgagtttatggaccaagttgcgagcaaactggaaaagggagatgagaccattgggcctggcatggctggggaggttatcgaccgctggtacggagcttttggagaacagtatgcaaaggcaactggaagccagtaaacatctatttgtataatcttagcggatattcaaagaagaatctatcactgttag

SEQ ID NO: 3627 - DNA, 691 bp, Sorghum bicolor
  unsure (1)..(691): unsure at all n locations
  Clone ID: SORBI-28MAY03-CLUS6147_1
gaggccggccggggccggggaaaccccaccccaagcacgcgagccgccgactgcaccagagaaagacggctgcaaacgccacgggcgacgaactcaggcggccggggtgcctagctcgccggttctttacgccttctcctcccaattccttgggatcaacgccctacaagtacacggcgaggcttgccccccttcggctgccactccgtccgtcctactctgcccgccgccggcgccatgctgtacatcgtgggcctcggcctcggcgacgagcgcgacatcacggtgcgggggctcgacgccgtccgcagctgctccaagatatacatggaggcatacacttccctcctctccctcggcctcgacccggccgcgcttgccaacctggagaagctgtacgggaaggagataacggtcgccgatcgagagatggtggaggagcgcgtcgaccaggtgctaagcgaggctgccgacactgacgtcgccttccttgttgttggcgacccgttcggggcaactacacatactgatctggttgttcgtgccaagaaaatgngggtagaggtgaaggtgatccacaacgcatctgtcatgaatgcaattggagtttgtgggctgcaactttaccgctatggagagactatctncataccatttttcacagacgaatggagaccagatagtttctatg

SEQ ID NO: 3628 - DNA, 839 bp, Sorghum bicolor
  Clone ID: SORBI-28MAY03-CLUS61480_1
aaagattgcattgggtggtcggtattcacgtgacttcttcaatcggtatggggatttgaggcacatccgacgcttgcggttctggcctctcaacaaggtactgatggagaagtacgagttcactgaagtaaatgctattgggatggcggattttcttgttccaatacttgattttgttcctgagaagcgccctactgctgctcagttgcttcagcatccctggcttgatgttggtcccctccgacagcaacctaagacactgccagactcagcacagagttcagttgatggtgtttctgagaagcaaaagaaggagaatgaagaaagagatgcaatggctttagagttggggaacattgccatagatggcgcttcatccaggatggcaaatgaccctcaagcaagcacaaataaaacaactgctatcccttctaagaagtgagctgcatttgatttcatgagttaagctgtaaaacttgttttcagtcgagaattgttccagagtgggaaacagatgttttttttaggtttgaaatatgttagatagcaaccaaggaaaacgaagagtaggccaaatatttggtgtgtggagttggatggacaaggctagattcgttggggttgcagtaaccctattcctttttctttgagaacatattcttttgtacaattagaatctgcaatttttttaaaggttaacagtgaacaactgggaacctgagatcagttttaccatgtagttctcaattggtctggtctgaaattttctactgggaaccatatggaaacaggatgtggcttctttgatcactgtaacgatttacatatttttacctggt

SEQ ID NO: 3629 - DNA, 697 bp, Sorghum bicolor
  Clone ID: SORBI-28MAY03-CLUS61566_1
cctagctttcagtggtatagctaacaactttccccaagagtatatacaggcttaaacaacttgaggtgcgtgacatacctatattgttgttccacgataatcatcttggccgtgttagcaaattcgttacaattaaacatccaaaacatgctgtggagtaaggtcaattaaggccttgattggtgtgtaaggctacacataagagttgaactctatttctcataggagaaagaattatggggtgaaggattaacctgcaaggttgtttggttaattaggcaaccagcttcctggtgtgctttcagaatcaaactttacaatcaatcccaggatcagacatgaagtgcaatttttttctccaaggaaagagcaactcaacaacttcaagctctagaatttgtttgaactcaacccgtctctgtgatttggtgtcagaataaatccaatttggtggatcaagaatctggttgtgcacatccttaagaacttcaagctgttacctgttggtttgtttgctgatccctggttggcggcactccatttttgtatcctaacaaacatgtatagtctgttacttttttatttgtcatttgtacagtaataccatttggtcaactgatgtattcactattgttcctttcttacaaggaaaaaaaggtaaagatatgatactttgggttaaaaaaaaaaaaaaaaa

SEQ ID NO: 3630 - DNA, 589 bp, Sorghum bicolor
  unsure (1)..(589): unsure at all n locations
  Clone ID: SORBI-28MAY03-CLUS6151_1
tcggggcacgcgccggcatggcgacgctcgcgcggtggcatccaccactaccaccagccccactggccgctggggcagccgctcggcctcctactgcccgcccgctcgctcgacggcggatcccgcgccgagccgcgaccgtggtctccccgcgcgcgttcggcggcgacttcgatggcttcgtacggcgcgcgtggcggagcgccaacgcgggggccgagcgcctcgccttcgaggcacggcaggccgcgaagcggctggacggcaggttctcgatctcccggaggctcgcggaggcctcccgtgccgcccgcgcccgcgccgttgagatcgacgccgagctcggcatcgggcggcggtggcgctccttctccgtcgacttctcccgcaactggcccaggtatcggagggagatcaatgacttcatggaaactcccatcgggagagcattagctacaatatttttcctatggcttgcactgtcagggtggntgttcagaattttcatttttggcacgtttgtgctgccatttgctgtcccacttctccttggggccttggctaataaggttgccattgagggaacatg

SEQ ID NO: 3631 - DNA, 638 bp, Sorghum bicolor
  Clone ID: SORBI-28MAY03-CLUS61580_1
caacgccgctgggagaatggatcttcaagagcaagagcaaacagaacagctgcggtcttcagggggcttgcaagggcttcatgttcggactacaagtcacagagctagttgaaatctggcctgagcaggttacccacggcaggagatgggtacccgtagaggaggcatacggtctctgccggtacgactggatgagggaagctctggacaagctcaaggagcagctgctcttcgagagcaacgaattcaggcctctgccatcgccagagctggtggactcgtcgagcctgttcatggtgatgccgccggctgccgccgaaggggcggtagcgctgtgctgatgccgatgatgatgatgatgatctcgcgccaatggcagttgctcgtcatctgaagttccaggagccaaatggttcagatgtcgatgatggtttcagtgtttcaggcttcaaatcccacctgcagaaagagttgcagtgtcagaaccttgcggaatcaccaggacaaattctagtgtttaattaattaataaccttttcatgttgctgagaactaattggaagaaacaagctaacaaatttaaagttctatttgtggaatttgtttttatcattattatatgaatggaaaacaatttg

SEQ ID NO: 3632 - DNA, 663 bp, Sorghum bicolor
  Clone ID: SORBI-28MAY03-CLUS60957_1
ctcggcttctcctccagagtcaagtctggaatcgggatagctcggcggcaagagacgccatggctgcgtcggcgacgccgaggccgtcgctgatcctcccgcgtgccgcctcgcactcgcactcccagcccagcgccgtcggcctcacctccgaccgcgtcgccgcctcccgccgccggcgcggcgactttgttttcgtcgtcaatccctccggcgccaatggacgcacgggaaagcagtggaagcagctgctgccgctcctccgcacccgcctcgccgatcagtgcaacatttgcgagtgcatcacttcgggcccgtcccatgccatagatgtcacaagggaggctataaaggatggggctgatgctgtgatcgctgttggaggtgatggtacgcttcatgaggtggtgaatggtttcttttgtaaaggaagtccagtgcgtgctctcgatcgagggcctgaccattcaacggcgctcggtctcattccacttggaaccggctcagatttttctcggacatttggctggacaaatgatccttgtgacgcgattgatcgaattgtgagaggagtaaaatcaaaactagacataggcgtgatggagggtccaaacagggaaccacacttttttgttaatgtggctgatatccatttgagtgcta

SEQ ID NO: 3633 - DNA, 919 bp, Sorghum bicolor
  Clone ID: SORBI-28MAY03-CLUS60976_1
gcacgaggggccagccactgctactaccagcgttttcttacccattaacataccggatccgtggtgaataatcaatccattgtacacctcgtgcagtgcctcgtccaaccacccaagaaccaaccaaccgagataatatcgcacacaccacagacactatggtcgccctcgtccccatcgcccacattgtggctgccgtcttctccatcatcgagctcggcctgacatcatatgttgccagcggctacaacggctataacggctggagcgggtggtggtcacgctcccccgacatcgtcaacttcctcatcttcaactcggtgtggtcccttctggtccttgcctacgttgggctcacgcccctgtacatgacccgtctcttccacaagctcgtctccgtcggcctgctcgtcatcaccaccatcttctggttcgccggcgccatcgccttcgccgtcttcgtcggcactccccgttgtggagccaacacgttctgcggctcctcccaggccgccgtcgcctttgccttcttcatctgggccatcttcatgttcctcgccgctctcgacaccctcgaggccatgcgctcgcgcggccaccacagcaccaaggcccaccacacctaccctggtgcttaattaagcaaggggtttctcgccaagggtgaatgaatgaatgggacaaattcaagactgagtatggataaagcggttcggctttctgatttaacagcccgtggaaggaagtggaaatacccctcgagtatgaaacggtgtttgagttttgtttttcagtatgcattatgtggaaatacctggcgtcgggggaggaactgtattatttacgagtggcactgcgtgtgctgcaaatgcacaacgtggcagtgaagatgaatactactgtttactgaatgacgcgc

SEQ ID NO: 3634 - DNA, 743 bp, Sorghum bicolor
  Clone ID: SORBI-28MAY03-CLUS60958_1
gcacgaggcttcgaccgccttcatctctgaatacatcacatgaactcgcataaacttcttctggtagtgctgctgcttttgcttctcaactatgcatcatatgctgccacatcatgggaagatgatgagttcctcaaaacttgttcctcgcggcgatgccacaaacatggaccagagatccggttcccctttcggcttccaagccaccctccatcatgcggcgcacctgggatgcaattatcatgctctgggcatgacaccatcctggatcatccagttcttggctcctgcaaagtgacagcaatatattacaggcatcgtgtcatgaatatcatcctgccagcggactcgtcatcgcactgcccacttcagaagctggtcacaagaaatcaatcaactcatgtgtacgcacctgtcacacgcaccttctcgtcagactcagtactagtaggctgctcaagagaagcaacaaatcaagatggtattgtcggaccaagctcttgcctaagcctaagcaacaacgcaaaccagctctggtacctggtgcttccttatacagatatgtctactcttcccatgggctgtgaggtggttgcaaagagcatcccaataccatatgcatacgataaaattggtccaaaagttgagacattcttcggcagatcactcttcaacaaaaaggcaaatagagcaatcaattttggtgaaacatcgttcagttggaaccttaaccacatcaccaa

SEQ ID NO: 3635 - DNA, 370 bp, Sorghum bicolor
  Clone ID: SORBI-28MAY03-CLUS6101_1
gcgcgacatcctatcctactcggcgctcgtctacaaggcaaaccaacttttcgtccccccgatcgcgcgaaccttccactccctcgcctcctccgccggccccgccatggacacggcgatcggctcggtcccagcctcttccgacggcgcggcgccggcggcgtcgggttccgccccacgcgacgcgacgctggggaggcacctggcgcggcggctggcggaggtgggcgcccgtgacgtcttcaccgtccccggggacttcaacctgacgctcctggacgagctggaggccgaggaaggggtccgcctcgtgggctgctgcaacgagctcaacgcggcgtacgcggcggacgggtacgcccgcgcgcgc

SEQ ID NO: 3636 - DNA, 758 bp, Sorghum bicolor
  Clone ID: SORBI-28MAY03-CLUS61034_1
tctggtggaaatggcctcgtcgtcctcctctgactccggccgcaacgccgaaaccctagcctcgcgtacgagctcggccttagcggcggcgtcgctaatcccggggctcccggacgacgttgcgactgtcatcctttgcctgctcaccttccccgaccagtcccgcctccgcgccacctcgcgcgcgtggtgcttgctcctctccgcggccacgctcctcccgctccgccgtagcctccgcctcccgcgccgccaccttctctgcctgttccccaccggcccctccctcgcctccccgatcctgctcgaccccgccgcgcccaccgcctggtggcctctcccgccgctcccctgctctccgcagctctacgggctcgctaactttgccgcaatcgccgttggccgccacctctacgtcctcggcggatcttgcttcgacgcccgcagctaccctttggggcaaccctccgcctcggccgcggtctaccggctcgaccttgccaattctcgacattgctgggaacgccttcccgacatgcagctcccacgggggagcttcgcgtgtgcccacacgcccagtgctggcgggctcctcgtcgccggtggtgggtcccgacaccccatgttcccctccaacggcagccgcaccgacagcaccgagtggtatgatgccactgcgcagtcgtggcacgttggtgcctcgatgcctcgtgatcgggctgggtgcgtggggttcctggcacgcggagcaggagacg

SEQ ID NO: 3637 - DNA, 401 bp, Sorghum bicolor
  Clone ID: SORBI-28MAY03-CLUS61621_1
tggaagatccgtccaggccaccacacccatgtagcccaaacgagaagccgtgtgaatctgtattctgaaagctgcgtgaatcgcctgctactcttcgtaggatctgatctgatatttggctgaactgacagagtaaatacaagtcgctgtctagtagtacgagtcatggttatctgttgaacaaactgcccactggcaattacagtgaggctgaaagacttgcgaccttgacgccggcttgtcggcttgccatattccctcagcatctgcgtaggctgtgagaacagacaatctttactgtcattctcagaggctgttgttagctttagtgtggggagagcaaaagataacttacacggatgtttggcagtaatttacaagcctttggaccggaactcttc

SEQ ID NO: 3638 - DNA, 684 bp, Sorghum bicolor
  Clone ID: SORBI-28MAY03-CLUS61672_1
gcggtgaaaacggacaaggccaagatcttgaaggtttcatgggatgggagtgctgattcctataatgcggcaaagttggaggagctcttccagaaatttggcaaagttgaagacgttgttatcaagacaaggaaatcaaggagtaagggctcagcaattgtagtcatgggttcaaaagaagctgcattattggcaatacagaaccatttctctctgtttccattaaatgttgctcctgttcaagaatcgggtggattaccagcaaggtcagcacaaacatatgaatctactgcaagcaacattgatggaactggatttagcgatttggaagcatcggtgttccgaaaacttcaagaggcccagaaaaggaaacagtgtggttaattgctttgttctgatctgatgcatagtgctatatatatgacatctcacacaacagacaatacctgaggatcgcctgggtagcgagttacagaaatctgaaccacacatttcttgagttcgagtcttgtcgcagataaagttctctctgagtcatagcaacggcagatcaatttttctgtcactgtacaaaccaatgtatgtatgaatagtttgtattatcaaattcaggcttgtcctgcgaagacatggtgcaacactttttcgctggaaattgggaagatatcacccttacgatgctcc

SEQ ID NO: 3639 - DNA, 430 bp, Sorghum bicolor
  Clone ID: SORBI-28MAY03-CLUS6168_1
gcacgaggaagaagttgattcccaggatattgcaattactcatgagaataaggtcagtgctgatgatggattgcaagtccaggagccaatacgtatttcaaataatcgaaatgacaacaaagttcgagaactagaacttagaattgagttgcttgaagccgagctaagagaagctgcagctgctgaggtaggcctttattcaataattgcagaacatggtagctcagtaaacaaggttcacacaccagcacgaaggctctccaggcattttgtgcatgcgcttaaaaactgtttaagagacaagatgggaagtgcagcaagaaacgcaacctctgggctggttttggttgcaaaagcttgtggatatgacattgcaaggttgagtttctggttgtcaaactgtgttgtattgcgagcaattgttacggaa

SEQ ID NO: 3640 - DNA, 638 bp, Sorghum bicolor
  Clone ID: SORBI-28MAY03-CLUS61680_1
aatcgccacaaccatgacacaatttctatggctgtgattgacaagatgggccacatagcagttgggacatcaaccaatggtgctacatttaaaattccaggaagggtaggcgatggaccaataccaggagcttcttcatatggtgataatgaagttggggcttgtggagcaactggtgatggtgatattatgatgcgcttccttccatgctatcaagtggtagagagcatgcgacaagggatggatcctcgagacgctgccaaagatgctatatcgagaattgcccgcaaatacccagatttcatcggtgctgtatttgcagtcaacaaggaaggagtgcacgccggggcatgtcacggatggacattccaatactctgtacgaaattccagcatgcaggatgtggaggtcatcacagtatacccttagcaatggcaattcaccgaaaacaaaagtttgcttttatcagcaggtaggatatttacacgtggtgatgaacatttttttttcacaaccacccctgctgatgttttaaaaatgaccttttcttaaagccgattgttttgaaactagtagtactatatgtaccaatttgaccatagttgttttttccccttctataaaaagtgttgaatgcc

SEQ ID NO: 3641 - DNA, 562 bp, Sorghum bicolor
  Clone ID: SORBI-28MAY03-CLUS61688_1
agagaaggaagctgttgcaaggactggatgaggagttggagtgcctgacatattgggtctctcgcttccttgtcttatggacttctcatgcatccgtccaactggaaggctcgaacatggactggtatctggaagtaaaggaaaaacacaagcagcacatcactgcgacctggaattcctgatcagatatctaccatggatcgatcagtataaaagaatggagtgttccatgaaaggttcaaagtgtggatttactgttcatgaccaagaacagatatgcatgtcaaaagaacagagtacacatattttaagatctcaaatttgggacagatgctccgactacagggtcaaagactcaacacagaagcagagctacagcacggaggaatttttttgttactcaccacactagtgacttgtgtataatatcaatataatgctggtcttagttgagaactctgtcctggattaggaatgtatgtgagctttttgtatcgtggtgtatattaatcaccatttggatcttatagtggacgttcccatgattatatattatccatct

SEQ ID NO: 3642 - DNA, 730 bp, Sorghum bicolor
  unsure (1)..(730): unsure at all n locations
  Clone ID: SORBI-28MAY03-CLUS6171_1
gcacgagggtccattgaccccccatgaggaagcacaatcagttggtcagcttagggaagtctcaaataaggcacacaatgctgagctgaagttgtttctggaagttgaacttggaccagagttatgtccaattcgtccacctgagaaaagcaaagaagacatacttcttttcttcaagctttataatgctgagaaggaagagcttcgttttgtcggtaggctttttgtgaaggctctgggaaagccatctgaaatattgacaaaactgaatgaaatggctggattttctccaaatgaagaaattgagctatatgaggaaattaagtttgagccaaatgtgatgtgtgaacatattgacaagaaacttactttccgttctagtcagcttgaagatggagacatcatctgtttccaaaaggctcctgttccagatggtgatacacaagtgcgctatccagatgttccttcattcttggagtatgtgcacaataggcaggttgtgcactttcggtctctggacaaaccaaaggaggatgatttttctttggaattgtcaaagcttcatacttatgatgatgttgttgagagagttgcacatcaacttgngttggatgatccctcaaagattcggcttacatctcacaattgttactctcagcaacctaaaccacagcccattagatataggggagtagaacatctactggatatgcttgttcattataatcag

SEQ ID NO: 3643 - DNA, 482 bp, Sorghum bicolor
  unsure (1)..(482): unsure at all n locations
  Clone ID: SORBI-28MAY03-CLUS61257_1
aggatgcttccgccctgcttcccttccctactcccctccttccctccctatatctctctgcttgctcctcgcaccagcagcatacatacctcttcgcctaccttctcaatctcggtctctcctctggcaactggcaccggtctagtgactagtgtggttttggcgtggctagtatagcttttcctgtcagggattggcagttgcatggacgggctgacggacgagcagaggctcgcgttccaggaggccttctccctctttgacaagaacggcgacggatgcatcaccatggaagagctggctgcagtgactcgctccctaggtctcgatccgagtgatcaggagctcaatgacatgatgagcgaggttgatacggatggcaatggaatcatagatttccaggagttcttaagcctcattgcccggaagatgaaggatggcgatggcgatnaagagctcagggaagccttcgaggtcctgga

SEQ ID NO: 3644 - DNA, 570 bp, Sorghum bicolor
  Clone ID: SORBI-28MAY03-CLUS61302_1
gttcttcggatcataagtgacatagcgcttgctgagatagccgatggttgccctaagctcaaagaaattgcactctcccactgcccagatgtcaccaacgttggtctggaccaccttgtcagagggtgtctgcagctggagtcctgccagatggtctactgccggcgaatcaccagctctggggtagcgaccatcgtctcgggctgcaccaggctgaagaagctcctcgtcgaggagtggaaggtgagtgagaggacccggcggagagcaggacctgtcttgtcgttcctctgcaccgggctctaggttcagaagaagggaaataaatctgtgcagtatcaactcctttgttacccagaaagcttctgatgtggtttcttctttttttttttccttccttttctttggataaacaaaagcttctgttgttgctgttgctgtgctgtataccatagcatcattacctcaaaagtgtcgtatgaactatttatttactcacaaagtgttgcgcagaacaaaatgttgtaccaactgtttcatcaaaagtgatgaccaaataaagatcaatgg

SEQ ID NO: 3645 - DNA, 748 bp, Sorghum bicolor
  Clone ID: SORBI-28MAY03-CLUS61311_1
aaactctcacccaaagattgctgattttggtttggccaagttgtgccgtaccaaggagagtaagctttctatgaccggtgctagaggaacacctgggtttatagctcctgaagtgcactctcgaaccttcggagttgtttcaacaaaatcggatgtttatagttatggaatgatgttgctagagatggttggaggcagaaaaaatgttaaatcagtggctcaagagtcaagtgaaaaatattttccacattggatttatgaccactttggtcaagatgatgggttaccggcatgtgaagtgacaagtgaaaatgaaggaatcgccaaaaaaatgagtgtgattggcctatggtgcattcaaatattaccaatgcatcgtcctaccataggaaaggtcttggaaatgtttgatagaggtttggatgaactagacatgccaccaaggcaaaacttcagtgaaatattcttagatcctgcttgcggttcgtatgcagttcgcacatgcttgatcggtcgtaccaaaacaaaagcttctagtgaagtgctaaagatgaaggagataagcattgtgaattcaaaaatcttacaacggttgccaactctatgaaatggttacctacaacactggaattgggcattcaacttgtgtaggtatctctatgacagagggcgaaatcttaacttactagaatatttatttcaaaacaaaaaggccactggcttaatataatatctttcattcaaagtg

SEQ ID NO: 3646 - DNA, 618 bp, Sorghum bicolor
  Clone ID: SORBI-28MAY03-CLUS61402_1
taatcctcagcgctatgaaatattcttctgcttcaactctatatcatttatggcatctattgttgtagtcatgtatctgttgaacaaatctgcccggaagaaggatgtgccacttgaagtattgcatttgatcatgatattggacctgctggccctcatgacagcttttgctgctggaagctgcagaaaattcaggacttcagtctatgtgtatgctctagtgcttggtgttgtagtataccttgtgattgtagttcttttgtcaagtggcattgcaaaatgtctgagaccgatggagagaaataaggtttcctctcagagaagtcctagtcacgcttctacaacaagcacactgatacttgaagaccaagtttgatggttccatccctttgattgtaaaagagtgcaatcttgaagctacatgtgtatgccgtaagttccaatctatgcaatgcaataacaatcaaatcctggagactatatcacgattttctgtttgtcccgtatgcctgagcttgaaattatgttgtgtatggcattgccgttcgtaatagtcttggagtcacaactctgaaggttccattcttgtggcagcattgttagaatgaaaatattttt

SEQ ID NO: 3647 - DNA, 743 bp, Sorghum bicolor
  unsure (1)..(743): unsure at all n locations
  Clone ID: SORBI-28MAY03-CLUS61422_1
aaganagcaaccggtgattggaagaatggggggatgtctggtgtagcaggagattcagcccgtgctgctgtgatgaagaacgagtggaaggaccaagaccttggcctgaancaggtcgcgttcgatgagtcaaccatgcctgcgcccgcctgctcatgcacaggggagctccatcagtgctacaaatggggcaatggtgggtggcagtcatcttgctgcaccacgaacatgtccatgtacccgctcccagtgatgcccaacaggcgccacgctcgcatggggggaaggaagatgagcggtggtgctttcacaaagctgctcagccggctggcagcagaaggtcatgatctctcgattccggtggacctcaaggatcactgggccaagcatggcacaaacaggtacatcaccatcaggtagcccagtatccgccattcaagctggaagggggacagatcacacaaacgtgaaacgtcacttctcctgcatcccctaaagccacacttttgccatgttctgtagtgtcattggtttgtggtggatgtaggtagagttttgcgatcaggaaatcacagcgcggtaggttcccccccgctttttgctcgattggtaaactgtgctcgcgaggctggaatgccaacaattgaagtgtaattgtagctgtacagtttgacatctggattcgagtggtggtaattagcttcaggatcgtcgtcgtcgttaatctgaagctgtcgttctgg

SEQ ID NO: 3648 - DNA, 341 bp, Sorghum bicolor
  Clone ID: SORBI-28MAY03-CLUS61857_1
acaaaaggcgaataagagagacgtttaaggattttccacaatcagcactgcagttgatcgagacactacttgcaattgatccagcagatcggttaacagcaacttctgcattgagaagcgatttctttacaaccgaacctattgcatgcgaaccatggagtcttccaaaatatcctccaagcaaagaaatagatgcgaaacgaagagacgaagaagccagtcggtttgtccccttgccactcatttcatttagttaggaattaggatgatccactgtgtctgtgtgtcatagacttatctgctttgagtgtacagtaacaaatcttgttgctatacaaatc

SEQ ID NO: 3649 - DNA, 631 bp, Sorghum bicolor
  Clone ID: SORBI-28MAY03-CLUS61878_1
aatcctttcgaagcagcagacagcatcaaggaatattggccaaagacacaaaaactgataaaggaaagattttgtatatataagctgttcatatccatccaggtacctcctttgataagccatgattgtccgaggatcagtttactgtcctctgagggatcagtaagagacaagatatcagttatcaccctaatgtgcagatatgcgtaggctgcaaaccaacttttattaggatttcagattatggtatgtggtatatgttgaatcaacttgagttctctaacatctcacggctaaacttacgtaatgtctgttgtggccaggaactttcccaggagacatcagtaaagctgggagtggagtacccccttgcttgcaattatatgtgtgttagattatgtgttgtctggaggcttacagtaagttttcaatacatttccatacaactaaagcagagacaatttgatttggttttagaggattttgcatatggcattcaacctggtttcggtcactgtacctatacagcagcatacagatttagttttgttgacaattgtacaaggtattgtgcgcatcttgaacatgcacttaacaggtttctgagcgataaatgtaaaaagggttcccg

SEQ ID NO: 3650 - DNA, 534 bp, Sorghum bicolor
  Clone ID: SORBI-28MAY03-CLUS61881_1
atctctcgcgtgattgctaagcaaaggagggatctcaacagagttaatgttaaaaaggacatagatatctcaagttccgaaaactgcagggtttgggtcgaaatgcaatcctcaagtgacctgaatgaacagggcacttcttcgacgagtgtttcacattacgctgggagcccttcaagtgacatcgttcttctttctgaattacagcgtcaaagcagtaaaaaagaggatgttgaggatataactgttatacccaccattccaaataaagaggatgataaggatatcattgctatgcccgttattccagataaagaggatgccgttgatgggatccctatcctcgccattcctcgcgccatgttgtgtaatctagttacacggtgtgtgcattttttccgaccttaatcctttatcaccgtgtctttttgctactaaatttgtaccatggtaagtttctcagtaacatggtcggttgtttgaatttgtaatatggttctgaataaatgaaaatgctaaaggtgggcctttttt

SEQ ID NO: 3651 - DNA, 594 bp, Sorghum bicolor
  Clone ID: SORBI-28MAY03-CLUS619_1
gcgtccgtttagcctttagacgtcaattaggaagttctatgaattttcttggtagagataaatccaacttttggaagctttcagagatatttgcatgagctccaaatattttaatttggtttctcctagctcaaggtatctatagaatgtttttcgatttttttagtcttgaagatattttcattgtttaaaaaacttattccttgtatacggatttgtttttggactaaaaggggatgatgtggctcaaaaccacttttaactgctgcagggggtaatctgtacggttttcagagttggaggatgtaagatttcagactcagccacaattcagggtagtcaaatggacttcacacaaaataatataactgagaactgtggtctaagaacaaggacaagcctacttactcaaacttctatggagcatgacaaatcattgtgggaaagttgcagcaattgacaaaaaccatatatacatgaggtgtgaagattctagatagatagacagttaataacatagttgttgaaacattttcatgtatatttgacacaatgactatcatgtttaaatgcaacaatcgtcagagactcaaa

SEQ ID NO: 3652 - DNA, 813 bp, Sorghum bicolor
  Clone ID: SORBI-28MAY03-CLUS61904_1
tgtggaccaatgcttggtgtggcggtgcctagagtgcctgggctgcaccttttgtgatcaatgctataaacaaaatggtcaaagtttgcatagtcatgaattgaggcagattcacactagtgaaactttgcagaagcacactctacaggattacattgatggtcttctgcatgcatcgaggtgctatgatccacgtaactgcacccatccagtctgtttaaccctgaagaaattgttcttccatggtgtacgatgtgatatccgtgcccgcaactggagtggttgcaataagtgtgtctttatgtggaaacttctgctctgccactcaaaagattgcaacgatgtaaactgttcagttcctagatgcagggatataaaggcatatatagctgaaaagttgaaggttgttggtcctgtgttgtagcaggccatctggtcagaagccgtcttgtataatctagcactggattccccccctccttaaccagtaaaatttgttgatgaaaatgcaataaactgcagttggccatctctggtggatggaactgcaaggtaaataaagtggtggcttagtgctgctggtgaggtggccggcttcatcggagtcatttgttccgtcggtttccctgacattggtagaaggaaggtggcttctgtttgctctgtgctgagctccattttgctaatatgggcatggcctggagtctgtctgatttcctccaatgtcactgagaggatcaccaacggaagcttacataggcaatctgacattgtttttaatgtccgtacataccatgtacatatagtctgtat

SEQ ID NO: 3653 - DNA, 685 bp, Sorghum bicolor
  Clone ID: SORBI-28MAY03-CLUS61919_1
gtggacacttgtaaagataagttcctgacgttcgaattcgaagacgacttccttgttgttttgcatcgagaagaagcggctgctgcatcatcagacattctcaaggaacatgccataccgtctatacggtcatctgatctatcagaaccatatgtagaaacaaagaatgacatccaaaaaacaagcgaagattttggtgaaagtcctgtcacaaactttgaaatgggaatcgattgtctcttgtgggcatgatcattcttttttaatggacgagctactgagtgtgaagtttcagttaaatctgcagtaaggccagtgaattgcaagcatctgccggtgaacaatggcggcaggagtgctctcccattgtgtactcacacacgtaccttgcggcaaagctgagtcatgttttatgttagcatagacacaattaagagttatgttgtacactagaagccataggatgatttattcatcttcattttttaggcagtcaggaattgagggattgtacaatttgtccatcagcaatcctgtaaacctccggacatgcaaatatgcaatagatggtccagaaattttgttggtttacgctacacctgctctcttattgatattgcagaacaaagaatatctgtaggatgttatgtttcctttagtttttgtaatccatgaagttttgctt

SEQ ID NO: 3654 - DNA, 472 bp, Sorghum bicolor
  Clone ID: SORBI-28MAY03-CLUS6640_1
gctccatgcactcgttcggaaatatggatgattgagaaaggttcactggaagatgatatattccacgagcccatcttttcctgcctatctgaggagctaaacgaattacacaatcggacatatgaggctattgtacgccctgctgttcagagcatggaactacaaggtcaattcgacatgcctgaaaccattccggaaagcaatattgctgggtttagggctgctaccattaatgacccacttcacataccagatgggattcaatcagatgccttgctgtcaggtgcaaatgatgcatgtggcgctacacctacttttggtttgcaaattcctcctgacaaccaggttaacggtgcatctaatgattttgttatcggcactctgtttcaaggggtgactgaaccttttatcgataatgagaaagaagtggcacctgctgacagagagcatgctcaagtagatacactgtata

SEQ ID NO: 3655 - DNA, 663 bp, Sorghum bicolor
  Clone ID: SORBI-28MAY03-CLUS66393_1
acgccgtcctctcgaagcatttttcctctcgccgccgtctcgcccccgccgcttctcgctcctcccgcgcgctgccatgggctccgtagccggggacaccgccgcccgcctcgcgtacccgccggcccgccgcgacgattccgtcgtcgacgactaccacggcgttcggatcgcggatccctatcgctggaggacccggactcggaggagacgaaggagtttgtggcgcggcaggcggagctggcggagacggtgctcgctgggtgccccgacagggagaacctgcgccgcgaggtcacgcggctcttcgaccacccgcgccacgccgcgccgttccgccgcgggaacaagtacttccacttccacaacaccggcctccaggcccagagcgtgctctacatgcaggatgatttggacgggaaggaagaggttcttttggatccaaatactctaagcaaggatggaacaattgctctttcaacatattctattagcaaggatggaaactacattgcttatgggctaagtgaaagtggtagtgattgggtctctattcatgtgaagagcatcactaacaagcagcctatgcctgataaattgtcctgggtaaagttctcatctatcagctggactcatgacgggaaaggttttttctatggtcgg

SEQ ID NO: 3656 - DNA, 668 bp, Sorghum bicolor
  Clone ID: SORBI-28MAY03-CLUS66421_1
tggccatttttgaccctaaagaaaaaactgtgcgtcgtctgtgctttgcttaatgctgctggaatcatgagggggtgccacggccacgataggagacagccttttggcaccgaaagggttgtcagtgaggatgttgattgcgttttcagtacatgccttgtccttgaggactttggtgtctaaatacagtggcggtgcattttcttttagtacgagtgtactgattgttgtgctttgctggagattgacaatcgaatcatgatgtccctccgcttgcattgttactgaacagctaagatcacttgatcaatcatatgacatcaaaatgggggtatgggtgtttaactgttcctgaagaaggtgggtcattattaggcatttgttattgagtaggttaacctcacctgtggtgcctgatgaagggaaacaaggattggattacaggtcctctggctgaacattgaactgtgcttgattgcttcaacctaattgcatggattctttgtgtccatgaacatgaaccactaatttgaaaattttcttagtcagaactagatattccaccccaagagttctcagcttattgcctgtattactctgcacaagttggtttctatcatatttacgtgccttcggttttctatagcttcactgagtctacatgtgaa

SEQ ID NO: 3657 - DNA, 736 bp, Sorghum bicolor
  Clone ID: SORBI-28MAY03-CLUS66424_1
ggatccgaccattctcgctcacggctcttttcctcctccccgtgtccgtgtcgtgtcgtcgtcaaaccgccgctttccaattccaggccatcaaggcagcagcagccccccttccgtctccgcacgccaccacaggacaggagcctcgccgcgcgtgcagcgcgatccgagggccaggccatgatgaggagcgtcagcggcaccggctcggccgggagccggaggagcgaccccggcggcagcggcgagctgtcccgcttctccgtcgccaccaccacggcgtcatccgcctcggattcttccgcgagcagtggcgcgcgcgggatctccttccttgacgccttccggtcctgcttcgtgcccccggaggcgcgctcgccggagaactccatgtccgacgactcccacccctcccaccaactatcacagtctttgagctcacaaggttctaacagtgggagcgtgtttgggagcaggcgatcaattaaaggaatgtatagtcccatgcacaagagttctttagatagggagatccctggcagcacaaaattctccttgtcacagatccagaaagcaacaaagaacttctcaccaaacttcaagattggacagggtggttctgggactgtatacaagggtcagcttgctgatggtactcttgtcgctgtcaaacgggccaagaagaatgtgtatgacaagcacatgggtcgtgagttctggaacgagattgagacat

SEQ ID NO: 3658 - DNA, 708 bp, Sorghum bicolor
  Clone ID: SORBI-28MAY03-CLUS66438_1
acccaatcacgcgtacatataagagttactttttctgagggaactttcagatctttgtaatcgtcgttagctagtccctgtgtctttggtcattgctggatcaggggcatggcttggcctaggtcatcattagttttgccttttggtctcatcgccttggtgtttgcttgtgttgctcaagcttcgatcgtggagcacaccttcaacgttggaaacctttctataagccagctttgccagccaccaaggatcatcacggcggtgaacgggcagctccctggcccggccatccatgccagtgacggagacactgtggttgttcacctcgtgaaccagtcaccctacaatgtgaccattcattggcacggcatattccagcgtggcacaccttgggcagatgggccaacgatggtgacgcagtgccccgtgaagccgggcggcaactacacgtaccgcttcaacgtgacggagcacgaggggacgctgtggtggcatgcccacatctcctacctccgcgccaccgtgtacggcgccctggtcctccgccctcgtggcggcaccgaggcctacccgttcccaaccaagcccgacagggaggagacagtcatcctcggcgagtggtggaacgacaacgtctatgacctcgagcagctggcgttcctcaccggcttcacggcgcgcaacgcccatgcctacaccatcaacggc

SEQ ID NO: 3659 - DNA, 494 bp, Sorghum bicolor
  Clone ID: SORBI-28MAY03-CLUS62000_1
cctcgcctgccccgtcaccacctcgaacaccaccgtccagaagcggtacacgtcgctcgccggcgtcgccgtctcgtcgccgccgccgccgccgccggggcggtgcaggaagtcggagatccggggctccatgtcgtcgccgagcaggatgttggtcggcaccagacggccgtgcacgatgggccgccgccgccggccggacccggcggccgcccccgtccacccttggtgcaggaacgcgagacctcgagcgacgccgaggatgatgcggttccgagtcggccagtcgccggcgggttttctgtcctcgatggcttccatggtgtccatgcagatgtcctcggtgtccatgctccccactggcagctcgtggacccaccggtggaggtcgcctttctgccatgtactcgtaaagcacaagttttgggttccctgttgttgtatgtatacattaacaagcggcggtataaaatctttacaagaataggatgatc

SEQ ID NO: 3660 - DNA, 678 bp, Sorghum bicolor
  unsure (1)..(678): unsure at all n locations
  Clone ID: SORBI-28MAY03-CLUS62052_1
aaggggatgctgtggatgaagaagttcagagaccaaggagtcgccggaggttcataagatcaagatcagaggagcgggcgtaatacattggtagctgtggtaattacattcttcactgctgtgaagttctttaaccatgaactcatgatgactccttgcatgatctttgcatgccagtggagatgtggatgatgtgcttccttgcgtggttaaaatgctggtgcatcccttggaatcaaagacctaaaggcgaatggacctcaaagttcaagttgagaagaatgcaccatccatgggcccctctttaatcaagaaacactcattcttagggcaaagctggaggtgacatggaaactagcgtttggagatgctcactccatcacagctggtgctgtcactgatgcaccatgtcttctttaccttttgcactgcgtatcatcagtatctgttgtatattctttcncatgttacatttcattgagtccatgctgctactgttctggctgatatccttgttcagctgaagcagttacagttgaatttcctgcatctgattaacattaggggtatacttatttccatccattcagagcatttgggtgtgcgtgttgtaattcaaatggttgccatcattgactcattggcttgtcaatccaacccttaggcaagtttgatggc

SEQ ID NO: 3661 - DNA, 556 bp, Sorghum bicolor
  unsure (1)..(556): unsure at all n locations
  Clone ID: SORBI-28MAY03-CLUS6210_1
cccacgcgtccggtcgtggcctcgtgggggttggggacggagagccagggagcgcagcaagcggttcggtgggtggggggcgggcggcggcggccggaccgatggggagggcgccgtgctgcgacagtaccaagggcctcaagaagggcccctggacgccggaggaggacaagctcctcgtcgactacatccaggccaacggccatggcagctggcgcatgctccccaagctcgcagggctgaaccggtgcggcaagagctgccggctgcggtggaccaactacctgcgcccggacatcaagcgcgggcccttcacccccgaggagcacaactccatcctccagctccacgccatagtcggcaacaagtggtccatgatcgcggcacagctgccgggcccgacggacaacgagatcaagaactactggaacacgcacatgaagaagcagctgcgccaggagggcgctgncgcccagcttcgcaacggagcggcggctgcgtcgtcgttcttgccccgccgcccgccacatggcccagtgagagatcgcccgcctcg

SEQ ID NO: 3662 - DNA, 507 bp, Sorghum bicolor
  Clone ID: SORBI-28MAY03-CLUS6213_1
agagcagagcaggcacacctcaccgcagcgccctcctcgtctctatccccgtcggatccaccaccgagcaccgaccgaccgcacctctgctcgctcctgccgccacaatcgctgctcttctctaagtgctgtcgatttgtgcgttggctggttttcattcggttccatccttgtgttgatcaatggctgacggtgaggatatccagccacttgtgtgtgacaatggcactggaatggtcaaggctggctttgctggtgatgatgcgcccagagcagtgttccctagtatagatggccgccctcggcacacgggtgtgatggttggaatgggccaaaaggatgcctatgatggtgatgaggtacagacaaaaagaggtatcttgaccttgaagtaccccattgaacatggtatcgtgaacaactgggatgatatggagaaaatctggcatcacaccttctacaatgaactgcgtgttgctcctgaagagcatccagttctgctgacag

SEQ ID NO: 3663 - DNA, 667 bp, Sorghum bicolor
  unsure (1)..(667): unsure at all n locations
  Clone ID: SORBI-28MAY03-CLUS62110_1
ttgtggccaagtacgctttgttgtggaagctgtccaatcccatactacatgatcgtagaacccctgttgtgctntactatgtgggaatgactgcatgctctttttctcctatatatatgttcttcgttggttgagtctgtactgttgtaaatttatttttgcatctgaaagtatgcatgttttaaatgtctagggatttgccctccctggggtctctgagcctccatttccccgttcttccacccgctgagcggtatctacagcttgtattgctgcttctccccaccttctgactctgtcgtttttgttcaacttgttgccccgagctgccttcttccggggggcttgtcccctctcccccactcgtcctcggccgtctcggtggtgttggaactttgccccggtttgtagccttcgagtgcatgcggtccgggtgttgtccatgcagccgggaattcggctcctttgacgtggtaggtcggattttcatgtgaaccagtatcctccggaagatgatttaggccgtcaaattttcagagatatccatgtagtatttcaatttgatctatttatatttgtggcattttaggtattgattgagaacaacttgggagaggcgacattctatgattcactgttgcccttggggggataaattaatgttcct

SEQ ID NO: 3664 - DNA, 712 bp, Sorghum bicolor
  Clone ID: SORBI-28MAY03-CLUS62141_1
ttaacagactgggatcgttttgcacgaagagagtatgtaagattggcgatggaagaagatggtgaagatgcttccaatgcaagtggagatgtttgggatgagtcacttgaatctcctttctagattgaaaaatacactgtgaagacatcagacattcacatgcagccctaataatcaagtcaaatcatgatcgcagcaaagcatgaacagttatttgattcttatctttacagaaactatagttgaggcagctgcatgcttgctggcaccatccaaatttttcacatggaagcaaaaacagatacgtccacctagtttgctgcagagtccattttgttcttggtgacattgagaggttttgtcattgcatccatgatatggtctagttttgctgccaaaacttcaactgattgattcatggcagcaacaagagaacagcaccttgtgattattccaaaggcagacaataagaagatgagcaggggtccttgcagcggatgcaatcttcatatggtggatagtgaatagttggcatccacaatttttattctcatagtgtctcgattagctatctgtcaaagtattctttctttgttgaataaggtcatcaagaaggccggccatttacttgtgtattctgtactttatttagtttgtagtcacatgaacaatgagctgaaatactatatatcacaggtttgttgtcattttc

SEQ ID NO: 3665 - DNA, 460 bp, Sorghum bicolor
  Clone ID: SORBI-28MAY03-CLUS62174_1
gtggcggtgccagatttggtggccgtgatttccggcgagataggggcagtggtggagggtatggtggtggttcctttggaggaggtggcggtggtggtggatatgggggatcatcaggatacggtggtggctatggcggcggcggtggcagcggctatggtggtggtcagagtatgagttcttgggactaaaccagactctaagcgaaaaatgggtcaaccatgatcaattagtccctgttgggtggaacgaatgcttggaatttgttgctcgacttgacgagtacggtgtcgggaaatgtcccctttgcctgggttctggttaaatcttgtgttttgtgttgtactagggattggcttatgttattatctgaattggtgggttcttctacccctcatgcttgtgctgtctcttttcacggaatatctgtttgcattttatatcatttgtttactcccca

SEQ ID NO: 3666 - DNA, 589 bp, Sorghum bicolor
  Clone ID: SORBI-28MAY03-CLUS61735_1
tcatgttctttaggtttgtcacttctggtgaaattcaaaggaggtctgacttctttgaaccattcatatctggcttgacaaattcaactgtggttcagttctgcaaggcttctgtggagcctatgggtgaggaaagtgaccatgttcacataattgccctatcggatgcactaggtgtacctatccgtgttatgtacctagaccgaagctcgtgtgatactggcaatctgagtgtgaatcaccatgatttcatcccttcgtccaatgcttctgagggtgatgctgcgatgacatctactcctgacgctgagaacccttacatcactttgctctaccgtcctggtcactatgatattctctacccaaagtgaattttgctcatggctagtttcatgacttggttgaggaagcacacactctagaaatctgtagtcatttttcgcctgtgtgctgccaaaggtggcaaacttgcttttgtgtgctgatgccctcgttcaaattagttgttttctacctcctgtaagtcttgctctggtacaacgacttgacattgtgttgactgcggagaagttctgttgatattgctcct

SEQ ID NO: 3667 - DNA, 624 bp, Sorghum bicolor
  Clone ID: SORBI-28MAY03-CLUS61792_1
cgtgagattggcaatgcgttttctgaactcacagacccaatcgatcagaggagccgttttgaaaatcaaataaaacagcacaatgttaagcgagctgcaatggctaaggaggtgaaatctactgagggtgatggagaggatgattattcctatgaagtttctttagacgaagacttcttgacttcattagaatacggaatgcccccagcatcaggaatgggccttggtattgaccggttagtaatgcttttgacaaactcttctagcataagggatgttattgcctttcctgtcttgaagattcagcaatagtccattctagttaagaagagatacactattggtgacagatgtggctgctgaagaaagtagcagcagactaaattttggcttgtttcagtacagcagattttgtatttgctaatctttttagctgatagatagttgtggccatttatttatattgtgatgtattatggctccgagtccaagctgaatatcaacaacctgatagatgtttcaacacttgtatcaataataatggatggatttcacattttgcaatcgatgtgctgcaaagcagtggtctccactggataatctgattcctgagtgacatgatta

SEQ ID NO: 3668 - DNA, 411 bp, Sorghum bicolor
  Clone ID: SORBI-28MAY03-CLUS61852_1
ggaggctcgccgtggagaggctgatcgtgttattcccactttgaaaccaaagcatctgttctctgggaaacgcactcttggaaagacaagcaggcgataagctcagcacctcattgtatctggtagtaaaggactggtgcaactttggtgtggacaatttgatgaaacgggagcttttgtcttcagccagcacttatttgtgctactatttatgaaatatgtcttgctgtatcggggtcctcttgagacacagttttgctagtttatacatgtattgctctgaattggtttggctactatatattagctttctggtgttaatttctcttgaatggtacgaagttattcatctctcctacttgagaagtctgtattgtgtctgagattcagcatcgattcttctgtgctgct

SEQ ID NO: 3669 - DNA, 368 bp, Sorghum bicolor
  Clone ID: SORBI-28MAY03-CLUS61805_1
agcagactctgcgcgctgcgcgagatcatatgctacatgaatgcaaaccatgttgctaatgctgcaacaacaatgaatgcccatccagcaactatcatgagcggagctgctaactacaatacttttggcacaagcgcaactgcatggaactctgccatgcaaatggtccagcagcccatagatcacttgcggtaccagtgcttctaggatctagctagaaggaggtcgagggccaagaccaacaaggcatgcctacgtatatattatatacttctctgtcacaagtcagcaagtagtgtatgtcttttgatttaatttataaaagtttgtggacttgcgggcgaaagccatatagtgtttttgcctct

SEQ ID NO: 3670 - DNA, 507 bp, Sorghum bicolor
  Clone ID: SORBI-28MAY03-CLUS61853_1
ctccaacagaacaagcaaagctgacatactgtagaaacttatcaggtggcctacacagcgccaaagacactaatgtctctcagaaggcaattcttgagaggattaaatccaagagtgagtctgaatcttatcaacttggcctaaagttgtccctgaaatggagcactggagctggtcctagaattggatgtgtgaaggattatccaacagagcttagaatacaagcacttgaaatggtagacctgttagcaggggcatcaacagtaccacatacgccgttgcttgcacaagctcaagaatgtcatgacccggctagtaggttagaagcctagaagacgatctcatcacatgtgcactgcatggatcaactaccattactgacaataagaaacctatgcagttcgtatgttggaaaatgtaactttagagctgtattgtgattgtgttgtgtactagaaggatttcttggttctttctttgaatctgctatattgaaaagttcaccta

SEQ ID NO: 3671 - DNA, 574 bp, Sorghum bicolor
  Clone ID: SORBI-28MAY03-CLUS62284_1
cccatctgagatgacaaagaagcacggggtgaaacctgataaaggcaatgtttccccagatgcccagaaatggctcctgaagctgaaggatttggatgtcaactgggtggaatactagattagctttgaacaaaagatatggtctctcattattagctcaactctttcccttcttcggaggtgatctggaagcattccgacaaaagaccccgcaaattgtgtacagaaaagtgcgatacaccggccaaccctgaaggcaagccaccagcaggcaacaggttttcttgtgtcagtaatcacgactcttggctactgcgtatctagaactgttgacaatactaacagctttgttgcggtcaaattgatccgtggatttgacaaagtctagccactaaacgcagatcgggtgtgcaatttcgtgtttgagtcagccttgcctttcaaagcaggtggtcatcgctgggttaaactgtggtgttgacacttcacagtttggtcgcctactttgttagtgatgatgtaagttgacctggcccttttgttttgacacggaaaagagaaaggttaccatcct

SEQ ID NO: 3672 - DNA, 628 bp, Sorghum bicolor
  Clone ID: SORBI-28MAY03-CLUS62311_1
tcttgcatctgacaacatggaagagcacacctctgtgcacttcagagtttacaaatcacaggagaagtacatggttcttatgtgctctgatctgagaaagtcgtccttgagaccagaactgtacacaccagcctatggaggcttctttgagttcgacctcgagaaggaaaagactatatctttgagaactttgatcgatcgctctgcagtggaaagcttcggtggaggtggtagggtctgcatcatggctagggtctatccggtggcgctcatcgacgatggtggcactcgcatgtatgccttcaacaatggcactacaaccgtcaaagtgcctcggctaaaggcatggagcatgaggagagcacaagttaatgttaagaagggataagcacagacagttagtatacacttagtgtagacgctatgaaatgaagaactctggtcttatgattttctttgactggagtgttaggctacacagagcaaaacagttaaatttgaaaagcaacaatcaattggcacaacagatatacagaaagtatggtcgcacaccctaatgatgacacaattttcaaggaactgactgtaaaaaaatacagagaaatttctgttgtttactgaatgtttt

SEQ ID NO: 3673 - DNA, 582 bp, Sorghum bicolor
  Clone ID: SORBI-28MAY03-CLUS62337_1
agcatatgtcaaaagtgttgttgatccaacggaaagattaaagcaaatagctgagatgcttgctatacattactacctcttgtttaacggatctgatgggatttggcatcatatgaagacattctacatggaacaatctacattcagtttctcagggaaggtgtatgttggccaaaatgacatttttgatagtttgtcaaatataagaaagaagctaaaaggtgataggccccgagagaaaattgttcatgttgtcgagaagctacattgtcgtgcgaatggtgaagatggagttgcaattcgtgtatctggatcattcattgtgggaaaccaatttcttgtatgtggcgatgggataaaagctgaaggaatgcccagcttggatgagctctctattgacattccaagcaaacgtgtaggccagttcagagagcagtttatcatgctaccagggaatttaatgtcttgttattacatatcaaagcaagatttgtacattatccaatcctgatggaacatattatttgtaagatttactctctgaagctcatgtaccatggatctggaaaaaaaaatcctttg

SEQ ID NO: 3674 - DNA, 498 bp, Sorghum bicolor
  Clone ID: SORBI-28MAY03-CLUS62447_1
cgatgagaggtcaaagtgatagcttgcagcttacaagggtgccccaataatgagctgctgctacagtgaggttggcctcctatgaaaaggaagaaaaaaattagaatctggatgagtacttaggaactggatagtaaagcacatgaagatacatcaagctcataactaaatgcaggcgtgttatctgccaatccacgcaactatggaaatctcattttttttaccataattcattatagagatttacatgtgtcatttccatacattttgtgatgattaggttttgtaccatttagccccttgttccatttgattttggccaattggaagattattgttgcattgctgtttagatcaaagtctcgaaccatctaaaagttccagacaaattgtgaatgtgaaggtacatttttgctgcagctcatgtctaggttctccaacaaaagtgtaaatcacagttataaatatggaaaattgtgaaaacaaaatctttatgtt

SEQ ID NO: 3675 - DNA, 582 bp, Sorghum bicolor
  Clone ID: SORBI-28MAY03-CLUS6246_1
gagagacgcaagaaactaaagagagagcagcaggatgatgggtcaaggctacattcccagcagattaggaatgattatgcccctcaacccaaaaggcatagtcgctttaaagaggcacctcagggctggttggactgtcctgcatttggggagccaatagataaaatcataccatctaaagttcctcttgatgaaacattcaatgagtcagtgcctcctgggaagcgatactcctcaaagcaactagttaacaaacaaagaaaagctggccgcgaaataggtctggtgattgatttgacaaataccacccggtattattcaccagcagaatggacgaggcaaggtactaagtatgcgaagattgcatgcaaggggagagatgctgtacctgacaatgaatctgttaataagtttgtctatgaggcaatgatgttccttgatcgacaaaaacaatcaaagaatcctaaatatattctggttcactgtacccatggccataatcgtacgggtttcatgattattcattaccttatgcgcacacacgtctcttgtgttgctgaggcgataaatatatttgctcaa

SEQ ID NO: 3676 - DNA, 655 bp, Sorghum bicolor
  unsure (1)..(655): unsure at all n locations
  Clone ID: SORBI-28MAY03-CLUS62388_1
agtggccagcatattgtagaggttaagcctcaggctgtcagcaaaggttttgtggccgagaagatactttcaactctcatgancaagggaaggcaagcagacttcgttctgtgcattggtgatgatagatcggatgaggatatgtttgaacagattgctgatagtatgaggaggagcatggttgatcctgaaacctcgctgtatgcctgcacggtcgggcagaaaccaagcaaggccatttactatttggatgacgctaatgaggtcttaaacatgcttgaagcacttgccgatgcatcggaggaggctggttctggttcaccggaagccacggatggaccatctacactggaggaagcatgataatggcatcaggtcccatcctggggaggtggaagtgcttagctgatttggcactgccaggactagacgaaaactgaagccgatttcgttcagcaggaagtgaaacgttagcaataccaggatagtcaatgtcaataacctagttgtttctctatttctgcttccttttccagtttaccttaaggtagagtaattttcatattgtatctagtagtaggtaggaaaaagtgcctggagggaagaatccatggccggcatcttttcacctttttcatccttggtaccagttaag

SEQ ID NO: 3677 - DNA, 723 bp, Sorghum bicolor
  Clone ID: SORBI-28MAY03-CLUS61928_1
gagcagaggagaaaacgtatcaatttgtcccgtggatccaagtattatataaagcagctgcagccaaagcctgctggggttaacgcgaacaattttgtcatcagatgactcagcacgcacggagcttggtgccacttaagaagatagctaagatcacaccaattttgcgcttgcccaaaggcataatttcacaaagaatcaaaacaccatctttgtttaagtatgtgaaggaagtttgtttcaccaatggaatcaaggcagagaacaaacagctgatcgaattatatgtaaaccctattaacaagcaataccaaatagaggcatgcagtcagaacttaccttttccacttttattgagagaaaaaataactagtgaaaccattggttctatattgtatccataggtgccaaagtacccgcgaaaacaaagaatagaagataggttgccttttttttttccccgtgtgtgtgggtctgcaaaaaggaggcggctttgttatccgccagctggactgacaggttttctagttttgctgccaaccaagagtttggttttctttaattataagcttcaaaagtggaactacttattctgataatgactttgttctgctgagatcaaaggcaaggcttttctacttctttttctcccgtagaaagagagaacatcagtaacgtgtgatggtgatatcgtatcattggcgaggctttattctttcgctg

SEQ ID NO: 3678 - DNA, 560 bp, Sorghum bicolor
  Clone ID: SORBI-28MAY03-CLUS61943_1
ctcatctcctacctgcagccatggaagtacaaggcagtcaaggcttcagggtttttctcccggaaaacaaaccatgaagactgccctatttgcttgtccactttcagaagccgtgaaaccatgataacgttgccgtgcaggcatcactaccacgcagcttgtgtcaccaaatggctcaaggtcaacaagacatgtcctgtatgcaaatatgaactgtttggacattcctagcatccgaccgcgtcaccgaccgagctgataaactgatgaggcgtcacacccggctggttgcatcatctacttttttagtgtcaagaaaattgaaaatgaaaaaaaaaaacaatccaaaaggagaaaaaaaagttagaagtatagatgcttgatccccccaggaaaagaaatgaaaaaggaaaaaaaatgaattttaggtgttttaattttgcctttggcttgtggaaatgtattttaaagagacccaattttatagttggttagaagcttgctctttctcttgccatgactatatgtatttgttgtgcgatgaattatgaaaactgttt

SEQ ID NO: 3679 - DNA, 491 bp, Sorghum bicolor
  Clone ID: SORBI-28MAY03-CLUS61939_1
ccttgcatggatttgatgggccgatggttcaggtgattctacacttggaatgtacagaggacacaaacccccctcgcttgggtaatgtgcactgggtacagtcgtacagatgacacaaaccacttcgttcaaaaaaggaagtaaaaaaaaatgcccggccatttagaaaagactggcaatgtgcatggggtaatacggcagatgctaatgatgataggccctttgcttcaggttccaagtaacgaaatcagcaattttgtcatgctgggctagttgagtccctgaaggctgaagaagtgcagaggtaatgtgctagtgcagaaggaagaaatgcatttctgcttgatttaaaagaaaaaaagagagagaaatgctaggattttttttcccttgtgtacctgtgtaccaggccagaacccaggaggtggcaacacaggagttttccctaatgtatgtattttgcatgtacagagtaaactaatcccttcccc

SEQ ID NO: 3680 - DNA, 484 bp, Sorghum bicolor
  Clone ID: SORBI-28MAY03-CLUS61972_1
tctgctcaggatatcaaggatctatatgctgaagaggctgctgctcagagggaaaaggaacgccaacgtatgctttccattccagggctcatcgccccgaatgaattgcaggatgagatggtggattcatagtgctaccttagtatgacattcaatgtcttgcttcacttctggagcccttgtgttgaaggcccaattgtttttctagggtgatgaaagaagtgctccgtttagttttaacattcttcatagttacactactggttcaggggtttctgaagtagatagttgaaggatttagttgtctgagctgtttcagactgccagtggtatattggggggaggtcttgggttcaatgtatttagcttggagtgttgtttgtgccacactaattatttacagtatgatgaagcctcgatggcaccacatgccaagtgtggcttcattttcttttgcttatacataatagaatgatttcctttt

SEQ ID NO: 3681 - DNA, 568 bp, Sorghum bicolor
  Clone ID: SORBI-28MAY03-CLUS62670_1
gacctctcggtagcatgggtcatgcagatgcaggagaagatcaaacatgtagctgagcttgccacctccggtggtattgtccaagttgcagggaaattgccgattcaatggacaaaaaagagagggagaagagtagccgccaaacgcccattacttcttcctcattctaacggcagtttgcagaaggagacgaccccaaagaagagcaagaagaggaagaggctatctaggtttctggggtaaatgcgcctcctacacttgtggtctctctgtaattagacggctactcttttttctttttctttttttttgggccccggtgtattccatgtcgggcaattacctttgggctgagtggacctgctcagctacttgtaatcagctccacttccctatgtctcctagtactaggaacaacagttgtgcagtctgtaatagggagcctctggatgggtttctcttattccagtaggaatgtaggatgctgcgaaattccagtcttattcgttttgctggtgcagaacttccatttgaaacatgtgatgatgtgcggattcagttgctgctc

SEQ ID NO: 3682 - DNA, 671 bp, Sorghum bicolor
  Clone ID: SORBI-28MAY03-CLUS6269_1
ctcgtcggagagaaagatgatgtcgtcaagggagcgcaagaagcaggcggctgctcttcaggagaagctgaagatcctccgctccatcactcattcccacgctttgagcaacacatcgataatcatggacgcgtcggcgtacatcaaggagctgaagcagaaggtggtgaggctgaaccaggagattgcctgcgcgcaagatgcgctgagacacaagtcgtcgtcctatccgacggtgaccgtggaaaccctaggagtgcaggggtcgttcctcgtcaacgtgttctccgacaagagctgcccggggctgctcgtctccgtcctggaagccttcgacgagctcgggctcagcgtcctccaggccaccgcctcctgcgccgactccttccgcctcgaggctgtgggcggcgagaacgtggcggacaacgtggcgagcacgtcgtgaagcaggccgtcctgcaggccgtcaggaacgctccgagagcggcagcgagcaggacgaggagtaagcagggggcaggctgatgagcgcgtaagcacacaccaagcctctacttgcattggtcgacgtcctcatgtcctggaccgtatgtagtgtcttaaggatacatgaattaagccgagacccctgtattgtagtagctccgttccctctctttaaaattgatttt

SEQ ID NO: 3683 - DNA, 1041 bp, Sorghum bicolor
  Clone ID: SORBI-28MAY03-CLUS62729_1
ctccattatttgaaaagatcaaggggcttgttagcggtgcaaacgtttctgaccaccagatttttggggaccctggaaaactgcaaaatgcgaaattatgtgagctgcatccagcttcctggttctgtgtggcctggtatcctgtttatcgtgtgcctcgtgggaatttccgtgcggcatttcttacttaccattcgctgggaaagttggttcatcaaaaatgctctctggatacgaatgacgagcatacacgtgtagtttcaccagttgttggtctccagagttacaatgacaagggagaacagtggtttcagctgagatgcccagatttgaagcaactgccaagagaagattcttcgaaaaccgatcctgctgaagttcataaagagaggctgaggacactgaagatgggtgcgttggccatggcaagagctgttgtcccaaaaggaattggggagtctgtgaaccaccatccagattacgagttcttcttgtctcggtgcacctaggcttggcggttgtgatatcaagaacaggggctgttctgcttccctcctgactgtagtgacaatgaaaaagaaaagaaaaagagtagtgactaaccagaggctggctatgatatagttgatccaagagagaagagtctggggtgacacatatcactgactgtataggagatagattcatagattagatactctaacctgataccggattacaaatgcaaaccaagttggtgagcagtaccctccacgcgggatgggtgcttttttggggctggaggcaaagatgagaagatactacagatgagatgacgcagtgttcgacgactctgcaggtgtagctgcaggtgtagtgttcatttttgtacagagacaacaccagaggagcagcaagaaatttgctaccacaattggcgcctttgttaacttctgtttacatttgcctggttggcttttcttgtggctagattgcttgacagtgcgtgaatcatgatactatgctgcttctgtgaatcataatactccgctgcttctgttg

SEQ ID NO: 3684 - DNA, 726 bp, Sorghum bicolor
  unsure (1)..(726): unsure at all n locations
  Clone ID: SORBI-28MAY03-CLUS6276_1
tttgaaggtgttgatgcatgaactcaaattccgtacttctcttagaaacattgttgtatgctggataataaaggtttgaatttataatattcaacttgttaattgtgtaaatggaagtcaccacaaggatatagtaaaaatgttaccctcacaggactctggagtctggagttatatatggttgagcaacatctttgtgtagttgtgatctatttttcagtagttttacacatttattgaaactatgacccacgcgattccatgtttcttatgtctggctacagagattgaaggagataaatacacagtaccaggagaaactattagcacttggagctcggcaagcaaactatagagatgagtttctgcataaggaatctctagcacgccagcagcaataccagcatgccagcatgagccattatgccaataattcggcagctggggaacaacatggttatcacccaacagccttgcctggggagcagcatggatataatgcaacacctgctgctgctgctggaggtgctacggagaggctcatcgaggttatgcttctggccagtatgaatctttagcgaccgtccagattacccagagttccatggtgggggcagaggtcgtggtcgcggttctgagcaccgtggtcaataccctgtgagcgtgcttataactctggtggancggggttctaggtatgccttgaagaacgatctggcactctgt

SEQ ID NO: 3685 - DNA, 726 bp, Sorghum bicolor
  Clone ID: SORBI-28MAY03-CLUS62775_1
atccttccttacaacacacatgtcacgacagagctggtaggcactctgggttacattcctcccgagtatggccaggcttgggtggccacgctgagaggtgatatatatagttttggagtggtcttgcttgagctgctcacagggaagaggcccgtccaggttttgaccaagtcgaaggaacttgtccagtgggtaaaagagatgaggtcccaaggaaaggatattgaggtcttggatcctgctctcagaggaagaggacatgatgaccaaatgctgaatgtgcttgaagtagcctgtaagtgcatcaaccacaatcctggcttgaggccaaccatacaagaggtggtgtactgcctggaaaccgtagttgagcccctgcaggtgcaggtgcaggtgcagctgtaattaaaggagaacatattgtaggtggcaatattgtactccaccagattagttgtaacatcagtagaaggaagagtttctaacaaagagtgcaggtgggtacatttctgaaagaaaagtctcactgtcatgagaccatgtaaacaatttttccttattcttctgtggaaatattgcacttccaagttcaaatgactgaacatgtaaagtgcataaaaagagcattgggctcttgcttagtatgcctacatttgtatcctagcaaagttgtacagttgtgtatggaaatctgtgaaaagaaaaggctcacggctgagcttctgt

SEQ ID NO: 3686 - DNA, 1011 bp, Sorghum bicolor
  Clone ID: SORBI-28MAY03-CLUS628_1
cgcgtccggcgtggcgttggcgccggcgccggcggggccgggtcgcttcaaacagggggaggcggggacggcgagggggcgggtgatcagggtcgccgatcccgtgcgggagggccggatgccggtcccgccgccgccgccgctcctcgccgcgccggccacgccgtcggagtcgccgccggccacggggaggcgtggggacgaggacgacgaggagaggcagaggtactacctcaacatggggtacgcgatccggacgctcagggaggagctccccgatgtgctctacaaggagcccagcttcgacatctacagagatgacattgtcttccaagatcccttgaatacattcaagggggcctggaaaattacaaaaggctattctgggcgcttcgttttactggccggatcttcttcaaagcattgtgggttgatatagttagtatatggcagcctgctgagaacatgatcatgattcgctggattgcccacggcattcctcgagtaccttgggatgggcatggccgctttgatggtgcttctgtgtataaacttgacaagaatggcaagatctatgagcataaggtgcacaatgtcgcaatgaatccaccaacgaaattcaaggtcctaccggtccatgagctaatcagatcacttggttgcccctctactgcaaaaccaacttacttcgaagcttcatcacaatatctgtgtgctgggccatcttatttgagattagcatggataagatgctacatctcattgtgccgtatgctttcgctagcaaatctgggagaaggatagcgtgggtttagcatggtacctccaaattttgtattttcagtatgatagcgcacaaagttactgagtactactgagtcatggcagttgtatatatgtacagtgatagtttatagaataagacctcttagttaaggtgacaaggtgtacaacacttgttattgattgttaatcatcagtcagcaaactagtctgacatgttatattccc

SEQ ID NO: 3687 - DNA, 592 bp, Sorghum bicolor
  Clone ID: SORBI-28MAY03-CLUS62205_1
tcttcagtaccagcaacaaactgaaggctttgaggaatcatacatctaccttgaaaatgcaatctctcaaatgggcagcttcgatggaatcctgggcttctctcagggcgctgccatggctgccttattctgcaggcagcagcagaagatctgtggctctccgaagttcaggtttgggatgttctgctccggatatccagcacctgtgggtgattttggcaacgaaccaatcaagctctcctcgctccattgttttggtaatggggatggtcatgataggcagatagcaaacagggcgagcgctgaacttgctggtctgtttgagcaggattgctgctccgttgttgagcatgacatgggccacataatccccacccggtcaccctacatcgatcgaataaaggattttctttccaatttccaatgaaatgttttcaagtgattgtattctgttgtaagttgatggtgtacacaagttgagttttgaaaggcattggccgtttttactttcattagtgttttgcgtctgattgtgctaaacaaattgggattctccctcatgttgactcagagggattactggtgccgcggc

SEQ ID NO: 3688 - DNA, 630 bp, Sorghum bicolor
  Clone ID: SORBI-28MAY03-CLUS62226_1
ttgggctcgttgatgatgatgagcatgggcaagacagacgaggagaaggctgagggcagaaagcaatcgtctgacgctgtggagactctcgagcgggcactcaaggagtgctccaaggggaaaccattctttggaggcgacagcgtcggatacgttgacgttgtgcttggaggcttcgtcgcatgggttcatctcatcgatcgcttgacaggcttgaacgtgttcgattccagcaagaccccgctcctagcggcatggctggagagcttcggctcgctggacgcggccatggcggtcatgcccgacgtgcagaggctggtggagctcagcgcgagatgacgatgcggttgctggcttgctgctcgagtcaaaagcgagaaagatattttgttttcagatttcgttgagtcttccgtccaattgctgcgttcgacagtttaggccagcatgcaggcccaagtggtgcagtcgtgaacactctaaaactagcatttccctgcaaggctgggaacaaattcaaaatatagtaggacctagtgcgtacacactgtcaagaaatacgtcgacgatgatgttttaatgtctctttgaagttggaaatggcaaattattgctctgtcgtcagtactg

SEQ ID NO: 3689 - DNA, 640 bp, Sorghum bicolor
  unsure (1)..(640): unsure at all n locations
  Clone ID: SORBI-28MAY03-CLUS62237_1
cagcactacgcgcagggcgtgggctactacccgccgccgctgggggcgaaggccgtgcaacagcaggctccagagcttcatcacgtgccaggccccggtgccagcatgccggccggcgccggcgccgccgcgcccggagtgctgctcccagagagcgcgccaagcagaggaccagggtgactaaccaaaaaggacaaatcacatggctgggctgatgtttaattaatttgacaagtatgaaagaaaaaaaatagactgcacagaaggaaaagctgatgaaataacagggggcattttctttagcagccctattttgggatctgtgcggaaatttagcaagggattgatctcttaacagattgtacttagcatgattttttttagttggaaccatgctaactatagtctttagtttatcttctcaattcttgggttgagatgggtacacgtagctgagacggctaaagagccggtgcttctgttttgctgtctctgctagattcaaagcaaatgagaagttcatgagcttattatgaaaacaccaaaagcaactgtaattgttggtgttttatgagttgtgcagttaccattgtatataatagaagcgctcaaagagcaaatatttttgttcttggctncg

SEQ ID NO: 3690 - DNA, 695 bp, Sorghum bicolor
  Clone ID: SORBI-28MAY03-CLUS6226_1
gcacgagggaagaaatgaagaagattgttctcaaggttgtgaaacagtgtgtcagtacagagggtgtggaggctgattatatccggaatgacatccttccagatttcttcaagcacttctgggtgaggagaatggctctagatcgtaggaactataagcagcttgtggaaactaccccacgcgtccgaaacaaggttggagttgctgatatcgttgggaggattgttgaggatctgaaagatgagagcgagccttacagaagaatggtgatggaaacaattgagaaggtcgtggccaacttgggtgcttcagatattgatgctcgtctagaggagctgcttattgatggtatcttgtatgctttccaagagcagactagtgatgatgcaaatgttatgcttaatggttttggagctgtggttaatgcacttggacagagagttaagccttaccttcctcagatttgtggtaccatcaagtggcgattgaacaacaagagtgcaaaagttaggcagcaagctgctgatctaatctccaggattgccattgtcatgaagcagtgccaggaggagcagcttatgggtcacatttggtgtgtgctgtatgagcacctagggcttctttccttctctccttgtatattccttggccaccaaagcacatatcatctcttatcgatctaacctatacttata

SEQ ID NO: 3691 - DNA, 640 bp, Sorghum bicolor
  Clone ID: SORBI-28MAY03-CLUS6288_1
cctactggttttattggggagctaatgaagcagtctgagcggtgcatagatgaaggtactcatccaagattcttggtcgatggttttgatgttgctaagagagcatgtcttgattttcttgaaaagttcaagacgtcagtcgttattggtgaagaaccggacagagacaccttgaaaatgatagcaagaacaactcttaggacgaagttgtatcacgcgtacgctgatcagttgacggatattgttgtgaatgcagttctgtgcatcagcaaaccagatgaaccaatcgatctttttatggtggaaataatgcacatgcgccacaaatttgatgttgacacccgcctggttgagggtctggtcctggaccacggttctcgtcaccctgacatgaagcgcagggcagagaactgttacatcttgacctgcaatgtctcattagaatatgagaaaagtgaaatcaatgcaggatttttttactcaaatgcagaacaaaggagaagatggttgctgcagagagacgccaagttgatgaacgtgtcaaacggattattgagttgaaaaataaagtttgtgctggaggtgataaaaactttgttgtgataaatcagaaaggcattgaccctccatcttctgatct

SEQ ID NO: 3692 - DNA, 666 bp, Sorghum bicolor
  Clone ID: SORBI-28MAY03-CLUS6290_1
ctccgaccagcatccaatccaatttaagtatcatcacgatcgtcagtcagctcaaagggggtgatctgttgtttggatagttggatccaccagggcatggcattagacatccatcagccaatccatccccttaaccaccctttacgtactcagcgtcttgggtggcggcggcttggctgtaaaggatattattctgtacagcattaggttggattcagcacaccatctgttttattgttcttcctgccggcacaggacctcattggcagcttgacttccagtagatgttagtggtctctattttttttcttagctgtgacatgcgtcgtttttgtgagtgactttatatttggtgattttttatcttattttgtaatttgtagatgttgcaggaaataggtctgcacaaaatgttgtgtccatcagcagtaccattcttttttttttaccttactttcatttcttttgtgaatctagaagacgtgaagctgataatgtcatgcaaatgcaaggggaaagatagtggtgagcacaagcacctaagtgcctgtttggatcacctcgtcgaaacttagctctaaacaaatttagagcagttcacctcagttttaagctctaatgtaaggtgggtgaaagtttaggtctaattttagaccgtgagtttgg

SEQ ID NO: 3693 - DNA, 632 bp, Sorghum bicolor
  Clone ID: SORBI-28MAY03-CLUS6298_1
cttcaatggaagtgtgccggactggcttgactcattctcgaacctcacggttcttcggttgcagagtaaccagctgaaggggtccataccggcatcagttggcaaagctgccatgcttacagaactcgctcttgctggcaatagcatctcaggggatattccaaatttaggcagcctaaataagcttgagatgctggatttaagggacaacgagctggatggagagcttcctgagatgcctacatcagtggtaacaatcttacttagcaaaaattcactgaagggtgaaattcccgagcagtttggtcagttgaaccggcttcagcaccttgatgtctcattcaatttccttgtggggagtcctcctgcagagctgtttgctcttcctaatatcagttatctgaatttggcggcaaatatgcttagtggttcactttaagtagtttaacatgcagcagcaccctgggccttgtggattgtccactaaccgactcacaggtgatctgcccagctgtctgaatggtaatttgaataacaaggttgttaagtttgatgggaattgctttagtggtgaccctgcccaccagcatgaagctaaatattgccagcaatctcataaggtgaaaggatca

SEQ ID NO: 3694 - DNA, 617 bp, Sorghum bicolor
  Clone ID: SORBI-28MAY03-CLUS62970_1
aaaaaggtggtcaaagccagaaagccataccttcatgagtctcgtcatcagcacgcgatgaggagggcaagaggaaatgggggacgcttcctaaacacaaagaaaagtgacaatggtactcccaatggtagagctgagcctaagaaaggagatggtaactccgagcatctccatgtccctcctgacttactacagctacgacagaacggggcttgaagtagcgttctggctctggcatcctagaacagcagtttctgcccacaggcataggcatttgaaaccggactcgtagctccacagtatgcgcagccatatctgcggtaacgctcgttcacctgaatgagctttgtaccgaggtaggcatgcaatgcaatctgggcgcaggagtccatcaggtgtccaatgccatatgggtgtatgctgtttcaggcaattcattcttggctttcacgttccaccacccatgtgtagcgctagtgtgttgtaagtgaaactaagcttgtgctctgtattgggccgttcggcgaaactgtgaaacatctgtataattaagatcgaactctggattaactcggtagtgctttgtctggtttttcttttagcttttgaactgtaac

SEQ ID NO: 3695 - DNA, 706 bp, Sorghum bicolor
  Clone ID: SORBI-28MAY03-CLUS6304_1
atggcaaaggcttgttaatccaaagatggtgccagatgatgaacatgcactatcaccatcagaaactactactggtccaccaagtccttcagttgaagattacatggcaaaattcttaagtgacagctttagcagtaaaatcggatttgatttcacagagaatgatttcaccacgcgttccatcagctccgactcaaaagttgatggcaacatattggcaccatccaaaatttcgtcagttgtgaatgaaggttacaggagcacagtaggttgtggtcaggctaagaaagatgctgatattcagcaagagaatatgcccagctgttcaagtgagcatgcaatggttactccaaaatttgggaaagattcagtgaaccttgggactacggatgcattagaactaccaactgaagggatgactccaaagtttggagctattcgaggctcagaagacagtattggcaggagattacgaagtggcaaagttttgccaattggtggaccaatgaagaagcagaaaaagatccagcagcagatggttaatcaaggagctacacctgctgcggatctgacttctcatgaaaatgtaggtcgaattttacaccttgaataaatcagttaacaacagttaatctaatttagtataatattcttttgacaccctgtcaccctgatactcgttttggcttgtgattcaccctttact

SEQ ID NO: 3696 - DNA, 657 bp, Sorghum bicolor
  Clone ID: SORBI-28MAY03-CLUS63040_1
tatacatacagtcattcttgtatgtgaagattgaatccagttgttttatagtcttgggatagctggatcagaggatacataaccttttagaatacatggaattcatctctgctgtgccaaatttgcaaactccaggttaatccaagctaattctgtactgaacggcagtaaaattgctattgggttactggctgctgttactgttgccaaatttatagagtccttcggtaacatcagtgtgccttgattgctagcagcaatgcgacgaccatgaggaattccagtgatgctgtatgaaaacgtgttcgaatgtttggtctgcacagctttaggtggtttcttggcaccatgctattttctgattgtttgttgtttctctgaatctctaatggctggctgtgcactgagaagaggtgtgttcctacttcctagttggttatacagatcagcctgtactagaatactggcatgtataatctaattaggaagtcaattcatgtattcccgacatctattcgttgggtgctacacaatattactgtagtattattactgatatacatggtacaaatagaatgggagaactaccaggcccaagtatctgaactatgtaatgattattgaactggcaatgggaatgtatgccattttaggttg

SEQ ID NO: 3697 - DNA, 976 bp, Sorghum bicolor
  Clone ID: SORBI-28MAY03-CLUS62583_1
cttacacatctgatactgattctagtgatcatgaacacatggaaagacataaatctagtagtagacgatcatctgacaaagacagaagcagaaagcatcctatacaccacaagcacagacgaaaagatcatgttaattattcatgaatgggaactgctggaatatgactgtacaaatgagggaagatgcagtgagcagccattggttttgcaaaccatggaaagtttttgatgagaacactgggagatatggaaaaattgctcacaggaagtgttctgtgtatcttggccctaagctttctttgttggattggtggaataccatgcagcattgctgtaccagaaagcagtctatgctacctgaattgcatgtttctatctcttttagtttcaaatatgcatattcaatggacttttgtctctgcaacatgtgggctgagcgaactcaactgttctgaaacttgcatatatatggaatgctcccaatgggaggtagtctggagctctggatgcagtttcatggcaaggaactgcaatcatatggtgttcctgtatgcaaaacgttgatcctggaagctaatggtttgattacaaatccatggggtgggcaaaaccgcaagttgtatgacagctattttctagttttacttaattcatatatagggtagttttgtttacacaaggtaattaggtttttgagaattattattccccaaaaaaaggattttgagaattgtcaaagcatagtgtagttgagcgatttgggcctggctgttcccaacaggttttacctttttttattggcagcaagattttgccatcaagtgatatggtagggtagatttgatggtaatgcttggtaagatgatcagttcccctgccgaggctacacttttgctgtcccttttgcccgtccttgtttagggtatgtagttagcccctctatcccaaaataaaagtatttttgttattttttt

SEQ ID NO: 3698 - DNA, 564 bp, Sorghum bicolor
  Clone ID: SORBI-28MAY03-CLUS62585_1
gtgaacagctgtacaatgctggttttgaaaatttgttctgggtacaaggaggcctcgaagctgccgaagaggaggattttgagagggaaggttcccagcctttcaagctcgccgctattggaggggtttctgaattctttggatggacggaccagcaacgcaggcaggccgccaaggaaggactcggataccggcttgtcttcactggtcgcttggtcggagcactggtgctacttgacgctttgtttctaggcgctcaaaggatcggtcctctgcttcaagaaatgcaacctcattgatctccgcagaacgctgctgtagccaaggtagctctgcaaacgcgtccgcttgggtttattgtgtcatcagagacaccaagcatgttgtcctctgtacaagtgtacatgtaaaagttcgcagcagggtcttcgagttgcctttgttgtaggcctgtagcatgaatgaacgtaatttttttatgagtgtatgtgccaagaggagcgcttggcactttgtagctgtttagcccggcaaaaacaggaagaaattccttttttgagaggc

SEQ ID NO: 3699 - DNA, 847 bp, Sorghum bicolor
  Clone ID: SORBI-28MAY03-CLUS62589_1
ttatccatatggttttcacccacaaggtgagatactttcctgagccttgttaatgcatgttccaaactgcacagctattaatgtaaacttgatcatcgtatctctcctctttatgaccagctttatcaggtggaccagtacacagccatggccaggtaagcaacagtatgtatgattacagtaggcaatttggttctgttctgaacattgcccataggggtcctgttatgaatgcctttgtccatggacctgcgaatcagccaattatgtacccatcctaggtgcagaagaatgcagtatgttgagagtacgcaggttccacataggttcttgacacctccatgttttggtaactcctagattgtagtacctcgtagtcgtgctcaagcatgtaaatatggttatcatatcctctagatattcagaagaacgctggcaaaaatcctgtcctgttgtgttctccattgtcacaactctgaagccagctgatgttacttacaaaagagagtcaagtactctgttatgttcgtgccagccacactagtgaatctaactcgtgcgggttggattgctggaacaacagaaagttcctgaatatagacatgtccaattagtttttgtgttgacattgcagactgagagcgtactaaatgacaacaaaactcagttgttgcactagttatcatgcaatggttctgtgtgtcatctttcactgctagcaagatcttagttagcatttggcctttattttttgagttaggtgaggagaattgatgagattgcccggtgcctgaatatatagcctgtctttatgtttgacgagtctgatagtttcttttattagtgc

SEQ ID NO: 3700 - DNA, 532 bp, Sorghum bicolor
  Clone ID: SORBI-28MAY03-CLUS6267_1
gcttgctcgtgattggaaggtttctgttaaggaagcaaaagatacactgaaactctggtatagcgatagaaaggaggttctggcttggcaaatgaaacagaaacagctagcacatgagaagtctgaagtttatactttgcttgggcgatcacgccgttttccaaatatggctcatgcaacttctggccaaaggggtcacattgagcgtgctgctatcaatgctcctgtacagggcagtgcagctgatgttgctatgtgtgcaatgcttgagatagacaggaatactcgtcttaaggagcttggttggacgctactgttgcaggtgcatgatgaagtgatactggaaggccttcagagtctgcggaactggccaagtccatagtggttgagttatgtctaagcccttctatggcaccaatatcctgaaggtcgaccctgctgttgatgccaagtgtgcacagaattggtatgcggccaagtagaccgtagtactttccttccttccctgtccagtgttgactaccaaacacag

SEQ ID NO: 3701 - DNA, 420 bp, Sorghum bicolor
  Clone ID: SORBI-28MAY03-CLUS63127_1
cttgcgctgaaaagtacgctgcagagagcgcgaagctggcatgcacggcgtacgagggtgtcgagcaggaatcccccttagaagatgattactttttcgctgcactgccggtggttcagaagaggattgctcaagggggtgtccggctggccgctatactaaacaagatatttggtgggaagagcaggcttcagattcagagcagttgattgatccatccatccagtagatgttaaacaagagcggagtggggatggcatggtctgcaatttgaattagaataagagtatctttgtctgacaatgtaacttgagtaatcacacacaaccactacagtatcagagtagctcacgaattattattacaaaactgaagcacttgtactactgtgcaatatatgatgcaatcccatttgttttc

SEQ ID NO: 3702 - DNA, 591 bp, Sorghum bicolor
  Clone ID: SORBI-28MAY03-CLUS63138_1
tttcataacctaaagctacttgttctgttaattttcaggcattggcaagatacacacgaagggaggcaacttgtctatcattgactgacaaagattctatgttctctgggaacttcaaattcacaaccctgctgccggcaactcccagttccagcccaaagaagcctgtgcgatgaactgccgtggtacatccacattccatatgaagatttgaaaacagcaggatcagtggatatctgtcattctctcagcaatacaaataacaggcttcttccagcagtagtttattctggggttctcacgattcaaacccttttgatggatatatacttctttctagataggaagtttattttattaatcttacgagaatctgctctagtaggccacccacatgaatggagcctttttgtctctttttctatggtaatctttttcctttggctgatttggactctggtcatcgtgccagtgcctagtgggaggtgatagagaaagtaaccatacaaatgcattgtctaaatatgtacttttgtttgaagccatagctggatggtttgggaaagaatgcagatgcggtcagctttattg

SEQ ID NO: 3703 - DNA, 654 bp, Sorghum bicolor
  Clone ID: SORBI-28MAY03-CLUS63181_1
cagtggagaaccaagccatagtaccccattatggtttctgtgtgagacccatgcgacaggattgtggactcctgctttcgcttgcgttatatgaatgaagcaccagatgatgcatcaatccagcagaccaagcagcaagttagcagtcattctcctgacttgccacggaaatgtcagtcatgtgagtagttgaccgactcggcctgtatgatgaagcttctatctgctctttaaaagaaaaggaagcatctgagaagccgcatgcttgtgttcccatgaaacttcaacaatctgactgtcaataaagcagatacacgcaacacatctagtttccccattttatttacattctgcaacactctttgctgcactccaatattacactgaaaactcgttcagtggcatctgacaagtttttgggatgagcagaagatagtttgggtccagacaacgggtaaattataaacgcctatttgtccttgtctgtaacaggaaggctttcttcatttctattgctcatggtcccggagactggctggagttccagttcttgcttgcatgaacgtggagacctggaatttcgagaacaatggcaattaggggactcatgtgatttctgaacacagaaaaatataatttttttattcttcgctg

SEQ ID NO: 3704 - DNA, 784 bp, Sorghum bicolor
  Clone ID: SORBI-28MAY03-CLUS63241_1
cgcttgcatgaagaaggcgtacacccagattacaggatatatctacaatgccttttcagtgcactggagccatcttctctagctaaagccgtatatccagttttagtatcgtattcctcacctgacaagcaagcattcccacgacacactctgagccgtgctgctctaataatgagcgaaagtccaatatttcttctcgacacatttaccaaccttattgtttactatttgtcaactgctgatccttcaattccttttcctccaccccgtgactgtcttttgagaacaacaatcaatagactgaagcaggacagatgtataaccccaaagcttacattcatccatggagggaaagatgattcaacattgtttgagagctatctcattgaagagcaagatgttgatggatcaggctttactactggttcaggttttgtagccttccgtgagagcgtgaggaatgttgcaggggagatcatccaggaagaaattggaagttagtttcagctcgatcccccttttggttcagctgcagagtgtattgactaggatgctcccttagttaatgccatcgtagttaactgaaacttagatagccaaaatggggaaacaatgtcaatgaataataaaagggggccccctgataaatagttacttctgtcaaaaactgctttagaattgatgtcagagaaccctttttggtacaggggttccaggtttgtttttccatgttaaaagagacgagtttttttacaacaataccccgtgggaacctggttttttg

SEQ ID NO: 3705 - DNA, 583 bp, Sorghum bicolor
  Clone ID: SORBI-28MAY03-CLUS63289_1
gtctcttaaacttgatgatgtcacagaaaatcagaaggagaagttgttctctgaacatgacaatctgctgaaacagagagagcatgttcgccgccttcatcaagaggctcagaggcaacatcatcagaagtttcataaggtgtggggacagctcatgaagactgggtaccaaaattccagatttgctcatcaggttgagagatttgcatgcttgtacagcagccaggttacaaacttcggtttgtattcccccaacaagtactatcgtccgagcgaagattacatgccccatgagtttgatgtgcttgggctgtaggagcagtctctgctgctgctcggagttccccgttgtaattgacctacagcaggataggagggtgattttagttgtgacattatagtttctgtatttatagacagaaagcttcgcccattgtgaaggagcaaggtataactatagtaaccacagttctacattataaccgtaacattacctgtatataaatatgtgcataataactagttttaggatgcaaaggaaagcagtgccgatcatgcctggattgaacattgagaattcagc

SEQ ID NO: 3706 - DNA, 502 bp, Sorghum bicolor
  Clone ID: SORBI-28MAY03-CLUS6283_1
tccacccccgattccccgtctctccggctccctcgccctcacacgccgtctctttcctcgagcctccgctccgctagcgacgccgacgcgcgcctctctcacccgcgtcgacgagaaagcacccaccgatggagtacgccgctgtccaccaggaggatcacccgctcgctcgccgccgccgccgccgcatccgcccagaagagcgccgccgccgccgggtcggactccgccgccctcttctcccgggccaagaagaaccgcgcggtggagacccaggcccagacgcgccgccgctgcacgacatcagcaacgactcccccatcgtcggcctcgcggggggcgggcttcacgccaccgacaccacccccgcttcaccggcggcaagaccttgccgcagttcgaggggaagcacaccaggttcatctacaacagtgacgacgagatcgagcgcgaaggggtggccgacgcagctgaggcgacggcggagcttggcgcgtgatgc

SEQ ID NO: 3707 - DNA, 505 bp, Sorghum bicolor
  Clone ID: SORBI-28MAY03-CLUS62835_1
gcaagctaattgattcattatagatgatagtctgtttctccaggtgagctggtgatgaaaacctaccagcaaaaatcctaattctgcagatatcccatgagcagcttcagtgccctcattcagcacttggttcaggcatcatgatcagttggtgccaaggaaattgatctgtccatagctgattccttacgttcttttgaatttcatcgctccacttctttttgcattaacatcttcattggaatatgaaatgtaatagacccgtggttgatgaaatgtaagggagccaggctagtgaaatgcccttattttttttgaagatttagtgaaatgcattggttagaccctgcagaaggacacacgtcgtggccccatgttgttcagtgtttgctgactttgttaacagctagattgtctagtcaggaaataacatgtgatttgttcgttttgaattgtaaggggggtaatgtgaaggatgttgcttgatctcatcatttgagggcct

SEQ ID NO: 3708 - DNA, 464 bp, Sorghum bicolor
  Clone ID: SORBI-28MAY03-CLUS6285_1
ctcaccgcctccttcctccgcttcctcctcctgctcctcctccccctcaccgccctctacttcttctacacgctgcacctcctcctcacctccgcgtcgtcggccgcctccaactgcgcgcctgacgccgcgtcggtctcccgggtgtctgccaacctcacggcggcgacggcgtcggcgtcgacggcggcggcggagaagcagctgcccccttcccccttggctgtgccctcagcgactacgctgcagcacgtggtgttcggcatcgccgcgtcgtcgcggttctgggacaagcgtaaggagtacatcaaggtgtggtggcgcccgcgcggcgccatgcggggctacgtgtggctggaccgggaggtgcgcgagtccaacatgtcacggcgcgcacggtgctcccggcatcagatctcgtccgacaccgtaccctccccctacacgcaaccgtcgcatcgatt

SEQ ID NO: 3709 - DNA, 718 bp, Sorghum bicolor
  Clone ID: SORBI-28MAY03-CLUS62852_1
ttctgttccagatgggatggaacaagtggtcatgtattacaaagaaagatacaataacacaccaatctatattacagaaaatggttatgctcaaggaagcaatagcagcatgagtgccaaggattttaccaacgatactccaaggattaactacattcgtgactacctgacctttttagcctcagccataagaaacggtgccgacgtgcgcggttacttcatatggtctttgttggattgctttgagtggacgtctgggtacacgctaaggttggggctctgtcatgtcgacttcaacacgctgaagaggactccaaaactttcggccaactggttcaggaagtttctcaagggatcacttgttgggacaaggctccgagacaaaagttcccagctgcagcactacacggcataatgatccatgaccgttctctcctcatcggattgctgtgtgaaaaagctagtatgcatgtttgattgcgttgaataaattggagtgaagcccctcttgttcgactcactctggaaactgcaatcaaatcctccatcgagtgtacgacacacgtgttttgaggggttgttttcattttgaaggatgccgtgtattgagtttgggcagaacactgggcacaaacgtcattagtggatttcatcagcggtgcgatgtatgtatgtatgtatgacttataaaaattaaataacatttactgccataagc

SEQ ID NO: 3710 - DNA, 685 bp, Sorghum bicolor
  Clone ID: SORBI-28MAY03-CLUS62857_1
ggaataaggtcatataccttgattccaacagatctgcaaaacatgatttcagcatgttaaaatccttgattgatgaggcttatgaaaaacacacaagcaagatgaaagacaggccgcaaccattgtgacgcacgcttctaaatatccgggccgtcagctaactccgcgctgctcgtccggctgcgtggctgcccgctgcgggtggttgcccatgcaagtgtcgcgcttcgtgtccccggccgtaggtgacgtgctgccggcgccgatcgctttcatcgcggtgtctgccgagctgaccgagggcgtgccgggacggtgccgctccgcgtgtgggggggtccttgttcctcgcgtggcgccagtgttgcgtgttccccagttttttcagtcggtccggtctcggagtctgtttgttgttcgatctcgtgtccgagccggctctcgttgtagctctctgggctgggtatctgtggagccccttggccctggtatgggtttcttctttcagtctaccattctctcctttctgctcaacttgcaagaacttgatatctatgcaagaacttgatatctatgtaatgagcttggctcaccctgagacgacatgaatattttgtagtatgaattgtatctaaaaaccttgtaaagaatgtattgttgaaatggtgaaacatttgtgtgtgct

SEQ ID NO: 3711 - DNA, 495 bp, Sorghum bicolor
  Clone ID: SORBI-28MAY03-CLUS63492_1
ataacctcaaaattttttgagcaggatggtattgatgcccaataaaagcatgactgcgttgctatagctggtgagaatagagaccattcgaacacacaagtgagagcctgtgtgctcatgtcatagctggtatataaactgatgaagggctgtgagctaggaagtaaatgctagctgattgattgctcgaaactgcaactggagcaagcattgtttgcttgatagaatttttaactcattcgacacatggctcccccttgtcagaggggtagaggggtgtctttgggttcccccccaatttgtagaaacccagatgctcccctaatgccatgctattttgttggcattagtgttaggtacatagctgagcgtaggctttctactatccccttgatccatagcttaaataaacgggaactactgactcctccggtgtcctgaaagctgaatcaattgtagagtgataagaggaaattcccatggctttcacttgag

SEQ ID NO: 3712 - DNA, 704 bp, Sorghum bicolor
  Clone ID: SORBI-28MAY03-CLUS63547_1
tcggttatatcaaaggagatcaggagacagtcaataatggatccatgaatctagtggatgttcgtgatgtcgctgacgcccttctgttggcttacgaaaatcctcaggcatctggacggtacctctgctgttcaccagcaataagagtctctgatattgtaaacacactaaagacctcatatccaacacacacttatccccaaaaattcgttgaagtggaaggtagcaacacatatatcacggagaagcttcggaagctagggtggacctctaggcctatggaggaaaccctgcgggacagcgtcgattgctaccgagctttggggatcctgaactgagcttccattcagctctgggctttggctgctgctgctgctgctattttcagcttcttttggatctcttcatgtaagcagtgaatcagaaatttaattcagaataagctggtgtaggaactagaaaaggggatcgtgggagatgctgatgctaagaatgaacttgaacaccatcgtttctgagtttttgtctctgcgtgcttgagggcaaattagtactcgcatgctgtaacgcttaaatctggtgtcgcagaactgaaccaacaatgaagaggttctgtgaataaatcgaagtacgtggtagactagcgccatgctgtgaataacaaacgtggtagaaccgaaccaacaatgaaaagtttctttgcc

SEQ ID NO: 3713 - DNA, 612 bp, Sorghum bicolor
  Clone ID: SORBI-28MAY03-CLUS6360_1
acgaaacggacgccaccctcccggaggctcctctcctctcctctcttctccccacctcttcttcctcctcgccttgccgtgttcactcgttcatccatccatccagtccccagctcacgagcgcaagttattgcgcgccgcgtttagcctcggcgtgggggcttctgttttgcctgtgtggcgctggggggcagcaggtgcggtgccgcgtgctcacgactcacgagagagggaggctctgctactctgctcttgagctgctgctgctctggagatagaggaatagaaggcggccggggcaggggaggtgaggcacgggcatggggattggacggcggcggcggcaagctgccgtacagctacgcggcgcaccaggacggcggcaagctggtgaagagcttcagccgcgtggagccgcgcaagttcgggctcggcctcgtcgccggcttcctcctcgtcacctgcgcctacttctccaccgccaagttcgacgccatccacatcgccatgatcagccccatttccagcaatgcggctgggatcggctcgctggtgggcgccgccgccgacacctccaactccaactccaagcagcaatttgattcgggcaag

SEQ ID NO: 3714 - DNA, 609 bp, Sorghum bicolor
  Clone ID: SORBI-28MAY03-CLUS63666_1
ctgctcgtggcatgcctcatcgcccggccgtccgggctcgccttggtcccttgtcgcttcgagacctcgatccccctcggtcatgccaggcgccgggtggctggctgctacgccgccttgggcgccccctgccgtccgcccgccggcgtcgtcccgtctcgccagggtcgtgctccgctacgtatcctgcagccccccctgtaatgcccggcgccaggaacttggctctgccgccaccgctggcggctcctcccggttgcccgcgggcttggctccgtctcaccccggggccttaccaaggtgctctcgtgcttgactcggtgtgttccctgtgtctctgtagtgtgctttccgctttctttcggtctttacttctgcctgttggtccctacctcccgctatctcttgtgctgtgtcctcggccagttgctcccttcctcccccttttccggtggttctgcccccgccgtacatctttgtccccgccccttctccggtgtcactgccaccaccttccaggtgtcacttctcgtggcctggggagtcgtttccccagtgttccggttgacaatacttgaatcttggtgaatttttcaccagagttcagtt

SEQ ID NO: 3715 - DNA, 610 bp, Sorghum bicolor
  Clone ID: SORBI-28MAY03-CLUS63679_1
gccatgtacgtgccagagacgaagggcttgagctttgagcaggtggagcagatgtggaaggagagagcgtgggggaacagcggcaactgccagagacttttgggtgctgctgcgccgtaggctacctgtcagcattgatcaagcgcggaagcaatggcggcgacacttttaagatggcccccttgcgcttgattccctccgtcctagtatagtaggaagaaagtacatacgaaagtggagatgcagatccaaactgttttatgtgatggctcatgttgcttatattattgctatccttttgcctgattgtacgtgttgtcatcgtgggaaatgttcagtgcgagtaaaagtatcaggtcgtaccgtgatgtcaaactattatgccaaaaggtctgttgtatgatccagatgggtgattatattttttttgtacagtttccggaataatgtcctggagagtcagtagggcagttgggtaggcgcctttttttttcttggccaagcgcccaagtgagtagtggtggtgagttggcgtttgggtcggtctttgtattggattagagttgtctgggggtgatatgtgacactcctagtgaaaaaaaaactagcc

SEQ ID NO: 3716 - DNA, 673 bp, Sorghum bicolor
  unsure (1)..(673): unsure at all n locations
  Clone ID: SORBI-28MAY03-CLUS63739_1
ccatggttcacatcagagttctggtgccactntgctatgggagaaaaacgagcctccagtcaatcctactcggtacaacttgtccgcatttgcaataacattaaatgagttaacaccagagctcaaggagaagctgccaccaacggattcaaggctgagaccagatcaacggcacctggagaatggggagtacgagaaggccaatgctgaaaaactgcgtcttgagacacggcagcggatggcaaggaagatgcaggagagtggctggaaaccaagatggttccaaagggacagggaggatggaacataccgctatgttggaggttactgggaagcaagggagcagagaacatgggttggctgcaatgacatatttggtaacttgtctagcagccaaaagctgccaccatccgctctctacactagctcaagtatataggggtaatgccgtaagggcatattcagtaggtgttgacatcgattactcacttctggtacataatcgagaggggtttctctcgtttctgttgtgttaagctgtgagctaacatgctttcctcttgtcaattgtcacattgaaaccaaggacattcaagcataacccaaccttttgtcgatactaggacacttatgagaaatcttgctaacattattgtaaaaaaaaaaaaaaaaa

SEQ ID NO: 3717 - DNA, 657 bp, Sorghum bicolor
  Clone ID: SORBI-28MAY03-CLUS63045_1
attgcaccagaattatattctcggaactttgggacagtatcatacaagtcagacgtttacagctttggcatggtggtactggaaatgatgagtggaaagaggaggagcatatacccagagaccgagaaccaaaatgatatttacattcccgagtggatatatgagaaaatagtcaccgggcaagaactggaactggtcagggaaatgacccaaggagagaaagatataatgaggaagctggctattgtagcgctgtggtgcattcagtggaacccagcaaatcgcccgtcaatgacaaaagtggtgaacatgctgacagatagcttgcagagcctaaagatgccccctaaaccatttgtttcatcctttggccagcaagcatgaagcaaaaggtagagaccacatcataatcattcagatgtttgtgtctatcagttattcagttatcgacatgtaccagtgatgccttgtgtctatcatatttttcgtattatacctttttttcccctgtaaccactggattgcatacattcagattcctggtttaaccatgttaatggatatgtaatgacattagcagaacactgcataaaaatcagtagctggaacggtagaagttacagcttccattgaaatgcagacaaggttaatgttctt

SEQ ID NO: 3718 - DNA, 762 bp, Sorghum bicolor
  Clone ID: SORBI-28MAY03-CLUS6307_1
gcaccagagaaaagctgggagtcatggtgggaaaaagagcaagagccccttcggtactctgggaagcgtggtactattgtcgaaatactgcttgcattgcgtttctttatttaccaatatggacttgtgtatcatctgaacataacgaagaagataaccaaggataaccagagtgtgctggtttattgcttctcatgggttgtaatttttgtcattttactggttatgaagaccgtatcagtgggcaggaggaggttcagtgcagagttacagctcgtgttccggttgatcaagggtctcatatttataacttttacagccatcgtggtaatcttaatagcaatccctggcatgacggttctggacatctttgtttgcatccttgctttcatgcccactggatggggtttgctcctgattgcccaagcgatcaggcctgtgattcaaaagattgggctgtgggggtcaatcaaggctcttgcccggggctacgagatcttgatgggacttctcctgttcacgcccattgccttccttgcctggttcccgttcgtgtccgaattccagaccaggatgctgttcaaccaggccttcagcagaggtctgcagatctcccgtatctcggaggccacaagaaagaccgagggacccggaacaaggagagtacgggatgctgattgaaggtacggcggacgccggcgccggagtcctggaacaataggttcagagagagagggcggtgggacatgatcagtacctgct

SEQ ID NO: 3719 - DNA, 858 bp, Sorghum bicolor
  Clone ID: SORBI-28MAY03-CLUS6308_1
ccagaacgtgctgttgaatacctctactctggtattccagtgacagctgaagttgctgttccaattggtggccaaggagcaaacacaactgatcgagctcctactggggaagccggtctctctgggattccaaacactgctccactaaatctgttcccacagggaggttccaatgcgggaggtggtgctggtggtggaccacttgattttcttagaaacaatcaacagtttcaagcagttcgggaaatggtccatacaaatccacaaattttgcagcctatgctgttgagttgagcaagcagaatcctcaaattctaaggttgattgagagaatcatgatgagtttctgcagttactaaatgagccctttgaaggtggagagggggacttcttagaccaacttgaggaggatgaaatgcctcatgctatcagtgttacaccagaggagcaggacgccattggacggcttgaatccatggggttcgacagagcacgtgttattgaagcattcattgcctgcgataggaatgaggagctagcagcaaactatcttcttgagcatgctggtgaggaagattaagcgggaatagttttcattcgccatttcgtcgacatctgacccacattgatcaagattggaagttccgagtcgatatggagctgacagtcatttgaattgatttctttgtgccagacctatctttacatgttgcctttttatacattcaaatacatgtagctgaacacagttaagtagaatgctacagttgtgtcttcccatcggtgcctttcatcagcgtgtagtctcctgtatgcgtagggtgcaagtacaacacgagtatggctcgggagaagtac

SEQ ID NO: 3720 - DNA, 640 bp, Sorghum bicolor
  Clone ID: SORBI-28MAY03-CLUS63095_1
ctgccgattttgcagatggcgaacttaaggaggagatgtttgccatccggtttggttccgtagaaaattgcaagaaattcaaggagttgattgaggagattgctgagtcacttacaaagaacgaaggcaaggaaggtgaagatggttcttccacggctgaattgctggagaagctcactgtgagcgaggacaaatctgagggaagtggcaagtcggagtcaactgattctggcaaagtgaacgaaaccaaatctgacgcagccccagccgagtagttggtgttgtttcacgcagatccacccggtgccaaatctgtttgtgtccttcccagtggaagtttggtgcccgttagccatgaaatatgactgctcacatttgggggcgagttggagcagtctcaggtgtttggatttggtctactctggtttggtccgggcttgattttgttaaaaacttggagtccatcggggttgtggaacgtttggtatgtgagtcgctagtattttattgcatggatcggtatggattgcggtaaattcattcatataaggtgcatcctatatttttttaatttggttcaatacacatacatatgttgtattaatactttatactttatgccaatgttatactttatgcc

SEQ ID NO: 3721 - DNA, 511 bp, Sorghum bicolor
  Clone ID: SORBI-28MAY03-CLUS63102_1
tgctttctagcattcttgcccacaggatgggggatactgctgattgcacaagcttgcaagcctcttgctcgacatgtaggattatggggatctgttcgtgcccttgcacgggcctatgagataattatgggggtgcttctctttactccaatcactatattggcatggttcccctttgtgtccgagttccagacgcggatgctgtttaatcaagcgttcagtagaggactgcaaatttctcgaattcttggtggtcaaaagaaggaacggtctgctcgcagcaaagattgatttagtctcctttatggtatttcaacatgcacatgctgtaaatatttgtcacgaggtatattgtatttttgtgactacagtacagatcaaagtgtcgtattgtatcccggtcttcctcctgtgatcctgtcaccaatcccacaacattgtaaaatttcagatgaggctcgtctgagttctttctttcttgcagtaaaggcgtcatttggttgtgccctgc

SEQ ID NO: 3722 - DNA, 674 bp, Sorghum bicolor
  Clone ID: SORBI-28MAY03-CLUS6388_1
ctgcatgcgcctcttgtcctgtccccctgccctctcctcctgtcgtcgggcgggcgaggtgaggtccaagcaccatggggctcttaggtatgatgggcgactcgtttggttgctcggcgaccggggagcgacttgtctctgctgcaagagatggagacatccaggaggctagagccctcttggaactcaatccccgccttgcacggtactcgactttcgggatccggaactcgcctctccattactcggcagcaaagggccaccatgagattgtctccctcctaatcgaatccggcgttaatattaaccttagaaattgcagaggacagactgctctgatgcaagcttgtctatatggtcactggaaagttgtacagattctagttctttttaaagctaatattcacaggagagattgttttagtggcgcgaccgctattcattttgccgccctaaaaggtcatactcggtgcattcggcttcttgtggctgattacgtgcctagtttgtcagagttttggaccattatgcgtgcaaagtccaaagatcaaatgaaaaaggatgcctttgatgccgtggctctccagagactagttaatggaaagtcggatggtggcgtcaccccgcttcacttggcagcccttcatgggcatgctgagagtgtgcagctgctg

SEQ ID NO: 3723 - DNA, 553 bp, Sorghum bicolor
  unsure (1)..(553): unsure at all n locations
  Clone ID: SORBI-28MAY03-CLUS63915_1
ggttttcggtgcagccgtcccgccccccctggagttcgccaggccgaggcacgcgcttagggggcggggccggtcttcagtgcagccgaccccgacccccgcgggggcgtctgggcgtaccgtgggcggagggaccatcaccgagcatgatttgttgcggttgcgaccctcgtcggcccctcggctggtgaggctgatgcccgggtacccgccctgggggttcaccgtggtccgtcgttccctcacggtgggcctgttgtagatgcttggcccctcgtcggccgctcggccggaggggccggtgccgtgcacccctcccgatgggtccgcttttgtccttcatttgctccctgctcgcccgttgtcactgcttgtctcggtgtggtgctggttttggctctagccacttgtgtcggggtccttcgaatgctacggtcaggttctcctctcctcattggtctgcttttgttccccactggctccctccccgtgcttgtactctgtatagtcaggtgtgtggatgttttcggnttacaaatagggggggcccggg

SEQ ID NO: 3724 - DNA, 637 bp, Sorghum bicolor
  Clone ID: SORBI-28MAY03-CLUS63917_1
agtgccatccggtttggcagcaagacaagctccggaagttatgccaatccaagggtgttcatctttctgcattttcgcctttaggctcacctggatctcctggaatcaatgggtcaagtgtcctcgagaactcgattgtggtctctgttgcagagaagttgcagaaaacacctgcccaggtcgctctacgctggggaattcaaatgggccatagtgtactaccaaaaagcgccaatgaatcaaggattaaggagaacattgacatatttgactggtctattccagaagatttgatggcgaagttctctgaaatcaaacaggtcaggctgctgagagctgagtttgcagttcaccctcaaggcggctacaatacattagaggatttttgggatggtgaaatataaaaagcatacaaatttgttcagaatagaagagccaggcgaggaaactattctgacatggcagatgctttgcttggacagctgagatatgattgccttggtttcgagagagagaaactgaggatagttgcccctgttgctgttccaatagaagctttgtgtttcattgtatccaaagatgtctgttccaattccgaccaaataaaatgcagtaatggcattttcatcttatcctt

SEQ ID NO: 3725 - DNA, 705 bp, Sorghum bicolor
  Clone ID: SORBI-28MAY03-CLUS63936_1
gccaaagctggagtttcatgaaaaaactagttgttccacagcagcggacaagccatcctcaatctgtgaaagcagttacatctcctcgaagatccgggcagcagtggaaatacttaactcaatcatcaagacacctgcccttacagtgggggatactactgaatcaattcccagcatggcactccctgttaaggcaatagtcttctcccagtggactggcatgttggatttgctgcagctttcactgaacagaaatgatatacaatttaggaggctagatggtcgagtccgcatttggcgaggatggttccagaggcactgctactaagttgacggtcgaagatctcagatacctcttcatggtgtgatggcagcttgtaatcatccgtagggctgatgacttttgttgtgacaatcctaacggataggctaggttagagttgatcacagtatctggcacccctatttttgtaagcagtaggcattttggagctgaggtagcgtttgtttatggttctcaccatggctgatgtttcgacccactttcgtagttcgggttgacctgactctcttgtgactattcccatgggatggagctcctaagagaactcttacaattccaggcttcaggagagaaggcaattgtgtaaatatgacagttacccttagattctggttatctgaatatggcagggccatgcgtgt

SEQ ID NO: 3726 - DNA, 454 bp, Sorghum bicolor
  Clone ID: SORBI-28MAY03-CLUS63940_1
gcaaacacttatgacgagctcccagagcagctcctaggagctgcacggctatcacacatcgaaccttccgcagcagtgtgtcctgaccttgaaaacatttgagcgggacaaatcaatctgtgcagattctttcattctttcccccccaaaaaggcccaaacgctctcaatttgttcagtcactgcagcattttgcagttcgatacagtgaggttcagacagactgcagcagtccacaagtgccttgtacctcgcctttatacagtttttgactttttttgggtcttttttttattactttactggtgtagcttgggcttcttacagatattgtaatgcagtagatacatcaaagtgagatatacagatacagcatggttcggaaaccaattcgtgtacattagcagccggcagccctgcaacgaggatacatcaatgctatagtttattggttg

SEQ ID NO: 3727 - DNA, 681 bp, Sorghum bicolor
  Clone ID: SORBI-28MAY03-CLUS63950_1
ggcatggagctgagggacaaggtaactgagtatgtgaaagagaggattttagctctaagagcagcaaacccaggacagtatgacaacatatctgttgtccgcacgaactcgatgaaatatattccaaattatttcaggaaggctcagctcaccaagatgttcttcctgttccctgatccacacttcaaggagaagaaccacaggagaagggttatcagcatgcagttgttagatgagtacgcttatgtgatggaagtgggaggaatcatatataccatcactgacgtcgaggaacttggagagtggatgcggtcgtgtctagagaaacacccattattcgaaactgttcctgaagaagagattaaagctgatccggttttcaaattgctgtctactgccactgaagaaagtcagaaggttgccagaaatggagggcaaactttccatgccatcttcaggcgtatctccttaaaagaagaataagtcacttacgatgttattagctcgtagtgtacttcccgtgttatgtctttgtcatttttatacatttttttagcagttattgttgatgaaggcgtacttgatactaaatattacaatattgctttgcaaggttctgcagactcaattattctgttcagctttaagagaatttaccaagacgattttgttgagttttcc

SEQ ID NO: 3728 - DNA, 605 bp, Sorghum bicolor
  Clone ID: SORBI-28MAY03-CLUS6329_1
gcacgaggctccggaggagccttccgcgcgacgctccacggctccaccaccgctaaaaccctagacggctagcccgcgcacggaagcgggagcggagcggaggcgagcctctcctgcctcgggttcccccggccaccgcccgccgccatgaagctgacggtgaagaccctcaagggcacgcacttcgagatccgggtgcagcccaacgacacgattatggctgtgaagaagaacatcgaagagatacaaggaaaggacagctatccatgggggcaacaactgctgattttcaatgggaaggtcttgaaagatgaaagtacattggatgagaataaagaaacgaagatgggtttctagttgtcatgcttagtaagggtaaaacatctggttcaagtggaacttcatcttcccagccctcaaacactcctgcagcaaggcaggcacctcctctagatgccccacaacaagctcctcagcccccggtggcaccaactacaacttctcagcctgaaggacttcctgcacaggctcctctctaacacatatgacaatgcagcatcaagtcttctatcaggaagcaatgttgacacaatgattaaccagct

SEQ ID NO: 3729 - DNA, 662 bp, Sorghum bicolor
  unsure (1)..(662): unsure at all n locations
  Clone ID: SORBI-28MAY03-CLUS6331_1
gcacgagggtcgccctctgctgcggccatgtcctccgccgacgagctcttccacaacggccagatccgccccgtccgcctcgccgccgcgctgctccagccccacccggaccccgccgtgcttctcgacttcccccacgacgccgccgcggacacggacgcggtgcgggaggaggtggaggtggaggcggacgagcgtggccgcgtccggacccgctccgtgcgccggaaggcgcgctccatgtctccgttccgcacccacgcgtccgccgcgtcccacgtgcctgcagcaccgacggtgcccgtcccggagcacgagtctgcagatgaggcgcggcagactgcgacccctgcggcgtcgcgctcgtcgtcgtcctcgtccaccgcctcctccgcctcgtccgcgtcctcctcgtcctcccgcggatcccgccgatggggtgggttcctcaaggacctgctccaccggagcaagtcggacggcggcaagaccacacaccacgcccagcattcccaccacgctgctgctccagcttcgccaacgcgcagtccaagacgagcactcgtccgtctccgtcacccgcggggcgaaggggactaggggtgggacgccggggcaccgcggngnnggcgcgcgcggcggcaggaggtcggcgcacgagc

SEQ ID NO: 3730 - DNA, 714 bp, Sorghum bicolor
  Clone ID: SORBI-28MAY03-CLUS63331_1
ctgggtgccgcacactggctgaagcaaagatacacatagaacaaaagaggaaaaaagaatacgagctgaatgcccaaaaagctaaggagagcagccttattgcaaataataaatcggtacagaagatgaatcgatctatgaaaattgagtctgatgggaatttggatccaaagaaaggtggtgctggcttggattctcctaaaactacaggacttacaagtgttaagcagtgggatgactgggatatagttggtcttcctggggcagagctattaagtgctagcgaaaagcttctatgttgtcagaacagattgctacctagtcattaccttagaatgcaggaggtgttgatgcaggagatattcaagggtagtgtcttaaagaaggaagatgcccatgtcttatttaaggttgatcctaccaaagtagatagtgtttatgatatggtaacgaaaaagctgggcaaccatgaggaggctccaactgtctagcttatgcttttgagcttgcctgctgtgacatgccgaagaaaacaaatcttggtttcgccccctttgcagcgcatctgaaccatagctgaaggtggaactgtactaaatcgaattggccatagtttacagaaattcatatcagttgtcagaagcacaataaggcattccagccaagttgtaaaattattacccgcccgagcaaaatgtgtagcatgagttattc

SEQ ID NO: 3731 - DNA, 649 bp, Sorghum bicolor
  Clone ID: SORBI-28MAY03-CLUS63361_1
tagaatggctggctgtggacaagtggcacatggaggtggtgtggagataacagcaagggggaaagattaccctgtgagggaagagagtgtcactgcagcggtctccgctttgtcgtttgaaaaggaaactgtaattggggccaaccttcagtcagacttccgagtgggccgaggatcaaaaatatcagtcagcgctaacttaaatagtaggaatttaggcaagctcagtgtcaggactagcacgtcagaccacgctgagatagctctgatagcagttgtgtcattgatccagttcattcttaggagaagatcggcagcagctgataaaggtgagcaagagattgatgacacctatttggatgactaaataacaggtagaaggaaaagacaatgattgcgtgctttagatgctcttcatcatcaagattttctgcaattatgttaatctatggcggccgccaatctagggttccatcttgtacagacattttgtatatgagttattatatgagcataatatatgaaggcagcattttccattaagagagctccttctgcctataggcgattttctaggttttaaggatgtataagcagatgcagttttgagttttgacatcacatggaattggtttactttattacttgc

SEQ ID NO: 3732 - DNA, 673 bp, Sorghum bicolor
  Clone ID: SORBI-28MAY03-CLUS63409_1
atcgacgacgctgtcggcgggctccaggtgcagaagcccaacgacgatgatggcgtctggtacgacgtgcccatcgtccccaacgcgttgcttgtcaacgttggggacgtaacagagatcatgagcaacggcttgttcaggagccccgtgcaccgcgcggtgacgaacgccgagagcgaccgggtgtcgctggcgatgttctacacgctagactcggagaaggagatcgagccgctgccggagctggtggacgacaagaggccgaggcggtacaggaagacgacgaccaaggattatctggcattgctgttcgagaggttcaccagaggggaacgagccttggacgcggtgaagatcgacctcaacgacgactgaaaacatgagtgactctggaacaagaattaacgatgatcgatggacgatagattcgcattcgctttgtagggaagcttctttcaatcttgcattgacctacatttaattcgtggctatgttttcgtgaagtgaatcagtagctacctttgtatttgccatttgtgctttactctgtcctgtttaattcaaatcagcgctttgattttcttttacatgtaaaaaaagtcaaagcgactatgtaaaaagaaagtcaaagtgatttataatttagaataaattgtagtattttgtttttgtg

SEQ ID NO: 3733 - DNA, 515 bp, Sorghum bicolor
  Clone ID: SORBI-28MAY03-CLUS6410_1
gaaaattatatctcacgcaatagttatattaatgagtattatcacttctgttttatgaacctggacattgtcaggcttgccagttgcattgtaattcagtatgtgctggtgtccttagataaattcacttatttccttgataaaacacaatttacaatggctagctttcgacaatggtgacccactgatctattgtgcccaaacagattttttactcactgggtggcagaagtggtgtgaccatattgtttccttgctataggagctacatccctggttagtgatctaaaattctgatgaacaaatagacccatgaccaatgccacctgtctgatcataacctttactattacaagaactttttgtagcagtactaaagcaaggaggcatttttctactggttagtgaaattatctcagtgtgacatttgtatcttctaataggtcatctgctattaaagttttgactttttttctcctaaatatcttctaaaataatgtaacatcatttatgaa

SEQ ID NO: 3734 - DNA, 656 bp, Sorghum bicolor
  Clone ID: SORBI-28MAY03-CLUS64119_1
gcagaaacacgatgccaatgtttggagtccctgggcaagcaatccatccctcagcatctagcatacagccattcccatctttggcgggtcttcctgttaggccaaacctggcacctcaagcttcagccgtcatggctaccatggtgcaggagcaacagcaaggggctactcagcagcagcagagcctgaataacgaagctcaacagggagcaaatacaggagatcctcaattgcagactaccgtgcaggctgagaaccagcattttagtgtgccctattcagcacaaaccgaaagcaatcagtttttggatggtggtggcaacaggacagatactacagggagaaatgaagctgaaacataaaaatagtcagcaagtgcgagtctcgactaacaagctgcagatgtgaatatcagcaccaactcatcctggacgagcttaacgagtttcaagatccacgaggcagatctatcacttgaaaagagtccaatcaatcaagacagatttggtggcaggacggctagctttagcgagctaagatgctcacaaagttttgtgtaaaatgtaggtggtagatggaatctggttacaagaaacatttcttgacagcccagtgcagttttctagttggtggcgcttcacctgaagtttttttgg

SEQ ID NO: 3735 - DNA, 613 bp, Sorghum bicolor
  unsure (1)..(613): unsure at all n locations
  Clone ID: SORBI-28MAY03-CLUS64159_1
cacgtgcaaagctggatgatggtttactggatcagatattcagcaagaggaaagagacgatccggataaactgggctgcttacccgcactaccaagcccccgaagagtttgctccgatagtgctggacgggaagcagctgtactacgtgaacacctttgagagcgcggcgagcgccatagagacgggtgccgtggcagcagagaatgtggcacggctcatcattntgaggcgttctctaccgcagcgaggagtggagcctgatgctcctcatatcaagccattcgcggagcaggaggaagaaggttcccagcgtcggcatgtagacctgtgattctgtgaagctgggctgggatgtgcctgtccctgtgaaactttgtatagattttagctgggcactctaggcgcaacagatgcattatgtgtggagctgtggcactctggcttttacccgtgttgattgagttgtactcgactactattacttgagtgtctcctgttgagttgcagcggcattttggtacatttgatttggcgacgaatgttttgtagatggatgatacaatatatcatactgtagcactttggtttgtattcgataaacattgtctaatc

SEQ ID NO: 3736 - DNA, 667 bp, Sorghum bicolor
  Clone ID: SORBI-28MAY03-CLUS64160_1
atgaaattacttggtgctgtgagtgaatctggtcataattgatttcatttggcaccaattcttgagttgtgatgattatgcttgtctcttttatatctgagaaaggatgaatctttttcaaagattagactgttacttcaatttccatgaatttcagatgcagagaacattctgttaggaaagcacccaaatttggttttactgcagatggataattggcatcagttttatatatgttttatttacatatacatatgagcttatggtacacagcggttgtttttcttcaataggtacctcttgaaatcggcatcagaacaggttcagacgaaggccagcctatcgttgtatcatcaccgaactctgcatccgcgcaagcgtacgtaaatattgctgagaaggtgactcaaaggctcaatgagctagcagaggagcgacggatgggcccagaaatcttactttgagaaattcaggccgcttttgttcacacctttacccgtttcacgctagggctgcaaagaaattatatctctactgataagtagattgttttttttaggcaaaagataagtagattgttgttggaagtaaactttaaattttattatcagttgggctggaaatttactcaaataaacctctgctggcagccttgcctttgtcatgc

SEQ ID NO: 3737 - DNA, 548 bp, Sorghum bicolor
  Clone ID: SORBI-28MAY03-CLUS64226_1
cggatagttccgaggctgttatgagcagtggcctcggagcccagttgaatatctgggttcggcacgagctacattttgaagaagctggagtgcccctgctgcaaggttcttttgtttgaagtgcaggtggtctggaagcaccgggtcttgtaacaatcttgtgctggtgggagatgcttgcaagctgtggtggttgaatgtttggcatgtgatgctgttttagggagcaataggttatagaaatcaagggctatagatttcagaactgatatatgttcactaatttgtatgcttaatactatattagtcatgtacattcagattctgataaacatttgactgtcgtgcgatgaagtaataaggtagactactgtagagctgcacggtgcactggacattttggatcgagcaatatacatacctgtaggcagtgctaggtaaaaaggacatggttgtttgcttattgtagatttgcgatgtatgtaactggttgatgtagaattgtgctaatcatatagagttttgaatggcactatctaaattcattg

SEQ ID NO: 3738 - DNA, 329 bp, Sorghum bicolor
  Clone ID: SORBI-28MAY03-CLUS64231_1
gcgcccggtgacggacctggaagagacgtcgagccgggatcgcacgggggattagaggagttttagctagtagtaatattttgtggttagcaagtaagaaacccgctgtgttgctgtaatgtgaccacatagatgaggttgcagattatggaactctgtggttttaggttgtgtgataccgtgtgcctagctatatagcgtgggcagcagcatgcatgttggcactctgtaccaagtgggtggaggaattttgtacataggaaatcaaacaagtcaaatacatttgagcaaggcctaaaagagctttgtggcaatgttcctggtactag

SEQ ID NO: 3739 - DNA, 649 bp, Sorghum bicolor
  Clone ID: SORBI-28MAY03-CLUS67613_1
tgggagacaaggagaaaaacaaaagctgaaagccgatgtgaagacagcgctgtccctcgcacttgggcgctccggtcgtatactcctcgacgagtctcctcctcgactcgatcccccgcaactacctagatctcgaaccctcgccgccgccgctgccgccgccgcttctttcccgatcgccgcggccatggcgaaggagttccccgtgccgccggtggtcttcacgccgtccaccccgacgcaccgccgccaccctgcccccggcgtgggggcctcccctccgcccgcgttcgcgccgccccgcccctccacctcatccgccgccaacccgcttcccttcatgtcgttcgatgtctcagctgccgcggcctcctcctcctccgcgccacccctcttcacggggcctatcggtgtcggcggttccggcgcatccttcgaggacgagccgccgctcctcgaggagctcggtatcaacacgcgccagatctggcggaagacgatctccatcctccacccgctccgctccgccgacccctccctccacgccgacgccgacctatcgggcccgttcctcttcctcctctcctttggactcttccagctccttgcggggaagttccacttcgggatcgtgcttggctgggtcacc

SEQ ID NO: 3740 - DNA, 674 bp, Sorghum bicolor
  Clone ID: SORBI-28MAY03-CLUS67646_1
cgttttgatttgatccccaacaagacagtagctgcttcctctgtcctgttcggcgcccctgtgccgcctgcccctgcagagtctacaggaatgacccagcctgtagattggggcatcctactagagtgaagggaagctgcttctctttgctgcaggggagggggtcaaacaaatggagattattcgattatggcatctcgattcctttcttggtgtggtatgcaatccaatccaatccaacccaatccaatccaatcccatagtgtgagctttccgacatctagctactagctagctagctaagcttgcttgcttgcttgtacagtcagtcaatcaccacgcgtcacacgaagaagagaagaggtttggggctctttgcctgggcttggggggcacacagaaatggtggagatgcgcagcatcagagctaccgcctgcttcttgctcttttccttgcttgtgtctcagaggcttgggtcttgtgcttccatcaatgaacaagggagacctttcttgagatttggtgagaacctagcagatgaacctactggatctttgtcgaatcaaggagtgaattgctcacatgatggtaaagcggtggcgctgttacccaagggttacaagttatctggtgaattgccatctgacttgcacaaacatacagagatgatttc

SEQ ID NO: 3741 - DNA, 675 bp, Sorghum bicolor
  Clone ID: SORBI-28MAY03-CLUS67652_1
tgcaatttgttcatgtggccgccctataaatcctcgcccggcctcatcatccctcttcgacaacctctcagcacaaacgctcctctcgctccctagctagctagtcccctttcgcctgcagagccccctgcactaggcacagctagctagctgcagctacagcaatggtttccgccggggttcatggtggcggcggcgacgggcaggaggcggtggacttccgaggcaacccggtggacaagtcgaggaccggagggtggctgggcgccgggctgatcctgggcacggagctggcggagcgcgtgtgcgtcatgggcatctccatgaacctggtcacgtacctcgtcggcgagcttcacctctccaactccaagtccgccaacgtcgtcaccaacttcatgggcacgctcaacctcctcgccctcgtcggcggcttcctcgccgacgccaagctcggccgctacctcaccatcgccatctccgccaccgtcgccgccaccggcgtgagcttgctgacggtggacacgacggtgccgagcatgcggccgccggcgtgcgcgaacgcccgcgggccgcgcgcgcaccaggactgcgtgccggcgaccggcgggcagctggcgctgctgtacgcggcgctgtacacggtcgcggcgggcgccggcgggctcaaggcga

SEQ ID NO: 3742 - DNA, 582 bp, Sorghum bicolor
  Clone ID: SORBI-28MAY03-CLUS67694_1
ttggcaggagttttgccagatggtgaggaagatcgtgatccatcccattggacatgggagccatatggaggcttggccttgcccggggcaggatgggaagagggacttttagaagaagggagggtaactgggcagggatggaaggtgggtttttggagcctttgacgacatggttgttttttgctgcggtgggagaaggttgtagctgaaaacttgatggcatagcttgtcgatgacgaagaacgcaacatattggttgctggcgtcagttctttcttcagaagaattcagtggaaggaagaagtgatgtaacataggctttgcagaaaagaaaaagatttgatgatgtgtcttttagtttggtttggtttaaacaagatgacagttaatgcgtgtctagtagtctgcctaagcttagtgacgagcaacaagcaataacaaggatggatgtataagatagaccttgggtatgtaagttgtgtaaatataatgttagtaagtagtaggtatatcatatatatatatgggaggtgctactattatgatgacattaacttgcattgggtgacatccttgactcgt

SEQ ID NO: 3743 - DNA, 594 bp, Sorghum bicolor
  Clone ID: SORBI-28MAY03-CLUS64406_1
agttggcccctggcttatctgggtaaatttattcctgtgcccgtaagacccttcccggactatttcaagcctcgctgttgtcagaaattgtcgcgccgagacgaggaggaaggtggacagacctaaggtgcaacgagtgggcagtgtaaataggcatgtgataagaaatggagataaattgcactggttgattccatggtagcagcatcttgggggtgtacgtataagatggcagctagtcggcctcgtagttttcttctaggagaagcagtgaggggaaaaaaaatatacagaagccaacctcgtgtagtagaaccctaccctacctggctggtgatctgctatgcggcagcgaaagggcaagcaagcacaaccatgccaaactcctgtactagctgcgttcctcatcagcataacctgaatgaagcagcgacatcgctaggttgcgatgtagcagcaattttttttcctggcgatatgatctgactgtaaatttgtaaatgtttatcgactacgagatgttcgtattttccatacacctgttctacggaccatttttttttctatacgaaaataaagttaaagaatagctct

SEQ ID NO: 3744 - DNA, 646 bp, Sorghum bicolor
  Clone ID: SORBI-28MAY03-CLUS64437_1
catatgaattgtttgacaaggagggcaaccgaccaattgtgattgaagaacttgcatcggaacttggacttggcccttcggttccacttcatgttgttctcaaagattggatcagacattcagatggaaacctcagtttcctcgggttcataaaactattgcatggagtttcttcacgcacaatccctaaagtctaagataaccatttgcatcgaccaatccctaatctctggccaggttgtagaagttgcatgaaaccagtacaaagattaacaggtcatcttagtgtaagaggtaaaatactcctagtaggtgtatatttgccctgccttccgcaacatggatcgacattgtcctcaagatgttcggaggaatgtacagatttggtttgggaagagtggaaatgccaaaggaatttaggccggtttttttgtttgttccagtaaacgcagttattgccttcatttgtgctgtgcacctgtgccgcaaaatgccccagtcgttacatatgctactgttgttttgatttataattctacgagagttaatgtacagcttggtaactttggaatccttgccacacgaaggattagtcggcctcgaataatgtataatgatgtggctctgggaggtgatctcaggaaaa

SEQ ID NO: 3745 - DNA, 661 bp, Sorghum bicolor
  Clone ID: SORBI-28MAY03-CLUS64485_1
ccaaacactgcgctagctcatgcggcaacatcagtgatgggaccttgggagacactggggaacccctgcgtgggagggaatgaggtcttcagatcaacaacattcttctcccagagcacatttgtcttgccagttccagggctgccgggctcattcatcttcatggctgatcggtggaacccatccgatcttatagattcgcggtatgtctggctgcctctgacgataggggggatccctgatgaagccgcagattatagcttcatgttccctctctggtcccgggtgtccatttactggcacaaacggtggcgtctccctgaggagtggagggactcttgaaagcctaaagttttttttagaagaattgaagttcttattcgctgttattacattggtatagataccaaagtattgacatttgacacgttggtctccatggtataggtcagatgtagatgcagggtttgtaaatgtgcagttttgtgagtttgcactcaaatcagataaaactttgtggccgtttgggcgaggtgttgtggtgatccactcgtcttagtttcaagaataatctggctgcgccttcagaattggtcttttcgtttgatctagttggaaatgtgtgctgacggctaggggacctcattcagggtcttccata

SEQ ID NO: 3746 - DNA, 689 bp, Sorghum bicolor
  Clone ID: SORBI-28MAY03-CLUS64529_1
caaccaaacccagagataagaccaacggcagtatatgtcatgcatcatccactcttctggagccctgaattgcgcctttcatttctaagggataccagtgacagaattgagaaaaccagtgaaactgacctcataaacgcactggaaagcatcggaccagtggcgtttggtggaaaatggggagagaaattggatgctgctttggttacagacatgggtcgttatagaaagtataactttgagtctattcgtgatcttctgaggtatatcagaaataaatcgggccattacagagaactttcagaagatctcaagggcatacttgggtcattgccagagggatttgatcgctattttgctagccgatttccaaagttgctaattgaggtgtacaaggtcttgtgggtgcactgcaaggacgaggaagctttcagtaaatatttcaatggaagctcgttataaccggagaggattgccttttcttactgtacatactaaccctgatgtagaagttgtatgtacacgtgatatgtatgccatattactcgtattatagaataaaaagagctcaatctgtacattatgtagtatagaactgtgtttcctataaatccaagcttttactgttgaatggtgactatggttaacaaaatttgctggatggaaaccattgctatggtaggaccagt

SEQ ID NO: 3747 - DNA, 699 bp, Sorghum bicolor
  Clone ID: SORBI-28MAY03-CLUS64604_1
caatttttgcagagcgccatgaccgaaatggtcaagataaaatctcagctcaccagttatcatggagaaatgggcaagctggattcgaagtttgtggagaagactgcttcatcctcccgagttggtgcactgcttgatgaaaaagatatagctgcagctgagctcgagcaagaacttgggcgcattcgccaggagagccagaagattgccaaggagaaggaaaaaatagatgcggaggtcgctagtctcaagacagcggttagcaggtacgaggatctgtgcaacggtgcggaaagtaagtttaaagacgtcttggctgggctgcggctgaagaggctaacctgatgcgcaagctttggatatagtttcagtgcttctaacttgacatctgtttatttatgctgttgggctgtagtagggctatctatgcatcacagtgggttcagatcgatgtgctgtggttatgttgtgcaagtcattcggtaccttttttatgtatctgtaggtatctatggcttagggagcctgatgaagtttctgactcttataatagctactgctatattaattgccagctagttggactgtacttattagcctgtaacatatttagtttgaaggcaatctgtttccgttcttgtaaactttgattcccctgacttttgccgtcagatggtagcgatccaacatgatatagta

SEQ ID NO: 3748 - DNA, 643 bp, Sorghum bicolor
  Clone ID: SORBI-28MAY03-CLUS64612_1
aggcgctagaggaagggctcgtggggcatcaagctccgctcccaggaccaacaaaggatcatcgcggcctcccgtcccgcccaggtcgaaggggaaggcatggcccgcgcccgtcccccgcaagggggacaaaggggcctcaacatcctgtccgcctccacctgtggatggaggagagacagtggcacctcccgagttccctttcgggctcaaaaacgcggctgccacctatgcctcttccgtgagcacttcgataagtgcgtacgcggatcttccagggcaccacctaagatctaccctagatcttatctccacaccgcccgttttgtcatatccggaggatcctacctcaagcgacgacgagtgggtcggcgctgacttttccgggtgtggcgacccggggaccttcatgcgcttcttggaggccagcaactactgtctcagctactccgactctgacgacgggagctatgacccgtcgcgagaatgtttcaacctggaagtgggagggacgccgcataacacccaggggggcgcaggaccctctaggcaggagaatgcgaccccacctcccaaccgtactcccgggaccaatcctggagcccgtggggtagcatcggcccccgtaggaggacaccgccct

SEQ ID NO: 3749 - DNA, 684 bp, Sorghum bicolor
  Clone ID: SORBI-28MAY03-CLUS63973_1
tgaaatgataaaagatcccaaggcatcatggaccgaatccaaaccgaaacttgaaaaagatccgcaaggtcgtgctcgaaatcctgacttaggccaaggtgatgcagaaaagttgtttcgtgaccatgtcaaggacctatatgagcggcgtgtacgtgatttccgggcacttctatctgaggttatcactcccgaggtagcagcacggacaacagatgaagggaagacggcaatcaactcatggagtgaagcaaggtcttctgagatctgatctgaggtacaacaagctggcgagtaaagacagggagtctatttggcggcgctatgctgatgacttgacgaggaaactcaggcaatcagacacaaaggagaaggagaaagacaagcccgatacagatgggaaacaacttaggtcctctgatccacctaggcggaggtagcttgtagttgtagtaacagcccgcttgtacttcctagttgctactcctaatatttttactgttgatagttataagggcgtgcttacactcatctgcaacattgaatagtcactggcgcactgccactttcgatactgagagtttccatccatgttataggaggttttgccttgcaaatctatttccctttgtggagcagatcatatattgttgaaatatgaggcgactttgcacttgacgagtt

SEQ ID NO: 3750 - DNA, 568 bp, Sorghum bicolor
  Clone ID: SORBI-28MAY03-CLUS63979_1
ctctaagatgcaatcagagtatgatgctcttgttgcacgcctcaattcccctagttttgtagaaaaggcccctgaagatattgttcgtggagttcgtgaaaaagcgtctgaggcagacgagaagatctctctaactaagaatcgtcttgcttttctccaatcaaccatctccacttaaatacagcgtgatgccattttgatcgatgatggaacgcaggacaaaactgatcgttggttgatagtttctggttaaaccatctcatagattgacttcctcaaaaatgatgtagattgccattaccaacgaagttctgtcgtgtagcaaggcgtatatttctgacttatggctttagagccttctcagaatgccctagttgagataaattttgcttggctgtaacattttttttttatgtttgattctgtattttttctctccaccgcatatattccacaacaatgtttttgccaaacttgtacgggttcaatattatattatgatcccttaaagaatagttttgtaagaatggatgccccatctattattaaaactaattatatatttttt

SEQ ID NO: 3751 - DNA, 544 bp, Sorghum bicolor
  Clone ID: SORBI-28MAY03-CLUS63988_1
tgtgctgtattttggtttctgcagatgattttgagcaactgaggaggtatctcaggtgccggtcacttcaatttccttgtgctaagtgcttttcggtttttgagatgcttatatttttcggtttctgagatgttccatttcataagaagggcagccgagcaccgtaaaaacgaatgagaaagcaaactctacaggttcaagcatgtatgcagctactaacaagcttggatgcgacagccaacgctacacgagatgatctccccgaagaagccatgcgaaatgatcagagtttgcatgcatttcacggactgacaatttttaggtccagccgtccaggttgtggattttacccttttcttatcttttttttggattgatggaaagaacgtgagtttacttaacctacccttcgtttgtcagaatcttgtccagagctcgtaattctcaagtttaacacgagatgtcagactcagcttgtacatggagtttgtttgtccaatgccaattgcattggcaatgaaaaaaatactagtaaaacttattc

SEQ ID NO: 3752 - DNA, 706 bp, Sorghum bicolor
  Clone ID: SORBI-28MAY03-CLUS64050_1
gaaaaatgcagaaagtgtgtcatcaaagggtgggtgcagttacttgtttgacattgcttctcagattgatatggaaagagttcgaactgtaggggctattgaatacttgattgatgccacaaggtctggaaatgtttcccgctatattaatcacagttgttccccgaatctcagtacccgattggttttggtagagagcaaagattgccagcttgctcacattggcttgtttgctaatcgagacattgccgtaggagaagaacttgcctatgattaccgacaaaagcttgtagcaggcgatggctgcccctgccattgtggagctaccaattgccgaggccgtgtctattgattttgcaggaagacactaagtaactgttcagcgcttggttgcagaactccggagatttcaacagttgtgtaggctgctgagcgatttagtattgcaattttcctagagcttgagtgcagggctaggatctcattcttcatgctgcaaatagggattgtgatataggactcacaggcaagcattaggcaacaacatagtgtcgattttagtcatggtaccatcatgcttaactgattatttgttagacgcagccagaaatgaaagtgattcgggctgctttgtttgtaggcgagaattctctccggtaaattccttcattcatattttattgatcatgggcacatcatcgacgtg

SEQ ID NO: 3753 - DNA, 551 bp, Sorghum bicolor
  Clone ID: SORBI-28MAY03-CLUS64790_1
cctgacgttgcaagagcgattatggaaactctggtagaaattgcagatcaatctcccccaaaacggccacgctatgataaggaagatgaggaactccttgagaaggcaaattctcaggaggtgacagagatgacatttagagactgcttgactcagcatgttgaacaggtcgactatgaaatggcgctggactacgccatgcagagtggagtaagcgaggagccccgagaagcgatatatttgaactcacttgaaggatcttacaagtttgtcgacttacaaagtccagtcttcgtgttcagatttgttccttgagaaggaaacttacacgtccgccatcctcaggcccccatatttcttaggatgaaaatgtccatgaattctattgattttgtacctgaacttaacgcttaagctgttttgactgagctgttcatgtagcataggcaatgtccattacaagttgctaagtagcttgaacctggatgcctctgtatgtatggagggaataatatttattacatgtaattcaaagctagtgcatggggttc

SEQ ID NO: 3754 - DNA, 694 bp, Sorghum bicolor
  Clone ID: SORBI-28MAY03-CLUS64793_1
tgatgaaagctttaatacgtgttgagcagtttgataaggttcctgttatctatgaagaaatgatcacatcaggatgtgcccctgatcgaaaagctagagcaatgctgcggtcagctttaagatacatgaaacacatgagggttgcataggatattagacacaattactggtagcacctgatgcaatcataaatcttctccagatcttataggaaatttgaacagaaggtgaagcaccacatgctgattgccacgctctgctttagtgcaagatgacagaatcaacaatatcttcattttgtcttcctataatcatctagggggaggcaaagacataattcatctggatcatttgccgtggaaggagattaaatacatgacaccaataagtgaggatcttggtataggaaacaaatacatagcctgtccagacctcgaaatttgaattggaagcttggaattgacattggtttataactcaattccagtattttgcgagaaaatgaattgtgacatggaattacaattccagcttttccaaattgtatttagacgtagaaatttctagaatttgtctagggcaatacaaaagaaaatgtattacatgtttattgcctaaaaacaaatactggcttttgcccttgtatacaatttcactaagatgacatcaaagtaattaaagaaaaagagtaccg

SEQ ID NO: 3755 - DNA, 381 bp, Sorghum bicolor
  Clone ID: SORBI-28MAY03-CLUS64916_1
ctagacggatatatgttgaccttccagatgcacagaaccggatgaagattctaaagattttacttgctaaagaaaagctagaatctgattttaagttcgatgagcttgcaaatgccacagaaggctattcagggagcgacctaaagaacctatgtgtagctgcagcatataggccagttcatgaactattagaagacgaaaagaagggatgtgtgagtaacggaaccagttatctgagaccccttaaattggatgattttatccaagcaaaagctaaggttagctcttctgtttcttatgatgcaacgagtatgaatgaattgagaaaatggaacgaacaatatggggaaggtggcagcaggactaaatcaccatttgggt

SEQ ID NO: 3756 - DNA, 487 bp, Sorghum bicolor
  Clone ID: SORBI-28MAY03-CLUS64825_1
caaatggtccaattagatgattggtgcatcagatgaacaagtggatgtcttcaatgaagtttggtacactgttctaataaatgctggagagacttccaaagcaattgagattcttgccaaacaaattaggaaacgagagggtgcacctttcttgtggcgcttgctggagaaagcatactcattggatggcagaagcgcagatgcttcagtagcatctaaaaaggcaaatgctttacaagccgcttatttccattagctgataccttgttgaataatgaatagccttgttcttggaaggtcgtgtaagctctcttttttttaccggtggaagttgccagtatgcaccataggaagtctacagtcagtatatataccgcacaaatcaacagtttcataatactggagcctgtgcattgtatcaatatgtgcatacatggaagttttatgttcagtaaagttatgggggtagatatggtttttggatttt

SEQ ID NO: 3757 - DNA, 546 bp, Sorghum bicolor
  unsure (1)..(546): unsure at all n locations
  Clone ID: SORBI-28MAY03-CLUS64919_1
tcgacgacaagttgttcccggcgtggtacggcatggtgaaagcccaggcggaggaggagagggcggagaaggtgaaggaaacgcttgccgcaatcgagaaaatggaagtggccttcgccaagtgctccggcaacggcaacgccgccttcttcggtggcgactccatgggctacgtcgacatcgtgctcggctccttcttgttctggttcgaggcggtgcgcagggttgacggcctggagatcattgacgcgagcaagtctccgctcttggctgcgtgggcggagcggtttggagggagtgtagaagcgaaggaggtggtgccggtgcctgaggcggacttggcggtacagtacatcaataagtttcgtgcccctgccatcgacgctgcgaagttagcgagttcagaatgagttcaggccaccaaagctggaagaggtaaacggtggggtaacagttgctatgatccttccaattccaaccngaataatgttgaaacttgaaagattattatattgataaatatgtagcggggttgactaatttttc

SEQ ID NO: 3758 - DNA, 801 bp, Sorghum bicolor
  Clone ID: SORBI-28MAY03-CLUS6496_1
cggtgggatccaggggtgtgtcgccggtgccatggtactaccacccctccacgacgccccctccgccgccgccgccggccgcgcactacgcccacggcgcgcaccagcagtaccacggcgtgctcccattctaccccgccgccaccacctacgggtactccccaaattacgtcgcggacctgagctacaatgcgaagttaggccaagcggcagctggcggcacggccgggtcgtacctacagccacaggggcacttcgcgtacccggcggcagcgcagggcggcatgcatgtggcggcgcccaacggcatgatgccggtgtacccgttctaccactaccagtaccaccacgcctcgcagggtctgggcgtccccgccgcgcacttcttccccccggtctccgccgccgccgtcaccaccgtcccggccatcgtctccaagcccaccgtcatggccgctcctcccaaagtggagcaggtgacgggctgcagctgaaggcacgaggcggtgatgatgatggcgacgatgagcgggcggcgcaatgaagggaggaggccgaaggtgctctctgctctggtttaacaagctgcactgcacatgaaggggtgtcgtccgtctgtcgggtcggggggccgaagcaaagcaatatgcgaaggccgccgcattacattcgttcaattccctctctaacttggtgcgcggcgtggcgcgtgcgcccgttggtggggcacgaccacgaccaccgccgtaccggcaagaaacagtctcagtctgtaacaaatgattcgattcgtctctcgtt

SEQ ID NO: 3759 - DNA, 610 bp, Sorghum bicolor
  Clone ID: SORBI-28MAY03-CLUS64252_1
ggtcacactgaatactcaagggaaccaaataattgcaaacggctctttcattggcgcaggaatatttttggcattgctggtcagatctatgcaaagagtgaagaaactcgacaaatttgagaccatgatatgatcatttcattttgtaaagacagtgcaatcgccggatttacatgggagctgcgcgtcccttcgaggttgtcgatagcctatacgtagtgtatatgtatatagtaaatgtcattctttctgggaacaacctaacgtgttgctcctgtaaatctgtacagactgtatcattctttagcccgtaaaaggctaagcataccgatcatcaagcagtcgacaaaacaaggaaatcaagatagctgtaacatacactacactaaaattatactgccttcaatccctcagtcttgaaatactagggccttggatatattctcaccatggagaaaagcaattaattagagtactactacattcaggcaaagcaaaagcaacatcaaactactctactacggagtagttatttgtcttgtctgagacgaaagcttttgttgactagtatttcccatattgtacctttattgttaaatataaatactcc

SEQ ID NO: 3760 - DNA, 634 bp, Sorghum bicolor
  Clone ID: SORBI-28MAY03-CLUS64278_1
tatgtctgcattttccttcaccacctgatatgtaatttactttatggtttacacttacacgtgttgcctgcaagttgcattatgagcagattatgaggattcccttccttccaatttattgtggcgtgagtgagctctccacgcttgtgtgcgctgggaaagacctttttctcctgtgcttcctctccttgccattgccaggaccgggtttatgtgtggatctggctcgccggcatcgctggaggaacccacaccgaagcatctagcatattgcacatgctgaagggcaacaagatatgaacaacaatttcatatgccggagagagatggattaggagaaggcccgcaccaatttaatgatgcccacaattttttcatataaaaggagagccagacatgagcaaagtgtgcgttggtccatgtagagtgcattgcctacaaacaagatatatgttttacctccaactcttaaatgttcactggcgtcgcaattgctatcttcgcatgtaatctattgataagtggattttgtttgcatcgcaagttattgaacccggtatgaaacattcatggccagagtttcatagggctatacttgatgttttgattgggtacagctgctgagctttttaag

SEQ ID NO: 3761 - DNA, 509 bp, Sorghum bicolor
  Clone ID: SORBI-28MAY03-CLUS6433_1
gatgaacaaatcgtaggcggacagcaccgtgccagaaaaagaaatgatggtgggtgcacacaaatttgcaacagcatcggggaacataatgcagatgccaggacgcagacggcccatcagatctccgaagggacacgccggtacagctcctccttgtccaggcgcggcgtggcgacggcctgcagcggcgtgtccatgaaggtgacgagcccgggggactccaccatcctcacgtcctcgggccgtgtcccctccggcagcgtccacctgaagtggtgaaccatgtggccgatcatggacgccacgaggttgatcccgagctgcgcgccggggcacacccgccggccggcgccgaacggcagcacgcggaagtcggcgcccttgatgtcgatgttctcccggaggaaccgctccggccggaactcgagcgggtcgtcccacaccgcggggtcccgcgccaccgcccacacgttgacgacgacgttggcgcccttggggatgtcgtagcc

SEQ ID NO: 3762 - DNA, 782 bp, Sorghum bicolor
  Clone ID: SORBI-28MAY03-CLUS64364_1
ctgtggagccctgtgaccgagagctggaggagaaggttagggaagcccaggagctgaaggcggagcgtctgcgcaagaagcagcaggtggaggagctggagagcatcgtgcggttgaagcaggcagaagcggagatgttccagctgaaggcgaatgaggcccggcaggaggcggagcggctacagagcatcgcgctcaccaagtccaagacagccgagcaggactatgccagcatgttcctgaagcggcgcctggaggaggcagaggcagagaaacagttcctttttgagaagatcaagctgcaggagaaccagaggccagccgtgggtgtgggcagcagcagtggtgctggaggtgactccgcacagacgatgatgctatccaagattcaggacctgctcaagaacgtccgcagcaagccagcgaagtcggagggtcactagttggaataagagctgctgctgagattttcggtaattatatatacgtgtgttccactgatttgttcgagtagaggtgtaacgaattgtgtggtgctttgagaaatttggatcccttcacgttactgtcgctaggcgtcttgatgcttttgagtactcttgtaggcttatatacacgtatctgttgttgcaggtggccacagtgtgcttcaaacaatgttttttttttgacaagtgcttcaaacaatgttaatgttacatcgttaggcacgaagcaaccaccagttgtgtctctctttatatctacatatatatacaaatacaaacatgcatttgtaacgg

SEQ ID NO: 3763 - DNA, 597 bp, Sorghum bicolor
  unsure (1)..(597): unsure at all n locations
  Clone ID: SORBI-28MAY03-CLUS64398_1
ggtgtttatgggcattggagcttgatcaaaatagagacataaagaagattatatagaagtaatatactaaggagttgagctagaaaattaagagactgagggattaaatggtattatcatttgcatggggtcgaagattattgtgtgataggagaaaggagagaggatgaccatgaaggaatgggctgcttctccacgtgaatgagagggaaaggagatattaatagctgctgcatgctttcatgcatttgaagatgagaagaacaattggagtacagcatctgtttttgcatgagtggagtaaaggaatgtggagtccagccacactctgcaatttatttgctgctcaaaaataaaatggagattaagaggaggtgattaagagaaaaataaatcaaggaaatctgagaataagaattatgtgtgacagttatattttttttgcttgaacaaaaaaagtaggggctgcaacacaaggagaggggatactgttttcacatgaaagggagtggaaatttaagattcatttatatgagtggttgagagatgataaaatattggcctgaataatccatggacaccaaaatgatntaagag

SEQ ID NO: 3764 - DNA, 543 bp, Sorghum bicolor
  Clone ID: SORBI-28MAY03-CLUS65053_1
taagtgcagaatacataaatgatgatgagtctgaaacaagcattgctggaaacgaagagggccagctcgagcagtcacctgatctctctggcgatgaacattttgagcttgacatgcttgagcgtctggagtcatctgtgccattgggatcgctgccgattgacggcatgatagagcagctgaacagtgagtgaactacgatgagcagttcattctgtccattggggtaactactgatgatcagattgcaacctctgattgcaacctcagtctgatgatgatctcaatagctgagaattttcagcgatttggtagcaaacatgatgtaaagaaaataattgtagcggatgggcatgtggcccagtggtgaaggctccaagagaggagccggcccgtgggggtttgatcctccgtcccgcatctgccctcctgtgaagggcgcaccaggtggtgctttctaaaaataataataatataattgtagtataaaaatgcactaactgatcacacgtatcaccaccatcaatgagtgtgcttgcatgt

SEQ ID NO: 3765 - DNA, 650 bp, Sorghum bicolor
  Clone ID: SORBI-28MAY03-CLUS65100_1
catgggtcctcaaactcgaaatgctcgagaggcttgtcataaccagttgtgatgggttgctgaaggttgttgaagaagatagcggtgatgaggcagagacaaaaacagaaggacagggaggtaagtggattggtgatggtcaaagtgcgtgcaatagcggtgacaacgcgcatgcagagttcctgaacctgcgatcaatcgagctgactgatgtcaagatgctgagaagtatctgcaagccaagaaattttcccagccttgagaccatccgggtggaggattgcccgaatctgagaagcatcccactgagcagcatctacaattttgggaaactgaaacaggtgtgctgttcagttgaatggtgggagaaactggagtgggaggacaaggagggcaaagagagcaagttcttcattccaatctgacagcaaccctgttctccagcggttgctgcgtcatcagcacaatactggcacgaataacccaatcgcaataatctgtatatgcgatgagttgtttgtacatgtaggcaatctgtatgagtgtatatattgctggggttcacaaatctgtacatgttttatttgattgattgattcattcattcattgttgtaaatgctataaataaaactccatttattaacttgc

SEQ ID NO: 3766 - DNA, 596 bp, Sorghum bicolor
  Clone ID: SORBI-28MAY03-CLUS65134_1
tcattatcatgcattgcatgtagctgaacaaatagatctatatcaaagaagatcaggtttgtttgattcagatttagcaattcaggaagctactgggacacctcaagatgtctggtgggagaaacatgggagtggcacgaaggagctacaatcttttgctgctcggatcctaggccagacatgctttggcgctactaggtacaacctcgacaagagcttaaccgagaggctgcacaccgagaagcgttccttggccgatcaagagaggttccgcaacatggagtacatccattacaaccttcgcctcgtgaatgcagtgcctcgcctgaacggtcctaagcatggtaaggtcactgctcagctcagcgactgggtgtcagcatagcacaccgcctgctcgcccgtcgcccctggtggcgcggcgaaccggcttttgagccgggggaggacataccgtggcgtgggcatttccaacaaattggaggcctgggaaacctttgttgttaaaccagacttttcctttttggctggatgggtaatttccatcttcagaggttggataattaatttagtgcatgaaggaaatggtttccctg

SEQ ID NO: 3767 - DNA, 671 bp, Sorghum bicolor
  Clone ID: SORBI-28MAY03-CLUS65163_1
cgtaactaatagcaatggtggagtcaaccatagtagaaatgaaaaggctcagaatttatcctcagaaaaggaagcagccgacgatcattcctcagtaagcaaacctgtctcaccggatgcccgcaaattaacggaccaagagaatggaaacgatgcagtatagagagtggatgttagcgacgctagtcgttctactgcttttacatgttcactgcaaatcagtgactgaggcgttgctgcttcatcgacgcactgttctgaatccacggaccacggacggaagggtatagctgtcaccacgctacagctacaggagacccaggaatcacacgaagatgcaacaggaggcaaaattgttttaaaccagaaaccacgctctaggactagggcctttttttttcctagaatctgtggctgtactgtaggttatgtggagcatatagataggagaggatccaaacgagtattatgttgtccagctgggattggatgggatggatgcaaggtggctgtgataaatgtacatctcccatcctcgcctgattttgaccgtgcaattcgctaatttactttaggccgcagtgtacctcgtgacaataaggaccgaaatttttccgtgacactgtagcactttggtttgtttatggtaattattgtcccaatcatagtct

SEQ ID NO: 3768 - DNA, 558 bp, Sorghum bicolor
  Clone ID: SORBI-28MAY03-CLUS6521_1
cagaggccaaagattttctgctgaagtgcctgcagaaggaaccagagctgaggtctactgcaccggacttattaaggcatccttttgtcactggaaaattggatgacctgcagccactcaatcatgctgcagacaaggactcttgtaatgagattcctgcagatgatatgccaaatggcttgggtttgaatcattcttccaactggtccactatgaactccaataaatcatcaaaaatcaagcctttatgggagggtagctgtgatgatgatgtcatgtgtgagtttgctgacaaggatgactatgcagcagttggatctagctataatcctatgtcagaaccatttgatgactgggaaaacaagtttgacataagcccagagcaaaattctcatcaaccaatggaatttggtgaattggccaaacatgctgaaagcagcataactgagaatgattttacgttccctgttgagggaagttgcgaagatgatgatgtacttacagagtcaaaaataaaggcatttcttgaggagaaggcccttgacctgaaaaagctac

SEQ ID NO: 3769 - DNA, 705 bp, Sorghum bicolor
  Clone ID: SORBI-28MAY03-CLUS65253_1
ctaggaaggagtatgaagagaaaaaagaggaggtagccaatgagattataagaaggcttgaaaagaagttgtttcctggtcttcaagattcaatagtcctcaaagaggtaggctcaccaaaaactcaccgaagatttcttgctcgaaatgatggtacatatggaccaatgccacggggtaaaccgaagggcttactggctatgcctttcaatactacttcaatagacggcctttactgtgttggtgatagctgttttcccgggcaaggtgtcatagctgtagcattctcagggatcatgtgtgctcaccgagttgctgcagatattggactagagcaaaaatctccggttctagatgctggtcttcttgggctactcaggtggttcagaacacttgcatagaatgatatcagacaaagttgagaatggagttcatcttctcttcagaaggttgatgtttcactaagttaggatactgcacaagctgatgatgatcttgaggactggagctgcagcctttgttatctataccatatcagcagcaatttcccaaaaatcccaaaagaaaaaaaaaaagaaataggaataggtgtacaagtttcagatttcaaaatgacaaattctataattaggaggtgtcatggccaaacgaacaaggcgagctgtacatttgggagcaattgtaaatcatgttacctagggcttg

SEQ ID NO: 3770 - DNA, 685 bp, Sorghum bicolor
  unsure (1)..(685): unsure at all n locations
  Clone ID: SORBI-28MAY03-CLUS6467_1
gccggccgggctgcggaacacatccgatccacccaccagagccggtcgatccgttcgaaaacgctccgaaaagaccccacgagttcttctcccacacccaccacccacaccgcactgctccgccgccgccgcactagccgttgccttctccccttcccttccccgttcccattcccaaggagttatcctcaccggcggatccggggcgccgcagcaagagggaggaaggaggaggagaggatactacccgaatggcgtcgcggacggcgtccaaggatatcatcacgctgcgaggctccgccgccatcgtcagcgagttcttcggatacgcggcgaatagcatcctctacaaccgcgcggtgtatcctgaggagagcttcaccaaggtgaagaagtatgggctcaccatgctgctcacgcaggacgagggggtgaaggacttcatcgccaacctcacctcccagctctcaaagtggctggaggccgggaagctgcagcggattgtgctggtgataatgagcaagggcaccagcgaggttctcgagcgatggaacttcaatatcgtcactgacgccgaggtcgtcgagagggggctatcaaggagaagagcgacaggagatcatgagggagattcagggcatcatgcgccagatcacctcctgcatcnactacctcccctgcctcg

SEQ ID NO: 3771 - DNA, 624 bp, Sorghum bicolor
  Clone ID: SORBI-28MAY03-CLUS64690_1
tttggtccgttccaaattgaagcgaaagtcggtgaagttgcctacaagctcagcttaccatcctcttcacaagtccatccggtctttcacgtatcacaactcaaacacgcccttcctgtcaagcatcaagttgctgatttgcaaaacaccttggatggcctccagttccctgaacaagtgctccaacgccgggtatcttcaaaagactccgctgttgttctgcaaggtttgataaaatggtctggtcttccacaatccttggctacgtgggaagatttggagccattgaagcagagatttcccagggctcctgcttggggacaagcagtttccaaaggaagggggggtgttacaacatcgcctagtaaagaggctcagggaactggcccagtcactatggcctctccagcaacagagaagagacagagcacacgtatcaggactccaagtacccgtactactgggcctcaatgggcttgatccctcggactagagcagctgcgctgctgggacaagctccggctatgccgatgtataaacatgagagaatacgcttgagttgggcatgatgtaattaaaccaaattccttcctaagaaatatgcatctgtccttcctttctcct

SEQ ID NO: 3772 - DNA, 918 bp, Sorghum bicolor
  Clone ID: SORBI-28MAY03-CLUS64699_1
tcacatacggcacttggtttggtgtgaagggactaattgctgctggtagaacatttgagaacagtcctgcaattagaaaggcatgcgactttctgttatcaaaagaacttccttcgggtggttggggagaaagctatttgtcctctcaagaccaggtttacaccaatctcaaaggcaacagacctcatgcagtgaacactagttgggccatgctggcactgattgatgcaggacaggctgagagagacccaacgcctctacaccgagcagcaaaggttttgatcaacttgcaatcagaggatggagaatttcctcagcaagagatcataggagtgttcaacaagaactgcatgatcagttactcccagtacaggaacaccttcccaatttgggctctgggtgagtaccggtgccgagtcttggcgtctggcaagcagtagtgtggtagtgcccccgtcaactagattgaaaaggcactttgttgccttgtggctctatcttggcacgccaaggactgtcttgccggggaacgggaggtgtgtctcatgaatcagtttttgtgagtagccatgtggcagttggaataatgtagctatgttcaggggttgcgctcctagttctaataataataataataatgtatattgaaagtgggataatgttagattcaggtctactccgttcttttgctaatgatgtgatgtagttctgagctgcgcgattgccagttgacttattacagtctcaaagccgtgctgctggtacctggtatgccctgtgccatgcaattttgctcctctcagatgccagtcacgcacctgagagagttgggagaatgaaatccaatcggcgaaggagtacttgtatactgtagttgggagaatcaaatcaatcaaatccagtctgcctattgtctgc

SEQ ID NO: 3773 - DNA, 728 bp, Sorghum bicolor
  Clone ID: SORBI-28MAY03-CLUS64748_1
gaacgagcggtggggaagaagctgcgggagaaggaactggaggcggaggcgatgaacaggaagagcaaggagctgaacgagcagatcaggcaagtggccatggaggtgcaatcgtggcagtcagcggccatgtacaaccagtcggtcgccaacagcctgaaaaccaggctgatgcaagtggtcgcgcagagcaccaacctcaccagagaaggcaccggcgacagcgaggaggccgacaatgcggcctacagccagaaccccaacgccagagccggagccgcccacgagggcttcttccagtctgaccttctgggtggtggtggcggtggcagggcaacgacgtcgacggctaccatcgggctgggggcctgcaggtggtgcggcgggaaggaggcgtcggtgctggtgatgccgtgccgccacctgtgcctgtgcattgactgtgagagggtctctgacgtctgccccgtgtgtcggttccccaagagcggcagcgtggagatcaacatgtcctgacaaggacctatgtaaggacgctcgatcaaaattggcgggcagagtatacacagtaactagtaagtagatggtaagcgtgtttcgtacagcgcagtacatgtgaaacatgtttttccttggcgacggacctcagctgtccaggtgtaaggtcactttccccccgcttggggtttcatcattagaaggtaaatgagatcatgtttgcgtcctgc

SEQ ID NO: 3774 - DNA, 618 bp, Sorghum bicolor
  Clone ID: SORBI-28MAY03-CLUS65388_1
cttcctatcgcaagacaattggtcgattctgatgggtcaaaactcagttctgtgtcattgaagaacctgagagaacgctataatatcccactcacaggcagcgcgcatcgtgccatgcaggatgtgacaaccctctgttatgtgcttcagaaattgacctttgagctgaaactaactgttcctcagctgctcgagaagtctttccaagcatctgatcttccagcgactcgtgctgaaaagtaactgtatcggcctcaccgggaagatcgtctgaagcactaaattattccattgttgttgtattattacaaagatgttatttggatatccatctctgatttcttcgaatgttctttctaacaacctaataaagccagcctgattgtcactgatacatcagtagtacagtaatccgtattactgatactctgcccttgtaggcttgtatacattactaaatcatcaattcaacatatatttacttgactgcaaacttctgtgtgctgctcaaccaagaaatgtaatgttcttgacagtttctgtgggatgtacatgtactgcagtgtcaggctttcactattcctgtgatactatttcacggcaataaagaccattcca

SEQ ID NO: 3775 - DNA, 617 bp, Sorghum bicolor
  Clone ID: SORBI-28MAY03-CLUS65414_1
gaagaatctgagaagcctgagctgacttctccagaggatcttggtgttcaagctgcatcaatgctactagaagaggtggctcaaggaggtgttgttgactctacacatcagggccttctatttatcctgtgtgctttatgcccacctgatgtatcaaaggttcgagtgggacagctgactccatatggtatagagacacttcgaaacatcagagattttcttgacgtcaagttcatcatcaagcctgatcccaattcgaacacagttacattaaaatgtgttggtgccggagcgaagaatcttgctcggaagatttcataagcaacaggaccatattaatctgataaaggattcatgatacatcaagagactcctatgagaccctgttggtaactgcagacagcagtggagtttcccttagctgctcctgctgaaattctgttcgaggtcacgcatattatagactgaaaacctaaattttaaggcatctaagtcggcttcactatcttaaattcctgtcaacagtctcggaggtctagtttagttcgatttttttttagtggttgagggtactcattttgtttttatttgacaattattatccaatcatagactaa

SEQ ID NO: 3776 - DNA, 610 bp, Sorghum bicolor
  Clone ID: SORBI-28MAY03-CLUS65420_1
tgggcctccgctgtaggcccacccctcgggtcactccatgcctcccgtactactgggtacggtcacggcacgctgcatccgtgcggcggcgcaaggggctgcctttgctgccgccgtgctcgctgagcttccggctggccgttttcgccatcagcttcgatcgttgttgggctgcagcggaggtgtcgggctgggcggcgtgcggcgtggccctgcggatcccactctggcggggcttctggggtcggcgcagcttggtgctggcgctggcctgcctcgtgggggctcttctggtggtgtcgtctcggggctcttcttgcagccagtgatgcttggcctccgcggttcgccataccctctctgctctcccaggaaatcatactactgagtactgatacaggagagttcatccgaggggagatcagagaagtcaagaagttcgttattcagcatatttcttggaatgccacagatgtgaggcttctgggttctacgaagctttgttctttgtgtagtgttgatctttgtggctttaaatgttgtgttgaaacgagtatcatgtttcaaaccagtgatatattgccttcttggatccagtatattttttctg

SEQ ID NO: 3777 - DNA, 660 bp, Sorghum bicolor
  Clone ID: SORBI-28MAY03-CLUS65532_1
gtccaattatattattactagctgctgatgaaattaataatagacgatccctgctgctgaaattaatgaaaatcagctgagaggatttgatctagctagctagctgccacacgatgcttgcaggtgagggtggagacgtgcgtggagaagggcgacccgcgcgacgtgatctgcggcgcggcggagaaggccggcgccgacttgctggtgatgggcagccacggctacggcttcctgcagagggcgctgctgggcagcgtcagcgaccactgcgtgcagaactgcaagtgccccgtggtcgtcgtcaagaggcccgacagcaagcagcagcagccggcgcgcggcggcgacgcgagtcttggctcaccttgaggccgctgggcaccactcgcctcggtgcaacgtgatgatggtcccctgtcccctgtacatagtcataggagcttcggctgttgctctgcttgtatgtcgcccagagtatcaaatcgtcttcactaactcacatactatgtctatatatgatgttcccggtcactatagctgttattatagtcacattgtctgcacatatatacttgcttccagtttgtatgtgatctacgaaggaaacatattattccaataaaattttcgagcgtgcagcacaccctgcaccgctcc

SEQ ID NO: 3778 - DNA, 663 bp, Sorghum bicolor
  Clone ID: SORBI-28MAY03-CLUS65560_1
ctttgcgacaggtggtcgaggcaatagatacagcggcggcaccagcagctattatgaggggaggagagggaggcgcagctaccagtcaagggtttctaacgattttgttgatgctgcctcaactgctgttggagctgatgataacaccagcagcagcagcagtggagatggctggggaggcagcaaaagcagtggcggatatggaggatgggatgagattctggacaacaacactgctgctgcccaggaggcgaagaggagcagcaactcattctcagctggcaacaatggttacggcacgaaatcacggcctccaacgactggggaggaagatgcggattatactgccgctgctggcggtggtggaagagtggaccagggagtaggacctcctccagaaagaatgagaatgagacgccggcggatcccaagaacgatggggctgggcagttccaggtacaagcaggcccccctcttgatgcgcttgttggtggcagtcttcccgttcatgggatcatggttcaggttgtaccattggtaacgcaaatgtaaatgaattaacgctgtggacgcaaatgtaaaggaattaaagctgtggccattacggcaacacgtacgatttgaactgatttcatttccatttgtgttactgttctacgaccc

SEQ ID NO: 3779 - DNA, 599 bp, Sorghum bicolor
  Clone ID: SORBI-28MAY03-CLUS65580_1
caaggcttcaaagcttgcaaaggatactccaaggaagtgtggctgtgcaggtcaacagtggggtattaagtgtgtgcactgcattcttatctggtgagccagcgacaaggctcagatcccaagaactgcagcaactcatcgctgcattgcttgaattcatggctgtctgcaagcgtgcaatccgtgtgcatttcagattgataggggaagaagaccaggaattccacacccaacttgtcaatgggttccagtcactcactgctgagctatctcactatatccctgctatactctccgagctatgatagagccagaaattagggtttattctcaagagatcctccggaagagcaaaagctgttttgaagtctaaaatggctccggcctccttttttggcactgaaaaacggctcctcctggtagggctcttctaaaagtgccggaggagccctaccaaataggtcttaagagcaaggtcttaagagcaagtattataatacagtcagccagcggctgtaagatttctttatagctttctcgcagtccactcatataatggttagctcatcactattaatacatgtcgcatacgttttctc

SEQ ID NO: 3780 - DNA, 459 bp, Sorghum bicolor
  Clone ID: SORBI-28MAY03-CLUS65830_1
cttcatcatgatagtacttctgattttgaagaagatcattttctgacatacatagctctctcattttaatggtggccaagcacacaccacgctcatctactcatgtgagtgaggattacaccatgcctgcatatggagaacgccacagttcatttgaatagcgcgatacgactcactgatctgaagatggttctcctgcccatattcataatggctagcaactgtcttcagtcttggccacaatttttttgcatcgttgcagatgtagagatcccctattcatacatccctcttatttttagagagaaaaaaaaatctgaagaggattgtttgacacgtttccccttccagtttcccttggagcaaccaggttagctggctgtgtatccctctgtatagagcgagttgtatcatacatcaagttatcggaaatcagaaagtagattcagttcctgtgtc

SEQ ID NO: 3781 - DNA, 728 bp, Sorghum bicolor
  Clone ID: SORBI-28MAY03-CLUS6499_1
gcacgagggtttcgggatatcagatccgccgcagattacttttaactggcactccaatccaaaatagcctacaagaactgtggtctttgcttaactttattctgccgaatatttttaattcatctcagaatttcgaggaatggtttaatgcaccatttgcatgtgatgttagtcttaatgatgaggaacagttactaatcatacatcgtttgcatcaagttttgcgtccatttttgctgaggaggaagaaagatgaagtggaaaaatatctccctgtgaaaacacaagtaattctcaagtgtgacatgtctgcttggcaaaaagcatactacgaacaagtcacaagcagggaaaaggttgcactaggatctgggctcagatcaaaggctctgcaaaatctgtcaatgcaacttaggaaatgttgcaaccatccctacctatttgtagagcactataacatgtaccagcgggaggaaattgttagagcatcagggaagtttgaattgcttgatcgtctacttccgaagctgcagagagctggtcacagggttctacttttctcccaaatgacaaaactgcttgatgttttagaagtatatttgcaaatgtacaatttcaagtacatgaggcttgatggatccacaaagactgaagaaacgagggggttactggcagattttaataagaaggattcagaatatttcatgtttctcctcagcacacgtgct

SEQ ID NO: 3782 - DNA, 535 bp, Sorghum bicolor
  Clone ID: SORBI-28MAY03-CLUS65002_1
tgcatcaagtggaaattcatatagcatcccgtcaacttttgtgccaatgaatcaatcgcagaatgtaactgttgttgttgaaaacccaatgccagtagatgccaagggaaaattggtgagcaatgttgtagtaggggttacaagtggtgggaaaaagtaacatatcccaccctgggtaactttgtttattatgtttaaaatatctgaaaaggtttaagaataccatgtatcatactgctgtttggcgatcggctgctcgacgaaggaatccctccctgaagagcatagtggcaaagcacgcggctttcgccattgcgatcgtgctagaacgagcgaaaacgaagtgcgggtgtggatggatactcagaaactgtagcttgttacccttgattcttttgtatgtaatatgggctctcccagaatttcccctgtgtgatcaaattccaaagcccgtggggctcttgctcccttgttattagtgaataacgccagaaaaaacattgcaaatgtggctcttgaaatacagtgggttttt

SEQ ID NO: 3783 - DNA, 626 bp, Sorghum bicolor
  Clone ID: SORBI-28MAY03-CLUS64998_1
caaggcaaatcaagtgggcactgtcactgaggccatagaggttgtgaagcaggcaaaggatgctcattggggtgtggtggtgtcacataggtctggagatactgaggattctttcattgctgacctggctgttggtgctgcagccggacagatcaaagccggtgccccctgccgtggagagtgtctaactaagtacaatcagctgcttagaatagaggaagaacttggaagtgaaggcgtctatgcaggggagaattggagaactgtaagcacgagctaatctgtggtatcatttgagttgcggggagaattggaaatcttgacctgcttcgtatgtagccactttaacttttctttgttgtcttgtccaattgcgtgtgctcatcctcagcaaggatatggaaatagggtggtgaaatgcaccattttgtattagatgatggcattgttgtcgaacatatacatagtggatgcagtggtggggtttacattttttgtgttgttcaacttggatttgtttaatttgtgtatagcatgggttataaacatgagtacagaacctgagaagatggtttgaggaatagaagtgatttacattacattctagtataactggtccttttctt

SEQ ID NO: 3784 - DNA, 722 bp, Sorghum bicolor
  Clone ID: SORBI-28MAY03-CLUS65027_1
cgtgggtcagcgtcagcttgtatgcctaggtagggtaatcctgaagcggagcaagatcctcgtcctggacgaagccaccgcttcagtagacaccgcgacagacaacctgatccagaagactcttcggcagcaattctcggaggcgacggtcatcacaatcgcccacaggatcacgtcggtcctcgacagcgacatggtcctcctccttgacaacggtgtggccgtggagcgcgacacgccggccaagctgctggaggacaagtcgtcgctcttctccaagctcgtcgcggaatacacgatgaggtcgacgcacacgtagccgcagcagctgaaaaagttcttcgtcgtgctgctttctttgctccacgtacgccgtttgaggctgccacctgggctggggcaaggctgactagtcgaccatgccggcagatttttatgggtcgccggtgaggcaggctgacttgtccgatgatgccgaaaaaagtgatactgatcgcgcgctttgttgctgatatagagctagcggtaatctgatcgttgtaacgttgaggagttgatgttcaggaaatgagttaaggaattaaggtgatttattagaaagttgatggaaagtagtagtgttcattctgagcatactaaagcctcaagaagactctactacgtctgaattaataaaatagtgaagtgcttgcacgttaacgaacaaaacggagcagcattcg

SEQ ID NO: 3785 - DNA, 660 bp, Sorghum bicolor
  Clone ID: SORBI-28MAY03-CLUS6504_1
atgtaattagggaacagaactttatggcagccaacgagatcattgagctcttctgtgagctgattgttacacgccttcccatcattgcaaaacagaaggaatgtccagcagacttgaaagaaggtatctgcagtttgatatttgcagctccaaggtgctctgagctccctgaacttggtcgcatgcgtgacatttttgaaaagaagtatggcaaagattttgtttctgctgcagttgacttgcgcccagatgctgctgttaacaaccttctgattgagaagctgtcggttaagaagccttctggacaaattaagctgaaagttctaaaggatatagcaaaagagcaccagattgattgggataccactgagagtgagcaggagcttctgaaacctcccgaagagttgattaaagggccaagtacatttgttgaagcttccaatatgcctgttaagactattctgacaccacatgtcctgcaaccaaatccagttaacttcagctataggtattcggatgatgaatatgatgacaggggcactatgcaattcaaagatgcagcttcagctgctcgagcagctgcagtctctgctgagagagcagcatctgctgccaaggctgcagctgactttgccataagaacaaccatccatttgatga

SEQ ID NO: 3786 - DNA, 665 bp, Sorghum bicolor
  Clone ID: SORBI-28MAY03-CLUS65617_1
atccatgaggtggagaggaagctgtgtgttgttgggttatggtgcattcagatgaaatcccatgatcgaccaacgatgagtgaggtcattgggatgcttgaagctggcgttgatggtcttcagatgcctcccgagccattcttctgtggggatgagcagaattccgtaactggtactttccgtttgtcctcggagttgagtgcaatctcagagaatgaatgaggttactgattccccaagatgaaccgccaatgtgttccagggggcggggtgctggagttcggtgttccccgttctccgtggttctggctcggtgctcttctggtggtgtcgtggctcggcggacgtgcgcgctgctatctgggggactacgggggctgccaggtcgttcgcgtggtgctggtgctggctgtcgccttggtgttccggatggcgggggggccgccgctttcgctgctgctgatggatgatcttaattcggtgtctgctgtttagattccttttgcaatagtcctgtagagttttttgcttcagttctgttaaactcttttagctgttgtcgaggttgctctggagtttggtctttaatctcggatggtatgggaatttgcacttccatatgctgcgatcctggttgccatccaaacggaattcataagtttggg

SEQ ID NO: 3787 - DNA, 517 bp, Sorghum bicolor
  unsure (1)..(517): unsure at all n locations
  Clone ID: SORBI-28MAY03-CLUS6563_1
tgctaccatccatggtgcagtccttgctttgacagcttcagtcctttctgttccatacgacatgcctagctggcttccttctcatgtcacgctacttgctcgcttcatccgggagccttctcccattagatcaaccgtcacgaaagctgttgcagagtttaagcgcacccatgctgacacatggagcatccagaaggacgcatttactgaagacgaactggaggttcttcgtgatacatcttcctcctcatcgtactttgcttagattaaaatttcaaaggtcataggatattctctggtgccggtgatgtgtatacgaaatttgttactgttgaattgccagtgttgctcatatagtataacctatacatagttgttttatttcttcaacagatgccttggtacaagatgaagctacgcatatatacatttgtgaaaaannnatttgtgttgtagtagggaagtnnttttaattaaatttataaatttatgttatatcccttttaattaataatgt

SEQ ID NO: 3788 - DNA, 584 bp, Sorghum bicolor
  Clone ID: SORBI-28MAY03-CLUS65730_1
agaaggcgaggtgattcatggattacttgagaagttgggtcttggggaagcatgtgcggttgctaatgctctgatgggtgccaatgatgcagttcatgatgaggcactatgtggacacagctcaaagctcgctgtcacattcggtgtgctgcatttaccggaagggcggccaatccgtgtgacaaagaactcaaaagtctgcagtcactgccatgaggctgccaagttcatatccaagatgtgcaacagagagatcattctgagagattcaagcaggttccatcattttgaaggaggcagatgttcttgcagggggcacttctgaaagaaacaccagtcatgtaactgtggttttgtttgttcattagcagagagcacatttattgctactagcagttctagcaccaccatatagcctgcatctgtaatgattttcctttataaagatgaagagatgacattagaacgatgagggaagagacctttagaaggtaacaattttgtgtgttcaggaaataaaagctactgtccatagaaatgtaaagaaatttaatatatataaaagcattttggcatcttttacg

SEQ ID NO: 3789 - DNA, 483 bp, Sorghum bicolor
  Clone ID: SORBI-28MAY03-CLUS65716_1
gcaaagtatggcatttctccagtgaccttagcgattgcatttgtcttgagacatccacttgttgcatcggctgttttcggtgcgactaaattgtggcagcttgatgaagttcttcaagcaactacagtccatcttcctgaggaaattcttgttgaaatcaatgatgtacatgcaagataccctaacccatgcccatagaaaagctttgggatcatgttcgtttgatgattcactgattgcaatatccgtatggttaggatggagcagcaattttgtcagagccgagttagccatctacttttttttttctcgaatacagttggccatagacttatcctattcattcttcaagctttgtcaaagttgtcaagaagtgtccagaacatgaaattacctgtttcatctgccatgttacatctctaattttgttttctgtttgttcaccaactcaaatattgaaatggcaagctgtgttaattcatc

SEQ ID NO: 3790 - DNA, 953 bp, Sorghum bicolor
  Clone ID: SORBI-28MAY03-CLUS6576_1
gcacgaggggaaccttgaggcatgcactgtcttagttcaggttggcaaaaaggatgatttgatggtgaaagacaaaactggcttaactccagcacagcttgctgccgataagaatcatcggcaagttgcatttttcctcgacaatgctaggagggtacacgacagaggatgtggtgcaaacaccagatttgggaaattgtcaaaattagggcttgctcctcttctttggtgcaccattattggcatgcttattatttacatgcactctgttatatcaggacaatatgccacaactatgacagcaccatttgggatgttcgcatggtcaggagtttttcttgcaacagctggcttggtcatgttctataaatgtagcaggaaagatccaggttacatcaacataaatacaaggggctcacaaaatcaaagggacgatgaaccgttgctgaagatggagttagaaaatcctgcacttctttctggcaactggtcacaactttgtataacctgcaaaatagtcagacctgttcgttcaaaacattgttctacatgtgatcgttgtgtggagcagtttgaccaccactgcccttgggtatctaattgcataggaaagaagaacaaatgggaattcttcatgttcctcactctagaagtttttgcaatgatcattaccggctctgctgccattataagaattgtaagggatccagattctccatcatcctttggtgcttggattcattattctgcgttccagcatcctggggtggtttcatttctcgcactggattgtttccttttctttggtgttgcagtgcttacagttgttcaagcatcacagattgcaaggaacattacaacacatgagatggcaaattccatgagatatgcatatctcagaagcccaggtggcagattcaggaacccatatgatcatgggattcgcaaaaact

SEQ ID NO: 3791 - DNA, 591 bp, Sorghum bicolor
  Clone ID: SORBI-28MAY03-CLUS65807_1
aagatataaaaatatttgtgcagacacataagtagccattttgaataatgactattttttgctagtctaaacatgtggcttttaatttattaattttcattttcttgcaaaccaaactttgctctatcctaggcaggttgctcgtgaagatacccattctgtaataactggatggggacggcagcctgttgctttatggactttgagctaaaagctcaccagagatttaaagaagtcctcaatgggcttgctgatgctagatggtctgtgattgaaagtgatggagtggatgatgcaaagcatcaacacatggagttcatctcgcaatatctgacaagtaacatttgggtggggagcctcatcctcttgatggaatcagctcccaagaaaaccgatggaaattggaatgaaagcattgaaaagacattggctaagaaagcaattagatttggttaaccattcaaggctggaaaacttgtgtatactttatagtagattattgtcccatttggttggccgacacacatgcttctttttttctgcgagaaagtacaaatatttcttgtacatatgttgtcttcatataggttt

SEQ ID NO: 3792 - DNA, 665 bp, Sorghum bicolor
  Clone ID: SORBI-28MAY03-CLUS6535_1
acccgacccgccgtcttccccctttaccgtccttccccggcgaccgaagccgccaccccggcctcgccatggactctctccttgccagctacgcctcttccgacgacgacgccgacgaggcaccgcctgctcctcctcctgcccgtacccccgcccccgccgtctcctccggtggcggcgcaggcggactattctcctcgctcccgcagcccaagtccgcgccggccccgctcttctcctccctcccggcgcccaaatccacccccgcgccgctcttctcctctctgtcggcgcccaaatccgcccctgcacccgcccccgcccctaccttctcttccatcccggcgcccaagtcttccggaggaaaccctaagcgcgtcgtccagtaccgcccgcagccgatccggcagcccacaggcgacagctccgacgacgacgaggacgaagccaagaagcgccgcgccagcaacaacgaggcgcgcctgccgcctgtgtctgctggctcggggcccgtgtcctcgttcctcccgccgccgaagcactcgctcgggctcggcgccggttctggtgccggagccaggaggtcggcaatcgatacggctgcgccggagaagccaaatctcggcgccgccgtaccttcaagctcggttgccaacacaggagcc

SEQ ID NO: 3793 - DNA, 667 bp, Sorghum bicolor
  Clone ID: SORBI-28MAY03-CLUS6533_1
gcgccggcatcgaactcagccagccatctctggcccgaagacatggcctgcctcgcctgcctcgacgcccaggcacccagatcagttgtctatgtggcattcgggagctttacagtcttcgacactgcaaggctccaggagctcgccgacgggctggcactcaccggacgcccgttcctgtgggtggtccggccgaactttgccaacggcgtcgatgaaggctggctggaccagttcagacgccgcgttggagacaaggggctagtcgtcggctgggcgccccagcagcgcgtgctctcgcacccttcggtggcatgcttcatctcgcactgtggatggaactccaccatggaaggggtgcgtcacggcgtcccgttcctgtgttggccatactttgccgaccagttcatgaaccagaactacatctgcgacgcgtggggcacgggcttgaggattgacgccgacgagcggggcatcttcaccaaggaggagatcagggacaaggtcgaccagctgctcggcgatgatgggatcagaacgagggcactgtctttgaagagagcagcgtgcgagagtatcacagatggagggtcctcgcatcaggatctgctcaagcttgtaaacctgctgagagaacaatatctttagattgtcagaattgcttagt

SEQ ID NO: 3794 - DNA, 707 bp, Sorghum bicolor
  Clone ID: SORBI-28MAY03-CLUS65353_1
gtgccaaatgatgtgtactgccgggatgcggtggcgcttggactatggagtggtaagtggaggatgattggagacatgtgggaggaaggggagaggaggcgtcttggccccattgcatctgtatctgcagatgatggaagaattaccgaggtgttcatgctagacgacaataatgtcttcaggtatgacttcacttcaaacaggtggctgaaagaggcaaccacgagaagaaagatcccgaacactgaaccttgcggtttcataccaatgaacggggaactgtacgtgctcagatctgcaaaagttcgtgttgaagcctctggtccgtggaggcagctgaagaagaagctggctatggagtttcaggtgtacaaccctgtgacgaagaaatggagagtgctcaccacgtatccacctgttggtgcacccattgatttcaggactgcagctctgtgtacggttgagttgtagatcgattggtggtcactattgactgtaaagattcaggtgacaagcacgaaaatcgattgcaaatatagctgaaaatgcctaatgcttgaagtgctcccagcagatagttgaaagtttatgtgctagcgtgtatatacacagtagaggtaacatatgtcctacatcgcaagaattggtgtctttggtgctgaatgtgattgctgctaacaagatacaaattgcaccactgtttccct

SEQ ID NO: 3795 - DNA, 593 bp, Sorghum bicolor
  Clone ID: SORBI-28MAY03-CLUS65355_1
tcttattaaatcttctggagctgttggattaattgcagctaattccattaatggcctgcggcgtcggacgtatgctgcatcgggtctgtcgggggccttcgtgggcccttgcccgtgctggcgctctgggcctgctggctggcgcacttctcccattgctggtcccaccgctgttttctccgagagggttttcttgaacagaaagaggttcaagcaaactgttcccattcacatagcggttggcatcatgtgcctgagcatcgcatcattcgagatttaccgtggtgaaaagcagttcctgaggcagataatcagaactttgaagcatcgtgacaaagctcagtgatttgaagagacagtgcatttcatagcatattctggcttgaacacctgatgaaagagaactggtagtatagtgggtgactaatagtgtgtatacaggagatcggtagttaaaaaaaaagaggaggatttataaaccagtcagatagataaattggttgcttatgggaatcgctgatttttcttattgactgaaactttatattacagatcaattgagttagtgattagtgattctatattttataatt

SEQ ID NO: 3796 - DNA, 165 bp, Sorghum bicolor
  Clone ID: SORBI-28MAY03-CLUS65994_1
ccatgggggctttatttaaccctttgcattaggtaactacccaaggggtttgatgtttcggattagattttccctctgggcagggagggggtaaaggatttcccccaaaacatgtttgtttttgggcagcttgttgcaaagaaccctgttggcctggtttttgtt

SEQ ID NO: 3797 - DNA, 875 bp, Sorghum bicolor
  Clone ID: SORBI-28MAY03-CLUS66037_1
gaagcaaaaagattcctcaagtcgcagcgggaggcccttctgaaatgcctggaaatagctgctcggcgctacagaatcccatggacgcaaaccgccattgacatctttgcgaagcacgcgtacgacaacgtgacccggttcacacggcagcagcgggacgcgattgtgaagctgtggaactcgatcaaggagcagcagatccggcggaagcagggcaagtcggtgagcgggaagctcgatgtgaacgccttcgagtacctccaggagaagtactcccatgagaagatcagcatccggcatagcgtcggcggtggcggcgagcgccgggcaactgcgtggctcggctaggacggccgggtcggcagagccgttgcttcttctccctggcgtaacatgatgatctggttgagttcaacaaggacggcgttggcctgatgcccccccatggatttcggtgcagagtgtgtgatcaatgcggatgatgcctcctttgcttcagcgacacggcgtgggagttgtttgtgcttggtttttcggagaggagagttgacatctccatccccgtgatctcatctgtcagctccgtagcatggtgtaatgtaaccttgtgaatgactgactgaatgtgaaggctcttggtgtacgtaacgtagctgcactgcacacccaggagacgggccaacaaccgtgtgcacgtgtgggcaagtgccctggcctcgtgcgtgcaccgggaagtttgattcgctgcgtcgtctcctctcctcgtaactgcaataagtttgattgttgacaggcatgcgcctgtattataaacgtgtgatatcatgctagcaaggtgttagcacggtatcggtatggttggtttggtagcatgt

SEQ ID NO: 3798 - DNA, 668 bp, Sorghum bicolor
  Clone ID: SORBI-28MAY03-CLUS66153_1
ccgggcgacggcgaggcttctggagctcgacgacgacgacggcatcatcggccagttcggcgacaggggctccataaacgccaggttcaactactacccagcctgcccgaggcccgacctcgtcctcggcgtcagtcctcacaacgacgcctgcgtcctgacgctgctcctcgccgacgagcacgtcggcgggctgcagttccacagggacgggacctggtactgcgtcccgcccgttcatggccggcccttgctggtaaacgtcggtggctccttggagataatgtcgaatggggccttcaagagcccggtgcacagggtggtgaccaactctcagaaggagagggtgtccctggctatgttctacgcgacggatcttgagaaacaggtccagccgatcgctgaacttgtagatgagaagcacccagcacggtacaagaagattaagtacagggatcttatggctgctcactatgaatacttctctagaagggggagagttattgagtcgctgaaggtctaggtgtcatcaggtcatgttcctcgtaaaaaaattataaaagttgtaaggtgacgtatcttttagtttcacgtacgggcaattgtggccgtgtaggggaacgtttatttattgcgtggtcgtttgaacaaattgtggcccagagatt

SEQ ID NO: 3799 - DNA, 644 bp, Sorghum bicolor
  Clone ID: SORBI-28MAY03-CLUS6622_1
gcagcagctatacgacgagatatatcgagtagctagcttagagctcatcgtcgctgctcgctcgctctcatccggccggccggcggatccaccatatcatatatatatatatatatacacctgcagcaggcagaggccgatcgatcgacttgctgcttgcttggcataaatccatgcattccatgtcgtcgtcgtcgatggcgccctgcaccatgatcatggcgagcgttgcagctgtgctcgtcgtcctttcgtcggctgccgccgcagggctggacatggatttctacagcagcacgtgcccgcgcgtggaggccatcgtcaaggaggagatgacggagatcctcaaggtgtcgccgacgctcgccggcccgctgctccgcctccatttccacgactgcttcgtcaggggctgcgacggctccgtgctactggactcgacccctagcagcacgtcggagaaggacgcgaccccgaacctcaccctgcggggcttcggctccgtgcagcgcgtcaaggacaagctagagcaggcgtgcccgggcaccgtctcgtgcgccgatgtcctggcgctcatggcgcgcgacgccgtcgtgcttgccaacggcccgtcctggcccgtcgcgctgggccgccgcgacggc

SEQ ID NO: 3800 - DNA, 593 bp, Sorghum bicolor
  unsure (1)..(593): unsure at all n locations
  Clone ID: SORBI-28MAY03-CLUS6634_1
cagaaccatgatggttctaccgaatggaaagagacttggtgggagaaaagtgactggactggatataaggaattaggtgcggagaaatctgggaagaatgctgaaggtgattcttggtgggagaaatggaaagaagttctgtaccaagatgaatggagcaatcttgcaagaatagagagaagtgctgaaaaacaagcaaaatcaggtgtagaaaatgctgggtggtatgagaaatggtgggagaaatatgatgccaaaggctggacagagaaaggtgctcacaaatatggaaggttgaatgagcagtcctggtgggagagatggggtgaacattatgatggccgtggatttgttttgaaatggacagataagtgggcagagacagacttaggcaccaaatggggggacaagtgggaggagaaattctttgcaggaattggttctcgacaaggggagacatggcatgtatctcctgcggtgaacgctggtcaagaacttngtgagaagaacactttggtaacggaaaagtcataagtatggtaagagacgactggcaagagtgagatttggtgtcgacgagggacatactatga

SEQ ID NO: 3801 - DNA, 655 bp, Sorghum bicolor
  unsure (1)..(655): unsure at all n locations
  Clone ID: SORBI-28MAY03-CLUS66381_1
aaaaaaaaaaaaaaaaaaaagacctcggtgcaaacctgccgcgaaaatagcagccgcccgttcgctctctccccactcctcccgcgatgagcgacccgcggggccgcgccgccggtcccgaccgcgacggggacgacccgcacgacctcccgctcgccgaggacgccaacggcgaggaagcgtggcagacgcccgagaaagaggcggttgccatgtcggaaggggcggctgcgcagggtggggacacgaccccggacgccgaaccggagagcgatgacggagagggaggagcgggctccccggatcaggcggagcccaatgcgggcggggagcgcgcaccgcctgtggccgcggccgaggagctggaggggatcgttagcggcgcaaaggtggagacgaacggcgaggacgccaccagccacgacgccnacggggaggacgacgaagacgatgatggagacgaggaggacgacgacnatnacgacgactccaccccggatgcgtccccgagggctgaggtgaaggtggagggcgagagctccaccgggatggcccagagtggcgccggccaccacgtggaggtggaaccggaccccttcctcgacggcgatgactctgggacggaggaggagcaagccgcgttcatggcggagct

SEQ ID NO: 3802 - DNA, 656 bp, Sorghum bicolor
  Clone ID: SORBI-28MAY03-CLUS65582_1
ctgtcccagatggagcaccatctgtggcagatccagatgcctggacagaggcacaggtcctggctctagtccaagctttgaaggcttttcccatggatgcgacccaaagatgggagcgtgtggctgctgctgtcccaggtaaaactgtagtccagtgcaagaaaaaggttgcagcaatgagagagaatttccggagcaagaaatctggggagtagactgaggcattgcctcattggaagtccattttgcaaggaagagaatctcggatggcaatatctatagattggatttagcatcttggctggcaaggtattgcttggcgaatctctcatcccttcagtggtgaggataattttgttatggagctgtgataactcatttattgtgccaggccaccagggttgtttgactttggtcagccgtaggaggatgccattgaagctcatcttctgttgatggactgatgattggcattttgtagcagtggttcctgttggactttgtttggtctggctcctggggttgtctacgcgttgctggaattggtgccctggttcggtaaaatgtagagaaccatatatgtttttattcattattaatgtattcattattaataactacgagataggaatatatgctacatcacgagacctatt

SEQ ID NO: 3803 - DNA, 530 bp, Sorghum bicolor
  Clone ID: SORBI-28MAY03-CLUS65596_1
aatttttgaataaggcaagtggtcaaactttaggtcaaaaaagtcaaacaaattatagtttggaacgaatttagtacttaggagttctcaaaaaattgaaacgatgcatattcatagtgaatctttagacgtacttcgacacaaaaggtgagatgtaaacttattttgtagaagttcatacaaaaattaaatgtttcaggtgcacctgcactagaagaattttgtcttgtagtgcatatgcacctgaaatcgttcatttttgtatgaatttttctagattgagttttcagctcaatttttgtgttgaagtacatctatagattcactatggatgtttatcgtttcaaattgtttgaaaacttctaagttcatttttctaggggatttctacgtttccactgaaaatggggtttgacggtacatgtgatgcaaatcactcatgataaatttcagttgtatgagaaactttgtattgcaaaatgttatcatcatgggaacaaatcaaatacaagtaatagacggagaaattt

SEQ ID NO: 3804 - DNA, 512 bp, Sorghum bicolor
  Clone ID: SORBI-28MAY03-CLUS65608_1
tttgatgacaggaggaagtattgaagtattcacattttgttttgtatgtgtctgatgctatagttagccttcttttttttctcttgaaatgacatgcttcggttaggattcttttgatgctgatgtagaaaaggcatttctactgtttcaattaaactttatctgttagtcctgacagtttaccttctcccaggatgttgttagcggagagacagtgaggaagttgccaaagtgctctcacaccttccatcagccttgtgtggacagatggttcattgaccatggttcatgcccagtatgtaggcaggatgtgtaggttagatcatgttggattctgggttatcatcatgcggtcatgcctttgcaaagttgctaccatagaaagaaagatacatagcatgtaaattaaagtcctgcatttgtccctattgtgagcaaaggtttactcataagtgattgagtttcatgtattctcattttatttgagcatatataataatgattatgagcct

SEQ ID NO: 3805 - DNA, 682 bp, Sorghum bicolor
  Clone ID: SORBI-28MAY03-CLUS65611_1
cagatacccaacttggttggtgaaacaagtcctgggtttgaaatgggaagcaacaccctagaaaagctcgggttgtacatgaaaaatgatgaagatgatgaggatgctgatttcacagatgaaccagtggttgatgttgaagagggagaaatagattaactgtgtttctggaccatttttgatacgttacaggagacctgttggcatgactgatctgatagcttttctttggtatacaaagtgacctgacgaaagatcgtgtcgcatcgaacctgaaggtctggtattcgtttttgtaactgcccaagttttggagccaagttggcacatgatgtagcgagcccaaacgtgttggaggttcgtcgtgctgcatgcgaggagtgcatggagtgtgcctatcgtttggattgagaatctctggactttccatatccataaaatggaatggcgagtttattgcatatatgatgaggccataaaaggggatgagaaggagagagggttgaggggatggtgatggttcttggctcttgagcaggtgcgagccgtttttgaggggtagttttagagccatttccgtgttgtgaatgtaatatcggaaactgtacaaaagttagcctgatagatggaaaacattgcctttaatttatgcagtgcctgttcttcaccgatcagttcactt

SEQ ID NO: 3806 - DNA, 650 bp, Sorghum bicolor
  Clone ID: SORBI-28MAY03-CLUS66453_1
gctggagaaactgctgaaagtgaaggctgtgaggaaggttgttaagatgccaaggaatggagatgtgccatacacgcatgctaatgtaagccttgcgcagagggagctcggttaccggccatccacagatctgcaaacagggctcaagaagtttgtgcggtggtatcttgagtactaccatcctgagctggctgagaagcagaagctgcgtaccagtagcaatggcaagggttcacgtggtcggaatggcagctcaagtagtgcaagatgactgtctattcagtgtcttcgtggcctctcctgacggtgtgtatcagaattctacctccattccttaattcatcagattgagaggctcattttgctcagcaaattgtgaaagtggaacagaagttaagaaacactcattaggtagccaccataattcaaaagcctgatgcttctctttgctacctcgtagctaagcatttaattcctagttccattagttggttcttaggatgacactgttccgaagatttttcatgtcatgggttttgggggatggcactctgttgcgtagactaccatagattcttttagtgactttttgtaccacggaagagaactaagtatatcatgacttgcttttgttcaattgaagttgaagt

SEQ ID NO: 3807 - DNA, 645 bp, Sorghum bicolor
  Clone ID: SORBI-28MAY03-CLUS66556_1
atccccactcgaaaaaacggcagcagcagaagcgcccccgtccccagccgcccccgcccaccccctcgcccccaatccccccgcgccgagagcccccgcccgcccagccgccgccccgcgccccgtcgccccctcgccgcccccgctccccgccgcgcccgcctccgcggccgcctccgcccgcgccccccccctcgcccccctcctcctcccccccccccccccccccccgcccccccccccccaccccccccccccctcccccctcccctccccccccgcctccgcctccggcggcgcccccgcccgcctcctcgccgtccgcccccccgcccccgccgcgcccgccccgcgccccgcccccctcgccccgcgccccgccgcctcccctccccccccccccccccccccgcggccccccccgccgggcggcgggcgcggccgccgccgccgcgccgccggcgcccccgcggcccccccgcccgccccccccgcgccccgcgccccctccgcggcctccccgccgccgcgcttcgccgccgaggggacggcgtgctcggcctcgacaacttcaacgactactacgacacgggcctcaagcgcggccgcgccgcgctcctcgcccgctccggggtctacgtcgtc

SEQ ID NO: 3808 - DNA, 641 bp, Sorghum bicolor
  Clone ID: SORBI-28MAY03-CLUS66557_1
cagttccccttccctctctctctctctcctctcggcgtactcggcgctggcggcggagcatggttaagcgcaggctaggacgccactatcgtgcgtgttcattggatctggtgagtcgaggttcccctctcttctcacggcttctccatgttgttcctctaggaccgtgcgcttccatggcgattcggcggcatggacgcgagaggacgacagcgagcacgctccctgccggtcgccggtctccctcctccccgccggccgctcgcctccccgacaggcagctactcgtccgctctcctccccgcgcaggtggctgggggcctgctcttcacagtggctcccctatccgctgggtggttggccgcctgacgccttctcccactggccgctcccttccggccgagcagctgcacgtgcaggtaagaacttggatgattggatctgccctcccttgcccagctgctgtattagctgaactgcatattaactgtctgtatattagctgaactgcatctatctatatttgtgtaggtcattgcctaaatctatctgagttgcagaatttgttacattgctaggtgttccttcgtgtacatgtattagtaatgggatgacagattctgataagtaaaggctgttag

SEQ ID NO: 3809 - DNA, 676 bp, Sorghum bicolor
  Clone ID: SORBI-28MAY03-CLUS66559_1
aaaaaaaaagaaaaaaaaaaaaaaaaaaaaaaagcctgcaagcaacaaccgagcagcatcgcccccatcccctcccccatcggatcgcggcctgccgtctgctcctgctcattcgacctgaaccaagcagccgcgttcgcccccttgctttttctcgtccctttcacggtttcaccccgcgttcgctcgcgctctctccctcccgtggcgacgactgggcggcgcccgcagccgccctagccaggtgcggctcctcgtcgggtccttcgccggcgacgggcacccaccaggatgaagacgaggatagtgtactcgagggatttcctgctgtcgtttggcgagttggagcattgcaagaagctgcccactggctttgatacagcgcttcttagtgggctgcaggagctgtctgcgggtgtgcttgagagaaacaagggctactacaatacatcccagggacggccagacgggtcggggggaggatatactattacttactcttctcgtggtgggaacactggagggaggtgggacactcgctcatctggatcaagtgatcgggatggggaggtacctgatcgagaatctcagacacaggggcgtggtggaaaccagtacagacgcaattggcagaacacggagcatgatggcctactgggaagtggtggtttcccta

SEQ ID NO: 3810 - DNA, 653 bp, Sorghum bicolor
  Clone ID: SORBI-28MAY03-CLUS66562_1
ctactgggcgggcccggaccgacctgtcccctccccttcccccccccccccccccaccgaactctcgctccgtccccgcccgctcccggccgccccccccccccgcccacccggccccccccccgcccgcccctcgcccggcgcgctcgctcggtcccaccctggccccccctcctgcatcccgcgggctcccgggctttcgggtggcgccgctcggtgccgcgccccggtcccctcgtgtggggaccggttttgcgccggcccgccggccctccgcgggtccgccaggttgcacctcgccttggggcggtttctcgcgtcctttttgcgggagtgttgctgctgggcggtcgcctggccaggccttcggtccgtccaccggtggtgccctcgggtgcccgagttcctccgggtgtcgttcctcgctggtcgcccccgtcccgtcacttgctggttgcacgtgcaggcacgccgctgtggcacgcggttcaggcggcagccaaggcagccgtcccctcctccgcggtggtggattttcgtgcgccccgcactgggcttgagggtcctccatgcggtcccgggcctcgcgtgctgcatctcgaggacggtgcggctgtcgtggggcacctcgccgagccccgtgcaggcagcca

SEQ ID NO: 3811 - DNA, 723 bp, Sorghum bicolor
  Clone ID: SORBI-28MAY03-CLUS65857_1
tgttggggataaagaaggtacaatttttggtggtttagttgaggccccattacagccatccagttcaaagaagtatcaggggaccaataattcctgtgttttcactaatttgcataatcgccctgtcatatatcgaccgacaggtgcaaataactattttacggtgtgctccactgactatatggctttggggggaggaggtcattttgcactttatcttgattctgaccttttgactggttcaagttcaaattcagagacttttaacaacgggtgtttatcgcattcttcagacttctcagtgaaagatgttgagctttggggcttcgtctacccttccaaatacgaggagatgctgacaatctgcaggactgagaaaccaggaatctgtcgatggtgagcttcccatagccagctgaacatccaaatagacatgtcacgtctgtacagtttttagtaggctttgagagttgcgagcatttttgtgcgcaggaccagtagtactagtttgctcagattgtaaatattgcacttttgttactgccactgtgccacatggcgaaacatgtacgttgctggttgttccagtgttgggcattttgaggtaaactgtaactgatggatcaggcttctaccagaactcatgaaacaggtgtcagcctgttgaaagccttggtcaggaagcaatcaaattaaatgtccaccgatgaacggtcccaactc

SEQ ID NO: 3812 - DNA, 494 bp, Sorghum bicolor
  Clone ID: SORBI-28MAY03-CLUS65864_1
aggagaatgctgcggctgcattgcttcagctctgtacaaacagcaacagattttgcagtatagttcttcaagagggtgcagtgccccctctagtcgccctttcacagtcaggaacaccgcgggcgagagagaaggcacaagcgcttctgagctacttccgcagccaaagacatgggaattcagcaaggagatagccttctgatttttcttttgttgtagtgtacattaagggacaccttttatgcccatcatcgcgattgagctcctgttgactgttgttgattggcactgacagatgcggtggctggaattatgcagtgtcctgtgctctgtttatagattgagattgttatgctcatctcatgtaagtgttgtgggcggtgagtgttgtctgttgagatggtatcttttcttttttttccgtttttgaggattttttgtatagcttatccattggtagcaacttacatatattttcaccgattttgcccggt

SEQ ID NO: 3813 - DNA, 345 bp, Sorghum bicolor
  Clone ID: LIB3476-022-P1-K1-C1
agaaaacaaatttatctcattgttgataaaagtaatttcttgaaactgttaatatgcaaagccatttaagttatttctagaagtttgatgaatttggctaactttgactttgcatgataatagtgttaaattattaactagcatatatgactcatccatggatccataatactaatttatagttaaatgtgagacttttgaaagctttgctgcaaagtttgcttacagaaaaatggcctctgtccattgtgtgtcactcagtttattgcaatattagcatgttggtacatgtgtttttatggtgccttttgtgccaacaaagcatacctgaacattacacaatca

SEQ ID NO: 3814 - DNA, 375 bp, Sorghum bicolor
  unsure (1)..(375): unsure at all n locations
  Clone ID: LIB3476-022-P1-K1-B1
gatcacacgagctccgcttactcgacgacccactgcactcgcctccgatcgatcgatccggcgatcacactagtcgagtcgactcgactcgagctgagcgcgcgccccctatccatcaatggcgggcaaagtggcgtacccgcttgtgttacgtcgccacgggcgcggtccgctcggtcggacttaaacgagcggactgttgcaaggtgtgacccaaagtgtgcttacagaaaaatggcctctgtccattgtgtgtcactcagtttattgcaatattagcatgtttgtacatgngnntttatggtgccttttgtgccaacatagcatacctgaacattacacaatcatctggttattcaagtgactatttagcta

SEQ ID NO: 3815 - DNA, 745 bp, Sorghum bicolor
  Clone ID: SORBI-28MAY03-CLUS65967_1
tgcagcgtcagacaataccctgtagcttgccaaactccgactgtgctaccgatacgcatggacacatccttcctctgtttcatcaatgccactttcatcaaagaaaggatcatagagtgggttcgggaagaagtggagaacccaaatggaaaagcgagagagaggatacaagcagttgtccttgatatgtcaagtgtggtaaacatcgacacttcaggactcactgctctggaagaaatacacaaggagttggtgtctcttggcatacagatggctatagccagtccaggatggaaggcagttcagaagatgaaagtgtcgcgggtggtcgacagagtaggagaagattggatcttcatgacagtaggtgaagcagtggaggcctgtctagctgctcataagggcacagctctcgaatgttgagcatgcgcttaattagcactccacctttagtactgctaaggataatcccataagcgatgcggctttgcatcctatgaaggtgttactgcaaatgcttacaaacagaaatgcatgtttgcacatgatggtgacgaagtacctatgagatatgactgaagtggtcgtggtgggaaacaatcctgctgtgggaagaacaatccttgagcttcacaagacatgttttggtgctatcttcatgatctgtacttgtacttagtttttcttttactgtttcttcctaaacaaagatgaaatcttgacctaataagaactaagtgagatt

SEQ ID NO: 3816 - DNA, 544 bp, Sorghum bicolor
  Clone ID: SORBI-28MAY03-CLUS66632_1
gcgccaccgcagagccggaaggtggccgccgggcccgggtaccacgatggagccgacgaatgaagcgacaagcgagcgagcctgcttgctatgcttggtgctggtggcaaactggcaatgattggggtcactagctggtttgttggttgagctggtgatggattaattaattaattaatggtattatggaattagtccaagaataaccctccggtggcatgtgatgtggtggtagagaagtacgtccctacatgtgtaggtccccgtccgggagaataattcgtgccgtgatcgattgatgattgctcgagagaggagcaaatcacgctccgtgtgatcgagcatgaagttattaagtagtatataatcactcattggagtacatcaggacaaggactgttccgttatattcaggttgtaagaacattgtacgggagtaattctgtgctatcttctttaagcattctatacaatcgtatccatgtatgcaaattatcctgtaacttgctgattgctgtttaggatatttcgtacagtccttttt

SEQ ID NO: 3817 - DNA, 678 bp, Sorghum bicolor
  Clone ID: SORBI-28MAY03-CLUS66638_1
gcgccgacccactggcggccgagcgcccgctgttcgagatcgtgtccgccgcgcaggccatcataccggagtccgaggacgtcatcaccatgcacctcaccaggggcggctacggcggcaacatctccaccaggcaggtccccgtcctcatcggcgacaacatcgagcgctgtctcaccgacgctttcgcgccgctcggcggcgttattggcgccgaatggaacgacctgttctgggacgtgcacccgggctcgtcggcgatcctggaccaggtcgacgccgtgctcaagctcaagcctgagaagctggcggcgagcaggcgtgtcctgagcgagtacgggaacatgtttggcgtcacggtgatcttcgtgctcgacgagctgcgccgccggatggagaagggggaagaggagggggcgccagagtggggggtcatggtggcgttcggacccgggctcaccgttgagacgatggtgctccaccgatcaggccccccagctgagaagaaactggcggaggcatgagaccaatttgtgttggaacttggatcaggattgcatgcatgttgcttggtcaacattccctttatgcctgtattaattaatgtgcaaaactttgcttgtttcgttggaattcttgataaatgcaaagtcggataactgataaacttcatttttc

SEQ ID NO: 3818 - DNA, 526 bp, Sorghum bicolor
  Clone ID: LIB3476-023-P1-K1-B10
atttttcttttatctgctatgagcttgttcgcctgagtttatttattgaatcttttagttattcaaattttcttttatctgctatgagtttagttattgaatctgttagacccgacactcctctgcactcgatgaagcacctcatataggtggagccgaagaaggaggcggcgggccgagcgccatcggtgaggtcgacgtgcgacacctgcgctaccatcaccaagcttgctggtgagacacaagttcctctctttctagagtgactgaatcggtgctcagaactggttgtagtgaaggagaattgcaagcggcagggccacagcgaggtgctactagccactacaatggaacggtgtcaacagaggaagatccagcggctctccatccatgttgacctgatgaggatgaccatggtagcactgtatcggatggctgggttccagatcgacagtaccatcgagggctactatgcaccgcacaaggacgcctgccggatgtactttgatcaggggagtactccagg

SEQ ID NO: 3819 - DNA, 444 bp, Sorghum bicolor
  Clone ID: LIB3480-006-P1-K1-H11
cttttcttttatcatcaatctaggagaatactatatggcttcaatttttcttttatctgctatgagcttgttcgcctgagtttatttattgaatcttttagttattcaaattttcttttatctgctatgagtttagttattgaatctgttagacccgacactcctctgcactcgatgaagcacctcatataggtggagccgaagaaggaggcggcgggccgagcgccatcggtgaggtcgacgtgcgacacctgcgctaccatcaccaagcttgctgggccacagcgaggtgctactagccactacaatggaacggtgtcaacagaggaagatccagcggctctccatccatgttgacctgatgaggatgaccatggtagcactgtatcggatggctgggttccagatcgacagtaccatcgagggctactatgcaccgcacaa

SEQ ID NO: 3820 - DNA, 574 bp, Sorghum bicolor
  Clone ID: SORBI-28MAY03-CLUS6664_1
gcgtctcctgatgccacccaaatcaaaaagcggcggctgtggcggctgtggagccagtagccgtcgaggacctcttcacctcgctccaccgccacatcgaggccaatgctttcgaacaggccgtcaagttctcaagacggcgccgggggatgaggatgtggtgcgatgcaaagcggtgtgatgcatcaacgccgacgggatcggtaagttcctcgtcaagatccgcgccaaagagcgccgtccgatcgacctcggctactacgtacaagggcattccttcctgatggtcaagaaattacaaggctgaggttctcacatattgcatggcaaggaatacgcgatccttcaagtgaggatcgagtgcatgtgttagaggttctcttcgtgttcatggcaacaaatgtctgatctgagatttgaggatcaagtgcatgtgttggttcgttatgtcgtgtgttgcatgatctatgtatgtgttcagattttggcagttggaatcgcagaatgtttctttatgtaaacctaagcatgatctgcagatcaagacaagtggaacggagcatgttccgggtgg

SEQ ID NO: 3821 - DNA, 728 bp, Sorghum bicolor
  Clone ID: SORBI-28MAY03-CLUS66640_1
gcacggggctcggacccaagggcttgctgccgtgcgcccccgccggcgtcagccacggcgagttctacgacgagtgcgcgccgccgcggtaccacgtcgtggtgagggactacgggcacctggacatgctggacgacgacggcgtgccctacgtcatcagcaactgcatgtgcaagaggaacacgaacaccaccaaggacctcgccaggagggccatcgggggcgccatggtggcgttcctcagggccaagctggaggacgacgacgaggatctcagggccgtgcttcagaacagccctgggctctcgccggcggtgctcgacccagttgaatatgacgatgacgaagccatggatgggccaggttgcgctggcaacaatggagtggcaggggcggccggcgagcccccctccccctctccacttcctgcgtgattggcactcccttgggcggtggccgtgtcgtgggtgcgctacatctgctcctgcgagtcctgcgcgctctgcaccgctttgaccccggggaagttctgcgcgtgggtgctgcccggctgttggatcctgtggagaggagttaatacccgaagtttaaagttgtctatccgttgtttgctattaaaggttatctctttaatattatgtacgttatatatttatgcattgttctttgatattaacccttattcgtagctatatgtgagatttgacttctaaaattcacatatggtc

SEQ ID NO: 3822 - DNA, 667 bp, Sorghum bicolor
  Clone ID: SORBI-28MAY03-CLUS66647_1
caggggtgctttaagagctgaaaagccagagttgcttactgtaattttaccacaaagtctaaagaagcaacctcctgaaagccaagaactgttgtctaaagtacaaaacttgatcgagaaaccgcagtatgatcatttgccactaattgaggctagcaggttatgcaatatggacatcatctctaaggtccaacaggtgatctgcttcgcgttccatgacagcaagctgctgatggaaacatgccaggaggccaagaaccttcggaagatcgtgacactcttctacttggattagctcctccggcatctcctacttttttgtccgtggcgtaggctgctaatgttgggggatataaaaaagcaagctgaacggtttagttagtttcgaaatatattggataggtggtgcgttgaccttccatttggtggaggagaaagtcattttgtttcgcccattgttttgattcttgtcacaaagaaaccaataatcttgtcgatatgcctagttcgtcagcgaagggaataagactaagttggagtttatttgtagttgatctcaggcttataattagtccgcgccttcagtttctcttttgtctttttcccgctttttatttgatgatgagatgttatcttgattgatgacttaatttctttttcaaatggg

SEQ ID NO: 3823 - DNA, 662 bp, Sorghum bicolor
  unsure (1)..(662): unsure at all n locations
  Clone ID: SORBI-28MAY03-CLUS68986_1
ccgccttcagcaatctccacctgtggtattggatatggggctcaggctggaggtgagatagctgactttattattgttctgaggaacacggatgctatcagaacattcagtgggaaggcacatctgtctgttggtgctggtgttagcgcttctgctggccatgttggacgtgcagctgaggctgacttccgtgctggtgatggtggttatgctgcatgttatacatccagttgtagcaaaggtgcctttgtgggctgtgcgttgaatggcagcatagtatcaactcgagatactgagaacgcacgattttacggaggtcctgtcaaggcatctgatatccttctaggatcaatggcgaggccgcctgcagcctctcctctgtacaaagctctgtcagaattgtttggcaagattggaagataatcctctttcttgcagactctgcctcaccttgtaaatacattcgaatttgtgcccttcacgaattggttggaagcaattgcttaactgtacagtaaggccattcttcaacacatcaaaggctccatgccttcattagtgtttagtggatactatcaacanaaaccactactgtacatacatgtacattggattgacaatccgcattaagatgtgaaaaaagagggtgttcattcttggtc

SEQ ID NO: 3824 - DNA, 534 bp, Sorghum bicolor
  Clone ID: SORBI-28MAY03-CLUS68989_1
tcgtatcatggagaactcgaaattcttgagaatgagattatttactgagaaaggaagaactaggaataaatatctaagatatggccttagattatttatgatgggctgtgtgtttttaatcgcttatcttacaaagagtttccacttgtttcttgggattaatcgggtcttgcgttatcactacactcgggtttggattgcctatttggctgtatatggctcagtttaaagagagaatcccctaagaagaagaagattatcaattatggcattctaggttttattatcttctttggctctctcgcctttattgtatcattcaaagggttggttgaggatgactaatgactaatgacgagtgatgaatagtttaattagtggaattgaattgctttgcttatttaataaaatgtcgtttcttttgtcaatttgttatttgtgtatgcattaaataggaattcatgtctgtttgtatgttatgtctgatttctcaattattttttatagagagtcttcatcgctaaatctataacc

SEQ ID NO: 3825 - DNA, 584 bp, Sorghum bicolor
  Clone ID: SORBI-28MAY03-CLUS69033_1
acagttcaggttatgaagggaactcaaacagaggttatcctggaaagagcttggaaggatctgctgtaaaggatcctgatcctctagacatgtctgaggaagctaaggcagagagatggtttaggagggcagctcagataaaggacatctgtgagctagcaaacattcccgacgaggacttccctgagataatcccgatgaggaagggggtgaacagattcgttgtgagcaagaggaagccaccattggagaggagattaacatccccgcaatacagaaggaacctgccaatcgtcagttctgaaatggacaaagatgccagctgaaagcagaagtatgattgcccgcataccacaatcttaactgcgatgcgatgccccatttttacaccaaggtattgctcaataacagtttgtgacgataagcgagcgatcagaaacagaaatcatgaaaaaaataatgccccaggaatggttttttgtatggtaaaattttgttcgctatgacctggggtttgctggattgtgtttgctgcatgtatactatacacatttgtgttgtactaaaaaaaacttattccatgc

SEQ ID NO: 3826 - DNA, 673 bp, Sorghum bicolor
  Clone ID: SORBI-28MAY03-CLUS68995_1
tgctgctgaatgtgacttctggtcctgcctccatagttcaggcggcagttccgaagattctttcagttgaacatccggagttccacaggaatgttgttgacctccttgagtctgcagcggacgctctgtacagaagagtgaaccaaattgaagccctgaagtgctactcaaagcctgagggttcaatgtttatcatggttgagatcaacacttcaactctacatggtgttgctgatgacatggacttcgcacgtgaactgatcaaagaagaatgtgtcctggttctgcctggttctatcattgggttgaagaactgggttaggatatttttcggagcacctgtcaatttaatactagaagcctgcgacaggattgagttgttctgccggagaaggatgctcaagcaaaacaactgaaaaattgacgttgttctgaaaccagcaattagggattttgttagcccagtaataacatatatatagcttgagttttttttttcccaagatatatgatgcacaatacgaggtttgtatatagaatctgagaacaggtgcttatctatagttgaatataggttatacaaataattcagaagtaacggtgtacacacttgtcacttctttacttgcaccatttgcttgacagatgcattaaggttagcttttcagtgatc

SEQ ID NO: 3827 - DNA, 715 bp, Sorghum bicolor
  Clone ID: SORBI-28MAY03-CLUS66737_1
gtctcggtctttccatccaacaggtgttgcctgcccaagcgcccagtctccttctccagtcaattcccagcctccgcctccgcccccgcccccgcccccgccctctcctacggcctccgcgtccgctcccgcccggaggctgcatcaaaccctacctctccggacctcccggccggccgcgagatgcgacgcctgtccggcccctaatcctcctcctcgctgctgcccctcgcccgcccgccggcatgggccgctacgggcccttccctgccgccgccggggatggcgggggctgcctgcccctgccgattgtagcggctgagggcgcgctggctgtcctggacgttgccattgcgaccgcggccttcgtgcagctagcaaggattcacaggcacaaccagctacaaggatggactcggcaaaagatattccatttaatgattggcctatcagacgttgtgttcctagtgtatttcgtgtctaccatcattgctacttgtcagagatggatttgctgggtgcatggatgtggatttgttctcatggctagtccacagatattgcttcttgcttctttcttgttgctactgtcattctgggttgacctgtgtcatcagacaaatgatgaagactaacaacatggaaggaatcagagtcaccatgaagctttactagacagaacaaaagtgaaacctggcatccgtcctgttaatat

SEQ ID NO: 3828 - DNA, 696 bp, Sorghum bicolor
  Clone ID: SORBI-28MAY03-CLUS66740_1
agcctccctctctcggtctcatcacatacagcgccgccgtccctgctagctcctcctccacatgcctctgcatccggccgccgcccctccctgctcctcccccacatgccgccacctccccctccggcgtcctctccgccggttgccgcctcttggcgctcctccccgtctcttcgacgaccgtcttctctgcccggcgtccagatctgctgctccaagcacaaccgcatcagggcaattgcagctccgagctcaaccttcttgtagtggccgagatgagcccgtcttctagccgccgaagtcttcgtcgggcgtgacgagcagccacaatagcggccaggtatgtctgtgccttctcttctcttccgttttgtgcaactgaggatgaaccctaatttaagctatttggttatccgtattcagaacagatttgatctaatcccaagtgtatgcatgtatgcggtaggatgtgggttgaattttgtaatatgactagtacttatttttttttaccagagctatacatgtcgaaaaatatgtaccatcctatttttagtatttgaccagtagccatcgaggttctctaggattctttttcacctgcaagttagttcagtagtcatgctcagtatgcatgttgtttgaataataatgatgctgcagttcaatctgcatcttgtctgcaatatttttgta

SEQ ID NO: 3829 - DNA, 623 bp, Sorghum bicolor
  Clone ID: SORBI-28MAY03-CLUS66742_1
agcaccactcgatcggtgacggctgctgtggtgctggtagcaacagcaagtaccaacaagtaccagcaaccatgggaagtagtgctgctccggccaacgtccgcgagatctgccgcgcacagcgtgccgacggccctgcagccgtgctcgccatcggcacggccaacccggcgaactgcgtgccccaggacgagttcccggacttctacttccgcgccaccaagagcgaccatctcactggcctcaaggaaaagttcaagagagtttgtaagcatgcatgggacctcaccaaccagcttattagattttattatttaccgagcagagctggaacatatctagattaacatatatgcacgtactacatacgtttcactgtcgatgcatgtatgcatgatgttgccaacgagcacgatgtgatgattgtgatttctgtgtctgcgtgtaccccggtccccggcccaggccagaagctgggcgtgcagaagcgctacctgcaccacaccgaggagctgctgagcgcgcacccggagttcctcgaccactcctcgccgtccctcgacgcgcggctggacatcgtcaagaccgccgtgccggagctcgccgcgcaggccagcaggaag

SEQ ID NO: 3830 - DNA, 524 bp, Sorghum bicolor
  Clone ID: SORBI-28MAY03-CLUS66744_1
atactcgcccatccacgcggcccgcgcgctctacttcaccgcacgccgtggcccccggagatggcttcggcgccgccggtggccatcagcactactgcggtgttcaagcgggggcggcaccccgtggacacgaagcacgtcgaccacagccaggtccccggcgtccccaagccgctcatggtggtcacccccaccgacgccggcgtctaccccgtcgccgtctgcttcctgcacggctgcagcatgtacaacagctgctaccagaccctcctgtcgcacgtcgcgtcccacgggttcatcgccgtcgcaccccagctcggcggcatcctgccgccgctcgacatggaagacctgaaggacatcgacgccaccaggaaggtcaccgcctggctcgccgacaacctggcgcacgtcctcaccaacatcctccacctccacgccgtcacgccggacctctccaggctagcgctggccggccacagccgcggcggcgacaccgccttcgccgtggcgctcggtctcgg

SEQ ID NO: 3831 - DNA, 623 bp, Sorghum bicolor
  Clone ID: SORBI-28MAY03-CLUS66752_1
agcccaactggtgccgtgccgtgccgtctcctctcctctcctctctcgtctcatccccagcccacctagcaatgccctcctcctcccctcccacatgacctgcgccgcgccgcgcagccacccttgcctggtcacgagaacgccgccacgcacatcagttgaagcgcttctctcccaccctcctattcgtggattggaatcgacgcctggaagtggatgacgatggcgggttcttgcgccgcgccgcccgttgccggtcttccctcgttgaggacgccgccgccaactcacctcagacttggtggcttcttgccctgttcctcggccgcgcggagtcgcggcggcgccgtgctgggatgcgctctgggggccaagaagcagacgccgggtgttctgaaccggttgctctgcggatacatgcgaagagatggccatgaaggtgatgtaagcagtcaaggaagggatgacactgttatgtttgggccagatgatgatggtgtaaagattcctactcaggtagagactcttgtaaagggcactgcaatggttgctgaaccagaatacaaggcgatcccagatctagattacctacaggagctgctggctattcagcagcaaggacc

SEQ ID NO: 3832 - DNA, 617 bp, Sorghum bicolor
  Clone ID: SORBI-28MAY03-CLUS6677_1
attgctgatggcatcgcctgcctgctcacactcacgcagaagcagaggctcccgaggcgcccgccatgctgcgcaacagatcgagaagcagggcggttggtgctggtgccggtgccaaccaaggaggaccaggcggcggcctcatggctgagctccccgcggccactgccgcccaatcgccgaggcatccttcgtccgcctcttctgctgctgccgctcctgtgttcccttccccgaggccgttcgtggcgatggcgctgccgccccaggccgggctgctgctggacgggtccttcgagggcccctcgtcagcggtgagccccacctccattctcgagaccaagcagttctgctgctccgcgctgcctccgttcctgtcggagaggagcctccggcgggcgcacacggacgcagctgtggctccggagccggccggcgtcggcctcgccgacgtgctccgggaccacggggacgccaaggtcgccgggggcaaggtggtgttcgggtccctgctcagaatccaggtcccatccggcagggccgtcgagctggtctcctccccgatcgagttcggcgccaagaacagggacgcgcagctcgcggtgctgtcgccggcc

SEQ ID NO: 3833 - DNA, 729 bp, Sorghum bicolor
  Clone ID: SORBI-28MAY03-CLUS66580_1
catatatgctttacaaggatacttgcaataggaaaagtaatcagcagaatctgggcacaattaaatcgtcaaacttgtgcactgagataattgaatttacaagccctaatgaaactgctgtctgcaacctagcatctagcgcgtggcctcgttttgtccgggaaaagggtgttcctttagagtcccatccatctaagcttgtgggtagcagtgattcaaaaaatagatattttgattttgagaagctagctgaggttacctcaactgttacttacaatcttaacaaaattatcgatattaactactatcctgttgagacagcaaagagatcaaatatgcggcaccggccaattggtataggtgttcaaggcctggcagatactttcatattactgggcatgccatttgattcaccagaggctcaacagttgaacaaggatatatttgaaactatctactatcattctctgaaagcttctgctgaacttgctgctaaagaaggtccctatgaaacatatgaagggagccctgtcagcaagggcattctccaacctgacatgtgggatgtagtgccatctaacagatggaactggccatctctaagggagaccatttctaaagttgggataagaaattctcttcttgttgctccaatgcccactgcttccactagtcagattcttggcaacaatgagtgctttgaaccctacacgtctaatatatacagcc

SEQ ID NO: 3834 - DNA, 638 bp, Sorghum bicolor
  Clone ID: SORBI-28MAY03-CLUS66582_1
gcccggcgcctccccgccgcccctgcgggcccggctgccctcggtcgcggggcccgcccccgccggcttcggccgcggcgcccgctcgcgccgtcctcgccggctactcccgctggctccggccgcgccgggaagccccggtggccccggctgctgctgctgtctcgagctggcccgtcttccggcgtcggtcgtccttcgtcccgctcctgttcgcgtgggccgggggaacgcctgggctcggcagccggtgacctccctgccctgcggcggcccccacttgccaggggggccgcgtgcccctttgcctcgcctgccctgcgcgattcccgaactccgcggggtttcggccggcgacgagcgctcgctctcctgcggcgccccccggcggcccggccgtccccggcgcccttcacctgagcacctcgccggtctgccgcccgcgcgactcgccagccgcgccccgagccccttcgccacgccctcgtcgcctctcgcgttctgcagagcagcttccagccactctcccccaagatctaatgaagctggagatgttttcctctcaccaaggtcacacttttggcacttgccgtttaggcacgcaagccatacacgatatccaaacagagggagaaatg

SEQ ID NO: 3835 - DNA, 570 bp, Sorghum bicolor
  Clone ID: SORBI-28MAY03-CLUS66583_1
cagagcaaacggtcgcacccgcagaggtgagagaaggagaaggccatgtcggcggcgcagcagaagcagaaggcggcggcctcggcctcggcggcgggagcggagcaggagggggagggggagcacgggccattccccatcgagcagctccaggcttctggaatagctgcattggatgtgaagaagctgaaagattctggtctccacaccgtggaggctgtggcttacacgccaaggaaagatcttgtgcagatcaaagggataagtgaagctaaagttgacaagataattgaagcagcatccaagatagttccactgggatttacaagtgccagccaacttcatgcgcagcggctggagattattcaagttacaactggatcaagagagcttgataagatcttggagggtgggatagaaacaggatctatcactgagatatatggtgagttccgctctggaaagactcaactgtgtcacaccctttgtgttacatgtcagcttccattggaccaaggcggtggtgaaggaaaggctatgtacattgatgcagagggtacgttcagacca

SEQ ID NO: 3836 - DNA, 652 bp, Sorghum bicolor
  Clone ID: SORBI-28MAY03-CLUS66597_1
aagcgaacggtggcggccgcttctctaatccctcacttccttccccgtcgtggttgaagcctggttccggtcacaaaggacttgatctggtgtccgacggaggcggcggcggcggctcctctgcagtttgattgaggggccatggaaaacccggcgccgccgaccgatcctgccgccgccacgggcgccacgccaacgccgtcgtcgtcgccgtcgcggcggctgccggacttccagcagtcggcgcggctcaagtacgtgaagctggggtaccactacctcatcagccacggcatgtacctgctgctgaccccgctgatggtgctcgtcgccgtgcacctctccacgctgtccccgcgcgacgtggccgacctgtgggcacacctccgcctcaacctcatctctgtggtggcctgctccacgctgctcgtcttcctcggcacggtctacttcctgacgcggccgcggcccgtgtacctggtggacttcgcctgctacaagccgggtcccgagcggcggtgcacgcgcgacaccttcatgcgctgctccaggctcaccggctgcttcacggacggcagcctcgagttccagcgcaagatcctggagcggtcggggctcggcgaggagacgtaccttccccccgccgtcacgc

SEQ ID NO: 3837 - DNA, 829 bp, Sorghum bicolor
  Clone ID: SORBI-28MAY03-CLUS66633_1
tgagaagtggaaggttgccagtttagctgctgtctcactgatttgtttctcgtcttctgctatacttgcacttgtgaccaatgttccagtgcttttgtattggtactcgacagatgtggacatcatcaacaatgctgtaattttgtttatatattacttcataggctcgtcagtgccatcaggatttgttctctggatcatgagagagatgcctcatcggcaggtagttgaaaggcccacagaatcgagagtggttactttgttcagggaaagaccatcaactacacaggatccacagtggaggacagctgtcacatcctcaaacaaggccctcaagtcaagcccaatttaacctgaagacaaactatcggcagtgatacttttattctgcttaatgtgctgggacttaccagcacacgtcaaggtcgcactggcgtctgctggcattgtgataactgttgggtacaagatgaatcggtaattgctacttgaaagcaacattggataagtgacggaattagttgtggatgtaccatacttctaagctctcggccacgttatgagctgatgcattagaactgaggttggggtaatgtttgaagaattaacaaatgtaaatagctttggcagttagtgtccccttttggatttaccatactcttcccgttggttacatgtaccttgttttatttattagtgcttcatctaatttaccatagaagggccctgtgttcaacaggtcttaattacctgcagacactatgaatcactgagcagttgtaacatactctgactagctgtaaaatggccaaatcctgctgctttggtt

SEQ ID NO: 3838 - DNA, 657 bp, Sorghum bicolor
  Clone ID: SORBI-28MAY03-CLUS66901_1
gaccgctcgccttattataacccatcgcctggcgccactccacacggcactcgctccagtcttcggcgccggtccgcgagcagatcaagagacgatggccacggcgacttacctctcctccttcccggcagcgccgtcgtcgcgcacccgcctgcggcggcagacgaccagggcgaccgcgtcggcgaccgaccgtccgcgcgaggtggtgtccccgaagcgccggctcccgctgcggaaggtgccgggcgactacggcctgccggtgctgggcgcgatccgcgaccggttcgagtacttctacggtcccggcggccgggacgggttcttcacctcccgcgtgcgcgcgcacggctccaccgtggtgcggctcaacatgccgccgggccccttcgtggcgcgcgacccgcgcgtggtggcgctcctcgacgccgcctccttcccggtgctcttcgacacctcgctcgtcgacgagacggacctcttcacgggcaccttcatgccttccaccgacctcaccggcggctaccgcgtgctctcgtacctcgaccccagcgagcccaaccacgggccgctcaagacgctcctcttctacctcctgtcgcaccggcggcagcacgtgatccccaagttccgcgaggtgtacggcgacctctt

SEQ ID NO: 3839 - DNA, 754 bp, Sorghum bicolor
  Clone ID: SORBI-28MAY03-CLUS66903_1
actgtcaattaataggtgctttgctcctcacaaagaccgaaggcatcgatcgatctcaaagctccagctccaggttggtgttgcattgaccttcagctgtcgtcatcccgcctcctccctcccttctcctcctcactcatgtcttcacccaacttccatcattagcctttctgacctcgtggctttcgtcattctacacctcacctcaccttaacctagtttccctcattttccttacgtgtcgcgctttttcgacctattgtcaatgcgttgtgatcctgttatatcgatctctggatcataaccctttgtcaacagagaaacctgcgatttgctttaatcacgcctttgcctcatcatttaacttttcatttgttgcaatttcggctcaacccgcccaccatgtcctccaaaatgccatgtacaattacctacaagaagcctgggacttcacctcctgtctttcttgcaggctcctttactgacccacaatggcaacttcgagagatggaatatactactgaccaaaacggagaccatgcttttcagtccgaggttatgctggaacctgatcgggattaccagttcaagctccgcataggtcatgacaactgggctctagccgagaactatcctaccgcaaccgatgattccggaaatcagaacaatgttatacgtgcacctgaaaagccagctgaagagcagatcgcaccagccggcgtcgatacgccagcgatcagtctgaaccctgcca

SEQ ID NO: 3840 - DNA, 635 bp, Sorghum bicolor
  Clone ID: SORBI-28MAY03-CLUS66925_1
gcacgaggctcatggcggcctccgccgccggccggccgctcccctcccacccccctccccccccccccccgccgccgccgcccccccgcccgcctccgcccctccgcccccccgccctcctgccccgcggccttccccctgcgtcccccgcggcgcctcccctccgcccgcgcccccgcccccccgctcctgcggggccggcccctgccgccggcccccgcccccacctccccccccgcgccccgcccccccccgccgcccccctccgcccgcggcctccgcgcgccccgccctccccccccgccccccccccccccgcggccccgcgcggagagggaccggctcctccgcgggctcgcggcggcgcgcggcgccacgtgccccgccgagccgctcgcgccgcccccgcacccggtcagcctcgtcgtctgccggcccagcggtgtcggcgaggacgccctcgtctaggcgctgctggaggggggggacgggggcctccccgttctcccggcaacgagcagggccatgaggccaggtgaagttgacgggaaagactattactttgtcagtaaggaggaattcctgacgatgattgagagggatgagttgcttgagtatgcgcttgtttatgggga

SEQ ID NO: 3841 - DNA, 682 bp, Sorghum bicolor
  Clone ID: SORBI-28MAY03-CLUS66935_1
tccgctcccttcctttcccattcgtctcgtctcgctctcgcctgccgcctccccttcgcgtcgcctcgcctcgcctcgctccggccgcagcagccgcctccgccctgccctcccctccctccggaaaattccccaatccatccccaaaccctaaataaatcctcgatcggcgcgcgcgggaatccagccaccgtcggatgggaccgcggccggcggctccgtagtggattggaggcgctcggttcgctgcctgtttcatgctgctgctacggcggcggcgcccgttctagaggattcaaggaaaccgaaaaaggaaggaaggaagaaggagattggaacaaaaggcaggcgctacgtcgatggctccatctcaagcggcggcggctggccccacctttgaggacctggagcgcgacctgcaggcagttctcatggaccaaaaccacacggcccctgcagacgagctcagcatgttccgcagcggcagtgctccccccaccgtcgagggctcacgcacggccattggcgcgctcttctctggtccgccgcttcctgccaacaaccttggtggcagtggcggcggcgggactggtgctggcattgacatgctcactgaggaggagatacggtcgcacccagcgtatctgtcgtactactattctaacgagcacctcaacccaag

SEQ ID NO: 3842 - DNA, 599 bp, Sorghum bicolor
  Clone ID: SORBI-28MAY03-CLUS66940_1
agggccccagcgccagcggcggcggccggaagatcgacgggttcctgtacaaatacaggaagggagaggaagtaaggatcgtgtgcgtctgccacggcagcttcctcacgcccgccgagttcgtcaagcacgccggtggcggcgaggtgaccaacccgctgcgccacatcgtcgtcaacccgcagcagtcggtgttcttgtagcgccagggtcgcggagctgaagctagaggctgaaagtttcagaggagcagatgaggcagacgaagacgcttaaaccttcttggacggaaacggattgatgcttaaacctctttggacagaaacgggttgaagcttaacttattttggcaggagcatgttgaagcttaaaaccgtttgaagagcagacagtgttgagatagcagatgagcagacgaagaagtttaaaccctttttttttttgtttttttttcgtttattggtactcatatgattagtactagtagttaattatatgctagctattccctgcgttcttcccgatcgagtgaaggacgcagggctggagagcaggatgctgctgtaagttaaggagcgagcaaatttccgaaatggatg

SEQ ID NO: 3843 - DNA, 660 bp, Sorghum bicolor
  Clone ID: SORBI-28MAY03-CLUS66964_1
acgctgaatcatgcgaaaacgtgtgacatgggacggaaatgctatgttttcaggactgtagggtgtgaaattacctttaaccctataggagaggtcttaggagcaagaattgaagaccagacatttgctctgcaagaactgcaaccacatcaactgttccatgtgaagcagttggccgctcaggcataccagatgtggggtcaactagaggaagtagctaatgaaatgccacttgctgcaaataagagctttgttcccacaatgaattctggtcgggagccgagtgagagtcaagggagcatgatcagttcaggatctcagaacgctaagtatctcgactgcacgggaaccgctacctccagtgccgcagcaatgtcgacgaacagcagcagcacctcagattctacagcagctgttccagctaatgatgccatgttctggagcccgagcatagcaccggaatgtgacttcagctggcaggactcggcaggttgttgggatcaagtggattaacctttgatcgatgctgtttgtttcctgttttcagtaatgaccagtttgatccgtagtagttattgtactatttcctcaaaagttatgcttttgaacatgcggcttgcatatggtttttcagttcaataagactaagaatgccagtac

SEQ ID NO: 3844 - DNA, 765 bp, Sorghum bicolor
  Clone ID: SORBI-28MAY03-CLUS6665_1
cttgatcaatgtgccgttctggtactacgcgttcagcgccctcttctacccgttcctgacgcagaggaccaagagcaagttcgtcgttgctcgcccgtccaaggtcaccgagaccctcctcaagtacattccgattgaggccatcccggtgaagtacggcggcctgaagcgcgacggcgacaccgagttctccgcggacgacggcgagagtgtcacggaggtcaccgtcaagggaagctccacccagaccatcgagatcgaagccattgagggtgatgccacgctgacatgggacctgacggtgctggggtgggaggtgaactacaaggaggagttcgtgccggcggacgagggctcctacaccatcatcatcaggaagggcaagaagatggggaccggcgaggaggcggtccgcaactcgttccgcgccggcgagccgggcaaggtggtgctcaccgtggagaacacctcgcacaggaagaagaaggtgctgttcaggcacaaggccaagagcgcctgcgccaagaagtgctaaggggagggaggctcagtagaaacatggatggaatcgaattgttcgaggatgggatttgggagtgagattgattgtggattcaatattcattcattaaattctttgtatgtaagagagagagtgagagtgagagtgagaacattatttggtggttatttgaggcgggttgttgcggcaaaaatacagagtttcgattgaggaattgtgaaatatcataaaagtttcatgtg

SEQ ID NO: 3845 - DNA, 656 bp, Sorghum bicolor
  Clone ID: SORBI-28MAY03-CLUS66681_1
acgaacgaggcggaggtggcgcgggcggcggaggcggcggggttcgaggcggtggtggcggagctgggcggcggcggcgggggcgacgaggcggagcaggcgcgggtggtgaacgcgttcgacgtggtgctgggcatgcacggcgccgggctgacgaacgcggtgttcctgccgcccggcggggtgctcatccaggtggtgccgtacgggaagatggagcacatcgcgcgggcggagttcggcgagccggccgcggacatggggctcgagtacctggactacagcgtgagcgcggaggagagctcgctgatggagacgctggggccggagcacccggcggtgaaggacccggactccgtccaccgcagcggctggggccaggtgttcgagctctacctcgccaagcagaacgtccgcgtcaacgtcacccgcttcgcgccgacgctggcgcaggcgctccatcacctacgccagcagtagaggggcagggcagggcagggacacggatacgccattaccaattttttgcatatagtacgacagccatttcagtggtacactggtactaagctactactggagtaatacaatacaatactacacaatgggtcatttggttattcgcttgaacttatctaccgaatctaacagtcatc

SEQ ID NO: 3846 - DNA, 760 bp, Sorghum bicolor
  Clone ID: SORBI-28MAY03-CLUS66689_1
ccttgccagtgcgcgcgcgtatgggaatgggatgatcatccggtggtgcgtggactccgcggtccggggatggataacggggataggtctggggcagccgcgggcgccgtcggcagcgccgggagcctcggcctccgcgtcgggcaggcggtcttctcgtcggcgtcgctgctgttcatgtcagtcggtgtcgagttcttcagctacaccgccttctgcttcctggtgacaatcatggggctggtcatcccctggagctgcacgctggccatgatcgacgtgtactccgtgctcgtgggatgccctctgcgcgtgccgggcgtcatggtcatcgtcgtggtaggagactgcgcgctgtcgatcgtctcgttcgccgccgcgtgttcgagcgccgctgtgatcgacctcctcctccagttccacggatcccactgctccccgaggttctgcgggaggtaccagctgtctgccatgatggcgttcttgtcctggttcctcatggctgcttctgccatcttcaacctctggttcatcgcctcacggtggtagtaggctagtagctgctggtaaacctgcagctagtcatttttgttttttttttaaaatagcgcacataatttggttttcgagatcgtagcacagggttcaggtaccttggacttttgaccaattagccatccttgctgtgaatatgtgattcccagatgattgagtgcatgtagtcagtcaggactcaggagactatctgaattggcttgtg

SEQ ID NO: 3847 - DNA, 662 bp, Sorghum bicolor
  Clone ID: SORBI-28MAY03-CLUS66709_1
aacgcgcaacaagcgccagcaactagctagacagctacgaagagcagcgagcgcggcggcggcagcggcagcaggaagttccgatgcgcggcagcgaggtgaagtcggggaagagccagaagagctcggcgcagaggcacatcagcgccggcttcgtcgtcgccggtctcctcatgctcctcatctaccttgtcgctcagcatttcgcggtcggcgcttcccatgttgttattacggaagcacaagttatcatggataatgtaaaagcgcccgatgaaacagttgtcattacagaagcgcaacgaatcatggatgatatcaaagctcccagtgaaacggagaatggcaaggtggtatgcaacatggaaggccgctcggacacctgcgaagtcgacggcgacgtccgcaccaacggcacggccctgtcagtgaccctcgtgccggcgagccggtcggagcgccagcgagtggatgatccggccgtactcgcgcaggttcgccagcctcaggaaggtgacggtgacgcagctgcaggaccgggccgccgccgcgccgtgcacggcgacgcacgacatgccggcggtcctgttcgcgatcggcgggtacgcgggcaactactggcacgactacgccgacatcctggtgccgctgttcgtcgcgtc

SEQ ID NO: 3848 - DNA, 623 bp, Sorghum bicolor
  Clone ID: SORBI-28MAY03-CLUS67017_1
gtactccacagctagcttcttccatttcacaactaaccccaataagcagcgagctaggagagtcgtcgtcgaggtcgtcgtcggcaactaacatggcgtcgtccgggacgatgccactggcgtaccagacgacggcgacgtcgcccgactggctgaacaagggcgacaacgcgtggcagctgacggcggcgacgctggtggggctgcagagcttccctggcctggtggtgctctacggcggcgtggtgaagaagaagtgggccgtgaactccgccttcatggcgctctacgcgttcgccgccgtgtggatctgctgggtgacctgggcctacaacatgtccttcggcgacaagcttctgccgctgtggggcaaggcgcggccggcgctgaaccagggctacctcatcgggcaagccgacctccccgcgacggtgcactacttcgccaacgggagcaccatcgagaccgccgccgcggagccactgtacccgatggcgacggtggtgtacttccagtgcgtgttcgcggccatcacgctgatcctcgtcgccggttcgctgctggggcggatgagcttcgcggcgtggatgctgttcgtgccgctctggctcaccttctcctac

SEQ ID NO: 3849 - DNA, 652 bp, Sorghum bicolor
  Clone ID: SORBI-28MAY03-CLUS67028_1
gtcgatgcgtcttcttccccttccgtcccctgctgccctctcccctccgcctcccctcgcgctcgcgcgcgccccctcgcgaccgtcgggcccccgccccccccccgggccggctgctgcccctttccttggtcccttcgccggcgacgagcacccaccagtttcatggacttttgttgtgaacaaacatggagaaaggatacctgtgatctcaactgaaatatggagccagtcaaactagttgaggggtacaactttgatgaccatactacaagtgatgtccgtgtttgctttaaactgattgatgagcagccggagtggttttcctgccactcatctgttctttcgcaaaacagcaagtattttgcagaccgtcttggtcaaaatgatatccgttctagtagttgcattgaaattgagtgcccaagagctgagtatgaccattatgtcaagatgttgaagttaatgtatcttcctggagaatcagttgtcgattcgtttgattctgttagatcagctcttggtgttcttcgagcatcaaattcgctcggatgtgagttggttaccaaaggatgtattgcatacattgaagctgcctcgtgggatgaaaatgaggaggaggagattttagaagtagctcggaaccttggct

SEQ ID NO: 3850 - DNA, 877 bp, Sorghum bicolor
  Clone ID: SORBI-28MAY03-CLUS67032_1
tctgcgaaaaatcctcctttttgtttagcggggggcgcaagagcaagctgtaagcagattagaggggcacgaaggtcgcctctgctctgctctctcctcagtcctgttctgctctctcctagtcctcgaattcggcttcctctgctgcggtgttctgctcatgtctcggtttcagacgtgagatttggagcagtggacaccgaattcttgggtttcttggccgctgcaatgttatggcgcttggggcatgtagagcctgaattctgtgatgacgggggagttcgcgtcgtggggaaatttttcttctttcccttttcctagctgagaaatctggtgatgtttggtgctcgccgagccgcggggcgtaatcgttcgttggtgtgttgtctgtagctgaatttttggccattgagaagcgttcttcctcggggaatccgtgggaagaagcggtgtccgacggaggcccatggcttctagggatttcctgggagggtttggccgggatggagggcaagcgcctgcgggtggcgccgccgcaaggacctgcggggagtcggacgggatcgagctcagcctcggcctgtccctcggcggctgcttcggcgccgacccgtcgcaggacgggaaggagctgcggctccagcgctcgtcctccatcgcctcgatctgctccttgcctcccaccagctgcggggcgcaggacgccgccgccgccgccgctaccgcgcctccgccggaccagctgctccgcacctcctctctccccgccgagtacatggaggaccggctccgccgccgggcgatgcagagccagcgacgcctcgaggccaagcgcaagcgcctcgagcggcggaactcgatgaactcgggcaggcca

SEQ ID NO: 3851 - DNA, 670 bp, Sorghum bicolor
  Clone ID: SORBI-28MAY03-CLUS67058_1
tctgggagctatatatgctaacgtaatatactcagcagtgccttacttacactgcaggtactagctacacggtctgctagctagctgataaaagatggcagcacggaggccgcgcgatgacgaggaggaggaggacgatgaggacgggggcggagccgatgatcatccgcacaggcgtggccctaggcggatccggccggcgccgcttgcttttaccgctgtggtaagaagagttgtggcccaagaaactatacaacaaatagtccacaatctggaaccacttattcgtagagtggtgcgtgaggaaatccagaacatgttttcacatcatcaagatcacgtgccactaagatctctttctctacgcatccaagaggcagatgtcctgcctccactgaagttagtcttcgctaagcagctcaagctaccaatcttcacaaacaacaaacttgttgatattatggacaacccaattgaaatccagctcatggacacgagaaccaactctatgatcgcactaccagatactcatcttggatcttcatcagtaaaactagaagtgctggttctggatggtgattttcagtgtgaggaccgggatgggtggactgctgaccagttcaatgcagcgattgtgaaggctagagaagggaagagaccattgctcgtg

SEQ ID NO: 3852 - DNA, 553 bp, Sorghum bicolor
  Clone ID: SORBI-28MAY03-CLUS6707_1
catcgcgccggcgccataagtagctagctgccgcgcgccatagatagatcctcctactccacaagcatccctctcgaagtcgcccacttcgatttctcccagacttgacactcctcgtcccaaacccaattccaactccccaaagcagcaccctttccgatccttttctttcccagcaagtagctagccagagcgccgccgccgccatggccaccaagcccggtgtttccgccgcagtcctgcccctcgtcctgctcctcgccctgtcggcaacggcggtcgcccacaacggccgccaccccgacgacgaaaacaacaacaacaacaacaaccccggtggcgacccgggcgccttcttcgccgggatgccgtggttcggcggcgcgcggaccggcgggggaccaggcggcgggttcttcggcgggtggggcgagggcggcgggctcgggtaccgtcgcggcgcggaggtgccgccgtccacagtgtgcccgcaagacgggccgagccgcgggaagcgcctcacctgcccgcagcgctgcttccggacctccag

SEQ ID NO: 3853 - DNA, 621 bp, Sorghum bicolor
  Clone ID: SORBI-28MAY03-CLUS66794_1
atggcgagtcagcatctcaagttgaaagttatgaggcccagaatacccgacacgataaggcctccagcgccaccacgactgcagataccccggcggctgcaatctcccaagcgatcgacagcccatctaccgacacgccatcgctcggtaaatctgtgcgaaatcaatcgcccagaacccccgagtccgaagcagttcaatcctcaaaagagccacaaccaacagcagatccaattatcagcaaagatatcacgaaaacggcggcttcaggggatccttctaaagcaccgccgcgtggcagtgttgtgcctttaatcattacaacgggagccctcgctgtcgccattgggatagggtggtggcaggcggcctaccactaggagtagtgaccttctaatttgggctggattgggtagttttcataataaaggataggaaggacatcgatgatgcagggacaaacagcaactgttcgtgtacgaaccgaggaggattgataacagaacagtgccatgagcaatggacagtagaaacctatacgagtcctaggagccaccaggaatcatttctattttgtcgatgcgaatattaaaccaatgagcacgatttatcatatttatc

SEQ ID NO: 3854 - DNA, 1231 bp, Sorghum bicolor
  Clone ID: SORBI-28MAY03-CLUS66820_1
atcgtctcttctttcttcgactcttctcctcctctctctttgcttccttccttccgactcccgatgccagggctgacggcgacggcgacagctccgagcgcaaccggcgcgttgcggccgccctcctcctcctccacctccacctcgtctgccttatcctcctcgtcctccttctcctccatcctcttcctctctctatctcccctgccctcccgatgcggcggcaggagccgctcgtgtggccggcccgaggcggcacgccagcgcctccgctgctccctccccccgcctcgtgtcctctccctttctctctccccacggccgtggctgcatctgcgccggggaagccctaggtgccatggtgggctcggatctagccacggtgatacccggcatgcgctgctctgccatgtctggctccgatggataaggcgccagtgcctggcacagacgggccatgctggctgcaaccactgtccttgtcctcctccaacctcgcacctcagcatgcccaaaaggataaatggatggtggcggcgccgctgtcctacaccaatcctagcagggcaataatctatagctacatgatttttgttgctctctgtagctctgtggaaattgattcaaatgcatcgtgttggctatgccacctggatttggactgtgatgcttagaaaaggagaataacattatctgaaagagcagctaggttttctcagcttttcaaaagtctgcggcttttcaggaaacagtggcaaataagaatgtgaaaactaccacagctacacaggatgacaaagacaggcctcatgcagcgccgctatagcgcaaactcaataggttcaattgaatactgtggcgcgccccttcaactagtacttgtaatagggtgcgcgccatcgcgcgcgtagattggcacaaaagatttctaatatgaagaatatatagactataatataaataaataatgtaggtagagtgtctaactacgtcaggataggccccttgagttcatgcctcaagagatttcgtgagaacatctatcgttcgtgtcactgttataggggtgatggtggttacataacagacaacattcaagttaacgttaatttaacagaaatggtagaagacaacatggaagaaatattttgatgccgaatttgtaaagttgaatctttttgatgttctaaactttggctctttcaatggtagaactctaatcttattcttc

SEQ ID NO: 3855 - DNA, 651 bp, Sorghum bicolor
  Clone ID: SORBI-28MAY03-CLUS6685_1
tcactcacgacactccacactcccagcaagctagcgagctcactctcactcccctgctccgcgtgagcgacgcccccagtgcctgcgaccgaggcgggggtggccaggcgaccgaccaaccatggcagcaacaacagctgcagcagcaatgcgcgccgtcgccgtctccgcagccgcgctgctcgtcgtggcgtcgtccttggccggcgtcgcgtcggcggcgacgctggcgctgtacaaccggtgcggggagacggtgtggccaggcattcagccaagcgccgggaaggagatcctagcgcgcggcggtctgcagctctccccgggccactccacatcgatccgtctccccgcgggttggtcggggcgcgtgtggggccgtcagggctgcgccttcgacgcctcaggccacggccgctgcgccacgggcgactgcggcggcgcgttcttctgcaacggcgccggcggcgctccgcccgccacgctggcggagatcaccctgggcgccacggcctcggcgcaggacttctacgacgtgagcctggtggacgggtacaacatccccatcgcgatgacgcccgtgcacggctccggcgcgcactgcgtccccgccggctgcgtcagcgacctcaaccgcgtgtgccccgcggg

SEQ ID NO: 3856 - DNA, 608 bp, Sorghum bicolor
  Clone ID: SORBI-28MAY03-CLUS66882_1
actcctccgtcctcgcctccgaagagaagaactgagcacgaaccaccggagatggacgccggcggcgagcctcctttgggccacaagtaagacggcgtagactgtagcggtcgtttggttgtaataggcagggcacgctgcacgcgccattcttcttgtttcggttgccaagtgaggacgacggtggttgtggttgggtggagcggggaaggggagggtgcggcggtggtaagtggcggccgtcgatgacgtttctgttcccggtgaagaaccagcagggtacgatagagggaaggccgccggctgcgcctgggagggtgtcgatggcacgggggctgttggtgcgggtgaccccggccgagcggctggtcggagacggcaaggagagagacaaggacgagaaggcgccggcaaccggcggcgctggagcggaggcggatgtcgggtcggtggcgcttgacaagatggtgatcagcttcatggaggagtcctcggcggccgtggagcggccgccgcgcgggcgatgcggcaactgctttaacggcaaccaggacggcatcagcgacgacgaggacttcgacttcctcccatccgcctcccaccccgcc

SEQ ID NO: 3857 - DNA, 630 bp, Sorghum bicolor
  Clone ID: SORBI-28MAY03-CLUS66896_1
attcggcagccttggtcgccagaaaatttcacacaccagccggaggccgcaaactcccgagaccgtaccagccggacaatttcaccatggcggcgccggcgcaggcgcaggtcctgcctctcctccggtggagccggagcgcctccttcctatgcgcctcgcctcgccgcctcttctccgccctccgccgccccgctgctgctgcccgctgcgaggccggctccaaggccatgctcaaggggatggactactcggaactcgagaattgggtgcaggcgcaggggtttcggccaggccaggccatgatgctgtggaaatgcctgtacgggaacaacgtttgggctcattgttacgacgagctgacgggtttaaacaaggatttcaggaagatgataactgagcatgctgatctcaaggcattaactgtgaaggacattcatactgcatcggatggtacccgtaagatactgctctctcttgaagatggctcagtgattgagacagttatcattccttgcgctaggggcaggacaactgtctgtgtttcaagtcaagttggttgtgccatgaactgtcagttttgcttcactggaaggatgggtttgagaaaacatctctcgacagctgaaa

SEQ ID NO: 3858 - DNA, 790 bp, Sorghum bicolor
  Clone ID: SORBI-28MAY03-CLUS6716_1
tccatgaagagcccggactttgagtacatagacaatcaggattcctcgatgctggcttcattgcagcgacggacaaatgaacatctgcgaataacagaggatagagatgttgaagaaaataagtggaagaaaaatgccattgccccaatggaaattgaccgcatttgtgatgttgacaacgaatatgaggacccacagttgtgtgctactctggcttctgacatttacatgcacctgcgggaggctgagacgaagaaaagaccatcaactgatttcatggaaacaattcaaaaagacatcaacccaagcatgagggcaattttgatcgactggcttgtggaagtttctgaagaatatcgtcttgttcctgatactttgtacctgacagttaactacattgaccgttatctttctggtaacgaaattaaccgccaacggttgcaattacttggtgttgcttgcatgcttatagctgcaaaatatgaggagatatgtgcaccccaagtagaagaattctgctacataacagacaatacatacttcagagatgaggttctagatatggaaacttctgtactgaaatacttgaagtttgaaatgacagcacctacagcaaagtgcttttttgaggaggtttgctcgtgctgcacaagcgtgtgacgaggatcctgcattgcatctcgagttccttgccaattacatcgctgagctatcactactggagtacaatctactctcttaccctccatcactaatagctgcatcggctattttcttggcaggtttatac

SEQ ID NO: 3859 - DNA, 564 bp, Sorghum bicolor
  Clone ID: SORBI-28MAY03-CLUS67174_1
acacaattcatccaacgcccaccggggcctcaacaatctccccaccagccgccgccgccgccgccgcatcaagcgatagaactaggaacccctccccaagaatctcaagaagacaaggacgccgtccagtcgccgccagccgcctcgatgggatgcgggcagtcaaagatcgatcaggaggaggcggtgagtcggtgccgggagcggaagcggctgatggccgacgccgtggtgtcgcggaacggttttgctgccgcccacactggctacaccgtccgcctcaagagcaccggcggcgcgctatccgatttcgcccaaggcgaggcgcccgaccctagcctggtgtcctcccatacccaccacgctcccgctgtggcggcggcatctatctcgactccgccaggcccttccgcagcttccgtcaccagcccctccccgccgccgccgccgccattcgccgacttctctcatgctagcctccaaaggtcctcctccactcccaatatccctatgccggagccgagggccgccgccaaaaaccgccctcctgccgatgctcctatc

SEQ ID NO: 3860 - DNA, 418 bp, Sorghum bicolor
  Clone ID: SORBI-28MAY03-CLUS6718_1
cgcttcttcacaattcccaaatccatcctgccccgatctcctctcctcctcccccaaatctcgggcgccgccgcaaccctaggcccccgcgatccgctcgccggagggaaggagggagccccggccggcgcccatggaggtgaagctgtggaacgacaagcgggagcgggagctcctggagagctacgcggacctgtacgcgatcatcaagtccacggagaagctggagcgggcctacgtccgcgacctcgtctcggccgccgactacgaggcggagtgcctcaagctcatctcccaattcaactccctctcctcctcgctcgccggcgccgtcaccgtcccgcgcttcgtccaggcgtaccgcctcgattgccccgccgcgctcaatcgccttcttcagtcgggcgtcccggctacc

SEQ ID NO: 3861 - DNA, 881 bp, Sorghum bicolor
  unsure (1)..(881): unsure at all n locations
  Clone ID: SORBI-28MAY03-CLUS6720_1
actttcctaccttcttctccgcttccgcttccgcttccgcttccgcttcaaaccctcgccgcaagaaagaaagaaagaaagaagaggtcaatcaaatcaagtcgcaccaaaacctcccgaccccacaaggccaagcccgtcgccatggtggtgtacacgcaggagcatgtgtaccggcacccgtgggaccgggtgacagcggcggcgtgtcgcaagttcacggacccggcctcccggacggtgctctcccacgtcgccgacgtccacaccctccaccgccgactcgactccgacacgggccgcctccacgccgcgcgctccatcaccgtgcggtccccgccgctccctttcgtcctccggcgtctcctcccgtccgccgcgtcgtccccaaacggcgccgcgctctgccactgcgtcgagacctcgctcgtggacgcccagcgccgcgccatggacgtcgtcgtgcgcaacgtcagcctccggggcctcatcgaggtcgaggagcgcgcctcctacaggccccacccggaccggcccgacgactggacgcagttcaggcaggagaccacgatccggtgccgcccgctcgcggtcctcgccgccgtcgccgagaaggtcgagacccggtgcgccgagaggttcctgcagaatagcgccaaggggagggaggtcgtcgagcggatctgccggtacctcgaggccgagtccgccggtgccgcgccctccgtaatctgatccgccctgatctggtttgcgcatccttacttgatccgaacggatccaaagggttcctcgatctgtgctgtctgcgcacggagaaatcgaacccccgctgctagggcgatgtnttactctgttcatttcttgtgatgatgaatgat

SEQ ID NO: 3862 - DNA, 642 bp, Sorghum bicolor
  Clone ID: SORBI-28MAY03-CLUS67208_1
aacgatcgaaaatatttgagcacgcttccgaaccgacgtcctcgccgacgtcgcctcgaacgtgcccctcacgagaccgacccgaccggccgccaccgcgcccgcgctctcgtcccaaaatcctcaacctatatagttcccgccccaccaccgcctagccggctgaccccattccccgagtcctgatacacggcagcaggcccggagcggagcagatatagccctgcttgcttgagccgcagcagatcggccgggggctcggcggtaaggcaagcgcgatggacttctcatccggcgacgtgaaggcggcgatcatgcggcccgcggctgctgctgctgccgccgccgccgaatccggcacgtcgacgctgctgcgggggtggcaggagttccggcggagcggcgcgccggcgaggttcctctgtttcgaggacggcaagtgggtcgacgtcaccggggaggcggtgccacggctgcggcgggcgttccaggagaggagggcgatggccgacgcctcgtgcgggggagaggcgtacctgttcgacttcctgcggatggtcaggatcgacgaggccaccggcgacgagaccgggctggcgtggatcgaccaccacgggggctgcttcttcccggcgcccgccg

SEQ ID NO: 3863 - DNA, 676 bp, Sorghum bicolor
  Clone ID: SORBI-28MAY03-CLUS67203_1
acccaaatatcttgccccttcccgtaaaaaagatcccctcggtctctcctccccgtcatctcctcccgacgcgacggcgcacaggcgacggcgccgcccgcgggacgggcttcccctctctccgtccctctcctccagcgttgcggcgtgctgggcgagcaagggccaaaccgcggcctccccatcacgcggtggcggggtgtcggcgccctccgcgggtgctcgacggaaccctaggtacccgttcctcaccgccggcggtggcggcaaagctcaccggccggtacgtcgccatccacttcccctacttccttgggtcgactcacggaggtgatggcgtggggcgacttcggcgatgcctagcccttgtgcgcggcagcagcctcccttgtccttctcctgctcttctaccacacccctttcttcttgcgacgaacagtggccaggccccgcgccgccgccccaccgcgcgaaacgctcgcgtgccgaactccgcccacggcgcagtgcgagcgagccccggcgttggctatcagcgtgggtgctccctgctgtggcgttttcctgctgctccgtgtctgctcctatgctcgatgaagccctaggtccatgtgcccgagtaccctggctacgcatgtctatgctttaccatccataagaattttttgtgtcctaa

SEQ ID NO: 3864 - DNA, 632 bp, Sorghum bicolor
  Clone ID: SORBI-28MAY03-CLUS66977_1
tcttgggagaatcagctcttgatcaattggttgaaattattaaaatcttgggtaccccaactcaatctcaaatcctccaaatgaaccccaactctgaagaattcagactccctcaaataaaagctcaagcttggagcaaggtccttaagaacgctgatccacttgttatagatttgatttctaaagtgctggtttacaatcccagagacagattaaagccaatggaagctcttgctcatccttactttaacgatttgagaaatcaaaatttccaaattcaagaatgtaaaattcctgaattgttcaactttagtgctgaggaactcggaggagttaagcaagaaattcttgatgtaattatcccctcttggaaaaagagcaaataatgtctctttggttttgtgaatagatgattttattctgcctatgaaaggggcttagactgaagattgtcccagaatagaacaagaatttttttacatgtgaattgattccttatctaggcacttcattaaatttggacctatatatgctcaacaaatttcatctctattgtaaaagcttatatgagtttttgttgataaccatctaaatataatctttatctcaaaataatgaacaaaatatacttg

SEQ ID NO: 3865 - DNA, 602 bp, Sorghum bicolor
  Clone ID: SORBI-28MAY03-CLUS66986_1
gccaaggtcatcgccaaggaaggctccttcaccgtcaggaccatgcagctcttcgtcaccacgcgccgctgcctcctcctccaggcccaggcacaggcggacgacgacgacgacgagttgccgcggtggctagccatggagacggcgagcaccgttagggcggtcgtggagcccatgctgcgaacgcacttcggctgggacgccatcgccatggatggactcttctgcaggtacagcctcctgctcgaggcatactaccgcagcatcaccagcagaagcaagggcgacctcaccagcgtcttcctcgtcttggagaagaaacagcactagcgcttttttctagctccagtctccatccacgatcgtcctcgatctgtttcttctggaaaaaaagaattacgtgtttaccgtcgactagtactaagcttcgatcaattccttgcttcttgtgctcctttcaattcgtcgacgatctatcttgtgctcccgagaggctccaacgagcattagggaggaagcacgaacttctcataaaaataccggccgtctatatatatcgtcggaagtttgtatcttatctcaataagcttccacatttactc

SEQ ID NO: 3866 - DNA, 573 bp, Sorghum bicolor
  Clone ID: SORBI-28MAY03-CLUS66994_1
attgaaagcgcaccggcagctctgatcgggctgttcccgggcgaggtgggggggctcccgcgggtggcgctggcgggggcctggattggagctggcggtgttctttcttagcgggccccgcgcggttgtgttaacagcgttcggggtggcttgcatagctcactcgtggcgtggtccccgctattcgtttgttcggcttatccgtgttcttggtttgcatgtgcagttgagttggacgctgcggtgatagctgcggaagcggctagctgggcgggctgtatatcggagcggattcaacgacttttggtgtttccttctcttgaagagcaatggcgcccacaagctgaggctaatgatgaagcagaaaggcttcttagttcagattcctcagaaacatttccagctggaactgtaatgtaattttgttaatgcgcagacaatattcttttatttcctgttagctatttctctctcttcaatgtaaaatttctctatcaaagtacaaacaaaactctagttaggcttctcaaggaaactattgctacagaaaattaaagaaatttttttttctcg

SEQ ID NO: 3867 - DNA, 513 bp, Sorghum bicolor
  Clone ID: SORBI-28MAY03-CLUS66987_1
aagaatgttaggccggattacctgaacaacatctggaaggtgatgtactggaaatatgctggagaggtgtacgaaaatgttcttgcttgaattgtcttaatggacaatactcatctgtgctggttttcggctgtttgatcatgtgaaataaagatggacctgtcgagctgctggaccttgtgtacatttcgctgaggtagactaatgcacaatggcctgctgattttgctcgtcctgcttgcgtgctactctgttctctgctccagtgtctggcactaccctttcgagcaaggtgatggccaggagagctattctccattaataaagcctgctgagcgcccgatgtttgcttgaatttgttgccatgcgtttccagtttttcgcctttccccttggagcaaaatcttgcaaatcatgttcataggcatcgtgtttatgtggagctgaaattactgttggaagatatctttgggtatcagtttcagtattcagtttgaggccgcttaccctttt

SEQ ID NO: 3868 - DNA, 635 bp, Sorghum bicolor
  Clone ID: SORBI-28MAY03-CLUS67001_1
accctgtgcgcgctcttcctgccggtcaccaactcccggggcgccttctacggccgcgccgccggcggcgcgcagctcgggaagcagctagcgggcgcgctcttcatcatcggatggaacgtggtcgtcacctccatcatctgcgtcgccatcaacgccgtcgtcccgctccgcatgaccgaggacaagctcgaggtcggcgacgacgccgtccatggcgaggaggcgtacgcgctctggggcgacggcgaggtctacgacgtcaccgaacacggcccgcgcggcggcgccgccgtcgcgcccgtgtccacgaccccgaattgaactagtagttagtacactagctgtgcattgttaatgttgctcgatcgacgacgaccatgtatattgctccatcaatccatccatccaagcatgcatgcattgtgttgatgaccatccgtgactaggcattgtttgttcgttaagttgttcttcatcttcttctgaatcaattaaacgttggcttgtgcatgtaaaatacgtacgttcctttttcctccttgtaatacttactacagatgagagacatgtgaatttgcaagagcatgcatgtaaatcatcaaagtagaagaagttttattattcagatcaaa

SEQ ID NO: 3869 - DNA, 485 bp, Sorghum bicolor
  Clone ID: SORBI-28MAY03-CLUS67293_1
tagtgatattgcagataagaagctcgttgaggaagctgagaagaactgaggcagcttcaaaaccattgatattatgccttgattatcaagccattctgatctttacgaggcttgctttgaagaggccaagctaaaagggcatctccagatagggcttccattacccatcccattttgttaatcgagatgaattacgcagcaatgtattagcatgtctgctctcttgtctcaccctgtattcagattcagagtatgggactaggatcatctattttttatggtaataataaccggatcccctccattccccaggtgatccatggcaaagttcgcttggtttcctagttctagtctaggatataaaaaccctaggggttgctctactcttgtccccgctagctattctggtttctgatggatggtgataaacccgatccatgtatggtttttgtttttccagattaaatttgatggatggattcgtt

SEQ ID NO: 3870 - DNA, 710 bp, Sorghum bicolor
  Clone ID: SORBI-28MAY03-CLUS67308_1
tctggattcccccgtttctcctagctactccctcctccggccctgccagcgcccgtcagcagcgctcccgtcctttgtcccgggtcgtcccccccacgcgcgcggcccagcggccggtgcgcgttcgttccgtcgtcggggttctgctgccgtggccggccgctccctttcttgggtgttgcagcgagccttccgcgcgctcgctgccttcgcttggtggcgcccccgcccgcccgggtgccgacgacgaccatggcggccccggccctgctgccgccggggttccggttccacccgacggacgacgagctcatcctccactacctccgcaaccgcgccgcctccgcgccgtgccccgtccccatcatcgccgacgtcgacatctacaagttcgacccatgggacctccccgccagggcagctgtacggcgacggcgagtgctacttcttcagcccgcgcgaccgcaagtaccccaacggcatccgccccaaccgcgccgccgggtccggctactggaaggccaccggcaccgacaagcccatccacgagcgccgccaccggcgaggccgtcggcgtcaagaaggcgctcgtcttctacaggggccgcccgcccaggggctccaagaccaactggatcatgcacgagtaccgcctcgccgccgccaacggctccaccagccccctcgccgccgcctaccgcccgccgtcc

SEQ ID NO: 3871 - DNA, 895 bp, Sorghum bicolor
  Clone ID: SORBI-28MAY03-CLUS6732_1
gcttcacccgaatatttgtcggttaatgttggtcgtgaagacataactggtattgattttgtggtttttgaacacccagaagtaacaatcttgagtggtcatgtggaaggagatggcattgatacgttacagccgcatctctctgttgagatcagatcagcagcagacccttctagagtagaatctgtacttcctgttcctctttcgtactattttgaagtgcgagatttgcccaagggcaagcatcttgttcagcttcgatctggccttccatcacatacacataggtttgaatcagagttagttgaagtagatctggaaaaggaaccccaaatccatgttggccccctcaaatataaaactgaagagcgtcatcaaaagcaggaactgaccccagcaccagtttttccgcttattgttggagtttctgtggttgcactggtgatcagtatgccaaggttaaatgacttgtaccagagcgctgtagggatgacttctctgggttcggggatggcaccaatcaaaaaggagccgcgcaagaacataattagaaagagagtgtaaacggcagattagcttagccttaggggtcgagaaatgagcactgacaaattgagcatgtcaagagtggaaatagctgctggtttaccctttttttccgaaaacgtgcgctgcacgtgcctcattaagaagagagttaaaagttacctccctcgttccaaatggtgaggtaccattggcacggcgggcgacacgagttacaataggcgccggctactacggcggagcgttgttggttgtactttctaggcgaaaagctgcacgttgctggtttaccctcgtgtaattttgccaacgaaaaggaatctgacagttttgataccatgcggcttca

SEQ ID NO: 3872 - DNA, 621 bp, Sorghum bicolor
  Clone ID: SORBI-28MAY03-CLUS6734_1
gctactgggcaaccacttcacgcgccttcccttcccttccggccgcctcccctcctcccccacctcccaaattgaaatccacccgctcctccccgcctagggttccgcttccgcttccgcccccgtccgtccgagcactacccaagcggcggcagccggcccttctcgtcgccctcgagacttccctaccgccggaagtctcagttgcacgttcggccgctcccctgcactgccgggcccgcccatcgcctgaggctcttacggtgccacggagttgcaactgcacgaaggccttttgtggtcacaaaggcactattgtattacaacaacagtcctaactgaagtaataagacatttttgaaactgtctgctaccattgcttccatggcaaccaatgagaacctcccaccaaatgtcatcaggcaattggctaaagaactgaagaatcttgatgagtcgcctccagaagggattaatgtgattatcaatgatgatgacttcactactatttttgctgatattgaaggccctgctggaactccatatgagaacggagtgttcaggatgaagctattattgtctcgcgacttccctcattctcccccaaaaggattcttcttg

SEQ ID NO: 3873 - DNA, 624 bp, Sorghum bicolor
  Clone ID: SORBI-28MAY03-CLUS67340_1
agacactcgtgcactccagcgatgctggcctcagcctgcctatccgcttccttgtcttcctccccttccaccgccgccacacacggattcctcgtcccctccggcaaccccggccgccgccgccgtggacggcggcacatgatgccaggttctcgttcttctgccgcacacgtaccagcggcgatggtggtgaccgcgacctcggagcagccgacctcccgcacctcccatcctcctcccggcgacacgcgtgagcagctgcgcacaccattcctcctccccacgccactgcgctgacccgcgtcctctactacctcgtcgcggtggccggcgcgcccctgccaaaagcctcatcggcgtcgccaggcgcaccagggcgagggcgagcggatgcgcgtcgccatggagcggttgctctatgaggctcgcgtcgacgtcgtgctcgccggacacgtccacgcttacgagcgatttacgaggatctacgacaataaggccgacagccggggccgatgtacatcaccattggcgacggaggcaacagggaaggccttgctctcaagttcatcaaggaccacaagtcggcgcacctgtcggagtttcgggaggcgagcttcgggcatg

SEQ ID NO: 3874 - DNA, 703 bp, Sorghum bicolor
  Clone ID: SORBI-28MAY03-CLUS67350_1
aaaaaaaaataatattctcgtccagtttttctcttcacgccactcgtttcctgtcaggctcaattgtgactcttcgtccatacgccagacttttatctacctaattcaaagaaatatctgtacgattattccctgctgcatatctcgatcgttcgccgagaaaccgcccgaggattttaaataaacaccatccacaaaatcgcaggatcttttccaattacaaaacagatcataatgcattccgttaaggttctttctgccattgcggcaatcggtgtctccgcggtttccgccgcctccacctgcaccagcgacatcaaggttaccgagcccacccccagcatcgactgcgacgttgtcaatggcgatattactatcgacaaggacgttgctggtaccgttgtcatcaacggccccaagcagatcaagggtgacttcatcgccaagggtgctggcgacctcatctctatctccagtacctccatcaacgccattggcggcaagttcgagctcagcaaccttgagtctcttagcaaccttgagttctcatctctcaccagcctgggcgagcttagcttcatcaagcttccccgtctcggtgagctgaactttggtaccgagggtgttactaagatcaagaccatccaaatcaccgataccttcatcagcgatctgagcggtctcagcgttgccaccgtcgaga

SEQ ID NO: 3875 - DNA, 686 bp, Sorghum bicolor
  Clone ID: SORBI-28MAY03-CLUS67071_1
ttaataaacaatttgattataacattcaaattctggaagactgaatatggattacaaaacagggaagtcgcaaggcaatggatataatactaaaccaaccaagaatgttgtatcaaatacaatagggaataacgctcctatgcattctgaagccggtacaagactgaatacttatgaaaatagttctacaaccaaaaagaccgctcacggaggtgtcgcaaatgagaagaaacaaacttatatctttaaagaaccagcaggcgaaacagtcactggtgataaaaaaacctataatgctcaaaagattgtgggtaatggaacattcggtgttgtgttcaaggcccaaattgctgaaactggcgaaacagttgcgattaaaaaggttttccaagataaacgctacaagaatagagagttacagatcctgaaggagctcggccatcctcatgtcaccaatctcagacatgctttctatacccaaggagattccaatgacgaagtgtatttgaatattgttatggattacattcccggaaatctctatgatatcattaaatactaccgccaaagcaagcataaagttcctaacgtcctcatcaggctctactcttaccaaatcttccgttctttggcttacatccacggcatcggaatctgccacagagatattaagcctcaaaatctct

SEQ ID NO: 3876 - DNA, 597 bp, Sorghum bicolor
  Clone ID: SORBI-28MAY03-CLUS6708_1
cgccgtggtggcgggcaccatctcgctctggtacattccccgtcatgttactcctacgtctgggccttcacgctccagatgtacctgcaggcgcagagcaagaacatcatcatcacctacctggcaatgctcaacctcggcctccacctcctcctgtcatggctcatgactgtcaagttccagctcggcgtggcgggggtcatggggtcgatggtcatcgccatgtggatccccgtgtttgggcagcttgccttcgtcttctttggtggatgccctcacacgtggactgggttctcctcggctgcgtttgctgatctcggtgccatcgtcaagctctcgctatcttctggtgtcatgctctgtttggaattgtggtacaacaccatattggtgctgctcacagggtacatgaagaatgcagaggttgcactcgacgccctttcaatatgccttaatatcaacggttgggagatgatgatttctttcggctttttggctgcaacaggagtgcgagtggcaaatgagcttggagctggaagcgcaagaagggcaaagtttgccatttacaatgtggtcatcacatctttctcgatcgga

SEQ ID NO: 3877 - DNA, 569 bp, Sorghum bicolor
  Clone ID: SORBI-28MAY03-CLUS67080_1
atggagatgcaggacgaggcgatagtcgtcgtcgcgaggccagaagaagcagcagcagcagcggtcgtcgccgtgcgccgcatgaacagcagcggcgttggcaagatgagctacgccgacaactccgacttccagcgggtcatcgcctccgtcaccaagaaggccaggcaggagctggcggcggcgctgtaccgcgcccgtggccgcccggactccatggccatcgccgacctgggctgcgccacggggcccaacgcgctgctcaatgtgtccgacgccgtcgaggccgtgctggcggagaaccagcaccacccgccgccccagctccacgtcttcctcaacgacctccccgccgacgacttcaacgccgtcttccgcctgctgccgtcgtcgccgctcgccgccaccggctgctgcctggtgtcggcatggcctggatccttctacgagcgcgtcttcccggaggccagcctggactacgtcgtgtcctcaagcagcctgcacttcctgtccaaggcgccgacgatgaggatggagcatcccgttaaccttggccgcgtctacgtctc

SEQ ID NO: 3878 - DNA, 692 bp, Sorghum bicolor
  Clone ID: SORBI-28MAY03-CLUS67094_1
taacggtaagtatctaaagttagacccgaagcctggtgattttaccataatcaggattataaaagtccgaacggaatattgtagcataaatatccgaagaattatggtaggtgtagtgaaagacaatactgaccaggatagctggttttctgcgaaacctataacagtaggcaatttaagtataatatcttagcaggtacagaatttaatctcagacaagacataaggctttacttgctagcaagtaaagctcatgttttattttgtacaaattgggggatcatgaagattttatcagtgagtatgtagactcggaatggcaaagatatatcttaaatcatcagacatagaatgataaggttgtatgtcaaaagggaaacagcccagaacaagagttaaggttcctaaattattagttgagtgaaattaagaaggtttttattaaagtcgacaaggagataggcttagaagcagccataattttatgacctcgtaacagagcgcttgttaagttttaaaagcatcgaaaatttatcggatctaaacaatataccgaaaccttgtccatattatttcataattaaagcttaattataattaaatggggtagcagaacgttgagctaaattaagatttttattttttaaatgaaattataataatttaactcaagtgataatggtgacatgagt

SEQ ID NO: 3879 - DNA, 604 bp, Sorghum bicolor
  Clone ID: SORBI-28MAY03-CLUS67130_1
cgacccggtgcgcgtcgccgggcacgtcatgctctgcccgttcttcggcggggcggagaggacggcgtccgaggcggagttcccgcccggcccgttcctgacgctgccgtggtacgaccaggcatggcggctggcgttgcccccgggcgccacgagggaccatccgttcgcgaacccgttcggtccggagagccccgggctaggcggcgtcgcgctcccgccgacgctcgtcgtggccgcggagcgcgacctgctgcgcgaccgccaggcggactacgtcgcgcggctcaaggcgatgggacagcccgtggagcacgtcgagttcgaggggcagcaccacgggttcttcgccgtggagcccgccggcgacgccggcagcgaggtggtccggctcgtcaggcggtttgtgtatggcaactcctactgactgaactgattgagtttgggactctgggtgctcgggcttgagccttgagtctgtcccatcatgacctttgttgttagcacgagcacgaagcactcgtgtcatggttatagtgaacgttttgtgttcactggataaaatgctcatcaataatagtttttttttgagaaattgctcatc

SEQ ID NO: 3880 - DNA, 623 bp, Sorghum bicolor
  Clone ID: SORBI-28MAY03-CLUS67545_1
cagatggtcgtgcgaaaagaataatatattgggaatctgtatcgaacttggttgaacctggtggcattgtggtcataacatcatgtaatcacacaaaggatgagctcctgcaagaagtagaagatttcaccaagagaaaatttggcaaggagaacgtggatgaaggtgcaggagatgtgtctgagatcttccggtacatagaccatgtccgaacatatcctaccataatgtttggaggaattgagggctctcaagtctgcacggtggcctttcagcgggtgtgagtgaaaactgaggcacacatagttcttggccaaatgtgtcgcgttggatccagaagaagtggataaaaattttgtgcttcacctgtgggactgttcctactgtattgagaaacagttcaaactgggtcttctgtcgttaggtcatctatccaggacggtcgtgtaattttagacggaccagacgatgagacgagtcagtcctgtattgtcaccgtggacgtttcctcgtattgccattcctcttatacatacgctagtcaatttattattactctttcttgtaaggaagaagtttcaacttgttaacagtggattattttaagtgatcgtcgtctattt

SEQ ID NO: 3881 - DNA, 612 bp, Sorghum bicolor
  Clone ID: SORBI-28MAY03-CLUS67549_1
cggagggccgggaccgggaggaggtggagccggcgggagaccgcggcggcggccgatcgagatgctgctgccgccggcgacgatggttccactccgggcgcgggcaccggcacggcagcgccgccggcgtggtgctgcatgtgcccgggcggggactgctcgctggagcccaacccgagcgccaacggcaaggaggacgccggcgtccggtccctcctcgagcagaacgacttcttctccgccgactgcaacccgcacgccgacgtcctccccgccggcgccggcgccggcaccgactacgccgccgcctacgagtcgccgtagcaggcacaacgaccggttcggttaggtgcgccaggcaggctgccagccagctactcatccgcattctcccccacccacactgcgatacacaatttttaccagtgatgatgagagaggaaacctttggttccgccgctgtcaccaccaccaccaccggtggagctcgatcggattcttgattccttgcttgctttcttcttccattgcttccttgcccgtaatctgtacatgtactttgccgtggttgggagcaaatgaatgaactgagtgatgggcgggcgggcgcct

SEQ ID NO: 3882 - DNA, 689 bp, Sorghum bicolor
  Clone ID: SORBI-28MAY03-CLUS6755_1
cagcttgtttagtagatatcagtggatcgatgtatgatggaggaaacaagctagctagctagcagcagccagcagcagggagaaggatagagagagaaaaaaatcctatattctcggcccttctccagcaggtcatctgcagatctgtctcctgtgaccttacaaaggccaggaccaggaaggaaatggcatcgccgtcgagcaccagcaacaactcggccctctcccctgtggccgcgtcaggggcgacgacgcccggtgccggggcgccgtgcgcggcgtgcaagttcctgcggcgcaagtgcctgccggggtgcgtgttcgcgccctacttcccgccggaggagccgcagaagttcgccaacgtgcacaaggtgttcggcgccagcaacgtgaccaagctgctcaacgagctgctgccgcaccagcgggaggacgccgtgagctcgctcgcctacgaggccgaggcgcgcgtcaaggaccccgtctacggctgcgtcggcgccatctccgtgctccagcgccaggtccaccgcctgcagaaggagctggacgccgcgcacgccgagctccttcgctacgccttgcggcacgtcgccgccggcatccccaccgcgctccccgtcagcgtgagcgtcagcgccgcgcccaggctctccacggcaatgacgacgagccctccgcagttc

SEQ ID NO: 3883 - DNA, 513 bp, Sorghum bicolor
  Clone ID: SORBI-28MAY03-CLUS67560_1
gggcgtccagctacctggacggcaagaggccgctgcgtgggatggttgatccgacggtgaggtcgcccgtgcctgaggaagatttagaggcgctgcgcgacgtcgtgaggctgtccctgtgcgtgcgctcggacgccggggacgagcagaggccggacatgggcgaggttgtgagagcgttgagaggcgtcaccgggttgtcgccggagcaggtgacgccgagggataacccgctgtggtgggccgagcttgagattgcctcggcggtggagtcggactgaagttcaaaacaaatcgtcaattgaatttcctctttctttggtcctcattttcttttggtatattgtaatttcttttctttttttttgttttgctgctgatcactgccaagaccctacaaatttgtaagaagtacaagtttagagcatcttcaatagtttggtaaaaattatttgccaaatcttgtgatttggcaagttgctaaatgatacgataaggaaaaaagagtttctc

SEQ ID NO: 3884 - DNA, 644 bp, Sorghum bicolor
  Clone ID: SORBI-28MAY03-CLUS67569_1
gaaatcatcaacaaatgcttttccaaaaggacagttgaagaaattatatccgctcttgaactagaggccacaaatttggcagatgaatgggttgccacgacaatccagtccttgaaaaaggcttcacctaccagtctgaaaatctctctgagatcgataagagaagggaggacacaaactgttggggagtgcttgcagcgggaatatagaatggtttgccatgtcatgcgtggtgacttcagcagagacttctttgagggatgcagggcaatattgatagataaagatcgaaacccaaagtggatgcctccaaggttggaacaagtgcatgacgaggctgttgaacaatatttctccagaattgatgatccacagtgggaagatttgaacctaccacccagacgttcccatggaagaaacatcgagtccaagctttgattgaaggttacgggagaagggtggaacactggaacggggcatcggtagtggtcagaataacacattattacacatcatctcaagtttggagagtctgcagataaaataaacctgaatgtgccatatagatcaacttttatcacagtagaaactcatttctgtttatacgtggaattgtattcatttttaaataatatagcattgcc

SEQ ID NO: 3885 - DNA, 658 bp, Sorghum bicolor
  Clone ID: SORBI-28MAY03-CLUS67604_1
gtgaccgcaaccctacctacctccccgttctgcccctcgcccccacccatggcgacgccagccgccgcgccggccccaccaaaccctaaccctgtccccgacgacccgccgctgcagcagcagcacgaggaggaggaggaagagtcgccggagccagagccggagacggcgccgacgtccctcaccacctcgatcgaccccaccccttccggcggcgaggagagcgagagcgatgactcctcgtccgtctcctcggcgccctcctcagcccccgctcccgcccccgcagcggcggcggccgcgacgccttcgcccgctgccaaggacctcctccacatctccttcaaccaggactacggctgcttcgcggcgggcaccaagtcgggcttccgcatctacaactgcgaccccttccgcgagatcttccgccgggaccttgccgccgtgggcgacggcgctaccggcgccggcgtcggcggcggtgccgggggagggggtatcggcgtcgtcgagatgctgttccgctgcaacatactcgcgctcgtcggcggcggcgataatccccactacccgcctaacaaggtcatgatctgggacgaccaccagagccgctgcatcggggagctctccttccgctcccccgtacgaggcgtccggc

SEQ ID NO: 3886 - DNA, 715 bp, Sorghum bicolor
  Clone ID: SORBI-28MAY03-CLUS67228_1
ctgggttgctcacagttgggtgcactgtgcttctcggcctctcgtaccaagctccaagctagctagctctcacggtctcaccagcacccgcgatgtcatcctcctcgctgccacacgtcgtcgaggacatgccccatgtcctccagcttctcagcgatggcacggtggtccggttcgccgactacgacacgctccctcctccgtccgtgcctcccgcgctgcccgtccagtggaaggacgccgtgtacgacgccacccacgacctcaagctccgcgtgtacagaccgccgccggcctcctgcggtaataacaagctgcccgtgctcgtctacttccacggcggcggctacgtcctcggcaccttcgcgctgcccaacttccacgcctgctgcctccgcctggccgccgagctcccggccgtcgtcctctccgccgactaccgcctcgcaccggagcaccgccttcccgcggccatcgacgacgcggcgtccgtcatcgactgggtgcgcgctcaggccgtggacgcggcgggaggggacccctggctcgccgagtcggctgacctgggccaggtgttcgtcaccgtggactcggccgggcgggaacatcgtccaccacgtcgccgtccgcctcgcctcggcatcggcatcgggcgagctctcccccgggctcgacccggtgcgcgtcgccgggcacgtcatgctctgcccgttct

SEQ ID NO: 3887 - DNA, 590 bp, Sorghum bicolor
  Clone ID: SORBI-28MAY03-CLUS67247_1
cccgctcttaccaacactccccccaagaagcctgagcagcccaagaaagaggccaagaaggaggccgcccccgccgctgaggctgctcccgctgctgaggaggctcctgctgcccccaaggccaagcaccctctcgaggctctcggtcgcccctctttccctctcgatgagtggaagcgccagtactccaacatcaaggaccacaacgaggccatgaagtacttctgggagaacctgaacttcgaggagtactccatctggaaggttgactacaagtacatcgtcgggcgtgcccccgccttcggcgcgaacaacctctccggcggcctcggcgcccgcctcgtccgtgcccgcgagcacgtccccgcctgcgctgccgcccccggcggggacagcgactccgtcgtccagcgcgcccccgccatccccggccaccggcacgtccccgccgtcgctggcgcccccgagtggcccagctccatcttcggcaagctcgacccccccgcccccggccaccgcctcttcgtctcggatgcctggggctgggagaagcccatcaccgtgaacggcaaggagtacaagcttgctga

SEQ ID NO: 3888 - DNA, 618 bp, Sorghum bicolor
  Clone ID: SORBI-28MAY03-CLUS67256_1
agttcgccaccgtccgcgacgaggtctggctggagagcttggccgccgccgcaaaaccaggcctggcaccgtcgatacccgccggtcgtgacattgatgagctctagaatgctataggaatacaggatacacgattgcaaaaatgcatgggtacgaaaggtatccgtagcatttgttggttatgacttcctcatgtcagaaatatagtttcaccaagattcgttccaagtcaagccgttgactctatcaatatctaagttttttttactgtatatagattgacaaggttagtattactagattgactgtatcaatatagattgccaacaagatggaagggaaggcgtcgcgctgtaccctgggcgggacggaggcttcgacgtggaggtggcgatgctgccggtgccggagcacatggcggcgctagaggaggacgaggagctttgggccgccgtgtcgccgaacgcggcgccggccggccagggccacgaaagaatgaaacctttttagcccacaaaatgctctctccaacgtgaaaaatgttgtttaatttgaatcacatgtccgctttttcgtttgttgcgtgtacttttaaattttaatcaaattgatgatcga

SEQ ID NO: 3889 - DNA, 630 bp, Sorghum bicolor
  Clone ID: SORBI-28MAY03-CLUS67265_1
caacgtctctttccccgagctcgaggagattggtggcggtttcaccatccagaacaacactaagcttcttgccatcgatgacttccccaagctcgagaaggtcactggtggtgttgctctccgcggcagctccgagaaggtcaagctccccaagcttgagcaggtcagcggcagtgtcgtcgtttcttccactaccgatatcgaggagttctgcaagtttttcgacgacatgaaggatgacaagaagattgatggtgaggagaagtgctctttcaacaacaagaacgccaacaagggtgaggacggtggccagaagagcgacggttccggttcttcccaaagcaacgaggacgacgacagtgccgccggcagcgtcagcatcaacatggctgtccttgcccttgctggtgtcgctgccgttgcccagctcttctaagcatagacgaggcaaaactgttggcttttccttttttcaaggcgtcattctttgtcgtcatcatgttttccgactcctctttacgacatattgtgcttggtcatccctcacggggcacaaattgcttttcatgggggcggtaactgcgtgtaaaggataacctgttagagcttaataatcgattgcattggact

SEQ ID NO: 3890 - DNA, 620 bp, Sorghum bicolor
  Clone ID: SORBI-28MAY03-CLUS67700_1
tgccgccgccgctggcggcggcggcggcagcggcgcccgctgaccccgtgacggagaggctccaagaagccgccgctgcccggcgcaaaacggaaggcgcggccacggcacacgcccggcgcgacgactactggagcccacagctggacctgccgtcgtcagcttctccgccgagcattcaccagaggggaagggacactcccgctccccagggccacggccgcaggcgaggagcagcgggtgaggcggccgccggcgccgggaggaagggcataagcatcgacctgacggcgccgctgcttctggggatagtcgcggcggggttcgtgggttacaacggggagaaggttgccggaggtggcagcggcattcaggagcatgttggcggcgccgttgctcttggagtcgtgaacagttttgaaatgaaggtcatgctggccggggtgacttggttcatcatcggcgcagccattgccggtgtgattcaggtacttggaagaagggaagagaacatttggaaatgaagatactggtcgaatccgtgtgtgtgtatacagaatacagaatagtgtacatatgtaatcctgcatcctgcataaatataggtgcctggctgtttg

SEQ ID NO: 3891 - DNA, 533 bp, Sorghum bicolor
  Clone ID: SORBI-28MAY03-CLUS67704_1
gaggacaagcggctgcaggcggacgtcgtcatcacgccggtggtgaagcagctcctccccgccaacttcaccctcgtctccggccaggaggacgccgtcgacctggccaggctgctgcgagccaggtatgtggtacccatgagcaacggcgacgtggacgccggcggactcctggcaaccgtgctcaccaaacaggggacgacgcagtcgttccaggccttgctgtcggaggcgcttccccaggcgcaggccctcgaccccacgcccggcgtgccgctccaagtccaactgcagctggacatcatcatggatcgatgatgggcaatagcatctactcctacatatattatatacatccattctcagagtttagggatactgctctctctctatatcagggagtattcatataacagcataatatatcagccagaatgaggattttatcccagctgcggccccatgtaaacgttaactcctgtaacttttattcattgattgcccccccacaaatgatccacatacatacaaat

SEQ ID NO: 3892 - DNA, 679 bp, Sorghum bicolor
  Clone ID: SORBI-28MAY03-CLUS6772_1
ctccgcccccttcgcccttcccgacgcgccgcccgaaaccctagctccaccgatctatctctctccatcccagcccagccagggggaggagatggcggcggcgccagcggcgggagggcagggcggcgtgggcatggacaccgcgctcgtcgacgacatcatccgccgcctgctcgaggtgcggaccgcgcgccccgggaagcaggtgcagctctccgagtcggagatccgccagctctgcaacgtctcccgcgaaatcttcctcagccagcccaacctcctcgagctcgaggcgcccatcaagatctgcggtgacatccatggtcaatacagtgatcttctaaggctttttgaatatggaggctttcctcctgaagccaactatctattcttaggcgattatgttgatcgaggcaaacaaagtttggagactatatgccttcttcttgcttacaaaatcaagtaccctgagaacttttttcttctgaggggcaatcatgaatgtgcctcgataaacagaatatatggattttatgatgaatgcaagcgtcgatttaatgtgcggctatggaaggtcttcacagaatgttttaacactctacctgtggctgctcttatcgatgataaaatattatgtatgcacggcggactctcccctgtctagcacacttggtgagat

SEQ ID NO: 3893 - DNA, 911 bp, Sorghum bicolor
  Clone ID: SORBI-28MAY03-CLUS6773_1
ctactgggtcttgggtcgcagcgcagccgacgctttttcctcctcccttctcccggtcccggtccctgtcttcttcttcttcttcctcgctgcagctcccgccgacgactcctcgccgccgttgaccgaaacgcctcccccatctctcgtcgtctcggaacggccgccgtcgcgtcaaggattcaatccgagggtggggagctgagttgggaggaggactgctgcagccatgaaggccctcattctcgtcggaggcttcggcacccgcctgcggccgctgacgctcagcgtgcccaagccgctggtggatttcggcaacaagcccatgatcctgcatcagatcgaggctctgaaggaagttggtgttacagaggttgtcctggccatcaattaccagcctgaggtgatgctcaattttctcaaggacttcgagagcaagcttggcatcaagatcacctgctctcaggagacggagcccctcgggaccgctgggccgctggccctggcccgcgacaagctcatggacggctccggcgaccctttcttcgtgctcaacagcgacgtgatcagcgagtacccgttcgcggagctcatcgagttccacagggcccatggtggcgaggccacgatcatggtgaccaaggtggacgagccgtccaagtacggcgtggtggtcatggaggagggcaccggcaaggtggagcggttcgtggagaagcccaaggtgttcgtgggcaacaagatcaacgccggcatctacctgctgaacccgtccgtgctggaccgcatcgagctgaagccgacgtccatcgagaaggagggtttccgcgcatcgcggcggaccagggcctcttcgccatggtgctcccagggttctggatggacatcgggcagccgagggactacatcac

SEQ ID NO: 3894 - DNA, 568 bp, Sorghum bicolor
  Clone ID: SORBI-28MAY03-CLUS67741_1
caccgtccctgactgccacttcaccaccaccaagcccattgttcccaccggctacactccccctaagccttccactcccgctgagaacaagggctgtgctgagaagtgctacgacgcctacaacaagtgccgcactggtgctgacgccaacatgtcttactgcgctgctacctactctgagtgccttggctactctcccttcaacggtgagggttctctcgtcacccccactgcctgctctgtcgctcccgttgccaccaagcccgttgctactgctcccgttgcccccgctcccggctacaacccccctgccggcaccaagcccgctggtgctcctcctgctactaccccccctcacgtcgtcactgctggtgccgcccaggttgtccctgctggtatcattgccgtcgttggtgcccttgccatgctctaaatggttaatggtgtgattactggaggagaggagaggaggtggatggtggacttttaacttcatccatgtgtaataatttgtgctagatctaccgcatatacatttatagacaattgaaatacgatttggtgctcg

SEQ ID NO: 3895 - DNA, 727 bp, Sorghum bicolor
  Clone ID: SORBI-28MAY03-CLUS67744_1
aaaaaaaaacgcgcctccgaacaccgacccaacccagatccaccctgttccgtgtgttacccaacggcggcgctacccctgtcgtcgtcttcccgcacgcgtccgactcgtccgagcgccgccctcccccggcccccagcctccaacctccagcctcccctccccctcatctccgtctcccgcgccgcctacgaggtagggtaaggtcttagggttccggcaagatgggtgaacgtaaggtgctgaacaagtattacccgccggatttcgacccgtcgaagatcccgcgacggcggcagcccaagaaccagcagatcaaggtgcgcatgatgctccccatgagcatccagtgcgctacctgcgggacatacatatacaagggcaccaagttcaactccagaaaggaggacgtcatcggagagacgtacttgggaatacaaatatttaggttttacttcaagtgtactaagtgctctgctgagatcacattcaaaacagatcctcagaattctgactacacagtggaatcgggggctagtcgcaattttgaaccttggcgtgatcaggatgaggcagcagacaaagaaaagaggaaacgagatgctgaggagatgggtgatgcaatgaaagcgttggaaaatagagcaatggattcaaaacaggatatggacattcttgctgctttggaagagatgcggtccatgaagtctagacatgctggtgtctc

SEQ ID NO: 3896 - DNA, 695 bp, Sorghum bicolor
  Clone ID: SORBI-28MAY03-CLUS67752_1
atagtggggcagaacagggacagaggagcttagcagtgaccgtcgcccaggggccagcggcagcggcggaggggctatccatgctgctccggctgaagatcgtcggcggcgtccactcggtggtgcttccagttccaggcggcggctatgacatccatggcggcggcgcctgctacgcggcggcagcgccctgctgctggcgtcgcagccggcgtagcgtcgtcgcgaggcggccgaggagggggagcgccacggtggtggtgatggcgctcaaggaggagcccgacggcagccgcagcggcttcgccggcggcggcgggccgagctgggaccccgggctggagatccaagtccccttcgagcaaagaccggtgaacgagtactctgctctcaaggatagcgccctctactcgtgggcggagctcagcccaggctccttcttcctccggctcggcggcctctgcctgatcaccttcactgtcctcgcagctcctattgcagccgcaagcttcaatccaggaaaggatccactcaagtttgtgctagcagctgggatcgggacgctgcttctggtgtcattggtggtgctcaggatctatctgggatggagctacgttggtgataggctgttgtccgcggtggtgccgtacgaagaaaccggatggtacgacggccaaatgtgggtaaagccacca

SEQ ID NO: 3897 - DNA, 643 bp, Sorghum bicolor
  Clone ID: SORBI-28MAY03-CLUS67440_1
ttttcagggcccctggtgttttgagaactttgttcaatcaagatcattgaggagagcccaggatgtgaggaaacaacttctcacaatcatggacagatataaacttgatgttgtatccgctgggaaaaacttcacaaagataaggaaagcgatcactgcaggcttctttttccacgccgccaggaaggatccccaggaaggatacagacccttggtcgaaaatcagccagtgtacatccaccctagcagcgcattgttccagcgccagccagactgggtcatctatcatgagcttgtgatgacaacaaaggagtacatgagggaggtgaccgtgatcgatccaaaatggcttgttgagctggcgccaaggttttataagggtgctgaccccaccaagatgagcaagaggaaaaggcaggagaggatcgagcctctgtatgatagataccacgagcccaactcttggcgtcttagcaagcgccgagcttgattgtaactcactgaaactgtgtactgtatgttcttcagtgctggttgatctatttccatgtcccaacttcaagttccaactaacaattttgtcgaaactgtaaatatttgtgaattgacacatttaagcatctctaaggccctgtttggcatg

SEQ ID NO: 3898 - DNA, 612 bp, Sorghum bicolor
  Clone ID: SORBI-28MAY03-CLUS67457_1
tgctgctgcactcggtgctccagtccagtccacgccatggcttcccgcgccactctcctgccgctcttcctcttgctcctcgcggcgcccgcgctcgccacctccggcaccatcgtcttcaccacgctcggccggagccgctacgccttcgacatcttcgcgctcccactctctccgctctcctccgccgccgcctccgcggagctccgcctcaccgacggcgtctccgttaactacaacggcaacttcgcgccctcctcctcctcctcggagccgccctccctcctcttcgtctccgagcggaacggctcactaaacctctaccgcacccccgtccctctttccgcctccgccgcccgccgccgcgaggcgctggaggaggaggacgactcgccgacgctcacgccgctgctcccgtgggaccccatcgcgctcaaggaccggccctcgctgacccccgacggcgcccacctggtgtacgtctccacggcggagcccgcggggtccccgcgccggagctgggcggcggtgtactccacgagcctagcgtccggggccacgcgccgcctcaccccacgcggcgtcgccgacttcagccccgccgtgtcgccg

SEQ ID NO: 3899 - DNA, 691 bp, Sorghum bicolor
  Clone ID: SORBI-28MAY03-CLUS67462_1
gatcatgcttgatgctgcccctgaaaggaccatccacactgatgtgctctttggtttgctgaaacaacttattaagcgcagatctgatatgaggcttattgttacttctgccacccttgatgctgagaagttctcaggatatttcttcaactgtaacatcttcacaattcctggaagaactttcccagtagagatactgtacactaaacaacctgaaagcgattacttggatgcagcattgattactgtgctgcagattcacttgacagagccagaaggagacatccttcttttcctgacagggcaggaggaaattgatcatgcctgccaatgtctttatgagaggatgaaggggctaggcaaggatgttcctgaactgataatcttgcctgtgtatagtgcccttcctagtgagatgcaatcaaagatctttgacccagctccacctggtaagaggaaagttgtggtggcgaccaatattgctgaagcttctttgacaattgacggtatatactatgttgtggatcctggttttgctaaaatcaatgtgtataattcaaaacaagggcttgattcattggtcatcactccaatatcgcaagcgtccgcgaaacaaagagcagggcgcgcagggcgtactggacctggcaagtgttatcgtctatacactgaaagtgcctaccggaatgag

SEQ ID NO: 3900 - DNA, 676 bp, Sorghum bicolor
  Clone ID: SORBI-28MAY03-CLUS67513_1
atcgagtccccctgcgtggcccaaatccgagcgactcgcgacttcgcacacggccgccggcgccgcacccgcactcgcactcgcatcccacacccgccgccgccggccgccccacacgccacaacctacctcctgacccctggccccccgctccgccgccctcccccgcccgccgcccccccaccccccggccgcgccgcccgccgccgcggcctgcccgccccccgccgccccccccccgccccccccccgcccccccccgcgctgcctgccccgcccgcccccggcctccccggcccccgccgcccagcgcctgcaggcccgccccctcggccgcgctcccgcacgcgcaaaggtagttgaatggcttccagtgcacggggcatcatgtttcggcgtctcaaaacactaactctaagcccagcactggcatctggtgcgaccagtcagcatcaccagcttcaacagcgtgcaccagtgagtggcacagccaaaggaaaggctaagctcaaagcaggtcagccgttgaagcgttccaccatcggagcgaagaaaggggcaccttccactggtggaggcgggcggtggccgtggtcgtcgtgaggccattgagcgcattactaatatttcagagtcttgtctcaatgcctctactccgctgcggcacttgtccccc

SEQ ID NO: 3901 - DNA, 775 bp, Sorghum bicolor
  Clone ID: SORBI-28MAY03-CLUS67778_1
acaccaccgacttcaccggagcaggaggaagcgtctgaaagattcggcaacgcttcatgtgcctgattggttggttgcgcgggctcgcgagcccctggcgccgtcccccgggcgctcgccccgggcgcaccgccacctgccctctcgtcttgcgggcctcgtgccgtcaccttgtggtggtcgagtggggtctgtccccttggcgtagtcccggggtgggcgtcccgagatgtctaatctctcagacccctcaaaagaagatacttcacctgaaggttcaggtactacccagagaactggagcctggagtaacacattgaacactcttctgcagcaagcctcagtctgtggtgtggctgccgggtattgtttatcagcgtcgctgctctccatcatcaacaaatgggcaatcatgaaatttccatatcctggagccctgacagctctgcaatacttcactagtgttgctggagttctcctatgtggacagctcaagctcattgagcacgacggccttaatctgaggacaatgtggaagttcttacctgctgctgtgatgttctatatctccatcttcacaaatagtgagctcctgcttcatgccaatgtggatactttcattgtgttccgctctgctgtgcctatatttgtcgcgattggggagacgctgtatcttcatcagccatggccatcactcaagacatggctttcactttccacaatacttggtggaagtgtgatctatgttttcacagacaaccaattcactgtgact

SEQ ID NO: 3902 - DNA, 677 bp, Sorghum bicolor
  Clone ID: SORBI-28MAY03-CLUS67788_1
tggtaatgatttaaaaagttttggaaaattgtgatgacttatacattatgacccattatacaaactacccttaatcacaatttcagtcagcatccatacactacaactccactttgcttgactgagttttttcaatctatttaatcagaattgaattaactacttgacatcagagtcgcaatcattcgcggtccctacaaagcatggcaatgtgaagcattgttgtggagtcatcacatccaagacaagagaagaaaatcaccactcacaaggaaagggtttgccatagccatacaataaagtttccggatctccttattataatgttcctcgatttttattaaacaaggcaagcttatgataaggtccaagatccaactatggcaaacgaggcctttgatactacaatgaatgactctgattcgctgctatacattattttaattactattgatggattcaagtcttgtcaggagtctcaacataccaagaatttttgagaagattttaaaagtcttttgaggtaaaagaacaaaaacaacaaccaatacggtcttgctcatgatcccaaaaaagcatttgctggagtagctactgagcaagcccttattagctgcaacaaatttgtaaaagaaattttcagctgacctcttgtgtaaaataattaatatttcaat

SEQ ID NO: 3903 - DNA, 618 bp, Sorghum bicolor
  Clone ID: SORBI-28MAY03-CLUS67800_1
tactggaacccaagtgaccgtggatcagccttcagccatgcctgcgcttctcgtgaacaccgtctcggtctcccctgccgccccaaggccaggctcctcgtggccccccacgcccacggcacggcgagcaagcactcgccacaggtgccgagccgaagcatccggcagcggcaccaacggcggcgacagcggctacaggccggggggcgtccgcggctcgtgggtgtcggactacgacctgtacgagctgctgggcgtggagcggtcgtcgccgcagtcggagatcaaggcggcgtaccggtccctgcagaagcgatgccacccggacgtggccggcgccgcgggcgggcatgacatggctgtcgtcctcaacgaggtgtacgcgctgctctccgaccccgacgcgcgcctcgcctacgaccaggagcaggcgcgccgctccgagttcgccggctacacgggccgcccgctctactcctcctggctgggccccgagtccgagcgccgggcggtgttcgtcgacgaggtgcgctgcgtcggctgcctcaagtgcgcgctccacgcgtcccggaccttcgccggcgagtccgtctacggccgtgcccgcgccgtcgctca

SEQ ID NO: 3904 - DNA, 643 bp, Sorghum bicolor
  unsure (1)..(643): unsure at all n locations
  Clone ID: SORBI-28MAY03-CLUS67790_1
tgtccccgtaaagaattttctggaactgttgttgataaaggagatctctctccacattggcaaggttctgactggaagacctcgagggtcaaatgggacgaagccacaaactttaatggccctgagagggtttcctcttgggaaattgaaccatttgatgcatccgcacctgccatcaacatacccgtgcaaccatcaatgaaaaacaaaaggcctagggagacagctgaaagcctggatattcatgcgctggaacctgctcaagaattctggctctctggaaggcctgaacagcataagacaagtataagctccaacgaacccaattgtatatctgtacatcaagtcgcttggacaagtgaacgcccaggatacagtgccatgagtagttcaatttgtcagaattctgcagtaattgggagctggttcaaggacttcaattcctcaagcaaaggggcctccccttccttgccagagatttctcagaaactgtttcaagtcaccagcaacgacgcaagggttcctccttggcctgngctctctgcttatcaagctgaggagctctcttccaagttgtcctgcaacactgctctgtgcagctaccagactgaggaggttgctccaaagttttctattgctgtcg

SEQ ID NO: 3905 - DNA, 535 bp, Sorghum bicolor
  Clone ID: SORBI-28MAY03-CLUS6781_1
ataaaaagcctcagtggtctgcaagctgtggatggactgaaagtaactgcatttcaactctagttttttagacattctataaaacattgggatcttatagtttgtttcttctatggtcgtagctgatgatgctagattgatggttggaattcattggtatggctatgggaattgggagaaaatacggttggatccaaagcttggcctggcagcaaaaattgcaccagcaacacttggtgagagagagacatttttaccacgtgctccaaacttggataaccgagctagtgctctcctgcaaaaggtatctcttttgaaccagaggtgaacctctggtttatttttaaatgtacatgggatcatttaactttctggacactcctcctttcttgatatgctaagtttaatggtctaatttataaactactaggaaatgcccgccagacagtcaatatcatcagtaatagtggagctcgatcaatgaggggccgacaaaaggatgtaccagagaaagaggataataaaccgaacaaag

SEQ ID NO: 3906 - DNA, 672 bp, Sorghum bicolor
  unsure (1)..(672): unsure at all n locations
  Clone ID: SORBI-28MAY03-CLUS67816_1
ctggctattgattccctccacctgtcccctcccctctcgcgtccccccccgcctcctcctcctctagaaagcttagcttctctctctgctgctttctattggttcctcttctgttcctagtcaagcagcagtagtgcttcaagcttgatcgatcagccatggtggagcgtagtgtgaaatcagagcatggagtcgacctgttcctgcctcctggcttcaggttccatccgacagacgaggaggtcatcaccagctacctcctgcagaagttcttgaaccctagctttgcgccgcacgccatcggggaggtggatctcaacaagtgcgaaccatgggatctcccaagcaaggcgaagatgggggagaaggagtggtacttcttctgccacaaggacatgaaatacccgacgggcacgcgcacgaaccgcgccaccaaggagggctactggaaggccaccggcaaggacagggagatcttcaagcagcctgggcgtgagctggtggggatgaagaagacgctggtgttctacatgggcagggctccaacgggcaccaagaccgactgggtgatgcacgaatttcgccttgatggcaagtccaggcacaccaacgactccnactccnatctacgattcaatcccaaggatgaatgggtcgtgtgcaaggtgcacc

SEQ ID NO: 3907 - DNA, 653 bp, Sorghum bicolor
  Clone ID: SORBI-28MAY03-CLUS70881_1
gagtcacattcatcgtacactgacgctacattctcgccggctcaagcacctaacccctccgcggcgcatcttttatagctccccggaaacaattaatcctatcacggctttgggggatgtcgacgcatatctcgtcctagagcggcatccatttattttatgtacatatcggtactctacaccaactagtcgccctcctcttggtgctctttcttcttcctcttccttcttatcctttcatttccacatcttctttctccttataacccttgcctccatctgtaaccactaattacaccgtcgacaacctccacgactctatactcacagcactcttcgaagctgttgtggtcatgtgctgctagtctcgttctgtaacaccatcgatatggcactcctcaatcctgtgtacgccttcgtcgtgcccttcctgtttgttgtcacggttccgcttgctgtcttcgctgggatcacaactactatcgccttctctgttctcattctccgagttctggctgtgtatctcgacgttgctctctctttcgttcctcattatttgggtggacgtaagactcgcccttaccatccaaatacttatcatcctcatcatcaccaaatcctcgacccgggacctgcggcgctctataccaatc

SEQ ID NO: 3908 - DNA, 645 bp, Sorghum bicolor
  Clone ID: SORBI-28MAY03-CLUS70888_1
ccctcagcttcaccaacctctctccactcccatctctgatcgctctttgtcatctggcaagatgttcaagagcggcatttcctccttcgcccgcgcggctcgcccggccgtcgtccctcgacgtgccctccgaccttcatctctccgactccccatctccagccgatgggcgagcactgccagcgtcggcaccggcaagattcaccaggtcatcggtgccgtcgtcgacgtcaagttcgatactcagaagctccccgccattctcaactctcttgagactgagaacaatggccagaagctcgttctcgaggtttcccaacatttgggagagaacgtcgtccgttgcattgctatggacggtactgagggtctcgtccgaggtgcttccgcccaggacaccggtgctcccatcaccattcctgtcggacccgccactcttggtcgtatcatgaacgtcactggtgaccccatcgacgagcgtggtcccatcaagactgacaagcgccttcctatccacaccgaagcccccgagttcgtcgagcagtccacctctgctgaggttcttgtcactggtatcaaggtcgtcgatcttcttgctccctacgcccgtggtggaaagattggtctgttcggtggcgctggtgt

SEQ ID NO: 3909 - DNA, 599 bp, Sorghum bicolor
  Clone ID: SORBI-28MAY03-CLUS70892_1
tatgaagtgggttgtgccttttctggtggcctttgtgcccctggtagcggcacaaaatgcaacgaaagagttgttgaccaatctgcctgcctgtgctgctccttgctatgaagacgccatcaaaaagtcggactgtaactcgaccgatgtgaaatgcgtgtgctcaactcaagtcatcatccaaacagcagaggcatgcgccgcccaagcatgtcacgtcagagatagtctgacaacgctcaacatgacatacacctactgcgaagtccccgtgcgaaacaagacccccatcttcatcaacgtcacaatcgtcctcggcgtgatatccggcgtcgcaaccgccctgcgtctctggtccaaattcttctacaccaagaccgagctcggcctcgacgacctcttcatcgtgctcacgctcttcatcggcatgccctccaccgccatgaacatccacggaaccgccggccacggggagggccgcgatatctggacgctagagtttgatgacatcacaaagtttgggttctacttttggttgctcgagatattctactttgcgcaggtttcgctgctcaagacgtcgttgttgttcttttacc

SEQ ID NO: 3910 - DNA, 353 bp, Sorghum bicolor
  Clone ID: SORBI-28MAY03-CLUS7091_1
cggacgcgtgggccgatgacacagcggactgagataatatatcacctaacctagtgtacatacataacacattctgtgtaactagttagccgtcagctaacagcatcgtgcaggtctcatgcatctcctagtacagtcgaaccgctcaggggattaggacccatttcagtccaacaatcccttctgctgattttatatctgttgtaccatctgtacaatatactgtgtatatatactcgatcgttgggaggcctttcacccctaaatccaaaaacttttaagattcttctcaaaaaaaaaaaaaaaaaaaaaaaaaaaaaaaaaaaaaaaaaataaaaaaatttaaaaataaa

SEQ ID NO: 3911 - DNA, 640 bp, Sorghum bicolor
  Clone ID: SORBI-28MAY03-CLUS67963_1
agttccccatcacgctggacgaggcgacgagcgtgacggtgaagaggccggtggcggtacagaggagcaaggcggagaaggcgtccaaggtggaggtgctcgtcatcgacggcatcgaggtggacagggacgtggccgccaagttcgacgtgttcgtgaacaccgaggaccacgccgcggtgggatccggcgggcgggagctcgcggggagcttcgtgaacgtgccgcacgggcagggccaccgccacggccatggcaagaaggggagagggatcaagaccaagctgcggctcgcgttgaacgagcagctcgaggacctcaaggccgaaggcgacgagagcgtggtggtcaccctcgtgccgcgccaaggcaagggtaaggtgaaggtcggaggcgtcaagattgagctgatgcattgaagaattcgtttatctaccatgcaaaaataagcagtttctttccgcggaagccgaaagattattgcaataagtggattggcagcagacattgctttgtgagtttgtgttgcgtctgtctaggatttgaattttatttttatttttatttcggggtctacgcggaactgtccaagttgcatgtgttagtttgaattggaatagattaacaagattgcttcaca

SEQ ID NO: 3912 - DNA, 611 bp, Sorghum bicolor
  Clone ID: SORBI-28MAY03-CLUS67949_1
atacattaaaaaaatttttatcctaaaaagatatgactgaacccaggcaaggcttacaagccactgccatcggtatcgatctcggtaccacctactcttgtgtcggtgtctggatgaacgacagagtcgaaatcatcgccaacgatcaaggtaacagaaccaccccttcctacgttggtttcactgaaagcgaaagacttatcggtgatgccgccaagaatcaagtcgccagaaaccccgtcaacactgttttcgatgccaagagacttatcggtagaaagttcgatgatcccatcgtccaaaaggatatcaagctctggcctttcaaggttgaagctggccctgatggcaagcctttgatcgctgttaagtacaagggtgaaaccaagaaattccacgctgaacaaatctcctccatggtcctcaccaagatgaaggaaactgctgaagcctacttgaacaagtctatcaaggacgtcgtcgtcactgtccccgcttatttcaacgattcccaaggacaagccactaaggatgccggtgtcattgctggtctcaacgtcctcagaatcatcaacgaacccactgctgccgctatcgcttacggtctcgac

SEQ ID NO: 3913 - DNA, 663 bp, Sorghum bicolor
  unsure (1)..(663): unsure at all n locations
  Clone ID: SORBI-28MAY03-CLUS67979_1
cttaactgatagagtggtagacattattttccatgtgttcgacacaaatcaggatgggaacctgagctcggaagagttcttaagagcattacaaagaagagaaaatgatattcgtcaaccaacaataccaggtccattggggttcttgtcttgctggttcagcggtaggaagtgttcttcacttcaacaggtggttctctgattgagacccctatttgattctcactgtatccgtcattcgcctttgattgtcatctcccggcgcagaaggtaatcaccaagcagtgcattgctgatcgctgatcgttacggcgactttgtatatgtcgtttgcagcagctgtaattgtaaatagtgtactgtgcagccctaggactgagagatcccttgtgttattctcatgtgtaaagtaaaccccatatgacctcaatatatgaaaccttgtcaaatgtagtagaccatagcgttagagtgccaaacagaccaaccaggtagcaggtaacaaccagccatttacgtgaagacaaganagacaatttcttttcttttttcttttttcttctttcttgtgagctgtctgaataagaaaaaatccaaatccaaatcctatcccattgacataactgtaatgggagaagaggaattacataggcatattcatat

SEQ ID NO: 3914 - DNA, 673 bp, Sorghum bicolor
  unsure (1)..(673): unsure at all n locations
  Clone ID: SORBI-28MAY03-CLUS68012_1
ctgcacccgcgcccagcttatatatatcgcatcgtctccgaagctgctagcccattgcgttctgcaagttttaccccggacatggcctccatngtcgccatttaattggctaangccagctccagcttgccaccntttcctnnctatcctctccgatgagaacganngctccggctttaggggcctcgccgcgtcaccngtccagcngcgtctcgtggcgcatcgnccaagaggcngaacgctcncgagcatgacgccccaaagcacgaccgccgcgacgtcctcctgggcctcggcgcgctcagtgccagtgcgaccgccaccctggtgaccgcgcgccgcgccggcgccgaccccgtcgccacgcccgacatctcttcctgcggcccggcagaccttcctccgagtgccaacgtgctgacgtgctgcccgccgccctcgaacgcgctgccggtggacttcgccctccccgacgccacgtccctgccgctccggacgcgccccgcggcgcactcggtcaccgcggactacgtcgccaagttcaacgccgggatcgccgcgatgaaggcgctcccggcagacgacccgcgtagcttcgcggcgcaggcgaccgtgcactgcgcctactgcgacgggtcgtacagccccgagggtttccccgacgtggagctcc

SEQ ID NO: 3915 - DNA, 602 bp, Sorghum bicolor
  Clone ID: SORBI-28MAY03-CLUS68023_1
agcagcagcagccagcaggaagcatcgaccaatcgatcggcgatcgatagatcgagctggttattcgatcggcttattatggcggtggaggcggttcttgatgcggctgcggcggtgatgccgtcgccggcgccgccgagaggcaggggggacgacgtcgtcgtggtggtcgtggtggctgcagctgcagcggatgatcaggtcgccaccacgagcggcggcggcggcacggcggcagaggaggaggaggatgtcaacgccgtggtgcagcaggaggagcatggccaccaagggttggcgaagcggaagaagcgctccaggcgccgccgcgaccgggagcagcagcagccccccacccctacccagacacaggaggagtacctggcgcagtgcctcgtcatgctggccaccggccgccgcgaccgcgacgtcccggcgcccgcgccgccgcaggaccacgcgtgctccgtctgcggcaaggtgttcccgacgtaccaggcgctcggcggccacaaggtcagccaccgcaccaagccctcgccggcgccgacgacgcctggcgtaggagatggggatcaccaccacgatgaggaggagaagaa

SEQ ID NO: 3916 - DNA, 682 bp, Sorghum bicolor
  unsure (1)..(682): unsure at all n locations
  Clone ID: SORBI-28MAY03-CLUS67759_1
atcccgacaagaccactctcgttcacagtccaactttttcgtgctcaataaacacttacactcgcttaagcttattccagcaccaaaaccgtcaaaagcgcgtgcatcaagtctgcctccatcgccagcgtcctcgtcggcgctgccaccgcctctccctactatgctcccccctccaacgagaccgtcaagtacaccactgaggtcgtcactcacctgaccacctactgccccgaggccaccactctcacctacggtgagaagacctacaccatcactgaggccaccaccctcaccatcgaggactgctcttgcaccatcaccaagcccgttgctaccggcactggctatgctcctcctcccaagcccactcacgccaaggactgcgctgagatgtgctctgacaagtatgatgactgccgtgtcgcccccaacgccaacatggccacctgcgctgctgagtacgctgcctgcttgaactacaacccctgggagagcggcaagttcgtcaagcctacctcttgccacgctggtggaaagcccactgctgtctacaccactgaggtcgtcaccgctgtcaccacctactgccctgaggccaccaccctcacctacggcaacaagaccatccccgtcactgctcccggcactgtcaccgtncctgactgccacttcaccacca

SEQ ID NO: 3917 - DNA, 676 bp, Sorghum bicolor
  Clone ID: SORBI-28MAY03-CLUS67763_1
gtcccccatccagccaacacacgcagacacaccggcgaggcagacaggcaggcagatcagccgcacctcccccagttccccgccccacctacgacgactgccgcggccgaatcaaaacagcttcctcctcccggcgtcgactccgcgcgcggaggctccgatccattccgccgccccgtagggttttgctcccccgatccgggcgccagatctcgcgtggcgacacgcggatctggggtttctctagcggcggcggcggcggccggagcaggaggagatggcgctctcggggatgcgggggctctccgtcttcatcagcgacatacgcaactgccacaacaaggagcaggagcgcctccgcgtcgacaaggagctcggcaacatccgcacgcggttcaaaaacgagaagggcttatcaccatacgagaagaaaaaatatgtatggaaaatgctttacatttatatgctgggttatgatgttgattttgggcatatggaaactgtctcgttgatatctgcaccaaagtatcctgagaagcaggttggttatattgggacatcttgcttactgaatgagaacaatgatttcttaagaatggtaataaatacagtacggaatgacataatcggacgaaatgagactttccagtgcttagcattgacaatggtaggtaac

SEQ ID NO: 3918 - DNA, 673 bp, Sorghum bicolor
  unsure (1)..(673): unsure at all n locations
  Clone ID: SORBI-28MAY03-CLUS67773_1
ctctctctccctccctccctccctcccacctggtcctgggtgctggcccccctccccctccaagcttcaaggaaacatcccaagcgcttctcttcctagtgagaggagactaaacgcgattaggagcagcgaatcatcatatactagtagcctagttagagttggatctgagtgagcaatgggggaggagcaggcggcgccaaagccggcggaggccgcggccgcggcgttggagctgacggggttcgtcatgagcgcggaggatgccgagcgccgcgccgcggccgccggagtggcgaccgtgcaggacctgctgccgcttctgatcccgtccgcgaggaagcgcgcgcaagtcccgatctcggacttccaagtgggcgccggggggctgggcgccagcggccgcgtctacgtcggcgtcaacctcgagttccgcggcgtcccgctgtgccactccgtccacgcggagcagttcctcgtggccaacgccgccgccgcgggggagtccgcgctgcgcgccgtcgccgtctcccacatgccctgcggccactgccgccagttcctccaggagatccgcggcgcggcgggcatccagatcctcgtgaccagcgacgccnagcagggccgcgcgcccgagtggcgcacggtggcgtccctcctcctccgtcccttc

SEQ ID NO: 3919 - DNA, 653 bp, Sorghum bicolor
  Clone ID: SORBI-28MAY03-CLUS67776_1
gagaaccgagggacagggagatcgatggccgcgccagacccgcccccgcggccagggaagcccccgctgccgtggcgcgcgcggctgcttgtgggcgccgcctccgcgctgcacgccgcctcgctccgccgcgatggcaccgtcaaccgcttcctgctctccctcttcgaccgcaccgcggcgctcaccccgacggcccccgtcggcggcgtggcatccacggaccacgccgtctccgaccacctgcacacccgcatcttcgtcccggagatcccaggcggcgggggcaaagagctcccggtggtcgtgtacttccacggcggcggcttcgtcttccactccgcggcgtcggcgcagttcgacgagctgtgccgccgcctagcgtccgccatcccagccgtcatcgcctccgtcgactaccgcctcgcgcccgagcaccgcttcccggcgcagtacgacgacggcgaggcagccctccggtgggtcctcgccggcgcgggaggcgcgctgccgtctccccccgccgctgccgtcttcgtggccggggacagcgccggcggcaacgttgcgcaccacgtcgccgcgcgcctccccgacgccgtcgcggggctggtccccgtgcagccattcttcagcggcgaggcgcccacgga

SEQ ID NO: 3920 - DNA, 1004 bp, Sorghum bicolor
  Clone ID: SORBI-28MAY03-CLUS6806_1
ggccccgcgaggtaagcactcttttaccactataaatattctatcttcagtatttattttagcatttactttccagcatttaatttttgtcaaattagaataattagaattagtatttaattttgctatgtattgaaaaaaaactaagtaattacttagtactataatttaaaattctcttttaaattatatgaagtttatctacctgataatttattctgagaactaaattctgtgggtagccaaaaacttgtgattcagtctaagtaattggcagatatgatataaaaaggttgagctagtatacattttattgtaagtgatagctaagctccagacattttgcaagaattaaattaatcaatctataattcatcttgctaataagatttgagtagactattttgttatacattcatgattgaatccacaggcataaaaataatttttgctctatgcagcaaattctcccttccgagtctaaaagagaaagtgggctataagattaaaagatgacataccagagaaatatgagcctaaaagatgtcatgccaaaaaggtatgtgccaaattcaaaacaaagagagtaaaataataggtgcaaagacacccgcctgagagaaaaaaatagggtacaaaagtatccgctggtgagatagcccacatatctcacaaggcagaaaagagaaaatattgcataagaatttgaaaatataaatttaaatcactagaacattcaatcatgatgtatagcctagtagtccactgcaatcttattagtagactctcattgttttaaaattaataagacctctggagtgctgcaggaacaaagaataaaatatatgcgatgctcgcttgcttattctatctttcaattatctaagatttgattaaagttgaagaggtcccacgttgaaaggaataagaataagtttgaaagatagatggatgaattataatccaaagatgaattttcaaattcagcactcaactatttagaa

SEQ ID NO: 3921 - DNA, 671 bp, Sorghum bicolor
  unsure (1)..(671): unsure at all n locations
  Clone ID: SORBI-28MAY03-CLUS68080_1
cataaagaacctacagtgccaaaggaggtcaaacctaagagcgggaaatcatctttgaagggaaaaatcacgagtttcttctcaaaacgaaagaaagcagaaaaagagaaggctaacccatctcccttgggaaccctgaacagtcgagcttcgtcagcaagtactgtagcagttggtaaatcagatgttccacaacatgtttgtactagtttacaagatgatgttgcttctgaaaatttagaagaacagtttaatcatggaccaattggagttccggttgatgaacccgaagcaccctctgtgtctaagtctccagcttcccatgagaaggcactatcgtttgagattcgaacttcccacttcgatcagcccagccctacatcagttcttgatttacagtttgaggacatcagtgagaaatcccccatttcatcagaaagtgcaattactgctaagcaaggtcctccatcttggcctctcccatgtggttcatttcctgcgacccttccgtggcatgttgcctcccgagcgcctccattgtccccttcctaaggagataaccttgagcaagagcagtatgagttcgttgagaagactctaacatctgcaggcttctgntatgagaaggtccaggacatctttgtccgttggcattcacttgactgcccttt

SEQ ID NO: 3922 - DNA, 634 bp, Sorghum bicolor
  Clone ID: SORBI-28MAY03-CLUS68120_1
ctactgaaaaaaactttttccctttttcctcacgtattgcctcgtctctgcatcacaaacatacgcggagcttgtgcaaatctttgtcacaaggcttcggctcttgctctcacgtcgccagcgaatcgtcgcgtcttgttcgtttcaactcaatacgctacacagtcgcacgaatctcgaccgacctactcgcgcttatcgctgcgttggtgtaaaccatcttcagattgcgaccaccatctgaaggcattgcgcttgacggcttgaggcttggattatcatccgctgcatctctgaccagctctggccccttcctcaaccacgaactcgatcacgttcagcatttgaggttgtgagatcaccaaacggctctcacaaattcataactgcaacaatctgcgcttctgataccacgatataaaataaaataaaaaccacatacgaaaaaggggaggagcaaaacccacaaaaactacgagcaagactaccctccagaaaaacgaaaaaaagtaaaagagggaaaaaaacactctactgtcactatctcgaatcaccacctaccactatggcgcctcgaggtcgtcagaataccagcgcacgcgagactcgcaatgcgcgcaagccagctaccacc

SEQ ID NO: 3923 - DNA, 544 bp, Sorghum bicolor
  Clone ID: SORBI-28MAY03-CLUS68146_1
tctgggtgctagctccttgtcccattaactacccccctacatttatctgcaacgtcacaacgacttcgacaacgaccactgtggtcaatttcttcctgctctagcaccagacctcacgactttgttgccgcatcccagagcggtttgcgcccatatcgagccagctctaattggccctgtacaagaggagagagcagggaagagacaccatcataatatagcttcatcatgcggttgccctcactatcagcagcgctccttggtgcgctcgcatggactgcccgcgctgatgatcttgatgataacatcaggagcatttcgctcaggactcattccttgacccagccctacctggactcggacatgcaaagccgctggtacgactttggcggagataccattattcgaaccgattcgtacattcgacttacttcggatcgtccatcgcagtcagggtggatgtactcacgagttcccctcactgcgacaaactggcaggtcgaggttgaattcgagatctcgggcaagaaccagctttatggag

SEQ ID NO: 3924 - DNA, 648 bp, Sorghum bicolor
  Clone ID: SORBI-28MAY03-CLUS68181_1
cacgttttgaataccgggcttttgttacggtgggtcggaatcctgacatcaagaaagtccttagagacattctcatagcccttaatgaggaatcttacacttattccaaattaatgggtttggatgaaaatcagctcgtgcggaaactcaacgaattcgtcaaggaaaagaggtacgagctagctagtacaatcactgactcaatgctaagttatagccgcttttatgttatatacatgcacaacttattctttacatcattgttctactaaagaaaggatgaaaaggagcgcatggttcttttaataataagtcttcaaaatacaatgtgccgaatgatctaaaagagcagcacaacaagtaatttagcgttttaagcaagaaacataagtagctgtatgaaatataaatctattttcactgttaaacagtgtgtatatcttgtatgtctatcacgtgatagagttgttgagatatcttgtgataggggttaggagtcctagattgtaggacaagttgattagtttgttttctaatttgttctcaatctgctgtaaccgattgcatctgtaagcgccacgatgggggctgttcccatcctatttaacacgtacccgaggtccctggaggggcaacctcgtctctcaa

SEQ ID NO: 3925 - DNA, 670 bp, Sorghum bicolor
  Clone ID: SORBI-28MAY03-CLUS68148_1
aggcctcagcgacggcggggcagtcccaggctcggcggcggcggcggcgcctcctcctcccgcctctcgccccccccctggcgccctccccgcccctcccccgctctccggcccgcgtcccggcggccccccgccgcctccgtacgccccggtccccctgtccccgcccttcccctccgccgcctcgcgccgctcccgcgcgtgggcgtggacgaaccggctgcttccgccgtactgcttcgtcgcgtcgaggggctccagcgcgagatggatgaaaaagtagatcttgttgaagtgttaactcgtcgagttgaagacctccagcgagagcgtgatgccctcagaaaagatattgagcaattatgtatgcaacaagccggccctggttatgtttctgttgcaactcgaatgcttactcagaggacagcagctttggaacaggatattgagaacccccagaaaaagttaggcggttgcttaagagagaatcaaaatttgcaagaggagcttgctgaagcttatcgaattaagagccaacttgctgagctacatggtgctgcgctatctaagaacaaggatctagaaaagcaagtaagatttttccagagcagtgttgctcaagcgtttgctgaacgggacagttcattaatggagtgtgagaaagcaaaag

SEQ ID NO: 3926 - DNA, 667 bp, Sorghum bicolor
  Clone ID: SORBI-28MAY03-CLUS67818_1
gcatgcattactagccaagccaggcacccagccgccgcccgctcttctcgtcgggaggagcggaagccgagtcctctcccaccgcggggcgggccacttcccattcctccgcctcgcctcgcgccccctcccctacccacccaaccagatggagcgcgcacgccgccacgccagccgcgcgctgctgcgccgcctgctcgcggcggccaccaccaccaccaccaccgcgtcccctgccacgtcatcgtcccgcggcatctccaccctgtcgccggcggctcccgcggcggggaggcagcagcagcagcgccgccggcctcctccccaccagcacgcgcagggccggccggtgtcggtgtcggcgctacagccgagcgacacgttcccgcggcggcacaactcggcgacgcccgcggagcaggcggcgatggcaacaacctgcgggttcgacggcggcctcgacgcgctgatcgacgcgacggtgccagccgccatccgcgccccgccgatgcgcttctccgggaggttcgacgccgggctcaccgagtcgcagatgctggaccacatgcagcgcctggcgtccatgaacaaagcctacaagtccttcatcgggatggggtactacggcacgcacgtcccgggcgtcgtgctgcgcaacctcatggag

SEQ ID NO: 3927 - DNA, 655 bp, Sorghum bicolor
  Clone ID: SORBI-28MAY03-CLUS67861_1
attgatgccaatggtatattgaacgtcagtgctgctgataaatctactggtaaatccaacgagattaccatcaccaacgacaagggaagactctccaaagaagaaatcgaaaagatcgtcagtgaagctgaaaagtacaagcaacaagatgaaatcgtcaagaagaaggtcgaagccaagaacggtctcgaaaactactgctactctgtcagaggatctttgaaggatgacaagatcaaggataaattctctgaagaagaaagaaccaacctcgaaaagctctgcgccgatgccctcgcctggatcgaatccaaccctgaagctcatgctgaagaatacgaaaagcatcgaaaggatattgaagccgttttcaaccccgtcatctccagaatctaccaagaaactggcggtgctggtgctggtggtatgcctggcggtatgcccggtggcttccccggcggtgctggtggattccccggcggtgctggcggccaaactggtggtgccggccccaaggtcgatgaagtcgattaaacaagtattatacactttataaattctttgttacaaatgtaagtcatatctcgagtggattccgtttccctgtccatttccattatatatttgttatcgttttaaactgtgggttaacaga

SEQ ID NO: 3928 - DNA, 625 bp, Sorghum bicolor
  Clone ID: SORBI-28MAY03-CLUS67890_1
gagtgccatgggtccggacgataccgaggagcagggtgctgtgcgttcagagaagtctggtggaaatgatgcaggtgagcaggatggtgttggtgttttggagaagattgacgtgcaagatgccgagaagcagcaggatgctgcgggttcagagaagactggtggtgcagatgagcatgatttcgttgttggtgttttggggaagactggcgtgcacaatgcagagaagcagcagggtgttgtgggtactgagaagacaggtgagcacactgcagagatggttgattcagtgttagaggataagatggatgaggacaatgttgagggtgaagttaggctcgcacagcttcgcagtgaagattgacgtgagatggacaagaaaggtagctcagtactggttattggtgctgtacatacttgtcaatgaaggattgaagggatgcgagcgacattgaatggactcagcttttggagactgtcatgttgcttaatatgaatcatgatatattgccaatgtaatatgttttctgtccagtttccaatttgtttttcttgttactacaacttgttatgatgatctcaaagtggcagacatggaggaaataactgagatgatgaattggtt

SEQ ID NO: 3929 - DNA, 566 bp, Sorghum bicolor
  unsure (1)..(566): unsure at all n locations
  Clone ID: SORBI-28MAY03-CLUS6793_1
gcacgaggtcattgcgccctgtcctcactagcttagctagctgctaccttcacctccatacccgtctgccgtctctctagtctctacacacacccacagacacaggtgagtgacactacagtgggagcgtgaacagaggaagcggctgagctctcgtcaagttgcggcgatgaagatgcatcgtttcgctctgcctggtctggggtttctcgtcctgtggatgctgctgcattgcggaagtgagctcgccgcggcggtgcctccagatggctggtacgattactctgcctacaccgactgcagaggccagccggaaccggcgctgtacaacggaggcatttcaagttcggcaacagcgacgactcggacgggtaccgcacgacggagaccggcgtcttctccccggcgttcgtggtgtacaacctcaacaaaaccaccatgtacaccttctcatgctgggtgaagctggaaggcgcgtactcggctttgatcactgcgaggctggcgccggacaacaccggcgcgaggtgcatcgncacggtcttgccggagcgactgtggccttc

SEQ ID NO: 3930 - DNA, 673 bp, Sorghum bicolor
  Clone ID: SORBI-28MAY03-CLUS67914_1
aacctcgagcagtggagctgaagaagccttccccccaagagccacagagagcatggccgctgctcccatggtggtgccgcgcatgaagctgggctcgcaggggctggaggtctcggcgcagggcctcggctgcatgggcatgtccgcctactacggcccgcccaagccggagccggacatgatcgcgctcgtccaccacgccgtcgccgccggcgtcacactcctcgacacctcggacgtgtacgggccccacaccaacgagctcctcctcggcaaggcgctgcaggcagcaggcggggtgagggagaaggcgcaggtggcctccaagttcggcatcctcacggacgccgacggcaactggggcgtccgcggcgacccggcgtacgtgcgcgcctcgtgcgagggcagcctccagcgcctcggcgtcgactgcatcgacctctactaccagcatcgcattgacagcaaggtgcccatcgaggtcacggtaggtgaactgaagaaactagtcgcagagggcaagataaaatacattggtctgtccgaagcatcggcgtcgaccatcaggagagcgcacgcagttcatcccatcaccgctgtccaactggagtggtctctctggtcaagagatgttgaaactgacataatcccgacttgcagggagcttggcatt

SEQ ID NO: 3931 - DNA, 645 bp, Sorghum bicolor
  Clone ID: SORBI-28MAY03-CLUS68313_1
tctggaaccttcaagttcaacctccacacgccaccaccaccaccaacttcttccctgctaggctgtccccccccgccgggccccgctgcacccacagcgcccccgccggcacgccatgggcactctcggcgggcacgtcgcgccgggcgccggcttcctcctcatcggcctgtggcagctgttcggccacagccgcccgttcctgctgcgcccgggctcctacgcggctccggtctggttcccggcgccgggcgtccgccacctcgagctcatactcatcatcatcggcgcggcgatctccgtcccgatggagctcgtcatcgtgccccgcgaagcaccagccgttcgacgacgacggcaccatcccctccgtccacctccacaacttcgagcacgcgtccatctcgctggcgcggctcgtcttcgccgccgccaccatccacctcgacagggtccgggcgcccctgcgggacgccgtgtcgcagctcgccgccgccgccgcgttcgcgcagcagctgctcatcttccacctccactccgcggaccacgcgggcgtgcaggggcggttccaccggctgctgcagatggtggtcgccgtcacgctcgccgcctcgctgctcttgatcccctaccaacggagcatcg

SEQ ID NO: 3932 - DNA, 648 bp, Sorghum bicolor
  Clone ID: SORBI-28MAY03-CLUS68395_1
tgcaattgcaggtgctggacttattgtgtatcaaatattcatctacagaccggtccacaaatatcttggaagtgtaaattcatgccgtgctgcatctgccctacccgtaccacttatcgctgcttttcccttcatgacacacctgtcaggactaaaacttggactagctctttattttgctactacgtttaaagctgctcttgggacaactacgctgacaagcacttcacttcttcagaactatgctgtgccacaacatcaaagaggcgccgcaaatggcatagcgacgactgcaatgtccttctttaaggctattggtccagcaggagcaggcgctttattctcatggacccaaaaacgacaagatgctgccttctttccaggggatcacatgttgttcttaattctgaatgtgctccaatgtattgggctggtgctgacctttaagccattcctagcagtaccgaaacaccttaagtgatagctgctgaacccaagcagtggaataatggtggattagcaaatcacacatgtgccagaaaatatatttttgagtggcatacaacaggatcatgtacaagcaagagcttatatgtgtcaagaaaaaatagccataatgatttgagtgtgctatatattcatctcctt

SEQ ID NO: 3933 - DNA, 742 bp, Sorghum bicolor
  Clone ID: SORBI-28MAY03-CLUS68433_1
agtccaactcgaaaccctccataattttgtgatcgggagctgattgagcagtccaagaagcaaggataaggttggtggacgtggaccgccggaggaagaggaagctaaggtgccgtcagcctcgccatcggccatggagggcggcgcccacgagttcgacggctccaccttcaaggagtgcttctccctctcctggcggaacccctacgtcctccgcctcgccttctccgccggcatcggcggtctcctcttcggctacgacaccggtgtcatttccggagctctgctttacatccgcgacgacttcggatcagtggacaggaacacatggcttcaggaaatgatcgtgagcatggcggtggcgggcgcgatcatcggcgcggcggtcggcgggtggacgacggaccggttcgggcggcgggcgtcgatcctggtggccgacttcctcttcttcgcgggcgcggcgatcatggcgtcggccacgggccccgcgcagctcgtggtgggccgcgtcttcgtcggcctccgcgtcggcatggcctccatgaccgccccgctctacatctccgaggcgtcccccgccaggatccgcggcgcgctcgtcagcaccaacggcttcctcatcaccggcggccagttcctggcctacctcatcaacctcgccttcaccaaggcgcccgggacgtggcggtggatgctgggcgtcgccgcgctccccgccgtcgtccagttcgccctcatg

SEQ ID NO: 3934 - DNA, 568 bp, Sorghum bicolor
  Clone ID: SORBI-28MAY03-CLUS6844_1
tactggagttttcctcgaagcacagcgccgcgcaatcatcctctctcggcttcgtggctcctgggtaactcaaactccaccagcgaagcgtggtgcgtggacgcgtcctattcttcttccctccccacctttccccaacctctcctgtctcctgcaaatccgatttccccgcgatcatgcgcaactctgccgccgcccagccctctcctcccgcctcctctaccgccacgtacggctcctccgccgcctacgtcgctcccgccgccatgtacggctcaggcgccgcctacgtcgcgcccgcctcttccgcccccgtcggcggatacacctacccggcgcccgcctcctccggtggcagcagcgccgggtacgccaagatcccaacctacccggcgcccccgtcggcgtaccctaaccccaaacctgccccgacgcaagtctccaccacccacgccggggcggtccaggaccccacggcgccgccatcgccgctggtcaaggccggcgagctcgtcacgcgcctccgggagcaggggcaggcgctcatcgcggcgcgccggccctgggc

SEQ ID NO: 3935 - DNA, 490 bp, Sorghum bicolor
  Clone ID: SORBI-28MAY03-CLUS68451_1
tgcggcacgaggcggtgggcctgttcctgacgcacagcgggtggaactcgacgctggagagcctcggcgccggggtgccgatgctgtgctggccattcttcgccgagcagcagaccaactgccggtacaagtgccccgagtggggcgtggcgatggaggtcggcgccgacgtgcggcgggaggccgtggaggcgaggatccgggaggcgatgggtggggacaaggggaaggagatggcgcgcagggcggcggagtggaaacaggccgccgcggggtcggcggcgaggtcgctcgcgaacctcgacagcctgatcaacgatgtgctgctctccggcacgattggacggctcactcagatcaaagtttgccgggtttaatccattttttttattttaacactgtgcatttatgtttgtatttggtaattattattgaaccataaactaattatatttaaacgattcatctcgtaattcgtctcataaataaa

SEQ ID NO: 3936 - DNA, 595 bp, Sorghum bicolor
  Clone ID: SORBI-28MAY03-CLUS68849_1
tgagctcatagaggaaattgccatgaagaaaaagaaagaagcagatccgaagaagaaaaagccaaagaggaagcctctttttgtgaagaatggtgcaattgttgtttgccgcattcaggtgaatagcttgatatgcgtagagaagttctctgatttccctcagcttggaaggtttacacttagaactgaaggaaagacggtagctgtaggcaaagtcgttgatgttccgcctgctggcagcccaacattctgagcttaagccaattttgaacaggatggataatcatgaagcagtgtgttctcttgagatacttttttgggagaagtgagattagttgttgagcatagattttttttccagcccggcttgagaatggtctatgccttcatggtttaggctagccaagtctgtgtttagattggttgcataatattacttctctggttatatgtgaggttgtaaaatcagtatggatgagtgtaccaaccttaatgtaccgtgccaaattgtggtggtatttttgcgtacaatgctgtaactatccagtttctgtgtgaagataaatattagatggccacaggtcggcagattcgg

SEQ ID NO: 3937 - DNA, 680 bp, Sorghum bicolor
  Clone ID: SORBI-28MAY03-CLUS68029_1
agccgcactcctctccaatcctaactttgtctggctgtggaagaggctgcgaggccatccacacccggctacgccatccggccccgaactccagtcgatgccatccgcaacctccaacgacatccatagcctctgacgctagccgcctgcgacgaagctgtccgcacccactgacgccgttcacaactctagtcgccaccaacggcagcactcgtcatcgacatctccgcatcaagatggctcctggtaggaagggcggaaaccagaagtcaactactcatgagccagtagagacgcccatgactgattatgagctgcaaagggcatacaacattctcgagaaaaatcggatgttccagcgacttggtttgggaaagttacgtgaacttgtgggaacaaagcctgtggttgttgctcgtgaagaatctgacccattgtatgaatctagagagtccataatgagttctaaacataaaacatggctgactggaaaacaactttctccacattaagggaaatcaaagctagaaagaagccatcatagcaaggattctagaaggtgtggccttcctatttcttgttgggctattgatttatagatatggcgttctagaaaaccaaatcctcagagaacactgtcagatgcaaagtaatgtttcacgtgacatttgtttcattca

SEQ ID NO: 3938 - DNA, 630 bp, Sorghum bicolor
  Clone ID: SORBI-28MAY03-CLUS68031_1
tctggatcgccgcttcctcccctctgtccagtgtcctccagtgaatcctctgtcctcgtcttcctcccgtaaccacttcgtccctatccgcagcgaccgttcgccgcgccgcgaggcccgctgatccgactgaccgacctccaccgccatggctcctctgcccagcgcggctcgcctccttcgatcgaccctcgggcggctgagatcgccaccgccggcccgagccttctccagcgccgcggcgaccgagacgggggcgggggcggggaacggacgcgaggccgcgatcgccgccgccgccgtggcgatggccgggtccgggctcgggctgtggctgaaaccgccgtcgcttgccgactctggcgaggcgcccggcggtcagatctcggtcgccggcgccacggaggcgcgggaggaggagaaggggtggttcctgtttgcagactcattccggagaagggtgttctttaactatgagaagagggtacggcttctcagtcctcctgagaagatttttgagtacttcgcatctgtgaggaacccagaaggggaagtttacatgttgcctgatgacttgatgagagcagtagtccctgtttttcctccatcagagtccaccatagttcgtga

SEQ ID NO: 3939 - DNA, 634 bp, Sorghum bicolor
  Clone ID: SORBI-28MAY03-CLUS6804_1
tcaagcgggtaccacatcctcaaggtcagcggctactcgcgcaccaaggggactccgaccggggagctgatcaagtctcaccccttcacggagggtggtcacccacgcgtccgccaatattatcccaacggagactcctccgagtgtgcagattacatctccctttatctttgccttgatgaaagtgtcaccgacgccgcggtgaaggcacaatttaagttccatttcatcgacgatgtggaggaggaggaccaaacacaggcgttgacaacagtatccgtgagaagcttcgagagcaaccaaagctggggccatcgaaggttcatcaaaagggaggatttggagaaatccaagcatctcaaggatgattctttcgtggtccgctgcgacattgccatcgccaacgagttgcgcaccgaggaggtggccatggccgaagctcctaccacgaccttcgtgtccgtgccctcatctgacttgcatcaacaccttggcgatctcctccagacagagaagggtgccgacgtggtgttcgaggtcagcggcgagacgttcaaggcgcacaggtgcgtgctcgcagcaaggtcaccggtcttcaacgcagagctcctcggccagatgaaggagagcgaca

SEQ ID NO: 3940 - DNA, 460 bp, Sorghum bicolor
  Clone ID: SORBI-28MAY03-CLUS68050_1
caacgccaagcaatgatcgccgagttatgcaagcaaactggcatgacacaccagtactccgagatgtgtcttacccaagtgaattgggaatttgaccaggctttggtgatatttaacgagaagaagtcacaacttccagctgaggcttttgttacggtggttggctcataggatggccggccaagcgtcgaagctttggacccaacttcggcaggacgatacggaaacacgcagtgtgtttagggttctcccaagaatggggaaagaatggacagtcatatcaaaaggagtgggtagaaattagattaacagcgatggtttgcagcactgttggagttcattggtccatgcggatatttgcatcatacatggttataggcggtactttttaagattcgggtccaggaagtcttcttatatggggagaaaagggaggcagtttgcataaattataatgaaa

SEQ ID NO: 3941 - DNA, 601 bp, Sorghum bicolor
  Clone ID: SORBI-28MAY03-CLUS68073_1
acttccaggacaaacagctcaagctagagctccagtacaaggttgaggatgagtggcagacatgcttcgacctcgaggatcccccagccattcctaacattgcctatgttggtttcactgctgagactggtgagctcagcgacaaccacgatatcatttcggtggcggcaaagaacctttacactcagcctggcaccagcaacactggcaagtcatctggcaccaagaacaagggacgcaagggcaccggtaagaccaccaatggaaacaagcagggtggtagctggacatggttctttaccaaaatcatcctgttcatcattattgctggcggtgcttatgttggttacactgcctaccgatccaaggccaaatcgcacaggttctagactggatcgccgagtatgaatgggaccagcgcctgaaatgaagtgacggaaacaagctggtgagacaaaaaggtctccgcttagacagcatcattcagctttccttgaatcttttgtatctatgtttcgagtaagggagaggcgatgagaagggtacaacccgttgagcactgtgacgtaccctttgatacaggaaaaaaaacaatctacta

SEQ ID NO: 3942 - DNA, 728 bp, Sorghum bicolor
  Clone ID: SORBI-28MAY03-CLUS68536_1
agaatgtgaattatttaccaagtgcatggaaagctgggattcaatggaggctcatgaccttccagagtgcatgaaatttggtttagagaaaatattcgacagctatgggaccattgaaaatatgctccaccaggaggagaaatatcgcatgccatatctaagacagtcgataaaagacctggttagaagctacaacatggaggtaaaaatgcttcaagcaggatacattccgaagtccactgaagaacatctgaagctttcaatgataacagttggatatcccattttgtcatgtgcttcgttcgttgggatgcatgatatagcaacaaaggattgttttgattgggtttcttctgtacctaaaatggtggaggcactttccgtgattctcagactggtagatgatctcgtgtcatatgagcgagagcagctcatccctcatgtcgcttcgacaatcgatagttacatgatggagcacaatgtctccattgaagttgcacgtgggcagatacacgtactcaaagaggatccccatttaagatccccatttagcactatgtgctgttataagaaataaattataactgtataattttgtatgaataatgtttgatgacctcatcctcctgcacgcttgttagttgtctagactgaagactacaatggcttgtcataacataagtttaaacacacaatcgagggccttcgcaaatagtagaactcaactt

SEQ ID NO: 3943 - DNA, 494 bp, Sorghum bicolor
  Clone ID: SORBI-28MAY03-CLUS68553_1
agcttaatcagcagcagcagcatctacatcagcagcagcaccttcaacagcaacagcaacttaaccagcaacaacttcagcagcaacagcagcagatgaccatgtcaggaaatcagaacgcgcaactagcacagcagttcaaacaggtcccatcaatgagtgcatatggcatgcgaatgccgcctgtgaaagtagaagccttccatgaattggtgagcggggactcttcgctgaagcatgataacgaccctaacaaactcacttctccaaagtgatctcttacatatgggggacacacatgtcgtgtatgtagctgtggtgtacaaaggatagcgtttgtgatatgttgtttcattcgtgcccccaacctcatctgtctcgcctgtttcttttacatacaataagaagacaagccgtgcatcgtagatgttgtctatttggctgatttaatggcttcaaaacagatttatgccattggctaatttactgtcctt

SEQ ID NO: 3944 - DNA, 554 bp, Sorghum bicolor
  Clone ID: SORBI-28MAY03-CLUS6858_1
gcatagttctgtagttctcctttcgtgcattgtgttggttggtctatttgccttgcaacaccgaggtactcagaaggttgcattcatgtttgcaccaattgtcatcatctggctgctttccattggaggaattggtttatacaacatttttcattggaactcaaatatatatcaagctctctctccatattatatggttaagttctttagaaagacaggtaaagatggatggattgctttaggagggatccttctttctatgacaggcagtgaagcaatgtttgctgaccttggtcactttacgagtgcatctgttagggtggcctttattaccgtcatatatccatgccttatactacaatatatgggtcatgctgcatttctgtcgaagaacacatttcacatgccaacaagtttttatgatactatcccagaacctgtgttttggcctgtattcgtggtggccacactcgctgcagttgttggtagccaagctgttatttcagcaacattctccattgtgaaacaatgccatgctttgggatgtttcccac

SEQ ID NO: 3945 - DNA, 655 bp, Sorghum bicolor
  Clone ID: SORBI-28MAY03-CLUS68598_1
aagatcggtggtatcggaacagtgcccgtcggtcgtgtcgaaactggtgttttgactcctggtcaacaagtcaccatcgcccccgctcaagtcaccactgaagtcaagtccattgaaatgcaccacgagcaaatgccccaagccacccctggtgacaacatcggcttcaacgtcaagggtctctccgtcaaggatatccgtcgtggttacgtcgtcggtgacaagaccaacgatcccccagctggctgcgctgacttcaccgctcaagtcatcgtcttgaaccaccctggtcaaatccacgctggctacgccccagttttggactgccacacttctcacattgcctgcaagttcgctgagatcctctccaaggtcgacaagcgtaccggtaaggccactgaagagaaccccaagttcgtcaagaagggagatgccgccatgatcaagcttgagccctctaagcccatgtgcgtcgagtctttctctgactacgctcctctcggtcgcttcgccgtccgtgatatgagacaaaccgttgccgtcggtgtcatcaaggccgtcaccaagaaggccgccggtgctgctgatgccaagggtgccgccaagaaggctaaataaattttgtaactatcactcgcgcgaataaaacctattt

SEQ ID NO: 3946 - DNA, 726 bp, Sorghum bicolor
  Clone ID: SORBI-28MAY03-CLUS68635_1
cttgaattttatgaagagaaggaactgttacgaaatgacccccttcccttggcattggaaaaggacaaggatagtcgtttactaacttcgcctctcaaatttcctgggaaacttgctgttgatgtgcagaacaatcgattattcatatcagacagcaatcataatcgaattgtggtgaccaacttggaagggcagttcatatgtcaagttgggagttctgaggaaggattgcttgatggcccatttgatgctgccctatttaaccgccctcagggtcttgcttacaattccaaaaggaatatcttatatgttgcagacactgagaaccacgcgctgcgagaaattaattttgtggacgagactgtgagaacactagctggaaatgggacgaaaggatctgattacaaaggaggaggtcaaggaacaaaccaggtcctaaattcaccatgggatgtatgctacgatcccacagaggagaccgtgtatattgcaatggctgggcaacaccagatctggaagcacattgtacgtgatggagtaaccaaagttattagcggtgatggctatgagaggaatctgaatggctcaagcgccaccagcacatcgtttgcacagccttctgggatttcattagcttctgaaatgcaggagttatttgttgttgatagtgaaagcagttccattcgagttgttaatttgaagacaggaggctcaagattgctggct

SEQ ID NO: 3947 - DNA, 651 bp, Sorghum bicolor
  Clone ID: SORBI-28MAY03-CLUS68228_1
tggggcgatccccacacacacagacacagacacaggcggagaggccacagctcggcggcaagcggcagccagcccagaccagagcgaaaacccaccgtcccggcacccaattttgaaccgccgcgacgctcccaagtcccaaccaaatccacgatccctccgaccgaaccgaaatctccgcctccctgccctgcccggcctaggaggaaagaaacgcacgcacccacgtccccgcgccaaagggaaaccgtcgccgcgtcgagagaaactgaagcggagcagaggaggagaggccgaaggccaggagaaggattcccggcggcgatggagcggtaccatccctccgaggtgtacgagctcttcgtgcgccacatgaacaccccgagggtggtggtggacaacggcgtgtgcgcgacggcgacgctggtgcaggtgcacagcgcgaggaagcacggcgtgctgctcgaggcgagggcggctctgtccgaccacggcgtctgcgtccgcaaaggctacatctcctccgacgacggccgctggttcatggacgtcttccacgtcaccgacgcctcgggacgcaaggtggccgacgccgacgccctgctggcgcgcctcgagtcctcgctcaccgcggacgcattgccgccccgc

SEQ ID NO: 3948 - DNA, 494 bp, Sorghum bicolor
  Clone ID: SORBI-28MAY03-CLUS68235_1
cctgacgtgagccctgctgacccgagcccctccccgttcctcagtcgcgcgcgccgcctcccgcactcgcgcagggcgcaaaggcaaagcaccgccgccgctgagcgccgagaggagcagagcgggatccgaagcctcagtttgtgattatttatcgtccttgcctcacgaaagcctcaatgggtggatgctgaccgtgctgaccccgtcacgcgcgtcccgcctgctccgcgtcttttctcatctcgaagctagggttttgcccgccgccgccatccgactctcctcctcggcatcgtcctcatcctcatcttccccagccgcatccgccgccccgcctccgatggatgcgccgtcggagtggacggcccggcgggtccgggagcagtacatcagcttcttcgtgtccaaggaacacacgaggtggccgtcgagtcccgtggtccccgtcgacgaccccacgctgctgttcgcctacgccgggatgaaccagt

SEQ ID NO: 3949 - DNA, 894 bp, Sorghum bicolor
  Clone ID: SORBI-28MAY03-CLUS6824_1
gcacgaggcgatgatcctgacaagaaggaaatcaagttcgcaagcaagatacagattcggatgtcccttgattttgggtatcatgttcttgacgagtccacctactacagcagtgatctgcagccatcatcaaagcctgcaaggaaaccaagcattgggatgcttgagctgggagttctgggtgcgcggaacttgataccgatgaagcccaaggatggacgcaccacagatgcctattgtgtggccaaatatggaccgaagtgggtgcgcaccaggactattcttgacacgctgaatccacaatggaatgagcagtatacttgggaggtgtttgatccttgcaccgttatcacggtggtggtgtttgacaatggccaaattgggaagaatggtggaggcccagatcagcggattggaaaggtcaggatccggctctctacactggagactgacagagtgtacacacatttctaccctttgctggttatacatccaagtggactcaagaagactggcgagcttcatttggctgtgcggtttacctgcacagcttgggtgaacatgatggcgctgtatggtcgtccgctgcttccgaagatgcactacacacagccgatcgcagtgatgcaattggactacctgaggcaccaggcaatgcagattgttgcagcaagactcagccgtgctgagcccccgctgcgcagggagattgtggaatacatgctcgatgtggactcacatatgtttagtctccggcgcagcaaggctaattttcatcggattacctcactgttctttggttttctggcaatgctcaagtggtatgatggcatcagaagctggcggaacccaatcacaacaatgctagtacacatgcttgtcctgatactgatc

SEQ ID NO: 3950 - DNA, 585 bp, Sorghum bicolor
  Clone ID: SORBI-28MAY03-CLUS68295_1
cgggatcccttacccgcggagcatcgtggtgagccttgtccggtcggccagcctcgtgctccagggcgtctggttcgccgtcatgggcgtcatgctgtggacgccggcgctcgtccccaagggctgcttcctcaacctcgaggatggcctccacgtcgtccggtgccgcaccgacgaggcgctcgaccgcgccaagtcgctcgtcaacctgcagttcagctggtacctcaccggcaccgtggcgttcgtcgtcctgttctacctccagatggccaagctctaccccgagcagccgcagtacgcgccgctggtgaagggagggggcggcggcggcggccgcggcgccgtccgcgagggccgggtcggcgtcggtgaccttgagcccgccgatgggggcgttggcgaggccgcaattcggggctgcggacacgtggttagcggcacaaagcctgtcgaaatcgagaggtgaggtcgtacgccgtagcaccgtaaggttaggttgttgttgtgtgtgattacagtacagtgtaatttgacttcaacgtttgttggtgaaaaacatgcaaatatttgtatagggagatt

SEQ ID NO: 3951 - DNA, 515 bp, Sorghum bicolor
  Clone ID: SORBI-28MAY03-CLUS68302_1
agtccattccactccaccaccatttcagcaacacagccaaagcagcagctcagctcagctgtgtttccagcgctcactagctagccagctgctgcgccacgccatggctcctctgctgttcagggacatgaaggggctctcgtgctcgtctcaggcgtccacggcgatatgcccgagcctggagcggcagccgatggtccggtcacacaaggccattgctagtcccagtcccagtcccagccccctggctcatgctcctgccgagcccaggacgcaccggcacgatggcaagaaagggcagcagcagcagcacaaggctgtggtcgtccccaacatcaccggtggcctcgtcagcccggccggctcgtccaggtacttgctgagcagcggccgcttcgccgccaccgtcaccgaggagatccaggaggtggtggagtctgccccggccccggccccggccgtcgatgccaagcgggaggaggcaagtgaagctgctgaggcgaagagcggcgcgc

SEQ ID NO: 3952 - DNA, 994 bp, Sorghum bicolor
  Clone ID: SORBI-28MAY03-CLUS68759_1
gcatattagcagttcgtgcagtgattgttcagctggcttttttcctccacattcagacttttgttttcagaagaccggcggtattttctaggccactgatatttgcaactggatttatgacgttcttctcagttgtaatagcactatttaaggatatacctgatatcgaaggggaccgcatttttgggattcgatcttttagtgtccggttaggtcaaaagaaggtcttctggatctgtgttggcctgcttgagatggcttacagcgttgcattactgatgggagctacttcttcctctttgtggagcaaaacagtaactattgctggccattccatacttgctgggatcttatggagctgcgcgagatcggtggacctgacgagcaaagccgcaataacatccttctacatgttcatctggaagctgttctacgcggagtacctgctcatccctctggtgcggtgaggcctgtgtcgaggcgacgcgatggatcggcggggtggtgctggtgccggggccggggcaacaactccacgggagaacttgagtgctggagtaaactcccgtttgaaacttgaagcatgcaccgtggcaggcaggagcaggaaggcaggcagtcgatgcatgtctacggatggcgcccaataaaattcccctgtgcttccgcgtacacgctacttgatgacatcccatatgtccgggtgacctgacctgatcgatcgtccacaacgtccaacgcccaacgtaccggaagtaactagaccaggtgagctgttagcccgtagttggcattgctaccactgccagtaatgatactcctcctattattagtcggctgagctcaacggcgtgcgtactacgtccgtctgcgccttgacttgtgcagtgggcgtagtagcttagctagcatagcatgaatgtatggtgcgtcacggcctgaacggttcgtcagtctgggccgtgttacttctgtccgaaaaagatcgcctgtc

SEQ ID NO: 3953 - DNA, 567 bp, Sorghum bicolor
  Clone ID: SORBI-28MAY03-CLUS68760_1
agtggcggtgggtgcccgtcccggactggggcagcagcaaggggctcaacatggccggcatcgccgtctcctccaccttctcccgcctctggccgctggccgcgcctgcgccggcgtccagcagcagcagcagccaccagtgaagcgaaagcgatgatccgggagcccgtgtcgtcgcatgtgatgcgtgcgcgcgcgtgctgtacgtgcacgtacaggtgtgtgtgcgtgcgagagtgggcgagtgctgctgggggtccaacgcgcgcgcggccgtgtcccccagtccccctcccccacgccacgagatgtgagcgggcggttcgtcgtttccatgtggagtgggggcccatgggcggggcgtggcgtggcgcgccatgatcccgcatcatagcttcgccgatggggacaatgcccgtgagagcgaaatgtttcagataaggaatggctagtggtgtgtcatgtgtgcgtgcttctttctattttgtataatccagctactacttcaagtttatggagtgtttaccatgactcttttagaggagctcgagccggctctttcgaacc

SEQ ID NO: 3954 - DNA, 810 bp, Sorghum bicolor
  Clone ID: SORBI-28MAY03-CLUS68781_1
acacacacacacgggggaaaacgagcactgtagcgtgaagaggggccaccggcagtcttctgacttggcaaccgccgcaacgcgacgagcggaacctgcttttgctgccgcgtgcctgcgtgcgtgcgcgtgcgtccaccactgccggccttgccgcactgtgcccgccccccccggcatctccactccactcgctcactcgcgtcccgcttcctcccccgcccgcccggccggccgcgccgcgacgcgacgccaagggggatggatgcgctccgcctacggccgtccctcctctccgccgcgcgtcccggcgccgcccgcccgcgagatcattttctaccaccatgttgttccatccaacgaaatggtgaagggcgaatttgcttttctagccaaaggacccaaggtcctaccttgtatcaccatcagaaattcttcgactggaaatcctcctattgtaggatatcacatcagtcattaaatacttctgttaatgcttcggggcaacagctgcagtctgaacctgaagcacatgattctacaaccatctggagggcaatatcatcttctctagatgcattttacagattttcccggccacatactgtcataggaacagcattaagcatagtctcagtttcccttctagctgtccagagcttgtctgatatatcacctttgttcctcacgggtttgctgcaggcagtggtagctgctcttttcatgaatatctatattgttggactgaaccagttattcgacattgagatagacaaggttaacaagccaactcttccattggcatccggg

SEQ ID NO: 3955 - DNA, 694 bp, Sorghum bicolor
  Clone ID: SORBI-28MAY03-CLUS68782_1
gcgaagccggatatcatcctccgatccccgagcagaattaaacctcacctaaccccttcccatcccatggccgaccaccccgtcgccggcgagcaccaccacccatcgcccgcaagctcggccgccacggcgctgggccctctactcctcctcccgtcggagctcctccacgagatcctgctccgcctcgccgtcccggagctcctccgcttgcgctccgtggcgcgcccgctctccagcctcatctcctccccggacttccgccgcctctaccacctctcctcgtcgccctcgggtcccggcccggccgccgcgtggctgctcctcttcaagaagctcccgccccgcgacgccgccatcaggggcttccacgggccctcgggccggtggttccgcatccccgtctcgtccatcctcgcccccgccgtgccgcccggcgaggacctctacttcctggcggcctccgccagctccttcctgttcgccgccaacggccgccgcgagctcgtcgtcgtcgacctcaccgcgcgcgccgcgcgccgcctcccgccgtccccgctcggcccccgcggcacctcctcctggcgtcgcttcggcctcaagctcgtcgccgatccccccggatcgaaccggtttaggtttctgtttgcggagctggtgaacaacacgccattcctcttcgagtaccggtccg

SEQ ID NO: 3956 - DNA, 555 bp, Sorghum bicolor
  Clone ID: SORBI-28MAY03-CLUS68827_1
atccggcccttcgacgggccacacacacacttttcctttgaggaccactcctcctccttgcactgtagagtccaaaaccctaccacccgcgccaccatgccgcgcctcgccgccgccgccgccgtatcacgccgcgccggcgaggccctgcgccgcggcgcgcttgggagactgcggcttctctcctccctccaaccgtcgaacgccgcctccagcgacgaggtgctcgtggaaggaaaggctactgcgcgcgccgccgtgctcaaccgccccggctacctcaatgccctcaccaccaccatgggagctaggcttaataaattttatgaatcatgggaggacaacccagacattggctttgtcatgatgaagggcagcggccgagcattctgtgctggtggggatgttgttagattacgtgaacttatcagtgaaggcaagctggaggaatgcaaggattttttcaagactttgtacatgttcatttattttctgggcacatacttgaaaccacatattgccattcttgatggggttactatgggtggggggtgg

SEQ ID NO: 3957 - DNA, 659 bp, Sorghum bicolor
  Clone ID: SORBI-28MAY03-CLUS68497_1
agagacgcatacggctgccgcgttaaacaccgggagcctgcccgtgacctgacgacgccacagaggccaaatcattccccacagtcgccactccccaaccgttcgagcgaggctcagaactagcagccatgccgccgccacacctcatccttcttctcttcctcggcctcggcggggtgctgctgcctgcggcgtgggccgccgacgagcagttcgtcttcgacggcttcaagggcgcgaacctcagcttcgacgggatggccacggtcacgccggacgggctgctcatgctcaccaacggcaccaaccagctcaagggccacgccttctacccggcgccgctccggttacaccgcgcgcccaacggcagcacggccacggcggcgatgcagtccttctccacggccttcgtcatcggcatcatcggcgcgtacgaggacctcagcagccacggcatggcgttcgtggtcgccaagagcagcgacttcacctccgcgctgccgggccagttcatggggctcgtcagctccgccaccaacggcaacgccaccaaccgcctgttcgccgtcgagttcgacaccatcctcaactccgagttcaacgacatgagcggcaaccacgtcggggtcgacgtgaacgggctcaactccgtcgacgcc

SEQ ID NO: 3958 - DNA, 703 bp, Sorghum bicolor
  Clone ID: SORBI-28MAY03-CLUS68518_1
aaaaattctcgtggagtggacgtctccggcgcccactttgtattgtactgtatcccgcgcgctcccgggacaagctagcttgccgtcgccgccgcccgcgtcgcgtccatggaaatggtggagtgctctctcgtcgctacacttgctccgcgcccgctgcccggacgggtcccaaaggccttgccgcggccggcggttcttggggggagagcgagactccgggtgctgtccgcgggcctgggccgagagcagcctccgccaccgcagcaggcgggagtccgggcttccggtccggatcacggcggccggacgctgggacaggctgcggtggggctcgccgccgcggccgtggtgtcactgaccgggttctccggggatgtgtccccgctgccggcgccgcctgcccgggccgagtcgctcaccgtcgcgttccccgtctccaaggcgcgcgaggtgaacagagtgcagaagacgctggttgagacgtgggggctgatccgtgagacctttgttgatcctaccttcaaccaccaagattgggatcagaaactgcagcaaaccatggtagagatatttccactgaaatcagcggatgctgcctacagtaagatcagtgggatgctatccacactcggcgatccatttacgaggatcatcagccccacggagtaccagagttttaggataggaagcgatgggaatg

SEQ ID NO: 3959 - DNA, 528 bp, Sorghum bicolor
  Clone ID: SORBI-28MAY03-CLUS6852_1
gcacgaggatctcgtcctcctctcccgtctctcttaacagcgaaggaagaagacgacgccgcgatcatccgtcatctccagcctcccacgcgcttcctccgccctattttaggctgctcggcacgccaccggccaccgacatcccacctcgccgaatcaatcccctttgtccttcccctccctctcctcgcctcgcgttaggtagctgtagcttgctttcgatccgacccccacatctccctccggtttcgccatgggcgccgccgccaacagcaaccatgaggaggagtcgagccccctcatcccagctgccgccgccgccgcggacgagaagcccccgcaggctccggctccggcgccggaggccgccaagtgctatgccgacggggtccctgtcgtgatgggcgagcccgtgtcggctcacgcctttggcggcctcccgcgggagagctggaactccgggatcctctcctgccttggccgcaacgacgagttctgcagcaacgacgtccaagtgtgtcttcttgg

SEQ ID NO: 3960 - DNA, 727 bp, Sorghum bicolor
  Clone ID: SORBI-28MAY03-CLUS68532_1
ggatcgaggcgccgtcgccgctgccgacttttaaggtgaggaaagagaaactaggggacagaatcactgcgctccagcaactagtctcgccttttggaaagactgataccgcatcggttcttcacgaggccatccaatacatcaaattccttcacgaccaagttgcgtcgctgagctctccctacttgaaaaatgggattcccatgaagcaattccagcacaagggctctgaggattccaaggacaacggtgacacgaagcaagatctacggagccgaggcctgtgccttgtcccagtggcgagcacgtacacggtggcggccgagacgcctgagttctggcaccctacatttggaggcacattccggtggtgatccaccactgttactagctagcttgcttgcgctgggtgtgcccgtgcgcatgacggcatcgtgtccccctcgcaagcactcgcaggcggtttggctgggctgaagctcgagcgatgcatacgcgatcaggcactgccgcctggcggtcttcgtcggcaggctaagtatatataacacatgttggatcaggtgcaaaagagaatgatgaattgaggccgtgtatggggcatctatactcatatatatgcaactttgcaagcaaataattcatgacagctatatataattagcactgtgtagtatgaattggttggcgttggaagggaaaaggtagggcaggtgccaaaattatt

SEQ ID NO: 3961 - DNA, 579 bp, Sorghum bicolor
  Clone ID: SORBI-28MAY03-CLUS68527_1
ttcagatcatgggagggaagaagtatgacatggacgagttcttcattggctgtgttgatgtccgagacgtcgcacagtctctgatagtgctgtatgagaacacatctgccgagggacgccacttatgcctggagtcctctgaacggatggtcgatttcaccaatagacttgctcatctctaccctgaattttcagtttacagaatccaagaggacaaacaagactgggtggtgaggcccaaggacccctccaagaaactgatcaatttgggtgtccgtttcactccattggacaaaactatcgcggacactatggactgctttaggagcaaaggactcatctagcgcgtcacgcccatttcttcaaaggaaaattagggaaatatcgagtatcgcatccatctggctgaatgtgaaaatgtgttgttcaaaaactgttgtaaagcctctggctgcaaacctgttctgtttttttttctattcaataaattcatgtaggggctacggcccctccagttttatattaaaaaaaactgttgtaaggtgaaaataaactgctagaacgcaaataatacattgt

SEQ ID NO: 3962 - DNA, 595 bp, Sorghum bicolor
  Clone ID: SORBI-28MAY03-CLUS68906_1
agacttaggacctttcccaatacattctacttcagttatgctacaaagaaaacaagaaaattatttggaattacagtgccttcaagtgttcttggagtgcaccccatgctctttctgagagtcctccagatgtgtatgtggcggcaccctcaaagtgcacctctgccttacaaaggatacagggatgaagattgggaagacaatgatggggctttgaacacaatctctatgacacacccccgcattcccattgagcatccacaccgtctgggtgtgcacgattcggaccgccatccttcccttcctggctgctggtattacaagattattgaagctgcccccattctattcattgtgaatcgggaaagagctggagtgcagttcgatttgctgtacgatggcatttttcagcgctgcagaaagcatgcctttaggaagagcccccctactgtaccaaacgaaacaagtcaatagcagaactaagacaaagtatttgtaggtagtacataggaagaagagaaacaaggtgccccagcatttttattaactgtaaattatattgttgattgaacgggaatagcatatttgtttttcc

SEQ ID NO: 3963 - DNA, 595 bp, Sorghum bicolor
  unsure (1)..(595): unsure at all n locations
  Clone ID: SORBI-28MAY03-CLUS68927_1
agacgagagagagagaccctcgccgccccgccggtccgcccccacgaccaaactccgcgagcgcgatccgagcacggacaccgcagcgcagcgcggcaccgagccgctgcgactgcgaacgagaccgcaccgcagccacagggagggagagacccgccccgcctccctcccggagaaaaggcagacgcggcgggcggcggcccaatccggagggcgcgaccggtccggtcctgtccttccttccttcctccgttcgttcgttcgttggcctcctcctcctcctgttccgttcctcttcttggcgcggcggcnaataagaggaatatagaagaaatagcaagagccccgagccagagggggcaacgaccaacggcacgccgccgccgccgccgcggacgctcgtgctgaggtcggtcgccgctgccacgacacaaggcgatggcgcggttcatcctgagcctgatggagctcggggtcagcgccaccgtgcacatgctcttcggcctctacgtcttcagcacggccgtcgccgccgacatctcgcaggccgccgcggcgtcggggtgcctcctgctgcgccgcccatgggcgcctc

SEQ ID NO: 3964 - DNA, 643 bp, Sorghum bicolor
  unsure (1)..(643): unsure at all n locations
  Clone ID: SORBI-28MAY03-CLUS68950_1
ccgtctcctccaatcaaacgccccgccccgtcgcacttgcacgcagcgccaggcgcacctcctcgcctcgcctccccaccgcggcgccgccgccgcctctcctttccgagtcccgcctcctctggcggtgcgtgtttccccatccgccgatcctcgcgacgccgcctcgacctcgaccccgacccggcgcggccgccggttccaggatcagccagctatttatccatgccttgattggtctactatgcaggcatattatggccaaggggtcttaccaccagcattctttaaccctggaattgcacctggtcatgtccctccaccatatgtgtggtgtccacagaatatgccaccagctgcctttggaaaaccatatgctgcaatatatccacatgctggtggcttcctgcatcccttcatgcccctagtaaatggtaaacccattgagtgcagagccagctaagtctgcgaacagcaaggataatagtttaaataagaaactgaaggaaattgatggaactgctgtttcaagtggtaacagtgaaaaaacaagtggggattacagcctagaaggatccagcgatggaaacaacccanaggtgagcggaacgccaaagaaaaagagctttgatgataggactac

SEQ ID NO: 3965 - DNA, 660 bp, Sorghum bicolor
  Clone ID: SORBI-28MAY03-CLUS68957_1
ttctttcttctccatgtttatgttttaattccctttttaaagctacaatgagtatctctgagaaggagaccaaaccggagatcgcttcctccaaggcggatatctatcctgccgatgagaagaagggtcttcctcagcatgacaagaatatgcatgacattgagatcatgtcgtctgataaggtgaagcagcctcttgagactgctgaagatatcgtcacacatgttattcaggttgatgatgaccctactatgaacccatggacgattcgcatgtttgccattggtattggactgtcggcctttggtgctgtcctccaagaaatcatgtacttcaagccccaagtcgtatacgtctccgtcatgttcttgaccgtcctcgctgaaacgctcggtaccggtctcgcgcacatcatcccacgctggggtcgcatcggtcgtcttctcaaccccggcccctggaaccgaaaggaacataccgccgctgtcctcatggcatcagccgcttcagtctcagccttgtctaccgaggccttgactgtccagaagctctggtatggcggatacccctctgtggcagccggtatcttcgtcaccctgtcatctcagctcatcggatatggtgtcgctggtatgatgagaagtgttctgctgtacccca

SEQ ID NO: 3966 - DNA, 865 bp, Sorghum bicolor
  unsure (1)..(865): unsure at all n locations
  Clone ID: SORBI-28MAY03-CLUS68961_1
gagtccccgctcctgctcctcctcctccgtccacccctgcctgcctgcctgacgtccacgcgacgttcctcgtgtccccgtcgccttccttgggctgggtcccgactcccgagatatagttgcggtggggtttccttctttgagaaaattctgaaccagaggagccgcgcggcgcgggcggacgggcgggcggagagccggaggcccttgctgctggtggtggttatttttttagtcttgctaacttctgttgagggttaatatgagggacagtgagtcatcagatgatgcacaattggatgagcccttagggcgagtggcgatactctcttacggttctgggcatatgctcaatgacatcacatcatcttgttggtttacctatttgctggtgttcttgacggatttgggacttagtccaggcgatgcgccttctggcttgctttcccgtctcctcgcggtgggctgcacatcgttctttgctgggctcgtgctggttccctttgggcgtgtcattcggggccttgctgcacgctcttttgctgtgccatgtcccttctcgccctactgcaagagaattttacctctgctatgcattatgaagtaagttcatgtttaattccaagttactacagaaaatattttactgcgataaactctaaaatgtccttgataaagaaacctttaaaacattcaaatgtttgcacaactgatcatcaaaattctgctgtccctttttattactagtgctagtaatgttcagaaagaaaggaaggaagaagtaatgatttacagtgctcaaaaactagtaaggcaatgacnacatgttagtagtaaatgctaaaatgaatcatacaagttagtt

SEQ ID NO: 3967 - DNA, 565 bp, Sorghum bicolor
  Clone ID: SORBI-28MAY03-CLUS6897_1
gcacgaggagagcgctgctactgagaccatttcaactccatcagttgctcctgggtcattagcatcaaccctgaacctcagatcactcattctgtcaggtgacttcttcctggctgctgttgttgcatgtaccctgaccaagcttgtgttgaggctggaagaagtgcagccatctaaggttgaatcaaacaaggcttgcactggagcattgctgatcatgacatcgattctgcagctgggccagtcttcttaccttccccacccgatcgatatgattcatatgataggattgtgctgtgtttgagattgctttgcaatactggtgatgatgtcaggaagatttggttgcagtcatgcagacagagctttgcgaaaatgcttgcagagaagcagttcagggagacagaggagatgaaggcaaaggcacagatctctcatgcccagccagatgatcttattgatttttaccacctgaagagcaggaagggcatgagccagcttgagttggaagatgaggtgcacgatgatttgaaggctgcaactggtgggtttactaaggatgcag

SEQ ID NO: 3968 - DNA, 703 bp, Sorghum bicolor
  Clone ID: SORBI-28MAY03-CLUS68639_1
cctactggatgctcgacgcacacggacgctgaacccttcattcatatatatccagattcccctcctccctttcctcccgttcaattcacctttctgccacaccacacctcgagcgaagcaagcaccgcaagaagagccagggatcgagatcttccatcactcccatccatggccgaccagtggtgggagagtacctctcacaggagtcacggcgcgtcggcgtgctcggccgccgcgccgccgccgctcacggtcacgggcggcagggtggcctgcggctggacctcccccaccgcagccgccgctgagtcgacgagctccgtaaccttccaggacccctacaggagctccacccatcagcagcctctgtctgatgccgcctcgtctctcggtgatcctcacatggactggacgcaagccttcttgagcgggaggagtgataccagcttccaagccgtgctccaagaacaaccccccgcgatgaacgatccactaatcagggacggcgacatgagtgccggcagcttcttggtcgaccagcaggcgcagctatcgccgtcgccgtcgccctacggcacggacccatcgcaagctcaagctctattcgacggcacggcggcggtgcacaacatttcgatgtacggagacagcgagtcctcggtcacctatgacgccacggcggcgtcgatgcagttttcttccc

SEQ ID NO: 3969 - DNA, 372 bp, Sorghum bicolor
  Clone ID: SORBI-28MAY03-CLUS6864_1
agctgatgaaggatccagagtcactgaacatgtctaaaaagtctccaagatcagcatcgaaattggcgtctaccctgcgcagcctctcattcaaaagaaaagatgagctcccagaggattgtgaacaacttcaacagcaaagcgaagatgatccttatcagacacttgagactgcatatgttgctcatgtttcattaagctgggaggctctgcattgcacctatgtgcacctgagccttatcgttgcagcacaacctgataatctacaacctacagctctgctgtcaagcttcacagcacaggcctgtcctggatcggggattcgttgaaaatgagccattcgagcatggtaccccggttgagatatatgca

SEQ ID NO: 3970 - DNA, 525 bp, Sorghum bicolor
  unsure (1)..(525): unsure at all n locations
  Clone ID: SORBI-28MAY03-CLUS68644_1
tgttggcctacaagtaaattttctctctgtatatatagcaagcagcttctgcttgaaaccacaagatcagtgcagcagtatcatgaggacctgcaactacatttctgcagctgtggcatcgccgccgccgctcaggcaatggcccggcggtatttcatggcagcggtccagcaggttgcaatgttctgccacaccaacacggcatggtgaccttgacaagaaaggtgacaaccgcctgaggcagaccaccggcattttccagccatctatctggggagatgtcttcctcgactactccaacccagcagcagcttcgtcgcaacaacaggtctgttcatttacagatgtactgtattatttccgtttcttattctctctctctctctctatacacacacacacacacacacacacacacacacacacacacacacacacacacacactattttccgcagattcagatgcaggaacgagtggacaaactgagggaagaagtggcaaacatgatngtaagttcaacta

SEQ ID NO: 3971 - DNA, 654 bp, Sorghum bicolor
  Clone ID: SORBI-28MAY03-CLUS68707_1
gaatcagcagcgaacagggatcatagatgctgttgttgcagcccgcatactgaatgcaacacttgtcattccaaagctggatgaagaatccttctggaaagatgcgagcgcctgtgctgggggatttgatgtcagactagccccagatagatagttcattatagttataggtttgtttttattacaaagggcttggtgataaattattttgaggacagaagctgctacataatttatctttctcctgtttattcttggagattggagacccatagaaacagctcaccaaagaagaaaggcctggaagagcttccttcagaaaagacagaaggaagcctatatatagttcagtacgaggtagcaactgtacagtgtttgatcggtcctcaaacaatgcttactggagaaatggaagtcattttgccagtcatggtttctctttcatatagcttgtcccgtagataggaacaaaagaattccctcttatgttttactgggtagtattataatgcgattttgatgtgtctatcaccattcttgattttgttttttcataatgtccgttaccaattttgctgacctccatttaaatttgtatatataacctgaaacatgagagtgtaacgggaaattttgtccgagcatacatcattt

SEQ ID NO: 3972 - DNA, 414 bp, Sorghum bicolor
  Clone ID: SORBI-28MAY03-CLUS6872_1
atatgcacagctcgcccatcagcccacgcggccacgccgaagcatggcgctctccgtctcctccctcgccgccgccctctcccacctctctctcccatcgacttccacctccaagccccacccggccccgctcctgcgcctgcgctccacctcccgccgcgccgtcagcctcgcgctccgcgcctccgcggccgaggccgccgagccgtccgaggcggacctgcccgtggaggaggtggtggccgtcgaggaggaggcggaggaggatgcgctgtcgggaatcgcgctgcggaagtatgtgaagcagaggctgccgggtgggttcgcggcgcagcggatcaccgccacgggccgccgcaagacggccatcgcccgcgtcgtgctccaggagggaaccggcaggtcttcatcaac

SEQ ID NO: 3973 - DNA, 619 bp, Sorghum bicolor
  Clone ID: SORBI-28MAY03-CLUS69063_1
cctactggatattaaaatattcaactttctttgtaattccatctaaatgcaagcagaccaagaaaaggatgtgagtcctgttgccgtagatatccaagtcaaagaagaaaccagtgacatcgagcccacgctggtccctcacccaattcgcaagcaagcaaattcttcaaatctccaagcttccttgacgttatttaaaagctttattggaactggactcctggccttgccctacgcttatagaacagcaggggtcactctttcgataataatgactgttattatcagttcaatgctgggctattgtttcctgcttttattggaaactgccaatgataaagtgggaaagggcagaacctcattcccaaagcttgcaagagatattcttggggtaaaaggcaagtatatcgtgcagacttttctcttgattgaacaactttgctgctgtattgggattatcatctttaccaaggactttttaaatcatattctttgttcgtttgagattgattctctttgtggaaatacagctttcaacttattcttctctttggctctcacagtcccactttctctcatcaacaatatgcactatttttatatcccaagtatggccgct

SEQ ID NO: 3974 - DNA, 656 bp, Sorghum bicolor
  Clone ID: SORBI-28MAY03-CLUS69066_1
gtacgccccaccgtgttccggcgccgctcacgaactcctcccggcgctgcccatgacgacagtgtcgcgcgcgctcggctcagcgttcgcgggcttcacgcgggcacccgcggcggcgcagactgcgacgaccctgccctccccgtgcggctcgtcggcgctactccagcactggcgctggagccgggctagccgcgcccggcggttctcgtccggccgctcggcacggataagcatgagcctccgcgccggcatcgtcgggcttcccaacgtcggcaagtccactctcttcaacgccattgttgaaaacggaaaggcacaagctgcaaactttcccttttgcaccatcaacccaaatgttggtgtggtggctatccctgatcctcgtttgcaggtgctctcaaaattaagcaagtcacagcagacgggcccaacatccattgagcttgtggacattgcaggtctcgtcaaaggagcaagcaaaggagagggactaggaaatcaattcctttcaaacatccgtgaagtggattccatacttcaggttgtgcgatgctttgaggatgacgatatagttcatgtcaatggcaaggtcgatcccagatcagacatcgatgtcattaacctagagctgatattttcggatcttgaacaga

SEQ ID NO: 3975 - DNA, 674 bp, Sorghum bicolor
  Clone ID: SORBI-28MAY03-CLUS69073_1
tgttggcctctgatatagtctgaacgtgaagacgacgacacacctcaacgacgacgacaaaaaaatgggccactcctatcttcaactcctcttcttcctactagtgttcatcaccttcaactccagcttccaccaatccatggcgcagactgacgccggcgagctagcaacgctcctaacaatcaagaaagactggggcaacccatctgccctcagttcatggagttcccagaacgcttcttcctactgcagctgggcaggcgtcgtcaggtgcgtgaacggccaagtgtccgccctgtccttccaaaagctcaacataatcaatccagtcccagcttccatctgcaacctcaagaacctctcccatctcgacctttcctacaacaacctcaccggccagttcccgacggcgctctacggctgctcggctcttcagttccttgacctgtccaacaaccacttctccggtgctctcccagctgacatcgacaaaaaactgtcgtcgccggcgacggcgatggagcatcccaacctgtcaagcaatggcttcacaggcagtgtgccgttggcgatcgccgggttcccgaagctcaagtcgttgctcctcgacactaacagcttcaatgggagctacccgggtgccgccatcggcgacctcacgcagctcgagacgc

SEQ ID NO: 3976 - DNA, 642 bp, Sorghum bicolor
  Clone ID: SORBI-28MAY03-CLUS69076_1
gcctactggagactcggccgccactccaccttcttgctcctgcacctgccccgtcacgccgccgcacaccaccaccggctctactctccttcctcctcctcatcctcctcccaaggtcattactcaaaaatgggtgattcaagtgagaagaatggtcatggcactctaacccgggtgctattttgtggtccatattggccagcttctactaactacaccaaggagtatttgcaggactatccattcattcaggttgatgaagtaggtcttgagcaggtacctgatgttattgacaactatcatatatgtgtagtaaaaaatcggcgtatagattcagatatcattgccaaggcaactcagatgaagattataatgcagtatggtgttgggttagaaggcgttgatgtaaatgctgctacggaacacaaaattaaagttgcacggatccctggaagtacgacagggaatgccgtctcttgcgcagaaatggcaatctatcttgcactaggtgttctgcgtaagcaaaaggagatggacactgctgtgaaccggaaagaccttggtattccagttggagatacattatttggcaaaacagtccttatccttggatttggggccatcggcgttgaacttgccaag

SEQ ID NO: 3977 - DNA, 609 bp, Sorghum bicolor
  Clone ID: SORBI-28MAY03-CLUS69089_1
tactgcgacagcctcatcccgatctgctatctacttgcattattattgtgtgcacttgcattgtccgtgcagtacagagcttccccaatcaaattaagatccccgtcgtctccctctcatggctcctaccgctcatcaggttggtacaaatgcgtgcaatgcaaatcacatttgccattcaaccatgcatgcatggctaagccgtcgcggcgaggtatactgtctgcttgttcaccagcaggcagcgcgggaggagctgctggaggagaataagagccaccggaggaaggacaacaccgtcgtcgtcgtcgtcggcaacaacaagcagtcggcggcggcgttggtgcggtgccacccggcgctggcggatcatccggaccgcaaggcgtccatcaggggcgtggtgggcgagctgctgtcgatggccgggagcgccgccagcggcggcaggagcctcatctcgctcggcgtcggcgacgcgtcctgccacgcctgcttccgccgcggcggggagttcgccgccgaggccgtcgccgacgtcgccaggtccggcgcattcgactgctacgcgccgtcccatggattccccgccgcacgacgcgcggtcgg

SEQ ID NO: 3978 - DNA, 492 bp, Sorghum bicolor
  Clone ID: SORBI-28MAY03-CLUS6910_1
gccggcgagctagcgagatctttccactttttttccagactgcgcgacggggactcggggagagagagagggcaccggcgatgtcgacgacgacggaggcggcggcgaagagtggcacagccgcaccggtgaggtgccagcggatcggctgtgacgccgtattcaccgacgacgacaaccccgagggctcctgccaataccacccctccgctcctatgtttcatgacggcatgaaagagtggagctgctgcaagcaaagaagccatgatttcagcttatttttgcagatacctggatgcacaacaggaaagcatacaaccgaaaaaccaattacaaaagctgtttcaactaataaccctataaaggcaacaccaatccaggcctctaagcagggtgtgggagttgaagcgtgtgcaaggtgtcgtcaaggtttcttttgctctgatcatggatcacagcccaagccacaaaaaccatctgctactgatgata

SEQ ID NO: 3979 - DNA, 656 bp, Sorghum bicolor
  Clone ID: SORBI-28MAY03-CLUS68862_1
actatgtcatgatgatcagcattgttgacaaccaggccgccatcctcatgtcagccgaaggtaccaacgtctggagtggtgcgcaggtccagcagttcaacaccctcgccatcgcctggtcaatcgcccccaagatgttctctatcggcgctcgctacgaatgggtcaccattgcctacctcattggcttcgccgctcctctccccttctacatcgctcacaagttcttcccccacatccgaatcttctcttacctcaacatccccatcatcctttggtacctcggttacctcttcgtcggactcaacgcctcagtcaccagctacttcatcctcggtgcctttggtcagttctacctccgaagataccgccctgagtggttcgtcaagtggaactacctgatctctgctgctcttgatggtggtactcaagtcatggtctttattgcgacttttgctgtctttggtggttctggaaaggcggttgccttcccagaatgggcaggaaacaaggtgaacaactatgactactgtgctttcaatgcgaacagttagatgaggagagtgcggaaatggccaaggagaggccatgtaattgcagtcccataattatagcgcttagaagcacattagtgaataaatgacttcattatgaaa

SEQ ID NO: 3980 - DNA, 670 bp, Sorghum bicolor
  Clone ID: SORBI-28MAY03-CLUS68867_1
ttttagtaggagaagatctaaatggttgtgcttttgtgtatggctcattaagttttgttgacaaagtttcatgtggagtagctctgtatgttcttgagtcctatcaaggaagtacaaagatcagatcaaatttaggaacagtatttggctattcagttacaagacttgggttgggcttagttccagcggtctgttcactgctttcagcaatagtagcttataccatggacctccctgatactcggcggagacctttggtggagccccttctagcttaactacgctggtggcactgttacagtttcaccgtgaacattcacagtaattgctcgatggaataacactgctgctggagcctgaagatactaacaagattataggcaaaggaggaatcgggtacaagtcaattcgttttgacttcatatatatagtctgtataaattattcacagtaattcgttttgcaatccaatgtaaatataacttagcttcattgttgaggacaacacgtcacttgcagcaaaactgccaactaggcacatccaacggttggcaaggaaaagaatgtctctggtccttgttttaaaggactgtaatttcattttaaatgttctcagcgtgtacatatagcatcatgattcaaaataaacaattcatatttatattgatgg

SEQ ID NO: 3981 - DNA, 680 bp, Sorghum bicolor
  Clone ID: SORBI-28MAY03-CLUS68872_1
ggacgagatgaggacatcgacctggtgatccccccggtgttcaaaggctgcaccaaagtgctcaacgctgatgaccagaaggtgccacgagacctctactgggaggcagtatgcagcggcgatgaggcgtcagactggctcaaagtggaggagctccttcagcagagcattgccaagaacccatttgtaggagaaccacacttggtgcttgcacaggtgtaccttaacatggagaggtatggcgatgcgcagatgcaggcagaggaaggtctcaagctgttgctggagtggggcagcagctgggacaagagaatgacatgggaggggtgggtgtcttggggcagggcgatgctgaccaaggccagcgagaaggattggcctcatactgcattcggcatcatcaacctagggcttgtcaaatgatcaggactcatccccaaatggcggatggatggttatgtaggctgcagctgccgatgctgatccgacatgtcatcttctcagaatatgtatatcacctgctgtatttgtacgaaataataaacccatggtcagtcaaaatggactatgctggaaaataaggaaactagtctattcataggttcatcttacctaatttagttcagccgccgcttgtacttggatattcagatattaatgtgaaataaagcactggaagg

SEQ ID NO: 3982 - DNA, 593 bp, Sorghum bicolor
  Clone ID: SORBI-28MAY03-CLUS68884_1
cgtcctccccgtcgactacatcaccgccgacaagttcgacaaggacgccaacaccggctacgccaccgacaaggacggcatccccgacggctggcagggtcttgactgcggcgaggagtccgtcaagctctacaaggaggccatcgccgaggcccagaccatcctctggaacggtcccgccggtgtcttcgagttcgagaagttcgccagcggcaccaaggccaccctcgacgccgtcgtcgacgctgtccagaaggacggcaagatcgtcatcatcggaggtggtgacaccgccaccgtcgccaagaagtacggcgtcgaggacaagctcagccacgtttccaccggtggtggtgccagcttggagctcctcgagggcaaggagctgcccggtgttaccgctctgtcgagtaagtaaataatatccacacctgttggagtacgatgtcttatgagaacctgttgatgacgggctatgaaaatggaaaaaggtcgggcgggaagggctagtctgtagcaaagactgaacagatcaaataattaaataccaaataccaatagaggcgcgaaagcgctataagaacgttacctcg

SEQ ID NO: 3983 - DNA, 691 bp, Sorghum bicolor
  Clone ID: SORBI-28MAY03-CLUS69322_1
cagatgaaagtgacaaattgcatgaagaacttattacaatcgaagaggatctttatgcatcactcggactccatttcaaaactctggatatggcaaccggggatctgggcgcaccagcctaccgaaaatttgacatcgaggcatggatgccaggcctagagcgatacggtgagatctccagtgcatcaaattgtacagactaccaaagtaggcgacttggcatccgttaccgtccatcaccctcggagcctccgtcaacgaacaccaagaaagggaagggagctggctcaggccctacacggtttgttcacacgctcaacgcaacagcagtggcggtgcctcgtctgatagtctgcattctagagaattttcagcaggacgatgggtcgattgtggttccagagccactaagaccctatatgggtggacttgaggtgatctccccaaaattcgagtgaccctctacagtcacccacggttgtgcttgtggacttagagctgtctacaaatatacactactgagttttgtgattggggctcctgtttcataactagtcttatcccccccccctgtttttgaatagcactctaatctgctggtgcacattatattggccaactactgtaatctgcatagcactacaaactcatgtgcatgatttagctttgagtaaattgcactataggtcct

SEQ ID NO: 3984 - DNA, 969 bp, Sorghum bicolor
  Clone ID: SORBI-28MAY03-CLUS69304_1
ccagcggtgcagagcaatgtcgccaagctcattatgaggaacaagcctctttcccatggcatcccacgattcaccatccccttgcactgtgacggacttgttctgatccccagcatcacagggcacatatttgtgtgcaacccggccaccaaggagtttgttgagttgccacgggcacccggaatgtgttgttggaacaaagggtcgcctttggcttcgatccttctagtggtacgtataaggtggctaggcacttcttgcgctcatacagtgaagggtaaatacgtacagaattcgacgttggacatgaggtcttaatgcttggcgatggcagggacacgttggaatggaaagcaaccattgatccaccttaccctatccaggccaggactcctatttgcttgccaggattcttctattggagtgcggtccagtccgtggctgaccctgatcagggtaagctcgacatagatgttatccttcgattcagcatgtgtgctgttccattcactgtgcgcccttgtccgcctggctcgtgctgcctatctactgatgtcggtgtgtgggaggctggtggcaagctgtgctatgtccactccctttccccgtttgaagtctccatttggttagcacaaaatggacaaaacataataaaatggtcgctacgttgtcgtgttaatctgcccataccaaggggtgctcgtgttttagcttgtgcttcagctgatgaggacacaatattcctctctgtggatgctcgggatcttttcaagtgcaacctccatgatgtcttgaaacagtagtcaatatgcgacatgacctatggtatcaccacgaggaaggggtaaagtttgtccatggttccctcccttttttgcattacatgctgccatatgtggaatctttgctgcgtattggaccatgctagccacctgacgtatgttatcaataccaataaaagaaagagta

SEQ ID NO: 3985 - DNA, 427 bp, Sorghum bicolor
  Clone ID: SORBI-28MAY03-CLUS6935_1
actggtttggttcaaaagcagcacagaaggtgcagatgcctctgactgctgttacctctgtaattgatggcttgaaaagactatatgttgaaaaactgaagccattggaagtcgcttacagatacaatgattttgcttccccattattgacaaacagtgattttgatgcaaagccaatggttatgctcttgggtcagtattcaacagggaaaacaacattcattaagcatctgctgaagacaagctacccaggagctcacgtcggaccagagccaaccactgatagattcgtagttgtcatgtcaggatctgatggaaggaccattccaggcaatactattgctgttcaagccgacatgccattcactggtcttacaacatttgggggagcaattctgtcaaagtttgaatgctctcagatgccaca

SEQ ID NO: 3986 - DNA, 622 bp, Sorghum bicolor
  Clone ID: SORBI-28MAY03-CLUS69351_1
aaaagccaaaggttagtgaattacgaaggcgaccaaacagaccccccgctcccgtgcactgctcatggccgacaatcccctgggaagacgcagcggagaaattctggagacctaaaccccggcacgaagctaggcgaactgcagcctgcaggtcgacatctaatccatttcttgccgcttcagcttcagcgttgagggggactgactggtgtctggtgtagttggaaggcagagcttcgcggcagcgaagatgagcagcagatacagggctgacagagggagggctgcctcagatatgacaaggaagctcagagagttgcttcaaaagagcgacaaccgcatatgtgctgactgcagcgcacctgatcccaaatgggcatcagctaatattggagtattcatttgtctaaaatgctctggtgttcacagaagccttgggacacatgtttcaaaggtgctgtcagtcactctagatcaatgggcagatgatgagatcaactccatgatagaagttggtggaaactcttatgccaatgctatatatgaagcatttctgccagagggctatcacaagccgcatccagattctagccaggaagagagagctgatttcatcaggtca

SEQ ID NO: 3987 - DNA, 659 bp, Sorghum bicolor
  Clone ID: SORBI-28MAY03-CLUS69354_1
tggaaactaatcgtgtcgtgtcgtgtcgcggacgcggtctcctcgggacgagccttaccctccagcaccagcagccaacaaactccaccgccggcggcgcgagatccggccatcccaccgcccctcagttcaggatctcggggggccttctaccgctcttcgccatgcccgccgccgcctcctcatcctcctcctaccacccctaccaccgcgcccgcctccgctcccgcgccgcgccgctgctcctcgtcgtcgtcctcaccgtcttcgccgtcaccgagctcctccgcagccgcacgggcctccccgcgcccgcgggccggcccggctctgccaccgtcaccaccacctcctcctcctcctcctccgtcgccagcgccaaccacagcgtggcgcaccgcaagatcctgctggacccgaccttcaccccgcggctgccgcggcagagcccgctgtcgctttcgctctccgcgcgcaacgcgctgcctccacgcaacagggaccgcttcccgacgctccccgatggccacctcaaggtcgtgctctacgtgcacaaccggccccgctaccttcgcctcgtcgtcgacagcctctcccgcgtcgagggcatcggcgaggcgctgctcatcgtcagccacgacggctacttcccggagatg

SEQ ID NO: 3988 - DNA, 602 bp, Sorghum bicolor
  unsure (1)..(602): unsure at all n locations
  Clone ID: SORBI-28MAY03-CLUS69375_1
cactccaaccaaaccaaaacccaaacccactgcacccccccgaaacccaggngcctcgncgtcgtttgatgcgattccggcggcgatcgcgagcgcctccaccaccacccgctcccccgtcccagcgtgcgttcgggcgatctcccctctcgcggcgggcatggctggcggcggcgccggggctcgcggctccgacagggcgggggcgggggcggcgcgctcgcccaccaccaccgcggcgatccagaccaccatccagtcgatcaaggaggtcgtcggcggccactccgacgccgacatcctggacaccctccgcgagtccaacatggaccccaacgagacggcgcagaagctgctcaatcaagatccttttcatgaagtgaaaaggaaaagggacaaaaagaaagagagtgctggccagaagagctttgctgatagtactgcacaagttgagcagagctcacagtggatgaagccacatacccaaaggatggaaaatgatcaaagaagaactcccaatcagggtcagaattcaggccctagccgtgaatttcgggttgtgagagacaacagatttcaacatgggtgtggtggagaacaga

SEQ ID NO: 3989 - DNA, 676 bp, Sorghum bicolor
  unsure (1)..(676): unsure at all n locations
  Clone ID: SORBI-28MAY03-CLUS69365_1
ggttcgcccgcggcctacccgcggcccgactcgctcctagccttcgcgagaacccgccggcctcccccctccgccggacagcggccgccccccccctccgcccctcgcccggcgcccccgtcgtccgggccgggcgcggccacggcgagctccgcgtccccggcggccagggcgcccaccgcccccccggcgggggtggcgccggcggccccgccggcgcggcggccctcggccgcccggccccccccaccgctcgccgccgctcctccccccccggcggcggccgcccggtcgtcgccggccgcgtcgggctccccgtccccggcggccagggcgcccaccgcccccccggcggggcaggcggcggccggccgttcgacgcgccggcccgctcccgctccacccccccccgcggtggccgcccctgctcctcctgcgcctgccgcggccggagaggtggtgcccgtgccggcgcctgcggctcctgccggcggggccgtgttccccgcccctcccccccctgccccgggcctgctggtgcagccttcgctcgggcttcccggcgctgctcgagcccccttcccgcacccagtgctgatggaaccctactggaaggcggatcatgactacnttgacnagctagctgaaataaggaagcttcccacactggattcag

SEQ ID NO: 3990 - DNA, 964 bp, Sorghum bicolor
  Clone ID: SORBI-28MAY03-CLUS72774_1
acggccgcgtcgcttgcacctacacgagcacaggggggtggagaggcgtggagcggatcgccgccgagcactgcacgacgctggggtgggtgaccgtgacagcccgttcccctccctcttggcggatccccatctctccgtctactagttggggggcggagatccgagtccaggcgaggtctgctctggtcatctccggcgatcctccttcctcccccatcgcctccgcctgccagttcccttcgctgggcgctcagagatcccgtctccctacgcttgcggggactaactcgagtagtgtcactcaatgaatttcctctaccgaactacgcagcctgcagcacctgagctaccaagacgctcgcacctacaccagcacagggatgccttacaaaagccaactacgacactggagggtctcatcgcggatgattcataccagccctcctccgctcgcagcgaagatggagttgctaataatgggtctagggataccagtggggatccttcatctctagattcaaaaagcctggtcccactggggacacattctgatgtcacagaggatgaaggatggatcacaattccatgcaaggcacttcctgaaagttggaatggcatatcagaaatggttcagttgcagactctggaccgttccttcctttttcctggcgagcaggttcatatactggcgtgcctgtcagctttctaagcaagatgtacagggtatatccccctttagaattgctgcagtgatgtctaagaatggaaattctttgcaaaactctacaaataaatctagccctgttagtgcaaatggtcatgataatggagcagctggagaaagtggctatcaggatgttgaactcaatggtgaagcttctcctacagaacatgatattttggagactcaatctctccttcagatggaggatcgtaagcagcagatcgaacatgtgttgcg

SEQ ID NO: 3991 - DNA, 475 bp, Sorghum bicolor
  Clone ID: SORBI-28MAY03-CLUS7282_1
gcacgagggtccacttgtatcaagtctgaaacctgaaaagaaagagcagctcgtggaacttctggacgcaaaggcgggtgatcttatcctgtttgcactgggtgaacaatcatcagctaaccggattcttggacggttaagattatttattgctcataagctggaggtgatagacacgtctgcacattcagttctttgggtgacagattttccaatgtttgaatggaacagcgatgagcaaagatacgaggccctccatcatcctttcactgcaccaaatcctgaggatatgaatgatctaccatcagctcgtgctctggcttatgacatgatttacaacggtgtggagattggagggggaagtttgagaatctacaaaagtgatgtacaacaaagaatttttgagatcattggtatctcgcctgaacaggcagaggagaaatttggctaccttttagaatgcttcgacatgggt

SEQ ID NO: 3992 - DNA, 614 bp, Sorghum bicolor
  Clone ID: SORBI-28MAY03-CLUS72826_1
gggacatcaccagttcagagttcaccacaccacgcctttgacctccagcccatagcccaatcccccaagcatccttccccgctataaatccgcccctctgcttccgattcgccacctaaaggaggcgcctttccccaaatccaccagccaccaccaagaacataaacgcaggcaagccgctcgctcctcgtcctccggccagcctagtctagtccactctcttgcggcggccgcgatggagggcagcagagccggcgccggcgactacattgccagcctgctgagctcgtcgccgaggctcgacttcggcgtgctcggcgccgccgacggcggcggggaggaggaggactgcctggacaagttctgcggcgacccggggttcgcggcgcgcgcggcgcggctgtccagcttcagcgcgcagcgcttccccggcgccgcgagcctcttcggcctgcccccgccggtgcccgccgcgagcggcggcggtgagttcgctggctcccgggaggcgtcgtcggtgtcggacccggcgtccgcgatgatgaaggacgccaatgccaagaagcggaaggcgcccccggcggccaaaggcaaaggcaaggagtcctctgttc

SEQ ID NO: 3993 - DNA, 847 bp, Sorghum bicolor
  Clone ID: SORBI-28MAY03-CLUS72843_1
agaacagctctcgcgcgatccaatccaacgcgaacctagctactcctcctctgtttgaccgcgcgcgcgattactcctagcaagcagaagcagctccccgaccgagccccatccgggtttataatttactccagtcaccaaaccttcggagttgaagccgtagtatatatacaacagcccctctcgagatcgacaaggagaagcaatcagcgtgcatccgagggagagactgatccggacgcgaaaggcatccaccgagtttccaggtctcaccagccaagaacaaatctagctactagtagtaattaagctacagcgcgagcaagaagaggttagtgtcgggtggtcgagttcgggttcgctccatggagacgaagaagcagaagaagcagcacgcgaggtcaaggagcttcacgggcggcgggctggcctccttcctcaagtccaccgtcgcctccttctcctccaccttcccgtcgtccagcggcggcggcggcggcaggagggcctccttcaaccaccgcaacgccttctcgggccccatcgtctccatcgtcccgccggaggcccgcggcggcggcaggaggaataagcggtcgtcagggtacgtgacgcccgagccgtcgtcgcccaaggtgtcctgcatcggccagatcaagcgcagcaactccaggcgccagaagaaggtcaacccgtgcggcaagaacggcggcgcctgcccgctcccgccgaggccgtcggtgtcagcggacgggaagccctgcaggccccccaggggctcgctcgtcaagcggttgtccttcttccggcgcagcaggtcgcgttctcggacgtcaagggcgtcgtc

SEQ ID NO: 3994 - DNA, 582 bp, Sorghum bicolor
  Clone ID: SORBI-28MAY03-CLUS69613_1
ctgcagatctgaaggaactctttaggtacaagactcccagcaaaatatagattgcatccactggaattcttacaaggaaaatatttcaaaactttggccgtgaagtgcagaagttgctttgttggagggacattgaacagggttcagattacctaaagaaatgacaggctgttagctaaaggctaaagctgtactcttttttttttcctgggcaaagaccctgtaaaggagcattcagacaagttcatacatggttttgatcccagaattttgtatgagacgtttgatcccagaatttgccagtacataaggagttatcagagcacagtgagcttatttacagatggttaaggcatgatgatgccactgggaaagtgggcatgtaataaatttacataggaacagtttttacaattgaaaatgacgactaccaattcttgtactagttgggaaggataattgccctttttgtaattatatacctgagcatggtgtgttcacctagtataggctgctaaagcctttaacagtgaaaatcaagccaggttgtgataccctataatactttgtgacatttcatcc

SEQ ID NO: 3995 - DNA, 638 bp, Sorghum bicolor
  Clone ID: SORBI-28MAY03-CLUS69722_1
gatagtttagtgcggcggtgggaaatgtgactcttgttagtcggtgatgtgcgttaagttggtcatttgatcatcttcctagctagctgccactagctagatgatccttttgtttcgtgttttgtttggagacaccaagcaatgaggatgaaacatccaacacctgccgcttgcttcctccatgagttcagtaactgtttgtcaattcgatctcttgcacactttgttgatactgatttttgttgtcaatactgatgaagaaagggagtacatatctgggagatacatgaatggtgaattgatgattattggcttattcctgagtttggagaatttcaacgcttcgatatatctccttgtccggttgtcctgcctgatccttttgtgatcaactgagttcttcttcttcaacgtcagctcattgctcctattcgtacacatatatcggtgttaacttttggatgactttttggttgaagagaagctcgagttgcaatttttttgggaacaagaagcaagttccccagttgccaagcgtgtgagttgtgaattcgaatgggtgagagatgcaatacagagcaatgcatggcacttgtttatctcttttttttttttttgaatcctgcacttagttgatc

SEQ ID NO: 3996 - DNA, 571 bp, Sorghum bicolor
  Clone ID: SORBI-28MAY03-CLUS69732_1
ggaaaggttatccccgaacttaagggcaaattgaccggtatgtctttcagagttcccactttggacgtctccgtcgtcgatttgactgtcaagttggaaaagggtgccacttacgaagaaatctgcaagaccgtcaaggaagcctccgaaggtgaattgaagggtatcctcggatacactgacgaagaagtcgtctcccaagatttcgttggtgatggcagatcctccatcttcgatgccaaggccggtatctcccttaaccccaacttcgttaagttggttgcctggtacgataacgaatggggctactccaacagactcctcgatttggccctccacgtcaccaagtaaaaaggataaaatttacaaagcattgcaggatatttcttctcaagcaaagcttttcataaaatggtctcttataatgacctttttaccagtttataaagttccattattatgaattattgcgattgagtttttatatttgagcaatcaaagaaaaagaacttactcgcgatgctattttattcgttccgttccgttccgttttgtgaaagaaagcacttaa

SEQ ID NO: 3997 - DNA, 577 bp, Sorghum bicolor
  Clone ID: SORBI-28MAY03-CLUS69745_1
cagcattggatccaggacaagaggcccgggaactggatgaaggacttggaaggctaccccgcttttgtcctcgtcaacagagtcaccggcgatgccatcgatgcctccgtagcccggggcaaccctttgaagcttaaggcgtacaacccgtgttacctggataagtccatattgtggacgaagagccgtgacatggggggcggctttcggtgcatacacatgctgtgcaatctctctctcaacttcaatgtcttgaagttgaaggtcgatggggagcaagatggcaccaaactcgtgctttcgtattggagtatggaatcagacaacctgcagcttcagtggaagattgtcccctggtaaatgttgtgctcgaggtctcgcctccgctgaactatgctggagttgtatgggtggaggtggtttccactttctgtctgtctgacgcaccttatgaaacttagtatgcatattgggctttgttgcacattttgggtttgcaccttttgcttccctaattcgcgtgtgctaagcattttgttttgaaaccatgccgtatatttaatatttaagctgactc

SEQ ID NO: 3998 - DNA, 709 bp, Sorghum bicolor
  Clone ID: SORBI-28MAY03-CLUS69145_1
tcaacgatgcccagcagaacgccaacattggtgacggcaacacagtcacaaatggcggtggccttgtcgtcttgcccctgcgccgcctgtccagcgcaagcacaaccaccaacaacaacatcaagttggccgtgaagaactccctgaacaagttcaacagcttggacagcagcgtcaacaccgccgtgactggtgtgaacaccggtaaggtgaccgtctccaccttcaacgctgcccagcagaacgccaacattggtgacggcaacacagtcaccaacgccgggggccttggccccgtgccccggcgccgcctgtccgccgcccgcgcagcctccaacgccgtctccgagtgggccgggaagctcgccctgtgcttgctctgcagcttggacccctccagcagccctggcggcacggggggcatcgccggtcagccggctgcctccaccctctgcggtgccctgcgcatccccgtccttcgtgccggcgtctccgttcccttcggccgtacccgtcccggcgcccccctgcgccgcctgtcctgcgcgggcacgtcccccttctacactctacgtcacacttttattgtcaacgggactgcctgtcaggcatatcggattgtatatcgggctgcatttgatttggtgtgttgtgattcctgagagcaagcttgagtcggcctacgacccggctttgatgcaacatgtct

SEQ ID NO: 3999 - DNA, 629 bp, Sorghum bicolor
  Clone ID: SORBI-28MAY03-CLUS69118_1
ctgccgttcggctaaacccggccgcccgcctgcggcactgcactgcaccccatcccgaagccgggagcggaggcgcaaaaccctctctctgctgctgctccggcaccatgggctgcgcctccaagctgctctcctccctcctcctcacctcctccccgctccgcctccgacccaccactactgccgccgccgccgcgctcttcctctccccgcccgcggcggcctcgcgccgcctgctcctgctctcctcgccctccccgccccgcaccctctccacctcgtccgctgctgccgcgtcctcctcccttccgcacggctccagctcggactccccggcgccaccgccccgagctcctttccccgagtggtcccgcctcgtcgaccgacttgccgctgccgggtacggctccggcacgccctttcctgatgacgagcttgccctcgcgtccggatgcggtctgccggacggggcgcaagccgctgtctccacctgcctcgccttcgcgcttgaccggcctggactcctcagttcgcttccaaggaaggatgtggaggtcctggtgaccaatgcggcgccgtctctgttcaaggatggggaggcatcagcacagcggcttcggcgctacctt

SEQ ID NO: 4000 - DNA, 743 bp, Sorghum bicolor
  Clone ID: SORBI-28MAY03-CLUS6915_1
cggacgcgtgggtcagaatggccattcaaagggatatggttttgttaggttttcaaagagggagtatgctaatactgctaaaaggcaaaagaatggtattgagcttcaaggaaagaggcttgatgttgatctttcaatggatcaagatacagttttctttggaaatctttgcaaagagtggacttcagaagaatttgaagaattgattcacaagacattcaaagatgttgtttcggttgaccttgcaatggcttcaaatcgttccttttcaaacaagaggaatatcaatcgatgctttgcatttgtgagatttacttctcatgcagctgcagcacgtgtaatccgtatcggttcaagaacagattttatgcttggcgatttgcatcctgcaataaattgggctgataaagagtctcatgtggatcctgatgaaatggccaagattaagtctgcttttgttgggaacctgccagaagatgttaacgaggagtacttgagaaagctttttgaacagtttggtgaggtggtacgggttgctatatcaagaaaaggacaatgtccagttggttttgttcacttcgccaatcgttcagagcttgaaaatgctatagaagaaatggatggtaaaacggtgagaggacctgatcgaggaccgtcttttaggatccaggtgtcagttgctcgacctgcagcagacaacgacaagaagcgatctcgtgaagaagtgagaactagaagatcaa

SEQ ID NO: 4001 - DNA, 703 bp, Sorghum bicolor
  Clone ID: SORBI-28MAY03-CLUS69261_1
ggagatgttactggaatgatagctactcccatgcatttcataccttcttcaaccattcaaaagtgtttggagatttggaggacatacagccatgtacctcggatacatcttgggatgaagctttttggcatcaaatgtttaaaccttgtcagtaaagagaagatatctcggaagtttaatgttgataccggtcttattgttaaagaggtgtcagcagaatctaatgctgagaaacttggtgttaggatgggtgatattattctatccgtgaatggtgaagacattgctactgcagttgagttggagaataagttgctagatataagcaaggcccatttggaacaaggaattgtccctgactccggcgtggatgtattgttagcgcttggagtattcaatgccaccaaatgtgcccgtggcagaatactgttaagagcaagactgtcaaatgatgaggaaatcatcgaagaaggtaaataccctgttatctacaaaaggccaaatgtagctgctccagatgtctccttttcgagcggatgatgatgaacttggtgaaaaaaaaatgaaggctgctcagtcgtcaccttgaaaaactttgcaattatttatctatgtttagagctttattttctcgctatcttgtttgatagcggctaattcaggtgttgtactaaaagtatatgataatttaatattggccttt

SEQ ID NO: 4002 - DNA, 621 bp, Sorghum bicolor
  Clone ID: SORBI-28MAY03-CLUS69303_1
aagcgaaaaagagttatttactctatactttaagttcatcgcaagccatgtcgggcatgcagattttcgtgaaaaccctgacgggtaagactatcacgctcgatgtggagtcgtcggacacgatcgaaaccgtgaaacagaagattcaggacaaggagggtatcccgccggaccagcagcgcctcatcttcgccggcaaacagctcgaagatggccgtacgctccccgactacaacatccagaaagagtcgacgctgcacctcgtgctccgcctccgcggtggctcgggtatgcagatcttcgtgaagacgctgaccggcaaaaccatcacgctcgacgtcgagtcgtctgacaccattgaaacggtgaaacagaagattcaggacaaagagggcatcccgccggaccagcagcgtctcatcttcgccggcaaacagctcgaggacggccgcacgctcgccgattacaacatccaaaaggagtcgaccctccacctcgtgctccgcctccgcggcggctccggtgcgctgcttttcctgcgcccgtcctccgcccacccctgcgcgttgctgtgtcgcgtccttttggcgtggctcaccgccttgcaaatctcgtcttttg

SEQ ID NO: 4003 - DNA, 737 bp, Sorghum bicolor
  Clone ID: SORBI-28MAY03-CLUS69821_1
atgaagcagcagagtttgcagttctggaaagttcaaatgggaaatcatttgacaatgattatattctatcagttgcttcaggtatcactaatggaaaaccttccaacaatggagcctcctcattaattgaggaaaaggaaagggaagtttcagtcgctactgttgatactagagcatctgccagcagttctaatggaaaggttcaggttggatctcaaaaatctgctgcaaagaatggtaccccttatcttgagagaagcaaatcagataatgttgatggaaatatgtgtgcatcttcaactggtgtcgttagactccagtcgagaagaaaagcagagatgtttctagtacgtactgatggattttcttgtactagagaaaaagtaacagaatcatctttggcttttacgcatccgagtacccagcaacagatgcttatgtggaaatcacctccaaagactgtcttacttttgaagaaattaggcgatgagctcatggaagaagctaaagaggttgcttcatttttgcatcatcaagaaaagatgaatgttcttgtggaacctgatgttcatgatacatttgctagaattccaggttatggttttgtgcaaaccttctattctcaagataccagtgaccttcatgagcgagttgattttgttacatgcttgggtggtgatggactcattttgcatgcatcaaacttatttagaacttctgtaccacctgttgtctcc

SEQ ID NO: 4004 - DNA, 575 bp, Sorghum bicolor
  Clone ID: SORBI-28MAY03-CLUS69839_1
tcaccgtgaacgtgaggaagccggcgaaggccaaggacggctactacggcaacgtcttcgccttcggccttgctgcctcgacgctgcgtgaggtcgccgacggcgacatccttgccctcgtgaggctggtaaaggatgccaaggcacgggtcccgtacacgtttgctgacggagcggcgtacatcgccgacgagatgggcggccggctcaagggcctcgacggttatgacaccttgtatgtgaccagctggtggaatctcggcttggacgacgtcgacttcggcagcggcggcgctgaacgtgtcattgggaacatggagcgcaaggtggtgccaggctgcatcctgtgtgggaggaaggacaaggccgacggtgtcgccgccatggcgctctgtgtcaagcaggagcacgtggagaccttccatgcggagctgcaaagcctcaagtgatgtggataatatgaatattgtctttttagtttgttagtgcacacaaaaacatagactctttgcccatggaattgctgtaacacccggcccaatgcttaataggattaataggagactcataccaac

SEQ ID NO: 4005 - DNA, 346 bp, Sorghum bicolor
  Clone ID: SORBI-28MAY03-CLUS6984_1
cccacgcgtccgaatgaagtcagtgctgctgaaaaggaattgcttgatgagattactgatttggaaaagcaaagagatgagcttgaggcacagctgaaaaaggtcaatatatcactaaatgctgctgctggacggctcaagcaaactagggaagagagggaccaatttgacgaacaaacaatcaaatcatatttagcttgaaaaaaaaggaggcttacctctcgtgctccatcggcttatgttatgattggaagtctgggctggagtagctaacagaaagcaaaattgtggtaaagggggtttatgaaatattaatagacacatgtgataattgtatgtgtataga

SEQ ID NO: 4006 - DNA, 626 bp, Sorghum bicolor
  Clone ID: SORBI-28MAY03-CLUS69843_1
caagaccagatggtcaatggacaggggaacgaggttatgtccagaatgtgttctcaaggatgaagaatattgtaaacccttcatcagtgggagcaattttgtgtgggcataaacagatgactgaggaaatcacaagagttcttgttgctgatggtttgtcaaaagatagaatcttaactaacttctgaccagtaggacactgttccatcccttttggaggttgtaccactttttttgtactatggtcgagcagctattctttacagtggcgcaagtgcaaatcgcaacaggaagacagttgcgtgcttacaaataagtgcagttcattctccatgtgaccacattggcttattgctgtacgcctgatgtaaatctcacaggcactggccgtagttgagatatgttttgtagcatctgagacattaatcccttgttaggcactgatgtactcagaacggccctttttggagaaataaaaaaggggtatagatgtagcattattttccgttagtataggttaagatatagcgctgagtgtgccttttgcagcgctgagattttggtgtatattgtcaaaattttgaattaattgagtggaggttagtatatggaatggatacgtgatg

SEQ ID NO: 4007 - DNA, 600 bp, Sorghum bicolor
  Clone ID: SORBI-28MAY03-CLUS7000_1
atttgacggctgatgccaccccgctcctcgtgtcctcgtcttccaccccgtccgcagtcacactcacacgcctcgtgctctgctactcgtcttggctgggaggtcgccggatccacgagcgcgggcgcggggcgatgggtggcttgggaggcgctggtggcggcggcggcggcggcgaggtcggcctgccggcgctcgatgtggcgctcgcgttcccgcaggccacgccggcgtccctcttcccgcccgctgtgtcagactactaccagcttgatgatttgctgactaatgaagagaaggttctaaggaagaaggtccaaggtgtcatggaaaaggaaatcgcacccattatgactgaatactgggagaaggcggaattcccatttcatgtcattccaaaacttgcgactcttggcttagctggaggtacaacaaagggatatgggtgcccagggctctcccttacagctactgctatttcaactgcagaagttgcacgggtggatgcgagttgctctacatttattctagcccatgcctctcttgtagtgccgactattgcgctttgtggatcagagtctcaaaagcaacagtacctac

SEQ ID NO: 4008 - DNA, 513 bp, Sorghum bicolor
  unsure (1)..(513): unsure at all n locations
  Clone ID: SORBI-28MAY03-CLUS6987_1
caatttgtattacaagaattaataattgttggctaaattattggtcaaagattataaagtttaactcttgacgtatgtggaatgccttataaactgatgatccaaatggagtaatagtttaatttattatgctatggttagccctcttttacattgaaaggaaaagcattgacactcttttgtggcaaggcatgattggtcaggactcaggacatgttagatttccttttagccttcatgcactgtttctcttgtgcgcatcgtattaacttgttaacacatcatttttacatttttcctgttactcttctggtactatgatgactactatcaagtgccttatcaaacatcactgtaatacagagcaccaatatgtctgcacccagccaataaagttctagatcttttgctgcttctgaagttctgataggtgatgcatatatattaaataaagtcctctttttnttaaaaaaaaagagacatgcacaagtgcctttcaaatttacgaataac

SEQ ID NO: 4009 - DNA, 500 bp, Sorghum bicolor
  Clone ID: SORBI-28MAY03-CLUS69415_1
cctactgggcactcgaggcctcccgcgcggtcccgcctccggcaacgatgctcgccgccgcgcgccccgcgtccgcccacctcctcctactcgtcccactcccttctcctccccgcctttcgcgtcccgcccccacccgcagactctacgccctcgcccctgcccgccgccctgcggccgtgcgcgcgcgccgcgaatcctctcctcccgccgcgcccgccccggccgactcgctcgactgcgtcggcactggctcggatgtcgagtgcttaatcgacgccggcgccaaagacgccgctagtcccctcctccccgcgcgctccccagccgccccaggcgcgtccaaggacgatgggaagaagagcgagggcgacgcggcggcggtctcggcttccctcctctgggagtgggcatccctggtgtcgcccttcttcttctggggcacggctatggtggccatgaaggggggcatcccccgcacgggccccttcttcgtcgcc

SEQ ID NO: 4010 - DNA, 717 bp, Sorghum bicolor
  Clone ID: SORBI-28MAY03-CLUS69472_1
ttcttagccacataattggtgaaaaaggcgtcttatgcatttcaatactcgcatccattgcttatgctttactttatggtgttgcatgggcttcgtgggttccgtactttagctcttcattgggtatcatctatgttctggccaaaccagcaatatatgcgatcatttccggtgaagtactctcaactgaccagggaaaagcgcaaggttttattgcaactgtgcaatctgtagctatattgttggcaccactatttatgagtccaccgacctcttacttcatttcagaggaagcgcccttcgattgcaaaggtttcagctttattgtggctagtttcttcttggtaatctccttttgtcttgcttggatgcttaatccaggaaacaaggacaaaggcacaaaatctgtcgtttcagacagccctgatgaggaagcagcgcaagcaccactattggcaaaatggcctagaccatgagtccacgaaactgaactatataatatacaaccagaagggaaccgagtgtgcataaaattgtaggatatgtgaattatagtagtaataacatagggcttgctttgtattatagtttatgtacatacaccagaatgaaaagtctgatcacctatatcaataccgacaagtgtgaagcgataaatttgaggttatctatgtgctaactcattatctaaaaaaggctatgtggtaacttggtgct

SEQ ID NO: 4011 - DNA, 739 bp, Sorghum bicolor
  Clone ID: SORBI-28MAY03-CLUS69529_1
gtccgtgtgcgaggggtcgggtgtccggtcctcctcccctccgtgcagcgcatgcgcggcagccggcagcggcgtctcttcttgccggtcccgcccgcgaatccctgcgccgcggtggataggaggaggaagtcgaggacgccataggaaaaagaaaaacacaaatccagcttggaatgctttcggagactgggggctcgtcgccggctgcctggactgatgctgggagcgtgcgaatttccgctcaagttttgatcttagcgtgctcttgagtctggaatcccgccattcattgggggctttgttcttgagtttacaaggctgcaaggccgtgctgctgattagtttgaacccatggagactactagcacaacaaatgggcagcctggtaggggggcaatgtgggagctggaaaggaatctcgatcagcccatggatgcagaggccgggagattgaggaatatgtacagggaaaagacctaccctacaattgtgctgttacaactagctttccaaagcctcggtgtggtgtttggggatttaggcacatcgcctttatatgtattctataacattttccctcgtgaaatagaagacacggaacaagttattggagcactctcgcttattatttactcccttaccctgattccacttgttaaatacgtcttcattgtcttgagggcaaacgataatggccaaggtggaacatttgctctttactcactgctttgccggc

SEQ ID NO: 4012 - DNA, 632 bp, Sorghum bicolor
  Clone ID: SORBI-28MAY03-CLUS69557_1
ctgtgcacgcctcagcagaaagggagagccgagggaacacggggagaagcgaacgcgcagccaaaccctagccccgtgctcgcgaccgcgggggagctccaccgcgccgtcccccccccccgcccccgcccgcggcgctgtccccgcttcgcgacatggctgattccccgcgcaggaggtactcgaggtccccttcatacagcagggggcacccaaaagcgaggtcaagatcacaatctccagctcggtctcagtctaggtcgcctgtgcctgatcctagatctcaggccaggtcaaggtctagaagccatgagagggaggaggatgctgttaaccgtggaaatactctgtatgtgactgggctctcttccagggtgactgaaagggatgttaaagattatttctctaagcatggaaaggtggttggttgccatgttgttcttgaaccccatacacgtgtttcccgtggatttgcctttgtcaccatggacactgttgaagaagctgagcgttgcatcaagtatctcaatgattctgtaatggaaggtcgaaacatcacagttgagaagtcgcgccggggccgcccgtgtccaccaaccaagatgctgagttcaccaattccaactttagct

SEQ ID NO: 4013 - DNA, 402 bp, Sorghum bicolor
  Clone ID: SORBI-28MAY03-CLUS70192_1
cctcactaaaggaaacaaaagctggagctccaccgcggtggcggccgctctagaactagtggatcccccgggctgcaggaattcggcacgaggcacagctctagcaggaccgaccaaaggcacccgcaccatccgcggctcaagcaagcagagaagtgatcagaagagaagatgtgcccaatcaagaaggagatgaccggagagtcgagctccccctgcagctcagcctcgacctcttcggagcaccaccagacggtgtggacgtcgcgaccgaagcggcccgcggggcggaccaagttccgggagacgaggcacccggtgttccgcggcgtccggaggcggggcaacgccgggcggtgggtgtgcgaggtgcgcgtgccggggaggcgcgggtgcaggctc

SEQ ID NO: 4014 - DNA, 562 bp, Sorghum bicolor
  Clone ID: SORBI-28MAY03-CLUS70201_1
aaaaaaaaaaaaaaaaagttctagtagccacgacgaaaacatccggatcctatgggccactcgctctcccttcgcggcgaattcacctagctagctagctaactagccaagttagtaggagctgccagtaggagtagatgcaaagacaggtttgctcacctgattagctaccaaagtctgttctagttggatggcttcagctgctgattggcatctgatggctggggttgttaaatggaaaccggcatcttatgaacagatggagcacacgagagttgcagcagagaggttgtcattcagatctaatagcgccaagtatcatgataccgggcatcttggtcattttgggaaggatgacaatctcatttgtcgttcacttaagtcaatatcaaaaccaaaggcaagacagtatgttattgccaaggtacataataaagatgttgatgagggttgcagctccaaagacgatgagattatttctagtccatttcaaagggaagaaggaaatcagctgagggcactggaatcttatttttctaaactctatcccactcagcagcta

SEQ ID NO: 4015 - DNA, 692 bp, Sorghum bicolor
  Clone ID: SORBI-28MAY03-CLUS70214_1
gaccagcaaagcaaacaccacagcacagtgctgcgaaaggtccatcgctgccagttgccagcagcagcagctagcagcgaagcgaagtccgagctctccaccgagaaaaacctcgatcccccaccctctctcctcaaggcagcatcagtcccctgctactatatatcctcctcctgttcttcttcctcgcatcgtcgatcggtgaggtccggccgtcctcggggctgtggcgcgcggcaatgggggagaggaggaggcttcctgctggcgcaggcgcgtgcttgctcgccgtggcgatggtgttgcaggcggcagcggtggtgggcgacggcggggggcttctggacccgcggcagctggagaagttcgtcgacgagctgccggacatgccgaggctgcgcgggtacggcgtcacggacggcggcgcgctcgtcgccggcaacctcaccatcggcatgtacgacaccacctggaaattccaccgcgacctcccggcgacgcgtgtcttcgcctacggcacgagcaaggagaccgccacggtgcctggccccaccatcgtggccatgcggggcgtccccacgcacgtgacgtgggccaaccacctcccggaacgccacttcctcccgtgggaccccacgctgaccaccgccagggcgccggacggccgcggcatccccacggtcgtccacctc

SEQ ID NO: 4016 - DNA, 434 bp, Sorghum bicolor
  Clone ID: SORBI-28MAY03-CLUS70266_1
aacccgctcagggagctgggaattcatggccatgcctttgtctgtgctggaaatcttggtaaattaactgagtgtgatctacggaagttccctgttactgacttcgtacaaacattcagaagttctgcaggattcggcgtagttgtgccacccagactgttccgcatagagatgaattactgctacatcctaaaccagcttgatcatgacaaggggaagacaggcatccagtttaacttttcatcgccctaatttctctggcagcgttgtctatttattaagatgaatattccaaattttcccccactattctgatcttatggaggagcctgtctagaactgccacgtgtaaaaagaaaggctctcacgctgtaactgtaagtgataaattgtttgtactgtgatatgcatttgatgctgtgacctgaaagcgc

SEQ ID NO: 4017 - DNA, 609 bp, Sorghum bicolor
  Clone ID: SORBI-28MAY03-CLUS70293_1
cattgatacggatcataattggctcctggaaggatggaagggacgcatactctatgccatgtcgacatgggttgcagataatcctgtctcagaactttagctgcttttctcactgcatacagaaatatcgataattgcaactatacatatatgattctgaatttctgttttaccaatgaacttcatgagcttctcagcagctttggtggaaggtatgcatactttatgccatgtcgacatgagtttcagaattcagatgatgctatctcaggactttaatggcttttcatcacaagatacagagatatatgcctctgttgtatgtggttcaacaacacttaatttaaagatgcttagatataagcagtagatgcattataatgtcttttaataatgtaatagtagatgcttctttaggtgttcttgttgcttcttatatctgcataggatcttagattagttctcggtgtgttgctgcagaacctgtgtaaatgtatgacaaactgaaaggccacttgtggtacctgtgttgtgaagtccactttttgttgtaacattgtattccattgcatctggaaagagtaaacagacacattataagcgtaaaag

SEQ ID NO: 4018 - DNA, 527 bp, Sorghum bicolor
  Clone ID: SORBI-28MAY03-CLUS703_1
gcgtccgcccaacgtccgcccgccgtccggacagaccccggcacgctcaacgcactgggcaaggacgtcgggacgcagtaccgcgcgggcatctactactacacggcggagcaggagaagctggcgcgcgcgtcgctggcggagcagcagaagaagtgggaggacaagatcgtcaccgagatcctgctggcgaagcggttctaccccgccgaggagtaccaccagcgctacctggagaagggcggccagtccgccgagaagggctgcacggaacccatgcgctgctacggctgacgccgccggcggccgtgtccctcactccctctgtccgagatcgagtcggttatatatagaagaatgaaatatagtactactagtctatccatcgccgtgcgtgtatgccaataaattatatactgttgaaaaacacacagtacgaattgtagcgagagatgagaacgggaaagctcttacatactatataaactctaataaatctaatgaatcatgtacagcctatgcttaaa

SEQ ID NO: 4019 - DNA, 623 bp, Sorghum bicolor
  Clone ID: SORBI-28MAY03-CLUS69750_1
gttgcccgagatcaagtctttccgcgccagaagccgattcaggcgcatcatcgagaagatcaagctccaggcacgtatcgagaagctcaaggctatggaggaggacccggagaactcggatctttcagctatcttctccgaggtcgccagagcaaagctcgccgatgacaaggaggagaaagaagttctccgtgtcactcaagaggtcgaaaaggatgtcaagcgtcgaagtttccaggcttaacaaatatattgagaatcccaatcaattgcagaaactttcacgcatattggacagcatcacggtgggcgaccttggcacatcgccgatatggatggcaacctaagtcctcgcaagatgcacgaagaaagggcaataacacggatggaaaagacgggtcggacttggtcgcaaagagtgatgcgactctttgggatgaaagcgttgttattttgtttcagaaaatattctttgggatttaaaaaaggtgggaattgaatgcctccgataagttataacccaaatgagttccatgtttttcactcacatcttagtgtagagtagataaatgctctatattcggtagccacccagtcgaccaacaatcttgtgtgatcgaaaa

SEQ ID NO: 4020 - DNA, 670 bp, Sorghum bicolor
  Clone ID: SORBI-28MAY03-CLUS69794_1
cctactggaagcaccttgatcctctgcatcgcctcgtcaccgcaaacatggccgaacaattgatcctgaagggcactctcgagggccacaatggctgggtcaccagtctggctacctccatggagaaccccaacatgctcctgtctgcctcccgagacaagaccctgatcatctggaacctcactcgcgatgagacccagtacggctaccccaagcgatccctccacggccactctcacatcgtctccgactgtgtcatctcctctgacggtgcctacgctctgtctgcctcttgggacaagactctgcgtctctgggagcttgccagcggtactaccactcgacgattcgttggccacaccaacgacgtcctctccgtcagcttctctgccgacaaccgccagatcgtttctggttctcgcgaccgaaccatcaagctctggaacactctcggtgactgcaagtacaccatcaccgagaagggccatactgagtgggcttcttgcgtccgcttcagccccaaccctcagaaccctgtcattgtctccgccggctgggacaagctcgtcaaggtttgggagctctccacctgcaagctccagactgaccacatcggtcacaccggctacatcaacactgtcactatctcccccgacggttctctgtgcgc

SEQ ID NO: 4021 - DNA, 533 bp, Sorghum bicolor
  Clone ID: SORBI-28MAY03-CLUS69787_1
agactcgaccgcaagaccaccacaccacacacacacacgccgtggccaggggagaaggacgaagccaacaacaccagcaagaagaagataatgacgacgacgacgtcgtccaaggcgacggggccatggagcaggctgtcggcggcggaggcggccgtgaaccgcgccgtggccgggagccgcgtgggggcctacttcaagctggacgcgcggaagagcaccttcaccaaggagctccgcgcgggcgccgccacgttcctcaccatggcctacatcatctccgtcaacgccgccgtcctcaccgactccggcgggccgtgcacggcgcgggactgcacccccgtgcccaccgccaactccacggtcgtcgtcccgcctggcccggagtgcacggtcgtcggggccaacccggggtaccagcagtgcctggcgcgcaccaagagcgacctcatcgtggccacggccgtggccgccatggcgggctccttcgccatgggcgtcttcgccaacctcccactggcgcttgcgcccgg

SEQ ID NO: 4022 - DNA, 577 bp, Sorghum bicolor
  Clone ID: SORBI-28MAY03-CLUS69808_1
cctactggatactccatccaaaggaaacaacacaaataaccatcctcatcctgcgcgcgggtcgattctcgtcattctcacgagactcctgatcctagtcgataccagctttcttttctaccaaacgacacgacggcgcagccttctcgagtagaagttctgccctcgtttttcgcttccgtcaccccgcgatttatcaaccctagatcgagctgtgcttgatctagattttccaaagcctcaaccgcaaacatggctgacaagggtcttgaggatgtccccgagggacagatcgagtccaactacgacgagaccgtcgactccttcgatgacatgaacctcaagtctgagctcctccgaggtgtctatgcctacggtttcgagcgtccctctgctatccagcagcgtgctatcatgcccgttatcaagggtcacgatgtcattgctcaggcccagtccggtactggaaagaccgccaccttctccatctctgttctccagaagatcgacaccaacgtcaagcagtgccaggctctgatccttgcccctacccgtgagcttgctcagcagatccaga

SEQ ID NO: 4023 - DNA, 584 bp, Sorghum bicolor
  Clone ID: SORBI-28MAY03-CLUS69820_1
gcctactgatcccagaggcttcaccctctcagacttactgtaacactctttgcgtggaccgaattgccgtgcgggtacatatctatcgtcttatcagctaaagacagactcgatcttgtcttcgtttcccctccagcttaccatctccaaaacccaaacgggtcgctttctaccccgccaaaacggccgccatgagtttcgccggcatgctgaacaggcttcatggccaacccgagagctacgataagaaagctaagtacaggtttggtcgaacactcggtgctggaacatatggagtcgtccgggaggctgatggcccaactggcaaggttgccgtcaagataattctcaaacgaaatgtgaagggaaacgaacagatggtctacgacgagctcgagatgcttcagaaacttaagcatcctcacattgtcaagtttgttgactggttcgagtcgagagacaagttttatatcgtgacacagcttgctactggcggtgagctctttgaccgcatttgcgagcagggcaagttcactgagaaggatgccgctgaaactattaagcaaatcctacttgctgtagat

SEQ ID NO: 4024 - DNA, 808 bp, Sorghum bicolor
  unsure (1)..(808): unsure at all n locations
  Clone ID: SORBI-28MAY03-CLUS69546_1
aaaaaaaaaaaaaaaaaccaaaaaaaaaaaaaaaaaaaaaaaaaaagtcggctaagctaagctcctaagctaaaggaaaggtaaccccacccccgcccccaacctccaccatcgcctgatcggccggccgatcgatccccacctccgggcgcttcctcctcctcctcctcctcacccccggcgcggcgttctatggcctacacctcctctctccacctccccaagcacctcctccttcccagcccccgccggacaaggcaccgcaggccgtcctccttcgtccccgtctccgcggctgccaacaagatcaacggcggcgtgaacggccatcacgcgcccgagaagccggcgttgcccaacggcaaggcgccacagcacatcaacgggcacgtcaacggccacggcaagaagggcgtcaacgggcacgtcaacggccgccatgcgggcaacaaccggatccaccttctcggtgagcacgggcggcggcgggggccaggatgggtccgggctccgcgtggcgttccagggcgcgccgggcgcctacagcgagttcgcggccaagacggcgctgcccgggtgcgagacggtcccgtgccgcgccttcgcggacgcgctggcggccgtggagcgcggcgccgccgaccgcgccgtgctccccgtggagtccaccatggaaggcaccgcgctgcggaactacgacctgctcctccggcacggcctggtggtggtgcangagatcaacctcttcgtgcactactgcctgctggccatgcccggtgtccgcgccgccgaggtgcgccgcgtcatc

SEQ ID NO: 4025 - DNA, 860 bp, Sorghum bicolor
  unsure (1)..(860): unsure at all n locations
  Clone ID: SORBI-28MAY03-CLUS7043_1
gcacgaggtgtacttgaagtgctcctgattaactttcctcgtggagtactttatggttgtggtgatttgatattttcatctcacatgattttcaccctggttttcgttcgaacttaccataaatatggttcgaaaaggtttattaagttccttgcttggttcatggctataattcagagtctccttataattgcttctcgcaagcactactccgttgatgttgttgttgcatggtataccgtaaacttagtagtattctttgttgacaacaagctgccagaaatgccggatcggacgagcgggctacctttgcttccattaagctccaaagataaagaggccaggcagaaggaggagaaagacagtaaactgaaggatgagttccacaagttactgaatgggaaccatgtggatgctactgatcggcgacagcgggcacagatgaacgggaggcacgacgaagacatcaatcacgcgctctccgaggccactgccaacggcacgtagggggctggcggcatctgcttttcgccgggagctttgtccttggcgctcggaggagaatcctcgcgggtgccgagaaaaactgcccggtttcggccggccgcctgttgtcctgaagccgtccgagattccagcaatccagccgcagcattcacatgcatcttcctgaaccgccgttgcgttgcgctgcgcaagaatcagaatctcgtggcgttcctcggtacagttttgcatcatacctcattgcaatgacatttctcaggatggcacagggggaaaaaatgatcttgttgtacatattgatccgctaaaacatgcgtgcattcgccgcggccttccaaaanaaaaaaaattta

SEQ ID NO: 4026 - DNA, 613 bp, Sorghum bicolor
  Clone ID: SORBI-28MAY03-CLUS70459_1
tgggcgtagagtcccttgttcatcagcaagaagtgtcagaaaacagccggcgacacagttgaggcagaagaagcttctctcgtcctggtgtttgagtttcagtaggcagcatggcgcatgctcaagaaattcagctccagatcagaggcactccggacaaggaatccgtccacgaagacgccggtgatgaacccaaggccgacacgcggtggtccacgagagtcagcttccgatggtggatgacagtggtggtggacatgctcatggttctctgtgggacgaccgtggccaccctccttggccgcctgtactacaactccggcggcaacagcaagtggatggccactctcacgcagtctggtggttcgccgcttctggccgtcccgctcctcatgacgccggcgtcctcagcggacgagcgccggccgccggcgtccaagatgttggccgtgtacgcgggcgtcggggtcatgatcggcttcgacaacctcatgtactcgtacgcgctgcagtacctgccggtgtccaccttctcgctcgtggccgcgacgcagctgggcttcaacgccatcacctcgcgcctcatcaacgcgcagcggttcacggcgctgat

SEQ ID NO: 4027 - DNA, 538 bp, Sorghum bicolor
  Clone ID: SORBI-28MAY03-CLUS70465_1
ctcccacccccatcctctccctcctcttcgcctctctctctctgcacgcctccactccgcgtggtcttccgttcggcggtggttaacctcgcagagaggcagcagacgaccgcagcagcgccagaagctagccatgaccgcggccgtcgacggggaggcctgcgcggtggtcgcggcggccgccgacatcatctgctctctccgtggcgcggacctcgccggctggaccccgccgtggcgcaagcacgagcccgccgcctgcgacggcggacaggagaagagcggttgcggcggcggcgccgccggcgacgtcgacgagcgcgacctggcctggccggcggtggcgcgcgggaagcgctcgcggtcgtcccggcgcgagtccccgtcggcctcggcctccgccgcctccgcggacgcgaagaaggagaagaagaagaagaagaaggcgaggcgcggcgcccgcggcagccccgcgtcgcccatggactacagcggcgggtctgggtccgggtccggcgcgtccaccagcggcggcgag

SEQ ID NO: 4028 - DNA, 627 bp, Sorghum bicolor
  Clone ID: SORBI-28MAY03-CLUS70481_1
aaaaaaccctaatcaagaattcccgtcgttactcgtcagcgccaccccctaacccaccacccaccccacccccgtctcagcctcgcgcgccgccacaatgcaggccgccgccgccgtccgccacccgcgcctattctcgccgtccccgggccgcgccgcgcggcaccggcgcgcacccagcaccgtgcgcatggcgctgcgcgaggacgggccctcggtggccatcgtgggcgccacgggcgcggtgggccaggagttcctccgcgtcatcacggaccgggacttcccctaccgcagcctccgcctcctcgccagcgagcggtccgcggggaagcgcctcgcctttgaggaccgcgagtacaccgtccaggacctcgcggccccgggggcgttcgacggcgtcgacatcgcgctgttcagcgccggcgggagcgtcagccggaagtacgggcccgcggcagtcgccagcggcgccgtcgtcgtcgacaacagctccgcgttccggatggatcccgaggtgccgctcgtcatccccgaggtcaaccctgaggccatggggaacgtccggctcgggcagggggcgattgtggcaaatccgaattgctcaaccatcatctgcctcatggc

SEQ ID NO: 4029 - DNA, 540 bp, Sorghum bicolor
  Clone ID: SORBI-28MAY03-CLUS70537_1
agaggggaagatggctgaggccaggaaaaaggagatggcgcaggagaagcccacggagcagcagcaggaggaggaggcaatgccacgagcagacagcatggggatggcggctctgcagcgcaggccggcctccgggagccgcggcctgctggtgaatgtggcggtcgccgtggcggtgctcctcgggatcaccgtctacgtgtggcacagcctgaagaacgcgacgggaggcgccggcgagcacggccacgggcacctgggggccggcagctaccgcgacgagatgtgaacaaagctgactcgaggtgtggcgtgagtatacacgatatgcacgtacacagtgcagtaaactcaaagggaggaaccaaatgcaagtatatacatacacacatttacgtacatgtacatgggaggcgcggtacggtactgcgctacatatactcctataatatgcctgttgttcgtttattatctggtgtgacggcttaatgagatttaacaaaaatggtttatttgattggtcaattcatcagttggccg

SEQ ID NO: 4030 - DNA, 681 bp, Sorghum bicolor
  Clone ID: SORBI-28MAY03-CLUS70495_1
ctactgggggggtcgcagtgacaggcccgggcgactgtttaccaaaaacacaggtctccgcaaagtcgtaagaccatgtatgggggctgacgcctgcccagtgccggaaggtcaaggaagttggtgaactgatgacagggaagccggcgaccgaagccccggtgaacggcggccgtaactataacggtcctaaggtagcgaaattccttgtcgggtaagttccgacccgcacgaaaggcgtaacgatctgggcactgtctcggagagaggctcggtgaaatagacatgtctgtgaagatgcggactacctgcacctggacagaaagaccctatgaagctttactgttccctgggattggctttgggcttttcctgcgcagcttaggtggaaggcgaccgaagccccggtcgcttcgcccgcaaggcatacccctgctcctcggccatcgcccaccgggagtaaaaaactgtgaaggctaagctttgggaatggtgttgacaacttctgctgaataacacaaaaaaaattactcatcttttcctgatttcatggaacttcttgatagtaatggtcacggggaaacaagagcacataatgctgaaaatattgcaccagtttctgttaagagcccagatacatcattggaaatccaagaaaagttccctcacgatttgacagag

SEQ ID NO: 4031 - DNA, 548 bp, Sorghum bicolor
  Clone ID: SORBI-28MAY03-CLUS70032_1
atagctcatagcaaaacaatacaagtagaacaagcacagaactgtcaagctccgcaggctgcagctcgtccccaatggcgtctgctcctcttgcgtcttctctcttgtgcagcagcagtgcttctaccagtagaagcgcagccatgccaagagtaatcaggatcccaattttctccaagaaccagtacagaccgcctcttcggcctcttaggagagtagttaggcgatcattgcagcaggagcaagagcagagggcgtcccccgtctccgtggcctccggcgagcaacaggaggaggcgacggcgtcgcatcatgtcggaggggtggacgaggccaaggcgtcgggtcatgttggagaggcagacaagggaggccaaggagaaggcgacggtgaggagaagaggagcaccgacgagcagcaggaggtggactggaagtcagacgaggagttcaagaagttcatgggcaatccctccatcgagggcgccatcaagttggagaagaagcgcgccgaacggaagctccgcgagctggaccgcgagcccgac

SEQ ID NO: 4032 - DNA, 582 bp, Sorghum bicolor
  Clone ID: SORBI-28MAY03-CLUS70116_1
ctggagcagcggtcgctgcggcgcgtggacgagttcagggactgcatgaagcgccggaacgacacgcgcgcgtgcgggctcgcccgccacctcgccggcgggcggaggcacgtcgtgccgcggcaggagcgcgggtggaagaacgtcttcaaggtgcggcccagcgcggtgaccaagttcctcgtgcggttcaagccgctcacagacgccgccgcgtccgcgtcgccggaggagagccgcttccccttcgacgtcaccactgggccgggctacgtgtaccattgccatattttggaccacgaggacaacgagatgatgagaccgatgaagattgtgcgttgaacggtttttattagggaaaaatatatttatattaatgcttcgccttcgtcacgaattatttagcaggaataatttttacaactagaattttgctcatacacttacactgtcttatagctatatttacaccgtcttattaccatatttacaataattcattcagtgtaattcattgggcagagttatgtaatttaggaataatacaaatatatgtcaaattttttaaataaaaaattgcaa

SEQ ID NO: 4033 - DNA, 573 bp, Sorghum bicolor
  Clone ID: SORBI-28MAY03-CLUS70152_1
ggcgatctcaattatagactcgaaggaataagctcgatgcctgcacggaagatgattgaggagaaccgtcagagtaagctaagaggcaaagaccagcttctgcaagaagctgaaaagggcgaagtgttcaacgggtactgcgaagggaccctgtcgtttaagccaacgtacaaatatgatgtcgggagtagcatatacgacacaagctctaagataagggtgccttcttggacagacaggatattgttcaaggttggccattcttcaggcttggatgcagtcttgagctcatatgagtccctcgactgtgttgggagctccgaccactaagcctgtgaaagcccatctttgtctcagagtacgcagtgacggtgatgctgactaatgacagcagttataagtcatggctgaaagttctgtctgctgatttgttgtgaacgaacaggatggtgtaaggcacaggatgaggggttttaactggcggttactgtattctgtaaattaacatggcttgctacgatggaaggttttagcgaggaatggtgattactgtagtatcacataacatgacat

SEQ ID NO: 4034 - DNA, 583 bp, Sorghum bicolor
  Clone ID: SORBI-28MAY03-CLUS70183_1
ggtttcccccatttcgctccgcataggcgtagcatccgcaatctcccatggcggcgtcgcccgccctcctctcgctgacccccgccgtctccaggcacccccacctcctcttctccccttgccccccgccgcgccacgtccgcctagccccccctctagccgccgccacaccctccccgggcgggaacggccctggccctggccccggcgtcttcctgtcgccgcgcgcgctctcgcagctcgacgagctcgcggcgttccgctacgagcacgccttcccgcacggcctcctcaccgtgcgcgccctcacgcgtggccccgacgacgacgccgtggccgaggcgctcgtccgcctcctcgcctcctccttctccgagaccgtgcggtgggccccggcgcagcggtacgcgcagctcctcacgttcgtcatccgcaggtacctccacgaccgccgcgggctcgcgccgcacgccgcggtgctcgtggggttctaccgccccgctgacgccggcagcgacgacagcgccgcctcggaggagggcggccgggatgatgagggcggcgaaggggagggtggagatga

SEQ ID NO: 4035 - DNA, 678 bp, Sorghum bicolor
  Clone ID: SORBI-28MAY03-CLUS70648_1
gcacgagccccccaccagctctcacattctcagtcatcgcccaacagcaatccggccgcagcgaccaatccctgcaatcttcgaaaaacgcaaaccgacacttgctgatccaaaccggccatggcggcggcggctcttcaggcacagcgcctcttcctcacgccctccaccacctcctcgtcactcacgacgcggccgccgcgccggacccggaccacggccgccccctgccgcgccggcccgtccggcgtccagacaacgaccgcgtcgtcgtcgtcgtccatcccagcggacggcggcctcgagcgccatctggctcgacggcaccgccggcaccaccaccagcgccggctccccccgcgccgccgccgaccgcagcaccacggcggtggtcgacaagctccgcgcggtggcggaggccgcggcggaccgggccgagatgcacgacatcatcgggcggcagcgggacaactggaaccacctgctgctccactccaccaactccctcacgctcgccgcctccgtcatggccgcgctcgcgcccgccgcgccggtcaccatggccgccgtcaacaggatccagccgtcgcagctcgccgaggagcagcgcaacgccacgcgcctctggaggcagctggagcgcgacgtccgcgccacgctggagctgcggcgggacga

SEQ ID NO: 4036 - DNA, 773 bp, Sorghum bicolor
  Clone ID: SORBI-28MAY03-CLUS7065_1
actaaatatggtggatgtggaaccctcaaaagtagtcagtatatgcggaggacttgtgacaaaagagctgatggttgtcgcaactccttggaattggcattgccatctagaagtgctcaggtttacaagttggtgcgaattttgaggatttagcatgtcaaaatataagtattgtaatgaaaccatggaactgcgtagagtatggggctttgcagtccttttggcatttggtgataagatggcaaaacagagggattgtagcaaccttgcaggtatagcttcaggacatctgttgacattgaggacccttcagttttgccctctggtgcagtgcaagttctctaaaatttgtacatgttgtgacagttatgactactgaggctcattagcttggaactgacttgaaggaggagctcagcaaggtttgatgaccaacaggacagtggagaaggagcatccacatgcgctcctcattttgacaaattgtttcatccgagttgttagcttcgctatccaaccaccaacaaggtttactgcagttaaaagggccaattgtaaaaaagtgcttccgactccacacccgtcgatgaggagcatcatgttgcacttagccattaaagcctacaacgattgtctttcatgtcgtgcttcacagttgtatccggctctgcactttctcgagaaaagatggtggctcttcacccatcagaattttaccaagacggttaataacatgtttatctgtaactcactagaagtatgcatatgcatat

SEQ ID NO: 4037 - DNA, 584 bp, Sorghum bicolor
  Clone ID: SORBI-28MAY03-CLUS70664_1
attgcgaagagccgaagacagcaaacaatggggagcacgagcaccaccaccacctcatcttcctcctctgctacccgcggcggcggcgcacacgtgctgctcctgccgtacccaggcgcgcagggccacacgaacccgctgctcgagttcggccgccgcctcgcctaccacggcttccaccccacgctcgtcacttcccggtacgtgctctccaccaccccgccaccaggtgagcccttcagggtggccgccatctccgacggcctcgacgacggcggcgcggccgcgtgctccgacgttgaagtgtactggcgccagctcgaggccgtcggctcggagacgctggcggagctgatccgctccgaggctgccgagggtcgccccgtgcgcgtgctggtctacgacccgcacctgccgtgggcgcggcgcgtggcgaaggcggctggggtgccgaccgcggcgttcctgtcgcagccttgcgccgtcgacgtcgtctacggggaggtgtgggcggggcggctgccactgccggtggtggacgggaaagagctgtttgcgcgcgggttgctgggtgtggagctcgg

SEQ ID NO: 4038 - DNA, 704 bp, Sorghum bicolor
  Clone ID: SORBI-28MAY03-CLUS70704_1
gaccccaagaacatgaacgctcctttgattgagcctaccggtattgataacaactctggtattattatgcctttctacgacgccgatactggtgttcttttcttggccggtaaaggtgatggtaacatcagatactacgaatacattgaggaccaaatccactacttgaccgaatacaaatcgaacgttccttgccaaggcatggcttcattggccaagcgctgcgttgatgtcaacaccaacgaaattgttcggttgtacaaggccaccgccaccgtcgtcgagcccatctccttcaaggtgccccgtaaatccgatctcttccaagacgacttgttccctgactgcccctccgccgagcccgccttgtctgccggcgagtggtccagtggcaagactgctgctcctaagctcaccagcctcaagcctggtttcgttcaaaaggagaccaaggccagcgcctctttcaaccccgtcaagcaagaggcttctggtcctcaatccgaggccgaattgcgcgctgaatacgaaaagttgaaggcccgtgttgcttatttggaagctgaagttatcaagaaggatgctcgcattaaggagttggagaacaaataagaagattaatttattataccattgaatattggcctacgagtcaaatatttgctaaaaaaaccttgttacattacgaaaataaatgtagtgtt

SEQ ID NO: 4039 - DNA, 650 bp, Sorghum bicolor
  Clone ID: SORBI-28MAY03-CLUS70762_1
ggctccgtggccgcctttcgagaagaaacagagggaggaaacgcaaaaaaaaactcatctctccccctcgctctctctctctccccccacctccctctctctctctcttgtgtgtgaggtggcgagcctgagggagcggaggccacaagtccaatccgcccgtatctaatccgttcttgcgccgcgacgaggaggaggaagagggggcagcggcgcggtcgggcttgattcgggctcatccgttcctcgcgggggcgcacgcacggttggcgtgtggggtggctggcctcggccccgctgtgtcctgctgctcggcgctgccatggcgggccccctcgcggcctctgcctcctcccctgcgcctggggcctcgcccccaccggccgccgctgcatccagggacttggctggtgggtttccgctgggcttctgcgcccgcggttgtgtgccgccccccgacgcccctgcgggcgccgtgcttgtgatgcctcctgctcgggcgcctcccaccctcgctggcgccttggttcgccgcggctctgctggctccggcattctgggggcgtggccctcctctgcccctaaagcttcctccttcccctcctggatgcctggatccggtggcctatgccagactcctaattaatttc

SEQ ID NO: 4040 - DNA, 626 bp, Sorghum bicolor
  Clone ID: SORBI-28MAY03-CLUS70728_1
gagaagataaacaatgggttgtcagttgtcaatgaaaaggtgaaatcagtagaccaaagattgcaggtttctgataaaacaatggctgctttgctggctgcagagcgcaagctaaatgatacaggctctgctgtgaaaaccaacaggtatgtgtctgctggaacaagctggctgaatggtgcttttagcaaggtcgccaaggctggtcatgttgctggctcaagaaccagagaaaagttccagttagctgtgtcgaatctaacagccaaaggccctgctgttgttgcttgagcgtgctgtgctggtagaagctcttcttcctgaggaaaatctattggaagtccctgtgcaagcatttccctttgattgtggacagtgtggaaagtaactgtgtgtttcactgttatcttgtccgtttttccttgggtgcaggctattcgatgattcttttgaggtttttggtatatagacgagttaagtttttttggtattttagaaccccattcttttagcgttgatgttaaattgattataggttatagtggcattctattgccccaatctgtgtggattcttgatcgttattgatgcctatgcttctccagttctcccagagctgttgctcc

SEQ ID NO: 4041 - DNA, 589 bp, Sorghum bicolor
  Clone ID: SORBI-28MAY03-CLUS70313_1
atccagcagccatggccgcctcgccggagggcgcgcgccgcttcgttgaccccgagcccttctccccgtccatcttcctcgacctgtccccgacgccccgccccgatggcaacggcgaggccccggcctcatcagacgacctcgtcctccccttcatctcgcggatcctcatggaggaggacatcgacgaccaattcttctaccagtttcccgaccaccccgtgctcctccaagcccaggaaccgtacgcgcagatcctctctgacgcagccgcggctcgcaccaacagcgctgcctcgggctcgggctcccccgccaccgtctcgccgtcctcctcctccgacccagcccagctcctcctgtccccgccgtaccccgatgcgggactgcacgacttcaccaacgaccatgtcggcaccttcttcttgcccgcacaaggtggtggcagcccggagttcgagcagagtccggcgcaattgaggaccacaaccttgcccgccggcgacggcgaccacgcggcgctggcctcggtcttcttcaagagggaagacgcggacgcggagatgctcaacaaggcattcctcaaggg

SEQ ID NO: 4042 - DNA, 513 bp, Sorghum bicolor
  Clone ID: SORBI-28MAY03-CLUS70345_1
ctctccattcctccaagcggccaccaccccacacctcggcgcgtcccgccaaaacccccccgacatccaaaccctacctagctccgccccctcccgcgcgccatgtccgtcgcgtccgcggcggcggcggcagcagcctccctcgtcgcctcatcctcgctctccatcccagaccacctccgcctccgcccccgcctcccgcctcctccactcccgcgcttccgccggcgatcgcgcggggtctgcctcgtccgcgccgtcctcgaggaccgcgcgcccccgccggccgaggaggacgccaagcgctacgggccccgcgggaacggcagcgggctcgggtacgacgatgccgccgtccaagcctacctcgggagcaacggcgacgggagcgccagcggtgacggcgcggcggcggtggcgcagaagcccgcgagcagcgtggccgtggtcccggtcccggtcccggtccagccggcggaggatgagaggaggaggaaggagagggtcgaggag

SEQ ID NO: 4043 - DNA, 631 bp, Sorghum bicolor
  Clone ID: SORBI-28MAY03-CLUS70359_1
agccccctcccggctttctcaacccacctctctctctttcacacacgcctctccatctctcttcctgcctgaggcagccatttccgcttccgatcgtggagggaggcttggagtggaaggaggaaaaggaggcagctgctggttttcggtgcggcggagatgtctgaggtgtcggtgataaaccaggcggaggtggaggatgcgggtgccgccgggcagctggacctgccgccgggcttccgcttccaccccaccgacgaggagatcatctcgcactacctcacccacaaggccctcaaccaccgcttcatctccggcgtcatcggcgaggtcgacctcaacaagtgcgagccatgggacctcccaggcagggccaagatgggggagaaggagtggtacttcttctgccacaaggatcgcaagtacccgacgggcacgcggaccaaccgcgccaccgagaccggctactggaaggccaccggcaaggacaaggagatcttcaggggccgcggcatcctcgtgggcatgaagaagacgctcgtcttctaccgcggccgcgcgccgcggggagagaagaccggctgggtcatgcacgagtttcgccttgagggcaagcttccgcagccgctcc

SEQ ID NO: 4044 - DNA, 828 bp, Sorghum bicolor
  unsure (1)..(828): unsure at all n locations
  Clone ID: SORBI-28MAY03-CLUS7037_1
ggtcggnggacgaatcgaaacccttcgttcctctcctattcgaaggccatggcggacacggcctcgtcctcatcagcagcgggaccctcgccggtagacgcggcctctctcgccgcggtggcggaggcggcgccgccggaggagatgacgctggtggtgaagtggcgcgggcaggagcagacggtgcggatggtgggggacgatacgctgggtgagctcaaactgcgcatctgcgaggtcaccggggtgctccccaagcgtcagacgctgctctaccccaagctcatactcaaggacatcgacgactccaccctcctctcctccatcccattcaagcccaacgggaagatcagcatgatcggtactattgaagaagaaatatttgtcggacaagaagatgatccggagttacttgatgattttgactttgagcagaatgaagctacagccattaaggataaagatgtctacaagcaaaaattaaagcggcgtgcaagtcaatataagatcaagctcttgaatccatgccgcaaaggaaagaagctgcttgtccttgacattgactatactctgtttgaccataagtcaacagctgagaatcctatggaactcatgcgcccatatcttcaccagttcctcacagctgcatattcaaaatatgacatcatgatatggtcagcaactagtatgaaatgggtggagttgaaaatggaacaacttggagttcttggcaaccctgactacaaaattactgctcttatggatcacttggctatgataactgtgcaatccgaaaatcaaagtaggaagaaaacttttgactgcaag

SEQ ID NO: 4045 - DNA, 650 bp, Sorghum bicolor
  Clone ID: SORBI-28MAY03-CLUS70438_1
cgctcatcctgtcgctcttcgagctcagcttcgagaaggtgatccgggtgcggacggcgcggtgggtgctgcggatgcagatgtacacgaacctggtggcgtcggtggtctccgtggtggggctgctcgcgtcgggggactggcggacgatcccgggggagatggcgtcgttcaaggacgggagggcgaggtacgtgctcacgctggtgggcacggcggtgtcttggcaagcggcggcagtgggcgtggtgcggctgatcatgagggtgtcgtcgctgttcgccaacgtgacgtgcacgctggcgctgccgctggtgccggtgttcgcggtggtgctgttcggggacaagatgacgggcatcaaggtcgtggccatgctcatggcggtgtgggggttcctctcctacatgtaccagcactacaccgacggccggcgggccgggaacgccgagtgccgcgtctgcgccacacgcacggcaagcgacacgctcttgcccgcctgaggctgatcaatgcttacatatattctggtatgtgcacaacagcacaaggcatacattcaagtacccaacgatctattgtatttgtagtctctgccagtctattggaataataacgaatagcaagatgcctagagatagcaatcattt

SEQ ID NO: 4046 - DNA, 580 bp, Sorghum bicolor
  Clone ID: SORBI-28MAY03-CLUS70831_1
taatttttttcctcagccaccgaggcagcgaactgctcaagaaaagtagcggcagcaacccgcggcggcgacgagtaaccaaccggaccacgccattgccaatcacccgagcaccaaggaggcaaggagtcctgccttgcccagccacagcgccttcctcttcccccggctcccgctgcgggttctctcgcgcagcccgaaatcggcgctggttcatttgaccgcttcttctgagttccttctcggcgccgttccatggaggagatggggaagagggtggtgaggacggtgcgggtgcggaacatctcagatctggcgactgagcgggaggtgcgcgagttcttctctttctccggtgaaatcgagcacgtcgacatcagatttgacacaggggcgtcggggaggacggcctacgtcacattcaaagatcccaaggccctcgaaattgcgcttctcctgccgggagcaacaattgtggaccaaattgtgaacataacccctgctgaagattacatatacatccctgttactgaacagcaacttatggtccatgaggtgacaagtacaagttcagctccta

SEQ ID NO: 4047 - DNA, 686 bp, Sorghum bicolor
  Clone ID: SORBI-28MAY03-CLUS70828_1
tttccccatttccctgccttctcctctcgctctccccacgagaccgcgcccaccaaattccctgcttgatcgcgccgagctcattttccgcgttgaattcgggtagtactctgcagctttgatttcacccgatttcagctgtttgcaccgccgagtcagtacgcttctttttgcccgatttcattcgccgactcccacctcactgagatcatcaaatcttggcatcggattccgggctgccttcgacgtcaatccccgtctgtttccggcgcggaatccagttccaacgccgaaccgtcagcagattcgttgttgtagctctaagcggcggctttcagttcgagcgcatcagaggcagcatccccgattccggcgatgtcgttgcccgcgatttccctgtacaccagtccgccgggcgcggtctactcttcggagttcgacccaacctcccgtggctcgtcgccgtccaccaccgctgcgcccccgccgcccgccgcctcgcaccgcttgccctccggcggcggcggcctgtcttgcctcttctcctcgccggcagctgcggccgcgccgccccgcgccccggcacacgacgacctcggcgcgctgtggcacgacagatccgacgacctgagcgtcgccggcggcgggtactcctactcgcactcccactcgtcttcaccgctcaa

SEQ ID NO: 4048 - DNA, 590 bp, Sorghum bicolor
  Clone ID: SORBI-28MAY03-CLUS7084_1
atcgcaagcactcccgcagaaatccccaccgaaattcctgtctcccagatcgccgcccttctcgccgtccgcaaaccctagtggacacgagcgcggagtccgcggggtcgcggcggcggcggcccgcgactccactaccggtggcggactcgctccccttgacagacggcagcacaaccttgctcccctcgaccgacgatggccctgctccctgcgaccatggtggcatcaggccttctgccggccgctgctacctcgtcgcggttgcggccaggccgggggatggtgagaagcagcgcgtggggcggatccagcacggtcgacttggatctggcctctggatgcgagaggtggcgacttctgagttactcgatctcggttgaccatctcgctgtcgccggagccatcctcccggggaagctcgacggcctcatactccccgactcctccgcataccactgcaatggtacctcctcctgtcgttgacctaggcagccagttctgttcttggatataaatgctgacgagagctctgcatcataacaggcagtaggtctagggcgcactggatctttggttgctggtgcgct

SEQ ID NO: 4049 - DNA, 628 bp, Sorghum bicolor
  Clone ID: SORBI-28MAY03-CLUS70851_1
cagtgttgctgtggatgtatggatgcttgcagttccaatgtggtaccttcgaaaactcaaactgcattggaaaaagaagattggtgtcgctgccatgtttatcgtgggaacttttgtcaccgtcgtgagcatcattcgtctccagttcctcgtcgatctcggttcatctcacaacccaacgtacgaccaaaccgacatctcaatctggtcaacagttgaaatcaacgtcggcatcatctgtgcatccatgcccgctcttcgagtcattctcgtccgtgtgttcccctctcttggaggctcatcctacgattcgagcaagtacaacaactatggagaacattatggacggaaatcgcatatcatgagtcgaagtcgtgctcgggtagagttaccgtctcatacaggtgattctatacatacacctgagcatggaggtattgagttgcagaggacgttccatgtgcagtacagtgagaatgatgagcagagtcttgttaatggggagagtaagtttaacaagactcaagttacgactcagatgaggtctgaaagtccgagcgataggtcgttgtagatgatagtagttgattgatacctttagcagaactaatgaacattttctacaaaa

SEQ ID NO: 4050 - DNA, 615 bp, Sorghum bicolor
  Clone ID: SORBI-28MAY03-CLUS70869_1
tactgccaagcattggtccagagcgagacttcgaaggtattggtggctggcgtctgggtggtgacgatgaaacgtggactaccataaactcacgacttgagcttcctgacaagcaacaccatgggcgaaatcatcatcgttccccatctggtggccctacgacacctggagaaggcgggtatcttatgatgaagggtcgcaaccgaagccccggagcaaaacgcttagcatctcctaatagctctcgtacaagaacaccttctggcccacggatcgcttttacaaacaagtcatttattgacagttactttccaagtctcaaaacttctccaaaaggactgaaaaaactcccgactcagggtgtcgtcgatgcgtaagaccgactcagactcgttgcgctatcgtgtaaactattctaatgatctaatgaatgtttgtggttaaggtggaaaatggcacgaggacccaaagtgtcacagttaaatggtaatatgggggtttccattggcgtttgagcgagaatttgtcaattatctggatttacgatgatgcgaaaataagataccaatgacgtttcgaaagaaaacgacaaaggcgaattccaatctgccataa

SEQ ID NO: 4051 - DNA, 954 bp, Sorghum bicolor
  Clone ID: SORBI-28MAY03-CLUS70877_1
atttaacctaagttattaaatatcattcgcgattgctggaatggacgactgggaaaattgggaagaagctgccgaaaaggacgtcaaggaaatcaagaaagacaccaaatttgctgatgaagaaagcgaagctgtcgatatcgatgctaagaatgaaaccgccataaaatctcaacctaaaaaccctgaaaagaacgccaagaaagaaaaggcttctcaacttgctaaaaagtgggaagaaaaggaaaagcaatacgacaacgtgattggtggcgataaaaagggtcccttgaccgccgaagaaagaagaaaggctcagcaattatcagaagcatctgatgcgaaaaataccgtcgacttattcggaggattcattgaacaaactgaatctcaaaacttgaaaactgaacaagcattcattgattatgctaagaaaatcgctgaaattctcgctcaagaagatagaaagaaatacatccaagaattcatgaaggaacttttgcaacaaatatatcccaagctcacttctcttgaatatgagcaaattcactccaagtgcacaatcctcttcaaccaaaaaacaaaggaagaaaaggcaggacccggagccaagaagaaaactactcaacccaaattgaatgctgctaagggtagcaacgccgcaaaattgatggactttgacgaggacgatgacgaatatgtcccccgtggcagaaatgacctttatgacgacttcatgtaattgataggtttcaaaaaaggcaacttgctcatctttgatttgaaacattagttataaatatgcatattttccttgaataaaattatttggatgacgccattggctgtgtaatgtttatatcatatgaaatgggatagaagcataatgattatgactgtaaccgtgattgtgaccgtgacgatgaattgagtataaacttgaacaaactaaga

SEQ ID NO: 4052 - DNA, 687 bp, Sorghum bicolor
  Clone ID: SORBI-28MAY03-CLUS70550_1
gagctgcgcggcctgctgcgcgtgctccgggccaaggacgagcaccagtacctgaaagtggggaagctggtcctggccgtcaaccgcgggctcgccgtggcggggccggcgctggcgggcacggcggcggtggcggcggccttcatcggggccggtggagacggagctgcttcgacgtctgcgtgggcgtccggcgccgccgtggcgtgcggcgcgctggcggcgtgcgtgaacacggtggagcacgggggccagctggggatgctgttcgagctgctccggaactgcgccgggttctaccggaaggtgcaggaggacatcgaggcggtgctcggggaggccgacgtcgagcggagggagaacggggaggtgttccggaccaaggtggccctgctgctcggccgcgacgcggcggagctccggcagttcaggaggatggcgtccgcgtcggtgaaggacgaggatatcaaggactacgccgggaagctcttctgatgatcgtcggaagaatgtgcgtatacactatcggaaactcgggttattcattagttcataacacaaattagtgttcgtacatactactagtactctactagataggaagaggaattccattgattctttttgtaagtaacatgcaaatcgcattcattccaactgtgaaatgacaattctttgattgagatt

SEQ ID NO: 4053 - DNA, 645 bp, Sorghum bicolor
  Clone ID: SORBI-28MAY03-CLUS70587_1
acagaaggctgaagaccaatttggtgcaaaccacccaaaggttggtattatattgacctgtatagctagaatgtacaaaatgaaggcaaaatcggaaagttctacttcaattatggtccaggagggattatacaggaaggccctagaagtattgaaagctcctgctattaattctgagggtaccagcaagcaggtcgattggagagatatcatctcccttgccagaggtgagtacgcagagctgttattaattcagtctaacaggaaggcggaaggtgaacggatgaagcagtgggcagaagatgcttggaggaaccgtaggctaacgctagcacaagctctagagttttcagaaccttcaaagccgactctcgttgttgacacccggatcggcagggtcgtgtagcttcagccaacaatctcatgagacgtaccatgatgcaatgcgaggatgcacctcatgtaatatttcgaacgtgttgctcccatgtggactgcctgcgcttcgcaggcaatccgagaatgcacctcatgtagtagtttctccctgtggacttcgcctgcgctttgcgggtttgatgcgtcccactaccatgtggccatgtcccagtgtgtctgcttgtttttttttaccactttttttgg

SEQ ID NO: 4054 - DNA, 638 bp, Sorghum bicolor
  Clone ID: SORBI-28MAY03-CLUS7062_1
cccatgaacaattgaggatggtcgctcggctgcaggtgaaagaggtggcctaccgtcttgccgaaaggggtgttgccttggctgtgactgatgctgcattggacttgatcttgtcactctcttatgatccggtctatggtgccaggcccatcaggagatggcccacgcgtccggtagtgacggagttgtccaagatgttgatcaaggaagagatagatgagaactccacggtgtccatagacgcttctcccagcaaagatgaactgatttacaaggttgacatgaacggaggactggtgaatgcgcagacagggcacaagtctgacatcctgatccaggttcctaatggaggtatcaacggtggggcagcacacactgtgaagaagatgaggttgatggaggatgaccaggacgatgatgacatggaagaagagtgactaggaaattttgcgacatagttgtagacaatttagtatagatcttagatgccccgagacgaactagttgaaggtgcagaagtgccaaccccagcttgtgtagatgaaagtgaactagtttgagatgtaatcgaatcctggaccttaagattccatcacatttcattccaaaaaaaaaaaaaaagactagttctagatcgc

SEQ ID NO: 4055 - DNA, 571 bp, Sorghum bicolor
  Clone ID: SORBI-28MAY03-CLUS70636_1
caaccagcacctccaccagcagcagaggcattccgaaagcacatcacattagctaggcgttccaggttgcaggacacgcgaggaaaccgcagccatggccaacaaccgcacctacgaggagtacgagcccgccgtcgagtggagccgcaaccccgaggccgacgccgtcaagatctcgctcccagggttcaagagggaggacatccgcgtgctggtggacaaccacggccacctgcggacgcgcggcgagcggcccatcgccggcaacaggtggatccgcttccagaaggacttcgagctccccgccaactgcaacgccgacggcatccgcgccaagttcgagaacgagaggctcaccatcacgctccccaagaacacccccttgccgcccatgccggcgccgccgaagaggccgccccatatggcggcggcggttcctgagccaccggtgaggcctaccgtgccgctgcccacggtgcccgcggcgccgctggctcctgctcctcccgccgtgaagccgcccgtcgagcccaggccgtcgatgtcgaggaagacgtacgctcccgtggcg

SEQ ID NO: 4056 - DNA, 566 bp, Sorghum bicolor
  Clone ID: SORBI-28MAY03-CLUS71021_1
ctaatgaaatgaaactagccccaaatcctgtgatttgtgtccaacaattggtatctagagcctagtccattacctggggattttcccctttaccaatcctcaatccgtagccatatccaaccgttccaatcgttccccttcactctcctcccatggctccaccacctctagcggacggaacagcaggcggtcggcgactagcgctgagggtgacggcgacgcgactgctgctgcgcagatcgcgcgggaggtgcgagcggccgcgcgggaagcgcgcgcggtatgcgaggaggcggaggcgcagctgcaggcagccacaggggcggcgcgtctcgcgcggcagaggccaaagccgcgcgcgccgctgaggcagccaggcaggccacggctgctgcaagcagaggaggcggcagagcgggtcgacctagagcgggtggactcggaccacgccggacgcgacatcaacgcgcgtggggagcgggtccacgtaggcgtgcggggcgagtaggcggatgcggacgtggaccggctcgcggaagggcgtgacttcaacatgcgtggacgcg

SEQ ID NO: 4057 - DNA, 647 bp, Sorghum bicolor
  Clone ID: SORBI-28MAY03-CLUS70957_1
cccgcgctgaccgccgctgcgctccacctcgacgagccgcgggcccacgtcttcctaggcaatgggtccggcgacaagatcgacgggtggtgcctcgacaccggcgccactcaccacatgaccgagcgatgggagttcctctccaagcttgactccggcgtttgaggctccatcaagtttggggatgcctctgccgtggagttcaagggcgtcggctctgtcgtcttcactgccaagaccaatgagcactggctgctcactggtgtctactacatccccgcgctgaggaactccatcatcagcttgggatagctggatgagaatggctcgcgcatggagatcgaggacggtattctgcgaatctaggatcgccatcgtcgccttctcacaaggtgaacagaggcgccaaccgcctctacatcctccacgtacaggtggcgcagcttgcatgcagtggcggagcgtgaaccaaaatcaagggggggccgaatcacaaaagctctagcgaagaagccaatatgtgatgagaaactcctcgccgtagtggctcggtggtgtcagctagtagtatcttagtagtgattatggttgagttctcaccttaaaataaaactatctagcaaagtttactcgatttagaaattttc

SEQ ID NO: 4058 - DNA, 642 bp, Sorghum bicolor
  Clone ID: SORBI-28MAY03-CLUS71046_1
aacagctggaagccgatgggcagttgtcatgtcccgcaatgctggtttcacttctcaggtagtggagcttgatttcttatatccgagtgagggcatccacatgcgttgggacaatggctatcgcatcacggcaacagctgccacatgggaccaggcggcctttatcttgagcataccaaggagaaagcctactgatgaaacacaggaaaccctgagaacatctgcttttcctagccagcatgtgaaggacaaatggtccaagaacctgtacctagcttccatctgttatggaagatcggtgtcctaaagcctgttttctcgatttggtttggttgccgagaggtatattaatatcaaagacaggtggttttatgatatgagatggggtgttttgaagctcaaaactctgctaacctacttacctgcaactaacaaaaggtaacctatatatgaaaaaaaaagaaagcaaagtctgctgtgtttcgctaatcgataccatggagcaaagaacattctggtctgttttgtgttgttgggatgtgtataaattatccaaaggattaggttatgttgtaaagaatgtagaagcgtacctgctgaaccgttgccatgtatataaagctgaatttttacaaggtgttc

SEQ ID NO: 4059 - DNA, 504 bp, Sorghum bicolor
  Clone ID: SORBI-28MAY03-CLUS71048_1
gagcgggaacataagctttgatagcaacggagatcctgtaatattggatcctgcttgctactatggacacaacgaggcagagtttgggatgtcctggtgtgctggatttggtggggacttctataatgcctattttcaggtgatgccgaaacagccagggtttgagaagaggagggacctctatctcctctaccactacctgaatcactacaatctttttggctccgggtaccgttcatcagctatgtccataatcgaagactacttatatgtgcgggcggcttagtttcttctgtttttctcccaggaaaatagaagcaacgatgtccctgtgctgtgcataacatgtttcagtgtttcccagttacccctctcgatatgcggtggattcactccctgtgaaatctgctgtgagctccttgcgggcatgctacaccactatatcaatcactgaaaaaaatcttcatatgtgtaaataaatatctcgctgctggtccattggcc

SEQ ID NO: 4060 - DNA, 691 bp, Sorghum bicolor
  Clone ID: SORBI-28MAY03-CLUS7106_1
atcaaatgatcatggccagaatatattctgttcttgccaaatcgagggacaagcttgatctctatcaggagctgcttgcaaggctcaaggaaagccagcgctcccttggggaagctactgctgatgccgaacttcccaagagcgcttcggatagaataaaagcaatgggacaagttttatcaaaagcaagggatctattgtatgattgcaaggaaattaccgagcgtttgagagcaatgcttcagtcagcagatgagcaggtccggagcttgaagaagcagagcacctttcttagccagctggcagctaagacaatcccaaatggcatccattgtctttccatgcgcttaacaattgattattaccttctgtctccagagaaaagaaagttccccaatagtgagaatttggaaaatcctgatctttaccactatgctcttttctcggacaatgttttggcagcatcagttgtggtcaactcaaccatcatgaatgcaaaggagcctgaaaaacatgtatttcatcttgttaccgacaaactgaactttggggccatgaacatgtggtttttgctgaatccacctggggatgcaacaatccatgtggaaaatgttgatgacttcaaatggttaaactcttcttactgccctgttctgaggcagcttgagtctgcagccatgagagattacta

SEQ ID NO: 4061 - DNA, 614 bp, Sorghum bicolor
  Clone ID: SORBI-28MAY03-CLUS71081_1
gcaacaaccaacaacacaaatcctcgggcgtctgtcgcaggagaaaaaaaaaaaaggctttcttgtcccacaggccacaggaaaggagactgggagaaaagtcgattgtgattagttgatcaccgtccacaccatgagctctcgcatggccggggcagcggttctgcgccacctaggcccgcgcctgttcgccgccgagcaggcggccgtgtccgggctcaccgcgaggggcgtcatgcccgcggctgcgaggcttctccccgcgcggatggccagcaccgccgccgaggctgccagagaagatgccggcgcaaaacagcatggcggcaccgggaagcaagaggaggcagcaggcggcgggcagagcaagaaggccatcgtcagctactggggcatcgaggcgcccaagctcgtgaaggaggacggcacggagtggaagtggacgtccttccggccgtgggacgcgtacacgtcggacacgtccatcgacgtgaagaagcaccacgcgccgacgacgctgccggacaaggcggcgtacctgattgtcaagtcgctgcgggtgcccatggacctcttcttccagcgccggcacgccagccacgcgctgctgctgg

(The sequence listing continues in the following parts.)

What is claimed is:

1. A substantially purified nucleic acid molecule comprising a nucleic acid sequence that has at least about 90% sequence identity with a nucleic acid sequence selected from the group consisting of SEQ ID NO: 10423 and complement thereof.

2. The substantially purified nucleic acid molecule of claim 1, wherein said nucleic acid molecule encodes a *Sorghum* protein or fragment thereof.

3. The substantially purified nucleic acid molecule of claim 1, wherein said nucleic acid sequence has at least about 95% sequence identity with a nucleic acid sequence selected from the group consisting of SEQ ID NO: 10423 and complement thereof.

4. The substantially purified nucleic acid molecule of claim 3, wherein said nucleic acid sequence has at least about 98% sequence identity with a nucleic acid sequence selected from the group consisting of SEQ ID NO: 10423 and complement thereof.

5. The substantially purified nucleic acid molecule of claim 4, wherein said nucleic acid sequence has at least about 99% sequence identity with a nucleic acid sequence selected from the group consisting of SEQ ID NO: 10423 and complement thereof.

6. The substantially purified nucleic acid molecule of claim 5, wherein said nucleic acid sequence shares 100% sequence identity with a nucleic acid sequence selected from the group consisting of SEQ ID NO: 10423 and complement thereof.

7. A transformed plant having a nucleic acid molecule which comprises:
    (a) an exogenous promoter region which functions in a plant cell to cause the production of an mRNA molecule, which is linked to
    (b) a nucleic acid sequence, wherein said nucleic acid sequence has at least about 90% sequence identity with a nucleic acid sequence selected from the group consisting of SEQ ID NO: 10423 and complement thereof, which is linked to
    (c) a 3' non-translated sequence that functions in said plant cell to cause the termination of transcription and the addition of polyadenylated ribonucleotides to said 3' end of said mRNA molecule.

8. The transformed plant according to claim 7, wherein said nucleic acid sequence encodes SEQ ID NO: 41987.

9. The transformed plant according to claim 7, wherein said plant is selected from the group consisting of soybean, maize, cotton and wheat.

10. A transformed plant having a nucleic acid molecule comprising a nucleic acid sequence encoding a polypeptide having an amino acid sequence, wherein said amino acid sequence has at least about 90% sequence identity with SEQ ID NO: 41987.

11. A transformed seed comprising a transformed plant cell comprising a nucleic acid molecule which comprises:
    (a) an exogenous promoter region which functions in said plant cell to cause the production of an mRNA molecule, which is linked to
    (b) a nucleic acid sequence, wherein said nucleic acid sequence has at least about 90% sequence identity with a nucleic acid sequence selected from the group consisting of SEQ ID NO: 10423 and complement thereof, which is linked to
    (c) a 3' non-translated sequence that functions in said plant cell to cause the termination of transcription and the addition of polyadenylated ribonucleotides to said 3' end of said mRNA molecule.

12. The transformed seed according to claim 11, wherein said nucleic acid sequence encodes SEQ ID NO: 41987.

13. The transformed seed according to claim 11, wherein said seed is selected from the group consisting of soybean, maize, cotton and wheat seed.

14. The transformed seed according to claim 11, wherein said exogenous promoter region functions in a seed cell.

15. The transformed seed according to claim 11, wherein said exogenous promoter region functions in a leaf cell.

16. A transformed seed comprising a transformed plant cell comprising a nucleic acid molecule comprising a nucleic acid sequence encoding a polypeptide having an amino acid sequence, wherein said amino acid sequence has at least about 90% sequence identity with SEQ ID NO: 41987.

* * * * *